United States Patent 7,745,391 (HUMAN THROMBOSPONDIN POLYPEPTIDE) - sequence listing, part 292

SEQ ID NO: 950400 - protein, 41 aa, Homo sapiens
KDPILSPRPAESKPCVCVLDVPTVLLNFANSARYCLMRVPS

SEQ ID NO: 950401 - protein, 127 aa, Homo sapiens
MIIYRDLISHDEMFSDIYKIREIADGLCLEVEGKMVSRTEGNIDDSLIGGNASAEGPEGEGTESTVITGVDIVMNHHLQETSFTKEAYKKYIEDYMTSIKGKLEEQRPERVKPFMTGAGRTNQAHPC

SEQ ID NO: 950402 - protein, 110 aa, Homo sapiens
RLTLGSPATAVNAGDPEDAIPRELAIGRKTLTSASRSVLYKRIACEEEFSDSEEEGDGGPQGTLPTSKKPRESKQRMKKRKTQRRRKKSPKRRKPRRRSHEAKGAQRTEV

SEQ ID NO: 950403 - protein, 49 aa, Homo sapiens
AAPRVNWLPILYLVPMAVAENNGNRESLLAAKGNQKKSHCCRGSQPKIS

SEQ ID NO: 950404 - protein, 49 aa, Homo sapiens
TGTSTHVSSPLEHAPTARSALSREPLAGGWGHSTTRRFLGTRTGRLTDG

SEQ ID NO: 950405 - protein, 78 aa, Homo sapiens
KKNPPPPLWGPREGGGAPGPPTKFLGTTGSPEAVLIAGYCAKPDFMLRIQENGRNESCEKKFSFVCKFKKLEEAEEMD

SEQ ID NO: 950406 - protein, 98 aa, Homo sapiens
MATSSYFMLISCLMFLSHIQQHAHTELPQARISCAEGTNAYRSYCYYFNEPTWVDANLYCHNMNSGNLASVLTGAFAASLIKEGTDNFNCLIGLHDPK

SEQ ID NO: 950407 - protein, 45 aa, Homo sapiens
SQPQRLSTQDCPALDRWSQGAKRHDPRKDKFVSPLLKKFYFGHAW

SEQ ID NO: 950408 - protein, 74 aa, Homo sapiens
KSNYQTKGMEYPTSGRNTEQLIDSLLAASQTTKWPINQENQRNQMTLTRISYLLMCFAQPSLHTLLMMSIPKFR

SEQ ID NO: 950409 - protein, 66 aa, Homo sapiens
PVDGPLNPNLTGVLLRRGRDTQRCAHFRDKTHEDTEKGGYLQARERGLGEANPAYALILDFQPPEL

SEQ ID NO: 950410 - protein, 135 aa, Homo sapiens
VILVKISNPQIPSAHLLKQMVFLGTLTLATRSRLTNFLSLFMEGDFTTFTERGAKDLVFAMTGFGPVHECPYGGGKGIAKRAEPQMGYYDKCSMKETKSRARSNIGHHLSMLCHLPTQVKHFLELSGTLATKSFL

SEQ ID NO: 950411 - protein, 105 aa, Homo sapiens
LFQTPPPFPPYSFPSFEGPSPLGLPLGFGAPPPPPPPFIFSPPFPRAPPWGPFPLFGLLEGPDCSQIFPPPFPPPPKGFSPPPFLPLFFGFSPLSLGFFWVKGGW

SEQ ID NO: 950412 - protein, 35 aa, Homo sapiens
LKNLTQYSWLLDGFPRTLPQAEALDRAYQIDTVIN

SEQ ID NO: 950413 - protein, 114 aa, Homo sapiens
GRRTSEAERRQRDRACQMTAWTQNACRSCDRGGPFLCEVPAERAGHGGVTSSGGTVRVGLKWSSQRSLMGSSTMTVQVAAAARGSIEAAQVVTVHLEHSINKHGVVAPLGVQCT

SEQ ID NO: 950414 - protein, 159 aa, Homo sapiens
PPGEKPPPPPGTVFRGGPPRGFFLGGAPPFSLFLSPAFPFFFSFFSRFTLLGAQGVGPRLKGLVPPFPPRGFCPGGPPLPFPFFFFFGSPGGEDLPFFLGGNWVGEIGVGPPWILGLTPVGPGVPPGFFPLFPGAPFFFFPMGFFFGGPPFFFFPIKRF

SEQ ID NO: 950415 - protein, 31 aa, Homo sapiens
VCSVRTLTLRQADCTKVRNNALSAKAGMAPA

SEQ ID NO: 950416 - protein, 33 aa, Homo sapiens
QWTDVTGGSLVPTAGNTSARKRPRECLFLTNPQ

SEQ ID NO: 950417 - protein, 76 aa, Homo sapiens
REAPQVTCLYTCSPCFRVASRSGELLVTVVRLSASEQGQCRFNVLKVTNAAGTLIETVPEVLRLDIGPFPHIVQRL

SEQ ID NO: 950418 - protein, 222 aa, Homo sapiens
AVSGVDIQFPGCRAASAHQHTVEDEIPEAKLHAAFPPLPPVPSPWSSQLEGRLNRLRGYDRLPKHCHTESSSISAVVRGAERAPCRGRGPRFASANPSTPVQTEYIKGRQYGLISLLGSFYQHSQRPFGTQHSHEIIHRDGAQDDPRGPLWEVLDEHQGHERTDHDEVGLLQHQRALPVDAHHAHCPEVPDSQQEGGVVHGHIVGLEHFPKVDIGEEEQQHQ

SEQ ID NO: 950419 - protein, 40 aa, Homo sapiens
KRTHHGKEKGHAEEKQKPQAERKEEKNGGCPFSLSEEIRS

SEQ ID NO: 950420 - protein, 97 aa, Homo sapiens
PRKPSAPKKGDSFSEELKLAPQLTGPVIPVRDVFKKGKARVLPGGGKNFKAFACFRLARSNARLFGIRAKRAKEAPEPGFEKKKKALLGAWNPSAVL

SEQ ID NO: 950421 - protein, 71 aa, Homo sapiens
YSQDDQKAPRSITEEYQSRSDSPRGSRVFTESEKRPLSIQDSFGEVSPGGPRPRVRLGSEIRDSGGRGGSS

SEQ ID NO: 950422 - protein, 51 aa, Homo sapiens
PTGIVYSCVDSLAADYIGSTDDDSFPHNGYIYTVSLLCVFSDVCEVHALPE

SEQ ID NO: 950423 - protein, 87 aa, Homo sapiens
PPLGRVAVRGMGPTVAVGVLKAVDKKASGAGKVPKFAQKAQKAEMNFFPNTCPPPLNQWWKNGFRTVCFNWPFKFCCKRLVNDNNAS

SEQ ID NO: 950424 - protein, 132 aa, Homo sapiens
FLKWTQGPRSFSAAGFRAGLTFTLILWLCAGTFLGGPGSCISGGLGPSMASLWMPCQFPPPDPRGGGWHFPEPRFFWPFPGFCDFPLLCIFRVFLGHLGWLPHIRVAEGRFSVLVKILWGYRGIWPVKFWGA

SEQ ID NO: 950425 - protein, 109 aa, Homo sapiens
AWNGPGSPRQSWGWSQPEAPGDALSSPGGGSPFSWVQGSLLVSSGPFSRLPFPLHLCLHIQKCLLSAASRKPPLSPGQGLQHFPLEHAPPHCFFCLTAPMGKVQPFCFF

SEQ ID NO: 950426 - protein, 135 aa, Homo sapiens
RRFFRLARGSFSRAASFSRTIPPLGLAFLARASTLWVALSPFVKWPMAFSFLKAFLLEPRSGFSPPASPFLFRRSGGLLGRLALSSLAPPPSFALAGSRPLGGRKPSLGPLRKAGFPREEGLYSRDRFFRLWGFH

SEQ ID NO: 950427 - protein, 102 aa, Homo sapiens
PHGGPPWGGGSNGRAPPGDGAPSPWGGGPFLTLGPRVWKLPRRGVGSVPQGPVSPGLFVSYAVVRGVSWGFLVSLTGPPPPGIRPPRPLAHFGPPQLPSCFP

SEQ ID NO: 950428 - protein, 96 aa, Homo sapiens
QTGAVLRGDGIERTTHRELSMRTEQVCHRLEDWEQPSLVVERLCRMLVVQRAVSRALVFCMVRTTAATSCGEPIRSRRDASFFEQLVTIMAALVTT

SEQ ID NO: 950429 - protein, 76 aa, Homo sapiens
EQVEMQIQMLAEELQGQRQTNGACVARIQAMRQALWKSDSHQERRCWAVGEASGHLQEQNTVLSLIFFISKWFANK

SEQ ID NO: 950430 - protein, 63 aa, Homo sapiens
MIPVIVSLGIQSTQLKNASNGQPEDPLSSKTKLSWRSLVVTKLEATRGCREMKGKGKGSEPSG

SEQ ID NO: 950431 - protein, 122 aa, Homo sapiens
SGDLLHELAELRLGIRLRMTDGGRVDGGGREPVEQLQTQKSGRAQNKGCPIDLVYKKGGGCRLLNRSTKFQQIVRGMNPGAGCAADCEDPAQASRERVNLAHRLLTELGDWGVHSSRFHGRS

SEQ ID NO: 950432 - protein, 52 aa, Homo sapiens
MPRQGAGENMYDPKNEEDDMREMEEERLRCGERLMKNVDTNQDRLRDPGGSP

SEQ ID NO: 950433 - protein, 58 aa, Homo sapiens
MKELKLLKTIAKGEFGDVMLCDYRGNKVAVKCIKNEPNGQGFLAEGSVMTQLRRTNLV

SEQ ID NO: 950434 - protein, 129 aa, Homo sapiens
LALLVKGFFPRDIPLGLGGPGPPGDKYNPPPSIFGSGGSFFLYRKLPVGQGRWPPGDIFSLSVVHGGFPNRFTPEGLFLFPGKWVGRPANPPFPGFWGCGGVFCTFPVYIFSGPPAWELSPPGFPGPLP

SEQ ID NO: 950435 - protein, 144 aa, Homo sapiens
SLTRSPRYHSPGESEHRELDDPRNTNCFELYIPNNKGQLIKAAKLRRTAEPVEGNHMVYRISDPTQEEKDEWIKSIQAAVSVDPFYEMLAGRKKRISVQEEAGAALSPYPNSIIYYGADPPGWPDPMGLGAVDPGSLFGKFITS

SEQ ID NO: 950436 - protein, 51 aa, Homo sapiens
TRCTLIDTFDEHDGPLRCIDFHNHHPLFVSGGDDNTTKVWNYKLRRCLFTL

SEQ ID NO: 950437 - protein, 72 aa, Homo sapiens
VWMFMWCMHRGSPTYRRGIPDMADDTCMWDRHTLRFTADEYDSDNGLWRRFGLGCSLRKGKSVNEASYAVKA

SEQ ID NO: 950438 - protein, 118 aa, Homo sapiens
TRGTPRSVLGPDLCSCFHSPHSCPKPLTPPRVVVCGLWDELRRGPFLSIGGFKKSTNTQFQFLSSNPVLQFLVVIDAYYFFYLQEMNVTSIALSAETWLLAAWHVNVPPMWLEACINW

SEQ ID NO: 950439 - protein, 129 aa, Homo sapiens
HRFIASALCEDSKLGVKCWASREDSQLHHLAWINTPRKEGGLGPLNIPLLAERDQTLSEDYGVLKTDEGIAYRGLFIIDGTGVLRYITVNDEPVRRSVNEALRLFQCFQYTDEHGEQFVPLAIIVSLPG

SEQ ID NO: 950440 - protein, 77 aa, Homo sapiens
TVQRIRTLGCEVLGVTVDSQFTHWLGSTPPGKREAMGPDTSPCSLTVTRRYVMRITGVLETRDASGWHWGSYYDVDP

SEQ ID NO: 950441 - protein, 109 aa, Homo sapiens
PGLGFVGPLPVFCSPIPPGLAILPPFWLGFRFPPPLVKIFFFLGGFFFFPRVVFGFLGPVVPLPLVPKAPAQFLVFSLPFLPPRGFFPFYGMAFLKWVFLWANFFSLEI

SEQ ID NO: 950442 - protein, 44 aa, Homo sapiens
MTVFDVLGHFGVNQSTGLILYQVMKLTDRWGSTELPVDKRTTLL

SEQ ID NO: 950443 - protein, 148 aa, Homo sapiens
GPFFFPRLGTLSGPFASRGIKRFFSPSPFGGARPEEFLGRGLKFGGFGLGKTNFPVFGNFGFGTRDPLNLGSNLAPAFGFTGLGFFLWWGGPGFAFPARRAGPGSFGPHPGFAKGGPFPFFPRRFVGTSLLANKFPVFSQRALKKFSW

SEQ ID NO: 950444 - protein, 51 aa, Homo sapiens
MTKTTAAKSDKNELIRHAITACGYLVRWGSRLTLPEFAAAIRRHSTDQRAE

SEQ ID NO: 950445 - protein, 108 aa, Homo sapiens
NKSTGSLQANVQRLKGYRSKIILFPRKPSAPKKGDSFVEELKLAPQLAGPVLPVRNVFKKGKARVITGEGKNFKAFASFRLARANARLFGIRAKRAKEPAEPGFEKKK

SEQ ID NO: 950446 - protein, 177 aa, Homo sapiens
EARGDMFERGVLQCFRRLSWDYKTNQPFKFGKRVIVTGLMTGGYAGSRATNELDDLMRVFHVLDGQPEADHRNGMHALISGARHERRREAENAYLHLRWFKNGNGHATFKRPDLVDKLNLILAKHYPAALAAELEAVMGFALDFVCPFETRPPEVPPQDQAVVMPGSRSRPAETPAA

SEQ ID NO: 950447 - protein, 153 aa, Homo sapiens
HEDSATAESSDACADALQSVMEDTDSAMEDAVDLFTTVVETGLPLILPLPPPAKKIAMHALTQVGNAAGLLLLNQVKAHDRALGEALGTLSTHCSEQVSVCGACPVEPPKPLQHCDAVTSRGKDAVPSVVPRNDIVTDSECLSFTGDAGLAGD

SEQ ID NO: 950448 - protein, 47 aa, Homo sapiens
MAIKYPLTVFDSRCFRCPLHSCVSCHAFQPFIAKAVTRSNDVVCPLP

SEQ ID NO: 950449 - protein, 35 aa, Homo sapiens
MTVTASQALSRSNLRNSRANSTGSAITPLHFIIIH

SEQ ID NO: 950450 - protein, 39 aa, Homo sapiens
GTIHRDELPSTRGTGGGDDSGTRAGPFQEITQVVWGVTA

SEQ ID NO: 950451 - protein, 38 aa, Homo sapiens
VPLTPGPPGTSTDVVVGPASALTGLARPPRILFIGWLL

SEQ ID NO: 950452 - protein, 81 aa, Homo sapiens
MRGQMTMTQTYAYCLETPWPQTRSYEHQLLVPFRYHETEEMLLTAVASAEPDTTNLVSGQCCSELSASRYLLLPDDFYGSA

SEQ ID NO: 950453 - protein, 59 aa, Homo sapiens
HEGDPYGCCGMNSLHGLPEYDSIPILVPAQRSLGPDMDASNPGLPPSPEGMKKYSDIFR

SEQ ID NO: 950454 - protein, 123 aa, Homo sapiens
MPASLTLEYPPGVHTGVERLPAKDIQTRCLHQAPSVPGAIPDGRGSYNTVFLANGNIPAESYTFFIDIPLDTIRLLDRCPAIEYAYRENSFSLRSTLDPLLHTHPSKISPPVYLPRNSSIIVL

SEQ ID NO: 950455 - protein, 44 aa, Homo sapiens
TRAVATVLPWADDGETRQEGGGVRHATGFVKCGYARSNFPEYIF

SEQ ID NO: 950456 - protein, 99 aa, Homo sapiens
AVQRVTYLQADSRVSPRGYVLRVSTSQDSFRELGLLCTSLGRSTLRVLSDCSMRALVTWAVRARVCSQNIPSPCAQTLYRGGYRGSTFVNLGSLAILLL

SEQ ID NO: 950457 - protein, 36 aa, Homo sapiens
FDSFTILIKDVSLQEVTDIGVRAGRTSGHARSPKGL

SEQ ID NO: 950458 - protein, 151 aa, Homo sapiens
HEVKQCNLVRKSYFISLPHQQKHFPFQMKTLAYSELKTESQMLRHILQQTLFKQKHQEISLRDTLAKLSGCQGLTLGSGEAWRSGGSHAQPSLLPTLKSKPRRPCPQVPRKLRTPGYERGSYQQGSRQERPQDDLTEPHLQAPFHKQGNAG

SEQ ID NO: 950459 - protein, 34 aa, Homo sapiens
NSMEYDISICLIATSSSLNHHLPYFCEWYCHPLH

SEQ ID NO: 950460 - protein, 171 aa, Homo sapiens
HEEGSCPDSKGCHEQLPGHPDSGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFIEHIGPDEVIGESMEMPAEVGQKSQKRPFPEELPADLKHWKPAEPPL

SEQ ID NO: 950461 - protein, 57 aa, Homo sapiens
MAHPDRAAAIKGSFVQRLDCYVHLRSDRSNPGLVSIYFKFLPVRKDKRNKAYFTKRL

SEQ ID NO: 950462 - protein, 125 aa, Homo sapiens
ITDNQYEMVYGEVFQEVTEYETCNKKELQQSLKDFQRMYRAQYVIHLPCSLYPFTPQSATDTPTQSLLHLTDHVTCSVHYVKPCCATECSQVTLQIVLVNLTPRPCMGQTLHMYLVQLQLIIGDW

SEQ ID NO: 950463 - protein, 71 aa, Homo sapiens
PDRIHSNISVSKPDWFGGFLVLLHFLPFFRLLYTGRRQKTHLTNPGFFHKCGTLGLSYGNSLWRYHVPQCL

SEQ ID NO: 950464 - protein, 39 aa, Homo sapiens
HEAYDYLCRRLTAEDLSEARIISLRDLESVPGGYQDPSV

SEQ ID NO: 950465 - protein, 48 aa, Homo sapiens
STSFVILIVSIYFPLPEMHALPFSLYYAVGRQIIVILTVIVIHVITAL

SEQ ID NO: 950466 - protein, 33 aa, Homo sapiens
ALALSLYTLWLYNLACSRWLDQHTLTGPVYLQV

SEQ ID NO: 950467 - protein, 145 aa, Homo sapiens
TRIYVDVVIRLIILFFIYHPQAHAWDQRNNLYAAFLSFGWCSLHSFFFRVIFLIVIVILIICGILIVLIPEEEGSSCCFHRCWYNFIFILILVLVILLILLTVIILLFITVFLLGILAIHCPLGWDGSTLLTRSCYQCFAWCGPF

SEQ ID NO: 950468 - protein, 46 aa, Homo sapiens
HEGIVRMGESMITYAEVDRQVIPIIVKCLDGILKAAESIDQKNDSQ

SEQ ID NO: 950469 - protein, 72 aa, Homo sapiens
MRRILVAAGMLLEDEYFSEVGERVTLADITVVCTLSVALISMVLAAFYSARTFPKYQHAGSYTCINPAPSSR

SEQ ID NO: 950470 - protein, 35 aa, Homo sapiens
MLHGDTADGPCSKSALSGNNGESVQFQHFLQKSGQ

SEQ ID NO: 950471 - protein, 37 aa, Homo sapiens
PGMTAAIWREDFLLFSIRRMKDTRHSHSAPWRSLRNT

SEQ ID NO: 950472 - protein, 111 aa, Homo sapiens
TTASPATALPQKTCELMNQGILALVSSIGCTSAGSLQSLADAMHIPHLFIQRSTAGTPRSGCGLTRSNRNDDYTLSVRPPVYLHDVILRVVTEYAWQKFIIFYDSEYGKCL

SEQ ID NO: 950473 - protein, 68 aa, Homo sapiens
LLPERHATPEPETDPRVTRATVLHIEMRYLRLSTASGDGRHYCYPHFTCAVDTENIRRVFNDLAVTVI

SEQ ID NO: 950474 - protein, 176 aa, Homo sapiens
ALKEESLAGAGFPGPQQSLPAQRTDTFLGPVLKQMYITYVRNCKFTSPGALPFISFMQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLP

SEQ ID NO: 950475 - protein, 211 aa, Homo sapiens
MLFFHDGTGKKQIKYRNQLARLVSSGTGGSVCVPGTTYPRITPTLVDSICENARRYAKLFADAYNSCCLSTKRGKWIHKDFLYVYIDHRLMIEQRSRDSEMPRSPQNQYPAELMRRFEPYFQGPSSSKPRVIREVRADSVGKLVTVRGIVTRVSEVKPKMVVATYTCDQCGAETYQPIQSPTFMPLIMCPSQECQTNRSGGRLYLQTRGPD

SEQ ID NO: 950476 - protein, 43 aa, Homo sapiens
RGGGDPFYTNTILIFRVTLDVYILHAYQASDYISHIVTYYSGK

SEQ ID NO: 950477 - protein, 131 aa, Homo sapiens
NILRVMSTEASQNITYHYQNGVDYMDHQTVNLKKALLPSHGSDEIKIRRQKGNSRFIYSVTVGGCTSHTGAWGKTVIVYYSIQTSRLPIIDVAPSWTLVPLDQECGFDVGPDCFLLTPIQSYLGPSQPTNF

SEQ ID NO: 950478 - protein, 50 aa, Homo sapiens
DTLYRHPLYDSLETHVRSPHRWVNSTCRSTLITSAGHGIIRLTLILNPLT

SEQ ID NO: 950479 - protein, 103 aa, Homo sapiens
YNFTPKPCQPPLPKPYPRWSCSSAWTHPLPINGVDCNSLSFLSVYHRRRPGRQRDADEGLEMDPIDCTTPEYHTCQCMPGADTVSPADPKNVTGNPMAEPEST

SEQ ID NO: 950480 - protein, 86 aa, Homo sapiens
ISNTSGLDYYINYTYSNAKTNRTNNYITYQLDMTYQKTPNWKRHPRQYQPLTFSSTLIIFTILILLTILANRCGLNPSSPIRKATQ

SEQ ID NO: 950481 - protein, 54 aa, Homo sapiens
SSSTSPIPSLRILYISDEVNDPVPYHHIHWPPVVLNLNEYTDYGGIIFNSYILP

SEQ ID NO: 950482 - protein, 65 aa, Homo sapiens
TLLPSEEAGMTQQDEKTLMELYYINANSTITNPQVLTIPTPVFKNYRLGDDSRAEPTPPTQYMLK

SEQ ID NO: 950483 - protein, 77 aa, Homo sapiens
MTKMDFPVLVSQQYSQCRLKANEIIYQISVELCSLLYFGNKEEVSRTHFSGLISNWQHTGFHGGVSRSPENTGAQPV

SEQ ID NO: 950484 - protein, 38 aa, Homo sapiens
GGAHACGQMNGHFSIAPLFSLYNPYATRAAKPAIPTGT

SEQ ID NO: 950485 - protein, 41 aa, Homo sapiens
TFVSRHILHVLHGGHHVRDDAVANLTQLIEGAQELHAYSMR

SEQ ID NO: 950486 - protein, 83 aa, Homo sapiens
ADVLQAVTVACVGCDFRCAGLDLFILEKDKMQFTASIWGKELEEPLTGQENSADVSSSLLYPHPLFILSRIMLFAVYNGSSGV

SEQ ID NO: 950487 - protein, 47 aa, Homo sapiens
VEEQTSFPALELIWSPEEGTTHGTTATVPCCYLLLPLHMPLSLGLPR

SEQ ID NO: 950488 - protein, 45 aa, Homo sapiens
RILIRDLGLTGHYHPADKAEHMKRQRHPMIAPPGRPRSIFPVPPT

SEQ ID NO: 950489 - protein, 75 aa, Homo sapiens
WKCFNVRKQLRRRAEAYYRCTLTLLQASLFAPGALHHLVLPGSEKHILQPCLTAFLRSDWRQRSIVDSSGLPYGT

SEQ ID NO: 950490 - protein, 73 aa, Homo sapiens
APPPNPLLDFNISLAMVMERGPSDKRISKRTPPIDCSMKHDLFAILLAPCLPPSDWQGRASSSTPPFSILPDY

SEQ ID NO: 950491 - protein, 93 aa, Homo sapiens
MSDPLIAGVHDCSPGTLCCTVVRVANFECSDGDLDLNAGPGLTRCAVLLVEPRLLIHRSGSFTVLLVSQDVSRPLGDCLLLTDPNFLCNLLNE

SEQ ID NO: 950492 - protein, 73 aa, Homo sapiens
FAPSIQSLQPDLGTPPLSSTKEKIAIVVLTYRPYSGSLLRSFLHLTTFNISFVILDSLHAYPRSFFPMSSIPG

SEQ ID NO: 950493 - protein, 70 aa, Homo sapiens
DLDDPLVHHPFTFDEAAINETDTPAQLEIEDEDTIDVSQQPAGGVPDSIPGRATVSIAARPQPGPSILAL

SEQ ID NO: 950494 - protein, 92 aa, Homo sapiens
TQCTLHTCKLTLRVFPLSCTISFHGFDGQASLMKLTLQHSWEMDDEDHHRRCTSITTAGVSPISLAGFSIYSARPQLRAVHPRIASIMDELN

SEQ ID NO: 950495 - protein, 64 aa, Homo sapiens
DARQGVIAPAVSGLTCGYTGTHRDTDARNGSSVRTGTFHGCYMYYFQYLSKTYCVDATRETNRR

SEQ ID NO: 950496 - protein, 39 aa, Homo sapiens
EVLLIRYTRLRLETEIEALKEELLFMKDEHEEEVKGLQA

SEQ ID NO: 950497 - protein, 44 aa, Homo sapiens
CLAKMKQELVKLKKERYGGGLRFCVHGVSKGPNDGVREVSEWYE

SEQ ID NO: 950498 - protein, 43 aa, Homo sapiens
QGQDYLSCKKDAKKVVNPLFEKRPKSFGIGQDIQSHKRDLTRF

SEQ ID NO: 950499 - protein, 63 aa, Homo sapiens
MIFKKGRRERESLQQMGEVTCEGIRLKKILIEDWQKAREEEAEKLIALQDGKKSLEDQVEMLR

SEQ ID NO: 950500 - protein, 107 aa, Homo sapiens
SYSRVSRSDYLVGVGPSCSEEAVRKESGESRCKSKVTKNCGIGQDIQSQKDLTRFVKWPRYIRLQRTRAILYKRLKVPPAINQFTQALDLPLSYSAALAGPHVLIGR

SEQ ID NO: 950501 - protein, 83 aa, Homo sapiens
RVSPVYLVHREGIMEYEEEERKYSGSAPGGPETPFEVLRSSLPEELQKCFDVKDVQMLQDAYSNDGPHRRKVPLCRRCILTLA

SEQ ID NO: 950502 - protein, 46 aa, Homo sapiens
ADSRVFRSALQHGKLACDELKEMQEKLDQQKPSVEHQMAKTGGTQT

SEQ ID NO: 950503 - protein, 72 aa, Homo sapiens
AFSSAIDRLCYMSVAEVQRDAMCCPGTLCVTMFDYDGRCNPILERQLDEQDHMQKEQLGTQSRKPTQKEAKY

SEQ ID NO: 950504 - protein, 80 aa, Homo sapiens
SLTVVTNYLVLGSVQAPSYGASDRSAAASSVYAGAGGSGSRISVSRSTSFRRGMRSGGLGPRDSRGSGQECDGIQTEKET

SEQ ID NO: 950505 - protein, 77 aa, Homo sapiens
SRKAPPCPRELSLPSIDYAELLPHFEKVQNKHLEVGTSGAGVRTNLDREVCPLKGLHGGGPNECSHEPLRVVTPSPR

SEQ ID NO: 950506 - protein, 52 aa, Homo sapiens
YISLMSALTGYVDILLVGTVRKLEDKSVSCITLKGIACLLTKVQGPSTKALF

SEQ ID NO: 950507 - protein, 34 aa, Homo sapiens
FAFFQPLRLSFGGLSLFAQATPFSRAGRGSVLKP

SEQ ID NO: 950508 - protein, 82 aa, Homo sapiens
DVPANFPLHGFTNYELSGVALVKILAIINRYPRDYDESLYSIQGHQQRILNVGSVHQFQKEVLFVYGPKNAKPDDGSIKSAQ

SEQ ID NO: 950509 - protein, 41 aa, Homo sapiens
MDLAFELGDRPSLASASVTDFILKFPHSATKVVRQAWKKAD

SEQ ID NO: 950510 - protein, 32 aa, Homo sapiens
MLMTSRPQWDFPCGRGGFDMNAPGRGGRPMPP

SEQ ID NO: 950511 - protein, 54 aa, Homo sapiens
DASEIPMRGRGGFDRMLLVGVGSHASIYEEIIDAIEPSSEKQHPLSSRNETDRD

SEQ ID NO: 950512 - protein, 56 aa, Homo sapiens
RIPAVHSIDVCYCRLSTYFGGTVRKLEDEISELHALIRHALSPHLSARSIDQSPVL

SEQ ID NO: 950513 - protein, 38 aa, Homo sapiens
ERDIQEKQCAPEKRSSPFQTNQLISEDSRAMNCSSTPN

SEQ ID NO: 950514 - protein, 121 aa, Homo sapiens
SLVVVIIVSTYDHHMSHDLPVLRIISIRSHPVIHKPSAILMSTMYLLQSPKLSSAQKPIHAVLTVSRSPSSVIGHEAAPPLGGAVRRKRKIPELCYHPGRLVWDAGESVSSISDSLYHYLY

SEQ ID NO: 950515 - protein, 41 aa, Homo sapiens
CRTSSGGPVRKLEDKSVSCITLKAWPVSSLECYVHSTKALF

SEQ ID NO: 950516 - protein, 102 aa, Homo sapiens
MLQQETVLTRDAPPGESMQGTAHPRAMHGHPPSPSQSSMHRQQDSSGALSSQAPGFSSSRGLGHSACAALGVCMHTPSVHTKLLHVLVDEVVAAHAEHPYRS

SEQ ID NO: 950517 - protein, 39 aa, Homo sapiens
MAQAVPLILVTAKVMFSVTGGAKIAEFLLLFFNLSFMSM

SEQ ID NO: 950518 - protein, 36 aa, Homo sapiens
FLRSSLSILRSFRYFQSGSGQKQQAPIILCMMQALL

SEQ ID NO: 950519 - protein, 83 aa, Homo sapiens
PAEMVAPPSLVMHRTFVREPGAPPFCSEHAYACICHMHSPGSACLLTCPWPISDSPTTFTEAAPKLRSLLLLTDSGRQIYTNA

SEQ ID NO: 950520 - protein, 51 aa, Homo sapiens
PYNISWRAYDNFLEHQNSGFYSQLVYKPCSSTIKPESATLAQQSSSDEMLE

SEQ ID NO: 950521 - protein, 48 aa, Homo sapiens
VPSNISYLLPTSHDESVEEEGIEEGIQQDEDIYEEGSYEMWKGDEMLE

SEQ ID NO: 950522 - protein, 132 aa, Homo sapiens
MEKSFEVVRHKNRGRDEVSKNQALKLQLDNQYAVLENQKSSHSQYNEGMGFDNPSEVTRLQLTTTNSHSSSDLCWIYRHRCRPLDFMTGPIALWKLKCHDCSMHIGFRGILIVTYMCDLVSTVFLHITSDNT

SEQ ID NO: 950523 - protein, 210 aa, Homo sapiens
LMLGDSRGPQQSSTRSCSENRQSSRVTKLRQRRRSEQLQTAGREMGGKQKLERHIFTLKHPALQTRKKESCRDFASTVEALEEGKKRVQKEIEETHPVVRGRRGPRMIKWKRPRTGFKQELDDLVVDLDNQRQLVSKPGKEAEEIGSVVSRGEKTSLPKYADERDRAEAEAREKETKALSLARALGEAWKPKRNLSGQQNAQSEMEDLVG

SEQ ID NO: 950524 - protein, 95 aa, Homo sapiens
RASEVRNCRWSSHIIVGTPGVLLLSRGFRTRFITYFKSSTSNNQGNFAVRHKCLLMCLEVTKEVHERTPFGILVKKEELTLEGIGQFYINVEGEE

SEQ ID NO: 950525 - protein, 33 aa, Homo sapiens
IVYGVFMLHKKTVNQKTTIYEIQDDRGKMEGTE

SEQ ID NO: 950526 - protein, 42 aa, Homo sapiens
MVTTTAYLAQVATGDHYESASLTQPGHAYPERPWNIEHEREM

SEQ ID NO: 950527 - protein, 58 aa, Homo sapiens
PRSRRIGDLTYKRNISILNSQLVYIILTTTAFLLLKPKLQHHDPTTISHLKQANMTNT

SEQ ID NO: 950528 - protein, 57 aa, Homo sapiens
MGSAQDYTRVRQLSLQDRIWVLTMWNLFSVSFLPAQERPSRKYDSCEMNLAWAVKHE

SEQ ID NO: 950529 - protein, 55 aa, Homo sapiens
VYSVTYAETHPEISTSPKYCGSCCAPRQPSAMADRINITRKGAWPSTLTVRAERT

SEQ ID NO: 950530 - protein, 102 aa, Homo sapiens
MGGGWAAGKAVDSSVRPEVVLSSVNSVVELRLAGCEQLSALHHEAEVVVLRGDTVISVEPGLLLETVVDSSLRPGVVVLAGDTVELSGTWLATGGGGFFTDA

SEQ ID NO: 950531 - protein, 50 aa, Homo sapiens
MELKKMEMLAEHDLRREERGQLTPASSCRLNSTCPHHKGTEPYPGWILSK

SEQ ID NO: 950532 - protein, 50 aa, Homo sapiens
VVYWNPGHIHLQGAEAGLSIIILRSAVAQLPWAAGCPVPELHLSTNLAIR

SEQ ID NO: 950533 - protein, 76 aa, Homo sapiens
SLKLTLTSDSAVPPEEAEHILSPGAGSCGGRTPEYSNYKQKNKFSPFSIKWYTQKYENLSIVTTVKAEQVVGQFHL

SEQ ID NO: 950534 - protein, 73 aa, Homo sapiens
TLFLRTTHDHRPVTDWDRAGWLQWRVLPFGNHCDLTSLLALHKLAPVKTEPPLCTFIETHYLNEQDKSHQRIG

SEQ ID NO: 950535 - protein, 53 aa, Homo sapiens
RNRDTTCMKGARLPGARVLLPAPLLPLPQRVQLLLVGLSIELHVVRHPSTTQT

SEQ ID NO: 950536 - protein, 61 aa, Homo sapiens
LTSHSVTSPSTLTPHSPPPRFLLFLLSLMPLTLFSPDLLGDPANYTLANPLNTPPRVIRDT

SEQ ID NO: 950537 - protein, 59 aa, Homo sapiens
KWAGAATTVSSSWCLCLYVYTRVSDYTHHWSDVLVGLLQGALVAALTVCYISDFFTARL

SEQ ID NO: 950538 - protein, 41 aa, Homo sapiens
FKSDRRFGKVPMELSGTSWGGLSSGSPSSAKISQLPSPLSV

SEQ ID NO: 950539 - protein, 80 aa, Homo sapiens
DLVPVGQEAAALPSLTLQKEGVLGVTEEQVHHIVKHALSRYSEDRIGLADWALESGGASVISTRCSETYEAKTDLLRGTE

SEQ ID NO: 950540 - protein, 55 aa, Homo sapiens
GPPVRWPMKAVSASSGCRWPNYMRQPVGHDCVRHEKASLLPHRTISCPPWAKGTG

SEQ ID NO: 950541 - protein, 96 aa, Homo sapiens
SWMSLPYDGPRGDITTSDRDRHTYGLLARLALEAGFDWLSYETKAHVYCSVSSEHSAAAKTGGCFPAGPQVRLESAARVVLSAVRSEDRVLTMGHR

SEQ ID NO: 950542 - protein, 42 aa, Homo sapiens
IRLKLLFRTRRQDAARGPHHEMGTVLLQHFSILLDGATTDAH

SEQ ID NO: 950543 - protein, 57 aa, Homo sapiens
ELQQKKLIPLSYGEECLWKIRWRCCVTDEGWKLRSQRERPNEQHHEAVGKSSWRSAK

SEQ ID NO: 950544 - protein, 70 aa, Homo sapiens
VQQTVCTGERLLEQECTRLTICDMAERLSVSAASKLLSNMMCQYRGMGLSIGSMICWLGLDRAPGLYYVN

SEQ ID NO: 950545 - protein, 101 aa, Homo sapiens
TDLEFPPMAMTLQPMEIEQRVAQLHLSLISTLPSPMGRSYTCPLSLSAITCSLYDASANPTRTLISFTGLHTMKHTPSVQQTLGLPASLSCAGSTGKGRGQ

SEQ ID NO: 950546 - protein, 69 aa, Homo sapiens
FQQRTTCSFSTLLMGPVILARVASQDHPFSSSIFNAPNHIPVHSQERINDEHNLHVSGRRRRVPELVDM

SEQ ID NO: 950547 - protein, 102 aa, Homo sapiens
DEEVTVVVDALSGLKGDLAGRYYEASVQMTRGMNSSQLIDDHFLFDKPVVPLLTCSSEWLEIGQHFRRICHNNEKSFLIWVNEEDHTRVISMEKGGNMNESV

SEQ ID NO: 950548 - protein, 137 aa, Homo sapiens
LEITQHFSSVKGLVAGITAVLVAAVESLSCVQCNSWEKSCVNSIASECPSHANTSCISSSASSSLETPVRLYQNMFCSAENCSEETHITAFTVHVSAEEHFHFVSQCCQCKGMQQHQRCPGPSPEERVQQRRVPCLL

SEQ ID NO: 950549 - protein, 71 aa, Homo sapiens
GSSEGYVAQRERLHWLYRKAQDVKKRQRKALGESSTGAKTRLHLCSSYGFRGMQESPNNLMWYGDRNCGLI

SEQ ID NO: 950550 - protein, 37 aa, Homo sapiens
EDPDQHISRGIIYRDLKLDNVLLDRDGHIKIADFEDV

SEQ ID NO: 950551 - protein, 35 aa, Homo sapiens
DLLTERDLPRLRLLLLLVLDRLSGFGDYGHWDRLL

SEQ ID NO: 950552 - protein, 165 aa, Homo sapiens
HIQQRDVVYGVAARQVDMVALSDPLGLLVGNARMASRSLILASGRVDFNCSWAEIRPSISSMVWTMNMSWRSSMALSIQLLNGAARLSVFQVLLVDGLQLLLCILQGFPATICQRAEGVPLVTDLLAPGVDIVGVVILQLVQLLGQWRRSASTAVPRAQPGRSRR

SEQ ID NO: 950553 - protein, 39 aa, Homo sapiens
MHGVDSPSQCAATSMDNFYDLQELFSSRWRRPSDQLPLA

SEQ ID NO: 950554 - protein, 71 aa, Homo sapiens
SECFLSFARRCALWHLRLPRWPAALPFLPSLGPLGRDRLALASWRQSLRPDMSSAVRLAAVRLLRKSGGGP

SEQ ID NO: 950555 - protein, 111 aa, Homo sapiens
IRTKALQNKPKKAATTTCDIDKVDEFMQALADQKELGEEIQQPIRKPVGFGDTSDEDELMAEYEALEQEEPNKNMLEVSGPDNSHSPQCSLYSPTITTRQEEEDDDMNALE

SEQ ID NO: 950556 - protein, 83 aa, Homo sapiens
LCNDGSASSELVRCKLRACLKLRVSVIHRGLEESPVAECSEKLGIQAEEIMMLKKQLYCIYAKHTKQSLQVIESAMKRGSGCL

SEQ ID NO: 950557 - protein, 88 aa, Homo sapiens
SFGGSLNTYKRFAIKLPDDQIPKTNCNVAVINVLGNPEAGMNAAVRSAVRVVIADGHRMLAIYDGLEGFAKCPDHRIRLNRCRGPGCL

SEQ ID NO: 950558 - protein, 116 aa, Homo sapiens
FVMIPPNHSRSYFSYLSPDPRLLDITIATRQNEETQHHLIFDPDRRRSPHSIPTTSTDYTVTLKFIYLSLPRHRNKSPILYTYYSGKKRNIWIHRYGLSCDINRLPRVYRVRTHIY

SEQ ID NO: 950559 - protein, 75 aa, Homo sapiens
MRFRRIFLSRFTLQPSPYPPIEEGDWPPTGITPLSPLEVHSPKHIVITRIRSINHLSSASLIENKRKRHLPRGAP

SEQ ID NO: 950560 - protein, 36 aa, Homo sapiens
MISVDGRLTVDIARVALPIRRMSWSPRRSSKPTYSS

SEQ ID NO: 950561 - protein, 121 aa, Homo sapiens
EAGVVWNPYFLQNSDHKTKNNFGVFSYLAFFLFFYPTLFNSSFGSLKPSEKYQGTGGHLFLMIGHYGFKQRILPVLTAALPIRKKKKLRSLRTCNFAISFDVGNTVIYKMLLDNSSFKSKI

SEQ ID NO: 950562 - protein, 57 aa, Homo sapiens
VGLRGCYFPYHRRAYHLTVITLLMIIFLICFLVLYAAISYTLHEYRLTKYYTSQDAQ

SEQ ID NO: 950563 - protein, 64 aa, Homo sapiens
SCLILLRWTCRAGRCANLLNSSCDVFWTVCLYVEGPGACYYFKEVVPHEEITRLEQKYQGGTEL

SEQ ID NO: 950564 - protein, 236 aa, Homo sapiens
RGLLHAQRYVNTLLTLIPRGAGSAGSKLRQEVHNGDMETVPGICRIAVDLGEDHSAGLAGPSRALAEFPDTRQHDYVLHRHPLATILSMRPTSSLSLTFWYTLQDDILSFEAEKQAVYQQVYGPVYFQLVDVLLHKAQYPSDEEYGFWSSDEKEQFRIYRVDISDTLMYVYEMLGAELLSNLYDKLGRLLTSSEEPYSWQHTEGLLYGFNAIAETIDVTYSDVVPGSLAHPGIDQL

SEQ ID NO: 950565 - protein, 225 aa, Homo sapiens
MLREHTSMKHHPARLMGLQEQMRQAVQNGDMETSQGICRIAVGQGEKQSRDLLDQVEHMSEFLDTRQHDYVSAQGDSLSHYSCQGDHRAPYPVTFWYTLQDDILSFEAEKQGVYQQVYRPVYFQLVDVLLHKAQFPSDEEYGFWSSDEKEQFRIYRVDISDTLMYVYEMLGAELLSNLYDKLGRLLTSSEEPYSWQHTEALLYGFQSIAETIDVNYSDVVLGSLA

SEQ ID NO: 950566 - protein, 60 aa, Homo sapiens
MSISTRGNYINLQTKILQLVLLLVVYGLFSIPDLRGLASLFPLVAHLTIWLSIFEPAIRR

SEQ ID NO: 950567 - protein, 64 aa, Homo sapiens
MLLPCACPKEPPKELDTASSEENNEDGDFTVYECPGLAPTSANGWCATPLFDHAALSARNRLMR

SEQ ID NO: 950568 - protein, 62 aa, Homo sapiens
AAVSRSLTTGEPSEHNPLPPWLVVFAEAVLGISPHRGCKVLVVGDAAVGKTSLVHEYSQDSL

SEQ ID NO: 950569 - protein, 39 aa, Homo sapiens
VPCARLHQRTTDNEGRACSHLSIYLAGREGKNCMVMEAS

SEQ ID NO: 950570 - protein, 72 aa, Homo sapiens
TANTSHIHFFISSALVFCVSSASLQVLLQALLPPLHQGSQFKLRRSILSILSPYALVSDKTVWDLAVVWFET

SEQ ID NO: 950571 - protein, 78 aa, Homo sapiens
DEDLMENLAQDETSRRDLGLEEWDVAGLPGWFLGNWRSNYTPRSKGSTDLQTNQDVGTAMVSDTTDDWGFWNESVSEQ

SEQ ID NO: 950572 - protein, 46 aa, Homo sapiens
VDPRCCCVHAFRMVLEHLRTLNDGCGELGLGHDGWALAIGGLVNAS

SEQ ID NO: 950573 - protein, 148 aa, Homo sapiens
MDTICGTSQDMSDVPVRDDAGSGYDDTAFYVNLGFHIDKSELAVKFLNTFDCVMLNMIGSILHASPSSYVLDNKRIATESNSEQISQSQVTRSLNHRTSGEGYGFDFHRQPVRPLDTYGSEHLLVLDVAHMMNASSYICTEVLTDVTA

SEQ ID NO: 950574 - protein, 73 aa, Homo sapiens
RASHDKTTHGYAWISLTKTQDSILSSFCVDLIFMPWSLYWIISGVVLLVRAMILIRVFWLIITITDFRPICSC

SEQ ID NO: 950575 - protein, 67 aa, Homo sapiens
YWSTAVVSARSPRPDLRLTAWVLGEPFHNRMLRFQYMAYSDNSLGLHSFKFAHRTCTMYTKPGIHAR

SEQ ID NO: 950576 - protein, 75 aa, Homo sapiens
AGPEQVVAEYWYGIAKLRSLRRAQKWMYNRISKLIWAQPSKANPFGGASHAKGIVLHKVGVEANQPNTAIRTCVR

SEQ ID NO: 950577 - protein, 46 aa, Homo sapiens
IVSDDLDFETHEPAKRLSLKRTLYNLKSYIAQMDQELAHASISKSF

SEQ ID NO: 950578 - protein, 55 aa, Homo sapiens
SAVRKHETGRSWSAFRTIWILGGECRDIVGNLTEFESEDIQTRSLADREPVSPII

SEQ ID NO: 950579 - protein, 70 aa, Homo sapiens
MTRKMGLSRYLTKGDNNAVDDRGLYKQGQQFGYEETTDVVGRARGFGPYIGIVTILMSDYSRFPYAVLFL

SEQ ID NO: 950580 - protein, 75 aa, Homo sapiens
REGHRHITLNAIYRRLVRGGCLNMALCSRFKRSCEVFIKMNNIDGKELLNLTKESLANDLNIESLGLRSKSAEEN

SEQ ID NO: 950581 - protein, 36 aa, Homo sapiens
WKWLETAKRCILRARDTVHLSFLSKVHPYPGWQSYP

SEQ ID NO: 950582 - protein, 78 aa, Homo sapiens
KYADQTDPYIMLTLLQDETAKWRYYADELAIRGAEMDKNKFKIAEDVKLELALSTGPIIQELKQESQKIQQQMENGMV

SEQ ID NO: 950583 - protein, 70 aa, Homo sapiens
YGKYIRVSISVVSRDLISNRCLLTTIVVCRDVLAGMVRLFAFMILSILPAHPYWLATKAHGDSSTGAETP

SEQ ID NO: 950584 - protein, 42 aa, Homo sapiens
IFFLRSSVRLSRAFTIAAIDYGEGAYKFLVCSSYRNSIEDQS

SEQ ID NO: 950585 - protein, 36 aa, Homo sapiens
VWHCKYYQRSQTCVVDEMGRLAKEEAERGGGHSMVG

SEQ ID NO: 950586 - protein, 42 aa, Homo sapiens
MGRMPRQFEYELEQAWKPSRSTLCLEPTRIGDETARWITVGK

SEQ ID NO: 950587 - protein, 55 aa, Homo sapiens
NYKAALNNYGWGDLGAEPNSEQYMLRLHQSKRITILNRSNNLTNGTSYPWVLRFG

SEQ ID NO: 950588 - protein, 104 aa, Homo sapiens
QTSRAQYDELARKNTRRSYDKYWSTADCMESTTVVTTTVCWGWSRLKRRYTELRRTVQSLEIELDSMRNLQASLENSLREVEARYALQMEQLNRDLLHLESELA

SEQ ID NO: 950589 - protein, 41 aa, Homo sapiens
TLPTHVPPSSTSLVTPNTHTVITHTHAQMSSRRGREFSSSR

SEQ ID NO: 950590 - protein, 180 aa, Homo sapiens
PAKDSLSFEDFLDLISVFSDTATPDIKSHYAFRIFDFDDDWNLDREDLSRLVNCLTGEGEDTRLSASEMKQLIDNILEESDIDRDGTINLSEFQHVISRSPDFASSFKIVLDSSPSVCPGTLSKNLFTGELWPRSSLCCQCGPSWSRVEMDLFSLTQGRGGPDGQGLLFVCVVIARFVLY

SEQ ID NO: 950591 - protein, 44 aa, Homo sapiens
GWSDLETVRQACLPPGTPCLAQRLTTESTRLPRLRVVPPPFEQE

SEQ ID NO: 950592 - protein, 66 aa, Homo sapiens
RSSRWLIIRKPVTVHSRARCRKNTLCRREGQAHGHRLAEGYSHIARIATRRSHGLARMTDFVAGLL

SEQ ID NO: 950593 - protein, 38 aa, Homo sapiens
NTRGHVMYVGLTDFKPGYWIGVRYDEPLGKNDGSVNRK

SEQ ID NO: 950594 - protein, 115 aa, Homo sapiens
MVIRCQGPDELLTILADIGVDLIEGTQHVELHGVQAGLLGEVGLHVLVTDGWGLGDVCVVSLHPALVAWDVLGKSSLLEGESLPSRCSDVEQESMKVWATTERASVMLPLWIFNT

SEQ ID NO: 950595 - protein, 37 aa, Homo sapiens
EDKKETEDKKTDVKEEDKSRDNSGEKTDTKGTKSEQL

SEQ ID NO: 950596 - protein, 134 aa, Homo sapiens
RRLILGWSLLRACDCLRAPRPSTMPSETLWEIANADVEKEGNKVEVKVMEREYCRKMCSLLCGSKIGGRDYIYISRGVLTRDEPPKPTLVWDIYLLARRAQGHNTPKEISHTLWRTSGGRNLFIWGLNQIYPIT

SEQ ID NO: 950597 - protein, 65 aa, Homo sapiens
IKDSTELRKSIGQQKVGESGSEGSCTYDRYPGDLSREAAGKDLKRTKGLLGVCQLMLDDVKNSAP

SEQ ID NO: 950598 - protein, 54 aa, Homo sapiens
MSFQREFDQCRTPTSTYQGQQRAACGREPLTDSSLQLLEPFDKWDVKDLGGPAD

SEQ ID NO: 950599 - protein, 47 aa, Homo sapiens
CDTFLGLLDSHLIRGPVDAESRVSYLKMNGDYYRYLAEVATGDDLKR

SEQ ID NO: 950600 - protein, 42 aa, Homo sapiens
DDPQPTEARAIRTISTAIYPWRKGELTLSEVVEIREKDVCVV

SEQ ID NO: 950601 - protein, 70 aa, Homo sapiens
WIADRVMIGHTDSVRLPRNIRGDFSVHISRNVIHTSDSVEGCQRKIQLWFQSSELVSWADGGQHSSTHPA

SEQ ID NO: 950602 - protein, 113 aa, Homo sapiens
DKRIGAGVRLETAFPAKGSWSKPQQRCSVWCPGTCSAGSGEEGREEKGESQRRLQMSTSLLDSGPRAACLMKLMSPLVEGGRERSLEHWPSSSGSIFLASCFPSSTPHWSKAC

SEQ ID NO: 950603 - protein, 68 aa, Homo sapiens
ETDVGSGASQHGEAGGAGGQDAEAAVACVPLELGDKTVLLQVRSLESVVGAIFPLPNLQLSQHCSEPN

SEQ ID NO: 950604 - protein, 118 aa, Homo sapiens
MRMRVVYDIAPPPKCYNILVRSDTHTQIMINQEIVNAKDQEAIYTLRVGGGRGEERDGVIREGSMKEVTLRKFSKPGEDLGKEETAFQVGRAAWNIGKKVAMRKGIVTDNRWTLILLF

SEQ ID NO: 950605 - protein, 155 aa, Homo sapiens
MRIGRGVHLRATPFQAVGKESSRLSLQRGQYQDLVLHPLLKDRISPLTDDQVVPLHHHDTDEEGCVAGELHDFPLLIGPLLPVAVFHIVDPAVIPVHSEAQQVNWEEAVLSQNHKVSKEASQGLDHSNLAIGHADQPLIHKFVCFGISRLSLHDV

SEQ ID NO: 950606 - protein, 109 aa, Homo sapiens
LTLEDSLDERIAAKYVIDVDTAFSCTSLDAVVNYFVSHTKKALVPFLVRPRTARTVLGYGTPIRENGETCVGGALRSGPRSCTLHRWPQAAVTCSRQDKLPPLPLIAYS

SEQ ID NO: 950607 - protein, 31 aa, Homo sapiens
MGWLHWERFMCTLACQEAPASCISEKLFMDA

SEQ ID NO: 950608 - protein, 32 aa, Homo sapiens
CDVIIVEWGLQSGVLPVVNVKESRSPGSRNNG

SEQ ID NO: 950609 - protein, 32 aa, Homo sapiens
VSEIGTTGDTTAQAPCCTGWGPEQHMQWLPPP

SEQ ID NO: 950610 - protein, 90 aa, Homo sapiens
MGMDIPPPSGPLWILGDVFIGRYYTVLTVTTTGWALPRLPASISQGVRALSTETEESSIAGGPWPGGPFRTHPHTCPPTVLGALEAGGPS

SEQ ID NO: 950611 - protein, 34 aa, Homo sapiens
MGGDSLGLFDPVSCKKGGGVLLGCHNEGQDEVKG

SEQ ID NO: 950612 - protein, 45 aa, Homo sapiens
QNRKQKENDYEGVIMKVISSSMMGKKRLVDLLALHVPSELLLPSH

SEQ ID NO: 950613 - protein, 92 aa, Homo sapiens
MVADSRPRSRKYRWEERGRAWDPSLRKYDVIFLSPSCFLDAEFSHITSSASFSMMVWAERQLNLTIWWKPNTCFTFFFNHTFVLRYMCILNH

SEQ ID NO: 950614 - protein, 58 aa, Homo sapiens
MDICFIRTSRPENAIIYNNNEDFQVGQAKVVLKSKDDQVTVFGAGVTLHDALVAADTY

SEQ ID NO: 950615 - protein, 82 aa, Homo sapiens
MHTDACGRYESPDEGFLLCPQMIFLTLHNLYLGLLRCNTMYSIATLGVIYLTCILSRLVNADDIHESSRLGYISSDLAIDSK

SEQ ID NO: 950616 - protein, 140 aa, Homo sapiens
MITMVKSFHEYSPTPTPRGTIDVMREAVLFYATCCAIRNVKGILRRTPRGSPALSPCLLGDNVITCIQLVVKNGPGFFYMICTMWFLSSFLMAAISIGIKFLLKIHISPGSGVRGSERDNVTLQGGSSLDRKVIHVPCQV

SEQ ID NO: 950617 - protein, 42 aa, Homo sapiens
CVVWRCVVCFLDVYIHAIVGYSGYDVLVSRPRYEERYGVEVI

SEQ ID NO: 950618 - protein, 119 aa, Homo sapiens
NQQPSPVQAWHGGPSICIPYVQPGTSQAQGTSPFSQLCIWVVQLGMALPKCMATSKGQISCYAPPSCRLLIIKNPAWKFRSKRLLGANIPWMSHPKKFKPSGVNEIDITVIHGYIDGYR

SEQ ID NO: 950619 - protein, 75 aa, Homo sapiens
RLECCHELSSPCSPETRVYTHALSSFNLRAILHPLFWFYCMRFWRTSPLGPVCALRRPSRLHVTKKDIQEFGDPN

SEQ ID NO: 950620 - protein, 44 aa, Homo sapiens
LADILGVGAVGQLYDQIRELHALERHGTVYSLECEVHAPKRCSD

SEQ ID NO: 950621 - protein, 67 aa, Homo sapiens
MMLPSARRVGHLLVGTVRNTCRMKSVELHCTLTGMACLLTLSARFHSTTSPDSDSINSLYMPGSTEP

SEQ ID NO: 950622 - protein, 44 aa, Homo sapiens
LQAVGHTSGGHVRKLEDKSVSCMHLKAWPVSSLECNVHSTKALF

SEQ ID NO: 950623 - protein, 41 aa, Homo sapiens
VCLASCPDILLVGTVRKLEDKSVSCMHFIQAWPWSPSLEMQ

SEQ ID NO: 950624 - protein, 51 aa, Homo sapiens
ELVPNSRSRWGQGMPRSTISKPKKLKVRSKAGSVLAVLVEANEDIPTVTGD

SEQ ID NO: 950625 - protein, 131 aa, Homo sapiens
MLFNECFIYFTEIRKYLCTRFKCAQDLGFFLLDYVHHSAHNSKASRRQEITKIRAELKEIETQKTLQKINESRSWFFERINKIDRPLARLRKKKREKNQIDTIKNDKGDITTDPTEIQTTIREYYKHLYAN

SEQ ID NO: 950626 - protein, 44 aa, Homo sapiens
MCGSMQEAEGGGRPVGLERICPPYSGKSRKPEKTLSEPWTCEPM

SEQ ID NO: 950627 - protein, 132 aa, Homo sapiens
MHGHNTRIDSGSYVKDNDLVLGLSHLNNSYNFSFPRCDRDSPGGRPVQPELPQLQQFSAKEQEPPFDVTVMIREKNPDGFLSAAEMPLFKLYMVMSACFLAAGIFWVSILCRNTYSVFKIHWLMAALALPYA

SEQ ID NO: 950628 - protein, 36 aa, Homo sapiens
LISHASMANPILPGVVFTSVLILIRAVRPGPSSMDA

SEQ ID NO: 950629 - protein, 55 aa, Homo sapiens
RNNIQRQTLHPLADCKRLDPLVNVLIVLQPALRRTGLTDDTQHVGAPCGTTAIGS

SEQ ID NO: 950630 - protein, 62 aa, Homo sapiens
MMKASQQAIERGVKVLPDLSDIISGEADIIDVTTVASIKEITEKNRHCLPDIAPHAIERLHH

SEQ ID NO: 950631 - protein, 54 aa, Homo sapiens
HATRWNYEHLPIIMQAITTFVGIPTMPNGETSPFISPSSTIFLGTTYDALSPEL

SEQ ID NO: 950632 - protein, 116 aa, Homo sapiens
YEVLYYMVVTLVHQWNSETSPEYHRSGAKDHHAVWVMSKVSLRGGLGDSDGDEVLDALKQALDSSMLPNNCTRIPSIWIPCFCSCSLHVVHKLVVYLDLCLIFLLLRFSLRIRFLH

SEQ ID NO: 950633 - protein, 147 aa, Homo sapiens
EDPVMYANTTFPSLQPVQNDGLRTARVDAVGEIGGLSQGKLNYKFLQARLRSTTRTSDSPSQPSPGAAWGGKSCSLRRHSWLGLFRGMEDSQSPTHSESRESSDTLLVRGPGGGFEPSELDFSDFPSKDLPTSCSLCSHPPVLGDNI

SEQ ID NO: 950634 - protein, 178 aa, Homo sapiens
MLSQHKHRSLDERISEAESEIDNVRNSAQSAERIAMRAGCGAGPQRMPGNKLGELEEALQKGKQDIGRLLLRYQELMNTKLVPGRGESPLYRKLLEGEELQTQWRKELDQVNISVGHKAVFPLDMAVAVAYWGWPPVEVLRAASVEVLPEVAVEATTPAAGGGVGLSGGLRVGGVGDT

SEQ ID NO: 950635 - protein, 133 aa, Homo sapiens
PTQHIWFICDVVNLISYTILHVTYEIKQVGNMSSANRGLTPVHRQHHPLIVAAVHGVTKPAPPTCCPQERYQALRATGLSSTACRRAGRSQGSMMVGELKGNGGKPSKVPSSVGDVLIVLYHVVGPAPVAEEA

SEQ ID NO: 950636 - protein, 33 aa, Homo sapiens
TAVIEPVPLQDYSEHCKHNDSGKRDVGINQATP

SEQ ID NO: 950637 - protein, 58 aa, Homo sapiens
MLDLDVTMIDVIHCLIVYPERTIRVLQAGVGDEDGVVRLNYRCGKQRRRLTRELQIVF

SEQ ID NO: 950638 - protein, 36 aa, Homo sapiens
LLHCSIWKLEHNAAVWAQCYVLFLVPYWTAVASVDP

SEQ ID NO: 950639 - protein, 46 aa, Homo sapiens
AYVCDPPLLHDRPLCFGRPFTCLLTLNFIRFESLISPRPLLTRLLG

SEQ ID NO: 950640 - protein, 35 aa, Homo sapiens
RHLSLPRMRVRRGRGEIRLSKLIKFNVREQVQVRP

SEQ ID NO: 950641 - protein, 52 aa, Homo sapiens
RAEVLETVELADQLKNYDPQKDTRFSGTVIYKDHSPPIRYSVIVSVGGHQQH

SEQ ID NO: 950642 - protein, 36 aa, Homo sapiens
WPVKSCSETLLSAHDLEPCAGDSLCHAGPFTASSPA

SEQ ID NO: 950643 - protein, 35 aa, Homo sapiens
MVGEETPFYTNTYSDFSGHPEVYILILPGHGYLSS

SEQ ID NO: 950644 - protein, 41 aa, Homo sapiens
KVKQITEAKAQQHQDLAVAGPEMQVKLLQSLGLISTLFTGH

SEQ ID NO: 950645 - protein, 98 aa, Homo sapiens
MGEPSLTVRPGVFRDTRDFIPSMLTLTHHQVHDDDLLSSSEEECKDRERPMYGRDSAYQSITHQRPVAASRSSLDLSYYPTSSSTSFMSSSSSSSSPA

SEQ ID NO: 950646 - protein, 40 aa, Homo sapiens
ELQAQFSSPMQLPLSSEALEGWCCCVAAIATADTRAQAPG

SEQ ID NO: 950647 - protein, 42 aa, Homo sapiens
RSEWGLHVQPGSTESTKMLLDLIRRQRIYGMEIAGIGENPYL

SEQ ID NO: 950648 - protein, 37 aa, Homo sapiens
TLAGEEERCPSSSSPLAAQCKAFLHAAKEKHSSLPGI

SEQ ID NO: 950649 - protein, 34 aa, Homo sapiens
MKSVCYYENDCAGEASGGSDENGCYYEGYVADEE

SEQ ID NO: 950650 - protein, 155 aa, Homo sapiens
ERIRRGAMVRLCRHADYDAYNDGYGFGSDRYVRDLNNCLAGMSDHRYGDCVSTFQSTTGTVYTMRGLPYRAAESDIYNFFSPLNPVRVHIEIGPDGRVTGEADVEFATHEDAVAAMSKDKAHIRHRYVELFIEFYSRSKRWVLTNTDMYELFLNS

SEQ ID NO: 950651 - protein, 38 aa, Homo sapiens
SVCDDCLRTEQEDACCRQEQTGELNKEMAAEKAKAVVE

SEQ ID NO: 950652 - protein, 38 aa, Homo sapiens
RSRVVLTSAQWQHRRLATVLEEIAAFPEREFVILAKQS

SEQ ID NO: 950653 - protein, 40 aa, Homo sapiens
LSSIATLGLIYLLYLKTPGDNADDIHESSRVGYISNGPCH

SEQ ID NO: 950654 - protein, 36 aa, Homo sapiens
GSDFLPPILEILFKSRSVGPIYQENQFRSLKKDRPI

SEQ ID NO: 950655 - protein, 49 aa, Homo sapiens
GLPCYKVMNIHLFVYPLYFTFVRPTEIIAFSNRAEDIRKLRCEVLDCVE

SEQ ID NO: 950656 - protein, 55 aa, Homo sapiens
CRLLTHVPMWSARLLTCPCGVPACSHVPMRGARLLTRAHAEGPPDHTLPMRSALL

SEQ ID NO: 950657 - protein, 72 aa, Homo sapiens
RSPGADQFDVQFSISVAVSSFLNIHDRIKHLEDGVQDSAGTRCVASFFPSGLVADLLNWPLFDTKYLSPHSF

SEQ ID NO: 950658 - protein, 80 aa, Homo sapiens
PTVIGFRVFPVMLLGSVGLGGKRAICLNVTCCPPKALAGLACVSVWTVVAALCLLCVAYMSLAVEALLQPAPLPCLIDAP

SEQ ID NO: 950659 - protein, 34 aa, Homo sapiens
QAKWNIELMDPLIKKSLACGSGWKSNRKATILCT

SEQ ID NO: 950660 - protein, 33 aa, Homo sapiens
MALIVLTNSAGIMDHEEARRKHTGGNILGFFFQ

SEQ ID NO: 950661 - protein, 121 aa, Homo sapiens
MDPCSLLWGAVALTETWAAPLHEVFPHLRVPARPGEPRFITVCYVDGTLFVRFDSDAASPREEPRGAVDRAGGAGVLGPGDTDLQAQRHRLTERTCGPCSVITNQSEGRVSHPPGICLVAE

SEQ ID NO: 950662 - protein, 60 aa, Homo sapiens
TRHRTHDTYYVVAHFHYVLSIGAVFAIIRKLAFTDFPIFSVLHPYIKPTLKIHFTYHIHP

SEQ ID NO: 950663 - protein, 58 aa, Homo sapiens
MAVSACSSHISIRAPAFVYAMFAVSLLWSLESTPVRPGLPANARLPMVRAVAVRGMVG

SEQ ID NO: 950664 - protein, 36 aa, Homo sapiens
AAFCEAARTHQKAISGSRVEVLREDYDATDSDHANW

SEQ ID NO: 950665 - protein, 34 aa, Homo sapiens
GDNTTVAVTEGPGVGVSTGPVPYCTTASATLPQP

SEQ ID NO: 950666 - protein, 51 aa, Homo sapiens
TEKTSEKAIVGLNSDVIAGVMGKFHVCDLQNNGRYIIYVYTLAEIRLLHNL

SEQ ID NO: 950667 - protein, 64 aa, Homo sapiens
WSGLWFMDMQRSRSTLRYSPIIEELTSPFTDHGLIIIWLYLLSSPVCPFPTITTNLTHTNIIRR

SEQ ID NO: 950668 - protein, 39 aa, Homo sapiens
PEYLQAASSDSAQALMCLSHLVKCETAALCGTERQELFL

SEQ ID NO: 950669 - protein, 76 aa, Homo sapiens
MSTGLRMCGRWGAPYCHSRFMEGTSTIRTFRFEAKASQIMKIIHITAVREMNEPTDYRMFHVVYASGSIRVTSGHT

SEQ ID NO: 950670 - protein, 43 aa, Homo sapiens
RHFVFLSRAGRLLGCAQWLVCGLLVNPPPPPLLQPLLPPPPPP

SEQ ID NO: 950671 - protein, 84 aa, Homo sapiens
LSRMKVKEHQVVRNEEQKAEQEEGKVAQREEQLEETGNQHNDVEIEEARQQAAGKRQHRDCSSVMQQKAHRQEAQQQQTGKSQR

SEQ ID NO: 950672 - protein, 52 aa, Homo sapiens
MVNPKPHQLMLQVCSCAQYAPELRTTHIDQSMCSYSSIGACSVIDKPRSTSA

SEQ ID NO: 950673 - protein, 54 aa, Homo sapiens
MVAFLPRCATEKATRAGCHAQYRHLAQASGVLRSASVVHQLVTPFSLALVTPMT

SEQ ID NO: 950674 - protein, 36 aa, Homo sapiens
SARSTIFTFHFILPFIIAALAALHLLFLHDEVIFCT

SEQ ID NO: 950675 - protein, 83 aa, Homo sapiens
LTTGSSSSRDSLEILVPRLLVSGTSVPLGNDTAAVADAPIALKWQISSRISSHLGLNEPGENRKDVARPLPGTWSVLSVELPG

SEQ ID NO: 950676 - protein, 38 aa, Homo sapiens
MNPRRSEYSRSVLSTSLFLLRTKVTMRNNAYFTKRLPP

SEQ ID NO: 950677 - protein, 114 aa, Homo sapiens
MCGIYMKIQGYVPEALYRVSGEIKLTKDNIQKQFDQDHNINSSVNGSNSKCCRWGPLKLTLQIVPDSFTSICSSSRTIGSKRKSRSKTERLHALKGNGREMTIRVNYDVFRIRE

SEQ ID NO: 950678 - protein, 41 aa, Homo sapiens
TVGSKLNHLQMQPLFLLNPIHPPQHIDTSSSSRQTNSQHAG

SEQ ID NO: 950679 - protein, 35 aa, Homo sapiens
MGFSGVMPVGGQCPPIWGEGAKLDVVQRLMKTSCR

SEQ ID NO: 950680 - protein, 77 aa, Homo sapiens
SADYFVGRRDAVPDRSLTRLFHEMCRTSGSVYITLKKYDGRTKPIPKKGTVGGFEPGDNKCLFAAHRMGKHRSISTV

SEQ ID NO: 950681 - protein, 77 aa, Homo sapiens
LLDIFVIWYLDRPMCVESFSDYPPLDRIAVRDMRQTVAVGVIKAVDKKAAGAGKVTKSAQQAQKANMHYSSLHHCPP

SEQ ID NO: 950682 - protein, 41 aa, Homo sapiens
MSTSIPSVYICCAHTINPKYANLYVHYLFPLVKISKWFFFF

SEQ ID NO: 950683 - protein, 80 aa, Homo sapiens
MREHLKLYWSRVNIPKVLELQNKLYLWAELVFAYDTYEEYDIAIITMMNHPIDAWNEGQSKDIITKVANGGTLTTRAITV

SEQ ID NO: 950684 - protein, 57 aa, Homo sapiens
MYEYTNELEGYNVTVLVTKYVVSSTGDQCVFTFSRCKNVVVRVYIIIMFVYSAMKNR

SEQ ID NO: 950685 - protein, 44 aa, Homo sapiens
MTLVDLVGPPESRRLISSPRQTVNPMGHLPESLTKPDQVAPVHL

SEQ ID NO: 950686 - protein, 56 aa, Homo sapiens
EDPGVAGSDQPALRLFTVQIPHKRCAAPSLLLTGRDGSNFLPLRTKSCGHAALLPQ

SEQ ID NO: 950687 - protein, 183 aa, Homo sapiens
LLDYSWTEGATPVPRALSSPSQCSPSDSRSGHDLEAGLHIMESDALLLTIYWIIARSSVRSVGKSSQRSFTIITQLRSTHTGPSRRSYLIWWNGAPKHIISYVSKKIQNVQIAQVIRESMCKAQGGYKTFFNTLYHNKIPLSIFSAGMDDILAEIIRQMKVYHPNIHIVSNYMALMKMVPPGI

SEQ ID NO: 950688 - protein, 36 aa, Homo sapiens
AVTEGDAGVCILLLASNSTPTVQRGHGLVVVCACMP

SEQ ID NO: 950689 - protein, 132 aa, Homo sapiens
MTDRAIGKKRGFALVAFDDHNSVHKIVIQRYHTVNGHNCEVRKALSKQEMASASSSQRGRSGSGHLGGGRDGGSGGNDNFGREANFSGRGGFGGSRGVGEYGGSGDGYHGFGNDGSNFGGGGSYNDMGNNNK

SEQ ID NO: 950690 - protein, 38 aa, Homo sapiens
AGSRNNGEKYVGVEDEPAIILVLIALPSLRILYITDEV

SEQ ID NO: 950691 - protein, 77 aa, Homo sapiens
VTIVGIGTDEEVDERYREAPMDKKGNSITSSHTHPETVEPKTKMTERTLAKIFQLHGLTLFYFSDTSPTLIEPVACN

SEQ ID NO: 950692 - protein, 31 aa, Homo sapiens
MDKRCTLTVPGSTSYPSPATASYPSPVPTAT

SEQ ID NO: 950693 - protein, 35 aa, Homo sapiens
DLEDPCCLTICGALDHLRRHRAGTHVKHVVVDFVT

SEQ ID NO: 950694 - protein, 68 aa, Homo sapiens
LEQLVQMAGGVLPLFDMWSSTEDMLKNTKCIALCSSRDRTFCYKSSMDKTVSILSSDFTSRVVGLGTR

SEQ ID NO: 950695 - protein, 53 aa, Homo sapiens
ADYCGKNSRLYTTTQRPNVVGPYGYYNPSADAIKLFTSYPFVFLHIFNKLVSS

SEQ ID NO: 950696 - protein, 75 aa, Homo sapiens
MRSLYWWSSRGIAYPSGLPAEAENVSWAASSLYADDSASAMDFGVGLVSGVPETRGNQCLKPPMLATTDPIAEAH

SEQ ID NO: 950697 - protein, 114 aa, Homo sapiens
CVCVGGSQYGWSGNMAENHESTSVPNGQGTSLQITMRVRSKTFEINPRHPRIRDMLRRIKDDEDDENSLGSGRGLVCNSNASAGYVLPDTKAYGDRIERMLRLRRKMDPDGVPS

SEQ ID NO: 950698 - protein, 75 aa, Homo sapiens
MPNLEIQLHIHQHQQQQSGQHSQTEMSLIIMFSDKVICVLWASHDSHISTLLVSQFPAREISIGDTTVHATAITV

SEQ ID NO: 950699 - protein, 167 aa, Homo sapiens
LRTDRVAAVAAPLLLSRAYKLVMLGAGWCREECHDHAGASANDIPEDHDPTIEDAYKIRIRIDDEPANLNIKDTAGQAEVYSHAEPVYERQAERVYHLLLYHGSSKYTMKYVSSQQLINRVRRTDDTAVVRVRNKSDLKQIRQVTKDEGLALAREYSCPFLETSDAY

SEQ ID NO: 950700 - protein, 129 aa, Homo sapiens
MATSEGPKRTHGILELAQYESLLYAARWDLTVRTTLVMLGAGDVGQSAMNMQYITTDTQKINDPTIEDAYKLRIRLDAEPANLDIRDTSWTGRSSRPAGPVSAGRRRVSHLFLLSRLVAVPMTFVRSNP

SEQ ID NO: 950701 - protein, 103 aa, Homo sapiens
MVYLRSLIGFGSSGPQAGADSNVTGMVISSDCVASLAMGASTVSVPSAHREEETWVGSTPGGSVYCRVKHREMEPCSSCRSSCLPVISTRPSLVLTVSSSGAV

SEQ ID NO: 950702 - protein, 65 aa, Homo sapiens
LEDPVPHLHGVHYLHLTGVKVFELTCSTPRKLYEMICCSALSPRIHLTFHRRWTEWHCISKLITG

SEQ ID NO: 950703 - protein, 62 aa, Homo sapiens
MDLRLNRCPECPGWSRTQISKMVSAAKLRTDEAKQSAEANPVDDKCYQKENWATSNEELSNL

SEQ ID NO: 950704 - protein, 30 aa, Homo sapiens
MLLESDDELLVNEEEAAALLDSGSSVGALA

SEQ ID NO: 950705 - protein, 102 aa, Homo sapiens
DGLLYFIRRVCYPPGTLKVWHSRLECIGPIHFSPSRCARASIRSEPNNYVGLAIHMGHGKMGSPKAPYLAGCLSALLELVLTPIGVALFSRSPWACSARHNS

SEQ ID NO: 950706 - protein, 122 aa, Homo sapiens
LIGPEVSFFLLWRIINKAGQNILCSLGHLPPQDTLNGKWTHMMTGNSIDRYCQGKPAHLPKSLTSIHSQHLITEYLSSSPWRTTKMIMYILLSQPDVRKIRYIMATLIISETAISGQSLLTF

SEQ ID NO: 950707 - protein, 48 aa, Homo sapiens
MTSGLVIPKEAYLRVRMSCNGYSLHVLTHVFHDFVYWICLYLVMKFII

SEQ ID NO: 950708 - protein, 61 aa, Homo sapiens
MIPQYQCHAVEPDSSSGSYDWFSSVLAVGKSLALPGRTQMMTGLPDELPIKTGETGVMRMM

SEQ ID NO: 950709 - protein, 56 aa, Homo sapiens
MAHRDEYKEGVGYVFVRRLTNECEAYYTIAAGSRVLRQVLLTQRKRHLHRRKRLFI

SEQ ID NO: 950710 - protein, 54 aa, Homo sapiens
RFHFLLEMLDNAFLSALGKFLRDFCLFPFSHERDILSRAGLKPLFGFPKTASSS

SEQ ID NO: 950711 - protein, 86 aa, Homo sapiens
MPFSYTADVSAPVDDDALHGDTEALIQAPDAVGFTKSSLPGLGNSRSVPDFPKYDSKAGSGKIQRVHEAEGGRAGRTAEARLPEST

SEQ ID NO: 950712 - protein, 116 aa, Homo sapiens
TCRVLLKLGGYGIIRLTLILKPLTKQHSLPLPCTIPMRHNYNNAPSCLRQSRPKHRSVAYSINTATIALGSNMPFYIQKPPVSFTARSHSHSPTDLYILSYYSGLANSNYENGIFI

SEQ ID NO: 950713 - protein, 45 aa, Homo sapiens
PPKVCSPPLLTDGEPCYYSVILNDPGGQLILLTLKRGFRYGFRCI

SEQ ID NO: 950714 - protein, 113 aa, Homo sapiens
DRLPLPCTIPMRHNYNKLHLPTTKRPKIAACILFNTATSALRSNRPFYIQNAPDSFTARQSFYIMRPRDLLSTITILAYATLNTTKHGIFTRRTTASFIAQTASSSAKTASSS

SEQ ID NO: 950715 - protein, 47 aa, Homo sapiens
VDRERSSDRNKDSQSTQEKKAEIVEGNESGKERERENESENENGIFI

SEQ ID NO: 950716 - protein, 47 aa, Homo sapiens
RVSPDVAADDPGAKAQVVPEHEVPLQVYYIVLHLRATRTLGRRGTEL

SEQ ID NO: 950717 - protein, 45 aa, Homo sapiens
QDRHLEDPSTVLRIGGMLYEFIRTGRLEVGSMETQYVVVEYQGTS

SEQ ID NO: 950718 - protein, 45 aa, Homo sapiens
SEVDLRIPEAHKDGWYRSLYGHPGLDAGKTPWARRKGRHMGIGER

SEQ ID NO: 950719 - protein, 59 aa, Homo sapiens
NLATSSTIELRVAPEEHPVLLTEAPREPLGQPRGKMTLRSGLSTYRHPCRMYRCLSMAR

SEQ ID NO: 950720 - protein, 163 aa, Homo sapiens
MPVHEQVRRPPAAGESPELAPWYLSRWQNDGERQLVEEVGLEGSRQRKSVDLPQALPPQGQEHRATEQIHERKRIGIESVQIAHSDLTVAPDGTHYRYSKLPLSPQKDTPMYCPSTMKLKVPSYMSRTTRKESGTMNVSSGSREAEYVIARLVLAIVVEPVAP

SEQ ID NO: 950721 - protein, 51 aa, Homo sapiens
LEQSTPVCRRQTRKKTLETRLISETTSVCKTEQVGKQIVYDSHTREISPES

SEQ ID NO: 950722 - protein, 111 aa, Homo sapiens
MADDLNFETGDAGASATFPMQCSALRKNGLVVLKGRTCEIVEMSTSKTGKTRTDQGSIWLVLTSNNGDDICRYLPVNSYIWMSPTSKKEMTSSCFGIPGWVPNHCSRTSGE

SEQ ID NO: 950723 - protein, 48 aa, Homo sapiens
LIRVYRVESKRGGIVYMTAAGSLSVCSEDLRIFRIFEGTNDILRLVCG

SEQ ID NO: 950724 - protein, 67 aa, Homo sapiens
YLYPSSSLHASGRTAIFQLQGQTGFSHTDHFTSSEQLYLNVLLCTASNFLIHFSHSTFYIHNALFVD

SEQ ID NO: 950725 - protein, 117 aa, Homo sapiens
SLYMTTYKSMEKQEGGSGIYLLGPQSLRHLKSKMIYSQLQGRHQEEADRDHSMNSKQNCYEKVTDRCNLAEKLGGSAVISLEGTLCEPLLDPCLEHLADPHLPLAVAGCHLTDRAEG

SEQ ID NO: 950726 - protein, 36 aa, Homo sapiens
MGLSTLTVLYGAPSCPSRAQACPHEASLTEQEHVDF

SEQ ID NO: 950727 - protein, 67 aa, Homo sapiens
RLNDDRLAVSRTIGETGRGDVCICVFGDIGQGVSQSDVLLLLEKKGSHTGDAALEEEGGDVVSILCR

SEQ ID NO: 950728 - protein, 39 aa, Homo sapiens
VTLRFRHSLGLLSTFTQPLAPHPISGQSQKTHGSQKPGE

SEQ ID NO: 950729 - protein, 35 aa, Homo sapiens
SEFPHSLGLQYCTRTSSKYLSHGDRLYIGLAGLAS

SEQ ID NO: 950730 - protein, 70 aa, Homo sapiens
VPFSARVIDSLDLSFLVSEGTKELDFLRVWGLGCGLRFRACCLQALLEGLVRGPAPRRFPYQTPSENSTV

SEQ ID NO: 950731 - protein, 56 aa, Homo sapiens
EDPCTVLSRRTTVTRGVILTTRDFFWPLVLFFVSPFSLEPVSTKPSFSFRGSTYGC

SEQ ID NO: 950732 - protein, 112 aa, Homo sapiens
HEVNGLHNDMTQDMKFIIKHWCSLCRRCGATNKGAIIGLMVGGVVIAIDHRHHLGDAEEETVHIHSSWCGGGRRRCHPRGAPTVQDAAERLRKSNLQVLRADAELDPRHSSL

SEQ ID NO: 950733 - protein, 36 aa, Homo sapiens
DGVLAAASAFFWHLVLFLVSPFSLEPVSTKTSFSFG

SEQ ID NO: 950734 - protein, 98 aa, Homo sapiens
RYSDMTQDMKVISQKSVFYAEGVGSNKGASHGLMVGGVVIAIVRVITLVTLNKKQYTSIHHGVVEVDAAVTAEERHLSKMQRNGYENPTYKFFEQMQN

SEQ ID NO: 950735 - protein, 34 aa, Homo sapiens
RTIRVISQEGFDLDVDQDIPMVQPLLKVRCSPIK

SEQ ID NO: 950736 - protein, 108 aa, Homo sapiens
FDISEVKMWVESDIDSGYEGSSVKNRCSMHKMCVQRKVQVIGLMVGGVVIAVVRVVTLVMLKKKQYTSIHHGVVEVDAAVTPEERHLSKMQQNGYENPTYKFFEQMQN

SEQ ID NO: 950737 - protein, 192 aa, Homo sapiens
VYDAQKSAQEEKGHKWSPCARIFSSELCEVGAQEIDGLIREEHVIIQAEFYLNPDQSGEFMYDFDGDEICHVDMAKKETVWRLEEFGRFASLEAQGALANIAVDKANLEIMTKRSDYTPITNVPPEVTVLTNSPVELREPNVLICFIDKFTPPVVNVTWLRNGKPVTTGVSETVFLPREDHLFRKSHYLPFL

SEQ ID NO: 950738 - protein, 53 aa, Homo sapiens
GIPGLKVLWRALAMLESEVFPDPLALSVLAGKDGEARAQVPPGPAGPAGERGA

SEQ ID NO: 950739 - protein, 60 aa, Homo sapiens
ASQFPLSFSLHVCLLPGLSAHLLVGTVRKLEDYISDCCMHFKGMACLLTSVHGPSTKALF

SEQ ID NO: 950740 - protein, 66 aa, Homo sapiens
ADSLAVIQFDPAPALVAWHLPPVRRQAMPFQCMRSLISSCSFRTVPTRRMSDTPGRRQTSILTVQP

SEQ ID NO: 950741 - protein, 49 aa, Homo sapiens
MSATDRLCSDILLVGTVRKLEDKSVSCMHLKGMAVSSLECKVHRPKPCS

SEQ ID NO: 950742 - protein, 49 aa, Homo sapiens
MVTPTLRDEDCRIALLPRNHKKNRCTDILPQNRCLPFLITIDGKSSIYI

SEQ ID NO: 950743 - protein, 52 aa, Homo sapiens
ARTYFWLGTVRKLEDKSVELHAFYKAWPVSSLKCKVLIDQSPDSDQLLIFMP

SEQ ID NO: 950744 - protein, 136 aa, Homo sapiens
CHISRLIQDWLCFYMLPTSKWSPRVMCEYDLVFFVTTSYGCFVTMLEAALYEDLDYHSQGAVERLLDSTQCQQMSQAPTKYNHVLGKSFHYSGFQNILTCCKIPEFFDHLVSLHRKLPGSQLAFSEDRRRAIMLLG

SEQ ID NO: 950745 - protein, 106 aa, Homo sapiens
FSRVERELMDVAYTGPSAGLSGGCCMSWLPNGQGDLGFIAEEARSDEAQYPCDDLGVVASLNKDNTRGDSGEYCRYKGSEEITPGPVDEWYLGVQVTHFEHKSSAA

SEQ ID NO: 950746 - protein, 77 aa, Homo sapiens
SRRKLISDTSSSARVLVGHEESELMDQNNSLHLTLRLGSPQAAMTLGIPIFSPMMPYGTGLTPQPIQNTNSLSISEE

SEQ ID NO: 950747 - protein, 39 aa, Homo sapiens
MAQYPCDDLGVDSSLNKDNNGGDQVEIAAIGSEEYPAVI

SEQ ID NO: 950748 - protein, 108 aa, Homo sapiens
RYLLCIPVLVHTASYTDVLISLHHMYVNSYPAHSLSITRITLTFLVPLLFHSKLYIQPSGARKKPVSHVSLALTWQSSGILKKQHIFMAVFLFIKIVCLHFTYVFTCI

SEQ ID NO: 950749 - protein, 32 aa, Homo sapiens
MADANQAQLAMNHLSGQRLYGKVLRATLCKHQ

SEQ ID NO: 950750 - protein, 52 aa, Homo sapiens
MLAGLGLCCHVPQILSGGCSTCKPMAALPGCCCKWDVIVVTICVDLGIAQIM

SEQ ID NO: 950751 - protein, 106 aa, Homo sapiens
MSGTQSMQVMLNTGPLFSWALSLPGPSLGHCFASGIWRSLVHSSGVPTRTQETALPADIPITTFLRQACKLKSVTILMAQKDLNSHLYTSPLDMERKVIAGAKIDG

SEQ ID NO: 950752 - protein, 35 aa, Homo sapiens
MRVPGMAGESWGPPTPPSRARAPVVAPGVSSERAV

SEQ ID NO: 950753 - protein, 125 aa, Homo sapiens
MIFTCISKYGPRVTKLHLTWETCHISKEVIPTVVGADTHKPKRWDSQDELKGFFSQFMNIEWSETSRLTRTTEMQIRLIGNCPFHYLLALASSPMQHCATDRNKLYDYWAPVSQIHGSETLHNAG

SEQ ID NO: 950754 - protein, 73 aa, Homo sapiens
NSRCDVDKIPGLLGVLQKLMASKANDHQRLCIFYNCIIRAHASVNQLTNNRKQIFILLIQSTQNTKTTKCIKS

SEQ ID NO: 950755 - protein, 137 aa, Homo sapiens
HADRYQNGFGFLILKLEHQSLSCLDLRSTIQLSNEPGNQNNLKLINAVVLYVGTQAIAHIPKQGQHTLQVSTTHSLSTQWISSRTVAVDLDSEARYISSGMQLKLSSGPQIATLNTSVAPVLYLIAEDNTEASKNRS

SEQ ID NO: 950756 - protein, 38 aa, Homo sapiens
TLDDSLTTTVLMYGEVGGCSSAWFSPGVQQKRRRRSVV

SEQ ID NO: 950757 - protein, 57 aa, Homo sapiens
SGLSRGSRPAVSLAPLAFINVEEAHHIEYEVKGEQGLRKLPEKNYQVLSFPDCFPGA

SEQ ID NO: 950758 - protein, 120 aa, Homo sapiens
AHRGQMQAIPENAYPEESGDEDEDEPGQGASQICSSDKRIACEEEFSDSEEEGEGVSKNSSNFKKAKRVKTEDATEKDPEAQTEVTEEEKTKEGGKPEAKGGTEEVKVGLNGTSPALASC

SEQ ID NO: 950759 - protein, 32 aa, Homo sapiens
MSHSKGEGVDEDKNTLRKYFTCTRLYERIGEH

SEQ ID NO: 950760 - protein, 37 aa, Homo sapiens
RTCLDVQQKTDRLAEVKLRFKDCLGEKAQEEKRLSLA

SEQ ID NO: 950761 - protein, 41 aa, Homo sapiens
QIIQTQVVIDAGVSRLSQPAHQPQNSHSEGSYVNECQPSQP

SEQ ID NO: 950762 - protein, 61 aa, Homo sapiens
LPAHIRTSVILMISFDWTSATHESPMNNSTEHLLEQEIHTGQVMSGGVTTVLQRPGAFSGL

SEQ ID NO: 950763 - protein, 59 aa, Homo sapiens
MLHILASKIPLTDPFYSLKLMSKPPYAVSIVLAAVIFKLGGYCIIRLTLLLKPHIKHMA

SEQ ID NO: 950764 - protein, 84 aa, Homo sapiens
VHGPRCWCKNDGQVACSLLFVHKEWPVHRALVFESKEGVCACPPSYFETTDWWVDYVLQQILYEREMLASFLSLVSGAETFYMG

SEQ ID NO: 950765 - protein, 70 aa, Homo sapiens
MGRLGVCQGVEKECERVLYHSRLVIRVLRQVLLTQRWGLRDGPSLESIKWQSRKAGYLSLYKAHLSPAQS

SEQ ID NO: 950766 - protein, 81 aa, Homo sapiens
MSRCFLAMAESVACGAHIRTMARGLASMVLSRLLRLPKEESPLDVPSCLKWGSRDSRGCGAAVYLYWGMACISRMLPNPVV

SEQ ID NO: 950767 - protein, 39 aa, Homo sapiens
MGIPKLHLGTLAEALMGIEVLPDLEKFIACQVYICTVAQ

SEQ ID NO: 950768 - protein, 66 aa, Homo sapiens
NAFFHDRQRLILSLEFLSVCHWASTIECVWSYQSGLHEDLHPTSETEHQVRCRLFLDVVVRQVQRI

SEQ ID NO: 950769 - protein, 107 aa, Homo sapiens
MAIGGRHPPEWIQTQRADLEKLTSLFCRYVSHYETEGPQVLLYFDFNPTSRECVGFEAVQEVPGGAGAAGQRNLYDYYNPERRCSVFYVAPSLSRLLATLCSAEVCQ

SEQ ID NO: 950770 - protein, 153 aa, Homo sapiens
DVFMYRAVPGAEEGRLCSWMRSSPPRTLSPRAVRMFADYLAHESRRDSIVAELGREMNRSVDVTTTTFLVMDASIYLHDQNPDAALRALHQGDSLECKDMTVQILLKLERLDLARKELKRMHELDEDATLNQLDNAWVSLAKGGEKLQDAYLH

SEQ ID NO: 950771 - protein, 52 aa, Homo sapiens
QHIQKRDLEAEHVEVEDTNLNRWTCSFRILVVSAKFEGKPCFTDTARILDDY

SEQ ID NO: 950772 - protein, 43 aa, Homo sapiens
GQEGGLYGRLNGGDRWRIASRHHMVRLYSKPLLEKMPDHGKKL

SEQ ID NO: 950773 - protein, 178 aa, Homo sapiens
GPDGDWACSQSMRYIYTRESRAGRGEPRFITVGYVDDTQFVQFDSDAAKSRCEPRSPWVEQEVPEYWYRETQKYKRHAETDRVSLRNLRGYYKQSEAVSHTLQRMYWCDVGPDGRLLRGYNQFGYEGNDYFALNWNLAPGPPRNKAVQITERKWEAGREAEQRRAYLEGTCEKWSADT

SEQ ID NO: 950774 - protein, 122 aa, Homo sapiens
MPLEPGDFLGNWSSPDSYPDQPSAQCGSSAHRGEGAWGQVPVICEARALPPQTEWPRGAPLLEEHHLQLCHSPSTWLHGCPAGLAEAWCQPAAFESSRLLCSHNSDLTWEGPEILKTSRCLL

SEQ ID NO: 950775 - protein, 103 aa, Homo sapiens
MTQMWGSFTWRAKNGTKISMPARWASCTAFSMAAGVAPCELASENIGSLFLAAPDEVSRLQAGSLAHGIADVGGVVGKVLGSTALAMPCILRNGATPVWRCGL

SEQ ID NO: 950776 - protein, 51 aa, Homo sapiens
LCRIASRSFYDSPPGSAGGYSGAPCSEGRCSMGMLSQRRLFAQYVLICCRA

SEQ ID NO: 950777 - protein, 118 aa, Homo sapiens
MQKGSRATSSNTDLMPGSPSPESQPNSPWQSDLCSTIPGKRTIIERSTGSSSIAEVQSEIERIFKLAKSLLLVVLDADTINHPAQLAQRPHMAPNIVFVKVSSPKVLQRLIRSRGNSH

SEQ ID NO: 950778 - protein, 47 aa, Homo sapiens
GCVPVSSSASPKVTTNHLSLITTPPTMSPLIAPLFEQQRFIAKARQY

SEQ ID NO: 950779 - protein, 33 aa, Homo sapiens
RLVSVFSCSQDLDRYMLLEDYTSDDNPPSHCTD

SEQ ID NO: 950780 - protein, 68 aa, Homo sapiens
ETNLPLVLAAGRTSEEQWDMSSLYMRHLLKGSLRNQHLDARITKPWVSERLENTVSSPSGLLPNHVPL

SEQ ID NO: 950781 - protein, 67 aa, Homo sapiens
EVPNMALGISVVPSQRLRSALGVPSYVSVPNDSSETSRNGANLLQRSSQKSSERLKYWLFLQKKSTR

SEQ ID NO: 950782 - protein, 93 aa, Homo sapiens
MRSSEISHSIIFEELPCVDRILKPCKDIFLVRDTRELQLEEELYAKLIFFYRSPRTMIKCTREKERSCCCRPEREGAVLLGVVATKEEHSLVL

SEQ ID NO: 950783 - protein, 154 aa, Homo sapiens
VDDHMRGQQHMGYAKMKASVEDFEEKLRKSPEEADRDERLQREKQERAEREKKGRGKGKTDKGTGEGTTADRERERARDRDRRQRSRPEVHVRRTSAKTRSLGPTRSEVRRGDRRMARAKPIVEGNVQWVRNKTMSHDGKGPWGRATRGTGEGP

SEQ ID NO: 950784 - protein, 129 aa, Homo sapiens
MIGTRCPLRQDNRSRRRRSARALRYILTLGGGTRAAGRCLRVLAAVTHVATQSCALVVSVSATLAVLKIRFKKGYRGTLPVSYITQYLLVWGNDRFFRTNIWGINQISGPGVSSSVLEDATPNVTKDEH

SEQ ID NO: 950785 - protein, 48 aa, Homo sapiens
GKSEEVEVNVRSTSRQINDIQLSRDMTMSVTASKDNTAKLFDSTTLEH

SEQ ID NO: 950786 - protein, 202 aa, Homo sapiens
QQESTTLPLPFTLTKQDKTHVIVFARVLLWRIFTVTSFINNVPYVLTAIIQELNPQPPMTLPVCTQLFNQLIAIISAGRLLAGHPVNHHTTSIISRALPTASLQSSSSREDFPRLSLLLSNDPLFAAVRPSRPGVITNILTFLHHLLIRSLPRLLLPSWGPPAVMDVGGGPPLEFRCMLLVGAAVVYIVVGDSPGGRLWAGG

SEQ ID NO: 950787 - protein, 38 aa, Homo sapiens
ILIRKKTGKVSHKQVAAELLDREDARNEMLEGEMICWK

SEQ ID NO: 950788 - protein, 79 aa, Homo sapiens
PVREALTGFIRSSGLNPSYTIVWLKIGMEGYPTAQVIWRVILLVSGNVVHIHKQNILDYPLSSDISFHTLHPDMHYSSN

SEQ ID NO: 950789 - protein, 103 aa, Homo sapiens
KKHSISNLINAHSATDEAGLAANTGLCIKFLSSVAGCNLGKSKLKFSSLPNIYLLNGCKGFTKIACKALKSGQCRQQVHNEINLKYRVQIIMISTVLQPQSTQ

SEQ ID NO: 950790 - protein, 96 aa, Homo sapiens
VESKGSNQPFGFLTLVGQAAWACCNRLSVISLGPGLSPTWWHQMQPHYGMVARTLSLGVAGTQQPPSTKAVSLRTSSEAGPLGWDQGLGDGPGFTQ

SEQ ID NO: 950791 - protein, 57 aa, Homo sapiens
KVNRARRGVVDLQDNPGVSMVAQEFGPQVLDGRVVSGCESREGPGPFFWYQSRIFTS

SEQ ID NO: 950792 - protein, 68 aa, Homo sapiens
TKQDHNWLIDSNNQYTHREEDKLGQGQQLECQEPSPQTQHKKLVAQLLNYESFLSPTTSGTQKSIDKR

SEQ ID NO: 950793 - protein, 76 aa, Homo sapiens
SDPDSRLSSCATVRYRLVEGLRSDQRTSSWASSSDAASEGLAPKLPLLPFPQLSRPPGAQSWLIESMEPSLVDLDA

SEQ ID NO: 950794 - protein, 39 aa, Homo sapiens
WRNGNVGLSGMAIADVTLLNGFHALALLTYEKLTSLSDR

SEQ ID NO: 950795 - protein, 54 aa, Homo sapiens
MSPVGCTESELNGLVTSAELCPQHPDPSMAACMQVPFLAAQASPETERLRAAST

SEQ ID NO: 950796 - protein, 96 aa, Homo sapiens
MFDDSVDHGCSCLSVSNRTHQIAMMLLSGASGLCRVHREARVPWRCAQVYLAEIPEDPKFFRDHNKLRLCFKDFCKTMEDALRNSKALIGPDQKEY

SEQ ID NO: 950797 - protein, 43 aa, Homo sapiens
FWFLVDEYSTPSSLFWLHPRSAANVWLKKTLFFGLTHLGKVRK

SEQ ID NO: 950798 - protein, 57 aa, Homo sapiens
THGASGATGRTKRQLTRIHRRNGKVGLSDMAIADVTLLSGFHALLTNLEKLTSLSNR

SEQ ID NO: 950799 - protein, 102 aa, Homo sapiens
DPDAAKSCCLEGTDEGPPEVFLAGICLPLWVSSTQHIGGDYRAVVVGLLTLPVENQLHNSHLQLLLIEIGGRILFSNASDLTGCAKLRIVIHLGQADGLYTP

SEQ ID NO: 950800 - protein, 146 aa, Homo sapiens
KVYHPDSRGDEFEVENLILHKDHSADTLAHHKDIALLKIPSKEGRCAQPSRTIQTICLPSMYNDPQLGPSCEITGFGKENSTDYLYPEQLKMTGGEADFPPGVVSSPTTTALKSPPKCCVLLTHSGKQIPARETQGEPSSVPSKAA

SEQ ID NO: 950801 - protein, 79 aa, Homo sapiens
SASHHNPDVGPKYLDLLYQNLLQVNLVYEMIQSNLKSIEYKGSFTSVYIQFYHHEMNEHNSREITRQDTTVGLLRLPHI

SEQ ID NO: 950802 - protein, 118 aa, Homo sapiens
SGIIQITGFHSVGNGRLAGWSRCRGELIEQAAQYTNAVRDRELDLRGYKIPVIENLGATEDQFDAIDFSDNEIRKLDGFPLLRRLKTLLVNNNRICRIGEGLDQALPCLTELILTNNS

SEQ ID NO: 950803 - protein, 45 aa, Homo sapiens
ARVISSATRLPTLLSRVGELCLVEFRDLNASVSAFQRRFVVDVRR

SEQ ID NO: 950804 - protein, 123 aa, Homo sapiens
YTSESRFSGWCRLSRDLSACKVFWGGRVSSGLGAPSQVRKCSRWDLSLGCTSGSDARCPPSSAGFRALLSYLLASSRLTLFALLKHCSCGLQWLPSPSLLPSAFSEIIWLKLLLLQVLRRADR

SEQ ID NO: 950805 - protein, 53 aa, Homo sapiens
SNATSNLALPLLVLCPLQSQFHCHLHSPSLSAPHFLPQPRLHSPSPSEPVDNR

SEQ ID NO: 950806 - protein, 237 aa, Homo sapiens
AFINCPPWCLAVHRSFDLPPMPCRPTSIELAGQHALSNPGIVLTFVLTTEQLHLGKIEELLSGENRGPILLPYQFRMEEIEGFRYRCRDAMRSVTKQAIREARLKEIKEEFCILRKLKTYFEDNPRDLQLLRHDLPLHPAVVKPNLGHVPDYLVLLLSVAWYSPHKKRKKLSSSCRKAKRAKSQNPLGSFKHKGKKIQTHSQALLRLLGLSGAEPLWRQATPSWTARSVLLTAERRL

SEQ ID NO: 950807 - protein, 98 aa, Homo sapiens
GAFGGTYILDVHNTIMDTTLPLTLQEEKEWGNPSSDDKHKNYIKRYCPYQNINPQHYPSIHITAYDNDERVPLKGIVSYSEKLKDAIAELAKDTGQGQ

SEQ ID NO: 950808 - protein, 42 aa, Homo sapiens
ISGTAPMGFCKLAHLIHRAQHEGSACVPNGLTALLGKGQAAG

SEQ ID NO: 950809 - protein, 92 aa, Homo sapiens
PKAGMIGVSYTPGYCFLKDLAKRSTLKMPGCYDVMADARNNLIPGDLREKDDIVTFHELCKSSMRHNLACNAIRQEAPKELLATSPCYPRGT

SEQ ID NO: 950810 - protein, 57 aa, Homo sapiens
TGQVTCYCITYRDYFIGLNSRVHCQSPANRFKCLSKLLNSILFNSTTCLSLCSDLFG

SEQ ID NO: 950811 - protein, 62 aa, Homo sapiens
IPKVLAANGHNSDCASSPVAHEDVEMRAALQFLMQHMVKRPVMLVTHKHNIGIMLIWNERKP

SEQ ID NO: 950812 - protein, 71 aa, Homo sapiens
MLVLSHCARPGVGFSGSQMTPFCQSWCFQEALGLDMETVGCSRALQEQGPFYSASVLGQFPGNRQFCSFHL

SEQ ID NO: 950813 - protein, 118 aa, Homo sapiens
VDQRIPRYGSGVILAMTGPFGPCTSWPGMLYTGSSCLQFPHHGSVELDEDVLLGVNHNGVKGLSHHDLDGSLVVLGHWLGFDDWLQFSFFESSDKLAEGVRVKLLWLHGELLPTPVPG

SEQ ID NO: 950814 - protein, 84 aa, Homo sapiens
MAILGLTERNNSMAIYIYAKAPTRCMPLTVYYNPSSDALRYSSPNEPRTSRHIFYHHYYIIGLDLSYSPSLFSYYLTPLPVPKG

SEQ ID NO: 950815 - protein, 33 aa, Homo sapiens
MAGLPVGLPDNSLDALFKIRSCMLAHPVTDNGE

SEQ ID NO: 950816 - protein, 85 aa, Homo sapiens
PDPDISTTRASRLHDYEFGFHLRQRISDAGGPGVTVTHLSPCGPGSCRHHFQSQKGCQLGSHCPHGTWPQAVTLHRATQCLELTD

SEQ ID NO: 950817 - protein, 97 aa, Homo sapiens
MTELLIGAARSNEAGTWSSIRAGGRMAYRVWDRNATAVDVCFMADEGLSAHGIPHVPQLDRGITGASHKRAAIGGQGQGHHIPTVSSKTHCPLAYST

SEQ ID NO: 950818 - protein, 38 aa, Homo sapiens
YASEYCNSLNEVYFDPLIPEVYIIHVVLPLYRQTPTGI

SEQ ID NO: 950819 - protein, 61 aa, Homo sapiens
MWKNDSKGCNYCGTFGHPVSLASEASELSEMSFKSTGGSEGRAIICCETKTNVTYMAMNPH

SEQ ID NO: 950820 - protein, 100 aa, Homo sapiens
IGRTRDERVELGLSLGDGKPDAKGLASGEGWWIPVNSQVDLFAIAWVGFIHGALKDLWRWIPWVPTQLWGERTKIEGMPPAPLGPLALDLCWSLFNAAQE

SEQ ID NO: 950821 - protein, 33 aa, Homo sapiens
ENMRGVRFDVHDVTLHADAIHRGGGQIIPTTRL

SEQ ID NO: 950822 - protein, 46 aa, Homo sapiens
RFWHVEIGENANTAQHPAESSVAEPTVTNILKTMDADHSNVTGVDC

SEQ ID NO: 950823 - protein, 81 aa, Homo sapiens
LNACELHPIRISGNASLYVGNLVTLPTCNALSSSRGSAFSHCDDIIDLDDPEAGGQVYRHVLVAPLESVVLADVVHIVQRL

SEQ ID NO: 950824 - protein, 45 aa, Homo sapiens
MACMKESQISSEIDLPPTNDEKKWARPPISMNFEVPFAPAGLRHM

SEQ ID NO: 950825 - protein, 70 aa, Homo sapiens
MCIRLIKWEEPCCDGGSYMKQTVPTSKPNSWSGAPTSNVANRSLAGGGLGGFVFNHCLAPGSGVTRGNVH

SEQ ID NO: 950826 - protein, 71 aa, Homo sapiens
CVVSRSLGHAHFLVYSDFGYSNRLVNLMAQDCLQGVRPLEHASPRNEHNEDERDPHCWGVPCHLNHTTPHI

SEQ ID NO: 950827 - protein, 165 aa, Homo sapiens
WSNQSSVAFTHRKVFKRKVSNNPNQRQLYRDQCVGPAIPISLCLTLKRLRVTTQKIGAPEAGPGVRAEKSSRAAKVPAAPCPVWRGRRLAKTPPGTESSPLAQNRSRNSPLWERASLGQASIQNGKDSLTMPGSRASTASASAAVSADRPRQHQRSMSASVHPNI

SEQ ID NO: 950828 - protein, 79 aa, Homo sapiens
CEVIIVSVEVQRHAVLLNLDSEHTGPYVLSRTLKHANMSNTLDPIHPPLPEEACPRINTAFGPNGPIIEKYTKTNSRHH

SEQ ID NO: 950829 - protein, 73 aa, Homo sapiens
RYPFVPDRPAWYDSRNHAELLRHLSAHHMRLDVDHSLTAGHLNLVDPRQADHQEGALPPWIPDDSMLCCCPWF

SEQ ID NO: 950830 - protein, 86 aa, Homo sapiens
MLGRVQEIDAHSIGFGNRFGYPRSSAELLAMRYGMLVISRKCAHYDSRCPILVHCYMPVEAYLQAYGCYKLTTADTPDHSEWRMAH

SEQ ID NO: 950831 - protein, 69 aa, Homo sapiens
MPIQSAVTPLLVLLTLIDEVVHCCSHSSVNSIYVHALACVPPGRQGLPGGYMACATAPKIRLVQLLAWL

SEQ ID NO: 950832 - protein, 98 aa, Homo sapiens
SRACCTCLHKAADTEVVLQCRDALICEDGRVPEYWTGYRLVLGRCIVMETSFTEGVQARHRTLGHWYRSRQMLHTRNCLSIGWTSGPGLSSLFAMAPT

SEQ ID NO: 950833 - protein, 49 aa, Homo sapiens
MQRTDQTKRGVWYCGYGRRFYIEYLSVIKLILPKIEETSARCWDQSVRM

SEQ ID NO: 950834 - protein, 69 aa, Homo sapiens
QFGLYGAASWGWSPVRYGRRLVTVRDLEAEQRDWYPSLATMQESLRVKQLAEEQKRREREQHIAERIVH

SEQ ID NO: 950835 - protein, 85 aa, Homo sapiens
VLQRSMDMRYASWLMTLFLSAKLLALFAPRVPYSIPATPCRKCHMKNSQQINLIVALRPSIREFEDPRAAPPPTRAETREERMDQ

SEQ ID NO: 950836 - protein, 114 aa, Homo sapiens
MCNTFDKVRTPQTLSGAWITVVSYFTLATKGSLEEIPLEHWDHCEGSNILSSDSTSCCTDAQIFTRLFLSMRSSRVQEQVADGPLRRALKPRMYGQCHNKVDVCLHVAFSGVDV

SEQ ID NO: 950837 - protein, 76 aa, Homo sapiens
VSEKVGQGNKYSELSLTEVIRKVEIRERLQYELRISSAFTSITKPSTSIRSASPETPSSIPLTDSSRTLKYTILID

SEQ ID NO: 950838 - protein, 91 aa, Homo sapiens
PVKYLRINRSLASPDDAENLSGLRGPPQNPIRGTEQRLPSIGGSNANSSSYEQALCRHLQIWKVLRKSMQLKEPQTWSDLNLKWKKGMENS

SEQ ID NO: 950839 - protein, 59 aa, Homo sapiens
LTSPVCRAFFHRPPSFPLRTSLCRQHYSIIAPGMRFHPPFQQASSPEQFRLRASSVCLY

SEQ ID NO: 950840 - protein, 109 aa, Homo sapiens
MFRAAILQGSVREPAIALCPDLHVIGALDEQGLLEVASCFVQIGNAVLAEVGDVLGAFRGQQAEEGHLDVGSVGSQIVISIAEMEATIDGFSKPDVFLLLALETPTGSE

SEQ ID NO: 950841 - protein, 34 aa, Homo sapiens
PLKEDQSFCPTVNLHKLWTLLQETDMGECVRRTC

SEQ ID NO: 950842 - protein, 78 aa, Homo sapiens
SLGIIIVSRVLRVPASSMESQQVGYKTRIIEVCYVLKAEGRCRRGLGGMSRRLLHYSSVAMTHSFLSSDIKHTDWYNE

SEQ ID NO: 950843 - protein, 109 aa, Homo sapiens
DISLAKVQTEMWTDFLEACGTLGVLEEKLCLPHDIREEKGLVKVGISDSSITRHHRNEGSVQMKLPLLHGGLRICSHPRILNSAPGTCANLVSHPLRVSSVSPVTLKQF

SEQ ID NO: 950844 - protein, 54 aa, Homo sapiens
IALAVRLTANMTAGHYSALIGSATLAISTINLPSTVIIFTILIVMTILEMVANP

SEQ ID NO: 950845 - protein, 164 aa, Homo sapiens
YTYQGYNEIESDPVILITGSHLTTCNTGCVKVDITYMRLSAVIVQDVSFSRNTEKGRAAGEAILRAENPFPSTKTASFNPASSCASEGGGSVFMLETKLLSQLPAKSPRLTDKQRRTIQSDYWALKSSVQLLPGNGGQTVCVPFYRGWTECGLPGELGKPGPNA

SEQ ID NO: 950846 - protein, 94 aa, Homo sapiens
VVRFRVFVIVTVSTRLIYQWQSVNTGTPGLVTLLCLWSGLSWERLTGNKSPPWVYRSESEKEEGLVHLHTSMSSPATGCDSVWDPGFVGGQELH

SEQ ID NO: 950847 - protein, 30 aa, Homo sapiens
MGVERAVPKENLDSIYEKFLKTSRSKAVFK

SEQ ID NO: 950848 - protein, 82 aa, Homo sapiens
MVSLRILVVGLASISNGTGFTPGLRQLSQRQHRWPPKHVQEQNGTEIFLLPLFSYVVCLPIIITRCLMRVTLEFSFSVPKTC

SEQ ID NO: 950849 - protein, 83 aa, Homo sapiens
RVSLRQICRSAISGIRSTRRFEKHHRKINEMEAIKQGHKNAYEQTQEFQTVLPFRRLFLGKLSFGNRGLKNYNSSGLLIGRQN

SEQ ID NO: 950850 - protein, 37 aa, Homo sapiens
TCHQSSSSFIVYDAPDKRTWERARSLKSWGAVEQGYR

SEQ ID NO: 950851 - protein, 36 aa, Homo sapiens
WCSSNSPSPPTSTTGCTLKARPFPDGLAEDIDKGEV

SEQ ID NO: 950852 - protein, 70 aa, Homo sapiens
TGSSRTALPYFIPRVSRNTNPQDSLVQKTVVPGFPLDPFLRCVDCIPQETVTGHLQSHHSSTHRSCVDAN

SEQ ID NO: 950853 - protein, 31 aa, Homo sapiens
MRAVKSVPVGYAVVFGFSLFLYKKFNRAAPL

SEQ ID NO: 950854 - protein, 47 aa, Homo sapiens
VDSRDPAQSPGKGGCISRPDVVQVKLVALLGALQVHFVARSGSEESQ

SEQ ID NO: 950855 - protein, 108 aa, Homo sapiens
WCNLEDPSDVCNDNNDLRLFLPLLCHKVHLEGTKKGHKLQLDYIGPCTSIPPCLDSELTEYPLRMRNLALRTPGHPCNERDEDNKPSELRSKKLRGEEDSMRIEKAAW

SEQ ID NO: 950856 - protein, 38 aa, Homo sapiens
TVSHVVTATLHWQKNRRLLVCDNVDMDSERTPQGVVTT

SEQ ID NO: 950857 - protein, 157 aa, Homo sapiens
SQSKLISCTKFKQCIKLPASYVYEVCVKNEMSFVFRLTVTSQAVSYMYIAHMSNTTENKIQQSDNISWPSRIFGYWDTQACTEILGHDIRGSQLDVYLQNLPKPRPCFPMSWVTSRHAAPPVQMQAIPEEAIPEESGDEDEDDPDRSISICSSEKRI

SEQ ID NO: 950858 - protein, 97 aa, Homo sapiens
QAVNIDSTVKAMLTPNDGCYREEVALEGYYKDKLFDQRIAPFGELAREKNLDLPNGRERAIQRYGEGRPIPWGTSEPELMLRGPCRKGKCSNIPPKC

SEQ ID NO: 950859 - protein, 34 aa, Homo sapiens
KQLIQTQTNQQGYISGKTQYKTKMPLVSLIGLRS

SEQ ID NO: 950860 - protein, 76 aa, Homo sapiens
RDRVYDPLRTDEIKGMYKRNAEQDWTFHDVPASWDLTAAEAERQQHNQQLGCRSATYAHVAAGVGNYLVRRILHAK

SEQ ID NO: 950861 - protein, 30 aa, Homo sapiens
MQALAINSCGGFSAKQQRADGSHKGTTYFC

SEQ ID NO: 950862 - protein, 35 aa, Homo sapiens
MDTSRVPIKLASVTKVLGRTGSQAQCTQVRVEFMD

SEQ ID NO: 950863 - protein, 54 aa, Homo sapiens
SIGSEPSALTPSLVVLSYGNAKVLNIQFHKLYLTFFIPLIKLLALGSKAMVHRN

SEQ ID NO: 950864 - protein, 37 aa, Homo sapiens
GDNAAPDDSILQMLPVSMALLDPRRYETALSAYSPWK

SEQ ID NO: 950865 - protein, 49 aa, Homo sapiens
LAVTLSARVLTANPGPFLVSEGKKELDFLRALGPGLWLEVPRLMNPMHA

SEQ ID NO: 950866 - protein, 85 aa, Homo sapiens
ILRSILAGMSMAVILALCSLVVDSFSRVVDDVGQICILEIIYADTSEINISHKILIAVSNLQLVLRAKDGLFFSSYRQHDRPRIH

SEQ ID NO: 950867 - protein, 53 aa, Homo sapiens
MRQSLPLNELNTGYELDEGSIIFNKFRPVISYTTEEKPIFTLNTVASADSVSI

SEQ ID NO: 950868 - protein, 39 aa, Homo sapiens
PVLLALLLLILVLLASLGVQSTQLLEAFLVFEDGWQYLL

SEQ ID NO: 950869 - protein, 39 aa, Homo sapiens
SVIWRDTGLAEGAASSFARSCEGLLPPHAHPLRPPCQMR

SEQ ID NO: 950870 - protein, 114 aa, Homo sapiens
QVDLEVPARSVEGREKFGAVYLWDSGSSVGESTGHNKVINSVYIKQSRPYRLATGSDENCAAFYEVPPFKFTFTVGDHSRLVNCVRYSPDGNRFATAQCYGQIYIYDGKTGQKV

SEQ ID NO: 950871 - protein, 44 aa, Homo sapiens
SLGDAGPVVPPASCTSWSPCPPSTGFDFSFLPLATSREGSRMVA

SEQ ID NO: 950872 - protein, 61 aa, Homo sapiens
MLAHVCDDTETTESGVGERCHTPARVVHVQLTGGSGTAMRSRELGLGEATDLGDILLRGKA

SEQ ID NO: 950873 - protein, 129 aa, Homo sapiens
SRDPPFDRTVVLHGYVPCSSCDRTSPGSEPCDRSHSFTRRQERLSACSVSAELNAYRKHEKRSPCCHLLLSSENQLYEQEGAVEFQHGRRDLVVALRMPMVLPFQGDFAGIEAFDQAGSGFLVLGRLIP

SEQ ID NO: 950874 - protein, 54 aa, Homo sapiens
DERVVNNQIGFTTDPRMARSSPEPTDVPEWCMPPFSSELRMTPKAVHVRFANVV

SEQ ID NO: 950875 - protein, 85 aa, Homo sapiens
MFGRWYNWLRCWALGMHSPTVLVVALARACLPQYKRPRGWEEGTPVGETWRWWTSLFIPDVNMDSKGVFKLCADPSRLGSPLGGP

SEQ ID NO: 950876 - protein, 69 aa, Homo sapiens
EDPPHVSDKRVGQVSSPSRATGRRDTQAERGRCTSMSTSLPKASTVVTTFCLGMECADSCRLSLPVTPS

SEQ ID NO: 950877 - protein, 199 aa, Homo sapiens
MYTCGTCQCILVPTAHPGAGARGPSHSFTRRQGEALLRVVVVQSLSITEHEKTCPCCHLLLSTVSLLQRKKEPSEFQHGRRGLVVVLRLPIALPLHGDIAGIEAFDQAGQADLVLGQLIPGWGQGAHLLFSGLPFGFGDGFLDGGWEGSVGDLALVLLAIQPVLVQDGEDADHTVRAVVLFLPRVCLGIIHLHAEHVRA

SEQ ID NO: 950878 - protein, 160 aa, Homo sapiens
MTCLLVPMGFKLDVPRSSWATLWLECGYTQGSHRVSMFAELTLSGIQCLQPLVGVNPSTLHFFQSGVAHLRGHGRSRAGFLRLPSGPRMYSDLLTQALEGGVHLEVTVTNHIGIVSPVVAGTIVSLLLRCLGQEAEVETSAGGPGGPGGPGGPVDQQDRI

SEQ ID NO: 950879 - protein, 81 aa, Homo sapiens
KHSFQMPNHISNDSTAGLSAAILAGSCGEGRQHPKAAITGKQLEFDYVSICVCVCVCSVCVSSIMWGVNCHLQCGQQSKWD

SEQ ID NO: 950880 - protein, 102 aa, Homo sapiens
DSELRMTILGSPFVDRTPGSPAHPGRREDADLKHVNSDSRHRLTIRYSRLAKSECNLAPFCCDTSWYTLASLILLEWVLVLVVLPLEPRPVVRLFLASAPPA

SEQ ID NO: 950881 - protein, 33 aa, Homo sapiens
SRVSVGGELEKHRSDSTVVWLVYLGPKGAGGSM

SEQ ID NO: 950882 - protein, 149 aa, Homo sapiens
GARAGHLHLSPKNSYHGDPPTVAGHGGGLLQAHGNLVNFHRMIKLTTGKEAALSYGFYGCHCGVGGRGSPKDATDRCCVTHDCCYKRLEKRGCGTKFLSYKFSNSGSRITCAKQDSCRSHLCEGDKAAATCFARNKTTYNKKYQYYSNK

SEQ ID NO: 950883 - protein, 143 aa, Homo sapiens
MRPSWRPAGEYHADGGGLDDVLVVVIFQKGYTIGFMGHDRRTRVAAVRLGLILVVGPASRERVDFVNSATSRHHSNAQLCLAEEITFMEPEGRFYTVFCIAFSGIVGSIERWHRSLDVRGHLAKCRQDSPPGSRGWYRIGMVP

SEQ ID NO: 950884 - protein, 32 aa, Homo sapiens
MLSAIHIHEVGIGALQHAFLLVFPLLLFWRGM

SEQ ID NO: 950885 - protein, 52 aa, Homo sapiens
GTLRIPESTVSLLLRPGFGLSDSCSVPMTGARGQVLEVVRSPSPPLPLMLQQ

SEQ ID NO: 950886 - protein, 58 aa, Homo sapiens
RTARDIVRKGKMKNYAKHNIARTKPVYLLHNELARNNFAWRARAKTPVQQTSYLRTAT

SEQ ID NO: 950887 - protein, 53 aa, Homo sapiens
MTLAFPFGGSGSALRRNVSLPRLSEGRTFALSDFIVDPWDAELWWHLLSGGRP

SEQ ID NO: 950888 - protein, 63 aa, Homo sapiens
VQSVPRHEEVENPALNRQKPGASCKVGLATDEPGYRRTVEELQTPDELAALTMADGITYLELL

SEQ ID NO: 950889 - protein, 97 aa, Homo sapiens
ACQLRRFLPLADVPSRDNDQLGVCRYILVFCQRQSLVSKEKAAMLEIIISPFNLSSMTLYQSKFICQVLHEDTDGTGHDNSTKPDNCNLILGGLFFL

SEQ ID NO: 950890 - protein, 53 aa, Homo sapiens
ERLLSAFGEREYTIKKETERREKVRREQREKGVNRKGRSVQGSTGRGGGTAEP

SEQ ID NO: 950891 - protein, 43 aa, Homo sapiens
AAAQCTAASEGGVDGELRVAPGFLVYVRAGRAKTCSRNSRFSV

SEQ ID NO: 950892 - protein, 162 aa, Homo sapiens
PVYLWSPGRLLRAPPVDIESSRRIPDLPSAGSPGVPPRTRSRLVCNPFYTYWGPAPLMLAAHPGGVRKHTGSPPLNWGCSSPLRPQRLLEGSKAGVPSRGGPPPGVKSRPVNPWGTRNIFPARVYPSRCFTRLFLHCPLLQQRGVCTAGLNQEIPVLSPLSL

SEQ ID NO: 950893 - protein, 37 aa, Homo sapiens
FNDKAHIYPIMAHISYYLNTISLHIQPIALDVRLSAE

SEQ ID NO: 950894 - protein, 56 aa, Homo sapiens
PGNRAYAKNGAEINSRTMGMKHVGMLHRLQSIDRQYTPVALQRMQQWFGLDVRRMA

SEQ ID NO: 950895 - protein, 34 aa, Homo sapiens
MAQGWRWHLLGALHTQSDVYIVVRDSNKCRASLR

SEQ ID NO: 950896 - protein, 98 aa, Homo sapiens
VHTPRTHAELIELQRSETYGFLFRLTVVGKTGIVFANSSLDIVLHDTYSVVSPTSHYVLINRQLYLPIIGGFISTRFPLILRATPLTQQGASSRSQHL

SEQ ID NO: 950897 - protein, 48 aa, Homo sapiens
MLSKWYLYTGVSKFTIMGDYSDAWSDMNLALQGDLKNQNRCRNRMGSP

SEQ ID NO: 950898 - protein, 33 aa, Homo sapiens
AEVSVDYSVQANWIGSTAPGKREAWAPEHPHCL

SEQ ID NO: 950899 - protein, 74 aa, Homo sapiens
MSKPPSQGQSYSAAVLLKLGGYVYHTPSHSFSTPRPNTQPPPYLKYPYEASFIHKLTICRLHNTDLNICTYAYS

SEQ ID NO: 950900 - protein, 69 aa, Homo sapiens
PYEDDGACVFKEGKYKQLYYSIRSSCLGWRYESSFSNEEAQKALALRLAAVLHMGMCHMKLQAFSAVIP

SEQ ID NO: 950901 - protein, 47 aa, Homo sapiens
APAYLWSFQRHLLAVLGCAQPFDVATTPVKFCHSLDMMLRTLGFNTE

SEQ ID NO: 950902 - protein, 73 aa, Homo sapiens
EILRLENAVQEESTQKLVFRTELARDNGFYAWYMLSRKSAVAEQSLRIQPCFVPPGSEDSAQFTGREANSRIA

SEQ ID NO: 950903 - protein, 59 aa, Homo sapiens
VCQGPFYFISRVDTVGQADRSASIGVCAAKQDGSASLQRAKLCALVQMVRDNITVILLE

SEQ ID NO: 950904 - protein, 55 aa, Homo sapiens
GFSYGLLVLFPRLRGKRWLGREESQVGDGKEFTEKQTEPTSKPNTWSGAPTKLPI

SEQ ID NO: 950905 - protein, 47 aa, Homo sapiens
MDYAIAALVVDNGSVMCKALLRGRRCPPAAVFPSIVGAPQCTSDVTG

SEQ ID NO: 950906 - protein, 197 aa, Homo sapiens
WRGGPCRRHGTHPDRVDAICQDAQHSQDQHQQQGPATRRRSKINSRLKHRATPSATRIQYQDWAKSSKILTLMSRALRLSIRPLIPCCMVVSLVIPVERRWSNVGPWTAASQSWSSVGGGHWGRVPVCRLVITVIFQGTPGRQKFRVYCNRRLPQQSCENSYLPTVHGSSGQEDTHTWCVGHCRPFSANEMMELDRM

SEQ ID NO: 950907 - protein, 36 aa, Homo sapiens
MEHLQVVKIMALPAGEDLNAGQVCREVVSEQVSVCD

SEQ ID NO: 950908 - protein, 105 aa, Homo sapiens
RYRKAFSRSPLNSVRDAFPTCHQGCNSCAYQILSGGGATLRSVMMLIHLWHTSSSFPLPLQRHSASRASWSIQFQIKDRDHPLLYLTFGQGHTHQLAKVNDVGPE

SEQ ID NO: 950909 - protein, 63 aa, Homo sapiens
MCMTLCPYIFLFTFCQGVELYPLLSLQVSWSFLRFVGLVAAGPLDLLAKKCARCPPSGAPLRV

SEQ ID NO: 950910 - protein, 137 aa, Homo sapiens
LIGEARLRRYSLANVLPSSYSADFLVLIYGGMPYTRHLEASAVCIPYTSLPLSRNQKKWNLVSQTTSSSESTESTSTYMHLIEELATLPRRSYPDLFFKKVAATDYRPHPPPTSRRAYTRILLINLQHLHPQHCSGF

SEQ ID NO: 950911 - protein, 143 aa, Homo sapiens
LAAGCPVHHGQSDMRWCKEKYYKNDGIRELFYKGTAAIYERLPKNVEHSTNTLALLPLPLTPQRATDTPTQSLLHLSAHVTCSVHFVKPCCATECSQVPLQLVLVNLTPRPCMGQPLHLYLANCNSSSVTGYHTIAGPFGPCM

SEQ ID NO: 950912 - protein, 40 aa, Homo sapiens
MTKTSGLMLIGNTQPRCNEVTEVIVTSVPGQELQVEVFDK

SEQ ID NO: 950913 - protein, 66 aa, Homo sapiens
SAITGKAVINRKLLICAFTLHYVTEWRKPKRGEHVAKPQKDRCLKRKNFKVFLNRYEKGKGDVKLM

SEQ ID NO: 950914 - protein, 138 aa, Homo sapiens
NQVKIKRSFDRNIQNNTRMRIQKKALLGDNSLSTMFYKMLIRKGWGINPLDTSSKNSGSNGHLNSYKIMGLLGQMYRGRDRKAACLAPLQLTGYNLRQESISSVTRVLSQCVIVILNALQFKEVLATYTLLTGGQVCH

SEQ ID NO: 950915 - protein, 42 aa, Homo sapiens
LACCCRLCPGSPWRERRVWPNLDPCGACWCSRLFLQRELKHS

SEQ ID NO: 950916 - protein, 61 aa, Homo sapiens
RCAPDILTAHHSGTASRRSLTLSSLSSRRTHLHSSGVRTTTNEEEHDPEKALQLKYLLSAF

SEQ ID NO: 950917 - protein, 104 aa, Homo sapiens
ASSTVSPPMPLFPITSSLSNTSAWPGEFHLRRPVAAHAPRGVHVLSCGRPCAAFSSIVSRLQRYCNCNSQPPTPVKIAVRKAARNELRAILRLYVKQLSQQRHP

SEQ ID NO: 950918 - protein, 39 aa, Homo sapiens
PAADERPRRAGVGRHQDDPQAGLTNLTRNLLPLVHQPMQ

SEQ ID NO: 950919 - protein, 45 aa, Homo sapiens
VAKVKIVACDGNHTDSNTTECIDNIDLYTPISVQHKLKKQNLSKQ

SEQ ID NO: 950920 - protein, 82 aa, Homo sapiens
NPSIRNEPSLIGDGECVLVECPGLRTSLKQRATQQLRPVLPGPSTYALRVRWQRKHHDQWYPFVQAVAITGPALPDGRSPSP

SEQ ID NO: 950921 - protein, 77 aa, Homo sapiens
IPAVKQVETSEDVYSCAIFASHAGMCQGHASKNGRMVLALLDAVATFRIRHRARDQLKRRIRVHTGEADCHSLVPSL

SEQ ID NO: 950922 - protein, 44 aa, Homo sapiens
MLTFVVLWPTQDREWSSASAPIKLLRMAPCHYQHAAFLPYRHAA

SEQ ID NO: 950923 - protein, 129 aa, Homo sapiens
QDAEIDHNAGSFYYIVEVINVRKKPSLVCVVVAESVAFLTVFLSGQAGGPAFLEEERQPSISVFHWDNKLDVAGKAESAKVPLLYPKLGGTQPGMALGYQAGDMARHLPVQALWAPGPGSLEGLLCWIP

SEQ ID NO: 950924 - protein, 48 aa, Homo sapiens
MRSVPDPSTRALLLLALLILYALLSRLTGSRASGAQLEAKVRGLERQV

SEQ ID NO: 950925 - protein, 62 aa, Homo sapiens
MVGYEVLYYPKPVISQLVAKHGDRYTSRAEQMCLYSPGWLRTPALLGTDLQQGNVVLLMQRC

SEQ ID NO: 950926 - protein, 191 aa, Homo sapiens
QRAIKTKCGTVSLKNLLFSYHCCFWLAGLAVMTVSILALALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAGGRVVPDSCCKTVVALCGQ

SEQ ID NO: 950927 - protein, 151 aa, Homo sapiens
LLLNESFWCDSSEIVDQLEVVIRNITLLLQTLDTLVLKQCRDYGSRPSRALKTKLKECEASKDQNTPVVHPPPTPGSCGHGGVVNISKPSVVQLNWRGFSYLYAWGRDYSPQHPNKGLYWVAPLNTDGRLLEYYRLYNTLDDLLLYINARE

SEQ ID NO: 950928 - protein, 69 aa, Homo sapiens
IGTNPVYLLRIELTRNTLQGEPQLRPPKPDELPMNSYNSTPVYVDNMCEESMGGGDNPTEPALFLVSCL

SEQ ID NO: 950929 - protein, 200 aa, Homo sapiens
SPLMGSRGSPREGSPEHHELRPSELRLFEQSATRKTSSDGTWLTHARELLILFAVLKGPGHPVDHEPPVIAQGGKQPRVSRGPVHGIDAVLVLLVGGDHVVLQGLLALLFRTVVLLVTDVIVVYQVAEGLRRDGHHVGKDDSAVTAAREDQLVMRVVVADVPHPVGVLLQGLHGFGDISGVPELHLTVVSAAGQVVLLIG

SEQ ID NO: 950930 - protein, 39 aa, Homo sapiens
GGRRTSSLTYDSSLRSLQILLLRKKSNFLAGPNLKLLLT

SEQ ID NO: 950931 - protein, 59 aa, Homo sapiens
LGWSGGGCEQPVGTPAAGGCGDWGQLVVRKGSSAAAAHVSLGYPLLATSSATSTRAGHS

SEQ ID NO: 950932 - protein, 103 aa, Homo sapiens
GRAGLTAHRRRARGSPSVSASNTMRLSALSLLLTLETRGRRGSRCDPRGGAVEGGGGQAEPAGCPQPPASPAAAAPGAPPYPPPHAAAAARVLGPLHAGRARS

SEQ ID NO: 950933 - protein, 128 aa, Homo sapiens
MACEIIILGARVSGDEHQWSTLLYSLDHSVVYSLIYLVSWMMSMLQPKTSVKSVRGSSFEQHGTSNRLLFESLILSRFPEPHTRGRTCAAVIPRDGTMGDAQLVLGLLTQIAQTVDFTDILTLGPKAC

SEQ ID NO: 950934 - protein, 52 aa, Homo sapiens
PSLDYVMAAVNLFALYLTCLTGSQDRAAVVTIPAGLVHVPRIRPTKSGDLRS

SEQ ID NO: 950935 - protein, 72 aa, Homo sapiens
MRKTVTAAADMSYGIIFFLGKGYMKLGNRTNIFTVILEISRISPIRVYFNLFSNLKIMYFNHSPIVYAEDIT

SEQ ID NO: 950936 - protein, 122 aa, Homo sapiens
PKTEWLSLDCLQLEVVHGFYKDHMREASDVCYADVHRDGTGLLDFERPEDMTYAVRKLDNTKFRSHEGETAYIRVKVDGPRSPSYGRSRSRSRVVAEAVAEATAGVAVTPQGEAEDHHAILP

SEQ ID NO: 950937 - protein, 37 aa, Homo sapiens
MRHREVGEVEERHHRGMGLVGLHQAEAIGSTSSHSMK

SEQ ID NO: 950938 - protein, 91 aa, Homo sapiens
MTWPKSHEEWPPGMIKSSARRNVSSHSIQLQNWSKFTHFLRVLLKAVGLVLLLRLLWLLFQLPQLQNEKDLAVLSSIQWVLDGLPDHVKGS

SEQ ID NO: 950939 - protein, 111 aa, Homo sapiens
INWKNLPRFTNHITYLFQITHGTPGLHQQDAISEFSPLKLYIRSLVSVSFSIEITASSTPAQHPWAWRATPSPLISASDLYTPHVLLNSDQDVPRALPLWSSGESISHTGH

SEQ ID NO: 950940 - protein, 123 aa, Homo sapiens
NEKTRDIKIPPLLAEQKCRGVYLALMIIAEMNVEPALYVYQVALIRRGLYLPICCLTYAFRHGHMAYQAHPWLLQLGRAEKERSRGYRCTRFGYDLKTVLVSPYTEYSGRGYECKSELPVHQL

SEQ ID NO: 950941 - protein, 49 aa, Homo sapiens
YRIQHVPLSGGEHDSDYDPISLTVALHGVIQPIRKIQGLVMNALNHAQE

SEQ ID NO: 950942 - protein, 65 aa, Homo sapiens
VIVVSMGIYVASTYHVACALFTQWPCTVDYASACSYLYDTQKVIRRAEVSTMYGVQNICIPITRM

SEQ ID NO: 950943 - protein, 56 aa, Homo sapiens
MTQQALTGHVTGHDILVVTATLPQHLLVGMLDGLNWFLCKYFCIFLRNLLPPLLTL

SEQ ID NO: 950944 - protein, 161 aa, Homo sapiens
YTYRGYLWSSLEACIWGCWHFYTQSVVSLGQEGFCPPLMSQPCQPRVPNLVKVLDDMNSSAVSPYLHLWTSLSPRSLCSRHTGLSAVPTTVCYRCGFFSLQRSSPKYLCDSLPSGLGSDGTIRMRPSLTPPLKLLPMSTGHGKENKQKNEKEKKEEKFLLT

SEQ ID NO: 950945 - protein, 47 aa, Homo sapiens
MAPLTIHSIGHQWCCTYEYADYGGLICNSYVLPPIIRYNHGGLCNQV

SEQ ID NO: 950946 - protein, 97 aa, Homo sapiens
IIKVTQKLQSPEGNAPLADSSLSLSRGIGRYTRSAMYSRWDMYTRKYSAAKSNVDKKTKAQVLATVTHTVGGDKNGGTRMIQLRTMPRYYPTEDVPR

SEQ ID NO: 950947 - protein, 145 aa, Homo sapiens
FNSLPISITGRRPTGNRKPTLKKKLQFAKRLPEAESEVERTSVVLVILVEVIVLLVVLPDVGHRSLHPGAAVLRPIEACGQHPICTVGQVTCAVRRETCRRDEHGLQQFPEAISVTYGSRALGTRLLAIYTVFGKSKFPKSSVLI

SEQ ID NO: 950948 - protein, 67 aa, Homo sapiens
WTISHQTSVNADPVSHEIWTSETLLQVLVELWLHHYSYGDVSTQCSTLHAKAGRYCNYTDSGDSQRC

SEQ ID NO: 950949 - protein, 58 aa, Homo sapiens
VWYGAGHPYSHSRFLADSSTIRTFRFEAKLQIMNIINITAVREMTEPTDDRIEHVVYA

SEQ ID NO: 950950 - protein, 118 aa, Homo sapiens
MKSQALLEVSEDKKLEAFLEFERKASDPNRFTNRGGNLLKEEKQRAKLQKMLPKLEEELKARIELWEQEHSKAFMVNGQKFMEYVASTMGDASIGERETHAGKTPDEPKTDETEMLYG

SEQ ID NO: 950951 - protein, 75 aa, Homo sapiens
MAPLSATHELLHERLRIGKAYAQQLTDVGRRWRQLVETGPEYGTVEKAWIAFMSEAERVIELHLKVKRSLMNDDF

SEQ ID NO: 950952 - protein, 70 aa, Homo sapiens
RIVTNPRRNEYHAGAVAGLSAAVRLAMAPPMECARRQQGSPMYVFLHGIHMLPHIPDEHVDVRHYHPLPF

SEQ ID NO: 950953 - protein, 139 aa, Homo sapiens
MHDMLLIRKGTTPVFFVSEYVCSRTTRAWVTNPKWMGLNHCALEALNSTTNPLTATALIYAFGAGITAGAGTRLVLQLLLDFGWVKYPPLKTTMKSTAALIFSLPHYNLHWAICRLSLRKVYYTSSSRMNLTPSVGMSH

SEQ ID NO: 950954 - protein, 67 aa, Homo sapiens
DHQNGNLYIRTNGEPLLYLSRHTVKPRDLSTFLFGSIEVQPPMAVDTRGRSALTSLSRTPDPSDACA

SEQ ID NO: 950955 - protein, 148 aa, Homo sapiens
MTPAPREACCATSSSAHQSPWSIRNPEGWGPGGSQMLGHLNPREPLEKFLFCSVHLLLVTGWSWDRYIVCVWVELELPLRVGSRGLVALLLLLLLLPLLHVQHSLLQLSFLGLQAALGPPRASVSWLRRLALAFSSASRAGSSSSKRL

SEQ ID NO: 950956 - protein, 113 aa, Homo sapiens
LQSATISPRSNSNTHTKTPVSYHAAQIILTTSPTALTSYITHSASANSNTTQRTPQSPSITPTLQGLQNSHSPLHQLLRCTSQQASLTPSLHPHSFNLTGQHTLCASNHVLLI

SEQ ID NO: 950957 - protein, 45 aa, Homo sapiens
NQIKTRDALSYAPTEFSDPSLTNEEASLNVLLYILILGNTPHPPY

SEQ ID NO: 950958 - protein, 44 aa, Homo sapiens
MLLSLALPPSQIPIPRIKQLLVILQQYKTQIVFLFNPPTPNTTE

SEQ ID NO: 950959 - protein, 72 aa, Homo sapiens
LYIARAGIRIICFLLSSVDSYARADANTAAIQAILINNAYRENIEFHTSPSAMHFSSHSQVMRPTTTSPSKR

SEQ ID NO: 950960 - protein, 157 aa, Homo sapiens
MTKVHALNDVTAVYEHTADILSVHRAGEMRVAVVTPISTGSADPQKLISNEVLGPGHAWVLSGLGSSILRSSVASKFWKVVLNLRFPSKDFLSEQILLVEEQDHRDGAQPSVVPDALEEVQSLLQAVGLVVLPDDHVVAAGAPRRYGATRDVRSLAG

SEQ ID NO: 950961 - protein, 72 aa, Homo sapiens
MAGQLHHWGWPTKQYQHIIPWSGQVFPDHVGSHKALAVGPIFWGMIQSEPELTAIGIAGLQFLYSPPGDDIF

SEQ ID NO: 950962 - protein, 38 aa, Homo sapiens
IIGIALQGPRLGRDEKVNGMEISLDCDGSLGMEGLQGQ

SEQ ID NO: 950963 - protein, 54 aa, Homo sapiens
AGPCITADKSTRTIQETSTQPWAEQLWDESTDRQLGELEIHSLKDRIIPNMPHR

SEQ ID NO: 950964 - protein, 41 aa, Homo sapiens
RVTTHHLSEYRPSIRDNPSLLPQNVFCFAVIFRDAFLPSPC

SEQ ID NO: 950965 - protein, 158 aa, Homo sapiens
MDMSIQHTMDESGTSTGTGVSLGGVILQSGAHDRIKATQSATPKCNIPPAPRHAFEIYRRFYLAKHSGRQLTLQHHMGSADLNATFYGPVKKEDGSEVGVGGAQVTGSNTRKHILQVSTFQMTILMLFNNREKYTFEEIQQETDIPERELVRALQSLA

SEQ ID NO: 950966 - protein, 67 aa, Homo sapiens
PSSDDNCCITVAQRLMIVTVHHDICSAFVNFGTFYCDHRLLYLRYVIYYKHIMESLDELRCCMTLIS

SEQ ID NO: 950967 - protein, 32 aa, Homo sapiens; identical to SEQ ID NO: 875313

SEQ ID NO: 950968 - protein, 48 aa, Homo sapiens
NQKYSSTALYNFTGVLFYPYKLRDGVSLHHFRGIYGSTFFVATGFHGL

SEQ ID NO: 950969 - protein, 107 aa, Homo sapiens
FNEPPSGQKIPKIILVILEPIPKIFPGLLKNQGETEKPKKMIKEIGGLDKFEAQTHENESVKRLSLSLIEKDFSVEEQKDQNVVPETTSEGTFQVQDGAPGTFNFVM

SEQ ID NO: 950970 - protein, 34 aa, Homo sapiens
MWSRRVSQSCPQRSERDIGLKSFSEKAKGYRVHL

SEQ ID NO: 950971 - protein, 35 aa, Homo sapiens
PPIPLMPYTPSDATVYAKPYAAGLHPRGWPMIVPL

SEQ ID NO: 950972 - protein, 53 aa, Homo sapiens
DAPFEETCPGDFIYRSYTQAPSFLGRKKTQNSQGLLKAKDYLGKKEFCNQKIA

SEQ ID NO: 950973 - protein, 30 aa, Homo sapiens
MRTLCSETIFVLLTNLLKETRIFHDDLLLT

SEQ ID NO: 950974 - protein, 64 aa, Homo sapiens
GGPPWREPGLVTKQKGRKFASKQNRGTKVGKARRSARPNIPRLELTFESGERPNTALQPLAAQF

SEQ ID NO: 950975 - protein, 31 aa, Homo sapiens
GGLNLMKLYVHALDDGDPHAGFGLRLAKHQN

SEQ ID NO: 950976 - protein, 78 aa, Homo sapiens
IWLPDVSSQPILRLGPFDASLGLGTHPADTVGVPWAGRRQAEGGEWMLGRQKGCGRQKVETGSNENPCLALRVWVEQT

SEQ ID NO: 950977 - protein, 60 aa, Homo sapiens
RSVPELVPCHSGTFFGDIFESTTRVTLQWPHPQAPVPAALLVPETPGLLGGSNKANPDQK

SEQ ID NO: 950978 - protein, 60 aa, Homo sapiens
GFIVQGTIVRSLLTAFFVSIVSDAVEPTCVHTVRPERNSVFQQGDEEQDLAIMASLKTTA

SEQ ID NO: 950979 - protein, 155 aa, Homo sapiens
DAAWCLMFVSISWVAWRPLVDPQVCWAEGGGQYAVNASPFLALSTDTSRSELAFLRKRMNTKPSRGTYHFRAPSRIFWRNVRGMLTHKTKRGQAALDRLKVFDGIPPPYDQNTRMVLPAALKVVRLTPTRKFAYLGRLDHEVGWKYQAVTSGYRA

SEQ ID NO: 950980 - protein, 77 aa, Homo sapiens
VQLNLLSLAPASSPCIIGIVHLGFLLTVLQGSVSRHGTSRRVLLDQSPPESVHLDTSDNIPYGSIEAESHKWEIKSS

SEQ ID NO: 950981 - protein, 65 aa, Homo sapiens
MCLLIFIAGAFYVFWTYWCRFSPIGQVAGRCGEVSKPSDRRLRCTKETCDESSSEVYTAVANIPV

SEQ ID NO: 950982 - protein, 31 aa, Homo sapiens
MDITMIRRAVHDDHRGCTQTCLSLHQQHHSP

SEQ ID NO: 950983 - protein, 71 aa, Homo sapiens
PKEQKDSRDYVYYLAGENITRLKEYEKAFKYVRKLMQTEPQNNQAKELERLIDKAMTKDGLVRIGNRDICH

SEQ ID NO: 950984 - protein, 37 aa, Homo sapiens
EAKDLPLDTSESSSDTESFYGAVKRPVNLSLSPYALL

SEQ ID NO: 950985 - protein, 53 aa, Homo sapiens
TGRTSLRLLASMLRHPAPCVAPSECIIEPSLRQIARTSYCDTMICRMYYAHLQ

SEQ ID NO: 950986 - protein, 70 aa, Homo sapiens
SHGLRCFAQTAGEGNSAAVTGVGEGGPQCRWVPRVAHMESLVSMLGTDLARDRGHSASGPKANADTDTRA

SEQ ID NO: 950987 - protein, 98 aa, Homo sapiens
SSRQHCSTVTFCQPQQCPETVFAFAYQRTDQYRNSASALLSALSGRLDDGDFGPIEDCLLSMPLLRLRASMKGLRTDKDPLDEDHLSQNQPGCDGNAD

SEQ ID NO: 950988 - protein, 33 aa, Homo sapiens
TVAHLSKVIMTNFGIVEGLMTTVHAITAIPERL

SEQ ID NO: 950989 - protein, 77 aa, Homo sapiens
AVPRGFHSSRVNGNKYKPERVPSQDGRRLSRALARHLFSLLLVPAHLGRVQLLLAQPLAQWGQVCLGNLLAELQSCS

SEQ ID NO: 950990 - protein, 63 aa, Homo sapiens
SIDVASAGFVDILLVSTVRKLSDEISKLHASKGIAFSSLKCMSIDQSPVLINTHLQTREYRAR

SEQ ID NO: 950991 - protein, 44 aa, Homo sapiens
MTRVTLAVHSLDQYTGLWSMDLATQVRRQAMPFKCMQLTDFILK

SEQ ID NO: 950992 - protein, 40 aa, Homo sapiens
FWCSLCGNLGCLSELHHLKGMPVSSLSAMSIDQSPVLINT

SEQ ID NO: 950993 - protein, 62 aa, Homo sapiens
MSLTRLTTVGFPSAGKMVVLPGMPPGRGVLPVPPSRRDYYDLSPRREPSPPPPGLVGRDGSR

SEQ ID NO: 950994 - protein, 45 aa, Homo sapiens
GRLTSAGQLGDRPCLQVRLVTDFLAQFPHSAHHKYVQQAWQKADI

SEQ ID NO: 950995 - protein, 36 aa, Homo sapiens
MLGDRPRLAMCISSLISSSSFRHSGHHKYVNKPRRR

SEQ ID NO: 950996 - protein, 52 aa, Homo sapiens
VLMSASAGLSDILLVGTVRELEDWNSVTLHALETAWPVSSLECKVHRPKPCS

SEQ ID NO: 950997 - protein, 161 aa, Homo sapiens
MRAECVEKSFACAIIVVTELERMSCMCSKNLIIHIFDDQRTGLSSDADYLVERHKAGPVLYRAIGQSPWIPLHPCRKASGQLLDVHILQERAVRPEDRQHLFVLVFIVAACDLPALSLFTSDNLHKRIYVRSGTIENLDFPLKWKTGTNTNRTWPTTPGDK

SEQ ID NO: 950998 - protein, 58 aa, Homo sapiens
LFIVQVVHLDPAHIDMSGFADGVGQLCRTARCGWLMPIVLYEILVDLKWRRLRIFYAC

SEQ ID NO: 950999 - protein, 52 aa, Homo sapiens
MTTARREDPLELSLNKCQQYLTNPQVLNSQSCIRNYGWGDLRAETNLRAVNA

SEQ ID NO: 951000 - protein, 41 aa, Homo sapiens
MDCRPVKETGHAFQCMRSLISSSSFRTVPTISLCDKPGRRQ

SEQ ID NO: 951001 - protein, 57 aa, Homo sapiens
QRIPDGKRCQRHTILIQQVRDFLTEPETICRHYPGGQQGRTGHENTHRHQLVYCRNM

SEQ ID NO: 951002 - protein, 44 aa, Homo sapiens
ALVDGPLSSVGEGPAFHVHLLTAFLLSFRTVPPKYVRQAWQKAD

SEQ ID NO: 951003 - protein, 56 aa, Homo sapiens
PRIPWLYIVRSEQALVDGPALHSRRQAIAFKCMQLTDFILKFPHSAHQKYVRQAWQ

SEQ ID NO: 951004 - protein, 68 aa, Homo sapiens
IFIIVMLLLVSPEGLCILTLVTHCQIETLTGLCRLTPAYNARISGNPVTDQKLTCINKQNIYLLTRIS

SEQ ID NO: 951005 - protein, 128 aa, Homo sapiens
MCSCCGLQMIRVHVHLFPDVSTESLVNRCFCPEGTMNYAPGFDVCVKTCGCVGPDNVPREFGEHFEFDCKNCVCLEGGSGIICQPKRCSQKPVTHCVKDGTYLATRGQPCRHLLKHYRLQVLVLELQI

SEQ ID NO: 951006 - protein, 86 aa, Homo sapiens
HYRPGIREVLFRRTPYSHHPVTGPQRAAPLTTDPIQSSPPSMVHRRSDVTLLAEALVTVTNIEVINCSITEIETTTSSIPWAIETR

SEQ ID NO: 951007 - protein, 80 aa, Homo sapiens
MALADSCRSWRRSMVSGGSWSSCSIQCLGVAYRVLRGVLIPFLSDIEAWPNCTYRGERVGIEEVPTMQILSRERTSGTEK

SEQ ID NO: 951008 - protein, 50 aa, Homo sapiens
MKQANNDYTPLTPSTLLTLGEPCPRIHRLYAPNGPLSKNSQKNNSHNTPV

SEQ ID NO: 951009 - protein, 126 aa, Homo sapiens
DASLKDSGCRCQHRRACDAALKVDVKSPKTKTTLFGQLYFPDVSVCTIKSTTFKAECPLPQPQHWRVTLPAPDLATFFASAFTSKVLKSRRRSPRSRMPHVAPSQCHTIWVTLKGPKVQANLGAPE

SEQ ID NO: 951010 - protein, 57 aa, Homo sapiens
RAHVARIGEEYEEQGVFVQSVLPYFVATKRAKIRKPTVDKPSPETFVKSAIKTVGLQ

SEQ ID NO: 951011 - protein, 106 aa, Homo sapiens
MRAEAILEWTWVPGPGYSLWYQAGLVIPEALARHPMGDCPPPGLAQSQGAKSSLQDTGQDHSREGAPMPAPPHAIGGQACGSKPLSWACPESLGPSRGCMFILSPA

SEQ ID NO: 951012 - protein, 87 aa, Homo sapiens
MDHYNFKTQFKLPRNALQPFSHFYIQIRANPNMFLNDHLWSFKWSMEILQQRTAVLFKRTSTLALKESNELIYTPGHIFKGHYLPYV

SEQ ID NO: 951013 - protein, 74 aa, Homo sapiens
VEDKPTPRNLSCELTIMSDVCMKKGDYVRGGIYRNCCINCLDLNSFMKVWGMFMHKVIALADLKLPHTMVHINP

SEQ ID NO: 951014 - protein, 63 aa, Homo sapiens
GAERRRGKYELVVVVSVRKKGIKDKAADKENENEGVIRKGDKRDEDRGSSVGESHVQIDKGIH

SEQ ID NO: 951015 - protein, 118 aa, Homo sapiens
KLVIYHGNCSSYLVLSTCKDLGLGLPFMLYLCLAILLKHRDHIMRNGLDYHELEMHFDRLVRKHTPGARTDAGLRALFADNLQSEVWDSEEGAEAQSRIYDQAISSPQYGPTRSPYFD

SEQ ID NO: 951016 - protein, 97 aa, Homo sapiens
ARYRAEDHSQKITPYYAMKQLEKRKEKKSGMALLRVSHVRLECSGMIPGHCKLRLPDSKDFSTSASHVAEITGTLEIHGWGYTVQLGGIVNFRKMCL

SEQ ID NO: 951017 - protein, 43 aa, Homo sapiens
MRAANTEESIAHQFATVFMATAATAVILFQPNEDKCWQEHHQY

SEQ ID NO: 951018 - protein, 56 aa, Homo sapiens
YVRTVVSVLSRSEVFYSKRSSASSCSIFTGHVFKVLEVGVPSSWTSSTEMYASVGS

SEQ ID NO: 951019 - protein, 50 aa, Homo sapiens
DVTAVYSAVCVISVVRELCCCEETQPYGHILLAVLQPSVNSLPVPCPPLS

SEQ ID NO: 951020 - protein, 78 aa, Homo sapiens
YEGERCAGTDPDGCEFATAFACFAEAASGYIPADHLRALLTTLGARFTDEEVAEMYREAPHLIRKATSHYVEIQPQSQ

SEQ ID NO: 951021 - protein, 53 aa, Homo sapiens
VRWPTVLCKETADFTDVHKRALADEVELKVTDETGPKGEERVKQKALGGLRQM

SEQ ID NO: 951022 - protein, 38 aa, Homo sapiens
MVVTQENQREQEGRMDGSELSQQLNEKAHIEATHVGSP

SEQ ID NO: 951023 - protein, 213 aa, Homo sapiens
MPVSSRVGTFGCSDSGQSGPCGGLFTLPFVAGSSSRGVYYLMALTPQNIQHCVVAHEMTSSKGKEEAFVRELLQKGLHPLPYSLTPLVDQLPAEVAVNLLSSDALLGAVMAEDDGAEVPAVIVFDEILRRVGDLKTACSQGFPAAGGVWFKAKMTCEKFNPFNGWHCSSTFSTAPVCFLSRSGSWGTAQVKTGTPRNLLSTSVKELTMSINQK

SEQ ID NO: 951024 - protein, 85 aa, Homo sapiens
LAAALGAMLEREPEKAQTRLIEQRRLSERGARQARAELSLAVHHCPPLSFAAIGDLLLTSIPLDPGKVCAVLLIQQGAHCQSRLG

SEQ ID NO: 951025 - protein, 75 aa, Homo sapiens
APVQLVRQCTGTSCEHNTWRDLTQLHPEGLRKPCVLHNAEVVVLIATFDCEVDDEAVKDPSLLGPKSPWPVAQRQ

SEQ ID NO: 951026 - protein, 183 aa, Homo sapiens
IEIPVDSSPRTKVVSLSGKCLVVMLEPGTGVVGQNSSTRPEVVERAEMCVVGIELGLPWEVVDGSTKADVVVGGAGLVSFELGQLWNVVDSPCRVVEPAVDSVVCGDLLLLWTGVDPSRSPEAVVFVTVKSVVSVEPGLLWKVVYSGPRDGAVVLPGDNVVSVGPGLLWEAGRFLTEAWHGGT

SEQ ID NO: 951027 - protein, 56 aa, Homo sapiens
NRHGSRILYGDDLVRYRELECNAAEIPLIRQEYCGAGLEAEWQDRLRFAPDRYDAH

SEQ ID NO: 951028 - protein, 76 aa, Homo sapiens
MHIILSRAETVIIFKCVNQLFKFFIIHVFYTFFICIPYSYLYNSNFFIIPVEKHFIHWYLAFFFSKELLTVHRKMT

SEQ ID NO: 951029 - protein, 44 aa, Homo sapiens
MTPVGIAMILVAAVQYARVSTSIPHCKSSWCAHTHHTPLGTPIA

SEQ ID NO: 951030 - protein, 65 aa, Homo sapiens
HNRGGSEYFLFGDRILRSVPSRRGGVLARLVCILILSNNAPSSIYPNKRAIGRPKGGGPRKVRRG

SEQ ID NO: 951031 - protein, 35 aa, Homo sapiens
QRVPVREVSSIVMRAARTGRDSRSRIAVIRTDQTK

SEQ ID NO: 951032 - protein, 36 aa, Homo sapiens
MSVSTFSTLCKHAKCQQGTGHGCIIAQGGAHAKSQQ

SEQ ID NO: 951033 - protein, 45 aa, Homo sapiens
MFCGSHRISEHLYTLDSGDIINALCFSPNRYWLCAATGPSIHDLG

SEQ ID NO: 951034 - protein, 55 aa, Homo sapiens
GLSNVRYGRGFILIIVVMKLMAPKIEERPARCKEKMVGLQSEFQATRKPQAGYRA

SEQ ID NO: 951035 - protein, 41 aa, Homo sapiens
MTQSNSSTAYYNFSVSSICTLLQASEYFESPFTISENGFFI

SEQ ID NO: 951036 - protein, 118 aa, Homo sapiens
MSRFNICSQHAMGHIDAYLVLPTKSFIIYFVSHSASLLLSHNSSPQLFAICPALSTILMDPVVSTCHLVQRPLLHSNLAGVERCHAKREQRMPGRQENRGLWAEPAQRLLCSFPVRSG

SEQ ID NO: 951037 - protein, 63 aa, Homo sapiens
TRCPEMSIRTVFRQSKFRHVSVQPVTNEQCYKDIRVIRVTWDSTFCAVKPKLLAVIVERVPSS

SEQ ID NO: 951038 - protein, 144 aa, Homo sapiens
WMLEKMLTPHAQMDTTEGTQEESGHAQTRETHRVTRGTCVKELPQHHKWLIVWSLETLCPSCNWAPASPHAISTIQAAGCEKNFSLPELKCFISDSQLTRDAALHLRLEDRALRCSGSGGLWRDSTLARRRGVKRVTWAPALQL

SEQ ID NO: 951039 - protein, 41 aa, Homo sapiens
RRGQTQDTELVQTAQQETEPSEVGSCGGASGEEQRYTCHVL

SEQ ID NO: 951040 - protein, 69 aa, Homo sapiens
RVKICWDTGMMVDVGGSSSSSVWVVGVGEPGDSAVDTVGDWDKEDDVVSREAQRLGEADNVPLKYRKSA

SEQ ID NO: 951041 - protein, 84 aa, Homo sapiens
PWSSSSLFAECDALAGLPLVALLQVRAESAVAISCSKSKDDVTQYLLTVTHGFPDRDRDDEAIDLSSVKIYHEVVSQVPDSQVP

SEQ ID NO: 951042 - protein, 86 aa, Homo sapiens
RRIQQGMRATQDTELVVTDQQEIETFQKWAAVVVLLEKSRDTHAMYSMRGWPKPLNLRWEPSSQSTVPIAGIVAGLAVLAVVVIGA

SEQ ID NO: 951043 - protein, 92 aa, Homo sapiens
SSAGPVASSRGTVRRPMLEGRQQNATMGTVEPGKTAPISGVEGLREALMAGNGMCISALLQKAPPKVPTSGRFYLLVGWSPQAQCPEFGPRH

SEQ ID NO: 951044 - protein, 88 aa, Homo sapiens
DCQNQQGCRVKLRTLELVETDQQEKNSQKCAAVVVLLEKSRDYTCRVQHEGLAKPLTLRWEPSSQSTVPIVGIGAGLAVLAVVVIGAV

SEQ ID NO: 951045 - protein, 95 aa, Homo sapiens
ISGRSDSAGQSPIQTGLDKPGNKNAHDGTVDWKMVHLRVRGSEPLMPDMACVSLLFSRRHHHRCPLLERSVSCCSGLHKAGVLSLVLGIPLAGNG

SEQ ID NO: 951046 - protein, 69 aa, Homo sapiens
RFINIRSFTRVVELVDEQDGQVIDGFPQLDYLHVTDAHREAEEDPSKEKLSAITFSAQRRSPSVTLLHP

SEQ ID NO: 951047 - protein, 120 aa, Homo sapiens
MSAVDPAELHSFYWFFGLAVLEEDEHFLLPDLTPGSLEVRSKGVGKHILLMTYPGCYGTEDPPFVRNSSGSRYITAMIVDQFGEIVGGTKMLDYSNNFCLLISAIFTIIECTPEFSNSAS

SEQ ID NO: 951048 - protein, 37 aa, Homo sapiens
QQRRRGQSQDTELVETDQQEIELPEVGSCGGAFWRRA

SEQ ID NO: 951049 - protein, 105 aa, Homo sapiens
MRMLALTIGYTSRKVVDVGGFMESSETSGIVQASLGIIGTGLVLVPLAEFLNGLLDVPRVNRNGGSPTLSPGYGAKNGVHQNMIPVEQILHEGSWCNFLPVLSQW

SEQ ID NO: 951050 - protein, 35 aa, Homo sapiens
MNAFHSKILTPGTIKAVALVGLEEVLTPRLAGKWL

SEQ ID NO: 951051 - protein, 62 aa, Homo sapiens
FSYTAHKREGFGIRILWDKQTRPSFINRWNPGSTTCPMPLSQNIRWLAQTEKTASSAAQLGK

SEQ ID NO: 951052 - protein, 54 aa, Homo sapiens
EVIASRILRNRLVQCSNAAERRTFVLAAHIPYVELDIFVSHRLHVETHSVNGAH

SEQ ID NO: 951053 - protein, 88 aa, Homo sapiens
SRPCTFQQRKSSITTAGRQAAQCHDGTVDGRRSISCEGSGAPHAVHVMCISALLQKATTQLATSWNVLSPAGSGLHKLSVLSLVLAIP

SEQ ID NO: 951054 - protein, 50 aa, Homo sapiens
QALCPVLPIGAIRYCPCSRTWIQTLLCSTPCRRLGKRQRIPFTLVLLLHS

SEQ ID NO: 951055 - protein, 61 aa, Homo sapiens
MAVCACVRVSRFTPGASHESQKRIRANLCEQDSCSLSAHRDLGSRRTPGISTGVNLADSRT

SEQ ID NO: 951056 - protein, 72 aa, Homo sapiens
AEEGTAVVSVLPSKRAVSKHCDLATALGIPGFIGNLPVSLSQKERCTFWLSLRVKIPVFIPQHSRGDCSVMK

SEQ ID NO: 951057 - protein, 42 aa, Homo sapiens
LAALEIPAAVGANPEAEVLWEDVTRRSRGRFTGINLRVEEQS

SEQ ID NO: 951058 - protein, 48 aa, Homo sapiens
MLVRLDRICSHGNASKLEWSSSLHGIHMLLALVPDLEEAIPGPCRHSH

SEQ ID NO: 951059 - protein, 166 aa, Homo sapiens
VRGGKRGEALPRSSQRWRFGRSFGGSRFGGTLGAGSAALSTSSEPGAKPEVDPVENEAVGPEIHQPEPPETELLSVARKERGWRTVFPSREFWHRLRVIRAQHHVEALVEHQNGKVVVSASTREWAIKKHLYNTRNVVACESIGRVVAQRCLEAGINFMDYQPTPW

SEQ ID NO: 951060 - protein, 102 aa, Homo sapiens
TRSIPSLLGLALEQLQLEGGVESLPQACMWRRSADSTSALCGRGHCTPGFLLGGSVMGNQLGPYGIQNLVAMRDNVQEDQIRHKLSGNYNYPTNRPQTGSKR

SEQ ID NO: 951061 - protein, 140 aa, Homo sapiens
MALRSQLRGTRFAGTLGAVFAAQSTSSEPAAKPEVDPVENEAVGTEFTNRNPRNLELESVARKEWGWRKVYHSREFWHRLRVIRAQHHVEAIVEHQNGKVVVSASTREWAIKKHLYSTRNVVACESIGRVVAQRYLEAGI

SEQ ID NO: 951062 - protein, 32 aa, Homo sapiens
RDRSTTAHVLRILKRHLETVPIQRRSPEKFLG

SEQ ID NO: 951063 - protein, 38 aa, Homo sapiens
APCILLPQACESTTLNEPSFSWGFDQDPALKGWGPLPQ

SEQ ID NO: 951064 - protein, 79 aa, Homo sapiens
GSGEGGWSYIIAIWEDGIQKRVIQEGRGELPDTYNDGTKATYHYRTLHSDDEGTVLDDSRARGKPMELIIWQEVSSCLV

SEQ ID NO: 951065 - protein, 94 aa, Homo sapiens
QDVHLGDTEVMPRSSAQMKNHCLNEVHCCVCNGYRESFPTIQNLSDFILSDTSDAVKQGQSGSWIVTTHADIKQTLPSRTEGTTVTRNCCPFIP

SEQ ID NO: 951066 - protein, 214 aa, Homo sapiens
YRKHNQPSDVWTSLIGSMLGGHRNYLNGVRGWCCTRRNLCALPVIPGRLYKEDDVVFKKAQKFGEADEVLLELRNQLLGTPVEGDLEVLPVLRNFLEEQHNMLVIISAHHSDEITRKSRVNPYVAQHKLTGLATWNKSPDPVITLLLPKQDGGEIVALILFQLIDSDIIFSESLSSQRIASLQAYHIPIPLELVVLKSAVKYNGTNSIELATEK

SEQ ID NO: 951067 - protein, 40 aa, Homo sapiens
MSVASALRLQPFCHSCRAAGCWLPLVVQRRIFTVVPGPWV

SEQ ID NO: 951068 - protein, 47 aa, Homo sapiens
SSTTPLASFTTVASEPPVKLEPPPVESVSQATIVMMPAPPAPPIQGT

SEQ ID NO: 951069 - protein, 68 aa, Homo sapiens
FERERRLRNPKCSGKRRLAAVVVVGSCREWSSIARTPIQGQRRERTAKVVRDDIEDEVLPTFLISSVN

SEQ ID NO: 951070 - protein, 36 aa, Homo sapiens
KDVNTNQMDLGVAVLANLRRRHLDDLNMAAFEHHQY

SEQ ID NO: 951071 - protein, 112 aa, Homo sapiens
GHCQIPPSKAGISPLFNCALWGCGSLGSEYSYMFCTPTPIAPSCLQDFVRSCQNPADSRCTVLHVFPGHSRLIILLQREMLVHFEHHQYKYIRPDIICNWWFWPLGLHRGLF

SEQ ID NO: 951072 - protein, 86 aa, Homo sapiens
KQHEAHGLEITWGGSHSNKKLLASLGIDTRNILFTGNKKQPVIVAMYAAGLGMLEPTKESLKPLSAAEKIASIGQTATMCFMLVGY

SEQ ID NO: 951073 - protein, 86 aa, Homo sapiens
PAVAPAFRLHDSFPLAVDLAAWIGLMEGDETFPPSVSSQWTQHPILSQVQQACADDRTQITDSTVVAVFFNTQQAVILSKKHLGDV

SEQ ID NO: 951074 - protein, 82 aa, Homo sapiens
LEHKGIASALSHSGWHINELGCQASTELCCTEHAMHSTQSPFRYAWGTLAYQKHGLPRLQGKQVPEVDGKADDITWVLLVQL

SEQ ID NO: 951075 - protein, 78 aa, Homo sapiens
NCDISHYWNCTKLATDKNDPHLGDFIETHNLHEQVKAIKELGEHVINLRKMESALNLTWRNISLRSTPWKNTISSGYR

SEQ ID NO: 951076 - protein, 119 aa, Homo sapiens
PGGTQREPSGSQSRVWLSRRAARESRKARMDSSELSPASDKQAHLDSTLVGGPPQPIVNGRPEPVRVGNSQSGQVLHDSDVDETPGIVHHLEYTLQVWNAATRTQSPEPTHHIQHNKTT

SEQ ID NO: 951077 - protein, 68 aa, Homo sapiens
ILEFYGDYIARLKLAQKVKMSTHARPICLPCTMEANLALRRTSKQHLRDHENELLNKQKCTCSFRPHE

SEQ ID NO: 951078 - protein, 92 aa, Homo sapiens
SGAAGTCCLIGLMEARNLPPSVSPGIRTILAGEEAVLVDRAQITDSTVVFYAFYTQQAVILSKKHLCDVGDDSAGYSDSCSPGDPLVLERPH

SEQ ID NO: 951079 - protein, 145 aa, Homo sapiens
MGLEKKCVARPPLHFPQCSVAHCSSISSEGTELLVQFFSDLIVTDDGFSASYKTLPRATAKEGQGPGPKRGTDPKVQLPPKSQPPEKPEDSPSAPDAPPCPKQCRRTATCRAALCPRLWYFNVPPVRTRYSCRIALLGLTAVTAF

SEQ ID NO: 951080 - protein, 64 aa, Homo sapiens
DPVIYALKGIPERYKSITNGYYNKYINAKQGSITGITMVQACYMLFTYSFTYKHLKHERLRKYH

SEQ ID NO: 951081 - protein, 214 aa, Homo sapiens
MIPEWGPARVALDVLSPEEALKQYRNERTFVATKPLYVALAQRKEERQAHLTNQYMQRMAVYEAVPNPVINPYQPAPPSGYFMAAITQTQNRAEYYPPSQVAQLRPCPRWTAQGARPHPFQNMPGAIRPAAPRPPFSTMRPASSQVPRVMSTQRVANTSTQTMGPRPAAGAAAATPAVRTVPQYKYAAGVRNPQQHLNAQPQVTWHSWCHVQVR

SEQ ID NO: 951082 - protein, 61 aa, Homo sapiens
GAVRNTAGPDYITDKSTGLRVEQQPFDGARASRTNDKPGGPHYILRWTFAQVIMENSTSKV

SEQ ID NO: 951083 - protein, 70 aa, Homo sapiens
MMPMVHSSPSADKPAKLKAVPVIVDRTDKIIQVIIGVQDRKACQEHKQAQGQLLHVRALACVVHQAGAEV

SEQ ID NO: 951084 - protein, 82 aa, Homo sapiens
YGQNKLCTERKRCLENVSILKMFAEVARAEGDCVSRSEMAPAPAGEVLLGAPPCTRMAGFMAAAIGPRVLRTLPLHQCWFPD

SEQ ID NO: 951085 - protein, 37 aa, Homo sapiens
ALGTGVSCTIRSPLLGLAKTGSIPIRDPFFRSAQRWI

SEQ ID NO: 951086 - protein, 81 aa, Homo sapiens
LRTPGTSQDRNELLQKYKSLWMFEIPKEESEADFLRKRGKPMACLPTTIPKRSLGLWFLWTPAQLVKLQGRGSCACTAVMG

SEQ ID NO: 951087 - protein, 43 aa, Homo sapiens
SDSGPFFMMPLKRVAQAMDWKPPDFFFFLFLGTHQSPGGPAVM

SEQ ID NO: 951088 - protein, 45 aa, Homo sapiens
LGDLFGLQYLSSQGPALVPMSLLGAMETLRQYGGASVLKKGVRLS

SEQ ID NO: 951089 - protein, 54 aa, Homo sapiens
TSYSGPQVPIRGAPCSGLQYLSSQVAPYVPMSLARGHGDTACQYGGASCLKRGG

SEQ ID NO: 951090 - protein, 37 aa, Homo sapiens
WCNPQITIYGDLEEQCLMGRGIGVSLLQLVVERYESC

SEQ ID NO: 951091 - protein, 62 aa, Homo sapiens
MGDEDDEEQSDAVVPQVLDELGLSLTDELSEPPLNWGLLSVAAGGKKAEAAASALADADADL

SEQ ID NO: 951092 - protein, 58 aa, Homo sapiens
MQLLTSGPRYDYSSSFSIAEGLQDELSWFPLRPSTLSSMISFGEEHRREKGNGLLQDG

SEQ ID NO: 951093 - protein, 61 aa, Homo sapiens
VVNDGVRHLDCNYISLIYTNYRRARMTIKGSSRALKPFETLLSQNQGGQTFIVDTTVSFAD

SEQ ID NO: 951094 - protein, 40 aa, Homo sapiens
GSYLGWHEVVDEAIPATKPLSIYDEQLHYRPPPYCTSSTS

SEQ ID NO: 951095 - protein, 40 aa, Homo sapiens
MSSSMLPGLPRTPMPFKKKDELYGVAQSKLLIFPAATVVS

SEQ ID NO: 951096 - protein, 49 aa, Homo sapiens
MCTGSFLVWGPHVPESAFATCLAGHNTYLHGMYMAMRDAHCIMLNIPLT

SEQ ID NO: 951097 - protein, 54 aa, Homo sapiens
REQSPEMHNAEIYEAAGETLELLKDSDKIPFIREAEEVRLKHMVTTPIQYGQEK

SEQ ID NO: 951098 - protein, 47 aa, Homo sapiens
MPATMKGLTEMAEELRNAPLSFRRAMMFYLRNYRKDLANLHREGETP

SEQ ID NO: 951099 - protein, 86 aa, Homo sapiens
DLEIPPQAGKDKGCYTETTVLPADPAVLPTGSLMRSIGVGLAALNEYCGLRLHEFSFSLGMPFNQLGTLAGSKYYNVEAMYCYLRW

SEQ ID NO: 951100 - protein, 88 aa, Homo sapiens
AGYLETHPKSPRSQTNTLNHCSLDVGCIVMYTTLESWLPEQKGSPKPPGSQYPQDEWQRLWLKVGARCSFPVHSLLKIIHEEREKSMS

SEQ ID NO: 951101 - protein, 62 aa, Homo sapiens
GRLDWVERSQVGSGGMFTGMQSRTIVAAGFLVWGTNVQGGHIDDGQAGGLGGFVFNHCLAPG

SEQ ID NO: 951102 - protein, 66 aa, Homo sapiens
SCVVPQYRPQCEPEDMLHQQEPTRTRGIVRYGESMTDGYQNEYGGQGLTNTADVDIQLNIYCALIV

SEQ ID NO: 951103 - protein, 208 aa, Homo sapiens
LVMDGQACRGDVTSLVLEQCGDPSPPDTARQPALRRRASISASLEISVPTSLSSNTDVSSWIEYPSGQVYVAAVRLQRVVPTCELCRTWAEVRWTTDGEEVVESAALLLQKGRHCPTTDADRWSARGTPGKYLCKIDDESDSFTVTVHKSLNKSGTVQIKFREVCVLLKKPENREIWSRFPQGPLIFWPLVPCLLEEARGSCDSQCRL

SEQ ID NO: 951104 - protein, 43 aa, Homo sapiens
SVDGGSVCTKDAFFKLLSRRWLGSSGPGLGNSTCSMLLSEPEG

SEQ ID NO: 951105 - protein, 213 aa, Homo sapiens
MCITVSSSKDASSYPEKLSRNYIDSELASQAHSEFEKAMKELAYRKKPHLVKQFQKLSEAAGRVGSDMTSQQEFTSCLKETLSGLAKNATDLQNSSMSEEELTKGIGGARHGRRGMGKGTSSPSCRVLCRTYSPRDVLYPSLKEITEKYPEWLQSHRESLPPEQFEKYQEQHSVMCEICEQFEAETPTESETLKRSFEMGWSYEQYKILAPPK

SEQ ID NO: 951106 - protein, 174 aa, Homo sapiens
SGPDSSAQKNQLVRESWRVVSVYLQPILNFLKMSLDVQLAFLRLLTSRATQEHHIITAKIALHTWIRASGNVKNPLKLWGPNEGEFKAEGNSKYTYTVLEDGCTKHTGKCSKTVFEYRTRKAVRLPIEDIAPYDIGGPDQEFGVDVAPGCFLYTKLYLKSQKKIILLHMCSSST

SEQ ID NO: 951107 - protein, 117 aa, Homo sapiens
STLAWFPKALNSKSETQGIPHTELIKQYTTMNRPVKYHPSLAVCLKNTPKITRGRVDLTVGSNPYHFPRVDCWLVQRCSPYEGSGETRRWYLLVSTTSAGGNSTSRSCMVDCRSVSH

SEQ ID NO: 951108 - protein, 84 aa, Homo sapiens
NDGQCSYPLDSIIPNTEPKKCKTNPKNLAEAYPNNGVQNLVCAEMFPLDLYSTLPKKEARARNKGHPLDIFATLQWITIDGRLS

SEQ ID NO: 951109 - protein, 61 aa, Homo sapiens
SGAGGKTVMNTKHQDLPPAIIDVAPLDVGAPDQEFGFEVGLSASCKLPPSQPGSLPPNQLS

SEQ ID NO: 951110 - protein, 57 aa, Homo sapiens
SPIEPLQHQTDGNVVIACLGTGLLPPGAIQCDLELNADEGVDRQKLPNQPWMPPGTC

SEQ ID NO: 951111 - protein, 56 aa, Homo sapiens
GGVPPYAFAEVIDLIVGRLTHCMMMHGRNSVTKLMTVRIVKQSFKIIHLLTGENPL

SEQ ID NO: 951112 - protein, 78 aa, Homo sapiens
CQILSMMKTCVSPVRFLLHLPTILGRWQNLTYTGSYDEPENIHKPPEIILSFLRHNKITHIIFVKGVNISFITPIKFW

SEQ ID NO: 951113 - protein, 124 aa, Homo sapiens
PKKMKHELVEDSPTPANVQLFTQFLSLCSAGKWGQMAVSVGAVLTWDLCGTPGPHPPECQEHPTPCDNQKMPAVTLSVPWGGPLPDPGQQRAYDIDVASPGSTETATTFGRTRVSRAVQQDCQN

SEQ ID NO: 951114 - protein, 40 aa, Homo sapiens
MVILWQLAKITESSSTRRTRLKNNERYFFVENLSTLPAQR

SEQ ID NO: 951115 - protein, 42 aa, Homo sapiens
MASQCFTLKYGQPKTTMQLRKPPTWERPRKTNKQKIMLEETD

SEQ ID NO: 951116 - protein, 126 aa, Homo sapiens
EVPAEGASRPCAAVPGGQRGCPCPLARERELTHLLLPASESDTPQVTPHHQRRCLCLSNKYSQTCHPLSSKVQRCKPGPRDKQLTRVDKSPKIWCIILFSLLTWVYAEPTIYREILSPNYPQAYPV

SEQ ID NO: 951117 - protein, 161 aa, Homo sapiens
GCCRRRRSERACGAGDSGVGSASLQAAGSGGGGTMSGGTPYISNKINLISKAEIRYKGILYTINTKNSTVALAKVQSFGTKNKPTNHPIPPQNKVFKYIIFHGSNIKDLTVCKPPKPQYSLPQNPAIVQSSLSSSTSSFQSMDSYRPFHKIPTYNQFSPSS

SEQ ID NO: 951118 - protein, 34 aa, Homo sapiens
NLQPEDFATYHCQQTENAPNTFGQGTNLHIKRTV

SEQ ID NO: 951119 - protein, 69 aa, Homo sapiens
TRGFLSRSEKRNIRVGVTRFSRYVLTPFFDSERELPDPLRFPGGGNASPCFGSRTVRAPTGLRPLSGTP

SEQ ID NO: 951120 - protein, 80 aa, Homo sapiens
EEKSQPHDKRRPKGPTKKGRVHPAYEADIEDSQFKNVTLQVIMMKKKWVFTGTMQNLPVKIPVASNSVWKLRLQCGCTDS

SEQ ID NO: 951121 - protein, 148 aa, Homo sapiens
LLSSGENAFELISKSWFSTLEVSDGYCEKKAMSRKQWYRLAATAEMQNVEECVCWNSWTDTALKEKPSGFGSLAGQGRRRSWRGRRDGILGAADCAARHWRGHWDASCNIQPEHTHEDKHGPTYLPSEKQNHALSLERRGKLESYYLK

SEQ ID NO: 951122 - protein, 109 aa, Homo sapiens
TLDDPLLQTIRSTVRLAILEFGIYRCVTRGISGSCEILGKLTVIEHGKSSAGPGEIGENTELLRRVNFIAGHADELEELINYYQDRGYFEELITMLEAALGLERAHMGY

SEQ ID NO: 951123 - protein, 85 aa, Homo sapiens
MLNSPSCSNESRITNISGPVVSAHSRKSLSFFANENNHLSWRDVDERPPGDGGPDGGRVLVAHDGRVLRGPGRHEVVDVGVPRRP

SEQ ID NO: 951124 - protein, 73 aa, Homo sapiens
KGKVCADTCGAMELSGPALETQGSPGARLSESPQSSSVSHFHQKGNALSFLHTNWLAVQLDTTVCEQRCWEIA

SEQ ID NO: 951125 - protein, 65 aa, Homo sapiens
LWRSETSYVPPSDGDDPRWSSSVTHTRKVLLSLCQIPRTSGQSRAMPEASSSHDTGLSEEEVVVD

SEQ ID NO: 951126 - protein, 69 aa, Homo sapiens
RVGEDEIGGPLMRLCSNEVRDERDGLDGLHQAHLVGQDARSGLLLYRDTSHSKPLIWYCLRTPLTISAD

SEQ ID NO: 951127 - protein, 124 aa, Homo sapiens
MATICVFTINIGGCQTALSSPNEIFGSTFFFIKRESWGWTDFLMNPMVLMMVLPLLIFVLLPKVVNTSDPDMRREMEQSMNMLNSNHELPDVSEFMTRLFSSKSSGQSSSRSRKTGKSGAGQRR

SEQ ID NO: 951128 - protein, 195 aa, Homo sapiens
RGPCNDAVQTDGNVYIASVNDRHVTRSDSENDEYCNPTACVKPTVMEQIAGMYGAGLLSHRGGNPFEPGNILLTENNWYLARKSQVASGAGRNSKALDAWINVGGVFAPRACTGPHKVRECLTLNILQRNRFNYAPNGDYVKKICMQRFIKIDGEVRTDKTYPAGFMDIISIDMTGEKSRLIYDTDGRLAAHRNT

SEQ ID NO: 951129 - protein, 130 aa, Homo sapiens
LAPDFPDHLLFLSSAKFKLARLFVYGREEMLALFLKDNKIPSDLLDKEFLPILQEEPLPTIGFLVPFTEEEQRNFSMSVNSAAVLRLKDEEEEEQWWGLLEVEVLQEGEAEAEVNVVSNQRSFDEVEGVF

SEQ ID NO: 951130 - protein, 101 aa, Homo sapiens
LQEEASEQNSLHDVGELVDKQLKDLTSKGMYGQRTGYWADLERVQIALNHAVDHLSLQTDILQPIVICIDAMVEQITECHRADFAFILSIEQVLSAMSTQP

SEQ ID NO: 951131 - protein, 49 aa, Homo sapiens
MAVPKNELSYTVYHATSGLVGDYGASYQYEVHKLAILSAPRPERKRRVL

SEQ ID NO: 951132 - protein, 60 aa, Homo sapiens
YLTKDSKAILPVSTLNLFFPSSKPLSSAVLGIGVPDWQKLISSQMVHKETKVGTQGKKTG

SEQ ID NO: 951133 - protein, 56 aa, Homo sapiens
GRKNAGRERAGLWGKAPCGWRRLYEQGWTLGCVGFHDILKTNPSFSLCSPELLAPP

SEQ ID NO: 951134 - protein, 95 aa, Homo sapiens
KEERQKHLNNQYMQRMAVFELDQNPVIKPYKPAPPTGYFMAAIQQTQNRAALYPPSQICKIRPSPRWTGQGARPHPFQNIAGTIRPVGPRPPYSY

SEQ ID NO: 951135 - protein, 94 aa, Homo sapiens
IFLGCQHLTSLCEICFFPDRDIPSTSRQPHEDQRLLTAVSLLTCGAGTQQQVFGAHWERAWAPAPAPQREQTTDLLMEAVNPHGLSADVTGHLL

SEQ ID NO: 951136 - protein, 167 aa, Homo sapiens
LPPKNGHVNLCTFPVLYVSDVYCGSCKLLYQYREHGSSATLEHFYPHSKSSNVCCTDYTTPTVSRLYFMAPPNTVLCVDAGKCNPYPNHHIDKKTHSSCAEPQTGRVMFTHPHYHSSLECQYGGLQGSWSIFRRLTLSQLGLQSHDFSVNAKDLGRGLVSQASLPRE

SEQ ID NO: 951137 - protein, 47 aa, Homo sapiens
MALTPCVLTQYCTRDLSQKAGGAIADLPGCLLPPSSCEGPRRFYPWL

SEQ ID NO: 951138 - protein, 65 aa, Homo sapiens
SVQTKFDDELSFQQDNKPLAQKKCWENIIARSYLGLVVGGSLLIILIEQLAIFLPQSDTSNAPQT

SEQ ID NO: 951139 - protein, 118 aa, Homo sapiens
ELSKKPHFKRKREKRPKSVSSGPPSLFHPGQHPSRPSALTLVRVHQGSFLPPQPPPAPAGLLTRSRFGKGNVANISSSCQRRDLPSKGLDRDPPQVLHELAGQQFDKEPGPPLQVATQ

SEQ ID NO: 951140 - protein, 83 aa, Homo sapiens
MGALEMQDEEDRIEALKQVADKLPRPNLLLFKPLVYVMPLISKNFEVNRMGSSHMAICSGPNMLTMENDQSLFPILKSPDNQG

SEQ ID NO: 951141 - protein, 140 aa, Homo sapiens
ARLSDSSITSKLSHKQNLFHETKKPQAYTSSNQQEELKMQSAAFSIAADVKDVKAGQSNENLSDSQQEPPKGKVPEGPESPLIGNQNVQSMETQIDKAQAGYSACTPLRISLYLLQSTFPSKTGGMEGGNSSSNIIINSR

SEQ ID NO: 951142 - protein, 92 aa, Homo sapiens
STRVPMLWECRWGVTTANRSVAILPEMPEDLLFLDAAAQRPVFQARACSMKKTRRGGEKIPVPRAMKNIVLNSHWVLDMQSVPFIAFLENNN

SEQ ID NO: 951143 - protein, 117 aa, Homo sapiens
CCRNMGKGLRHLLGGKTLYRGPLVTVWKVYLRVILQVGILTPTGMAWVFDGAVLALRSSVFSAGCPAGSTDSPFIVGTIMPCVELCFGGADVNSHLLLLEVSPCFLHSGPAICVRLI

SEQ ID NO: 951144 - protein, 104 aa, Homo sapiens
MGNGSLNHCSKVLHLLKMVDSRKLSNAQSSGSLCCNGVPVSGRRQGGHIVRVEPLCQLACAVLHAVNRRPQSYTSNGSWRGCAESLMMYTYVRQQDVELPNSET

SEQ ID NO: 951145 - protein, 150 aa, Homo sapiens
TTARKCCSTCKMVDIRKLSNAQSSGKVVLQRCTRQQQAAGCHIVRVEPLRQIAVVILDSVNFVHNHITTNLDLGDDVLVSDDIHERRQQYVELPTPELREQRPDKQLGIPCKNTFSKEGAHLSNSYAQLDNDDIGTDDDEGAIYAFVVHE

SEQ ID NO: 951146 - protein, 69 aa, Homo sapiens
IFAGIMNNAEITFVLQLVGLLELGLWVPCVLHLPSPRQLLIGGFEGTSTPLSSTGQNCPWGPCWLSQLT

SEQ ID NO: 951147 - protein, 34 aa, Homo sapiens
RTKRLSPTSGEIASGGGHVTHPASLLDALTEGTI

SEQ ID NO: 951148 - protein, 66 aa, Homo sapiens
MGPRPCSPASTLIEKPSRPPGILALLDRGVLVSPKATDKSFVETVIAGAGHLPQVPEAKPAEDKLF

SEQ ID NO: 951149 - protein, 194 aa, Homo sapiens
SEYDLQRLNTCPNSEVDSHPELLAHINGIVTGTPSAEGLGDSGWTAKLLRSCVKESITVGHQCGTKGKIMYVGNVRGATQKHIQEVGPNQNLMIGGSPCNDRLYCQPYSAGISNKEPGRRFQKGLAAPGDNALANGGRIKRVLLDHRGMWWPCGESDQGGHLHEYRASYPLMLKMQKKVSSRKQARNLWVNFQD

SEQ ID NO: 951150 - protein, 88 aa, Homo sapiens
MDCPYSFPRYRNLMVQASHRAETLTTALERYRSAVYAPGVLPSPGVQSMGHMVSRASRMRTLANSPNNLALSVHLERGPLQNYKHALN

SEQ ID NO: 951151 - protein, 78 aa, Homo sapiens
MSHLSLTHNGTTILKEPEDGAIISLLGPRFIKEAVKLKEEPASALVEALASRVDDGEVIAGTTPNHQIEWAPLLDMLL

SEQ ID NO: 951152 - protein, 148 aa, Homo sapiens
PGTYPEVAGPMCNCHLFGVNHHRVGLDKSRDVPHVTNAHGHHILKEPKAGAIISLLGPRIMQEAVELKEEPDSALVEALASRVDEGEVIAGTAPNHQIEWAPLLDMLLCNAADVPEVHELPLVPHHAQRDGVLTHLRGNVAVHLNAQS

SEQ ID NO: 951153 - protein, 255 aa, Homo sapiens
GKGYWRLIPRENGVNHDPKSSSTAPTSRGSPYKIRVGEPGHGGDPGLVSAYGAGLEGGVTGNPAELVVNTSNAGAGALLETIDCPSKVKMGCQECPEGYRVHYTPMAPGSYLISIKYGGPNYIGGSPFKAKVTGPRLVSKHSLNEKSSVEVDSPDKGHCAPQHGAPGPGPAGASKVVAMAWGWTGLRRAEEHFTVTEHACTTCGGGGLARTLERLVKPGGRQGSTLSKGDLWSAIVCYARKTTTEKETKKKGWQK

SEQ ID NO: 951154 - protein, 218 aa, Homo sapiens
TDSLCDGIYPPKVTTVQLRRGSHRVPSLLDGIDTGLLVLKDLGIQVDRYIATEVCEDSKGWALYGNKGKIIYIGEVRSVTQKHIQEWGPFDQVIEGSPCNDLSIVKPDRKGLYYGTGQSLKEFYRLLHDARPKEGDDRPFFWIFENVVDMGVSDKKDISRLLEYNPVMIDAKKVSEAHKARNYRGEPSQYEQGDESTSNDKLELKNDKTGRNQNKKET

SEQ ID NO: 951155 - protein, 202 aa, Homo sapiens
HRIYCRIDPQRLTYLVPAEKRKPILVLSLFDGIATGLVVVKYLGIQVDRYIASEVCDDSIRVSMVDTRGKIMYVGDVRRVTQKHIHEWGPFDLVIGGSPCSDLSIVKPARKGLHEGTGRLFIEFYRLLRDARLKEGDDRPFFWLFENVVGIGVSDKREISRFLESNPVMIDAKEVSDAHRARLFWGNLPGMNRPLASTVNDK

SEQ ID NO: 951156 - protein, 217 aa, Homo sapiens
FAMKLPSKGLPPVPEKMNLIRVLSLFDGISTGLLVLKDLGIQVDRYIASEVCEDSITVGMVGTKGKIMYVRNIRSVTQNHIQEWGPFDLVIGGNPCEYLSIVNPARKGLYEGTGRLFYEFYRLLNDARPKEGDDRPFFWLFENVVAMGVSDKRDISRFLESNPVMIDAKEVSAAHRARYFWGNLPGMNRPLASTVNDKLELKSVWSMQDTNLANEDI

SEQ ID NO: 951157 - protein, 78 aa, Homo sapiens
MAFELQQMGTKLTKTMGSGVFQNGEALITREGTGFRLEADSVLKPCSVLHEYIVSATKRKKKFRGKLPKLELVVTQLL

SEQ ID NO: 951158 - protein, 167 aa, Homo sapiens
SGCYLSLMYSLQASWLVKDLGIQVDRYIGLEVCEDSITVVMVRHQEKIMYVGNIRSVTQKHIQEWAHSIRLIGGKPCNELYIVNPARKGLYEGTGRLFYEFYRLLHDARPKEGNDRPFFWLLENVVAMGVSDKRDISRFLESNPVMIDAKEVSAAQQGPDTSEVTFP

SEQ ID NO: 951159 - protein, 73 aa, Homo sapiens
WLPVLLPTVLKLDVQVSHWQTRSIHSPGQLYKRCIGAWAYLPSPGVQFWATLPPGWSSPTLQLPTLAVAIQRT

SEQ ID NO: 951160 - protein, 183 aa, Homo sapiens
KVTLYRYDLQMNHLFQTQKRKPIRVLSLFDGISTGLLVLKDLGLQVDRYIASEVCEDSITVGMVRHQGKIMYVGDVRSVTQNHIQEWGPFDLVIGGSPCNDLSIVNPARKGLYEGTWRLFKEFYRLLAYARPKEGDYRPFFWLFKNVVAMDVSEKRDITRFLESNPMMIDAKEVSAAHRARYL

SEQ ID NO: 951161 - protein, 228 aa, Homo sapiens
QRLFERDMTSKVSTCPTEKSEAIRVLALFDGIATGLLELKDLGYSVDRYIASKVCDDSITVGMVRHQGKIMYLEHFRSAQRSIILKWGPFDLVIEGQSLKDLSIVKPTRKALYKGPCRLFQEFYRLLHDARPKEGDDRPLFCLIENVVTMGLSDHEVHLRDSESKPVMIDAKEVSSFNRARYLWGNLPYEKALIHCNLREAQMLRLKDTIPKVDILQVIHEGTVIDLT

SEQ ID NO: 951162 - protein, 38 aa, Homo sapiens
MPHFAEPWLSCHAPDTPCSFQLIIHSGCQRPVPYRGRL

SEQ ID NO: 951163 - protein, 224 aa, Homo sapiens
PPKVTNCPAEKRKPIRVLSLFEGIATGALGAEILGDSGGPLNCLGKVCEDSITVGMVRHQGEIMYVGDVRSVTQKHIQEWGPFDLVIGGSPCNDLSIVNPDSKGLYEGIGRLFKEFYRLLHDARPKEGDDRPFFWLFENVVAMGVSDKRDISRFLEFNPVMIDDKERSAAHRARYFWGNLPGMNRPMAYNGNDKLELQECWNKGGKQIHKGDIIRGIPCKEQVI

SEQ ID NO: 951164 - protein, 216 aa, Homo sapiens
LQINQCPNKKRTPYWCCLLFEGISTGLLMLTDLGIQMDRNIATEVYGDSITGGMVRHHGNIMYVRDIRNVTQNHIQDWGPFDLVIGGSPCNDLSIVNPARKGLYEGTGRLFSEFYRLLHDARPKEGDDRPFFWLFENVVAMGVSDKRDISRFLESNPVMIDAKKVSAAHRAATSGVTSRYEQAVDTTVNIAGAAEFVSMQDASSQVRHYRVNSLKV

SEQ ID NO: 951165 - protein, 170 aa, Homo sapiens
MLRHQGKIMYVGEVRSVTQKHIQEWGPFDLVIGGKPCNDLSIVKPALQGLYRELAVVFKEFYRLLHDARPKEGDDRPFILVFENVLAMGVSGQRDISRFLESNPVMIDAKEVSAAQRARYYWGNLPGITGVGFPVNDKLELRMSGAGGYQVTSRPYTVIPRRDESSTSIS

SEQ ID NO: 951166 - protein, 138 aa, Homo sapiens
MNPSGWVMVRHQGKIMYVGDVRSVTQNHILELGPFDLLIEGHPLYDLSIVNPARKGLYEGTGRLFQEFYRLLHDARPKEGDDRPFFWLFENVVAMGVSDKRDISRFLESNRVMIDAQDVSAAHRARYFWGNLPGLDRP

SEQ ID NO: 951167 - protein, 34 aa, Homo sapiens
LVLSLFDGIATVLLVLKGLGIQVDRYIASEVCED

SEQ ID NO: 951168 - protein, 170 aa, Homo sapiens
KRKPSRVLSLFDGIATGLLVPQDLGIQVDRYIASEVCEDSITVGIVRHQGEDHLRRGLPQRPLRHIQEWCPFDLVIGGSPCDDLSFFNPARKGLYVGTGRLFSEFYRLLHDTLPKEGDNRPFFWLLENVVTMGISDKRDISRFLESNPMMIDAKKCRCKRDRNFWGTFPV

SEQ ID NO: 951169 - protein, 198 aa, Homo sapiens
KLIAMELTSKGEPTVPAEKMTPIRVLSLYDGIATGLLCAEGLGALQVDRYFASEVCEDSITVGIVQHQWKIMYVGDLRSLTQKPIQEWGPFDLEIEGNPCHDLSIVYPALQGPLLGPWPSFLRFLPVSCIMRGPRPEIISPSSGSLTNVVSIADTDNRDISRYLESNPMMNDAKEIFNRHMARYFCGNLPCINRAFAS

SEQ ID NO: 951170 - protein, 67 aa, Homo sapiens
MEYDLIVLGLTLLELGYTAMLQTLLQLQLIINSWIPTGLYIPGKVEPTEVAGPLVCKIDTISWHTII

SEQ ID NO: 951171 - protein, 120 aa, Homo sapiens
MLLLHAKPSLLDTHHVHYPLTGVPQVLSADLRLYLKTSHNTSLLGSLRKVSRNMAAGTRYMSLLEPSDCKVLEPSKFHSGNSSTHLGSLFRPPLGSEAPMSHWCRLLSFSMASSMYFRPP

SEQ ID NO: 951172 - protein, 68 aa, Homo sapiens
PETESMSGVCSCAWIRVCVCVWYMCAQSASFSDSTISVKFLYDLDHLRIGFCFRVSLGPDPGPCPPLH

SEQ ID NO: 951173 - protein, 52 aa, Homo sapiens
MQNCMAEKRENRVDRDSAESMCLFYTNQGFASLYPTSANIRCFGEELRDSPG

SEQ ID NO: 951174 - protein, 80 aa, Homo sapiens
SVTKEGLELPEEGGGEEEDGREQGKVRNLCKLMKEPEIRRFTTSNLQYTVSSLADCDQHYGGQHTERSEAGTRTLTGLCG

SEQ ID NO: 951175 - protein, 39 aa, Homo sapiens
MTGRIVATKPSYVALAQRKEERQGHLTNQYMQRMARERA

SEQ ID NO: 951176 - protein, 85 aa, Homo sapiens
TDRRRVVTDGHTCSPFPDHPLLQERDKIAAPISDSQKPRQQRVTLTLPVLNGARPVIFVATGHRKQLFVKRISEDQEENALTTSS

SEQ ID NO: 951177 - protein, 33 aa, Homo sapiens
MPEDSVEDQESQHTRRDSSPVLHNIILLFRGDS

SEQ ID NO: 951178 - protein, 71 aa, Homo sapiens
RKRRAVSECRSSGLPALGSGQDAVVWAEAPGVLQRSLSSARPLWHFSWERVRPQVGEAHSVYLVRAVQNVL

SEQ ID NO: 951179 - protein, 57 aa, Homo sapiens
MLSQSCGCREKACSFGHTAAPVSSSSVKVHCMKLDERGGHQSDGELRSSFTLQLSYN

SEQ ID NO: 951180 - protein, 129 aa, Homo sapiens
MMSDTLVAVQDRGLGLSSQFGYEVYVLAARFYEFCGITAMKNPERSAVCYGLITGLVYQTLYTCPFSRIFRFVRSAWCSSLRYPTDTYPGFVAYSYRSFLFCSKVASSGDGETYKINPFVGTILFFRGD

SEQ ID NO: 951181 - protein, 32 aa, Homo sapiens
MTSVDFCHCFRVFFWGGEIYKTEPFATIILLF

SEQ ID NO: 951182 - protein, 98 aa, Homo sapiens
MTQTNSARLISLTSIRREWYVYELFPSLLSTPTIQDLLRGYFMAGIPHTQNRAAYYSPSYIAQLRASPRWTGQDARAHPFHNMPGAIRPVAPRAPSSF

SEQ ID NO: 951183 - protein, 76 aa, Homo sapiens
LERDVATNERYWTQWTRSELKQRFSVFGETEECIIHFRVQGDQYGFSHYIRYAARRHLAAIDEWAQCCGRKIEQPR

SEQ ID NO: 951184 - protein, 46 aa, Homo sapiens
MGHGLRSRRGLYLSQVWALAVWASDRARDREGEAAVVSAQSKGFRV

SEQ ID NO: 951185 - protein, 90 aa, Homo sapiens
MTSDQNSSSMRNVHFVPLSRNHEGCSSALPQLVASLIMAANASSAVATSDEAVDVPLDTEVDGCTPQISPKMENLCVSSDRVMRPGYLSN

SEQ ID NO: 951186 - protein, 79 aa, Homo sapiens
ADFRLITFCRYNKDTFLVTDSVDADVIRMSGTASSPRLVASPSSVSCNEPWTCWPSSRLVSYQHAFLYIRQSRHTPAQR

SEQ ID NO: 951187 - protein, 49 aa, Homo sapiens
NYTSQSSTAIEKLTTHRVEPGKNVREIGNNTCWELTGGAETSLVIVRVH

SEQ ID NO: 951188 - protein, 49 aa, Homo sapiens
MQSHRIPNGQDVMNRAAHLAHVKIKSNSHLTSRERKANFAEKPLICGLY

SEQ ID NO: 951189 - protein, 87 aa, Homo sapiens
MLFMTLLRAVYTFPGRQKIHISNTCAFYRVQCSLYYEDVLAESRCIPDSCGLTYIPRRGSWTIVAPCTHEGFQCAAPLLILTNKFYF

SEQ ID NO: 951190 - protein, 61 aa, Homo sapiens
MVVHVIMFIRTMLQQQGCMLFMTHVQGCVRCFLAARRSTSQRSVASLEVSVLINMKTSCSE

SEQ ID NO: 951191 - protein, 133 aa, Homo sapiens
PSCSSRSGSRFIGEYMMWGRSVEVLYACSHCYVVLSSGDALAHVHLTPIVIWNDLLFSHHVFKFISIELGEAPLLLDVDLLAARKLELGPAQGLNHMLLVLQLGADGHDNLANVNPGHSALGLSKGTSHACLE

SEQ ID NO: 951192 - protein, 74 aa, Homo sapiens
MSSNSSALNLVKPHFFEMWIFWRPGNLNLALLQGLNHMLLVLQLGADGHDNLANVNPGHSALGLSKGTSHACLE

SEQ ID NO: 951193 - protein, 116 aa, Homo sapiens
RADSAPNTRIRMVDLWNRPQGTVARIHIGHIIIVHPHQCCSNMRIMLFMTHVHGCVHVSWSPEDPHLKPSVAFTKSNDSSTMKTILPESTLSSLMAVGSTTSPVVIIRTVRGALHS

SEQ ID NO: 951194 - protein, 64 aa, Homo sapiens
HVPTQIQENFEAFMKAMVCRDELIQIEVKDIKGVSEIVQNGMHFKYTTHRWVQSDPKRTHCGGG

SEQ ID NO: 951195 - protein, 31 aa, Homo sapiens
MRYFIIPCQSGEGSRRSDHSPHLGVVAAVPR

SEQ ID NO: 951196 - protein, 77 aa, Homo sapiens
MPGGIKGATQGNLLSVICTAELPKPSISSNNSKPVEDKDAVCFTCEPETQDASYLWWVNNQSLPVSPRLQLSNGNRT

SEQ ID NO: 951197 - protein, 34 aa, Homo sapiens
ILCTVVSRCLWKRCTEQGFVVVEKEELNMIDNFF

SEQ ID NO: 951198 - protein, 62 aa, Homo sapiens
PGTDLAKILSDMRSQYDELGYQNRNDSEAWFTSRTDELNRESAGHTEQLQNKVVRGELTCEF

SEQ ID NO: 951199 - protein, 75 aa, Homo sapiens
PEHTGVVYCAACSTPISPCSTVGQWKIWIMRQTRITCLHNSSHVFRLWTEPQICTSNICFSGPCFSCSTIANNSL

SEQ ID NO: 951200 - protein, 144 aa, Homo sapiens
HSNRDLNIFCVNKRCGISRFDEDLLAVPHGLPDAIRIGFRRWGNLEDVSGPESLKSRDAEEESETTKRLAVDCRAPPAALVVALVGFGANPELEVLWEELLEVPVVVSLEEICVGRSSASSSSPSPSLATIALPMSPPSVRGAS

SEQ ID NO: 951201 - protein, 47 aa, Homo sapiens
MAGPRTCGAPAAHERRRKALIEFHQLLPERSYEFLLASNTHHTNGRH

SEQ ID NO: 951202 - protein, 41 aa, Homo sapiens
KGEHQWVQLYKVQDQDGKSGMNSSLAANESVIHEPGRGSGT

SEQ ID NO: 951203 - protein, 105 aa, Homo sapiens
DPNGDEGGCLVVSVSVACAETRSVPISMTGITYIGLGQHLGVEADELKGFVLVTSVLSTLDMLGKEYRYVGAPLPGLLAVGTEERPCRISASTRFISTRNCLKVK

SEQ ID NO: 951204 - protein, 47 aa, Homo sapiens
MTETFIPMAKSTSAALGALVLGQLWLHAVIIPSHLWAALRAWACAFA

SEQ ID NO: 951205 - protein, 36 aa, Homo sapiens
LAKEYRYMGAHAGAACREHRRGHAESVPALGSLAPG

SEQ ID NO: 951206 - protein, 74 aa, Homo sapiens
LPISIQGSLRGLGQQLGGEADELKGFGIGTSCYSTLDMLAKEYRYMGAPFRGLLAENTGEARHNQCQQLGSLAP

SEQ ID NO: 951207 - protein, 65 aa, Homo sapiens
MDNYITIVDVMARRYVLKGEYGTNPEDIYPEELTDDDVSSGSSSEEEQHFQAVTVFYSRFLLPDL

SEQ ID NO: 951208 - protein, 36 aa, Homo sapiens
MLLTHPESSPPFPPELFLLHIIAVPELQGQLGQPGQ

SEQ ID NO: 951209 - protein, 173 aa, Homo sapiens
EGGVVCDHYDDIDGIPDDKDNCRLVPFPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSTSRFYVVMWKQVTQSYWDTNPTRAQGYSGL

SEQ ID NO: 951210 - protein, 90 aa, Homo sapiens
ETTTGGKQTRTEQCMLDFDYVCSRDNLCVAVMIYPFTVNHKHKFYWGHTVTLMPVFKNMADAMRNHPEVDVLINFASLRSAYDSTMETMN

SEQ ID NO: 951211 - protein, 56 aa, Homo sapiens
QQIFNQFPRIEDGWASLAHPQRMFSSMKRLCLLEHELGSPPFASNLEIHLVQYPVG

SEQ ID NO: 951212 - protein, 108 aa, Homo sapiens
GLEDSPATFAVGAASLKKVYISTRRSNILVSSSSTTDIKLYDQGVLMLLTWKNLKPHIQGIIQDVIFPLMCYTDADEELWQEDPYEYLRMKLDVFEDFISPTTAAQTL

SEQ ID NO: 951213 - protein, 114 aa, Homo sapiens
GGVGGALRAPCGVVGEGQRSCASCSYCWWYEAERGPSKDGSLRSGAVLGREARLLSCIILRTPADVWLLEALWAEAQRTGEFAGVAYQLRFSEPSLAPLTGQKLQHSSLKETLP

SEQ ID NO: 951214 - protein, 59 aa, Homo sapiens
MVLAVSIEETSDITPGPRQELYSLLILRGVVGASWLCKVVSAYLIFFSLTPILDTSREK

SEQ ID NO: 951215 - protein, 87 aa, Homo sapiens
RGVGCALPAALGVVGEEAEELCYMPVLLVVLGRERSGKEGLCIRGSSGSEARLLSVIILRTPADGMILEALAEAARELGICRVGLTS

SEQ ID NO: 951216 - protein, 74 aa, Homo sapiens
VIKAISISQYFRLCSISNIAYTSTCGSCSSSSKSNLFIHCESFQVDLLYVKLFINRQRLPITPSVELIYKPLNS

SEQ ID NO: 951217 - protein, 192 aa, Homo sapiens
GSGPSLYKSVTVTDLVDWVHALHVDHGQHTGKVVLSWLHAEQQAEKEVKRDPINPPNVDGATEMGVIQAMTPRSFSPKVTATALDANRGPVGDIAVTYSDIGKEIHKCDQWDGDEDGSGKVLVGSQQAPQSRNSGKFQPPYGKGALKEIQCDEADVRFAGNSQMHTLAPAEKYSPLHICTIPMMIIRAKGRS

SEQ ID NO: 951218 - protein, 42 aa, Homo sapiens
IEDYHTLVSIVDVKANKTHITQAVTNLYDIDVTQSVNTLNIG

SEQ ID NO: 951219 - protein, 92 aa, Homo sapiens
HVIYVKHTFYKSLKNLKLPLLAINMKDRPSSSRYYRPPLVLYDLSNPISESSHSCIWHVLHQVVLCLCLTQKVDIFFGRFFGGVSKRQQPPF

SEQ ID NO: 951220 - protein, 82 aa, Homo sapiens
MTKLHDEDIRGAALLRLQAQLVPCRVCMLPSLILRLPCVTYVCDDESVAVKNLQEAKDCYKSKFAEFSEVAKRNNDALGQDH

SEQ ID NO: 951221 - protein, 89 aa, Homo sapiens
MWILLIAANYNDINDVKRLTPDYLEATVDDIQGIRFLMDNQKLRLRLMQTLQIRHFALDIIKSTHDHWHASVTKKTNGPGLRSMKTTLS

SEQ ID NO: 951222 - protein, 79 aa, Homo sapiens
LVLSVDWYMPGPLVTFVLLWPGFVFGRGLNPERDPDISNGFRLISVTQFLRLCILLRDNNIAAMHLFPGSNLGIVAFSK

SEQ ID NO: 951223 - protein, 33 aa, Homo sapiens
RSARGSLSSAAEIVHEDFKMGSDGESGQASATS

SEQ ID NO: 951224 - protein, 34 aa, Homo sapiens
IGAIASASKIPPFIGPKFEDDGFTSQNHCIFRQH

SEQ ID NO: 951225 - protein, 52 aa, Homo sapiens
MGWNSVCSDKDLCSMAGEHLNDFPEMPSSDVTQTLEKCLCARMAGRGKLLVE

SEQ ID NO: 951226 - protein, 96 aa, Homo sapiens
KIEHPPHQVKQLHVRQGVLMHVTLQRFAALLHNTGPQLCPQTKLGPLSKNISASWYGGIMCDGMGPRIFSIITRCSRYFVGLEEWGAPVVLKEDAA

SEQ ID NO: 951227 - protein, 187 aa, Homo sapiens
MIMCSHTEYLSLSPHRLVIICNPPSRQNQWKEERPPDNRTRVRVRKSSRRGAEDYQKCGIHPYCKTGLSNLGQNGGRGAIDIRLRIALLALPQSCNLKSSVVHTSYLPRAHKNSMTEYLPGTQDTSRVFGHTPGRRERIKSQESPECVAGPFHPQLDDNLRHSRSVPLPFNLKDEISDTLSVAHPFT

SEQ ID NO: 951228 - protein, 85 aa, Homo sapiens
VDRQIIINSLSVQMSSYDSSSSSWLFTNGSTGITEGQRAAGTELNTAEGKILKLQKPPGERNQYSFVYVVMVRADSVAEMKIQDS

SEQ ID NO: 951229 - protein, 46 aa, Homo sapiens
DQFTADMLGSAEVAEEVNLNGSGKLLQITGCASPGKTGTIVVRGSN

SEQ ID NO: 951230 - protein, 156 aa, Homo sapiens
HWQSFLRLVKIMMCCTGIPGHYPVHETTSSRNPHLIWYTRQDDILSFEAEKQAVYHQVDRPVYFQLLNVLLHKAPFPSDEDYGYWSSDENEQFRIEGWNISDTLMYVYEMSGAELLSNLYGKLGRLLTSSEEPYSWQHTEALLYGFNAIAETIDVT

SEQ ID NO: 951231 - protein, 78 aa, Homo sapiens
SLEQKPTDCSIDMSHWIWRTCLLVLGVDQLYLGPVPMLEHQMRSSTSCQAHTAAVFLAPFSPHPLPYLPPCTSYYDTL

SEQ ID NO: 951232 - protein, 39 aa, Homo sapiens
ARYRHFAVYVLGYVTPGNSHRYNVTMIFGSIFTRSHPSG

SEQ ID NO: 951233 - protein, 49 aa, Homo sapiens
MCHIFLIFHLGLNHSSVSSPESSLLSLAFPYPDLAFLLHPLQVGFSLYK

SEQ ID NO: 951234 - protein, 175 aa, Homo sapiens
QELARSSQEHLQRKQIWGRGNDTPGEMNGFLKGQAIRLLLIHLPRGVDYRGNIQTFRVAAEVREELCRQMGITEPQEVQEFALILIKEKRQLVRALEPGEYLNSVLVGQDESLHSRRLHWETPLHFDNSTYISTHYSQVLWDYLQGKLPVSAKADAQFARVGGLQHLSKAKRNTP

SEQ ID NO: 951235 - protein, 223 aa, Homo sapiens
LVDSSMIPLTGGCAANGSTNGSHPASLGERRESISQGTGGSAASCTGATSNRLRRENAALRRRLEALLAENSELKLGSGNRKVVCIMVFLLFIAYNFGPVSISEPPSAPISPRMNKGEPQPRRHLLGFSEQEPVQGVEPLQGSSQGPKEPQPSPTDQPSFSNLTAFPGGAKELLLRDLDQLFLSSDVTDFNRTESLRLADELSGWVQRHQRGRRKIPQRGQER

SEQ ID NO: 951236 - protein, 75 aa, Homo sapiens
QGSWCTQDGFMGVEVYRYQTQTALDLGTLRMGNSSCQPVFEAQSQGLVRFHIPLNGCGTRYKVSTGRWHEVKSHL

SEQ ID NO: 951237 - protein, 112 aa, Homo sapiens
LSSYRRLRTIGSSRLTCSRLLTSLKGKTWQQLQTTLMALGSLAVTKNDGHYRGDPNWFMKKAQEHKRLFTESQLQEGTHFIGLQMGSNRWASQAGMTGYGRTRQIISYTGEG

SEQ ID NO: 951238 - protein, 47 aa, Homo sapiens
GYFSRARTITRPARQIWRVPPSELQIPPLKHPPGLGTPCFGRDLRAF

SEQ ID NO: 951239 - protein, 107 aa, Homo sapiens
TAPGLIIFYIFFESTLIPTMTVINQEGEPPDRLNAGSYFLFYILVGSLPLIIALIYTHNTLGSLNILLLTLSAQDTIKLLRPTNRSMTSIRNSFDSKDTSLRTPLIT

SEQ ID NO: 951240 - protein, 154 aa, Homo sapiens
EGTMARHCCLYFIPARPLPQALDIEFMERLSQGGQHRPFIAKEDTLTLEERVHFKQRITVDLLSNVIDVYPAEEFDEDSEDRLLNEKFREMIPFAVVGSDPKYQVNGQRDPLGGRPKWGTIEKFENTTHCEFAYLRDLLIRTHIRNIKDAPSCG

SEQ ID NO: 951241 - protein, 102 aa, Homo sapiens
MGDPEAHLFRLPSGLEVRKSRALQFENRFFYEPSRTRYLKSKLFQKLRISDHFKKPQKIHPSALSTPEIRVAPRAGPTLRRRAADAVVLPSALVYRGRANVG

SEQ ID NO: 951242 - protein, 71 aa, Homo sapiens
FKSWGTSCGPDNELQTDGNVQCGDTRALWSQDLAGHEMEFLKRVKQDCMDQFVPYRPSQDKQYPKHAWMEP

SEQ ID NO: 951243 - protein, 115 aa, Homo sapiens
KSFRVREEDGEGCRMTLFQLQKSQESQNRGGDKRTTQRSTKEVTEEEKTKEGAARSQRGQGGGQVGLNGPLQLWLPDEIPQVSSPNPQILYLLFRCVFISEFIRYKYPQGTETKA

SEQ ID NO: 951244 - protein, 103 aa, Homo sapiens
MATLQAVLSDHVQSGSVPPTRGTSFSEEAWPRWNKYPDVEKCLKIPQTEFSKRGETSRGREAARLRTREQALWTDSCMKKSSWFQETAPQAGLLENDPFPKPK

SEQ ID NO: 951245 - protein, 116 aa, Homo sapiens
MSTTTFPSWGVLSRLSGKTLGLVGDSEETVTVVPWAQISKASSCLSGLDILRAQKYRAVSSVVRLFICRYSNFFESSLEMGDLGFTDAGILSGNYYLCFYYGQPTPVPGVRGRIRI

SEQ ID NO: 951246 - protein, 68 aa, Homo sapiens
LKTEGHQNEDKLEKLEELTMDGAKVKGYTRMPHGPPWAWTYLAIDLINIRELTPVRSGDYIYKYPGYR

SEQ ID NO: 951247 - protein, 115 aa, Homo sapiens
NIMGAIYEKSGAKWTKVHELKGAQGQVTGIDQGPRRVTCIVTCGTDRNAYVWTLKGRTWKPTLVILRINRAARCVRWAPNENKFAVGSGSRVISICYFEQENDWWVCKHIKKPIH

SEQ ID NO: 951248 - protein, 68 aa, Homo sapiens
MVFRNAKYERRERRANSLPSIPKPFPELCSPPSQSPISRGAPPVKGGCSPENAAAPMVLKVYSEDGPA

SEQ ID NO: 951249 - protein, 60 aa, Homo sapiens
RVGKGSPQYAVLTTQPRVLTLTSLCSERNDSWLILGDQTHISILALKYALLTFLLRTPSK

SEQ ID NO: 951250 - protein, 94 aa, Homo sapiens
QERLQRSVPTVQWENRFVSVYSKDNPNLLYQQCVASQCRILPQVPHQLMRRSPTRHGVWNLPHEVTKERTDQCFLRVDDESMQRFHNRAASDSH

SEQ ID NO: 951251 - protein, 34 aa, Homo sapiens
PGDSRACWLLSVAAMKKVFNSSGWSRTNRVKVPR

SEQ ID NO: 951252 - protein, 117 aa, Homo sapiens
CVCEEKQVKEERSAGQTVQVYSSHRVSSDSAVWTEMQDSSHSRCDFKSSASLSARHLNVSAVLLAECEEVERQPTPVSTVTPVPTLTCVPSPIIFPVPEKWAGCLHLCLNYMARDIA

SEQ ID NO: 951253 - protein, 85 aa, Homo sapiens
RGSSIIMSIECSVAQSWSTKSNFTWLLLQDQPLDGDEAIGLGVSNHQPPALFTSLREERRHDRACDFLLSLQLHQHHRWPAHLRM

SEQ ID NO: 951254 - protein, 45 aa, Homo sapiens
MVDMGVGWSGGLSLFSRWSTREAIFILMVLFGPELLSWKRWPTAH

SEQ ID NO: 951255 - protein, 94 aa, Homo sapiens
MEDGEEDEEMIESIENLEDLKGHSVREWVSMGGPRLKIHHRFKNFLRTHVDSHGHKRLQGAHQRTCAKSNRESPGGELMRNLAARGARGWLTAH

SEQ ID NO: 951256 - protein, 44 aa, Homo sapiens
NGIDVKCRYTADEKEGAEYLRNPTNYPVFIRFGRPRLNLNEKAY

SEQ ID NO: 951257 - protein, 189 aa, Homo sapiens
ELGSTEPCRFGNGEALLSAALHLDELVDRGWPTLHALLQIDSGPRFAIMCPHVIIKKPRLLKSSTAHVTPVSDRIFVCSHVDLNIKSDSKCLPTYLTAKFICLAILFLGRFCSHLTFIKRTEILCFNPKNCWFTEEVGRCRIRTCGFRSSECVQVWHAEHAIQGHIPLEWDDILFLCRSEWNNSGPFHG

SEQ ID NO: 951258 - protein, 108 aa, Homo sapiens
VISQKPETKKTRVTLPYGTKRVLSSANRAVVGVVEAGGRIDDPFVKGGRAIHKYKAKRNGWPQDTGCGHKVLVTHPLGGGKHQHIGEPSIIRREFRCRPQSGCQCCPP

SEQ ID NO: 951259 - protein, 87 aa, Homo sapiens
MRAKNPVPQLRKFTTNVSPFFDKMIQSSHSQKSGSPISSEERRRRDQQHLDDFTAARASTNFTIAQADALHKKNPGHFTDTGQTRIM

SEQ ID NO: 951260 - protein, 116 aa, Homo sapiens
CCLHVLRDLCCPLCLVDHDRWSPLLDQTMIVVPGVACVMPVALDVVLRTIGSLRREADDDRPSWRNTDDDRSPRRPCRLRRGKLAVMRKMTRPPKRELDKARRKLANSYMSTEDQD

SEQ ID NO: 951261 - protein, 48 aa, Homo sapiens
WVARENSSEDVRPWRAYDNDCADEAGRGLDENGCDYEGYGGDGGKRRA

SEQ ID NO: 951262 - protein, 64 aa, Homo sapiens
RSRTVTVYRAHCVHDIFSGSSIRCDPYAKKKLQEFGDDSPYPYDHRLSLRTLRAPLTLQLWCIP

SEQ ID NO: 951263 - protein, 108 aa, Homo sapiens
SKDKLLVSPSTGLFDNHDGDDDDDFFSATHSKPSKTGKVQSTADIFGDEEGDLFNEKASSIASQPLCVRQMKIKQEQNNRLLHLPAKISKPSSETTTQKGLFSDEAAL

SEQ ID NO: 951264 - protein, 89 aa, Homo sapiens
HPCLGELVSSTWFVVLVAFYLQSKGYFRCKNCKNPKAKESLVDSGRDADVSFLTTTFPRRHTTHVCDDGRWYVTVCNVFFLDWHASRLG

SEQ ID NO: 951265 - protein, 124 aa, Homo sapiens
MALWKSRIRPENTKKRTFVAADGKSYQVPMLAQLSVFRCGSTSAPNDLWYNFIELPYHGDSLSMLMALPSESSNPLSAIIPHISTKTIDSWLSIMVPKRVQVILPKFTAVAQTDLMEASRMGTE

SEQ ID NO: 951266 - protein, 46 aa, Homo sapiens
CREDAPWLKPLEGRRCKPGAAAAGEGSAAAGSAAPEYAMVAVDPEG

SEQ ID NO: 951267 - protein, 42 aa, Homo sapiens
PLKPNDISYFAYPILRIVPNKLVVFLALLLSILILSIIAGPR

SEQ ID NO: 951268 - protein, 42 aa, Homo sapiens
GASHVTLYLWELYIFPNIVFLCLGCFLVDFECRIRPCDVAIS

SEQ ID NO: 951269 - protein, 74 aa, Homo sapiens
DATMGMVGWEDGSHLSVRGLGQTLMLHMAGVSLILSRSDHHRRPLLEGSIPCRPGLHKLRVLGLVLPIPLPGQL

SEQ ID NO: 951270 - protein, 60 aa, Homo sapiens
QQLNHSQDVHEITYSISSAEPCTTDKRGSSCFMLTDIGWPSLYGSDDKNQEQNRASGELS

SEQ ID NO: 951271 - protein, 50 aa, Homo sapiens
TRTQEVEVGGGDRGDVAGGLPQSLLPIRAAPQVQDGDLTRYQSNTILRTY

SEQ ID NO: 951272 - protein, 42 aa, Homo sapiens
MRVPTVLRARYFSEQQKCLGDFPTLNFGHIISKHLHLGLAIC

SEQ ID NO: 951273 - protein, 42 aa, Homo sapiens
NRGRYDNPTPIFWDFLEIDPTLHSNNISIPQELYERCWSHSN

SEQ ID NO: 951274 - protein, 113 aa, Homo sapiens
SFLDGHDWTAAHPSASGSVAVHGRMRVDQTLDLLNAVDHEHILQILHSALHPIVERSSPLGKLQVKLINGFSNFSILSKGFSPLLSKRSQSVPLVHKFSGTIIDIHRGVTELE

SEQ ID NO: 951275 - protein, 75 aa, Homo sapiens
KWCTQHLRAMIILPEMVGSMVGVYNGKNFKQVEIKPEMIGHYLGEFSIIYKPVKLGLAICKGTALAIVNQVVAVS

SEQ ID NO: 951276 - protein, 40 aa, Homo sapiens
MSASELLELLLGAGQPLVTLSTLKRTVLLRGPALAQCDDA

SEQ ID NO: 951277 - protein, 36 aa, Homo sapiens
LSRQIHPYNNGMPQALHALGVALFLRHRDVLGLGYH

SEQ ID NO: 951278 - protein, 43 aa, Homo sapiens
EIFYTPETERDYLGAAIRKVIQSHMCEEEEGDLLLFLTGQEEI

SEQ ID NO: 951279 - protein, 109 aa, Homo sapiens
MANNLQKGSAGPMRLYVGSLHFNITEDMLRGIFEPFGRIESIQLMMYSETGRAKLYGFITFSDSECAKKALEQLNGFELAGRPMKVGHVTERTDATRASSFLVGMMKDA

SEQ ID NO: 951280 - protein, 137 aa, Homo sapiens
TVLYTYPTVFAPYPKFFFRVWVNILKSPQFGFDIDTTDHIDACLSVIAQPFIDACSISDLQLVKYSPTNKLLYAKKIPEHRKIVPRCYKQIQDMTPLSEHDMNAHLAEQSRKYQNEFTTNLAMAESYKHAKRNPPQI

SEQ ID NO: 951281 - protein, 146 aa, Homo sapiens
QGFVPAAYVKKLDPVLAASRENLLEEQGFIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVGMMKD

SEQ ID NO: 951282 - protein, 56 aa, Homo sapiens
DLIDDSKLKDIEMGLEHELMVADRRQKAREFGSWNRNCISGRCQWTGITWHELSGL

SEQ ID NO: 951283 - protein, 47 aa, Homo sapiens
VIYREKEEKYAEGVFDKCSNGRKVILYGIGTVIPKGVCIDTQYSEQR

SEQ ID NO: 951284 - protein, 78 aa, Homo sapiens
CIGSLTAISQGLKAFVQLSSPFILQNKGTLLSSVPSQYWHAPGIVLPGLDTLASSIDNPAQSLLVQVNPFSDMAHGLH

SEQ ID NO: 951285 - protein, 55 aa, Homo sapiens
LPVVLGCGWPAGRDGVCLEPPPLTNYDAHVFTGITSIRETKELPTNSFLGCLKNF

SEQ ID NO: 951286 - protein, 72 aa, Homo sapiens
SWTTVEWSGDEPDMGRSPSSAGLGSEVQVHGRAGLQLERPGLELASSVFVAVLVFCFFIIKSKNIFLTTKGI

SEQ ID NO: 951287 - protein, 96 aa, Homo sapiens
TKYTTTDLVIDLQSKRGLDNLLQADIWQQVADVLQLVATLMVAGQHACGDFFQVAPDIQKLEYSPFKPWTWKVIRWDRVPTDVSLISRNKMSTPTG

SEQ ID NO: 951288 - protein, 38 aa, Homo sapiens
MGFRELTVQTAIHCWLATQLNCFVREMPSVLYKQNRLK

SEQ ID NO: 951289 - protein, 117 aa, Homo sapiens
MQWWNSRKDATFGCNVIATRAGEQMAPFLPQLVPRLYVNQFDPNLGIRQAMTKYLGMRWSLTNPWWIHILNEILQDLVQNLTSNMWRVRESSCIALNDLLRGRPLDDIIDKLPGYRA

SEQ ID NO: 951290 - protein, 35 aa, Homo sapiens
MGQVDSGAEARVRLFKMVMLHTKFRKVSLKGPVEV

SEQ ID NO: 951291 - protein, 123 aa, Homo sapiens
MGQRYQHIAKPSVKPNVGVIGVSLEHNITSIRMGTYTPDRYSFWRLMSVARIRTPICVSISSQLSKADVRISTDSLNKPTVDLAVVISQYWVFLYKVATKGKVLNKERLINTWMIQIMSGSCN

SEQ ID NO: 951292 - protein, 133 aa, Homo sapiens
MRSYYRKMLTGNCTKVCIVATVDSTVRALWVRPLQVSICTSHAKPIEAVIQPVLVPSPQSIHTDRVQIHSFSKVSFELTSHIAFIQFSSSPPVFSICHYVSFMPNTLFTHSLPFNTHLSIQPSHFQHPWVIQQ

SEQ ID NO: 951293 - protein, 73 aa, Homo sapiens
GCKMTPTMLALLLSNGSNRRLRVWSMWVQGSVRVRILLSKGARGNGKEKEGLVSLLYGNLGHAYITWPLNTFS

SEQ ID NO: 951294 - protein, 104 aa, Homo sapiens
MLPRSKGTSINAQQPMQLKTLRLATPPTGNQQCIQPFSTYTLKVSTHMLILTPRVWSHFCAQPTVVPTTIHTPQSTSTASAVKAVFSAPPHSRNQQLNKLHLQV

SEQ ID NO: 951295 - protein, 162 aa, Homo sapiens
ILKVSDVDKRTGQENTILITNDTGRWSKADIARMVQEAEKYKADDEKQRDQVSSQEFHLQSSCLPTCTATARSMRHFQGQDEPMQDNTDRFCDKVYMNIINFGLIKNQTAEREEFEHQQNELETVRKPIITTLYQSAGGMPGGNAGGYPGGGATPSGGVPQS

SEQ ID NO: 951296 - protein, 166 aa, Homo sapiens
PCRFQTGYCNGFPAGVLGHQQAVAITTPEYFYIPLRLGLTDINEAYVETLKHCFNVPQSLGVIGGKPNSAHYFIGYVGEELIYLEPHTRQPAVEPTDGLLHPGRELPTASTRPCRMSIGGSLTRPSLWGFTVRLKMTSMIGASKSKSCLCLEVPCHFELVSSAFTS

SEQ ID NO: 951297 - protein, 93 aa, Homo sapiens
AETLSRLIASIVLYHTRISTLSQDRQRTGNISSIPRLPRSNQSRKADASYRTGPLLFTTQQRLDYTHILCVDFTKKWRLNGIRPSQILSFQSI

SEQ ID NO: 951298 - protein, 189 aa, Homo sapiens
MGLTRNESTDDDFLQNLDGVSSALVQRGCPMFMDRRCGIYRKPLLESGTLGTKGNVQVVIPFLTESYSSSQEAPEKSIPICTLKNFPNAIEHTLQWARDEFEGLFKQPAENVNQYLTDPKFVERTLRLAGTQPLEVLEAVQRTLVLQRPQTWADCVTWACHKWHTQYSNNIGQLLTISLLTAQSSERRL

SEQ ID NO: 951299 - protein, 121 aa, Homo sapiens
MMFDNGSIYKPEVLDITEETLHSRVLEGVRNVASVCLQMGYPTVASEPHSIINGYKRVLAQCVETDDTFPLAEKVKAFLADPSAFVAAAPVAAATTAAPAASAAPAKVEAKEESEESDEDM

SEQ ID NO: 951300 - protein, 109 aa, Homo sapiens
MNYCFIPCFSSSFDYLLTPMSIYEPLHFYASSSSHWPLAACTQEMHLLHELHLDEEEKQLDVARDEYGIAICAECPLLAIFYDLNCFLYAIYFLLKRKRSQDAFSLATF

SEQ ID NO: 951301 - protein, 73 aa, Homo sapiens
PLSQLQTLADSDPATPRAVGMPFTPGPYSGVSTLALVARASAFSVGVVYGSIKLSILKATKPKKEEAHAHAHH

SEQ ID NO: 951302 - protein, 86 aa, Homo sapiens
EIHIQLYQSLVKLIHLDILYEVPAQYSNLVQTLLIQLQLLLPPPGLALLQTPQFLLPAFLVSTSEVSSSCPGACWNIGSCIYVALL

SEQ ID NO: 951303 - protein, 81 aa, Homo sapiens
AGLVQLVVSRGVREVCSRPPVSKWTWTSLTILLMPPRPKFGCHLSYDRSNFPVIVSGRWMSFKGYTSSSPKPFRLGVGQLD

SEQ ID NO: 951304 - protein, 193 aa, Homo sapiens
TLGSSELGRAGDMLAGVLAVCVDRCMKPSVQRSPLHLLAAADELGPVGWGFSTELTASRGKQSPHPAEPRKRQGCAQAHTGTVRVTQRCTAGGKPSSEKHLLLESCNSAVGVDLQGTVCRGRGGCGRGSVFKCDLQPDGARWEAGLLKLNTQGHTMLGQDGCHLELPLLVSPAIAGPAPASSLSRQFQAPRKS

SEQ ID NO: 951305 - protein, 95 aa, Homo sapiens
ALNLHSQARLRNENKSGGITLPDFKLYYKAIVSKTARYWYKNRHTDQWNRIENPEINPNTYSQWIFDKANKNIKWGKDTLFNNSTGIIGWPYVGQ

SEQ ID NO: 951306 - protein, 34 aa, Homo sapiens
MELRSMTKPFRRRGTCETEELYGGTFQLYKSADR

SEQ ID NO: 951307 - protein, 81 aa, Homo sapiens
RILTASRCHTEGDRNGVTAVNVTPYEENLNYMSLGHVLPHEHWPPLDKNVYQALTIGISSSDVEIKLKKERFYVLEDSGLH

SEQ ID NO: 951308 - protein, 75 aa, Homo sapiens
HCSASVITFQCPVVLGPSEFTQTCARVHDCYHPVDHSCHSEEKCPPMRFPNYYTWCMARALAVPLLAVEHKEKKS

SEQ ID NO: 951309 - protein, 35 aa, Homo sapiens
MGACHTCNDMNYDVARITPWLQRVTQNRKQMNERE

SEQ ID NO: 951310 - protein, 176 aa, Homo sapiens
MYGQREIMPALLMDMSSAAQALDSLPKGTQVIARNQVRLAEVWMDEYKEIFYRRNTDAAKIVKQKAFGDLSKRFDITTPPSVYKFYMVSRTTFIQRCMCQTLILLYLDTLKSVGQPLCLDVGENNQGGKPLIMYTYHGLGGNQYFEYSAQHEIRHNIQKAFVYMLLKGLVPAKGMY

SEQ ID NO: 951311 - protein, 113 aa, Homo sapiens
CLRRIPFGSMVWHILCFLANRCSSTNSNQALWTHTEKSVTRRMESANPFIRNCSINQHETDYKLKTRDGKKNTGIISHSLRRIVFTDDFILNVDSWPWSWAKSLPQINILSEG

SEQ ID NO: 951312 - protein, 179 aa, Homo sapiens
VESGLLNIMDFVPKKFYVLCGVGLTEIGARLSTTTAVPLTLACGVPYTCCIRNTTEVVNTMFGYTTIDKERFSVQEMSSTYGGCTNAVIIWFMDNYTIMAGILLGILLPQFLEGASLTAAVPLDRVENIIMEHSVTDGSWGPVPSPAEDRRHGMLLSANPIRAQTAMEAPTKTVWDSNS

SEQ ID NO: 951313 - protein, 34 aa, Homo sapiens
LNVSDGQVDLMSSWTRSCRVSTRGEPSARWLEHY

SEQ ID NO: 951314 - protein, 33 aa, Homo sapiens
SVTEALPVYEPWRCFPVLLSLLSHNAKNLDTGH

SEQ ID NO: 951315 - protein, 111 aa, Homo sapiens
MGASKSSWHERAKSTFTLEVGARPAGLPGFEMKSPTCSSGRPPDPAWHVSEFHVIQRKLGSLRKDASVHGDHGTAVVVQAVHVATLLVGQQVNPTVLAGDKSRDHPGVGYE

SEQ ID NO: 951316 - protein, 122 aa, Homo sapiens
TSQAVIALSVCEPGIAIAVHSQDVSIPHCPAEWRSWWIGYSFLMHMVAGDEGGAHSLVSPGSCLEDFLRQPIHRMQWRPGTLAILRPNKYSFGVTTIPRAALPGARPRLTCLKGPVSSRTHI

SEQ ID NO: 951317 - protein, 133 aa, Homo sapiens
GRTEASEVDSEGYRYRHCCGRGVEEQRAAEAAVANMAQSRDSRNPFTKPSKLNNPFQDPAIIQHQPSQYTTLNIYNPFKTQKPPPAYKPPAPTPLPPPSAPSLQPSRKLSPTEPKNYNSYSTLNLSYSNHVSY

SEQ ID NO: 951318 - protein, 68 aa, Homo sapiens
RVENGFEYNQLGPVQAAEHSESEGGVCAVRQERSALGALGLRLDARALQQSTLIGLSPDRIPLKGLAK

SEQ ID NO: 951319 - protein, 34 aa, Homo sapiens
CCQVFNALDNYKHHYHTLHRNVCSFCNQTFPSRH

SEQ ID NO: 951320 - protein, 41 aa, Homo sapiens
EQVEEYGGCASSAAGSVRVRVAGTAVLGVGPAWSPAVKYPQ

SEQ ID NO: 951321 - protein, 42 aa, Homo sapiens
MVLIRTVFRLWLSWGGSTSGTVVLLLREAKEWTGTEIRLSSP

SEQ ID NO: 951322 - protein, 54 aa, Homo sapiens
HEVSRTCVAWLCELLDYQMTLKGNYMSYSNISSFLWQLLIEMSIFRGQKSVMAL

SEQ ID NO: 951323 - protein, 54 aa, Homo sapiens
LPVSVTVLAWLCSELASTMTLKGNYMSYSNISSFLWQLLITMSIFRGQQSVLAL

SEQ ID NO: 951324 - protein, 43 aa, Homo sapiens
MCLIYWSDCFKEIHVVQNACSQLLHTKWLLNPNIYEQQIELIL

SEQ ID NO: 951325 - protein, 55 aa, Homo sapiens
PEEVMVASLTTSFPSSRGHHVGSLFLDADHLGGAMESLVSVLTDDDGAEEVFHSF

SEQ ID NO: 951326 - protein, 36 aa, Homo sapiens
RSVNVTGQKCEACCASRSTRRRAMCVSSRKEQNTVD

SEQ ID NO: 951327 - protein, 68 aa, Homo sapiens
GQSYCVLECFPTLQRELLLVLWSSGLDLIEHWFLALLLLRVFLDSLNPLLCSTWVQVINQCKSSGFTK

SEQ ID NO: 951328 - protein, 96 aa, Homo sapiens
DLRSWQSVHSALVRNLATTVTEELLEQAFSQFGKLARVKQIKAYAFIHFDERDGAVTAMADMTGHDLEGETSCNIVFAKPPDQQTATKATSSEAIT

SEQ ID NO: 951329 - protein, 37 aa, Homo sapiens
RILLTSGVTFHPDQYKGEKGSEGEPGIRGIFLMGEDC

SEQ ID NO: 951330 - protein, 38 aa, Homo sapiens
LQDAYSSLIASSSCRTVPTKSMCDKPGRRQTSILMYSQ

SEQ ID NO: 951331 - protein, 43 aa, Homo sapiens
QGHALQVLQLTDFILRYRPVPTTKYVRQAWQKADINTHVTAWC

SEQ ID NO: 951332 - protein, 149 aa, Homo sapiens
MLERLVESCALSFCVGCVGVVFGKHYHPMVPQSVCLISSVPSMSEHACYVPVYTSLELHMRRRVIVQENVHMVIVVPCHYNAKGPRPMSTHTDPCSHYGTLLGSWHCSRVRMTTVPVKFANAYCTTSSGVDGAGDSDVMLKRPVNQVGT

SEQ ID NO: 951333 - protein, 67 aa, Homo sapiens
RLLSQLVMHVSHGYTTEQWMTTSLSSLSDDHQRVAPEWYLPIIPMVSINGAEGIGTGWACTLPTHAC

SEQ ID NO: 951334 - protein, 69 aa, Homo sapiens
MEEPQPKRSGILGRPYAACGQNIVRSCSLTAGNIRDQVQQQVGVRVHDFKVRIVRAPKMITEKAKARAR

SEQ ID NO: 951335 - protein, 53 aa, Homo sapiens
MAEGTGSELYVERNWESEIKVQGVNPLKLGCPVHFNTISTLTAFNRASRIFTG

SEQ ID NO: 951336 - protein, 193 aa, Homo sapiens
YQNGPIVIMIDGVEWNHQMESNGIIIEYEFNGITEMNLNGMIIKWNRREGSNGIERSHRMKSSGIIKWIRMKSSSNGIEWNHRMDSNGIIIEWNEMESSNVIKWNHHGMNIDMETSNGPECKNHRMESNAIIEWTRMESSWDGIKRTHGMDQNGIIMELDQTESLNGPEWNHRLDLNGIIKWTRMESSLNGIN

SEQ ID NO: 951337 - protein, 78 aa, Homo sapiens
QSLMAAEDKSSQKEDRFEEEIKVLSDKLKEATRAEFAERSVSKLEKSIVDLEEKVALAKEENLSHQMLDQTLLEFNNM

SEQ ID NO: 951338 - protein, 48 aa, Homo sapiens
STRSYGHTCNGRTSVTHQDIVSDEIKLHLFFHSIGKSQYALGVIINNL

SEQ ID NO: 951339 - protein, 43 aa, Homo sapiens
PGTTTRRDDRLVLPYLMHRVVSHGQSCSSNEKENLQGPDIWCM

SEQ ID NO: 951340 - protein, 103 aa, Homo sapiens
SGSVDGEFEIQADDARARSWDLEDPCPPSPPRFAPRWSLFSGGMVRANKMKMKSGGFQSMGLGFPVFNGLMKNGFKVPTPIPWKTIPVILGGLGVVALARSVS

SEQ ID NO: 951341 - protein, 50 aa, Homo sapiens
AGIWAGRQAGARRAGTPQQVGGVVGGGGLGPGGLPALRFRGRAARRAVPG

SEQ ID NO: 951342 - protein, 106 aa, Homo sapiens
AYEIRTVTSEQKEMILFTPKCVRETHDSMPSHGHILLQETASLPAPAPVLRSVVIYMGNGLQHLVSFSIRINFEAGLVNKPINPIYAVIYTISIAAVVPHFAFSAR

SEQ ID NO: 951343 - protein, 50 aa, Homo sapiens
ITAAIPTQRSWRVEQDNKMTPGKPGHRVRAHAASATATEATVSLSSLVDY

SEQ ID NO: 951344 - protein, 132 aa, Homo sapiens
SEVQLGSALAAMDRQLMRLADTPWLCQSAEPGEESVMLVLAKRSRSGFRLVTKFGSVNKEAHSLGAPVHLWGTEEVAAWLEHLSLCEFDIFTRSDFRGSELLLLDRDLDLGVTKVGLKRILCGFLVLCRCAP

SEQ ID NO: 951345 - protein, 136 aa, Homo sapiens
CGASPPEAAAQVVQWVSFAASALVPPASAWVFPTLGVMRHIKQATAHAKEEVRRILGLLAAHLQTRTFVVGERVALAGITAACALLWLSEQALEPCFREALPNANRWVLTCLNQPQRAASGEALSEKMAHRAAKPA

SEQ ID NO: 951346 - protein, 38 aa, Homo sapiens
DREVEQETRYPRELGIVSGPRCFGHGHEAPCPLLPGGL

SEQ ID NO: 951347 - protein, 109 aa, Homo sapiens
GDTCGGHFPWAPETRQEGGSAAGRPLTAHGELGPWRGQESLSLLSPEAVHGPRHKETHAAQAAGAPGSAQVLEAKGMASGSGGGECEKKIQTAPANSGDSTPEKNVRTA

SEQ ID NO: 951348 - protein, 46 aa, Homo sapiens
INSLTSTYLPRINIVRHSPTNSTQHILSVKTRTSNLPVLMNSNSIP

SEQ ID NO: 951349 - protein, 62 aa, Homo sapiens
SNSSITTTHTSATEPFQVDGPTLGAQHLEAGGSPTRHVTQEFVSRTLTTSGTLSTTWTNSSS

SEQ ID NO: 951350 - protein, 67 aa, Homo sapiens
LNGRPTSPLFSVRTFGRKLSLKPGADSHYPHPVLTPAYPSVWRLFHQLTIDLAGPLNPWDFSSSLFI

SEQ ID NO: 951351 - protein, 115 aa, Homo sapiens
MVWSLQTVGSHFELNCGETYKDHENIVIAKMDSTAKEMKAVKVHSYPTLKYYPASADRTVIDYNGKRTLNGKQEIPEERWPGWGRGIDDDLEDLKEADGAQNIEEDDTQDGFWVP

SEQ ID NO: 951352 - protein, 72 aa, Homo sapiens
NIIVTLRLVLFGLSVDLLFFVLCGYLRRLLSFCVAGFGLVHLNCLLMMDNDLRRRDGRQAYRLREGETLVYD

SEQ ID NO: 951353 - protein, 82 aa, Homo sapiens
DNWDTGDELAWDEELRGAPAAGQSSPLHFSTGKTHRRFHVRRPVRMRASVTEKGSAVGRGATIFKVTLLLLANSPGNAYAGA

SEQ ID NO: 951354 - protein, 47 aa, Homo sapiens
MLEEDQAGLRIPSAVWESLMQNWMPVDKDVTVYDVPVYSDFYRRIAE

SEQ ID NO: 951355 - protein, 57 aa, Homo sapiens
QWLLREHSDSVEDLTGNRWSNDLDTCPMTLYVPSWLGHLELMLDNDGLLGNEWGSRN

SEQ ID NO: 951356 - protein, 65 aa, Homo sapiens
GDGVNFVGNQSIKHAISGSSNKNFRHQKSERSWWTSAYATSYRGTMPTPWKETEIHKPPNSPHGS

SEQ ID NO: 951357 - protein, 32 aa, Homo sapiens
MLMNNGGNNDNSDGDGGGDDDDDEGGDGGGDE

SEQ ID NO: 951358 - protein, 77 aa, Homo sapiens
ILLEILDEAWCVEAQEKSALLNEFVSTWTEGSWTTLVVDTPPGTSDEHIGTIEALRTYQTLWGLVVNTPQAVSREGT

SEQ ID NO: 951359 - protein, 37 aa, Homo sapiens
IGDVAKNMGEMWNNTAEQIDKQPYEKKAAKIKEKYEK

SEQ ID NO: 951360 - protein, 44 aa, Homo sapiens
ILSETPPSMRRSNSTPHYDMISRLYAHPPPAHMVLVTPPRLLLP

SEQ ID NO: 951361 - protein, 89 aa, Homo sapiens
MQVHCGGGGVFAHTLVWVGLVRVVPAYVLDHLELWLGLVVAEAAKEGVAVGVGEGMMAQASSPAESTVAHIAHIGFGLTVLAKVGAQQE

SEQ ID NO: 951362 - protein, 49 aa, Homo sapiens
MTLGLGYRSVAYSMRLVSGKQRLTVARLSISEPISLHNPVLQSSPVLQQ

SEQ ID NO: 951363 - protein, 36 aa, Homo sapiens
RSHTLRMTVYLTKFDQYFNVELIQPGAVNGYAYYKP

SEQ ID NO: 951364 - protein, 72 aa, Homo sapiens
AKATCSVVTMYPAKGQDQLTCYKFVPQRVPYTQHLETDKRAQDGTEHYFILRSVTRYRGSAGCPYVNIGTYL

SEQ ID NO: 951365 - protein, 108 aa, Homo sapiens
MYLSTPLARCYQVICVRSKASHHGFVLYSLSFVRVSPVPGTDLKDHSVLGILRPLFCFRCWFYGDLEVEFITGELIFGLSMIHCHHREGALAFSFSCDCKTLIFLGLF

SEQ ID NO: 951366 - protein, 35 aa, Homo sapiens
LSAHHLMLLMMVVLTAGLEGHEIRGQFPIRSFFLV

SEQ ID NO: 951367 - protein, 77 aa, Homo sapiens
LDAAIIEVFTSSAYIKVCGNGAEPCELIDCYSMTVTLVARGPHRVNDSFVAETYTKRKRNEAGRPVPNHTLFGLQKN

SEQ ID NO: 951368 - protein, 74 aa, Homo sapiens
FSYYIGRTPKIEQLSTMIVQSCPCRSYSSKSVKTKDDSDDDNDDDDNKDDACNRKTVTEPWSITVKKYEKDERY

SEQ ID NO: 951369 - protein, 122 aa, Homo sapiens
SLLVVRPHSFWNWTSVWFSRHLWVVEDRVGVQDRSPSRGRSGIRKGKEVVHGDNDGAEFVTEVVHQEQLQLLAAHLGHGEEAVEDSGLTGGKAEPGRAAVPVSLQSVGQGDVSPVVRVPGTL

SEQ ID NO: 951370 - protein, 38 aa, Homo sapiens
QVHTPTLQVRESRVTLKVLVGKAGSRYRKLETELLTLI

SEQ ID NO: 951371 - protein, 46 aa, Homo sapiens
YRERMQDRHLPWITRSKARLDPYLHVRIQTVIRGAFTILLTLWVTT

SEQ ID NO: 951372 - protein, 47 aa, Homo sapiens
QVSSLNIGLESGCQKGAGAPQTGGKKASELLDVVFQIGAGTGFEAVR

SEQ ID NO: 951373 - protein, 50 aa, Homo sapiens
MSWAPIIRGTSQIAKASDYDRVLLVKKIITNAWAATITLVDVVLTLKIVG

SEQ ID NO: 951374 - protein, 128 aa, Homo sapiens
RGTGEQLFARERSKRESDTSAKKEESITSSEIEAVINILPTKESAGPDGFTAKFYQRYKEELVPFLLKAFRTIEDEGLLLTSFYEARLILIPRPGRDTTKKGHFRPVSLTNIYVKTLRQILANRIQQH

SEQ ID NO: 951375 - protein, 49 aa, Homo sapiens
PRHHFLHGKVLALMSLMDGSHCEPHTNAHVGCGGQTISRDSLKLSNTPR

SEQ ID NO: 951376 - protein, 76 aa, Homo sapiens
SLNGVSRETECPHPILTAGSCCWAERQNCVTLGQSLEAFCPLAEKGGLLLESHWDSNGKRKTGQSPPSMMFLLPLG

SEQ ID NO: 951377 - protein, 39 aa, Homo sapiens
RCNTSPVLLGQPWALNEAQVQAQWVQVLTELLEQERRVP

SEQ ID NO: 951378 - protein, 40 aa, Homo sapiens
EQKHWNAKTLRMLVQVVGLQCYCLKLVSMDLKLHRPLARV

SEQ ID NO: 951379 - protein, 52 aa, Homo sapiens
KVPIHRDWEDGEDTGGTLMRGGATSLRVTSGRASRPLCSWLKSKSWSSCRRS

SEQ ID NO: 951380 - protein, 78 aa, Homo sapiens
MLVGALEEQGLLEVARLLVHVGHAVLAVVCDVLGGLGGHQAQAGQLDGHIGRVGALAAILELESIGHALAEPDIPLAA

SEQ ID NO: 951381 - protein, 39 aa, Homo sapiens
LAVSWLRRRGSKQEAGKMWSDVGMRKGATCEREVGLRQV

SEQ ID NO: 951382 - protein, 93 aa, Homo sapiens
LLWLSHLMRHRKRQVPNHLLTGVGKLDATRVDQIVVLHLHCGLVPKLKIKVLVNRHRRWRAFQRGQHDHDVLDEAERKLLSRVKHVTNCIGVE

SEQ ID NO: 951383 - protein, 101 aa, Homo sapiens
SWELVQKAQAHSAGPACPRAVWSGGAGCGEGPLTWQGLRGLALALGTVGGKGLCHHALHRCEEEAGGGAALRQLLAHSTSQVPPLVLEVPQVSVVLDRERP

SEQ ID NO: 951384 - protein, 148 aa, Homo sapiens
LKRKEARISVRISKKQIRRKVVGKRISRKVAKKVARKAKRFAQMNKSFRKKQMKKLRKAGASDRILIKINNINKVMKKNDKVLIVLSKKLKTAPKVKRAPIVKQIKVIKRVIRHQQHKERRTVRRVVRASIRITTRRRRETVNSNYFP

SEQ ID NO: 951385 - protein, 39 aa, Homo sapiens
SRPRPQKYGKNELDYPTQMNPLCWQVEQSPRTGTETPPS

SEQ ID NO: 951386 - protein, 104 aa, Homo sapiens
RGQTSEPDTLDHTHVSTTQSKECVSVLQCADGLHTCEGQGVGGRGPSLHWTELSPSLGTTLYFHTGGGQSQAGGLKRGHRPSISCPFPVCNKVSGPPFPTTWFI

SEQ ID NO: 951387 - protein, 560 aa, Homo sapiens
WRGGALSDQPLPAWIPQSSRRVACLPHPVRCPCLPRHAVPLVAWLSVHAVAADPSCSVGCVLLDSGLVCLLLLVPDVIVLLVLWLLIAQWRAFVRLLWSGCLEMPVADLLLLLLCAPLWLAAVLTPAPVVARGDACVAAEGPVGLGSALPLDCVPLPAMWMADVRPAHLCQWQSPTLHRRPGLWVGFRGAPFPGCGPAARGPARHDLHVLSERCFGHCGLACGVGHLGALAVGAPFACSDRAFTVALGPGKPYAFGAALARYSPIGLCTEEHSPGPTAVPNVDIRVLMDRKDPETGAQLNAESMCAAPGGKHFVSDAMAPAGIPRCLFPRGEQLGQPLGEVGSVGLPPSKGFPKRRPRFAKILHNTELTASHSKFRTAPHVWFLFACKRGDTVSQRRLYTKQVYERFAARFLQRMAHREITPRTAYTFLSGQFQRTGAMRQRQAKLRSPVAPDSRQHLVTATALWNLQALKDITFHMVGFVIPPTGGFHQYSPQLWCTNESRRTSCSARKQKTRCFETLYQKGDSGTDDETPVIELSGQNDVMCEDLPSHLMTKPQREQI

SEQ ID NO: 951388 - protein, 57 aa, Homo sapiens
IRMYGKSLKTYGPRLMIICYYLSYVLFYVFRDGVSHIVPQAGDAVAAISDSLAHLRP

SEQ ID NO: 951389 - protein, 36 aa, Homo sapiens
CTLTCVSIMMNVIMYVEAQITVRINVKRDTLGRRDH

SEQ ID NO: 951390 - protein, 42 aa, Homo sapiens
AELVWTLPLRTPPRDLPGLSLRTWGLNGIFSLISVLVLMVLC

SEQ ID NO: 951391 - protein, 47 aa, Homo sapiens
SRHWIDDRQCMEPDKMRNIDYSDDLHKSQTLQVVGETRYTDSEICHI

SEQ ID NO: 951392 - protein, 41 aa, Homo sapiens
MSVCGHVLSMFLQVFFITADLDRQGNNSSLQDLVSSGFATI

SEQ ID NO: 951393 - protein, 58 aa, Homo sapiens
RIFHCSLLAADRFWCPESNIELVNPIVDSDSRHMDCAVIPRVTCSVGQVIGSIEYSSS

SEQ ID NO: 951394 - protein, 209 aa, Homo sapiens
PGARQGQQQAGGRRSRKAAKAAVAPGLRRRVSAALYVARGGRPARGGDRAPGLPEPRRGREHRAGGRRGEGGGGGAGNPRLAERPRARGVCVRARACVCVCVCVGGGSASIMWLESRGELQLPLQGEEPRAGGGREPGRPAVAPSRCVRAVRAHVSGGGERPQVPGRARFGGSSPLYCARSAGARRDVTSGGRSRAGRGGGRKISTMRP

SEQ ID NO: 951395 - protein, 33 aa, Homo sapiens
MYDMAWLLSTTARDSLGCNLFYVTGCLFVAVQN

SEQ ID NO: 951396 - protein, 39 aa, Homo sapiens
MAYAHVSSIMEAKEVRSSVASWVARLQWRVARLQWPESG

SEQ ID NO: 951397 - protein, 64 aa, Homo sapiens
CSSIAAALRDVCSNIEVVYPIVDMDSRIGLRRYPLGTLFPLVTVIAINSSICRSLFDDARWGYS

SEQ ID NO: 951398 - protein, 91 aa, Homo sapiens
MVLWRSVILRRFQKSTELLIRKLPFQRLVREITQDFKTDLRFQSAAIGALQEASEAYLVGLFEDTYLCAIHAKRVTIMPKDIQLARRIRGE

SEQ ID NO: 951399 - protein, 34 aa, Homo sapiens
VSFFFREGNQIYNEGPQVKHASFLVLGDLAIRPM

SEQ ID NO: 951400 - protein, 37 aa, Homo sapiens
DLLLSKLYKALSVVTFPVSNLGHAGDSLIQSPTSVSM

SEQ ID NO: 951401 - protein, 95 aa, Homo sapiens
MTEGGDSLVATLPAPQGRFLANLRRVGRYRDAACNTGRISRGLYRHHVYKRGYVHHKRVLWAIKSGETRNSSAWVACLDDGKHERDAGRVTEPEI

SEQ ID NO: 951402 - protein, 38 aa, Homo sapiens
REFIYSLDLDQLFIWVLREYNEVEPIILSVGEEDEVSI

SEQ ID NO: 951403 - protein, 47 aa, Homo sapiens
TQCHLISRPLPYTLYINKAPSVTPYFNATHCSTTVSNFPLSSPHSNR

SEQ ID NO: 951404 - protein, 45 aa, Homo sapiens
HGDYQGGSQGGYEGGGYRGGYQCHPAGRHEKGRYASMYGGYGSGQ

SEQ ID NO: 951405 - protein, 48 aa, Homo sapiens
VNSYRPCTGRRLTQTVITMHGPSLTANSYDYALAVSYQYTGYDHALAC

SEQ ID NO: 951406 - protein, 48 aa, Homo sapiens
SHGRCPVPSTSVCLVVIAVLVGRMCLGGVVRCGVSFPFSRYLRRRTTR

SEQ ID NO: 951407 - protein, 42 aa, Homo sapiens
LTCYKHALGRRCTFNSYDACTGRRCRLDRYDHALAVVFHKRP

SEQ ID NO: 951408 - protein, 73 aa, Homo sapiens
RGSHAIISDVYIDAYTDDLILSTAKLVLDRRTSNLIVNGILFLVMNFILEVPSYNSELICDYLKKITAGYTRE

SEQ ID NO: 951409 - protein, 34 aa, Homo sapiens
KCRVIGCFSGSNSFSSTSFISTSVSWLMVDMKEE

SEQ ID NO: 951410 - protein, 53 aa, Homo sapiens
MATVYTYMYYTSCTRCLDYRSSHIYPALPPENGIRRPSRIPSCVTPFLQTLNK

SEQ ID NO: 951411 - protein, 46 aa, Homo sapiens
HRSPSLRILYIQTRLYDPSLTIKIKLATNGTEPTDIHLTYGVTKSY

SEQ ID NO: 951412 - protein, 37 aa, Homo sapiens
RIAMTMHWTTFYTQSYDHALAVLNTNSYDHCMGRRLT

SEQ ID NO: 951413 - protein, 67 aa, Homo sapiens
SRRTRIAGKYVRGPAEKISILAVNYSMSTENLDVLLVVFSLQKFIFIVGISLIIQFAICVKVGVLVW

SEQ ID NO: 951414 - protein, 51 aa, Homo sapiens
IYALSTLNDSYGMEPLEAMSHRPAGGRQFAGVLRLMLQYLSAGKDALILQD

SEQ ID NO: 951415 - protein, 70 aa, Homo sapiens
ALTGQDGEVLLTLSQQLHELDEVADDRVRKVVSHKSRHTTAAGKELTPSQLLEKLGFAAATLQTPVKDLS

SEQ ID NO: 951416 - protein, 35 aa, Homo sapiens
MDKDGIPPDQAQVDLMPGKQLEHGRTLSDYNTPGD

SEQ ID NO: 951417 - protein, 170 aa, Homo sapiens
EDHAGLPLHEVLLEQAKVVWQFRVTEDEDKWPVTSDKTIGGRSAVYLKMGKNNQSALLYGTLSSEAPQDGESTRSGYCAMISRIPRGAFERKMSYDWSQFNTLYLRVRGDGRPWMVNIKEDTDFFQRTNQMYSYFMFTRGEPYCQEVKIPFSKYYFSNRGRIRDVQMSSG

SEQ ID NO: 951418 - protein, 65 aa, Homo sapiens
KVMTSPYRKPNGEELASGQQMCMTLETNPPVPVKSSEAVALSDSLTKTSGETLSQNHSDKLVSDS

SEQ ID NO: 951419 - protein, 57 aa, Homo sapiens
LRHTGRIRVHGIWLVATSNRDLKIDLLAYPGLSETKSATLLSETGYPMSCYCSLGYL

SEQ ID NO: 951420 - protein, 106 aa, Homo sapiens
AGFGVGFDQHGAGGGEGLQVLDQVFVVAARAIGDGGHADQLVAAEERQAHEGIQRRMAGRQAAAARVVGWIVRQHRLPAVQDMAEQRLQVTEFEAADDIAPMASAR

SEQ ID NO: 951421 - protein, 61 aa, Homo sapiens
STAIHHWPSCTDNSYNQAQAVDSTVNSYNHALAVICDSYIAMTMHCPSLPTIGNNHEWLGM

SEQ ID NO: 951422 - protein, 34 aa, Homo sapiens
MEQHPVVGDDLLGLVVLARAALRIAAAQVPRRQH

SEQ ID NO: 951423 - protein, 51 aa, Homo sapiens
LFAQMAHVRRLHKNNNSLIIPTIISRTITLLKLYYYLRLIYSTSITAISPS

SEQ ID NO: 951424 - protein, 37 aa, Homo sapiens
MLFLSSPPLSPHALQLKPIQYLEVLERWDPKTDSETE

SEQ ID NO: 951425 - protein, 48 aa, Homo sapiens
LAVSAFALKMVIKGETYENGPRSQRVRDAVVATIATLYGIWLVVAAGA

SEQ ID NO: 951426 - protein, 66 aa, Homo sapiens
GIISSTCDLGPEAPLRVYNQLAYDGKDYIALNEDLISWTAADTAAQITQRKVGGGPVMAKQDMSLR

SEQ ID NO: 951427 - protein, 47 aa, Homo sapiens
RLPAGPASSPGKGIRLTPVYCGGSSSGYAAVEEVGHGACGWDPTRRK

SEQ ID NO: 951428 - protein, 40 aa, Homo sapiens
MTGGVYSVNALKSVRANHSFMPIVLELLPLKIFEIGPVHA

SEQ ID NO: 951429 - protein, 56 aa, Homo sapiens
KPYQQPPGNESGYINQDCSFLNPFGKTTDADSSSAGTPYNHLSTHSNSITWIGYLS

SEQ ID NO: 951430 - protein, 47 aa, Homo sapiens
FTLTAFYILLPLITTYYSYYALITAFYVLLLLITAFYVPLRLITAFY

SEQ ID NO: 951431 - protein, 32 aa, Homo sapiens
MAASMHFSTRDAMYTGLAGGHDPAVDKHTLER

SEQ ID NO: 951432 - protein, 74 aa, Homo sapiens
GVVYTNSNNHKMTCMLPSNSSYRSCDVHRIAKQYLHKRTQVEDYLLNFKTYYEASEKLRHRSTSKRLDTKINGT

SEQ ID NO: 951433 - protein, 67 aa, Homo sapiens
QRIPTKQLIQVSYQSKDLLITAQELDRWGTQPLELGRPVFPGPRISVGISVFCKGCDLKLFKTNHLW

SEQ ID NO: 951434 - protein, 53 aa, Homo sapiens
ALWLLPNTSAAAPYWGCGIHAPVQGCPCSQYSARTLEPDGRITTRGKGTPLEV

SEQ ID NO: 951435 - protein, 148 aa, Homo sapiens
MYRYELGLSTCSFEQLQRKLAESKATYFCSGGVSMVRTLMVTVVILLTILASLVVTMVTKPAYSSSGQRIPSDCCIAISCLRSCTESIKSYTITMDHWEGYQDLTFPSPTRSMEEYFRAHLKIATNVHHMGWYVFSLNNRAPINWDSS

SEQ ID NO: 951436 - protein, 31 aa, Homo sapiens
MTVGTGWNGTTTLGRTGDGVGWQQGGEWIAW

SEQ ID NO: 951437 - protein, 53 aa, Homo sapiens
FPNIIHCHIIPLTNPCKSLSMSNQQNVFDHLCDRLFHSGLKPPDLKLHSHQLG

SEQ ID NO: 951438 - protein, 48 aa, Homo sapiens
YHRLALLVLSREPSLPGMYFLGWVSANFIASNWAIFSHSFTSPKTARK

SEQ ID NO: 951439 - protein, 51 aa, Homo sapiens
MLDYPPPEQWLLVPPPVLTALKALSVVDNSQSPSWATAGDLLIHIAHQRFH

SEQ ID NO: 951440 - protein, 48 aa, Homo sapiens
MARISTSSLNQQESSVPEVPDVMHIMPLENAGTLSPSMTYSLWFSKLH

SEQ ID NO: 951441 - protein, 45 aa, Homo sapiens
KKARAQQTVKSVERWALPQREHGRFSTAEMSAVTQNDTGTEPTHI

SEQ ID NO: 951442 - protein, 38 aa, Homo sapiens
VVIWSRQQLHYVNKIRTKVDELTQIIRDASKARAPLSG

SEQ ID NO: 951443 - protein, 55 aa, Homo sapiens
DQLSSYPRYRRCQNCDRMEMEKLHSMSAEPMVSRSEYHGVSPKVESVQLLRFVKS

SEQ ID NO: 951444 - protein, 50 aa, Homo sapiens
MMSKNQLLDLGFKLGNVRDPLSTKIQKLARRCGRHLYSQLLRRLRREEII

SEQ ID NO: 951445 - protein, 58 aa, Homo sapiens
PHKFSHQLKQLAHAPTTHGNRSKAAHQSSRILSCVRAWVQCIRVLCGPTFKPARRTAP

SEQ ID NO: 951446 - protein, 94 aa, Homo sapiens
MCRRHELLILSLIGEDKGFGISVDIRAQSVGSGVQAAEADRSHVCVHVCVCVCVYSLVVDTYVFSNPGLRELPPELQVGNLWQLDTEDLTISNV

SEQ ID NO: 951447 - protein, 60 aa, Homo sapiens
WCYSCLACLTVDTAGADAPHCLWLGDTRPRFLEEVKFECHFFNGTERVRLLERRVHNQEE

SEQ ID NO: 951448 - protein, 62 aa, Homo sapiens
AYNVHSSDRGAVAYSLPSFFLPRTVVLNGLSTKNYYYDYVATLRLEATCQCMALGWSTTHEA

SEQ ID NO: 951449 - protein, 204 aa, Homo sapiens
VPELNPNQENSDILVLDDLFENKLPENYDPHIVQVYRFMNPEMYDTCIDLVAVGDRTESSFRSLHSRDNPFENSPHDYTKSYSISTDFFATKETAMQFVQQGMNLLNAKDLSDVSQAKSGIERWYTLAKKEEIFKMNSIDDIKQQLIMSSDWSALNAYEMTKRACAELTKHGHRVPSWNVIRDIIGKGSAGDINRGKDDFRKEH

SEQ ID NO: 951450 - protein, 41 aa, Homo sapiens
RGHIWSRQGSDLRPLLAAGACPEEEKAAVAVRLSHRSGEEY

SEQ ID NO: 951451 - protein, 66 aa, Homo sapiens
WVVRKLLKVYVPLLNGALRREKVMYVVAVAMLVVAGLVYTQVGKTFLPTMDEGDLIVGIEKLPSVS

SEQ ID NO: 951452 - protein, 107 aa, Homo sapiens
RNVKAAVVDVGWRVRMVVGGRQVVRCWAHTAVQAEGRSNEGRRQRYTAPTDGVRTCAVVVEWTKNMHVTCIVIASGWRLHSFDRLCFQSHMAGNQALKRYSRRMHKR

SEQ ID NO: 951453 - protein, 46 aa, Homo sapiens
AVPLHISHLGSYPGPHTIALSTTITRTTAIVATITSKSIISTITSS

SEQ ID NO: 951454 - protein, 120 aa, Homo sapiens
SGDGMLEAFKQVSLTKKVTVEVAKQYGSFDEEDPDAALEIDDDGLVEISQWRHAIVNFPHPLLKEGLIIDDTPGLNAIGTEPELTLNLIPNAHAVLFILAAYTVVSMSDIDVWRNHVGSG

SEQ ID NO: 951455 - protein, 41 aa, Homo sapiens
ALKCLDAPCLPVSCITYWRLSHHNLTLPSPGLRFSDTSQPP

SEQ ID NO: 951456 - protein, 96 aa, Homo sapiens
HGRKLKGAFKPASLPRRMTDLRQEGLSIQSVTINFMELTPSLHSLLDKQVDRPVSGRHSEIAMTQIARISDTGNERRLQAERLVGARLCRKPRRFR

SEQ ID NO: 951457 - protein, 102 aa, Homo sapiens
MLQDSRWYALPNFPACVYYPTLSQSLLPHPAASPSRVPEPFQMGGKGHTKGTKVIIGTQENFLPIYLLNYKAWGQRKLTEQAAEGQDKLCLIQRLAVVHPEA

SEQ ID NO: 951458 - protein, 200 aa, Homo sapiens
VASSESMNKIWPTRNHYLIAIFQFKCRQFIKILIICRQTERNTTRRFQLTHFCQHVSTCFLFRLQFERNYLCIYCTGLIGCGFSIFCTTLRFQSAYCFLQVELLLLAGLLTIKLSTKQISIRSCAARFRDERLYRFSWPHLIHTGNIHLSLNARKNLTFRNWHLNIVLRKNRHGITCLQTQIIFAFGIIHCPTKIKRQRG

SEQ ID NO: 951459 - protein, 105 aa, Homo sapiens
PRGSPDMLITEDCAHLFSEKLWPLDGPFFVYRPFGVHSMGDAGQLPAERNGYVTFGCLSRSIRINHKVIRIWAAILDAMPTARLIIDSGDFKDPQICEEMAARFA

SEQ ID NO: 951460 - protein, 96 aa, Homo sapiens
NIDCSVVSPIAAAGGDQMSGWAMLPRTAQVWLLGMRGAAIQYLEILNEEGGESWWPPTPGRAVRKSMICVGPSGLIIGQVDDVVLDALVLQLENGG

SEQ ID NO: 951461 - protein, 72 aa, Homo sapiens
RRAGLHLLEHRKQLVDEIGHLGRRTLGGRTNQQVLFHRQAREDLAALRHIGEPLRDTLVRGQFLDGAPFPID

SEQ ID NO: 951462 - protein, 36 aa, Homo sapiens
KVSSGRVSSSSTLRRPLMLASTLMRVSTLSHTCVLE

SEQ ID NO: 951463 - protein, 40 aa, Homo sapiens
ALVVSSLFQCSNASVNSTSIACTVSSTSSRVMWLHCLGTV

SEQ ID NO: 951464 - protein, 72 aa, Homo sapiens
MGGRQHRAVDHDGVVQPGYLDAEVSRIESLEYLDKMELLEHLMRHYCLCWATTGGKMRLGCKEKLIKSVTHK

SEQ ID NO: 951465 - protein, 41 aa, Homo sapiens
PPAPPSCGCYYLHVHYWAGQEHRNIAKKSPELTFSECPVLR

SEQ ID NO: 951466 - protein, 112 aa, Homo sapiens
VVVFLVSIGLLPDMLPIDDFWYVSGLVPTHEASWAVTEGLAPFWTTRDAPTASAQAFPSSRVRLVSALSAESIDNCRCLLGSQLVPLLACRSLSQLSSYLFIHQLNFQFSQK

SEQ ID NO: 951467 - protein, 45 aa, Homo sapiens
THGNGSQINFLMRKNRADPWQAAERCVWHTWSRNPSIQVSFPTFF

SEQ ID NO: 951468 - protein, 79 aa, Homo sapiens
MKEIKGIHISKEEVKLLLFADMIVYLENPKASSRKLLELIKEFSKVPGHKIIDTNQHLFCTPTVTKLRIKSRINPFYNS

SEQ ID NO: 951469 - protein, 174 aa, Homo sapiens
GPHEFIAKFYHTYKEELAPTLLKLYQKIKAVATPPRLILGSQYHSIPKSAKEITTTTTTTKLRVNIPIEAKIINKILANQIQKHMKKLFHHIQVGFIPGMQNGFNTCKSINVIQDVKIIENKNHMIMSIDVEKAFSKIQYPFMIKTLNKLGIKGTYRTIRAIYGKLTANIILNE

SEQ ID NO: 951470 - protein, 47 aa, Homo sapiens
SSWHTLQCIAYSCAAMVNSGVNMVKPVHHTHVFVNWSLILQQARGIL

SEQ ID NO: 951471 - protein, 100 aa, Homo sapiens
VNLEVPGDIVDRRLHKYFLIQGNFHAVYRDALKKLLETAVYSDIRKKGADVWFTELDINTDGAVNFQEFLILVIKMGVAAHKKSHEESHKEELSYWAQMI

SEQ ID NO: 951472 - protein, 48 aa, Homo sapiens
MTSRRDSQANVIHKLIVCHLRVSNSYSQTNSFFIWHLIVDFTSSTMIS

SEQ ID NO: 951473 - protein, 58 aa, Homo sapiens
EVRGDIVGYRYPYMGQTYFNESEYRYSVDSPTLTRFFTFHFILPFTIAALSRVPELDI

SEQ ID NO: 951474 - protein, 41 aa, Homo sapiens
WSGDEMSLMGAENLARGTLWHDCIGLPQSRMWELLGGGYES

SEQ ID NO: 951475 - protein, 32 aa, Homo sapiens
PELRRLATPIFYLSGWQGRKELAVLLKEVARG

SEQ ID NO: 951476 - protein, 30 aa, Homo sapiens
MRLRSQAPSLPPETVWPPRLPIYLLPLTCI

SEQ ID NO: 951477 - protein, 34 aa, Homo sapiens
QNTELQFRVIAAAQVGNFAFSRPQLLAIEMGQLL

SEQ ID NO: 951478 - protein, 62 aa, Homo sapiens
GLSSLKSHPGIRARPHASQPGLEGLKLGLVQASASSLVHFGHLLILCLDLSDDAVQVQVGVP

SEQ ID NO: 951479 - protein, 52 aa, Homo sapiens
PPTLPAVPTLVTLHVEFVQGDHSHSRISASSGMGLRADGAPRGVLLVVVGDT

SEQ ID NO: 951480 - protein, 33 aa, Homo sapiens
SPIQTGVDGCFPTTVEFNSKTEVHKEGCEWDAW

SEQ ID NO: 951481 - protein, 43 aa, Homo sapiens
PPPPSNFHVNLCSYHDAIMTFETYKGAKAADIFSCISPGWKLL

SEQ ID NO: 951482 - protein, 34 aa, Homo sapiens
GASRRNRQPREVWADPSDDWTSSVTPFFARIVLY

SEQ ID NO: 951483 - protein, 34 aa, Homo sapiens
APYQTGAGDIESIEQHTRIVDITRTSPAAKSPSA

SEQ ID NO: 951484 - protein, 92 aa, Homo sapiens
ENPLALPWIIGIKLTYSGKGDANWTQTITVAQDGKVTERRVDSGPTYYNSSDFSAYPQIQNGRVFTDAPGMNPISGLSKTYELSLIVRSGSA

SEQ ID NO: 951485 - protein, 73 aa, Homo sapiens
LILVISHFSDCCHEVFLYYKNHDQHELQNYTCFSDKPFLRSAPLNAIQKASQLASELYITNAVVSGTCDGFSV

SEQ ID NO: 951486 - protein, 49 aa, Homo sapiens
RSLLARVVFPEIGILTKQGDHVRANWPITKPALPLPPPPAKLGDEAHDI

SEQ ID NO: 951487 - protein, 107 aa, Homo sapiens
SRGSARFFVTSAAIDERLQCAYGPYAARVQQWTDRPVLSFEEPMIRGETGINEITRSLKYNCCEPGQQKGRDARSAGNDDGDLVLDPEEGKGGPGKGNRGLVTWKLL

SEQ ID NO: 951488 - protein, 81 aa, Homo sapiens
GAYTSLCRRRSVRPNETMKSQCDSVMQIGKLIKDADHRKRVTVHSRARCRKNTLGRRKGRHIAHRVSGKFAEGGTEARNSV

SEQ ID NO: 951489 - protein, 120 aa, Homo sapiens
TGADFPASDPGLFVRNGHGDVPGQRLGVVLRLVTLCALASRVYCRLLLTGRLHRQRPHSISRVQFQRAHIDQVTKFFADHLGPVPAQAIHHDIDRQQVVFALHVHLARNQELQGKIVEHP

SEQ ID NO: 951490 - protein, 33 aa, Homo sapiens
YYPRNTRYYPRTHTLLPTEHHSYYPRNTSYYPR

SEQ ID NO: 951491 - protein, 57 aa, Homo sapiens
SDLTYQDRFQSLEHTFNAPAAGIQFGDLLRTDALRQVAPEHQAAVAGVRWRMKRQFD

SEQ ID NO: 951492 - protein, 54 aa, Homo sapiens
METSSPTSLEQGEMTSAETQVSMGTGVTVDTGIGWLSSSSHYANRYADTFRCLI

SEQ ID NO: 951493 - protein, 104 aa, Homo sapiens
SFVFSDKSFAVSPRLECSGTISAHSSLHFLGSNSSYCLSLPSGGIKGASHHTRLILIFLLFLVKTGFHHVGQVGLNLLASSDPPALDSQSVHVTMPGLEFCFKK

SEQ ID NO: 951494 - protein, 108 aa, Homo sapiens
MPIRSTVARFYYVYAPTSRTSFYLDSHHQIFNAPSFFLPSFTKSHWLLNSYPIFTTNSCLLTCSSILASSNTGSWNPVCICLPRFTESNICVAPEISIRLMLVLRISR

SEQ ID NO: 951495 - protein, 50 aa, Homo sapiens
MECGRFVISWKKTDQVPEINDWTLCRNKSKPKSYTWLSRKIIAWEVARAG

SEQ ID NO: 951496 - protein, 83 aa, Homo sapiens
DEGPRCRSLPRLFLLTRKSLGFHNVNSLIVSMLRGVFLAGDLSGPSMLQMCIYAQWYAYLCVTVSVASWLDPTISSEIMHPKG

SEQ ID NO: 951497 - protein, 41 aa, Homo sapiens
SLPSASSVWCDTLLSYFITDQCSLSATIGAMEDARYANLVG

SEQ ID NO: 951498 - protein, 53 aa, Homo sapiens
IRCNSRGVPYRTGSSEQLSCRTCSKEKWQRIVIRDKYWSKGGRSSRAARTELE

SEQ ID NO: 951499 - protein, 57 aa, Homo sapiens
DEQILRARITQVEASNDDEALALVRDELISIHNEQAESLEKTRGELVNVSAKLQDTQ

SEQ ID NO: 951500 - protein, 33 aa, Homo sapiens
MDPPVVPPPLSSVRADLGILALSASTAGGAWVD

SEQ ID NO: 951501 - protein, 56 aa, Homo sapiens
PGLFAIRWGFIPLVIYPGCIRGADPGKPEPTVLSLFGDKWIILVFLDLGGNQDSLE

SEQ ID NO: 951502 - protein, 45 aa, Homo sapiens
PQSYRVLLSGFAVTPEQCLVMINISISCDHNAFLNSCFRNSTFYS

SEQ ID NO: 951503 - protein, 49 aa, Homo sapiens
MRFQIFFILFIFLLFFFILPSEGVGLVPCRWCIQSIISLLLWALSEGSD

SEQ ID NO: 951504 - protein, 47 aa, Homo sapiens
YSYDITQLFSLLLKLELDVRVALLPDPVNSAVGVDTQAEALVLAVQP

SEQ ID NO: 951505 - protein, 40 aa, Homo sapiens
SQYDAQMGTVKTVTKNTPHIEKSLSLNTVDQQRQLSQCLK

SEQ ID NO: 951506 - protein, 69 aa, Homo sapiens
ELTRGEIHAWGITELSPLGTLSKLKAKHRDLPVEQQRHILEKQGKVIYGIDMKIVDDAGRELPWGVPEA

SEQ ID NO: 951507 - protein, 91 aa, Homo sapiens
RGTLSGDHSGACLTRRRLSRSAASRDRSLYALDASGPSPPLRIGDLNPTPFRSAEVNGGHRPSLRKRRSSNSLRTDLTYVQLLVHMEPFST

SEQ ID NO: 951508 - protein, 52 aa, Homo sapiens
MDVEAALVHFRAADKDIPETGKKKRVNGLAVPHGLGEASQSWWKARKSKSHL

SEQ ID NO: 951509 - protein, 76 aa, Homo sapiens
YRKIRRSSRNKKRSTKKLEELKAKAAVTGALSHRWELRKSGKKKAVPCALSEMVTPLFHLVFKASLFPAITSFATY

SEQ ID NO: 951510 - protein, 70 aa, Homo sapiens
SRNAEQEREKELAKCHYQERRSRMTNNDEMDICRAAEEGRGRKHSGQCDRGANCPKQLMRAFSNIPVRTG

SEQ ID NO: 951511 - protein, 53 aa, Homo sapiens
MLADKQIVRKVEPHNVLLKSVEACVLQTNVDAVAYRSEHGDRETRQYSVGLYG

SEQ ID NO: 951512 - protein, 56 aa, Homo sapiens
QDTVISCANETLVMLVLEGLIGSRTHPSPESLCYLSSFLTFFHFTAYPVDYLLELA

SEQ ID NO: 951513 - protein, 53 aa, Homo sapiens
QPGNREYLPHRFYSKDHIIETAYISYTDAWALSITLIATSLTSAYCTRNNSSP

SEQ ID NO: 951514 - protein, 43 aa, Homo sapiens
PSNQDHKKELSILKVDLLECSVTPGKDYSVLIPCIHYYLLELA

SEQ ID NO: 951515 - protein, 52 aa, Homo sapiens
STDFGLVASGERVSNISEHTQQWGITIRKDSYYRIRSVDESRGSSDLVLLEL

SEQ ID NO: 951516 - protein, 73 aa, Homo sapiens
ASSLIRKYTNSTSVILFAARMVCLVNSVNPVGALQDECNVQLNTATSGNTNLKPEKSKQYSLGLVFQPTYRTG

SEQ ID NO: 951517 - protein, 54 aa, Homo sapiens
MNCSRARNVKGYLLTLLDQLNERFPNCMAYCQFIEHVWIAFCQISNDKLILKSR

SEQ ID NO: 951518 - protein, 41 aa, Homo sapiens
MAEDADPAYGIQLLVWPSQFQKPMHFLWDFFSYTLNDPLES

SEQ ID NO: 951519 - protein, 70 aa, Homo sapiens
LGSLEKLSTEVVLGVVHQLVVGRTEFRVPGIFAQARAVDQRLRVFDTETHRERLGFHVHATAVEHAEGIL

SEQ ID NO: 951520 - protein, 38 aa, Homo sapiens
VLLFDERIPLNKLWSGAQLVVLSKSSVKIQSTLVKQSG

SEQ ID NO: 951521 - protein, 112 aa, Homo sapiens
MEGRVHCEPQRCVQPANYSWYQAGSARPGPVTVYPYMHALDTLYVPLLVDTGVPLVTGATVLGHHQLLLHEEASKKGDSFTPQVLQVSSVYRPSYKPSSGGLDTLSLRPLFL

SEQ ID NO: 951522 - protein, 84 aa, Homo sapiens
PRRVLQEYGRDMRKKIQKITDFISFFRDNDTCPTCTQPITEDFKAQVIEAKANNRTELQSSLENLNALLQKTESEIEKLDEGYR

SEQ ID NO: 951523 - protein, 72 aa, Homo sapiens
MSVPPRGGVSGEVDEQPGGGCELEVADGRARIEQHGWGVGPLAQHGMQVERLLEVGHHAYALDVGPRGGPEA

SEQ ID NO: 951524 - protein, 168 aa, Homo sapiens
EHGAETRARAASSVSPSHYDYIRSDALMEKVDTMQKQMDNLNRKIPIIRKNKQEMIETKTNNPLRNEESFGWTHEYTANGLETQTPLLSVEDYVNHETFDKPDKLTTTNRLEPDGERLSNYKKYTIGIMRIPEEDREKGTTETFEAIMPENLTKLVPDTKPQIRKLRN

SEQ ID NO: 951525 - protein, 51 aa, Homo sapiens
LVSRAQFIRMIPVEKDLYDIKAAQISAQGNWDLFSENKSFYASQVVIQSAN

SEQ ID NO: 951526 - protein, 50 aa, Homo sapiens
YCIGKYQNRGYHAKPPSSQIQSTSDKYRRIAYPVHCEYVGRRPNLDRSLH

SEQ ID NO: 951527 - protein, 41 aa, Homo sapiens
GKGMKQVAEAGEAGECVGRWVRLPPCLLGGLAWGSVSPQLG

SEQ ID NO: 951528 - protein, 65 aa, Homo sapiens
GARSLYGGFFGAGMGNGTISAHCNFRLPGSSDSPASSLLSSWDYRHPPPRMANFFVFLVEMGFHQ

SEQ ID NO: 951529 - protein, 51 aa, Homo sapiens
MGRLIPHPIDPCILGNETMCLCLGIRPTELRVDEEGMDVIGLASHRKRGNR

SEQ ID NO: 951530 - protein, 45 aa, Homo sapiens
KYYYSDAKWDIKWKGKTPELLVLYAEYFKRSPKLKQVGFWKRWDE

SEQ ID NO: 951531 - protein, 58 aa, Homo sapiens
LQRQVSNPAVVFVTRKNRHVCATPEKKWVRAYINSLEMSWDEESLNLNLHKFASGGYR

SEQ ID NO: 951532 - protein, 103 aa, Homo sapiens
ARVYDSRRIPPLVWRRKITKTTCKVEKLKPLEVELRRLSRPFRIYVHDFAYMRKREEEMRDTNESPNTRVLYFSIFSLFCLIGLATWQVFYLRPLFKAKNSIE

SEQ ID NO: 951533 - protein, 42 aa, Homo sapiens
RQSQNRIYLTADNLVLNLQDASYTRGSASLINGYRNCAYVTK

SEQ ID NO: 951534 - protein, 35 aa, Homo sapiens
TYAECYAGLSFGITCYTFGMASTQVGVFKKANQIG

SEQ ID NO: 951535 - protein, 45 aa, Homo sapiens
PLDGLPRVPVYQLTSFVLAVGVVCCRAVCGHLVAGQQQGRALSKD

SEQ ID NO: 951536 - protein, 118 aa, Homo sapiens
PTVCSPALIQALNRRTPFFKFFLKKELIWVPFLGLAWWALDYPFMKRYTKAFLAKHPELAGQDLKITKEACELFKRQPVTVVNYLEGTRFTPAKRKQQDSPFERLLKPKAGGVAFVLA

SEQ ID NO: 951537 - protein, 33 aa, Homo sapiens
MTWTRLPCGAPALEVRGRQQSASGHTMEVERDH

SEQ ID NO: 951538 - protein, 36 aa, Homo sapiens
MTTEHRGMVHLLVGSLMRASSRVTPEFATRQTRGDI

SEQ ID NO: 951539 - protein, 82 aa, Homo sapiens
STGALREGILLKWRCSQMPWMQLEDDSLYISQAKFPVLAPYTGYRPDVVPSLNRRPLGQSCALAHDEDVCHFVLANSPYCSV

SEQ ID NO: 951540 - protein, 45 aa, Homo sapiens
SVLVQEEAMKENTAAVLVQVPVEVTSFLLNEKRTEITKIELKQRV

SEQ ID NO: 951541 - protein, 58 aa, Homo sapiens
MPSTPHGEADGLDVLLASPSALDTRWLSDWYPDKGVTLAATLGYAGGPKVASGEMGVP

SEQ ID NO: 951542 - protein, 34 aa, Homo sapiens
PPTLTQIQRCHRAVRSLLPRMMRPVPAPIGDIVV

SEQ ID NO: 951543 - protein, 42 aa, Homo sapiens
ARDHSGTGAMEDRQAKWTSRIGLASLEEMVHLGEHRSQSAAS

SEQ ID NO: 951544 - protein, 43 aa, Homo sapiens
KSALFYIYKSKENILACPLVMLRKKLGEMSEEHMLAECTSSLM

SEQ ID NO: 951545 - protein, 73 aa, Homo sapiens
MATSVLGVKCSKEVATAIRGAIYPCDKLSIVPVRRGYWGNKIGKPPTLVPCKVTGRCGSVLGTPSSLHPGHWH

SEQ ID NO: 951546 - protein, 41 aa, Homo sapiens
EHNTEQSSNPAVVFVTRKNRQVCATREKKWVREYINSYGDR

SEQ ID NO: 951547 - protein, 60 aa, Homo sapiens
MACTSRGAWWDSYHCRYGVLSSGHDAILHQCLGTNPLVIRCIVDNIDDPCITAVNTLSPN

SEQ ID NO: 951548 - protein, 103 aa, Homo sapiens
YACARSALVQASQLSYQNILSNKNVGIANRISISSLMQARHFPQITGYMRLPGRGSSHRERRLNIELDLDTDALSQVVFRCNLTQQLQQLNLGSTISTLLASC

SEQ ID NO: 951549 - protein, 36 aa, Homo sapiens
SWGYYGHALKSVETQFLAIVLELIPLKIFEIGAVIY

SEQ ID NO: 951550 - protein, 147 aa, Homo sapiens
VSSLNPRVAAASSYPRMYLTRSEIRQGLEYFFSLKKDYFNVEYAIVGYHSLVLPAIGIQTSEGVCLAVEKSISFPKLMEPEVAIGENGRALMLTEVVPMSGLMADAKTLIDQRQELETQNHWFTYNETMTVESVPKLCPIWLCSWDT

SEQ ID NO: 951551 - protein, 47 aa, Homo sapiens
SASFNQAAEKECDQLGLEFQHWTLSQADNAKQARTHHPAQAQISLHD

SEQ ID NO: 951552 - protein, 55 aa, Homo sapiens
KTGLLPAHSTPDGLSLTRLTEPRDPQIKLQLQAEARGVVSIKGVCATLLPGYDRQ

SEQ ID NO: 951553 - protein, 45 aa, Homo sapiens
RWGRDWGDITLRFNWNFQRDLATGGTVEYAKRKAHAGPGTPNSNC

SEQ ID NO: 951554 - protein, 45 aa, Homo sapiens
PWRGIDSIYPYELLQKNILPAENLLYLLKSGSFHRCRTMTDFTFT

SEQ ID NO: 951555 - protein, 111 aa, Homo sapiens
DVLASCPPILEPERTMILHSQVPRKVLAWFYSPSPKSYCKSISVTKITKPDGIVAARRTVVNSERRNKKTTVTREEADSSPRGDPDITRPPALDDAFSILDLYLERRFRTR

SEQ ID NO: 951556 - protein, 65 aa, Homo sapiens
YFGGLFAWLLVWRIVGLVVWLFGGLLVGQVQLPWRLKQEDHLSLEFKTSMGNIARPCLYKKIQKI

SEQ ID NO: 951557 - protein, 33 aa, Homo sapiens
DVGSRAAGDENLPESGQLVVVPIWEKQQKIHMA

SEQ ID NO: 951558 - protein, 46 aa, Homo sapiens
MRTDYYIYFMFIAYIHSSQKVEHNPMCPALAAWTKKEMLTHAATQM

SEQ ID NO: 951559 - protein, 92 aa, Homo sapiens
MEMGRRIHLELRNRTPSDVKELVLEQQSVHEGKLEGLTDELEDLEFLSTIKVGIQLNLTTYQKLNKLKKLELSNNRVSGGLDISEKKCPNIK

SEQ ID NO: 951560 - protein, 41 aa, Homo sapiens
SFYPSSRISETRSLVVNLNLPQEKCPVTSYFYVAGEVVEAE

SEQ ID NO: 951561 - protein, 37 aa, Homo sapiens
SLEDPLAKMCMNMRLEALLHFQAASEIHSLDMAINTK

SEQ ID NO: 951562 - protein, 43 aa, Homo sapiens
NCTSAPQPHDTLGCYPFYKTDPFIIPRVPACLLLWQKPKSPQC

SEQ ID NO: 951563 - protein, 62 aa, Homo sapiens
RPGLGAQEDSLAGVWGKGAAPLHVCCGSCSSVPRRIMYSFQLKAGPTSVSSTLRWSVFLYTT

SEQ ID NO: 951564 - protein, 67 aa, Homo sapiens
SFNSKQSTPGPTERVTSTPQRRAHLAVRGVVFRVRRYTCVSAERVWGDEQNDFVLPHQAARLLGSQG

SEQ ID NO: 951565 - protein, 40 aa, Homo sapiens
MSTPRATPLGALLSPTSSAVPPGSSYPPCCDPLASWADAG

SEQ ID NO: 951566 - protein, 74 aa, Homo sapiens
QLGPPFIQAVVGSLVIRGGGARRAQVAAIHPLYDVRPGLALVVVAAQFPQVHSVSLCLALVVLCLPVPDCLDYK

SEQ ID NO: 951567 - protein, 73 aa, Homo sapiens
MVLNSITPKLDQFYHLYSTELDVRYTVTVKHFSIRNVAPTSPTQGHVRADFSDRRQSSSRRKLASIPALRAQD

SEQ ID NO: 951568 - protein, 32 aa, Homo sapiens
SYLPEGVKAVDHKTGREIHFTFEDRINYCRVS

SEQ ID NO: 951569 - protein, 34 aa, Homo sapiens
QTYGRLPVWGYWDPESQSWKHLITVVVLNDLHNE

SEQ ID NO: 951570 - protein, 36 aa, Homo sapiens
DYRDTGQETYYLKLQYSKNFRLVGHVVSASTAPLRS

SEQ ID NO: 951571 - protein, 98 aa, Homo sapiens
RYRILVFSITHEDDAIKKVRRAKLLLLLTKLTTERTSGRKDGLEPLTTEKPETREASSRNANENALDGRHKIKHSDYYVNYRKLRQNGNNYRHQRPGT

SEQ ID NO: 951572 - protein, 43 aa, Homo sapiens
ELGPAFGVAKVNFFMCHIEVPTQHKEPRSRRNKSLKPSEFPNE

SEQ ID NO: 951573 - protein, 73 aa, Homo sapiens
LSPVTDNFVPVRFRKGTRRDIMDLHTLQPSWDELPDQEGSAATAQCFIVKSHIAQRCIGLLQGAPVNIEKCTL

SEQ ID NO: 951574 - protein, 60 aa, Homo sapiens
IGSARLFGWLLVGGEIMLEMDAAPGVDLSRIDLTTHLASQGGSSPPRAPTEEATPSAATK

SEQ ID NO: 951575 - protein, 40 aa, Homo sapiens
HRARSRLSGGAWGGEGDLGERTPHRCRNSQQVTESGRHKE

SEQ ID NO: 951576 - protein, 35 aa, Homo sapiens
YISSAVFSSVSTQHLSCRIGPLLSVEDPPCPRHNE

SEQ ID NO: 951577 - protein, 83 aa, Homo sapiens
DTRLVTLSRRCIADAYAGGLCASIRYRMRLRLCSSLVLTALLAACSSAPPAVDVAAQTGTAASPEAAEAYQEARERRLPGGSV

SEQ ID NO: 951578 - protein, 53 aa, Homo sapiens
GGGSQRRGVAVSAGGLGGLLAAKGVWISSVPPVSLLYVVLVQCGSLHGCLLCA

SEQ ID NO: 951579 - protein, 69 aa, Homo sapiens
MLFDIRWNTFRFRREGNLVIRNSVKKPGRYYVKQNKPGTERQIPHDLTYVESEKVEFLEAEGRLLGLQG

SEQ ID NO: 951580 - protein, 36 aa, Homo sapiens
MLCYMTPGRGVTQVSLLSFHGGRPKSPCAVHLLCAI

SEQ ID NO: 951581 - protein, 30 aa, Homo sapiens
MAWICTQVGVFKKANQIGLTCLLQNPDSCP

SEQ ID NO: 951582 - protein, 48 aa, Homo sapiens
MLQESEEVSLRFSCSMVVLGRQGCSIILTLSVCFSVAVSKLAISPMSG

SEQ ID NO: 951583 - protein, 76 aa, Homo sapiens
KLHSSISTLLEFALLFSMLALELPPAHMTFCSSCVSARAPDVTYEDLHAPTSHDVVKTLPESVKARAAHRDSCFYR

SEQ ID NO: 951584 - protein, 33 aa, Homo sapiens
VQLDVFWHNCYTYGMDMHTGWCLQITANLDMAS

SEQ ID NO: 951585 - protein, 45 aa, Homo sapiens
LFYIYSTVRHPLNGNQKLSTPPHIYTSHIDLEADEILQNAVDREL

SEQ ID NO: 951586 - protein, 53 aa, Homo sapiens
RIPLEAVYTGYRSGFFIDNLAVLALVYAADQLAVSLFTCYSRFSCTIPAIYEE

SEQ ID NO: 951587 - protein, 92 aa, Homo sapiens
CAYRRVAGCLLAIIVTRLAWICTHGCVSSNKANQIGLTCLLHTHDSCALEPNFCFNVLSNYSHQTLKGKLANQRYRDLLITVYIKGAPHYQG

SEQ ID NO: 951588 - protein, 44 aa, Homo sapiens
DSQRRVTADSTEEMTAQRRWKARFGMSQQPNREEPLGGYLLHTH

SEQ ID NO: 951589 - protein, 51 aa, Homo sapiens
LKSHEVLGSAYVLVAGWTQLNRLSGSPCNSLSPFPFSTQRYLSADIGCRLP

SEQ ID NO: 951590 - protein, 55 aa, Homo sapiens
VLEKRRFFLRIHPDVRVDGSGRSATLTSMLQLQAEERGVVSIKGVCANRYLAIKE

SEQ ID NO: 951591 - protein, 34 aa, Homo sapiens
FKASLCSSVLSTSSVLSTSSVLATPLCCPLLCAV

SEQ ID NO: 951592 - protein, 38 aa, Homo sapiens
MRQNTSRQKASERFRFTRVVRLRTFRPADKILHSLNHN

SEQ ID NO: 951593 - protein, 43 aa, Homo sapiens
YVSRSPVCSSSCSVDILAIAVCMAYFSPFNVDNVSTSFHFHMV

SEQ ID NO: 951594 - protein, 68 aa, Homo sapiens
CALSYIYSLVVILPTPAEGAHLPAFSEELLRVCGLLALLNLLQGMGRVLLCFDIIEGLCCVDIEECTL

SEQ ID NO: 951595 - protein, 35 aa, Homo sapiens
DQYDSTEEVVSTEEGDVSITPNLILVPKHCLASSV

SEQ ID NO: 951596 - protein, 45 aa, Homo sapiens
VPAVCQVSASVCPVCCQCLPGVCSQTCQVSAHRPLTDLHLRVRVN

SEQ ID NO: 951597 - protein, 48 aa, Homo sapiens
SRGSFAGRGAVQVVSRLCWLTMTCLHLALLQFILTKTLDPDTYCDQHK

SEQ ID NO: 951598 - protein, 41 aa, Homo sapiens
MRISLTKTLAEAGMQQKQEALTIEPYQVDLSFDGVHEDRKR

SEQ ID NO: 951599 - protein, 56 aa, Homo sapiens
SLGTGDTEEVEFTWLSYRGGSNKFNADEFEDMVAVKRLIPDGCGVKYVPSRGPPLL

SEQ ID NO: 951600 - protein, 49 aa, Homo sapiens
EEVGLAGRNYTVNTTWCGPCSQAAKPAILLPGLPVLSTSSVLSSPRVLS

SEQ ID NO: 951601 - protein, 65 aa, Homo sapiens
WCKSCVGGSVMAQQVTESVQKHSEAAPISHICFQAERGDRDSRCINSAHLKLCAAVEKQEAVPSS

SEQ ID NO: 951602 - protein, 43 aa, Homo sapiens
LKDPYKTLTGKLGWQKQEAGRAGQKQEASRKRRSRKRQKQEAE

SEQ ID NO: 951603 - protein, 35 aa, Homo sapiens
MWRSLGACRLILCGHSPTQHRGVAHPRLLLLRPSS

SEQ ID NO: 951604 - protein, 67 aa, Homo sapiens
LLLAEQSHPPLDIGAGTAVPGVVVAWAAGFCWPGWLNPDFGLCPHRCWPLSPFTFSPLCLPASPLLR

SEQ ID NO: 951605 - protein, 38 aa, Homo sapiens
LLEDPLQDPDEMAAAEEKVVERTRGAEDLKKPEGQKQE

SEQ ID NO: 951606 - protein, 35 aa, Homo sapiens
MSISLLNLLINSCLASNFSSVRVVLNSVVQSNTLG

SEQ ID NO: 951607 - protein, 66 aa, Homo sapiens
RIPVRSDHLGSLNLCLSSSSSSPASAFDVAGITGIYHNTRLIFVSLVEMGFCHVGPRRTRGPLEIR

SEQ ID NO: 951608 - protein, 61 aa, Homo sapiens
RLPTAKEAGKPDLDRHSPLGCLARWASVPTASLCCPPPLCCPVLSTSSVLSTSSVLSTSSG

SEQ ID NO: 951609 - protein, 65 aa, Homo sapiens
GGLQRTPRGDIKAYPTTEETARQTAWGNCEMGTVANTDAGSIPKVQGFKPILAQQQAQLPTPTTT

SEQ ID NO: 951610 - protein, 60 aa, Homo sapiens
PGDLSRRRHQHDVDFKVIVIYELAGMHLIAALVHLTKYYPDLRDDTVPIEYTLSRTDRVD

SEQ ID NO: 951611 - protein, 63 aa, Homo sapiens
ADNQEYKLLLHVNTPLQQKTGHTNGALLDGEDDHLIQFIKEPVYHPQVRTIVEEVQDGKVISS

SEQ ID NO: 951612 - protein, 73 aa, Homo sapiens
VCDIGEGLAVTRCGDGVGLLASAGQDGLTLTLGSACMVLATVPIYIFPTLICPHLLCRGYGLDITSGWSERTG

SEQ ID NO: 951613 - protein, 38 aa, Homo sapiens
VIEQRRLPDILADEGPLWDGLQGADPPAPLAVQLSTSS

SEQ ID NO: 951614 - protein, 117 aa, Homo sapiens
DPCRSDKITSGLRTDNSDNNTIFVQGLGENVTIESVADYFKQIGILQTNKENGTAHRLIVYTEQGKLCKAERETAWSLLDDHLSAKQLIDVGIDGKENSPEILIKRSHLHTRLRADR

SEQ ID NO: 951615 - protein, 55 aa, Homo sapiens
CEQHREAIQKKLTGIKHELDAKLLQSSVKGPLKPGQRILPVHCRHLAWSAKLFVG

SEQ ID NO: 951616 - protein, 49 aa, Homo sapiens
NTESSTYEVDRQRRQCTTALSEQSEDGLAVRIPGFHPGGPGSTPASSVL

SEQ ID NO: 951617 - protein, 237 aa, Homo sapiens
GSCRSDEIFDLARKLSPKTAYSPAAELESRVQLSDQVHQIISHALAERKLEPAPPTKAEATGNIRENRAEERLRERENAVVPEGVRAEPASLQSELTPKAHDSYAGERTAQVIDLLKRIRPGQAKMKGAQTFANYVRQDISEYAGNPLIEALPPILSEAAAVELISNFPQPVDPKELTLEGATRIHCIDRLRTVVQPFLLHLELEALFSLLIRRGYVGRTRCRRYRRHCILIWGQGT

SEQ ID NO: 951618 - protein, 68 aa, Homo sapiens
MSFWFFVKAASSVFMKYRNSVYGESVVITILSSILLEDSNQGTRCTDQISDRAGRFLAMLGDRDDRGT

SEQ ID NO: 951619 - protein, 53 aa, Homo sapiens
SYTVCQLYVSNEEFLNGLVLGSRILQQVSAANRLHVAAALLGTTIVPSFLCHL

SEQ ID NO: 951620 - protein, 45 aa, Homo sapiens
HKPDYKVDKTCCAQMLCRVPTCAQHQLCAVTVSLPLPPKTQGHPQ

SEQ ID NO: 951621 - protein, 38 aa, Homo sapiens
RGQLNFEPLTLVPIQTKMIDVDSLTDKECDWLNNYHHG

SEQ ID NO: 951622 - protein, 46 aa, Homo sapiens
LGVARGVLNEYFHNVCELDLVFNFHNEPRKEPHKEPRKGPHDEPHQ

SEQ ID NO: 951623 - protein, 66 aa, Homo sapiens
GRSRNNTDPYKRAVYCIIGRCDVTDNQSEVADKTEDYLWLKLNQVCFDDDGTSSPQDRLTLSQSQD

SEQ ID NO: 951624 - protein, 33 aa, Homo sapiens
ALGVDLKHKIRQRFSQTKLVTIPQTFPECPFPK

SEQ ID NO: 951625 - protein, 79 aa, Homo sapiens
EEGCSGQALLHQQALELPLAVLHALAGLRCPLPRMRPSCALNSSSRQLLTAGHFCATHHPTMFMLELLWISSGYRVSQF

SEQ ID NO: 951626 - protein, 48 aa, Homo sapiens
DTPRAPQRATQRSLTKSHTMSHPKRHTKSHTKSHTKSPATSRAKSHTK

SEQ ID NO: 951627 - protein, 50 aa, Homo sapiens
FRILRISSGSHQDLIRISSGSPQDLIRISSRDLLRISSGSPQDLLRISSG

SEQ ID NO: 951628 - protein, 69 aa, Homo sapiens
ESEETTTIVPCGPYIKTGLRRHPGREDENTFTVAVSSGLRLVMCKDALFCESSLQVANLPFTDAGYSVA

SEQ ID NO: 951629 - protein, 84 aa, Homo sapiens
KKEDEDEDWMKIRMNGTILGRIDEGTGEEILLLSDRDRLRSEVKAGMERELGIIIQDTEIELDPDRLDRRSHSCFLLCRISTSP

SEQ ID NO: 951630 - protein, 80 aa, Homo sapiens
IHLCAHEMYFFTSVSLALAAGSPAFIAVGYVDDTQFVRFDSDAARPEDGAAGCLVKEQEGPEYWGTRETRNVKAQSQSDR

SEQ ID NO: 951631 - protein, 60 aa, Homo sapiens
GILLSLPESLRAAAETIDSHRCDCQTAASFSPHLHTRICLPNGCQFGKVTLSFYSVWGIS

SEQ ID NO: 951632 - protein, 67 aa, Homo sapiens
SPPVCSLCAPVCSTSPSRLPRRAVWSKSARVRTRKMVNYARAREKTRENLWCRSVADPDVPNRSFRT

SEQ ID NO: 951633 - protein, 47 aa, Homo sapiens
ASPPGAPPLPHNSCGHQTITTLASRRVPASRLLRYRQELVCCISRYT

SEQ ID NO: 951634 - protein, 32 aa, Homo sapiens
IPIQSTDRIWYIHIERNVNKRKDAHGTLYGGS

SEQ ID NO: 951635 - protein, 47 aa, Homo sapiens
ENPHTEYTVSVSAYLDYELCYVLGHTIFKNDACTFKEADMPGEANVH

SEQ ID NO: 951636 - protein, 68 aa, Homo sapiens
HVVRGRSRGRHGLSRRGRRYRDRETQISKTNTQTYRESLRNLRGYYNQSEAGSHTWQRMYGFLTGARR

SEQ ID NO: 951637 - protein, 56 aa, Homo sapiens
NTLGVQVHSTRKMKTETADAPKAVEYLLTPLRSPSKILQFMVDPRVSCYRLLGLQG

SEQ ID NO: 951638 - protein, 45 aa, Homo sapiens
LVRVATSEPQGLSWMEEMLGLARSLKTNTLAAQSVIKKDNQTLSH

SEQ ID NO: 951639 - protein, 92 aa, Homo sapiens
LNGNYNNSSNGGRDQSIKLVEKWSTDNLQINDIYPMQDTIAMKEKYAKYLHSQSRAVCRQTLSEKLRDPIEERLTNSMMMHWTDNNGKKLMT

SEQ ID NO: 951640 - protein, 33 aa, Homo sapiens
MTDVSPWAIMTNDLLPVKLQRRIRMRMAVTPMR

SEQ ID NO: 951641 - protein, 72 aa, Homo sapiens
NTSHQHLNPHTIYTTTACTSTTTACTTNKICTLTINTKTLTTIYTYHCLHSTDHRPVLTCHQDSTGLMILFL

SEQ ID NO: 951642 - protein, 35 aa, Homo sapiens
RHQTSSNPQPLATVKGMENEKPRGPLPGKAAPGFD

SEQ ID NO: 951643 - protein, 31 aa, Homo sapiens
MTLYQPCQLRGLLGARYRAPNYPFINKVNSR

SEQ ID NO: 951644 - protein, 35 aa, Homo sapiens
MSAVDSRRTPPAGVCCVELRLLMLLLTDAPLLMLP

SEQ ID NO: 951645 - protein, 68 aa, Homo sapiens
PSRRKVMPAWRNKPQSSCSMADGSPTDKPARMPAARRSDTWAKIAARMRWRQRSITPCHGHSACYADA

SEQ ID NO: 951646 - protein, 134 aa, Homo sapiens
EDQERGCLKKCEHDPSAAVAKLFWSQRKITKAQEWFHRTVKIDSDLGDAWAFFYKFELQHGTEEQQEEVRKRCESAEPRHGELWCAVSKDIPIAHKKRGQLRRCPPPPNTFSRGFNGCHGRCRWGRVGPHVEGL

SEQ ID NO: 951647 - protein, 35 aa, Homo sapiens
QLGSIRSISSSSGVSNQCSLLTTQHTPSRRDRSAY

SEQ ID NO: 951648 - protein, 65 aa, Homo sapiens
GEGSLALWPRRECKGAIWVHGTLHLRGSSNSHASASRVSWEFTGGPTTGKSTTGRAKFWVIRQHK

SEQ ID NO: 951649 - protein, 54 aa, Homo sapiens
IERLLTRRLRNERLRNERLRNERLRNTLRNERLLNDASVTSASVTRFRNERRVK

SEQ ID NO: 951650 - protein, 32 aa, Homo sapiens
MRQYEPTSQERLPPSMISSQLSIIPTTTTTGA

SEQ ID NO: 951651 - protein, 67 aa, Homo sapiens
GRSEAPCVVNDEKRREEKRKEKKRKEKKRKEKIVSMPANTTSILQTHVVNGVILTLQDLIISKNIFL

SEQ ID NO: 951652 - protein, 44 aa, Homo sapiens
AYRHHTGPDDIMEEMWYTNSCCSNSVPLLLRHDHGEHDVKSVGF

SEQ ID NO: 951653 - protein, 34 aa, Homo sapiens
MPLICLPSPHETAPIRISTGPCPNMHLRPLPLKT

SEQ ID NO: 951654 - protein, 127 aa, Homo sapiens
TTIIVLSFSSQLYTDELLLYTYVLIVYLYVPPDWNVKPPEGREVAYYSEMGPTHHRTDPLRREGQAGLPGTLYFRLNLAHHSALGSPNIPLFVCPEHSDSASHYLRRLYLSKYLFCSYVSYFEFPGT

SEQ ID NO: 951655 - protein, 78 aa, Homo sapiens
TPSPPAPPCATVQQLERRWRLVDSIGFDDYIKELGLGIALRKMGAMAQPDCIITCDGQNLTIITESTLKTTQFSCTLG

SEQ ID NO: 951656 - protein, 102 aa, Homo sapiens
AGRLCRIPHLPPHLVKNLFVYTAGSSGYWEKTYSIVSAVHGSRWRMDGCLWFPVMTNGHCREHSSMPKWKLLDRCLGNTASPIYDLPSHYTARGGSPQIRWW

SEQ ID NO: 951657 - protein, 83 aa, Homo sapiens
MANTAPIDEDIVEVSYNVVRVVEIRCLADEFAEYNSQSGPPDGGKAKMNPRCSEALQAVSFHIRFRWMCGDVSSKYFARRWAI

SEQ ID NO: 951658 - protein, 48 aa, Homo sapiens
SLAEHHKRFSKRSISNRSISKRSGHACWGYVVLEEEEARRWHRSARLL

SEQ ID NO: 951659 - protein, 38 aa, Homo sapiens
FLRSTLAGSPLSAAPPGGHAPMQQHGSRSSHIRPSMVH

SEQ ID NO: 951660 - protein, 34 aa, Homo sapiens
MRSTVREFSKRSGHACWGYVVVGRRGGEEVCIDL

SEQ ID NO: 951661 - protein, 45 aa, Homo sapiens
FWVDLRIPSPAGVILLAEEEEEAPLTDAPLTDAPLLNAYLMLRLL

SEQ ID NO: 951662 - protein, 35 aa, Homo sapiens
EISKRSISKRSSTQHTPSRRDRSAYCCSVTDAPLT

SEQ ID NO: 951663 - protein, 30 aa, Homo sapiens
MHTNTTYPLAGVLRLLMLRLLNSVLMLRLL

SEQ ID NO: 951664 - protein, 50 aa, Homo sapiens
MRSISSGASVSGRIVAERSRLLGVCCVDRSLTDAPLTETQHSAPLLMLRL

SEQ ID NO: 951665 - protein, 73 aa, Homo sapiens
RPACNVLFPALLFRSSHSGSQQHNVSCVKPAITVQASCVFSGSFRSPLNTFVPLSADLSFILHCTVVHVSHHL

SEQ ID NO: 951666 - protein, 39 aa, Homo sapiens
MIPVKEKQKLQIYENFLEKNYLKLSDPNTTYPRRRAPLT

SEQ ID NO: 951667 - protein, 34 aa, Homo sapiens
SIAERHACWGYVVLSSLEELLVHVGAKGSAGAPL

SEQ ID NO: 951668 - protein, 50 aa, Homo sapiens
MRSKRSISKLSKRSGHACWVCCVERRGGEEVAYAPLTDARLLMLRLLTLT

SEQ ID NO: 951669 - protein, 47 aa, Homo sapiens
SSGASVRRDSDKRSISKRSISKRSSHACWGMLCCSLTDAPATDARLL

SEQ ID NO: 951670 - protein, 39 aa, Homo sapiens
AVDSRRTPSRLSAHQYAVSKRSGCWGYVVLIHLICARLL

SEQ ID NO: 951671 - protein, 50 aa, Homo sapiens
IPLHVAEQHPPAKLIFFSQYEQVSIIAESYRIGVKGYVYKRPVNEYARLL

SEQ ID NO: 951672 - protein, 35 aa, Homo sapiens
TRGSRGITGHGGLNWLFIFPLYHGSICLLVLSIRD

SEQ ID NO: 951673 - protein, 140 aa, Homo sapiens
VVQRRVATFNQICIGAKYLMNYCRLRVRRRLFAYSTRPTIKIASITSNSHASTHFNTRTVPCSLHMTKPANPAKTQQRFGPNPLKKEIKRNRKPDFPLEPHHRIGNEESSGDMSHKKFLSMENTQKNAGSRYFRRYENDL

SEQ ID NO: 951674 - protein, 115 aa, Homo sapiens
DEKKNRIPDINHSSRCTHIYTPHVHYLAFLRSMEDVTIAGCRTGAKLSLFSCTESWMLHALSQLTTENVVCALGLSCGSVVHHLLGPSSSSMDCLQALLLNAGGLCNAHGGDGVS

SEQ ID NO: 951675 - protein, 142 aa, Homo sapiens
LTKSELHLKQTNTQTNKTMLFLTVHLPTCRLSELTGPFSFSDSFSFQIHSCSYHHTYFYLCSWAELGGGLGLYLPLWCVGTAVTGGLILRMGERWRIWESVHLRFPYDILPSVFFIVTRSISILSKTPFKHNQVYLMKSKCN

SEQ ID NO: 951676 - protein, 62 aa, Homo sapiens
RRVHALTQNGNGKYVDEADMGCPGTYITEEKPQVCAAMNISQQLVLHSWCRHHTEKQCLGAN

SEQ ID NO: 951677 - protein, 44 aa, Homo sapiens
LPRLDSQINGCRKRDRLYLTSQNQESSDLLNILHDHIQIGLNAI

SEQ ID NO: 951678 - protein, 82 aa, Homo sapiens
SGSSRYDQPLVTAVLISAMILKKYCGEYFCNDPLFAKHEQIQPTDNSFYYCCFLAFPMLPILYYTYSFVSTPIPRMIRCLNA

SEQ ID NO: 951679 - protein, 152 aa, Homo sapiens
VNGLIYIATPELQGISEESDIYVLLEITSLPSNFRHRKGLILVHILNSNCKRALLAPTRLFSLSSVSTKILRDDLLTSDESCTLLKLNGEAAWAGDTGESVVVLTFAGELQEDPALLLFPSRVSEDTHTPGSDSCATSEESMLVMPWKNLFG

SEQ ID NO: 951680 - protein, 59 aa, Homo sapiens
SDLLATSSLSPYPPIRRARAPKQVVSPTKSPKSPTPKHIQYYSHQEYQSPELTIDLNAF

SEQ ID NO: 951681 - protein, 136 aa, Homo sapiens
MHHDCIRRADSNSPRKGSGTTMQAAFLGTYLTNNSGEPSVIVDNGSKVQTPSVLSSHELGSQEALALSGARTAAVAPRKQDFNNSRLVNDPGRTVSLFHNANDPRLVTLSVLGGFDFRTKASRLFSWQTNQCLNAL

SEQ ID NO: 951682 - protein, 118 aa, Homo sapiens
IAFTPLTCVIQNVTAGCMMMIWTNISSPQRRAPGKAKCKPPPIPQRRSDPDNGPWIGIHKKAPPLPIYDEALRILREENLIPPDDPDLVTWSPHDHFIPNRITVCPEPIPCFMYTVSM

SEQ ID NO: 951683 - protein, 80 aa, Homo sapiens
RYDDTLNMIIFKIFYAAAYVETRSNYPNSASNAKLIIEWSTLSFSATSFMVDKRISFCDLISRTGSVVNCCMAGHSLSFI

SEQ ID NO: 951684 - protein, 74 aa, Homo sapiens
DPLPIRFSSVCSCTPVRRVSGQDQIACDSEAELNFQWSSINEHWSPNPNLLGEAFETEPCYFSDLGTMHCIDVM

SEQ ID NO: 951685 - protein, 46 aa, Homo sapiens
TDINILGLNAISLNASALNAISLNAISLNAISLNAISLNAISLNAI

SEQ ID NO: 951686 - protein, 43 aa, Homo sapiens
HGLRLHGQAMTDKLRAVANATCEVHRTAPAGYYNQSSFLKHPR

SEQ ID NO: 951687 - protein, 84 aa, Homo sapiens
DSTYGWTATMERIMKCLRHFGSKSTMGYMSGHTEHLEIMPDHPIVETLRQKADGRHIMIRQVMESGECCLFEHTVLLIFWTFSS

SEQ ID NO: 951688 - protein, 98 aa, Homo sapiens
KLVERQSASLRNLVRWRISLGSFILVAKSDAYSAASSLFHLVRCFFSSDTPPYVLAGQVVYMQSVHIGIAIALTGWGLFMKELGVPGISLNASSLHGI

SEQ ID NO: 951689 - protein, 60 aa, Homo sapiens
AIRRCSTFELAGFPGVYWSSYEEDTKLFKLLLSMATLPSSILFEVYSIYLKVHIYVPNNK

SEQ ID NO: 951690 - protein, 43 aa, Homo sapiens
FRQKFLLRRILLERFTTPDLAPYPRNEEDTGPQAGITRAKSPS

SEQ ID NO: 951691 - protein, 55 aa, Homo sapiens
HWIHRYGLSYDITWLPQGLSCEHHIYLPVGIDVDTRAYFTSDSHNHRYPHRRQYR

SEQ ID NO: 951692 - protein, 55 aa, Homo sapiens
LRIPYTPYSTQQQQQQQQQQQHENSDLGIETAREQCDAMNGTSGVCVLLQRDGWY

SEQ ID NO: 951693 - protein, 47 aa, Homo sapiens
VITPSLDGDWTSDLVMLEMAPSVDVTLHVEHPAPEPITVEWRAVYRA

SEQ ID NO: 951694 - protein, 34 aa, Homo sapiens
QQLKVQGPIIKQVYQLAIPTGKQNSRATNQPVIT

SEQ ID NO: 951695 - protein, 43 aa, Homo sapiens
AYTTMDLQVCMGSKYWLYGTVFRNYLWDYSFGCGIEWYRVVSG

SEQ ID NO: 951696 - protein, 75 aa, Homo sapiens
RTNHLSSLLVIIENRPKPNNSSTAYNNLTRVTILPSYKPQEYFESPFTISEGIYGSTYFVSTWFHVVHVLIGPHR

SEQ ID NO: 951697 - protein, 45 aa, Homo sapiens
YTLSKLDHYTTLIIVLRETAYVHIADQIYGVKMLVYIDEWYQGGI

SEQ ID NO: 951698 - protein, 60 aa, Homo sapiens
NVNQTCKVISFIILVDISQEQFPKLYQDASSPSPTAQWALLMPRCVSNATWRVTQALQHS

SEQ ID NO: 951699 - protein, 42 aa, Homo sapiens
YLGERASHEEVAGLVEKIRFPMSYPKELFELQYNLVPDTGSH

SEQ ID NO: 951700 - protein, 32 aa, Homo sapiens
MVFSSFIHQAVVCAWHTHTGHSSHHTQATSSG

SEQ ID NO: 951701 - protein, 89 aa, Homo sapiens
LEVPELIHPKEIIVFPSFQELRQKYHVRSIPSERMMKFQVVRGHYKGPQIGQVVPVYRKTYVIYLERVPREKANGTTVHVGIHPNQGGI

SEQ ID NO: 951702 - protein, 62 aa, Homo sapiens
MVVFWRIALNNAGVVEAYKSSPSGWVPVTRAIHLPFNNGTSEIKVGDTITGASSGASGVPEL

SEQ ID NO: 951703 - protein, 37 aa, Homo sapiens
KISSQRPFAPDTGVGVDIVLGKKSISIIVQNQARYMQ

SEQ ID NO: 951704 - protein, 89 aa, Homo sapiens
DYKMRLAAYVRTCMYRGGGQRTIQLCFQSSELVELGRLGPSDSSIHPSLRLQAALYHPNPPGRTKIPPSSKNPEPTSKPACPKPFTPRY

SEQ ID NO: 951705 - protein, 87 aa, Homo sapiens
RQLRCHKKTYALSGIPSAHSEIAIRNTGDAHQCCPLLETLTDAEMEKKTPRPGQEHEANEALCKHGPGMNTSPFSTRLPRTHLRQIG

SEQ ID NO: 951706 - protein, 41 aa, Homo sapiens
YNMTQDIEHYTIIGAWAEVYSTALSLLIRAELGQPGNLLGN

SEQ ID NO: 951707 - protein, 43 aa, Homo sapiens
SSSQHVPLLMRLVKKVFGKVLQSHIIAVKVSGGVMAASESWWY

SEQ ID NO: 951708 - protein, 141 aa, Homo sapiens
MYKVSVSIEHYLPIPSTSPAPGNHCSTFCLYEFDFSRSLIQVEKYSMSFCDRLISLSIMSSRFIHAVACVRIAFLLEAADTSSCVYTVFCLITHLLVDTWVASTSWLLQITAVNMDIQISEARPGVHTCNPNTLGGRGGQI

SEQ ID NO: 951709 - protein, 40 aa, Homo sapiens
AVDAVTTLEIPDVGGSAHPCSTVTPVPMLTCVSSPVHAMG

SEQ ID NO: 951710 - protein, 105 aa, Homo sapiens
LARNIFCHHCQDLHLTPLTLRQLEQQEEIPRVPFRRNKEGVGWWKYDFCYGQHVHQYHEDQDSGKTSVVVGTWNPFFSILTWAKKNTARAISSSRRWYPDSQGGI

SEQ ID NO: 951711 - protein, 45 aa, Homo sapiens
MQARYMQDMHARYMQEYEAPEYMQVILNDEPSCPPFPLFCPRYMQ

SEQ ID NO: 951712 - protein, 48 aa, Homo sapiens
SVETSNTEHYNRYTKNEDEKLQYMTRETHFHKKEDRKNGRGDERRQYR

SEQ ID NO: 951713 - protein, 37 aa, Homo sapiens
CIVAACLYPCILPGSTYTGYVPCILVLTCTAGERFPR

SEQ ID NO: 951714 - protein, 70 aa, Homo sapiens
GTILLMRLSHCRQMGTILNQNLWNIKRSGDCQSVGCNVDGRHLMTSSMTSTSGAVELPSQLSPKETHFNK

SEQ ID NO: 951715 - protein, 32 aa, Homo sapiens
MLVCTSTAFLLLSTVMYNVYRELTRWRRAEAG

SEQ ID NO: 951716 - protein, 35 aa, Homo sapiens
YFITSAYLLCQHRQQPGKQNKCTSSILLLSARWYQ

SEQ ID NO: 951717 - protein, 42 aa, Homo sapiens
MNDTDTSFALPCHLRTHPDHSLSCPVPLPSPLHSRVHAMGYR

SEQ ID NO: 951718 - protein, 63 aa, Homo sapiens
CPLPLYRACPRETTKGWFWGRLLVKLCPIFQLPRVVHVLDIPFARFDEDSGPSCFLTPVTCKV

SEQ ID NO: 951719 - protein, 46 aa, Homo sapiens
DYRYTAKRRSKWKCYRARYSSKKSNKAGRDGSHLKYQHFERLRWYS

SEQ ID NO: 951720 - protein, 40 aa, Homo sapiens
MTSTDSPADYIQLELNPIFSCELSRGPPESPHASIGVSID

SEQ ID NO: 951721 - protein, 38 aa, Homo sapiens
MTCGRRNGERDKGDECGEEWGGLLYVQTVILFLPRYMQ

SEQ ID NO: 951722 - protein, 43 aa, Homo sapiens
GHIPLHLPGLALYLGSNNPLGITSHSDKITFHPYMHARYPVHA

SEQ ID NO: 951723 - protein, 89 aa, Homo sapiens
DTPQITTTTRFVEQAEALKAKGSQVVCCLSVNDAFVTGEWGRAHKAEGKVRVLCDPPVGLGKETEFITDDSLVSIFGNRRFQEVLHGGI

SEQ ID NO: 951724 - protein, 42 aa, Homo sapiens
SYEVVLSYTEGGIASYTSSAFLYTVNLWSLAGSEYKGGISAY

SEQ ID NO: 951725 - protein, 74 aa, Homo sapiens
LISINYYMHKLLQHNYYSINYYSINYYSINYYMHKLYMHNLLQHKLLQHKLLQHKLFPHKLLHDINLEHFWTSI

SEQ ID NO: 951726 - protein, 61 aa, Homo sapiens
MQLVGSTGHNLGLLRLKWEQSYGTEPFTCRICCFLWVDSVRTELIPNWCLLEDLWGTPTPT

SEQ ID NO: 951727 - protein, 74 aa, Homo sapiens; identical to SEQ ID NO: 951725

SEQ ID NO: 951728 - protein, 43 aa, Homo sapiens
CARGRDIEGVIKQYNKVSALPPTTHARTFHAPTTHAPTTHAPT

SEQ ID NO: 951729 - protein, 85 aa, Homo sapiens
PASSSASKSTWTGLHYLCKHTSTGESMKIKVLNASKKDLVRDFKTAIDFDQSTLFKKVYEEEFGTFGGSPIGALIGDYEIGRHPE

SEQ ID NO: 951730 - protein, 61 aa, Homo sapiens
LWARLQRDKPNELTSLWRPAPFTSPARAIGICPSHAMSYGNSLSACYLTHLTGFLQVPRAH

SEQ ID NO: 951731 - protein, 105 aa, Homo sapiens
ATAYVTSASVTERFLERRASVTEPCLHSTFFPDPAGRQDQNECQQTPTSSIFLTDMAKQIKTKVNKHAFTGGRDTIEEHSHVGGNLYDVDVSFMYLTFFLENDDK

SEQ ID NO: 951732 - protein, 79 aa, Homo sapiens
AEVISEDPYTPTPAEFSPLSDPGGYRCCCLYILPPSGGLYLSTLPQKEKGTLDYSLEITPWWYQAIPPLVSHEPWVTEG

SEQ ID NO: 951733 - protein, 47 aa, Homo sapiens
MRSLRRRSLRRRYYGGARYGGLLRRAVTEGARYRGARYGRLRRRSLG

SEQ ID NO: 951734 - protein, 61 aa, Homo sapiens
IIQSLSWLLSSELSSPELADEELSSREYSASLQLAVRSTLERQLRCCSESSRLYTLSAVYS

SEQ ID NO: 951735 - protein, 42 aa, Homo sapiens
EDTRNSAPMKMKNCDPDKTILERSLLEGARYCEGARYGRRVT

SEQ ID NO: 951736 - protein, 68 aa, Homo sapiens
RGSPIPPRNRPALLLSGNHHLSLVHCTLHNCFLSRGLPLIDSLVCSYVPNAIWIDLESVTERNLTLTI

SEQ ID NO: 951737 - protein, 81 aa, Homo sapiens
SRGYRNSSFVTSASNTLRNSASVTSASVTSASVTALRNERFRNERLRNSASLTSAYQRLRNERLLTRLTSASVTSASVTSP

SEQ ID NO: 951738 - protein, 50 aa, Homo sapiens
LGVYGGCRTACTDRVIRVRRRSLRRRLHNDASVTRLRNERLRNSPILPLH

SEQ ID NO: 951739 - protein, 39 aa, Homo sapiens
MPDGVISQRSGCTEPATVRALRSTPAARLRWSYDTATPG

SEQ ID NO: 951740 - protein, 71 aa, Homo sapiens
RNDASPMFRQDYTCPPTQVDNFTFAYGAVTRYGRSFQHRSANSLVGTGLVRVRSPLLTESRLALVTEDPSS

SEQ ID NO: 951741 - protein, 62 aa, Homo sapiens
SPNGGTQLCQLEHRLARDQQAEGVLRGMVGGGDRPLPQQGTDRKDVARLVLEAGSRHFRQAG

SEQ ID NO: 951742 - protein, 46 aa, Homo sapiens
AIHHSAEDSEKKKILKCAQHGRRHLKQLLNRREMLMEDVGSEEEQE

SEQ ID NO: 951743 - protein, 59 aa, Homo sapiens
MSSTAPDSRWDQQAECVSCVAGTVAGDLPAAPDTAPDLERRRPPRTGSRQPAIILTGLG

SEQ ID NO: 951744 - protein, 59 aa, Homo sapiens
IAMITSLYQRNDMANVSTILFFCYLVNRIEHLSNRLRQVFGGNMHRLPPSAAVRMLRTG

SEQ ID NO: 951745 - protein, 44 aa, Homo sapiens
MHRNDRRMRFDNERSVTDALECVYIWDRDFLFLVALYGGLYGGV

SEQ ID NO: 951746 - protein, 31 aa, Homo sapiens
MRIYHMFKKELIQRHRKEPKYTTTENNQGTE

SEQ ID NO: 951747 - protein, 34 aa, Homo sapiens
MHFPGARYGGARYGGARYGSLRRAREALVRRSLR

SEQ ID NO: 951748 - protein, 95 aa, Homo sapiens
ALAIIEASAGSAEKVISDAIYETGAQNLNVPAVAIVATLRGESVPRFALGGQHAGGIRLVGENGPELEVTGPARYWSYEQTRRLMGGAFEAGVPE

SEQ ID NO: 951749 - protein, 56 aa, Homo sapiens
MSDPGAVTEALLRRRVRYGGRSLRRALVTDGARYGGAVTEPLVTEALVRALVTGVS

SEQ ID NO: 951750 - protein, 57 aa, Homo sapiens
MRTLTLRFLFGVNPVAEFCQPRIVSILIFCKPSAKIMHPVWMTHDSIFIRNLLDPKA

SEQ ID NO: 951751 - protein, 108 aa, Homo sapiens
PYERSVRTSVTAFLYRAPPNTLTSASVTALRNERLRNTSVVVVVGVVSEVVLVSLVGAVISELGAGVSVVGVVALVGAGVSVVGTVVSELGAGVSVVGVVVSGGRCYG

SEQ ID NO: 951752 - protein, 102 aa, Homo sapiens
MIARNEPPNAEISSACLSSCELYLGRSHFLWKEPRHELAGGERPRSSCKQVDAGDPAVEACENRRKVLYQRAPRNIHRHVILSEIKEAVGARYGTAPPNTPP

SEQ ID NO: 951753 - protein, 54 aa, Homo sapiens
LLEDPYERWDSSYQHEETNKLRAKLGLKPLEFNAIKKEAGTKEEAVTADVINPM

SEQ ID NO: 951754 - protein, 80 aa, Homo sapiens
ISYERHQEYGLRDSGSRAEHRVETGQARQEDSEMQPLSVSWLRSLQIDLAQQSMSPVRTQVMLHDVMPRVIFFMACIERS

SEQ ID NO: 951755 - protein, 60 aa, Homo sapiens
MSVTSAFCNERLRNVLQLMRLLTPNERLRNDASVTSASVTAPLTDPERLLEGTYARTSYI

SEQ ID NO: 951756 - protein, 50 aa, Homo sapiens
SSVTCHVTLGNTDACAQLLATTVHTAHTMPCACSVGKKLAVTSRRMSFFP

SEQ ID NO: 951757 - protein, 36 aa, Homo sapiens
PCNERILDIKGGSVGDYWNLGVTEGARKGGARYGCV

SEQ ID NO: 951758 - protein, 32 aa, Homo sapiens
RNSAIERVMLLWGAVAASRSLQIAIQRHYKTA

SEQ ID NO: 951759 - protein, 87 aa, Homo sapiens
MQMKTCCAAQQSGWAQQEAGSPGDNSTWILQETWAGFHPAGSSWADISTLQIGKGATYEVGAGRSYWKTRLVSIVTLYFPRVYAFRN

SEQ ID NO: 951760 - protein, 114 aa, Homo sapiens
RLRRDDERIASLLLQAVMQKCWPVSSVPTLEWAPQGRDRRACHCDPSRGVSLHLPRGKGLRPVLPGVVYGIKHGIGLKSRGTETSADPVLEGEETVKELAILEEGREPFRGHPR

SEQ ID NO: 951761 - protein, 162 aa, Homo sapiens
SWPADEDYWNSQNDILEAGSGQSRDRMCRHNYELDEAVTLQRKSQPRVNVSPSKKGALASHHKAACMPRRRISTQAAFKSDGPWMARRKQLGVRVHPNLDPVMEDWTFQILVMLENDPPAGEMSTPARVEHTSLGIVLSRGSGRPSLDPARYMQGVRYPGTM

SEQ ID NO: 951762 - protein, 45 aa, Homo sapiens
TRTDLSDRLDVADRLDLLLIDEYGDALKHVLLIHLIGALVDDDRL

SEQ ID NO: 951763 - protein, 44 aa, Homo sapiens
SVSAPRVSSGERSLPASMAVIACPSRRFRRWLMWWLQRQAVALK

SEQ ID NO: 951764 - protein, 81 aa, Homo sapiens
DPPVRLSSALNGNDVVSGTMAGQHTGLPAEKGIGRLEELLRRAQDDIAVTVSAEEAADQCPSICHANAHSLAERARQQLEA

SEQ ID NO: 951765 - protein, 71 aa, Homo sapiens
VVSVVILRGSRRITLSQSHSSESCSSDLRSSLHSLARRHHRQECTGGRELLYGSAFLSKHVKVKKNPLAVH

SEQ ID NO: 951766 - protein, 54 aa, Homo sapiens
SNLRISYSSYLRTSYERLAARGGDRAQLGPKDVTMLAVRRRETLVKGRSGLTCK

SEQ ID NO: 951767 - protein, 74 aa, Homo sapiens
LSHYRNTEEKKYEMLVAGHVGQQWLYQAMKQRRPRGAELAERPFPRLHQQSCVLYPAVDISVIVRRYNDFLYVT

SEQ ID NO: 951768 - protein, 48 aa, Homo sapiens
IKDLVRALYSARTASYERFVQRSYELRTSSTSFVQPSNILVDPVHKWV

SEQ ID NO: 951769 - protein, 49 aa, Homo sapiens
DVYGGSLRKGCYGGAVTEELVKRARYGTEAVWRSVTDGCYGGARYGKRS

SEQ ID NO: 951770 - protein, 62 aa, Homo sapiens
IVVSEQHCRHERGQAIVLAQWCQHLVQSIDFTQTREQYQARGWIAEPTQGIEISKGDDHLGL

SEQ ID NO: 951771 - protein, 37 aa, Homo sapiens
NELHLVQSGAVTEGLYGGVVGRVVRRRCYGRVREGVT

SEQ ID NO: 951772 - protein, 51 aa, Homo sapiens
PSHRRLLSCLALSMSLVGSYFALVEPLVAIFPVLLLAWLRFGIGAIAMLRW

SEQ ID NO: 951773 - protein, 42 aa, Homo sapiens
MTGCCAYQRCVFRQVERFLLSSAVTACCPRVSESLTRSLPYI

SEQ ID NO: 951774 - protein, 38 aa, Homo sapiens
SQVTNYLTPTPHNHGKPRHLSSEPLSRKKLTTWVRSTW

SEQ ID NO: 951775 - protein, 43 aa, Homo sapiens
LAVLAVLAGLGAVEAAVMCRRNAVSWKRRELLSGCVQQQCPGL

SEQ ID NO: 951776 - protein, 49 aa, Homo sapiens
SVTSPRNVRNSAFLQRLLTAPPNTRCLLKLRSLGARYGRYGGSLRRVPS

SEQ ID NO: 951777 - protein, 59 aa, Homo sapiens
MVTDLIKTWTLLEDLSQTPSLHLRPGEKLKHNSLKVSKPDGDACGTIWGTCFHPSLCPP

SEQ ID NO: 951778 - protein, 107 aa, Homo sapiens
LCSDLDIHCGIGTYATLVVGGCLSAAPGGHSLVLEGDHQWTQDRKPRMVSATRDEVQEKRVLCSGRIGPDAEAEALSCYVRAFRSVSARHSLTRARAWMIPLLRGTE

SEQ ID NO: 951779 - protein, 63 aa, Homo sapiens
MEQEGPEYWDRTTQIYKAQAQIDRESLRNLRGYYNQSEAGSHIIQRMYGCEVGPYVSGHGYRA

SEQ ID NO: 951780 - protein, 57 aa, Homo sapiens
VPFDRSDQAHDGNADHRAAAAEQAVDGVVGGAHVDGRGSGQQIGLDPGLVGHERAGQ

SEQ ID NO: 951781 - protein, 68 aa, Homo sapiens
PRYPNDAYKAQEKRAKGALLAYSLGATVLDSGVVGDVIWDSPAFNAGLAPGMKVIAVGGREYSSQGYR

SEQ ID NO: 951782 - protein, 86 aa, Homo sapiens
SNNLTIVNKVTLSGITDAMPILEIHISKRALRARCRDQDIPYGAAAIKGFVCCNDLKSYVICVQTGVIQVGFYLASNCSLYDRTRM

SEQ ID NO: 951783 - protein, 56 aa, Homo sapiens
EHSCQKQGVEYVPACLVHLEEEEGGPLFLFFSEADPWMAGRPQQLGTCLWLEDTNV

SEQ ID NO: 951784 - protein, 64 aa, Homo sapiens
DSRASTNIVSLESSSHGPTLPYVPWASTRCHKVTKNCEQAQCTADAAVRLTNTHQCSVRGHDMF

SEQ ID NO: 951785 - protein, 104 aa, Homo sapiens
STFVSLPITERKYIIFSLLPRLGGIVQAMVLAIPYKGHDLTMIVSLPNDIDGLPKLDENLTAEDIDGMDKLAQYERRHVSISLVTSDLKRRKRAMTSRTRDRNV

SEQ ID NO: 951786 - protein, 52 aa, Homo sapiens
EHSFPVVLVIHQVLLHDLVILIKEQIADGTGWLRLSSARRGRCFGSTGTRMF

SEQ ID NO: 951787 - protein, 87 aa, Homo sapiens
VQYDSTHGKFHGTVKAEKREAVMKWKSASRIFQERDPAPNIKWGDAGAEYVVDVTGVFATMEKAGVSAGGPAGGEADSALQRQDTNV

SEQ ID NO: 951788 - protein, 45 aa, Homo sapiens
MGMVLGRAHTDDMDYEKGLRAPLVVSSCMGSTGYVQGATYGYRRS

SEQ ID NO: 951789 - protein, 64 aa, Homo sapiens
NIVSVRDALKTEFKANAEKTSLLSQFLRCCQKSSQHLLLNSVSGGSRSSIRNSGPWLFQGAKAC

SEQ ID NO: 951790 - protein, 56 aa, Homo sapiens
SLNTVLRCLPAGPVLAGTASRVGAVGSTPHPERHERSWKTHASTSATAVYSSPGIS

SEQ ID NO: 951791 - protein, 57 aa, Homo sapiens
DPASTRTVMPPSREFDSVAKQVHKNLAKFALIGIDVLRSVRCNINDEFQPLVIGAHL

SEQ ID NO: 951792 - protein, 103 aa, Homo sapiens
SYPTGEREQEAEGLAVRGQRLLDRVLPGELLQFLGTVLGSTPGPTQPRGDLSVLRGWTSIFLQCHRWDTAIHLSRDPLLGDAAAPLLTPVQQPDPDDYLPAER

SEQ ID NO: 951793 - protein, 82 aa, Homo sapiens
SYPTTTWADVQNIRLSEISRFRKTGNAESPFYVESKKYNSQKQRVEWRLPCGVGENEKQLVKGYKVSVTQDKEDLDFQGTTR

SEQ ID NO: 951794 - protein, 136 aa, Homo sapiens
GGNFEKLKVAGNGATTTINDTIDKVDVVLTATTTVGEGGNIVYTASLVDKNGAPVTNITNPLTVTLDNGKTITIGVNQSSGSVSVLAPDDVYKGDQTVTTAIKGVTGGEHFENLVPGTTPVNTTVTDTPGTDNTTT

SEQ ID NO: 951795 - protein, 106 aa, Homo sapiens
YFFGFSFLLPGEKYMVGKPLTSYGEGTSLAVASILAMTIFGSLLSCSPSSLYLGSRFLQLTTPRGIKFNQHIFIFIIHYFIKILCYHYLHRPIIALWDRFRLQVSL

SEQ ID NO: 951796 - protein, 93 aa, Homo sapiens
LHLKPILKFHRDFWIGRGGKFVLRIIGPVAQPARGGAARVAPNWASWRSTDCPAGRKLMFRERESLNAMSFAASSLLQFDKAIPCSGQGVAIQ

SEQ ID NO: 951797 - protein, 69 aa, Homo sapiens
RAAVDRKEYQIHIPWPPRIDPPVTMRQGEEKPDATYSDVAAWKDQIENRREEVETPLLNPESFVNLGME

SEQ ID NO: 951798 - protein, 112 aa, Homo sapiens
SRESPRETDFDKGHVTVQGENKHIKGNVTISADGKFGADNTNGVNKLEGNANTNGTATVKGQNSIVNGEVTLNANSNVSAGKGKKTTAGIDAEGKGHVTVQGENKHIKGNVT

SEQ ID NO: 951799 - protein, 98 aa, Homo sapiens
FSLIERLDSEPVEVDELCRAIGRGSESPNKRSQWNDGGAVIGRQGESRVFQRVAKDDGVGVMHIVFQQQHAVNQRHCGSRRVSGVLVVGVQGRGREFD

SEQ ID NO: 951800 - protein, 108 aa, Homo sapiens
APNPKRVKGPKKEGKKQPKGAKANPEAPKDLSRGSLKENRNSLSQFSGPVGPLRLSSGNAPSFLQGPVAYGKEGETPKQIPGTGFQWKRGLPLGAIFNYSLLKPAPSA

SEQ ID NO: 951801 - protein, 86 aa, Homo sapiens
MPRTEGQEKKGFFEDRRPSANCDPFPVTEAFIRTCLLKETGDEPFQYKNKRPRPPVVEPFLVFNPTPTLPLLPVVPIVIQRVEYHG

SEQ ID NO: 951802 - protein, 69 aa, Homo sapiens
YKIPEIGEVLGTRLAERGFDKAYEVPGQVLVLKKDEDLFREWLKDTCGANAKQSRDCFGCLREWCDAFL

SEQ ID NO: 951803 - protein, 126 aa, Homo sapiens
KNSIAFTPSEDGQYEYFLDRPAVRNEIRLNIIGHGDKGGVTFKSELKNAQSYSPEAFVGLIAPMLEKTSASQIRMISSKSGSTGFAEELSKRLNVPVKAPVGTVTQFEVMKDRYWILEKLPTHVDP

SEQ ID NO: 951804 - protein, 34 aa, Homo sapiens
MLDSIEKIYSYYEISYRSDRRFKLLVLYTGVSAI

SEQ ID NO: 951805 - protein, 107 aa, Homo sapiens
MALEIILLLIEWQISRPSGYEDSANEAGAAMAWKAKQLIRTQFHLPLSTSLLAKELHCNADYLGRVFRRTFHLTLTEAIHRQGVRAAEKLLLNEAASLTEVATRCGF

SEQ ID NO: 951806 - protein, 137 aa, Homo sapiens
IATPYTVLHQPQDQLNPALPADQGRTKSTIPSLSLRSDEEKSSATQTSNLARTAGQRNRRGEAMAEEEQQPTAEALKQRRKREKAAAKDAALGVEKFTVEVAGIFKGDLRKVMKAHGINNQQDIHQRLIINLIAADF

SEQ ID NO: 951807 - protein, 56 aa, Homo sapiens
RHRTATQPRRITQADRMHEMIRETLGSRDSLLLLRNAREMALGALFATLSSSYHLL

SEQ ID NO: 951808 - protein, 141 aa, Homo sapiens
ATPYVQEMSLEDELQALLKCLRHKGTSKPQTAAGEGLPSVLQQLRQIGGMMRIRTGRLSVFNAFEPADTRDIFDFHHWAQTNLSPVQGAVISILVPAEGSLMERFFSWRNLEHCPSHGSIETLVLCYKRCQLTEGNVSADV

SEQ ID NO: 951809 - protein, 141 aa, Homo sapiens
IATPYPRNEVWTSVQRSNTQLSSAMRDRSTPLKSTPIKRKGPLCRSIKSCSSSRCKALSATSVYCIGASGEAEKRGGDSNLPYPQKTRQGAGFSARGKVLLQNRTRCAKADRAVRLFLIQYTHCHERYPHRDRIYRHLNPR

SEQ ID NO: 951810 - protein, 127 aa, Homo sapiens
SDTVQNITAYYRQRLDEILEDRPDLARASSGRTAHFFLPDPEKTFHRGSTDYFVSDRKIDIGAFDTPTFTGLPVGTVEKAGKRDLQVVTHEPLSNGDGLNVLIKREVVGFRANIAEPKGEFEEDGEK

SEQ ID NO: 951811 - protein, 95 aa, Homo sapiens
SDTVPKRSHYACGACGTVQDVLTTVKATGKTGPMAAYAVQGYAPKRGASGKPYNGRFFAAYGTAQAQQHDTALAEWEARKDADLKEYWPRSELPY

SEQ ID NO: 951812 - protein, 93 aa, Homo sapiens
IATPYINEGLTQEQVLAAALSHNPNDRKTAQMNQVKHLFTRYKMLALVIAVAFIWLFFSWQTEGGFLTPRNLSNLLRQMSITGILACGMVLVI

SEQ ID NO: 951813 - protein, 119 aa, Homo sapiens
QSECEVYSMAILLREEGLLERTIGYATDINPASLDKAKQGIFSLENVRAYTANYQQAGGQRSFADYYTAAYDYAIFDKTLRENVTFADHSLATDSVFSETQLISCRNVLIYFNKKLQDR

SEQ ID NO: 951814 - protein, 79 aa, Homo sapiens
DVIVEEFFHAPAVAKSACNATAFAPSASIAATVAFASAWLEAAVVVHDHSLGAMLGQIAGDQPAEVLRTTRDQCNLAVD

SEQ ID NO: 951815 - protein, 84 aa, Homo sapiens
QSEWPIKDFSAICPELKAIFSELRAGFSFQKPWGLLHFDPVDYPIAKEELAGFQKAAMQSGVSFCFLSTWEQRHEDKDLLEMFK

SEQ ID NO: 951816 - protein, 113 aa, Homo sapiens
YRVNVSSRHLAIWSYRLLNTLAKRQGADLVASVIYIEIKRAAAVRRLANSPVSWAKGQDSGGGDLAFPFTTDECSAKVLVKRRIASWSSFDIARKLPNTFSSIFAQLSSWIGV

SEQ ID NO: 951817 - protein, 95 aa, Homo sapiens
YRVKVVSILGITGRQSECDELRRGGIQMVAADLVNDSIDQLAKVFARFDTVIGCAGMIAGRETPMKLATAALKSGVKRYFPWQFGVDFEVIGRGS

SEQ ID NO: 951818 - protein, 84 aa, Homo sapiens
QSEGVHHRGFPFKEGFAVEGQGRAAEHQAGDEGEPLSFFQLALRDEDGAVHYDRADEQYGSGTVDAPERQLVAGDFDDPEVEFG

SEQ ID NO: 951819 - protein, 95 aa, Homo sapiens
YRVNVSFCVDAVDEYSVTSVKLTLVIASVILCWAYSPIGVHMGLHCYSPGQLALLRFLIASVFMGGVASVLEIGRPPLRDLPWLFVLGFFGVFLH

SEQ ID NO: 951820 - protein, 90 aa, Homo sapiens
MNVNSTNTCQTSAVNNGAPWGSTAQRGDQIGQPRLGVSFRGDAFAGVQAQHRLHFADAQFGEQFAHLFTAATEGIAIAGVAQADDRSRQA

SEQ ID NO: 951821 - protein, 78 aa, Homo sapiens
QSECAFVLFAFVSSITPGPNNTMLVASGVNFGFRRSMPHALWISIGFMLMVICVGLGLAEVFKLFPWAYTLLRYDGAA

SEQ ID NO: 951822 - protein, 99 aa, Homo sapiens
YRVNVKINAINSHKLANLSPLSRRGVWLKRSKMALTNDDETWPGLRRRRNPDTQTRAVHPHLPATYSLVRSPLAPAVPPLPMLVLVLVLVLVLVGVSRH

SEQ ID NO: 951823 - protein, 45 aa, Homo sapiens
YLAVTSSVGTVIYFFPTESTLHSEKLHRAHRIAGSDSRSIVQYSP

SEQ ID NO: 951824 - protein, 41 aa, Homo sapiens
GTRLLIQSPPQTTHHSLQLLRRCRFHSHRLARHQHHPLDQS

SEQ ID NO: 951825 - protein, 69 aa, Homo sapiens
RSLPSTMSSDSVRMYCPLQYDVQNVDCRVKMTSSFLMLVISLISLMVICGLSPLSDFSPIRISRMVWDQ

SEQ ID NO: 951826 - protein, 100 aa, Homo sapiens
GPCASVCLCSSPGGTTTVPHFWKVPSAAGLHYTGSILCHWSYPSRQHPSHINAEAQHTAQHLRVASWSEMGGGQRVPLEDLRACYVSFPFSKYLRSNSRH

SEQ ID NO: 951827 - protein, 103 aa, Homo sapiens
FELGPVCVGVCEYDSTVDELVLLLQQVQVGGVVHEAAGILIQGTEVRPQPTRQLNGYAPDLLHLGLDPGPHNIGRADELPAQELRAVASASHSPRICGAARDT

SEQ ID NO: 951828 - protein, 67 aa, Homo sapiens
TSSLDPSACLRFQRSSTDGLRCNTPDTDLRSGSAQSGGVHWDRGHSESGGSSNASFPDRDPHAGQNS

SEQ ID NO: 951829 - protein, 133 aa, Homo sapiens
MSVKYSLLLTTVEQTDRRAFHQVQDQLGNGAGAADTRRVQTVQARAHPVEWTEQGELQALVAVGPDHAVQQLLGDGVDPALLVDRAHHQVGGVFVEILVLAHAIDFGGRRENHALVVLDAVAHQLEVSSKPVR

SEQ ID NO: 951830 - protein, 123 aa, Homo sapiens
MANFSTFYYRAYDSTLSLCLAAEACWQEERAQWDKHFIQTQHWTHQHRGFSAGEALKQNLLSMSNAYVTHNERLLEITKTVSLRHLHSQDPMATRDMPAALKADLVKTGTLTFELTLKLFDDD

SEQ ID NO: 951831 - protein, 39 aa, Homo sapiens
MTERRLILHRGWLLLLRTIYRGLTWYEVFSQEPDIGSPK

SEQ ID NO: 951832 - protein, 138 aa, Homo sapiens
HSAIGAVRESEHRLSDYWCGSSWPSSVGPWSTAMEKDVLALRMHPKGSATRERGCTCSNLYFSSRFYKIKSLKIEPWVMWWWKNTLGCFILQAGCLPRENGRTSRGTSAPWSVSRHLENQSVIITRKSQLTEDDMDKR

SEQ ID NO: 951833 - protein, 129 aa, Homo sapiens
PTYRYLEQTDITVPAMHSLLSALSIGQRWTTSRVRSQNKSIPSSTKAHAIDMRVRALLNIKVTQPVLFSIPDMTIYKHQYCFTDLHPLCNPMRRSVTAAWILQPTLPRFTRDAFSQVLWSKKSEGFQEP

SEQ ID NO: 951834 - protein, 137 aa, Homo sapiens
TYRSGLSVFDDQRLPVSIQVVARRRRHAQGLGAIVKKGVAGRFEYCRAPAHGYARQALYGSKLGRIKCQPIEKACDETGLDQYVPGFAPHVGQGQAVFTAQPGEACEQLIFAASVQLPAAQGVEGLSDGYLHVHACL

SEQ ID NO: 951835 - protein, 105 aa, Homo sapiens
MPLSVSNFTVDVQRMRPARGTRETILKSKATGLPCQIEKYNQVKHNHAPVHVHPLPTYSDETQHPGGERKLREPGAARECGQRHPLQQTPAKVGATGGEGLNGSA

SEQ ID NO: 951836 - protein, 158 aa, Homo sapiens
PCELSYGSYDTAGMAFGLNHALTEPGAEVQHYARLDVSRNTNHSYIDRDQRDAWSVAFSLLSDLTPNLSHTLALEYQDEHEDSPYWGTPVLNPKAGELKIDKHNRFNNYNVADGRYEQRTIWARSIIDYRINDNTTLNPLSYSNMFTMLPICNLCFNS

SEQ ID NO: 951837 - protein, 45 aa, Homo sapiens
YRDAGLTPIPGQVLRIQQVRSCDLDHNCGWDLIAGRELHMPRDRQ

SEQ ID NO: 951838 - protein, 103 aa, Homo sapiens
RLFTDGLPHIRVTGLADALQVVSRDVTTTFERIAWYAHDIAWIIALLLCNGVALWMGFCLFDIAVPLLFSVLLARLYRLSINELYRTRVESVKGFDSLLRSAH

SEQ ID NO: 951839 - protein, 135 aa, Homo sapiens
YPVFGKNSAHSAHIIFVGQFYRVVLRELHSLTGIIHGNSLKGGWFRPAHSDHGRTPPSPPFPLVSEQHNAIDHSAAVFEVHHFERQFRNRPVECQNPRLHQLTLRGVLATSVELDGVQLGIRAGFADDVAKLGDQ

SEQ ID NO: 951840 - protein, 51 aa, Homo sapiens
MGLNNQWMQRDLAVLWHPCTQMKDHQQLPLVPIKRGEGVWLEDFEGRYLDA

SEQ ID NO: 951841 - protein, 50 aa, Homo sapiens
DVYLRTSNLQEADVIFLDTCSIREKAEQTIWNRLHQLKACDKLKEVKEKS

SEQ ID NO: 951842 - protein, 43 aa, Homo sapiens
DPASIPSEFVKCKHHGFYGVFHLEGILVWSDEALDEARRTLGE

SEQ ID NO: 951843 - protein, 35 aa, Homo sapiens
NRNFSFTDFMHPEELEFMKEIVVLETLEDIDKNGE

SEQ ID NO: 951844 - protein, 61 aa, Homo sapiens
MKLTHNHCTDWHLSTVGREEQATMRQYEPASKPRFYCSGCTIDFLHHSDLLSTLGSVLCKL

SEQ ID NO: 951845 - protein, 87 aa, Homo sapiens
PGPCLVQALSPRRCVKDLLLSIAGGRSQEKRALALVVEEKTARRSGPEHRYRNGGSLKVRSLRELQTIALGAQQIDGADANLQVLGD

SEQ ID NO: 951846 - protein, 118 aa, Homo sapiens
GLALINGPAFDIPTLAFLQYTPLSKTLRLSRTPGNRIVYLYTKKSWESTKICMLCVPRHTSMGSCCMTYSSYEIVHQQRNMSAGSYGGSSVCYNVFVTRINLFVLIEEQKIVVKVLKP

SEQ ID NO: 951847 - protein, 38 aa, Homo sapiens
DVMNVHINAAHNWKSLGSSLLLAGFNSDHALESPQHLL

SEQ ID NO: 951848 - protein, 38 aa, Homo sapiens
LAVSWQLGIISEADQSRLTSLLEETLNKFNFARNSTAP

SEQ ID NO: 951849 - protein, 110 aa, Homo sapiens
YPTIRLENDVFALCSRDRRDTYRVRPVTMRKDDEVEVYVDTIRVSHIGNNSPTFTGQKYFIYFERVQREKANGTTVHDGVHPSIGSLNAESLTEGNSAIIVDMIVYRARP

SEQ ID NO: 951850 - protein, 74 aa, Homo sapiens
GDVAVAPKLAIFSPEWQQAILSGEHFYIGGLIVASSSDRIRMKGPSFSGHKSRGICVSGATPKPASKRSFSGAS

SEQ ID NO: 951851 - protein, 72 aa, Homo sapiens
TRGLAGFDGAAGKQGASDRGNQRDVIPDLEHLFDVQRGEAPKAFGPLVKGVQAIAKVTEDALDVDRFHVHWR

SEQ ID NO: 951852 - protein, 38 aa, Homo sapiens
VTEAWDENLAGGPSSPLRKAKRARLCSSSSSDTSSRSF

SEQ ID NO: 951853 - protein, 33 aa, Homo sapiens
LCACAVIIGFRSKIKALAHFLPQGTRYTLPYEA

SEQ ID NO: 951854 - protein, 87 aa, Homo sapiens
ALHRYEAKKKNLLLQFLMDSSMSFSERSSSSNLLRAYWAASMKSLRLLAVGRHFVFLSRAGRLGLLPLHLGILLLLLFFSLFLYVRV

SEQ ID NO: 951855 - protein, 41 aa, Homo sapiens
MPQLSDQSCACSVISYFSFSVSKISPSWCLGFRSFFFLKNT

SEQ ID NO: 951856 - protein, 48 aa, Homo sapiens
QWEWNLAIKKEWTEECIQPLAPPLAPGRILSGVIQHPGPSSLVHSVGP

SEQ ID NO: 951857 - protein, 100 aa, Homo sapiens
DLADRALRISQLVCADSGILQTRIISHYERGWITGSKGGHSEEKMEGRQILAVAAEGSMDMARGVKIQDIPQVLPQPGLHAEEIDVKVIVAAGPCYAGAL

SEQ ID NO: 951858 - protein, 39 aa, Homo sapiens
MKQSLRAIIAYSRPEGRSEDALKTLVWSGVEMTARAYTV

SEQ ID NO: 951859 - protein, 66 aa, Homo sapiens
TDSLIGVNEVDPHTNCVMRVIGAEMLLMSCSCLLLRVVPPAQQVSVVTAVSSFHAAEGLPYIFLKN

SEQ ID NO: 951860 - protein, 48 aa, Homo sapiens
IIFTVTECHVIFICSIMKPGAEFGLRSPLALPCALPVPVFKISLSRES

SEQ ID NO: 951861 - protein, 71 aa, Homo sapiens
SRTRSVSKHFALLEHSREHVQGQILSSPTTPRIKLRYSGINSSQLSMMNTRRHIEFDVVLFLLVLKQVQGS

SEQ ID NO: 951862 - protein, 144 aa, Homo sapiens
SVHSTPLHSTQSTPFHSIPVHSIPFYSIPLQSITFHSIPDFTPLHSTPLTSIELHSISTSLHSTPLQSIYSIPFHSTPFHCIPFHSTALHSIPHKSSPFYSIPFHFTLFHSSPLHSIPLPYTLLHFTPLCPSPLPSIPLHSTPI

SEQ ID NO: 951863 - protein, 91 aa, Homo sapiens
PLNGRNGQTRLYHHLVMVKTSPVNRAREALLKTTQFSCTLAQQKFELKPLAAWLEHNSRLVLELVLRLVRLRFQRSRQVRDGDKKSHQVTN

SEQ ID NO: 951864 - protein, 39 aa, Homo sapiens
GNLMWGPLMSSKTSCDSNYYTNVRLQGGSTRTIVHVTAS

SEQ ID NO: 951865 - protein, 33 aa, Homo sapiens
MPRHTLDDPTVQGTHHLGVIAGQVEEGTVAQHD

SEQ ID NO: 951866 - protein, 55 aa, Homo sapiens
ARPRDDALHYTPSLVVPERAPNYISAVRRIWAGNEPGVLPSSLRRQGINPRAVLE

SEQ ID NO: 951867 - protein, 66 aa, Homo sapiens
LISSTSSLGGCCPASRLRAGGAPRRLVVERRMAFGRDYAETLRRWRQSFEERLEAVRAQGFDERFV

SEQ ID NO: 951868 - protein, 45 aa, Homo sapiens
DTSGHPSIPACQQLLAGMDTSMLAAVRHASRRNQSQAAQQSSTAV

SEQ ID NO: 951869 - protein, 67 aa, Homo sapiens
IQIVTPEVHEGHPLNYISGGSATSDIELSRVTECMGLRRLYVIVVDDRKTRPELVPRLRDRGTAVPE

SEQ ID NO: 951870 - protein, 72 aa, Homo sapiens
MAGQAYRKFLPLFDRVWVERSAAETVTKGGIMLPDKSQGTVLPAPVVAVGSGSKGQGGEIHPVSVPVGDTVL

SEQ ID NO: 951871 - protein, 78 aa, Homo sapiens
YGVQVLLPQTLSESTFDSFFSSFTKKTVSRVNLSFFLAVSSSTASSSENATLRFRLRVAGESLMGDSVFFTTGVLMTL

SEQ ID NO: 951872 - protein, 73 aa, Homo sapiens
MATASANGSAIAPLIGKRTYRLYCFAGAFENLQDHRAGLVGQLHTLGGAVAGGVHAVDGLAGFVLDHGDHAPR

SEQ ID NO: 951873 - protein, 60 aa, Homo sapiens
SPAQATITYSAPSNTYIVDCGSPVSQRALITHHEQPLKDWAQSTVHEAEEEEEGSVTIVL

SEQ ID NO: 951874 - protein, 43 aa, Homo sapiens
PSPDRCGLEAFAVDDGGARLVVLLLANPHLLVEGGCGRRLVEG

SEQ ID NO: 951875 - protein, 55 aa, Homo sapiens
KILVQGRHPPDQQRLIFAGKQLADGRTLSDYNIQKESTLDHCAPLLEVGCRSSVK

SEQ ID NO: 951876 - protein, 42 aa, Homo sapiens
MYYAVKPTGFAPFGNLWITSYVPIPTAYRILSRPSSPLRAKA

SEQ ID NO: 951877 - protein, 65 aa, Homo sapiens
TYCCVLQDFTPVPDSYDVIWILWVISATYTDQHLAEYLRRCRGGLRPGGFIVIKDTLAHEGSDFL

SEQ ID NO: 951878 - protein, 43 aa, Homo sapiens
TRSNKKSSDFEKINHIDQSLAHYVDKDTRNVTGKKDWTFTQII

SEQ ID NO: 951879 - protein, 68 aa, Homo sapiens
PLHENAVLALAQIENSAAVEKAIAHYEQQMGQNGAAAHGKPQELLGPCTGHSAETRPLNVFYERTSFK

SEQ ID NO: 951880 - protein, 43 aa, Homo sapiens
LTGCMWLPVHQTLRTDANATQAVGAGESSSPAPGSELCIRSPA

SEQ ID NO: 951881 - protein, 38 aa, Homo sapiens
MWSLLCSIVCYVLFSHLSQKPKYYTTTLPPSTTSSRTH

SEQ ID NO: 951882 - protein, 50 aa, Homo sapiens
RICKRFFILLYLFLKRNYDKIDVVFIRHHTSAREVDEEEFFYSAAKLDGT

SEQ ID NO: 951883 - protein, 193 aa, Homo sapiens
GSPASHQVRDARVGVDHDLSSQAHLAGCVGLLGTEEVFPVGPMVIAQGHAHRGIGIHHLFSGDDFHLVGISVQGIRRRDTADFPVIGLDQFEGPLGASGNGLALVLFFGGHVTNLLLEEFTEDRVDIAGRDQLLLGERVGKCFADALVFEPQGLVLTGGDFDVSVVLQNGMIWLIKMSRQIGESSFQLFASEA

SEQ ID NO: 951884 - protein, 41 aa, Homo sapiens
MGASVGFISDGATSVPMFEWTMQPGDLSCCGISRDAPGQGA

SEQ ID NO: 951885 - protein, 76 aa, Homo sapiens
SGLEPSYIPRLDCACSSKPERVIGKIKQLTSGGYFRVDQIASLVIAVFKRKLHDSTTSCNVKLKRSDLLEQQSRAK

SEQ ID NO: 951886 - protein, 38 aa, Homo sapiens
SNTKLKEHDGTSNYECTARVTPSMLFIQKTDTLDHIRT

SEQ ID NO: 951887 - protein, 112 aa, Homo sapiens
MATYKVTRQRVGHRPSVMNRAVTHCAYMDKSAALIDDEIRQPSASRYGSFAEWVLAPAVIAALLIAIIRLEATGQAARLLWSILLASFCVGLLVVAYANYTRQCRCLAIVRP

SEQ ID NO: 951888 - protein, 128 aa, Homo sapiens
MPAGVTFLSLGHRDILIYNDLKLAVSRCGEDGPWVLLVRARAIHLQHLHVEDDALVVLLQGVQLSMAHGAVFTHLCNTASVPMALQGVLAHRDVAETLGHQRVQDHMLDVTEELGIYPSSMVHTMVYH

SEQ ID NO: 951889 - protein, 162 aa, Homo sapiens
RDLLVQLDPFMGPRLFLHLQGLEAGNGIEYLAAVCFTCPWRYNRLPYWWISGTAFALSSSAMAHGSCWYVPGLCTFSICMCEDEALRVLMQGVHVSMATELCSRICATPQHEPLALHGVLAHRDVAETLEHQRVQDHMLDVTDELDNLPFSHGAHDGLPHMQ

SEQ ID NO: 951890 - protein, 38 aa, Homo sapiens
ARACYEAGERRKGTDVNVFNYHPYHQKLFTTSQSVSEI

SEQ ID NO: 951891 - protein, 58 aa, Homo sapiens
MPVSTVLPPPLLLAAAGGGGLKQSRCPPQAWKSALPMVPSARVNPRLGIQVHLVPNQK

SEQ ID NO: 951892 - protein, 68 aa, Homo sapiens
QKDFILVQNLVDLWHHILAVYQEDVFDRIRKATCSTARPSVYLIFSPLNIRSRAASTPLDSAKSTSIR

SEQ ID NO: 951893 - protein, 57 aa, Homo sapiens
DWQMGFLQKYATPLIPSRGEVNAADAFDIGSFDEEDTKGIKLLDSDQELYRNFHVTI

SEQ ID NO: 951894 - protein, 33 aa, Homo sapiens
EIKFWLCPPNGIAGANSRFTQTSTFLGLKLILC

SEQ ID NO: 951895 - protein, 31 aa, Homo sapiens
MRQGPTHPSGSLWDAGPFCPSVAVCPEWVRR

SEQ ID NO: 951896 - protein, 132 aa, Homo sapiens
MQSLSIVVITPPFSSGIILSHSHWIDFAVYKLLTGSSPRVAGWWAPNDTHAREVGILPKVVYGGTVEDLACSDPTAKELERRTQNGLLSCISVKPLSLATDWTRRECSRKEQRQANGNVAWAHCAGARRDPP

SEQ ID NO: 951897 - protein, 97 aa, Homo sapiens
GDSEDPTKCNWPSEEMTYITHDIWEMTPLEHAVYFHSLVSSPVSFHIMIVLSREAERIMLRDLRGPSDLGYPAVVALEGATKGHLLSHPRRDWDPPW

SEQ ID NO: 951898 - protein, 135 aa, Homo sapiens
NTAVHATFSCRFLRYTPLDGPWLTFDLYPHVVCFLKSVDEMPNGANDIACPLTTLPEENYQSASFPDQLFLVQISAHSDQNKMTNTNLAVVFGPNLLWAKDAAITLKAINPINTFTKFLLDHQGELFPSPDPSGL

SEQ ID NO: 951899 - protein, 138 aa, Homo sapiens
QLDELEQWSARMNVSAAVSRLRFTFSESIQAKNRRNALILFCTEKRLPPPARSSVMCSCSCVTSSKRSGKGLPSSPCAIWRPTCFTFAAAPPRNSSGRRSQGVSVAPYSSIGKVRSNSELSIVPRPSADPAKCRHEAI

SEQ ID NO: 951900 - protein, 38 aa, Homo sapiens
FLRLFQRIPVKPQACLTPGGSQSHVQVVPPDHTAVGTV

SEQ ID NO: 951901 - protein, 79 aa, Homo sapiens
PGVQPGPQRWDGSRLQLRKRPVSSDEGSKMPRAFLGEEAVRLHVQEGKLGQPMLPDEERGEIYVPVSLGFVPNHSPYRG

SEQ ID NO: 951902 - protein, 197 aa, Homo sapiens
LSPGGSGGMALEELLVVLPVEVCLFGLPRISLRDVRTDTGNELAKKPSVTKMFAAIPTTNPSTMRMSIVISYGPFSLSPADRTCEIPSNPLSSDGYPNTQIIKMPQNARRPSHFLAFDMKEEKSLCFSNEDELLSTTRMIADRTVDRIEALPATGNCERSLGNASPNLRSSDAFACVLVHTTRQFRYVTTWLRDRSS

SEQ ID NO: 951903 - protein, 42 aa, Homo sapiens
MIPDTALAGVMQAWVPRFPAWSRARTWETFSETLRAHSMNSF

SEQ ID NO: 951904 - protein, 36 aa, Homo sapiens
TTAGHPSLYCVRVIVSDVLPPSSRVCVSSVRVIVYH

SEQ ID NO: 951905 - protein, 98 aa, Homo sapiens
DDITPSGIEYLLCVVNQLTQGHKKRHCPYAGGPLKFVGYWTHDTSHAPFEVVVVVVVEVRQWVVMGVTHSIVIVRMLGKKKTLWDIFIRELGGVEKGI

SEQ ID NO: 951906 - protein, 48 aa, Homo sapiens
SSSSRSNNNNNNNIVTMLAREASRTHCSTVGKQACSKPRQATASLLNL

SEQ ID NO: 951907 - protein, 33 aa, Homo sapiens
DNPDDNNPDDNNPDDKYTRTTSNPDSTITRTYN

SEQ ID NO: 951908 - protein, 108 aa, Homo sapiens
TRTTLPGHNNPETISPDDTNPENLPHDDNHPNDNNPDDNNPNDTNPDDTNPDDNNPDDNNPDTYNPGHNNPDDNNPDDNNPDDNNPKRTITRTDNNPGRQITRDDNNH

SEQ ID NO: 951909 - protein, 70 aa, Homo sapiens
GITHVPDKIRTKVNTNQTQKWRAREGGLIQQEGGRAGGAGRTGGAMEHGLEAGLTGGSAGVRLECKDVPD

SEQ ID NO: 951910 - protein, 151 aa, Homo sapiens
RDTTVLGYCDRNVQLLFARLSGDLARRALVSIVVHVSPSLQLVPADSSQPMVLERGRAISALKRHRELGQEHRIMGEHQNLAGLSPALTKRRAMARRYPCSSDVHRIVEKYTVDTYVGQEFEARRGNHSHPQSALVALLTATMKAFARDPC

SEQ ID NO: 951911 - protein, 171 aa, Homo sapiens
DTYTDQLRHHNLTGKAASPIDHSAQILSLFATQVYSQADNGFFPLAGDRIVTVFGGQAFCIDGRVLTEEANFLGGLRLFKLLVQLRSRSQRVKKRYLQMKTKSASLNLSREKPLNVDIDQLRVRYLHLSRAVVADIRVKRLITPLRMYLRPGTSFSFSLELRHGRSGDWRP

SEQ ID NO: 951912 - protein, 64 aa, Homo sapiens
MQYLIPVWCSPGGQEENMQPYSDFGHHQRQRCPEHGDQGKLFHDMQHLVLGVVPVTDNRIVCVR

SEQ ID NO: 951913 - protein, 36 aa, Homo sapiens
TNPDDNNPDDRKPGHNNPADYNPDDNNPDEINPEDE

SEQ ID NO: 951914 - protein, 34 aa, Homo sapiens
TSSLVWVIVVRVIVLLSSGLLPSGLLSSGCISNP

SEQ ID NO: 951915 - protein, 38 aa, Homo sapiens
MDHSPTHDRSRYYDDGSGASRYYQMNAINRTVEAVARG

SEQ ID NO: 951916 - protein, 66 aa, Homo sapiens
VTTRTQTNNPDTITRYDNDPDDNNPDDDNPDDNNPDDNHPDDNHPNDNNPDDDNPDENNPGAISTR

SEQ ID NO: 951917 - protein, 38 aa, Homo sapiens
SRLTTSMVQIPILSKIGAYHILGHTLPFQPSSLTTMSS

SEQ ID NO: 951918 - protein, 108 aa, Homo sapiens
MPSRKRKDNKQTPDSFKRFDEQGKLIDGGMMALHVQQDISSIQDDVTSGSTLDRGFLALSFTLEAYWSYEPKCLEATNEYPWIADQLLKSGQDMLQNKAGGQRKSNDK

SEQ ID NO: 951919 - protein, 76 aa, Homo sapiens
YPSNWPRPTGPQPKPITQVTFYQNGIGTGYGGWYQQYIGKYVSGATGEGLAFNIREAYNFICSNYHRDDEVILLGF

SEQ ID NO: 951920 - protein, 92 aa, Homo sapiens
HTQQPSRTFILVEPLPCAWLLEILPVWVGVEGLSDVLWFSPPRVALIQQGEGATAGKGPLKALSKAPGNTRMYSEEVCALTTAIDIEECRHL

SEQ ID NO: 951921 - protein, 55 aa, Homo sapiens
TSVPRVMPEMMRLRRGKLGLRGGVAERVLTHDQPLVGQAVRERQVSLRIDAVEAN

SEQ ID NO: 951922 - protein, 33 aa, Homo sapiens
MRQCNLCCKAQSDNVLKCHVLNDVLKYTVLNVT

SEQ ID NO: 951923 - protein, 54 aa, Homo sapiens
MYTRVQRQHRHFLAERKDRNTGEFGQTTPSGTGVTFYDRLAEICRRVPEERLTR

SEQ ID NO: 951924 - protein, 43 aa, Homo sapiens
ISTLSLQHGSILRVGSIETFLALLNDLHIFWYLNVGSLIQEFN

SEQ ID NO: 951925 - protein, 106 aa, Homo sapiens
KGNPKQHTSLHALTGVGVKKVTVLIDLGFHWQPWEGGGGGYGTVKVMNTPQRRKRRPEALSWLASATVERSFCLDQYTVTLMHLTLKIGKEEAVGFTHTVKREDPK

SEQ ID NO: 951926 - protein, 87 aa, Homo sapiens
CRLWRRRLSTIVGFFLCTDPYGGCNLEACQTILVGRISEWYIGVDMIASTLGDPFYDDGPAYISVEHCDALSPWIFVEHGDDYVGCF

SEQ ID NO: 951927 - protein, 99 aa, Homo sapiens
PSTQTLGYVAHSGRKLIVSESRSLLPTRYLNEERACAGSPYLVSTGTEVKSLGEGETEDERRLCRDPHPGLQKGGVLPRTGMTGSILLTTGCAHKSLVQ

SEQ ID NO: 951928 - protein, 59 aa, Homo sapiens
LECEVEWTTTRTTVSTLARVELRLVRYSNQGSGSPSRDNCNRYAERLAVVGIVEHLLLD

SEQ ID NO: 951929 - protein, 63 aa, Homo sapiens
MMQLSVRCGWSAQTDNGSNWLRVTCACSNSNQGIVLALEVELQPRPERLDVVGIVEHLLLDMV

SEQ ID NO: 951930 - protein, 39 aa, Homo sapiens
DYIGSCAIRCLALADFAAAAPDIYSIEDLAQLIHDLKNV

SEQ ID NO: 951931 - protein, 54 aa, Homo sapiens
NRLQLRAIQWDSKLTATYSPEKPRNRARDNIAVITNNQPGSALLPGFKRHHTQP

SEQ ID NO: 951932 - protein, 63 aa, Homo sapiens
TLTDNSSVALAQRRRWQLGLTLQRFIQVRKLLPELRGLFLLVDQTRECRITSASVSTVKANVG

SEQ ID NO: 951933 - protein, 36 aa, Homo sapiens
QQEQLWGQLQDLDSRLRAGSSEFDSEHNLNNAMKGT

SEQ ID NO: 951934 - protein, 54 aa, Homo sapiens
LSTGRISCLPVSVLSKGLVFIQGQISRGSRARASVQVSSSYYKGEKCSSSVTVR

SEQ ID NO: 951935 - protein, 40 aa, Homo sapiens
MLPSRLLSRCRNHAGAPRIVPSTPMSPMRWELSSDKVRVS

SEQ ID NO: 951936 - protein, 41 aa, Homo sapiens
WLVKIVRSLQHFSAQRIRRYKWGRISLRTMFLPINIPENVH

SEQ ID NO: 951937 - protein, 46 aa, Homo sapiens
TEGCRAEDDLRFEVSGLDLDDVTGLANRHFGAHGCGQIDALPSTRG

SEQ ID NO: 951938 - protein, 58 aa, Homo sapiens
MPISLVRDTDDPNAESSVRTYIDQICLFLLSVSIRGRILSGVVTKMKMQRTIVIRRVQ

SEQ ID NO: 951939 - protein, 64 aa, Homo sapiens
NGIKAGFNANGRTKYMMQPYKVWPASGLPFPQTILWGTGMLFGGITRGLLQGSWPDSIGIGVHL

SEQ ID NO: 951940 - protein, 55 aa, Homo sapiens
MPIMGCAPADCSRLDAPCWFTVTLVNYSSRGVRSEIVPIWKRTFLSLSDLFPTRA

SEQ ID NO: 951941 - protein, 53 aa, Homo sapiens
SPEAAVFSKDAGVLESTPAPQSSPASMETPPELPILPHHTWSGSSALAILGGV

SEQ ID NO: 951942 - protein, 72 aa, Homo sapiens
FTYVTRSLAKYVSGKLKFLGDVWNIKSNIAQVKRIGICRNSTVSSGGNMQTCAIADVHLLRCRGERSRDVKA

SEQ ID NO: 951943 - protein, 38 aa, Homo sapiens
RSETHAALLWHGKAIRPSSAICPGLLGVATFLDDAARV

SEQ ID NO: 951944 - protein, 36 aa, Homo sapiens
SRCRTWWMAGDNRSKFSAFLPTSFGGYKRGRGSIVG

SEQ ID NO: 951945 - protein, 35 aa, Homo sapiens
MGGVSHGKGEVPEARPRLIMLHKGAQTGGRAQDSS

SEQ ID NO: 951946 - protein, 64 aa, Homo sapiens
MERTQAQLRDAVKSLLVYSKDAGVVGVNPEPLKAPCLTGDKPELPILPHHTWSGSREIAILGGV

SEQ ID NO: 951947 - protein, 72 aa, Homo sapiens
GITPTALFGRQPLCHSLQHMCGGYPFLGDEKSMVMLPYPVTKILAEVEWHRCCHKYLTRKPRRKIQGASLYR

SEQ ID NO: 951948 - protein, 47 aa, Homo sapiens
YTERLEEPLSLGELDTYAAVSVLPFFDPDPHIVYLCSMGDSSIRSLE

SEQ ID NO: 951949 - protein, 37 aa, Homo sapiens
LDNVLVYFSPPSIVIPRGNKRGDTYFVLNELCMVIVD

SEQ ID NO: 951950 - protein, 42 aa, Homo sapiens
GNKRISPPIRLGRNHRLISFQTKRIYNRWNPIFFHCWLFVMG

SEQ ID NO: 951951 - protein, 37 aa, Homo sapiens
MHYGSGDDSKASIAASSICIPKDILDPPCDPFNPVVT

SEQ ID NO: 951952 - protein, 90 aa, Homo sapiens
AVGARERLAHPGSGSSVLLHSPVCLSPLVLQVPSGPAAVSQDVGSGDAMSARGRSGVEPTWLLAGLGASPANLWVLLRLQYGLDGPTRAI

SEQ ID NO: 951953 - protein, 66 aa, Homo sapiens
RTDSRVLRHNDYQRDNPSVKQDKKIDRGKLLRHSHYTILCGAAAYGGVTILRMSARPVELSPSSSM

SEQ ID NO: 951954 - protein, 60 aa, Homo sapiens
LKEEQRKLREERHTEYLKMLEEREEALEEAEELDRLVTAKTESVQYDHPNHTVTVTTISD

SEQ ID NO: 951955 - protein, 52 aa, Homo sapiens
DGAEGRRRHVHSSPEKVGRGVLRGLGRGGCGVCVSIHLRLQVEEAYSAGLAS

SEQ ID NO: 951956 - protein, 131 aa, Homo sapiens
GKVGKAVLTIDPRVCLLRIAKGLPANHTLTSETLRVFLHISDNQGENVLWKDATHNGLQGFDKMLLSGPVRGPHGTSRTCALHGPSQLKVGVDLELERKVSSSSLLRAVTGQEVPDNLCLYPLMFSFIPSG

SEQ ID NO: 951957 - protein, 42 aa, Homo sapiens
TRALKSFEQEFTQRTGGYCATELCCEPTNKSFAIAFRHADFT

SEQ ID NO: 951958 - protein, 131 aa, Homo sapiens
RIPCCTKDATPKLTPALPCQVYVNHGENLKTEQWPQKLILQLIPQQLLTTLGPLFRNSRMVQFHFINKDLESLKGLYRIMGNGFAGCVPFPHTAPCEVRVLMLLYSSKKKIFMGLIPYDQSGFVNGILCGS

SEQ ID NO: 951959 - protein, 48 aa, Homo sapiens
ARYPELARVDLRLVELEPGIGLVLSRYNCNRDQSALRLSASSSTFFLT

SEQ ID NO: 951960 - protein, 81 aa, Homo sapiens
DSVQIIVKTTNGRVNASIATRAPVGGAAGLANQASCSTSRWLGGLVKNKYVVVSAHDLKPVQPAVVPHLERSAIARSRANV

SEQ ID NO: 951961 - protein, 105 aa, Homo sapiens
VEESVVRRDDERTLEAICERLRPALYTRGTRLVRELDPVDSMLFIIRGYLDSYTTQGGRSGFFNSCRIGAGEFCGEELLTWALDPRPSEYLPRSTRTVRAVSEVE

SEQ ID NO: 951962 - protein, 70 aa, Homo sapiens
PQLLEPVNTATCCRQPVSSVRHRHFQPRKTSNTGELVDDTQWHRVTFYDRLAEIAGEYLKKGRPVYVEAN

SEQ ID NO: 951963 - protein, 38 aa, Homo sapiens
IVSLCAWWAVAQDRAHCGCSSVVTQDQQPFSIPGVEID

SEQ ID NO: 951964 - protein, 54 aa, Homo sapiens
DWTSAVRPQEAWELDDLRFEVTGLDPDDVTGLANSHFGSSWLRPELMRCHPPED

SEQ ID NO: 951965 - protein, 78 aa, Homo sapiens
GVEIDVCIRVAGGTILDPEDGAARVAARSAQNWTWSGYHPHVPEVGGDDPRWRGTVRELGWYQLGPRRFRSRQDVYYG

SEQ ID NO: 951966 - protein, 57 aa, Homo sapiens
QLTVFVRFDLRTAGDAETTSEFEVSGLDLDRRDRPCENVTLALMAAGRLMRCHPPED

SEQ ID NO: 951967 - protein, 84 aa, Homo sapiens
KVDSTASHPRAYTATSKCTSAMAQRLHISHTGHSTIPTNANPLHLRNVLYVPHITKNLLSAHKLTQDNEVFIEIHPNHFIVKDQ

SEQ ID NO: 951968 - protein, 51 aa, Homo sapiens
YVPGKRYILHSCRYTVRLRCGGTQIRCACDKAPKRLSWLERLGCKHPSIFY

SEQ ID NO: 951969 - protein, 33 aa, Homo sapiens
ISVDRDNVEIPQDSVRKNGRRSLCADLTVAYEI

SEQ ID NO: 951970 - protein, 65 aa, Homo sapiens
FHCYMQLQCLDAGEGAQTDKRFELARVTCALLNLEPGIGLALSENCNRDQSALLFVVIVIPLLRD

SEQ ID NO: 951971 - protein, 50 aa, Homo sapiens
VDDEFRRNPTMTAAHKRSAVTVCVSRGIEIVCLRVMHDEGLVAIGQDQAG

SEQ ID NO: 951972 - protein, 64 aa, Homo sapiens
VPRCVNRLPLAMIMLSFRCGLRARRTHGLELARVDLRLVELEPGYLELALSDNCNREQSALSLS

SEQ ID NO: 951973 - protein, 42 aa, Homo sapiens
MTRSVAWNGLCSVWACAAVERKRFIVASHALEQDVYRMSSTI

SEQ ID NO: 951974 - protein, 195 aa, Homo sapiens
GCGTGVGRDVKARDQAPTPTNVPDAVENAQLHQYYQMYASTNPSGSSTVDGETLFKNGELKSLEEIMADAGSNREDQVVGVLRPLVEAAGVDIHAYQDQYNESKGDSTEAMSYDEYKNGSYMKTSYHAFPLLATATLIAACSTVQLDGVESVPVSTPASTSPTNYVLLAGWIITNVWSADPGVDLFAEPVAVVRA

SEQ ID NO: 951975 - protein, 69 aa, Homo sapiens
MATITPCKDLFEPYPNGNPSRFYVHAVANVRAWPVLAHNEKNVRRRGRYRELSPVEGQCWVGDSSETVD

SEQ ID NO: 951976 - protein, 45 aa, Homo sapiens
MPLPVLKALVSCRPICAPCRAAVPVQSAEAQTSMSNPLGKSGRIL

SEQ ID NO: 951977 - protein, 33 aa, Homo sapiens
MQAPVVSMRGGVAQTEIVLELARVDLRLVRTRT

SEQ ID NO: 951978 - protein, 65 aa, Homo sapiens
LDDADNRKGRWSRLQFSLEGEPIPGIEFDEAQVDARHFEAVVQYEPANRIETPELHHEPLETDLP

SEQ ID NO: 951979 - protein, 104 aa, Homo sapiens
SLGFPIFVSALEEELGYDPFTLSQDAYYPQTFAEFVAFYDRYLAGSMISLGLLVHVGFHMAGSADSTASELRQLGVRPGLAMSRPALTLRDPAEFVRVICALDG

SEQ ID NO: 951980 - protein, 37 aa, Homo sapiens
SADSRGSLERVRVVSSKLNVCCSDVPWWTLPIQFNAF

SEQ ID NO: 951981 - protein, 60 aa, Homo sapiens
RHLYKVAYVARKRFILYSYRICYSGSATEPIQIRYAYNKAPQQLSKLTFLGLNEEVSTMS

SEQ ID NO: 951982 - protein, 53 aa, Homo sapiens
VSEDPSKERGWSTLQDAAVRSMQPALGECFSVDSQGRYRGLGPYQLVSCRVGG

SEQ ID NO: 951983 - protein, 35 aa, Homo sapiens
LCLMQLQCLDAGGVAQTDKRFNWTRVDLRVCRISE

SEQ ID NO: 951984 - protein, 151 aa, Homo sapiens
MSGVSRGSPGVTSTMFGGATSAVTSRTDPTTSPADSSAPTGLPPSGSTTGSVTNGANLRTRPAPDVRYVDIAGHVSGDAAERYRTGSGRSVCRKADRTSRRSYRAYRKPARDPRQESPTYKQNGRFVDCDIRAVAEIFIPAAYRESEQRCA

SEQ ID NO: 951985 - protein, 94 aa, Homo sapiens
QIARGNADRVAVLSAFYFGQTKTGDGDVPTPTEGHEGLDQLVTELGDIDASTNCTFPLDDSDVVVRVGRYGTYVEDPVGNRANGDDALPPEELT

SEQ ID NO: 951986 - protein, 105 aa, Homo sapiens
AYNIELDNQPIPHAGAVRGGLSKRRIGLGYTGLGTMMVQLGIRYGSNESINATGEVGKFIAVEAYWESTNLAVERDTFPLYDRDKIQEAEFVKKLRKDLGQCIYE

SEQ ID NO: 951987 - protein, 42 aa, Homo sapiens
AKVSLTWTSPFWSITTVRSYTHMKEGSKPELGLPEKIDVVAG

SEQ ID NO: 951988 - protein, 130 aa, Homo sapiens
HIRTPRRLTGTMLIGVGNRCRLDGESLGIGAIDHQTSRVYRYSFGYATCTEPRRSAYKVEKLLDSDKDTVYNCQRSSSFNPGQSTDAFVSITRRQTISMPRETQTATGDRLIAAFLWDFDGTLVEPESRW

SEQ ID NO: 951989 - protein, 34 aa, Homo sapiens
MIDGANAQGFTVKAAPVSDPMSMVPVSVVDSGND

SEQ ID NO: 951990 - protein, 50 aa, Homo sapiens
MPVQFRLRHLSEPRISRQGGEITRSDEDTVYNCAEEFKLHPGQYTDAFVV

SEQ ID NO: 951991 - protein, 57 aa, Homo sapiens
MTRSYEVRTGWAVTETVPAATRSMVIDGASAKGFTVKAEPVSDPMSMAPVSVVDSGN

SEQ ID NO: 951992 - protein, 130 aa, Homo sapiens
MTNVGNYGGYLPSGTLASSGHRCNLLTVGTMSDTHWLLDYPDSQNRIRTSGVSPLTSRCLGPGFCPQGASSEQLLSFENAVDFCKLGAPFFTPHNPQSGETLHPGVVDEDFGRKVTIMIIGIPRESLPGE

SEQ ID NO: 951993 - protein, 160 aa, Homo sapiens
MPPFLTGCQTNVGRYAFIRCGDSLFFQLLSLGGRDADGFGSALSHGFKLLDGDFALLFLEVSRQEEMWVSMTLRSARRDSACSRIATPKSSSCDTTVWWAFSASFPTVMTSEVGEIRNSPSLTHLHDELAIYPALIRRTDRYIEVGAVHAERNPVGEVFD

SEQ ID NO: 951994 - protein, 168 aa, Homo sapiens
MHVEADDPEFRRPVWPTSLADPKVLRVVALSGGYPRDGANKKLARNKGLIGELLSAFGEGLNVAQSQQEFDQTLRSFHRLDLRRLGVLTLRQRARWETCGPVVMRELSSALYSSRVIPELVAFDLDDPWPLRKLGLPQEMARIVARLLDRTSVCVISGGQFGQFRTSV

SEQ ID NO: 951995 - protein, 186 aa, Homo sapiens
VYLALTGHTAEESSNQEEVPAMSAATGAIAIDRAVPKPQGASRLRQITTLVRRNLTHIKRQPEMLTDVTVQPIMFVLLFAYVFGGSITIPGVDYKPWLLPGIMAQTIAFSAFIVAIGLNTDIGKGMVDRLRSLPISRSSILISRSVAALFHSSIGVPVMLVTGLFIGWRIHEGLLKGLPRKWAALL

SEQ ID NO: 951996 - protein, 63 aa, Homo sapiens
MVVIVNVALRVHQYGPYLEYERKVLVLHERTYEVPEVIRTINFDHNEKRAVIREMFDLFNERV

SEQ ID NO: 951997 - protein, 90 aa, Homo sapiens
CAIEDPTTLARHLGGFRCSCCIERLMCGKMCGLASCRVCRGRRARSDERRACKLFPMLLLAKAVKVRPAAPPHNPTLVIVRPKSLKGYRA

SEQ ID NO: 951998 - protein, 42 aa, Homo sapiens
SGGALEDPTNMASTLGVFDVALHRAVDVWKHARIGVMQGIVE

SEQ ID NO: 951999 - protein, 56 aa, Homo sapiens
MAFKPMANWILENAAYELVYTTTLAVEATECSILLNVEMADALMEGGTDAVNAGKD

SEQ ID NO: 952000 - protein, 71 aa, Homo sapiens
MANWILENAAYSSSIPLPLLLRLLNAQILLNVEMAVAWIEGGTDAVNAGKRLTERDKKSPVITPSLGGRGP

SEQ ID NO: 952001 - protein, 134 aa, Homo sapiens
LYHEAYWDMLIGSEYGAALMVNPLVLGPSITKPLRGCRYSFGYATCPNLEDRVKVVKLTRSDENSVYNCQRSSSFILASPPTPSSSINREQTISMPRETHTATRRTVFRRCLVGISDGTTSRTLSPRWVEANSR

SEQ ID NO: 952002 - protein, 34 aa, Homo sapiens
ITLEIPPPERLLDGCTHLTERHPSLAGSARLGRT

SEQ ID NO: 952003 - protein, 75 aa, Homo sapiens
RLKLVPDDKNISILMAEIKVMALIPDSSSQTDSLGLFFAGSRPGQTNSTEPSAWPVSGCAFVPMASTTPIVGGNK

SEQ ID NO: 952004 - protein, 34 aa, Homo sapiens
LLIYCWHDRYIDMIPLCDVLEVKSKQKKKIEEKQ

SEQ ID NO: 952005 - protein, 140 aa, Homo sapiens
TFPILMLNKSVMCPSSQTVVHKQTHLCVHLSICFLSWVKQQHRTFSPGEWVAVPLYPWQARNPVVRRKQVMKLRHVALCYSQDASTALSHVSPSTGKTQTCEEATVPDLGSQANVHKLLKDAGRSLLEPAISTGARGGGV

SEQ ID NO: 952006 - protein, 137 aa, Homo sapiens
IYLDTMNISIFDGMNKGHGPHPQTVVHKQTTPRYSVLIWFLAWSNQQHRTFSLVSAWLCLCTHGKHDTHRARKQVMELSTGTVSSQDASAALSHVSPSAGKTQTCQEETCPRPGLPRGCPQLLKDAGRSLLEPAIST

SEQ ID NO: 952007 - protein, 34 aa, Homo sapiens
CPGQILYEREMWASLMSLVLGAETFNMGLYRERV

SEQ ID NO: 952008 - protein, 50 aa, Homo sapiens
CCRDGIVTKSLVAELDVVDRLESLVSAFMDYETVDSYILLSNEISSCKMS

SEQ ID NO: 952009 - protein, 53 aa, Homo sapiens
FIDLRFGHFRIYHEHYWFMEDDSWLASVFVQTDAAQMGWYGCCARVVNEAQSC

SEQ ID NO: 952010 - protein, 41 aa, Homo sapiens
GPSFYTGRRLTLGRRLTLGRRLTTGRRLTLGRRFNTGPSFK

SEQ ID NO: 952011 - protein, 42 aa, Homo sapiens
VTWPSFYTGLSFYTGLSFYTWPSFYTGRRIYTGRRFTLAVVL

SEQ ID NO: 952012 - protein, 78 aa, Homo sapiens
SSTRGPDSVVKLENWTDASRVDGVVLEKVQEDEFRYLNVPRLSVSRRRACTRCMVDSRGLLVRAHAFGVEAATMSLHY

SEQ ID NO: 952013 - protein, 88 aa, Homo sapiens
IISTGPDSVVKLEIWTDASRVDGVVSEKVQEDEYRLSNVPDSGSQTHGWYRCMVTAWSPAQGAPLAISRTQSLQVHIEIDFHASGSYI

SEQ ID NO: 952014 - protein, 44 aa, Homo sapiens
MADFTEQRSALSPRLRVQCGHAQPLLVRHMVRRLELMPPRTAYV

SEQ ID NO: 952015 - protein, 68 aa, Homo sapiens
YREQYKAITRRVCHPQQRALLEADFTEKGLPVARALGTVRDAQSYLSVTWSQADNMPPRPPRFAPEPG

SEQ ID NO: 952016 - protein, 97 aa, Homo sapiens
RDSEDPSAAYLSWIIYENRIVNNGMRECSQLQYSEYEVTDHIYDSESSDDINNSSEYQKLNWNGARKGDGQTDSKSTPMPCELTEELASTVELISDN

SEQ ID NO: 952017 - protein, 45 aa, Homo sapiens
STAKLKVLTTYIWFKPFTKEIGGRCAVAKRKRMADVGWHIVRPCE

SEQ ID NO: 952018 - protein, 54 aa, Homo sapiens
VKLGDRILMRKRSGGQCKVNNTDYKRQYLKMYKQSRRIAIYVKPTDIWYGLQSQ

SEQ ID NO: 952019 - protein, 68 aa, Homo sapiens
MRRAHAQDEVDVDWHMSACDHVLIDALGIPPEPQPGDGHTFFSEIGLDHASFWAVDILVLRVIALHLP

SEQ ID NO: 952020 - protein, 105 aa, Homo sapiens
MYLSSSCRPLRSTGCSRSVRRSASAEHPPVAGGVLQQAAEKRRGQQVKVDLALVVHRLVQAVQLRKPGLIVEARIASVQDFHPQRLAAAQFASDIASTGVGQTRQ

SEQ ID NO: 952021 - protein, 79 aa, Homo sapiens
MYNTAKRSQTRIGLNFTKEIGGRSRGSRQTSRRGAFVRLRHVLIEALAILLKPKPADGQTFFSEIGLDQPPFAGVEQLP

SEQ ID NO: 952022 - protein, 92 aa, Homo sapiens
VNKHSETKIRNGEGNYPKTDVCQPQHRALIESDFTEKVSARRQAFGSARDRQVLSIRSMVAGGTNAATSAFVLRYEPQCIARQILYSVKGYK

SEQ ID NO: 952023 - protein, 44 aa, Homo sapiens
ILQVTHSETKVLTRIGFKTFTNEIGGRCAGLTAEDDGGRGVHLS

SEQ ID NO: 952024 - protein, 88 aa, Homo sapiens
MALNENDLHPPNQTAKMITVGFRTSQLTTTVASSRNSTEMEQRKVKVKRYQKSPNAIYYCKKSFHSLTQYHGHGVLQVSEQMLAGREA

SEQ ID NO: 952025 - protein, 37 aa, Homo sapiens
REVNTQRTRSELCVWFLTIRSTNYACLLHARHRSASI

SEQ ID NO: 952026 - protein, 42 aa, Homo sapiens
RLTITAKRRYLARLSHSRRRNILTKLRSREAFGGRKSWYTGD

SEQ ID NO: 952027 - protein, 89 aa, Homo sapiens
IGFKHLHDKRSAGRCAVFKCKNESDVAAFVRLRPCSDSSCWESRLNQSLVNGQTFSSEIGLYQPPYLLAVDILRYGVIRFYFLPDTYPC

SEQ ID NO: 952028 - protein, 38 aa, Homo sapiens
DHVTLVLKTFTKEIGGRCAGLKRKTAADVAAFVRPATM

SEQ ID NO: 952029 - protein, 95 aa, Homo sapiens
PLSAPKLSEENLTPRTEALAKLGINWCPLVGADAVPQPKERAPCQLWLLDPRPRYSLGPLAPSRKTQGPLLDLYGQKLPIGHTPPTPPAPPLPLP

SEQ ID NO: 952030 - protein, 40 aa, Homo sapiens
RLEYFVSSTSFRVLRIEYFVSSTSFRVLRYEYFVSSTSLR

SEQ ID NO: 952031 - protein, 95 aa, Homo sapiens
LILARSMDNDAPAIDHHRKMSNEIQRIVFYNGSKKPKELDYPETIKKKKIRGAIISVPDTKAYYIAIVIKTIYYQLGNIHRSMKRVEHANTDEQI

SEQ ID NO: 952032 - protein, 102 aa, Homo sapiens
VKSWGSVEHCPWSTDGVSLCSPGVVVQWLRSWSPQVPAPGFTPFSCLCLASSWNYCGVPPDPANCVVFLVQTGFHRVSQDGLDLRDLGIRPPRSPKVLGLQA

SEQ ID NO: 952033 - protein, 109 aa, Homo sapiens
LEDPDPITPVANGSQKGTRVSPLDSYPALSLACRVLSTAWWGWEQWSTCSSLWAVSWFGVWRRVYVYRGGESFLGRLGAREVCRMASARESRKGSADGSMGSVLQTMKV

SEQ ID NO: 952034 - protein, 84 aa, Homo sapiens
SIDLIKLASDDSHTRLVVIVQLSVYIRGRSHSWFLMTKVHRTYTHECSMYNSEIQICWDYNNVHILVLILYCVNMRWWWLVEVG

SEQ ID NO: 952035 - protein, 45 aa, Homo sapiens
MIPSIRYPHWQPTRSSGSSYAGGTVTLGDYNYRFMKANKLTLVKF

SEQ ID NO: 952036 - protein, 68 aa, Homo sapiens
LLMLTKCWDNEREPLCVDTYGAMHFIVLTNILNYMAFVSLHVKGIILMYHCISFEFVMRLMVYFNFLL

SEQ ID NO: 952037 - protein, 36 aa, Homo sapiens
DPPQFPKRSNLRIATHSQDCGTAVLSECSHSQGVYV

SEQ ID NO: 952038 - protein, 36 aa, Homo sapiens
KISRTEACHYIDTDGQQWIRNGILNSAFLLKCLLDV

SEQ ID NO: 952039 - protein, 70 aa, Homo sapiens
VRTRMCGSSGFSGPRSLHVAEQCGIDQSSLGGVTRCLRWELSGPGHAACMWTNVCNRDCECPNMNMRPDV

SEQ ID NO: 952040 - protein, 112 aa, Homo sapiens
VIPLQYSRGGLIWQLHNHIEYYTTTQYHAHRKGEGSGRPHRGEMMPKVTYLEKRRASIRAGSSHPKPVAIITSSQKIICHPQPSSPHHPVTLRCVWDHSLGQPEERCTLLES

SEQ ID NO: 952041 - protein, 37 aa, Homo sapiens
MHTSTHLLTLSKHVIVTCHRWASFQGWGHKGLNKNKG

SEQ ID NO: 952042 - protein, 105 aa, Homo sapiens
MIPCVMYPEWYAVTVWKQREGSNRDFRGKRLLKSTRGGTLEAGLANKASEVKALYEQSPNKKRLHKGFSLPSSKQLAMAGWEPRFDNASKIREGSLGKECRHLSL

SEQ ID NO: 952043 - protein, 52 aa, Homo sapiens
MLFVPLPWLRMSPLTVLPASTPASCRFILTTTSRSHFSHPLFNPAVAFVHHL

SEQ ID NO: 952044 - protein, 99 aa, Homo sapiens
TSTGIASDLHKGRTMSGCQHVRTGSGSWQKLRGAPLPWNECLLQVGPRLAPCSGYHQNAVLTKPPPKTTPFPGYSLLCAQVLWNTHLSSEYTTINKIAL

SEQ ID NO: 952045 - protein, 75 aa, Homo sapiens
GGGSIFWQGGMMEHRGVLALFLYLDLSHGYMHALLFLKLQLELYIIRPVHFACMYITPSMETCKRNLITFFFNSF

SEQ ID NO: 952046 - protein, 50 aa, Homo sapiens
TTTGISRDTQTLKRLQKSLASIIISGAGYYVDATHSSETRAMSRTAYLTE

SEQ ID NO: 952047 - protein, 48 aa, Homo sapiens
HRQWDKPRHTDVEEAAEKTVVHIISGAGFMCMNSLLRDQGHVVTAGYR

SEQ ID NO: 952048 - protein, 57 aa, Homo sapiens
VLVTAYIQTKLSLKRRMHLLVHCSSIHNSQVMETTQMSTADDWIEEDVVYTCNSVTS

SEQ ID NO: 952049 - protein, 36 aa, Homo sapiens
MALLFTTILVFFLREQLLSLGGGGNCFSFGTYFNPH

SEQ ID NO: 952050 - protein, 37 aa, Homo sapiens
MTNTPPKYFNILSPKKKRVLVHNHSTYVTPKTFINDA

SEQ ID NO: 952051 - protein, 123 aa, Homo sapiens
MVPKTRVSYVTTEDPQRRLAVLGHAQVSAGGDMKPVSSLTLLIHFSIIHNIEAAHKRFELDELVLVVIREPERPFGEYLRVGPAGPGRDKLKQVCKLPGVYAVLLSNRAGWGRGVRPWAWAAS

SEQ ID NO: 952052 - protein, 88 aa, Homo sapiens
IDIPREEDPSTVYSLFAEQVPVADTNLDFFQSDPFVGRDPFTVLILLEESIHLVVILSKVRIHLHQTVSSGNLLILLPLQALTLSVQP

SEQ ID NO: 952053 - protein, 64 aa, Homo sapiens
APCSSRGPEWIGDGESTSPSDAVVKKGTEGPEDQQTFFEELAVEDKQAGEEEKVLKVEGAAAAA

SEQ ID NO: 952054 - protein, 133 aa, Homo sapiens
GYCYWEQLGHGITHDPAVLSEHYRMIPGRYSTPVISYVSPWTCWGHTEILAERTYRLLDDNMDQLIEYKAFVSCLDIMYTGDMNERIQLLYRLHIPPALTENDRDNQSPLKESSVVNIETPGYGKPNGDAVDY

SEQ ID NO: 952055 - protein, 50 aa, Homo sapiens
TYRVVLHYSLRLRSYSALCVAAAKETRSPALATREKITQRAGALRPMPYA

SEQ ID NO: 952056 - protein, 75 aa, Homo sapiens
MSPVLFSSHCLLFQERFSDLLVLLPFLHHFALMGSCSLRPRIHSGSRRLPACGAFGHRAWQLTALPFPGHPHRVD

SEQ ID NO: 952057 - protein, 41 aa, Homo sapiens
VTDSTASTKRGNVPAVNKGGTHSVHPLTDVLDRVYQLSLSS

SEQ ID NO: 952058 - protein, 87 aa, Homo sapiens
MCNACYWQCVYHDNKDITIQDQCSEQSRELVEYSGYLYGSNRAATPFSDSWYYPSYPPSYPGTWNRAYSPLHGGSGSYSVCSNSDTK

SEQ ID NO: 952059 - protein, 43 aa, Homo sapiens
WEIAIMWRLFGVGAQVFLDYPRNLYLASSFKYSLSEISIHCLQ

SEQ ID NO: 952060 - protein, 118 aa, Homo sapiens
LVGTTGHHKRMDLPGRSLVSTTEQEARLEDDMCLPCSAKGPRIPPGRCALEKWGLLAPRGVASGVAFLDGAARVERTVLCVGRGSQLLPSAFMGSPLELHQPKEPQNPPAEHAMNLNA

SEQ ID NO: 952061 - protein, 43 aa, Homo sapiens
MPDVAECATRFLCTMAVRQLRSMLNRECMCQIIGCSYQTPHGR

SEQ ID NO: 952062 - protein, 45 aa, Homo sapiens
TGNGFEHQILLPLIHLIRSTCSAPKLAIMSRVTGPGGASSPLVRS

SEQ ID NO: 952063 - protein, 54 aa, Homo sapiens
AVTGYNSSEELSIYAHKLLNTVTLREHAQILVDKTVSTLKLLRDSINESNFPTP

SEQ ID NO: 952064 - protein, 82 aa, Homo sapiens
QNTACVGSYAPTPGPVHVEHEEKELSVQRTSQKPGASAEHTPSGISRKAHSGICNYGKKSLVKAKEIQSMYEAAAPLCSYAL

SEQ ID NO: 952065 - protein, 48 aa, Homo sapiens
ADRLVICCWRIFTVLLWAHGAVTAPCPSSWRNFLAVWRSPLSFSRVTH

SEQ ID NO: 952066 - protein, 204 aa, Homo sapiens
SQGRDPSADRKLIAAELDIEARYLCDKFTFRSNVFGKLEMSRTNIPERRLQLDMTAARNFAFEWNARGIVEIRPVFAIRHDFDTQTSEAPSPYSSYRVDLNMPVSSGVITCASKVLHSFGLPSADSGRNVRQLVYTNDLNPERAIESNRFAVLRLYVIQTWNTYVPIYANIRIINAAEILFIDKLKHLVIEQNSAKSRSVRDEL

SEQ ID NO: 952067 - protein, 76 aa, Homo sapiens
MGGVHHISAIADTPPPAKLQFMAGQSQTCCARREQGSVALEPAQPGRGGIFPGLPIAKTWGKAQYILQECTISPGT

SEQ ID NO: 952068 - protein, 66 aa, Homo sapiens
VTADGRVRDRDRPGGVTCEMLTDSVGDRTAGWRDLWILRKRGDTKRGGVTLWIAEERLVTRKRGGV

SEQ ID NO: 952069 - protein, 43 aa, Homo sapiens
RGSPLVKVLTGIQRHRGAFEKPRPSIARITIVQVIMSIRTKLL

SEQ ID NO: 952070 - protein, 33 aa, Homo sapiens
MAVDEERMDRVYQMTSKEAAAFGDVILEDTNDS

SEQ ID NO: 952071 - protein, 44 aa, Homo sapiens
VLQDLKEIPPCAQHNEDQGYAPPERSYSVWIGGSILASVSHLSR

SEQ ID NO: 952072 - protein, 47 aa, Homo sapiens
IHYPPTPADTGCHSTITHLLIDSLACSRRLINQIANDVNRVLARKII

SEQ ID NO: 952073 - protein, 96 aa, Homo sapiens
IDRYRVTVLGSWASPEVAARHSLAQLGILTCSLGVLIQGGKHGAYEALKANLKNSTLFLTHSIGSSQSQRQPSFRVGKSTPCLNGVCHVFHSTNAL

SEQ ID NO: 952074 - protein, 79 aa, Homo sapiens
QVYEQTSVNADDVKGLEQGRPGLGACVGHLVRADDVSNTPIMAQASTREAPRHGVKSNCSLDSGGARAPGIDSLDGSSD

SEQ ID NO: 952075 - protein, 74 aa, Homo sapiens
VLYCHRDAEGAQQQPPEPEWIGDGESTSPSDTVVKKGTEGQKIKKTFLEELAVEHKQAGEEEKVLKEKEQQQQR

SEQ ID NO: 952076 - protein, 85 aa, Homo sapiens
PCRPPQLPDGSFSDEYWCPSSGEYGTDRSHTNCAFLDLPSYEPDFNNQQQSYTALRLSFSLFRLLAVMSRRSLMKCSCIGVCSVA

SEQ ID NO: 952077 - protein, 50 aa, Homo sapiens
FGRARDLEPTPVTECLREQSWDTKTLVLNSRVPRSILVHIVLVGFTFRYP

SEQ ID NO: 952078 - protein, 52 aa, Homo sapiens
ALILEDPADSDKSPVDINPSFLETLFLCCWPSAWGSPEPKMQVSAQTMAAPS

SEQ ID NO: 952079 - protein, 47 aa, Homo sapiens
LNGADRDTLLFQLLVIHGLPWLCVEFHMAFSLFYFVSYKNTCQLHLR

SEQ ID NO: 952080 - protein, 31 aa, Homo sapiens
MFENHEKLAGLAIPKHRGGPHHERPTDWVTQ

SEQ ID NO: 952081 - protein, 56 aa, Homo sapiens
MPVYLRIPPSPQLGGHVGLPKCWDYRREPLTQPKTNFIFWEMALVVTQAVVQSRDL

SEQ ID NO: 952082 - protein, 81 aa, Homo sapiens
RHKSLKQQEPAKLGCGRKCMNKVSVLKEEKVKFEQQRLQVSLHMSQIVMDAVRYTCSPSYLGGPAQGGLLIATNVNNSKTL

SEQ ID NO: 952083 - protein, 44 aa, Homo sapiens
LPTGSEAELRYHEAKQSNFQQCISKAVSGASAGDYSDAIETLLT

SEQ ID NO: 952084 - protein, 62 aa, Homo sapiens
RSSVIFSINFSQILRSYTQTRMTKSTIDWQYHSAVRCRVSCGEECPWLIWGLQAELQMQPPF

SEQ ID NO: 952085 - protein, 70 aa, Homo sapiens
FFELLGDSARQYLLRVSGNVLDLDLLTNNEAKVCFEIGLLVTGGVLDLELLRVTGGVLERERRRVVGVLD

SEQ ID NO: 952086 - protein, 133 aa, Homo sapiens
IRFPTVARGENAGGLEQAGASRGPSKRIFPESGASVPSPNGLREVTSFSSFCSSVFAKIPALRNQWLRGFAVFLVKRVSETGWGSDGAWVQILTPALPDRVTPDEWGERSHPFQAALLTVKWGDKLPPHCGDG

SEQ ID NO: 952087 - protein, 37 aa, Homo sapiens
KGSPVYLELPAYTNTASSSEVLITTQKHRMLQHTVEK

SEQ ID NO: 952088 - protein, 90 aa, Homo sapiens
QDDPGLLREKERNSNLENIFEDIVHENFPNLTTKIDMQIQEIQRTLVRYYMRRPSPRHVLIRFTKVNVKEKILKAARENGQVIYRENPIR

SEQ ID NO: 952089 - protein, 58 aa, Homo sapiens
WNISNMRLMYLASKSFRQISLIPGDVIDLLVTFHVHHTFQVTLSNLSNRESSHRLTLP

SEQ ID NO: 952090 - protein, 47 aa, Homo sapiens
MLKRYTHLKASRLVKKLEGNKHRGQQVVINHLVPYPAITQQTPTGVV

SEQ ID NO: 952091 - protein, 75 aa, Homo sapiens
VGGTPAPDRVYGLFLTLEYILAPERAHLIPLDIFARQRKRRRVRQWQPQRLLLDLRLGLLVQLAAHALFAGGLAS

SEQ ID NO: 952092 - protein, 36 aa, Homo sapiens
SLRSLPLLFKRPALVALYVPTAMVVTAQFTAYSYVE

SEQ ID NO: 952093 - protein, 34 aa, Homo sapiens
LSRVGIALSHALFWSITASLVVRLAPEGKQVQAL

SEQ ID NO: 952094 - protein, 79 aa, Homo sapiens
MELYPMSDFNSPELITDSRGFATLWLSREAKNNAFNAEMIRELIIALDHVQGDPALRFLVLRGRGKHFSAGADLAWMQQ

SEQ ID NO: 952095 - protein, 45 aa, Homo sapiens
KLRVAFELKEDDMHAILKAAEFPVSKPELSALFRKFGHTNYRTCG

SEQ ID NO: 952096 - protein, 55 aa, Homo sapiens
AADQETMGIKAMHQAEQQRTNDPRTAEHQQDQGHGVATHAGNTFNKRLNIAVGRE

SEQ ID NO: 952097 - protein, 40 aa, Homo sapiens
VSYADDARRSYQVPAGSLSAALTRFAGLASRGDAGDLIAT

SEQ ID NO: 952098 - protein, 47 aa, Homo sapiens
MRLSTIGYLHADAKALVGYRQFQMTVLARSSLTGRLPPTCALRCCVL

SEQ ID NO: 952099 - protein, 60 aa, Homo sapiens
LGPPRDYYERFSLLSGQNARSLLLGARLATVHEERDKAARFGQQLERLYPGTPEYQQYLS

SEQ ID NO: 952100 - protein, 111 aa, Homo sapiens
VVLSRLALMAFSVGWPLAEGLQQLPLVFVSRHGETPRTLDILSDLANDEPLSPTQFSLSVHNAVIGLWSILRNETSEMTALAAAGDGLEHGMLEAAALLNEPPAVLLIITE

SEQ ID NO: 952101 - protein, 44 aa, Homo sapiens
LAQVSFKFASIHAEPLTMDAAWLIRVFGAPWIYGAFVGYIGAFF

SEQ ID NO: 952102 - protein, 66 aa, Homo sapiens
PLVQLIHLSDLLLYKGFEQPLIEVCRQVNTLLTLALATTQISITNHECFISTSLSVNMAARPFARR

SEQ ID NO: 952103 - protein, 69 aa, Homo sapiens
EKVSEELRIRVSVACPLTVKRYDGGFGVALNMVDIPDWSRHLIATKRIRVAAVRRLVDREMSKPARPKT

SEQ ID NO: 952104 - protein, 35 aa, Homo sapiens
QQHQHGLDFLTRAGNGVSHRVADQQAEDGAEKRHL

SEQ ID NO: 952105 - protein, 68 aa, Homo sapiens
VVLSLSLGMSGSLAAAELNIPAQSLEGALRELGQQSGRQILYSPDLVQGKRATALHGDLDVSSALQKL

SEQ ID NO: 952106 - protein, 54 aa, Homo sapiens
GYLTEHFDLAELRDQSADMYVCGPPPMVESIKQWLLDQALDGVQLYYEKFTESN

SEQ ID NO: 952107 - protein, 47 aa, Homo sapiens
PIAVPVILAGVRTAVVMNIGVMTIAATIGAGGLGVLILASISRSDMF

SEQ ID NO: 952108 - protein, 51 aa, Homo sapiens
PAHLIEVKREHAGNKKLDGEYIYLKPEWADKLASRAYLLGGVNPRYQPMVV

SEQ ID NO: 952109 - protein, 68 aa, Homo sapiens
PTATDQGSYLSVAGRNAHLDTPTDLESWLSDSARITQIAAATDLGSWVSDSGRISQSAISANICLLRG

SEQ ID NO: 952110 - protein, 54 aa, Homo sapiens
MFRVEAIPTLRFSLNAALQCDACVVFPEMLLAGHALDGSIFLVPDFGDIQQDIK

SEQ ID NO: 952111 - protein, 42 aa, Homo sapiens
IIGLQRPVTEVIRPAKYAPIGKPIASGSKCKAALSAPEPVTV

SEQ ID NO: 952112 - protein, 54 aa, Homo sapiens
VGGGEFGLLVQVEELLLDLVLVGQVTDGVVHFGLVVGLHGRVFEQFANLLLHRL

SEQ ID NO: 952113 - protein, 35 aa, Homo sapiens
VLPELVLDSSLTTCARAAVSPWAAASYSGLMVVMA

SEQ ID NO: 952114 - protein, 92 aa, Homo sapiens
GYCTARCPGADPADMVIGTSVNLDGIDAQVAVLVFRGVVQLSQSRVTGTGVVPAVGAFFGHAIKALDHLHRPIRLQLIEPHTQGCTHDAAAD

SEQ ID NO: 952115 - protein, 32 aa, Homo sapiens
ANSRTISRVIAPAGAEAAVLGGDAKGQQAALA

SEQ ID NO: 952116 - protein, 48 aa, Homo sapiens
RQQDDVLNAQRTKIANLAASAFAGATSYIASPYVGAPVGAGVRMYVND

SEQ ID NO: 952117 - protein, 84 aa, Homo sapiens
SIPRGSPINHPTLPIALFVARRPGTESYLIDLRDGALLQTITSKTNRHFYGHAVVHKDGEWLYATENDTSDPGRGLLGVYRFEG

SEQ ID NO: 952118 - protein, 59 aa, Homo sapiens
LAQPAEIIALSDYVQTACGLDAIIIFAPGTARRAESIAACSQCDVSVPGRPIILIGVNG

SEQ ID NO: 952119 - protein, 86 aa, Homo sapiens
EPLHFEQVDDLDGRVGLDGVIHLGEFETGAQVIVGLADHRGVDHHERGFLGVSERLHFVKSGAREIVFDLDRHAGNSYWQTKLING

SEQ ID NO: 952120 - protein, 80 aa, Homo sapiens
TPGCGRSQTIGYLLPQHPNLIALPIIGTRPGLGGVFKDQPRLTQLLHKITDVPRRKSSAVSYGEAAIGQSRRNGPVQCQQ

SEQ ID NO: 952121 - protein, 71 aa, Homo sapiens
QAGTADRELHAFIIRRLGIDAGLVLEHVFVGADAPLLHAAHIDEIGATGHALELRLGHLASAGFAAGDLDR

SEQ ID NO: 952122 - protein, 43 aa, Homo sapiens
MIPEMLVPAQISYLASNPLLSHIVAECDDPRRFGATWIRRTPS

SEQ ID NO: 952123 - protein, 66 aa, Homo sapiens
DSAICIENQEQQDILAKVLSARLDREVRLQVAEDATLIGGVIIRAGDLAYLMARFAGKLGESVPMY

SEQ ID NO: 952124 - protein, 111 aa, Homo sapiens
HPDYRLQRFAADSRIWRKYRPSDNQVARANDNTTNQAGILRNLHAHFPVDSLLGKPLRFVCCTLVQCKSTGHYNVYRYLYYGLVQVKQSGDLRQKRETVVFGNNVYPLMFR

SEQ ID NO: 952125 - protein, 67 aa, Homo sapiens
YAGRSTGSPALVLYPSDSESCAADVLVGVAQHLAGADFALGMNRDCPLHKRTCNFGGVIAGVRDIVD

SEQ ID NO: 952126 - protein, 81 aa, Homo sapiens
PQPISQCPRADPVGSLHHDGRHGGLDPIKETGYHGVLHRYAMHIHDSTIRMNSEGSTKSTPAITPPQVRCISQPMKVANCC

SEQ ID NO: 952127 - protein, 61 aa, Homo sapiens
AATVDLSERSPDYNPWRIITAQFAQRHLPPHKDTEQQNASELSKAQPIQTNLACCTFLLHR

SEQ ID NO: 952128 - protein, 35 aa, Homo sapiens
MAVHQAGRGIDGLSAASCPSRLTKKSTNVLTWVPS

SEQ ID NO: 952129 - protein, 117 aa, Homo sapiens
WAHQGQLNDLRAAIGFKGEGFHRGTTPFAVGMHHGKRRYSVREFPNTSHPPCENNPMFDWQDLYFFTVLARTQSLSAAARELQVEHATVGRRIDALEKALGVKLVDRLPRSRPLTEE

SEQ ID NO: 952130 - protein, 76 aa, Homo sapiens
DPHHRHGGFDRVSNSPFQAPLASLPSLQASAQVNGLKGAWVDWVLHAGIVGGAVADDQAVADLDDAFGARGDFAVV

SEQ ID NO: 952131 - protein, 73 aa, Homo sapiens
HLQVLVVEGKLEAVRSAEGSNVTERELAMAFPGKVGEALNLREVEQLVDQLNRLPSKQAQMELTPGKQVGGSD

SEQ ID NO: 952132 - protein, 49 aa, Homo sapiens
LYDHGRRDLDDAFGARGDFAVVGNQDDDVALARQFIEQCHDLGAAVAVE

SEQ ID NO: 952133 - protein, 94 aa, Homo sapiens
GLTLSGAVQAQAQSQPESATTTLPPATVVADRTGEAVKVERVSSGALGDRKAVDTPFSVNAVSSDEIQQRLAQTANDVFKYDPAVQVLSDRVPS

SEQ ID NO: 952134 - protein, 40 aa, Homo sapiens
DPQKISECRRGTNATRWSAPGSDPAAAISIPCCMKRKFPL

SEQ ID NO: 952135 - protein, 104 aa, Homo sapiens
VDIGPDEAELKVTTMYQCPWRGFPQRLATSDHLVSKSATHSVRLRLGRHTAAQREAPPKVSNAALVKNQPIWVSVPSQPKRTVNIPIGKAHSTAPVSASAANFN

SEQ ID NO: 952136 - protein, 32 aa, Homo sapiens
MAAHWEKTTALGTLYPVTLARMCSITWSLVRV

SEQ ID NO: 952137 - protein, 97 aa, Homo sapiens
CPARPRVQVDVLGFAGPAQAGGDAQGLADLPGGAAEDCETVGGLVNRGLAVIGDAERLVVVGREQGTAGSAVQVFVEQVGTDDPAHRLVLRRGQAQF

SEQ ID NO: 952138 - protein, 42 aa, Homo sapiens
MFWRVVARYERTDRRGYLTDACKISQSTYFGGRSITAYRVLE

SEQ ID NO: 952139 - protein, 73 aa, Homo sapiens
VSTRLGLPAESVGQAAKIAQAHARWRVVAQLVAQLTANAVLTRVSSVDRLTSDMERLRCRTTQVSSKLKGRAD

SEQ ID NO: 952140 - protein, 62 aa, Homo sapiens
TEDPLQAHFPVESCTENLGEFVLLFLVQCKSTGHFNVYRFLLFGLYKVKQSGDLRQKRETVV

SEQ ID NO: 952141 - protein, 54 aa, Homo sapiens
MTEPPSVQRLVKNVGAAQYLDAALPQRVLEFIGAVPPGPVSGKPSSIAYKPEAW

SEQ ID NO: 952142 - protein, 87 aa, Homo sapiens
DCDYSEIPDNQALLLLALDRAITPRLINDDFTVADCRGLAPRYVGDFVQQLREAGLILEDPAKARPGTYYWEGDEIWMLREQVAYRL

SEQ ID NO: 952143 - protein, 36 aa, Homo sapiens
MSRLKKSSSPYAPDALAGLWSPWPVHGEILDTLGAT

SEQ ID NO: 952144 - protein, 80 aa, Homo sapiens
SSRDRAELNGVKDALRAQLGALAVGGAEKILGATIDQNAHALSCVNKLCCVKFNASVRSCAELTTVGPDPYAKAAFVALP

SEQ ID NO: 952145 - protein, 80 aa, Homo sapiens
IQRRCAFNPRTPSAGPDQQMVAVIQAVSESGTRQPVTECRVRTLALSGIVPLAGDYAHLCADLVLLACPCRWGTRASEFV

SEQ ID NO: 952146 - protein, 49 aa, Homo sapiens
ALGLTPYLVGDELTGADIQMSFIGEIARAQGKLQAYPNVAAWVQRFQAR

SEQ ID NO: 952147 - protein, 55 aa, Homo sapiens
MTRKTYYAPGTKTRDYSYLGSDTVLHIGNELELVQDLWLTTGLAAIYTRRETQVS

SEQ ID NO: 952148 - protein, 77 aa, Homo sapiens
MLHVTHQYPQRNLPWGNFVLDIDYDRVLAWPCWFPCEGSMQFSILSRRGAWGLAAPTITEGKLTMAIVELGVLIYSG

SEQ ID NO: 952149 - protein, 104 aa, Homo sapiens
MAAAWPTLSAKCSHLHVFVIGGRGRIGLQAAVAVAANQVVDDRAGLDHYVGAVLNHRGFAQSIDGLEFRWRKIGFRVALVALELVRQAEFFEQPQDASRTGVVE

SEQ ID NO: 952150 - protein, 94 aa, Homo sapiens
RDRVPVSVVEPSVRIRTYTFEPWGGLGDVAQVGFGVGGEQAHALLVEVADVLGFLDGVAVADTVRADAAVHDLVQLVDRRDVEARTLVFEQVDD

SEQ ID NO: 952151 - protein, 37 aa, Homo sapiens
LYSPVVVQSKRVAVLDGLGKIYHSSVPFVVFSNITVV

SEQ ID NO: 952152 - protein, 101 aa, Homo sapiens
PGGVLYTVLLDVDNADHSLMAEMTTQVFFVANEARNVLTAPIAALQDGQQADRPQVRVVASDGTIQTREVRTVQSVTVLRGAEFLERLRIDGDPSADSVLA

SEQ ID NO: 952153 - protein, 46 aa, Homo sapiens
MCRRWYFVRYPSIFLMRHTRSAASHSFTVLRGRKTCQCTYSDPSFI

SEQ ID NO: 952154 - protein, 51 aa, Homo sapiens
LVCIMLEVCVTGPGARPMNSRTRCGKAASRYCAAPTVYDQDALALGGSVNY

SEQ ID NO: 952155 - protein, 36 aa, Homo sapiens
MDWKVSLDVKNLTNEKYVTAVQSLYDAKGQDTASWY

SEQ ID NO: 952156 - protein, 147 aa, Homo sapiens
FGRLAQSLSQLVPVLLSATHAIWLVKTALYLQILRFSNGSIMDFGYYCLASAVVLYGEPKSVIATASLLDTGRLCARYRLPHLRAISDVTLSHSKVNNSDIPSEIQGQEGTLMIDKISDCQGVVLTPRGGQRQDLTHPQHINTMLYE

SEQ ID NO: 952157 - protein, 143 aa, Homo sapiens
MRQTDARWTLMLQLPLSAVMADLQAMQHDLDAQRITDIFGMAVAGLLIAGIGLLVIWLVGHGIARPLKQMVAMLNDIAQAEGDLTRRLTSDRADELGAIASGFNTFLAKLQVMITQVVSSVQKVSDSSEHTADIAIRTNQGVH

SEQ ID NO: 952158 - protein, 59 aa, Homo sapiens
LALYHEKHTSKEHFLYTAEEELIGADEQLPEKAKIEVLLATSGGMDVDQLSNEEVQRYV

SEQ ID NO: 952159 - protein, 59 aa, Homo sapiens
TLIELIDAFNPKLVYGRLHERILSADFVRHYNGRLLNIHPSLLPKYKGLHTHQRALEAG

SEQ ID NO: 952160 - protein, 31 aa, Homo sapiens
MLLPYMALVVCTQCDFAGLHDLAHRTKGGVD

SEQ ID NO: 952161 - protein, 34 aa, Homo sapiens
SIEPYLRCDDQYLGFFQVQLAFPADAGQGDVAYV

SEQ ID NO: 952162 - protein, 54 aa, Homo sapiens
GIGVVSAVDYQVISADQLQRIVGVESGVVGIDLDIAVEVLQPPLGRLDLGHAQG

SEQ ID NO: 952163 - protein, 36 aa, Homo sapiens
RNSSGQVLGYAASERTCSLGLLSEREPMDCHYFVLG

SEQ ID NO: 952164 - protein, 39 aa, Homo sapiens
TGVLEEGGVEVRSVSSIVMTARKDWKRPEPQDRRDKARP

SEQ ID NO: 952165 - protein, 156 aa, Homo sapiens
MYAGALQRCRNRVVRPHGCLSSADSLVSQSCRVSAICSARLVDIGLRRFPELVEQSRQVIAAQAPELDVFDLQSDRCWETVRSGGVNVVTWAALAVRKYGRSSGANQRRKRYVPGCIACEAREEGVRIECVVNEELTIRRFLAIKRVSLSSLYWRQ

SEQ ID NO: 952166 - protein, 72 aa, Homo sapiens
VGAQEREKEEEEEEKKEEEEEGRKKEEGEEEESEEELVVVVVKAKRKRSLYVKESCQASSGGTQLFQNYTFC

SEQ ID NO: 952167 - protein, 49 aa, Homo sapiens
ELSKYLLSPMFCPPEAARLYVGVRYLITIVHQAKGEAIEDLTHPFSKDM

SEQ ID NO: 952168 - protein, 63 aa, Homo sapiens
SEDLQDSRTEDTQVYFHHLTLAVLIGLLKAQKSIVSVGCLWTFGGTSGKISIDYLGMLGSSFF

SEQ ID NO: 952169 - protein, 34 aa, Homo sapiens
LLVASWSEMVQYPVQSGVKTRLGGQLQAAPARCF

SEQ ID NO: 952170 - protein, 85 aa, Homo sapiens
MVIKNSHSDQCPEMWELETGSQLIADNHELAHALPAAIHEGEESHSCMNGHEWQDTEPMIIVQITTTSHAGNHIDNTHLQASKPS

SEQ ID NO: 952171 - protein, 134 aa, Homo sapiens
MITPLYSSLGDRMRPCLKKKKKTKSKFSTKKHKCLLRNSEALAHGVSTSFQLRLQSCPVFPQCPQPSSKRLSGRNSVHLAGPWLGPTWCMMHYKSKDWLGAWRKTTRVSNPRLDPPVPGLGAALLKEPDCATGL

SEQ ID NO: 952172 - protein, 139 aa, Homo sapiens
WLGEQAGGSVPWTTDKVTIIPKVLRCLRTDLDTLKGFSGDRVLFLPHRLGPSSLANPGELSSARTLGHRLARAGLLSWPGSVKKSLHSSSRRTIRVIMTPIPGHFTSKEPCSVKEIVALSLLSKSLPKKIKGQSGMYQN

SEQ ID NO: 952173 - protein, 44 aa, Homo sapiens
MVAGTCSPSYSGALRPCSVYRPGPVYTRYLKCNLVGTPRYPCEV

SEQ ID NO: 952174 - protein, 57 aa, Homo sapiens
LAFQLVLGLEEGRQGVFHGDLRAAVLAPFTLDSISPYSSPSTLMPPFGLRKGAHTSF

SEQ ID NO: 952175 - protein, 36 aa, Homo sapiens
ALDVDTSSRIRHCYTMEEQESNLGKISDFLGYCTPN

SEQ ID NO: 952176 - protein, 159 aa, Homo sapiens
CGPFMFAGEQTGRGKPHRRKAGGIIIHKIPVAQHHTEEEARVPIQRQERWAETGDEMGQDGGDEGKSTLSSSGHHQAQLTSRTRGRNGMRERKEVRVKLRIQIEKLCGGNTCAGTMKGKAKKGRRLEGKSGLPFDTEIGGDIQTHCSEAVQQAGGRICV

SEQ ID NO: 952177 - protein, 32 aa, Homo sapiens
VDQQDPFMFAWLSDTLYPHCPEPQGDAVECLV

SEQ ID NO: 952178 - protein, 55 aa, Homo sapiens
YGPGWSAVVRPQLIANLRLRGFKRFSCLSLPQLAGIYRHIATMCPGLIFVYFQVR

SEQ ID NO: 952179 - protein, 50 aa, Homo sapiens
PRVIPLFQLSRLPKNCLLDGLFRSSVEKMEILSNWYRIKIVGWFHTGKHQ

SEQ ID NO: 952180 - protein, 85 aa, Homo sapiens
MCSSGTYFPKLSSPHSFDLQQHVHKSYPHFLRMVVETVSESWQELLYQWVGSVGGPKSLADHLTTEQRPSAELVSNASTEGGVKS

SEQ ID NO: 952181 - protein, 54 aa, Homo sapiens
VGAAVAGYTTATEMQNQAASVTYTTAHGMSKFLNPLREARDQTCVLMDGRAIVR

SEQ ID NO: 952182 - protein, 34 aa, Homo sapiens
CAKLLSRGLAVVGSVLGASSPSQACGSPRPTGGI

SEQ ID NO: 952183 - protein, 44 aa, Homo sapiens
SRKKAKLRIFLVLEEGTRISAVGGTYAVISLGGEHGVGVLRVVF

SEQ ID NO: 952184 - protein, 38 aa, Homo sapiens
MARSSVKVSDHEILACSVEWPRETSSDLRMGQLFSDYV

SEQ ID NO: 952185 - protein, 32 aa, Homo sapiens
IAITSSYLACSDRKRKDYATVERCARTLGNSW

SEQ ID NO: 952186 - protein, 105 aa, Homo sapiens
KEIHDFITTHGEIWEPQCKRNITSPFLTSTSHSVIKPAAIIHHPTICLSFGSSVGIMSFCFRSHFILVQVHTTSLNPSVLPLSTAGNSSTGHQATCNHFTSKCPS

SEQ ID NO: 952187 - protein, 42 aa, Homo sapiens
NHITDIVTDSYAKSFACAEKFAAEKTAASASTLSCESKLKTN

SEQ ID NO: 952188 - protein, 39 aa, Homo sapiens
MARRVQDLQGPLVYRVGQDSTVVSGQHPFDAGLTLQVAK

SEQ ID NO: 952189 - protein, 38 aa, Homo sapiens
MARPGTDLQGPLDDRVGQDSTVVTGSTRLMLDFTLQVT

SEQ ID NO: 952190 - protein, 37 aa, Homo sapiens
MALSHVSSLRFRPLSEEKRRPLSSVKQRLVLLHHPLC

SEQ ID NO: 952191 - protein, 196 aa, Homo sapiens
KAHDARLTALWTKLMTPHYVVRCSKPQAPITGHMNVYSPSEYGSSTELNLPETAKSVTLSNLQPGVQYNITIYAVDENQDITPVVIQQETTVTPGSDSVPSPRYLPLAEVTDVRVTIIVNPPESAVTGYRVDVIPVNLPGEHGERLPIRRNTFAEVTGLSPGVTYYFKVYAVSHGRESKPLTAQQRSKLDAALTSS

SEQ ID NO: 952192 - protein, 42 aa, Homo sapiens
EAHDVRAKNQFFPNLRSVPAATRPSTYCARDRKMGDTDGWFD

SEQ ID NO: 952193 - protein, 48 aa, Homo sapiens
MAHDVRVLTFSRVERGCGSRSFGERIKEMGLSLMWERATGTGSMYVTR

SEQ ID NO: 952194 - protein, 71 aa, Homo sapiens
AKGQSRLQASNPEHMVCKQEYHTLQCKSLSFILGDAGLQWMSPLHSSTIPETIHHPQRRPPCEQQDYLEDP

SEQ ID NO: 952195 - protein, 112 aa, Homo sapiens
KRTMGSPATCDAVEERRRYKLDKQQTFRVNLFYGFDKYKRSVTSGISQRNSLSKTWGTYVYWLEEAECRDSLSSVIFDEWRPHFHILECRKRTLSQLKKERDGQRTYVALVS

SEQ ID NO: 952196 - protein, 36 aa, Homo sapiens
KRTMAALGHGAAVARSEMTGQAPPLMGRISYAAVGR

SEQ ID NO: 952197 - protein, 35 aa, Homo sapiens
KRTIASTVTKNGEIDHHREQYENLRMDLERKLEEL

SEQ ID NO: 952198 - protein, 71 aa, Homo sapiens
MGKSNSYHRFSQTLYSLRAELKGLSCHCKLQTKHSGRSYVNPLQEVTRVQEAEAAGELCPIGRWHTELPLS

SEQ ID NO: 952199 - protein, 47 aa, Homo sapiens
DGIHILVLGQLLLGWACFTLQVLLSSDGPIFCRDLATMKRTFGTLGP

SEQ ID NO: 952200 - protein, 33 aa, Homo sapiens
MALSYGHGAAVPVVEMTGQAPSMMGRISYAAAG

SEQ ID NO: 952201 - protein, 86 aa, Homo sapiens
MKPKILKSFANSSGSALSPCLHSKKISQRHRACFQIYTQEGTSAQSTLQVFSNGNAPISLQDSQIGHLGFRKRHNIPGPPRLGKIA

SEQ ID NO: 952202 - protein, 101 aa, Homo sapiens
MTTRRYTVREKRVHNYRSGSYCLDSLRPGNPGHRLLQHPRTSPKVFPAEPLQHPARWERGHRLPGPGLLPPGATQCDLERKRTGRDRMTLPTQPGCLRAPV

SEQ ID NO: 952203 - protein, 33 aa, Homo sapiens
YPEIRAHEPSIILLMTLYARPRITVKDVKQHPV

SEQ ID NO: 952204 - protein, 129 aa, Homo sapiens
EWTFQPEIFSTFLVPADEQPGPEALWVLGSYPGCCWSRSPSGLLGAEMMSPERQVHGQELQLRAALGGADLGLTSTAPRSPRHEHLAILPCPQGVSMFTYCIQTLNGPVKWRPQRHASWVFQWHHPTSS

SEQ ID NO: 952205 - protein, 40 aa, Homo sapiens
MRVHTAPKDDVRSSSAARRRTTRAPLMYGDAGTERALRES

SEQ ID NO: 952206 - protein, 51 aa, Homo sapiens
SARWRVLMKPLERLECVEGVAHIIDPKAISSDHLYGHPWTPYTREWTDGLF

SEQ ID NO: 952207 - protein, 80 aa, Homo sapiens
ARCIWNTSERSMLPAVGRQPVSLLLLPGESAGQCDAEVVMCLCSCSIQAAGGDSDARCGCINLSPRRTSTTLMIDQRENG

SEQ ID NO: 952208 - protein, 64 aa, Homo sapiens
DLEDPTPTRSKWSVQECTLDESYVTRDWYMLKVARIKATTPRTVVSVPDIIAGFGPETAGRSPS

SEQ ID NO: 952209 - protein, 116 aa, Homo sapiens
SKPRLYQVVRWLRAYSRVADVLVCPRMALLRASAEKATCEAIYHPSCTKTLILEGQGPTYDFIQPSLFSAEDPSSQIQPLTGLSVLNMKVRGGEATSMESHDRRLPRGHGCSEQAI

SEQ ID NO: 952210 - protein, 86 aa, Homo sapiens
MSRYRQLSSSTDPSPLSLPSSWTTGVHHHTWLTFVFLVETGFACARAGLELLTLNEPPASASQTAGITGVCHHAWLIFIFSVDQSV

SEQ ID NO: 952211 - protein, 42 aa, Homo sapiens
NCRRFLRTASLRRVATRTDSGPYKAHLDLLLCQTDIACDGTT

SEQ ID NO: 952212 - protein, 63 aa, Homo sapiens
YVIPSDSQQHAFIFPTSMDLVLATLWHIIRLLQPNSTGRGHITTEIAVSLLQCHVNLYSKLQS

SEQ ID NO: 952213 - protein, 54 aa, Homo sapiens
MAWRPDTKLRHSTVQCGEYTRPGLASRAGGTSSRTKLVTRRKRCVRRKPVSDIG

SEQ ID NO: 952214 - protein, 41 aa, Homo sapiens
PHVFSKNPPRLMLYMPLNLLGLTKPVIAIGNLAGTGSHLSA

SEQ ID NO: 952215 - protein, 77 aa, Homo sapiens
RCTARSTILVPSLLSSWDYRRVPPHLANIGICKETGYAMYGEAGLEFLTSSDLPTSASPSAVITGVSYHAQPIIVSI

SEQ ID NO: 952216 - protein, 124 aa, Homo sapiens
TRRASNRRIFSYVKMARRDQGIARTCTPPGTRRRLQNGSRVNGNTYIRNPVLMASGGMRIFRAFVGRCGCPQPHKNDRDGEHEGQNNGCNQRGDFAVIHALPSPSCEIRRADMATIVSPHADYV

SEQ ID NO: 952217 - protein, 73 aa, Homo sapiens
SSDLEIPTRRGQTGSPSYLVPAVRKYGTATSLCVQRNKKKSHCAEDPSLDFRNNPTMEDLGKLQPLLASNLCS

SEQ ID NO: 952218 - protein, 41 aa, Homo sapiens
AAPGVKPRPSITTPVITTWTPIFQKKSRNIEPNMWYNSIKI

SEQ ID NO: 952219 - protein, 34 aa, Homo sapiens
MPAAWGFNLIEFNSLLVTRKAARALGLLNRRSGV

SEQ ID NO: 952220 - protein, 41 aa, Homo sapiens
RCTWCIALYSICLSQTAHPAARIRAWSWGFGIVPGAAIYRN

SEQ ID NO: 952221 - protein, 54 aa, Homo sapiens
TLHLRSNCFVLHLPLQNCPTLLQEYVRGAGALRIVAGGVIIAIRKSSRQTTACV

SEQ ID NO: 952222 - protein, 55 aa, Homo sapiens
AAPRFKEGFWIPILKLRSPVTFLSRSGAGHHTRYPIEPGNRYRLSQLHQVHVVLI

SEQ ID NO: 952223 - protein, 178 aa, Homo sapiens
RRPRCQKDLDSYLKTTIASHLPESDLRSTYEVSNEPGNRYHSPATSMPWCSMSGLRPLGTSYHKGRAFSMSTITPLRTHGIIFPELGLWHWACQRVDISIYEGQLKISSGPRNSRHLHTSVAPGCTLYCRGQIREANTEHRSQEVLCGPGSPCNMGHILGGTTIKRFIALFKDPAFSF

SEQ ID NO: 952224 - protein, 63 aa, Homo sapiens
YQVVVKNVTIGGICTYTREWYRAKVARIKELLPDCGISDRVSSAVYRYVSTEEDHPRDTQASC

SEQ ID NO: 952225 - protein, 54 aa, Homo sapiens
IGRGGRIWAGTQVWLINTLLLQAQHQQAFFVTLQHFLTITHQWRQLPHECGCTF

SEQ ID NO: 952226 - protein, 67 aa, Homo sapiens
PDVVAHACNPVVCDAVVGGSQGQEFETSQYGEILSQKNKNIKAGVGPDTVPHTCNPSTLGGRGGHIT

SEQ ID NO: 952227 - protein, 45 aa, Homo sapiens
MTVLRYRVDRTGLTPRSLPVLTLPDRTWDFPYVTPGDSSTTSTLH

SEQ ID NO: 952228 - protein, 48 aa, Homo sapiens
WALVQGGRLVVSVVHSASQLGVHAVAQLVFFAMLAGCSTNAHIPQHPI

SEQ ID NO: 952229 - protein, 71 aa, Homo sapiens
SNSTKSTGGRTGNTHYGKTSRKPAGGQAMGVTERVTSVGACLVWRVGCHRGAYTWYIGGEEEGFLRIMGGG

SEQ ID NO: 952230 - protein, 50 aa, Homo sapiens
RRSLSVSGDVISMLEAINELIRFDHIYTKPLVLEIASETESQANVVKTEL

SEQ ID NO: 952231 - protein, 77 aa, Homo sapiens
MGSLYLGIIPYLRLNYDQQISKAHKADATHPMCQPYFHGLITHELVICQDPTLPCPQGGVSIRAGGDGTKNEKISFI

SEQ ID NO: 952232 - protein, 189 aa, Homo sapiens
LSLKCVSVCVCVCGIWDWLQTEAQKDMIHADLSPMAWKALVQSSPLHNWERHSQWRHAPIFYVCQFSQGEGTKRAFSCGSIKSPLKSDPSCWTNSRGSGFCPLTLPLSCQPSESPHNTKPSPDIRLLLQGKNTYFHVRYQELGFPGNSGREREFKMIRNIHSDQLDPFSSLLLRLYLQHRAGSQASPSH

SEQ ID NO: 952233 - protein, 66 aa, Homo sapiens
MPCDQHQMQIHLYLVRGPCISEVLPLVGLAKYTFTFFSLKQARNVEQSYNELRFISLHTDLDCTDG

SEQ ID NO: 952234 - protein, 52 aa, Homo sapiens
DHIYSTDSVYIVATFITSSGNFLLKNPTFMFVTCILSAIEKPSGSLQPLRDT

SEQ ID NO: 952235 - protein, 35 aa, Homo sapiens
GFKASQNELGRIPFSFIFGIVEENGILGKLVDKGK

SEQ ID NO: 952236 - protein, 44 aa, Homo sapiens
QRWRPEEAWALEESKIFLSPSPAQVSPFPFPSRWTIPSFTVKAF

SEQ ID NO: 952237 - protein, 38 aa, Homo sapiens
IHMGLSSFAVPLHGCTGIAVCTSRQEAGEHVSASFNSI

SEQ ID NO: 952238 - protein, 36 aa, Homo sapiens
GGSSRTPTLHVSKSSRKIWHPHIAADAISAKKSNMN

SEQ ID NO: 952239 - protein, 104 aa, Homo sapiens
MGENDQHATRQEYVCRHGILRTSRENMYLGSSELSETNMYMGSSELSERICIWDPQNLQRVYVYGILQNLQRPLHINGPGMMPALGEERVTTVPGKRAKNGQNR

SEQ ID NO: 952240 - protein, 100 aa, Homo sapiens
LYDFDYAQVLYKWNHTIFFVCNWLTSSSIISLRVIHIVMSENFFVFLRLNNISLYVYATFGLSIYSLMNTDCFHIVCVYVCVCVCVCVCVCMVFFWRQRD

SEQ ID NO: 952241 - protein, 33 aa, Homo sapiens
GSNNSPASASQVARDYMVRASTLHVIYGICFIL

SEQ ID NO: 952242 - protein, 68 aa, Homo sapiens
LLEVGLVSCYISFNKLSTQNKGYKHNDVIGIIRTILVGNHMAIFGKVKFLRKQSRQATQFKNIIHPTA

SEQ ID NO: 952243 - protein, 115 aa, Homo sapiens
SLVLFKCFIYWRWICSVPGLECSGTISAHCNVCLPGLSNSPASASRVAGTTGTHHHARLIFVFSVETGFHHVGQAGLKLLTSDDPPASASQSVGITGVSHHARPDFCIFSRDKGK

SEQ ID NO: 952244 - protein, 51 aa, Homo sapiens
KAANMFSIMPLCATLKCAVFHHGSLNTHTHNATNTNHSLHPTISGLSRAAP

SEQ ID NO: 952245 - protein, 36 aa, Homo sapiens
CSSNIHSIQGINHPRQAVVQFSAAWPTHAGASSQQS

SEQ ID NO: 952246 - protein, 38 aa, Homo sapiens
MGVASLPHKTVYEDKLRGSPTQCFDHVLFHELSVVKQR

SEQ ID NO: 952247 - protein, 96 aa, Homo sapiens
RTYVSGGCDASIKLREVRDSMCRPTFIGHESDINAVAFFPNGYAFTTGSNDATCRLFNLRADQELLMYSHDKIICDITSVAFSRRERMLLAGLQQM

SEQ ID NO: 952248 - protein, 39 aa, Homo sapiens
VFPPDSLKLLGSSDPPALGSQTAGITGVTYFAGLQHMPG

SEQ ID NO: 952249 - protein, 37 aa, Homo sapiens
TDSPMHRLVFHKHVLTLATKVTKPHGTKGWNFKGYVR

SEQ ID NO: 952250 - protein, 38 aa, Homo sapiens
SSYTDSPMHRLVFHTHVLTLCHEGPKPNVLKGGNSEDM

SEQ ID NO: 952251 - protein, 100 aa, Homo sapiens
RSTDSPSTDLLSTMHAYLSHEGPKPHVLRVDLKDMYRGIKQIPGGTVTFNDKVKISNKSYNPVLISDTSFKDNSFPKANPSSVRLARGVCFARGEFPILN

SEQ ID NO: 952252 - protein, 75 aa, Homo sapiens
SSRGSQQLYRLTKHRLLFHQARLTLATSQATRTKGGLQRFCPGINQFPGGPVTFNTGSNSATGPTIQCCFQIQAS

SEQ ID NO: 952253 - protein, 35 aa, Homo sapiens
KQLLHDSLVKAMLNANEGAIVEVALGMVLQGTMLF

SEQ ID NO: 952254 - protein, 61 aa, Homo sapiens
AVNYMTQYNNNNNNNNNKTMSSLTNMVKPVSSQNTKKISWLGWRVPVIPSYVRRLQSVLNL

SEQ ID NO: 952255 - protein, 84 aa, Homo sapiens
GSPSSYTDSNCLGWGGGGPASAIARPTTYLGLSLDIRKMQTVVSISEGSDLMSKCMVNCLAKCLARAEQFLVKVCILGYVQMMF

SEQ ID NO: 952256 - protein, 76 aa, Homo sapiens
PKQFIQTQMHLTPAVMCHPVLCVCVCVCVCPQLDVSTVHVCVSVPVGMYLLCVCLCVCLRVYVFVSLLGCVHGVGV

SEQ ID NO: 952257 - protein, 47 aa, Homo sapiens
DSPMLPHVSSMLAVNELPSSSTVLNQQLGCLWKRDQLLKCLPFGFHN

SEQ ID NO: 952258 - protein, 52 aa, Homo sapiens
VADVVGCADRRCSAMLALPKEVTAAPAGGVPPELCVAITTALSKVGPDNNQP

SEQ ID NO: 952259 - protein, 38 aa, Homo sapiens
PNAVIQTHGEGYVMPTEGAIVKVALASVYYNGQCSLTS

SEQ ID NO: 952260 - protein, 51 aa, Homo sapiens
MQASSQYANGQYRLGRARAHACVSRSDQDRLQSLGLSSSDVTQQLQFLLRG

SEQ ID NO: 952261 - protein, 55 aa, Homo sapiens
ALTTDQRQITNVHLTQILCFSVCCGSRQLTDSQESAITSCNWRLYSLAFAGIYFS

SEQ ID NO: 952262 - protein, 175 aa, Homo sapiens
MSPRNQRIYILLQHHTTPIPNLTTYWGSKALLSKCKRTEIIANYLSDHSAIKLELRIKNLTQNRSTTWKLNNLLLNDYWVYNKMKAKIKMFFETTENKDTTYQNLWDTFKAVCRGKSMALNAHKRTQDISNLDTLTSQLEELEKQEQTHSKASRRHDITKIRADRKVQYSTGYRA

SEQ ID NO: 952263 - protein, 32 aa, Homo sapiens
RYTIPFCCSHFDYRSYGRIKLCQTYHLRSDWI

SEQ ID NO: 952264 - protein, 85 aa, Homo sapiens
VSELSMPYHPCTHGPGTSRPPDHTAQEHPEHTLLGKGPAEENILIIFCREQGPNCLIMGTSLNIFPGRSPTAQTPPVQACKYPRL

SEQ ID NO: 952265 - protein, 49 aa, Homo sapiens
ICSAYTYSDVHLLLPGRVIALDPDASIHIQHLAGSSEHCKPVEAYNSLC

SEQ ID NO: 952266 - protein, 71 aa, Homo sapiens
YAIMSLAAVYKNITSSITSIRGLAWQPHGGRRAGVCSVDGSYDHACHVCQWPQGKREWYGKTSVQVGPIML

SEQ ID NO: 952267 - protein, 171 aa, Homo sapiens
SCVPPTLTLDLRYWIHHIATKSGKTVANFRHHFTDKHKKASIIHPWPLPIRELNTPLHLYCPGLKTLVLCLGHTRVGWVSGNGTSGSTTLQYSGPPSVGASKKQRLLKGGYSSYRSRVTNLYRHGSPGSLVFRAKLPSSKFFTPHSGSYKVLWANNTLLPSRSFLSSDNQP

SEQ ID NO: 952268 - protein, 82 aa, Homo sapiens
LETQIVIQKKILIALILSRLKEVRKLQKNKLKPSRSSFMKLKERSHLHKIKVQGEAVNADEEASASYPEDLAKIIDEGGYDK

SEQ ID NO: 952269 - protein, 41 aa, Homo sapiens
VKLTGQCKTDGQCHTTASVNCLASVNLTASVKRRPAVQRRP

SEQ ID NO: 952270 - protein, 57 aa, Homo sapiens
MAIGYAMTCDGVRTSGTLVLYGVGVVTGVGRHTVGDTRYNYGCPLTLVNNTLRYGGL

SEQ ID NO: 952271 - protein, 74 aa, Homo sapiens
CIRSTQYNYSPPSNSDMNQPSVQPLIHLIVITAVGLDLVHDCMAHGSNSLTQAMKPGTRHNGYCASKGGQQAPR

SEQ ID NO: 952272 - protein, 67 aa, Homo sapiens
PYKQLKTFWRGFIILDAIKDICDSWEKVKISTLTGVQKTLTSTLMDDLEGFKTSVDEVTADVVEIAR

SEQ ID NO: 952273 - protein, 78 aa, Homo sapiens
DEYDDAELIGKTMEGADQCKVLRLDSKLGAFQGQQRMAQRGCIRACEEERVETPVSEEPGARWRTLAPKLSHFLLNGE

SEQ ID NO: 952274 - protein, 35 aa, Homo sapiens
RIFCHEQTAAAEGKFGIAMVSLYCLLEGAAACEIG

SEQ ID NO: 952275 - protein, 61 aa, Homo sapiens
SKDPPSRLIQTHAVAEQNTSCFRKVLNPQDRSILQEPGYRKVPGTIHEYIAMTTMLTMEGA

SEQ ID NO: 952276 - protein, 121 aa, Homo sapiens
KRSCRGQPGEGGTLRTGQSLGSVPLAVLPSDIEHELWVPGTVPHACNPSTLAGQGRKITSPVLENSLGQRIETLSSTKNKKVSWMWCWHPVVSATQEAEPGGSIEPRNFRVGVCLTCLGYR

SEQ ID NO: 952277 - protein, 38 aa, Homo sapiens
MRNSHATVTDLYSSSGPMPQHAGQSRMSPGIPNVPVAD

SEQ ID NO: 952278 - protein, 114 aa, Homo sapiens
EQTVLNRITLMTICLVILAAVGVGGWSRQLQQKVCLFLLSALSVSALYMLKVCGLLYTHLELLLSSQWILLSLCNVPLFPKEFQQPLPLFKIYVYMILFCRPFTFNVPMLLCLK

SEQ ID NO: 952279 - protein, 68 aa, Homo sapiens
KQLIQTQVVIDAGRIAVFPSLLTNPKTNIQKESYVTHVEYHSRPPGTQITASGESWIRPIPCRVCSLR

SEQ ID NO: 952280 - protein, 33 aa, Homo sapiens
STLLHDTRNKVMENTDAVAQAHNGEAGGRTAHV

SEQ ID NO: 952281 - protein, 35 aa, Homo sapiens
LLLPKDAASLLILSPQNLAVSFRTTLAGILALLPN

SEQ ID NO: 952282 - protein, 47 aa, Homo sapiens
MVIPVHVKRRPVHAHTCSCQTMASDCQCLFVDVEANDCQCLVMAVDG

SEQ ID NO: 952283 - protein, 106 aa, Homo sapiens
AHKISYHTQHKGRLKLQSAPVCILSGRSCKISTRCGCCGEKIALDETPQACSSSCGITTRAACQASGCLTQDNQNWQTAPFWTPNECGEHTGQGCPQPATLYSSCS

SEQ ID NO: 952284 - protein, 142 aa, Homo sapiens
SRCPNGGHGLPIVTSYTQISDHSLATWVALTTRCSSLRSLHEVLQDNDKVWLLRDHKRWNETPQVGVSCLRNNYPCSMPGLSVLIHDNQHWSTAPSWTPEWNAGNTLNGDVLNQLHVQLMEQRSCKGFKQCNPRTRNMYPGT

SEQ ID NO: 952285 - protein, 139 aa, Homo sapiens
KIVTVYNISYHTQHKGRLKYRGSSLHPFRKVPAREGQGVAVAGSEALDETPQAVSSACRTTTRAGCQASRASPTTTSTGRRRLSGHLMHAVNTLDRDVLKQLHVQLMELRSCKGYKQCNPRSRNMDLGLKDGGRYEQYR

SEQ ID NO: 952286 - protein, 37 aa, Homo sapiens
HSRGGLPFYPTEVEAAVRSMPLVEDVAVVGLPAESGT

SEQ ID NO: 952287 - protein, 75 aa, Homo sapiens
ACHGIGIRNHLDSSKAGRECQCAGAIFAHSDDRGINVVKSSTKNNGPFPWDEKCVLPIKCPECMELVEDDRQVSV

SEQ ID NO: 952288 - protein, 138 aa, Homo sapiens
MLGDNSTHITGQRIKTPTSYLYKNQLTIDQTPKCHSRNVKLLESTTQGETLQDIGSAKIFAQHKTLKTQAHKIKDEQVGFNHKWTKFLHSKGDHQQSGPDSLQNVKKVQTNPMIFIPGRNGTGLNIGKPINVMHHIKD

SEQ ID NO: 952289 - protein, 39 aa, Homo sapiens
MLAHKWTRVVTGHLNSAFSACDCFWAYAKLSYVPSLPSF

SEQ ID NO: 952290 - protein, 51 aa, Homo sapiens
FLDLTVLDGLRPWKGSEMTAGVELIVYTVPGHTVPILSLPDPCPPHRRPGN

SEQ ID NO: 952291 - protein, 54 aa, Homo sapiens
DVRYSSYSNFLYTELSYIPDGRQNGECISTAPSRAQAGLTMNLGDTGTHTIHKI

SEQ ID NO: 952292 - protein, 106 aa, Homo sapiens
MSHVRITTLLGVERCIVFPGRDLPYVGTYGILGSPWRQSNGPSSDNLRVEVIGVVVSIFFPTNSIINCQRLTQKSSTAEGLNADIKCSQKLVTCMGAGGTFLWTAE

SEQ ID NO: 952293 - protein, 135 aa, Homo sapiens
PHRSTPVIPLEEACLISRTIGRETQQLRICAVAAGHPGICSPVRWKKLAYTWESTEATCRRHRATVDRYHLASPRPKQALSVRDDTPEMCSVSCASGERGLCKPNSLVPHCSNTPGALSLLQASAQGAHFLPLPH

SEQ ID NO: 952294 - protein, 70 aa, Homo sapiens
EVRQTKSAIYFQRGVTELHWCIAMASQVSAPFQLLPVSWLGLLRPTWNELHIWPHARGFVRWPLILWYST

SEQ ID NO: 952295 - protein, 109 aa, Homo sapiens
MPGQCCDWPCLGSELQTAVSDLREHLAVFAWVIRCEVALQLLQVAGCQKAIFKVKSVGQQQTHPAEQTIGSTFTDQNGSCHQSLPSASSYFFKAVFIIDGGLKALEWSR

SEQ ID NO: 952296 - protein, 71 aa, Homo sapiens
SLINKHTTKDTCLRRFRAQEESARKPWWAKHIMAARGVEGRGVAATEQTPGSVASSVFGTLGVAEPGLGWA

SEQ ID NO: 952297 - protein, 77 aa, Homo sapiens
MVSLPSSTWYLAVGENQWSQVPLHFITDDMQFSDLGGIHGIAVVFLGEFFHGVEQFHGVGESSELTRTVATDGPGTR

SEQ ID NO: 952298 - protein, 33 aa, Homo sapiens
MSISNDALSLQGRTNEGKPSSSMSSDFANATIV

SEQ ID NO: 952299 - protein, 119 aa, Homo sapiens
MLVSLLVAHLYLDTALKIGVSWLLGGVCAPLSLLIVLNQGGSQQHWLVLSNLSLGSPLIPVGGLLHGHWRVVVVATVMYLCRLLSVPAHLRCDGQVNADPYLHLDFTYFTINSLHMVPL

SEQ ID NO: 952300 - protein, 119 aa, Homo sapiens
MSVLVCLYGRECEYNLTPILLQKYSKPEKAVAQTSATCRDFVSSSLLLGTVLCIVEKPASCALPHLGDYMTLYPCVSTSMCADLDNYTRSKHDRTHAEETIVDQLTLSHPDASVLRLDE

SEQ ID NO: 952301 - protein, 71 aa, Homo sapiens
MVRHGNESLPLMPPGDLDYFLLPTAGSQKPSGPTWLDLHIFNSLVTSNFLMRQSTVRHQLNTVQGSSTGNL

SEQ ID NO: 952302 - protein, 41 aa, Homo sapiens
TKERTLKPAIQKHKANPPKEASFYLCRCVTTVNKNVRISNI

SEQ ID NO: 952303 - protein, 58 aa, Homo sapiens
HGPSLSTNSYNHAWPVVDRYTAMTSHWPVDDHYQHIPCTGSSFARKRPITIHGPCVVP

SEQ ID NO: 952304 - protein, 38 aa, Homo sapiens
NSYNHALGRRCYTNSYRPCTGPSLYSITAITMHGPSLN

SEQ ID NO: 952305 - protein, 58 aa, Homo sapiens
VNSYNHALGRRLTVNSYNHALAVVEQPTAITMHGPSLTMLTAYDQSWAVVDHSPAITS

SEQ ID NO: 952306 - protein, 33 aa, Homo sapiens
ITILAVVYTNSYTITGPSLSTNSYNHALGRRLT

SEQ ID NO: 952307 - protein, 66 aa, Homo sapiens
RWKLMDLDRLSLTQSSTEMMTWLNQRNPEDKHNAVVTNIVVSESTRGLVESKGHGNSFGMLTAFGL

SEQ ID NO: 952308 - protein, 51 aa, Homo sapiens
LSVLVARGTGTNMLERGASIEHRDKKGFTPLILAATAGHVGVVEILLDNGA

SEQ ID NO: 952309 - protein, 30 aa, Homo sapiens
CSDNPAGVITRIMKQEFETGLGIIVETLSL

SEQ ID NO: 952310 - protein, 42 aa, Homo sapiens
FYLHFWAHGETPLLLKISQMWWHATVVPATREADVGGSPEPG

SEQ ID NO: 952311 - protein, 42 aa, Homo sapiens
MAHRDYHAENLIWLPQRDGAARVGMIDFQDAVRAHPSWDLHS

SEQ ID NO: 952312 - protein, 37 aa, Homo sapiens
RTRKCSVSDESDLQMMKADRSPSVHRSGQRSVPIKDK

SEQ ID NO: 952313 - protein, 56 aa, Homo sapiens
RVGAGRLRCSSRKRIPPLTRQMARQGEVAPQHIEEPAVRSGRPQADRVGDGPPQKA

SEQ ID NO: 952314 - protein, 79 aa, Homo sapiens
SALVTPLGAKPGMEPAARECSANRSSTWRWSESELSPRELATKFTDEKQYFVCEATVYRLLKAQDLIASPAYIVIKARD

SEQ ID NO: 952315 - protein, 55 aa, Homo sapiens
MSWLRLAERIVVNSVKCCMKNRHRDEHRQRHARQRQQQKERDRRQRRIPGVAHPQ

SEQ ID NO: 952316 - protein, 61 aa, Homo sapiens
QLGPMINVLIVVTHFPVFCVCWGSLMDVQSTAEDKHIVCEEGHRSSQMISYWPLVHDRFVC

SEQ ID NO: 952317 - protein, 72 aa, Homo sapiens
DYGSMVAHPVIKHEGSERADSLRLGVRDQLGQHGETPYSAENAKISRAWWQHACNPRYQSGLGRRIAGTRDV

SEQ ID NO: 952318 - protein, 45 aa, Homo sapiens
SSLLQQLRQVQPHLIQRIVDILIDAHRQQRVRQGAADQELHRQVI

SEQ ID NO: 952319 - protein, 50 aa, Homo sapiens
VDPVALLGPMRLQHIGHAADFVMKLAIGDVAAVPGVIAFPDDRRLALAVG

SEQ ID NO: 952320 - protein, 50 aa, Homo sapiens
IILFVPSIASPPSKYLINNRSKRQPNNINHCPSLYTYHLQNSNSTDLLGM

SEQ ID NO: 952321 - protein, 36 aa, Homo sapiens
HSMRIPHYPIDQYSYSSDALPQSYAYPPQYCSIESG

SEQ ID NO: 952322 - protein, 40 aa, Homo sapiens
CPTYSMISRGDEWTLKECDPELSVVECTGADTKEVRCANR

SEQ ID NO: 952323 - protein, 174 aa, Homo sapiens
YDIRSPDRAVCWRLPLPGFRCKVVKTWLNLVRQHGSRMDATRNARSPNQCGMDPQMKSHCEFHSRNGLQSSIRLVRRTLDVLRLQGLYWIDFKGGITIYGLRNAEGLNELCNEHWFAYVGGMNALSLQRAALEASSEEELADRIVDESGICVRVGDARQLLGYRSLDAGRRAAV

SEQ ID NO: 952324 - protein, 60 aa, Homo sapiens
KPYACALIQPDLLSLQEYVQQIADALHYLQNVSGYLFVRLVQPATPTLSERHPCPAHSSH

SEQ ID NO: 952325 - protein, 40 aa, Homo sapiens
ATKLRITRTLPSRREYPSFQTSTWDAVAHTRACPDVLRST

SEQ ID NO: 952326 - protein, 138 aa, Homo sapiens
CAVAYILYQMAAALYALGWGVATCRCPLGLVSHTRVNARLACVPSEDAQFPKVHWSARVTSSSAWHNERLDVPVWDVEATLNFLKVHFFPNNIILELPCSWVICPEGCAECGRPVPDAGDGSACELESRNSTSGPWEA

SEQ ID NO: 952327 - protein, 59 aa, Homo sapiens
RRDGYESLVVVSNRIAPPDDKKASAGGLAVGIMGALKAAGGLWFGWSGEIGDDQQPLKK

SEQ ID NO: 952328 - protein, 83 aa, Homo sapiens
GSARRTGRTLCAGTHQVISTISAVILQPASSRPFFGMPFLSSSPYTFGKLPSLAARTPAWPTSIIHEPSDVRQAKAVKAETIG

SEQ ID NO: 952329 - protein, 58 aa, Homo sapiens
DPARGRICVTASSYRIGRWVSAVLDIYCAGGLVDANNIGDDSLERRESLSLCEIDAAA

SEQ ID NO: 952330 - protein, 64 aa, Homo sapiens
MIRPFSMMETVSHTPLLVKVVGGVRVVMCSRSVIAAGRPDQRELLGPDRQWVRRGTGQRDDALG

SEQ ID NO: 952331 - protein, 148 aa, Homo sapiens
LDVNYVGYRSWAELLASVMPPVSIHRPGKISTGMTMSRMVMRMPSNQVPDVQALGRWSAEAMGSRSRRQPVFLSLYFMEEAKCYEAQAARVHDEGVEQGPDDMVRHGGPLADVDHGGRRGSRVVGRPQHSHLVLLLEHHIVQRLTGTE

SEQ ID NO: 952332 - protein, 40 aa, Homo sapiens
SDAELCGIQNSVSANRSDPVTLDVLYGPDTPIISNIVQRL

SEQ ID NO: 952333 - protein, 104 aa, Homo sapiens
RNGHASTLSENDQRQEWSCCGRRRCWMSRNAEVPLEEENRSLKADLQKLKDELASTKQKLEKAENQVLAMRKQSEGLTKEYDRLLEEHAKLQAAVDGPMDKKEE

SEQ ID NO: 952334 - protein, 55 aa, Homo sapiens
LLFARPSWSEREKLRLHIPALEVACAPDVLLGTVGSAHPIAPQIPNNRLLHVQLI

SEQ ID NO: 952335 - protein, 35 aa, Homo sapiens
YGDAQLNEPAGPVLSVIEAAIRHSWRQSTTKGYRV

SEQ ID NO: 952336 - protein, 78 aa, Homo sapiens
MSLRLECSSTVLAHCNLHLLSSSEFPASASEVAEITGACHHTQQIFVFLLEMGFHHVGQAVLKLLMTSDLPVLALPYA

SEQ ID NO: 952337 - protein, 38 aa, Homo sapiens
MMTLNEHAAFKHLFEQSTSCTALNPFNPEWTQHIVQRL

SEQ ID NO: 952338 - protein, 82 aa, Homo sapiens
MTLLCALILQVQPASRSCHNEHVLYTCPPASVDCPDLVTSVTCGLSAWPLSKTVLLQRAQIVTNACLCTKNACSTYVHAVLT

SEQ ID NO: 952339 - protein, 81 aa, Homo sapiens
LQVDLRVSPSDAVTMCLHRQYNRFEEAPHEHVCTPTSPALEHVQIGDILTVGQCRPLSKTVRFNVLKVTKAAGTKKQFQKF

SEQ ID NO: 952340 - protein, 35 aa, Homo sapiens
FQAGYEEIKRIWTTTRAPVTTVTGLDRYSAHSSAS

SEQ ID NO: 952341 - protein, 68 aa, Homo sapiens
QTLNYVGGHTLGKHEGKRGKKGTKEKKQDLGTGITASQLHHYDQNQWLPTYFTCLPKYIIAGHIVQRL

SEQ ID NO: 952342 - protein, 54 aa, Homo sapiens
KEINKEYGPRTHETGNISPIGITTTRAPPPTGKEAFIVVRSLFREDLNSATHAH

SEQ ID NO: 952343 - protein, 46 aa, Homo sapiens
RQTLNYVLNYEVAFSAAIPPNWLPRDLRIVIAAFLLLKGRATSPTQ

SEQ ID NO: 952344 - protein, 37 aa, Homo sapiens
GGTLYLQVEALLCCNRSYMQHFGLKSDRPKFVFQICP

SEQ ID NO: 952345 - protein, 72 aa, Homo sapiens
PVNADYVDAEEVSRQEERWRDLVLMLTECDLVTCEDRWRDLWHTEEVSVTGRGVVSPVDAEEGLVTGRGVVT

SEQ ID NO: 952346 - protein, 71 aa, Homo sapiens
ASAIYRARNVAAPLNSKKNKKSSLNPCATLEEKCYDCGSPDRIMYALTIYYKKMRNMQTMEVIIINESLGF

SEQ ID NO: 952347 - protein, 35 aa, Homo sapiens
ESRGIPLDAELLCTTSDKYNRFEKRHKNMSVHLSP

SEQ ID NO: 952348 - protein, 39 aa, Homo sapiens
AFSNFWNCFLVPAALVTFSHVEAHLSCSEAGTRPLLRFL

SEQ ID NO: 952349 - protein, 39 aa, Homo sapiens
TAQRNFANMQRCPPETAADYWLRPGREFTPFSPEFTRAS

SEQ ID NO: 952350 - protein, 89 aa, Homo sapiens
SDAHYSALHPTRTTASRSATRTCLYTCPPVFRDRPASGDTRHTCGDVPVLCSKDSRAVTRVSKFTKVCPVPRKPVPEVSESWYIVPASP

SEQ ID NO: 952351 - protein, 114 aa, Homo sapiens
LCGNEQEPGKDVCCAPSMPNSEFLSGGLHEPTCSPCSSLRTMPPRRDLESAVGIVTEGDHLLCTLPATHEVHAQVPSRAGVVGEVVETGHLAGELATAGLIIVVHVGDHIVQRL

SEQ ID NO: 952352 - protein, 52 aa, Homo sapiens
SDVNYVGHAAAALRRGLGSLGVPVCGAAELSVNSLEKFTSSHGFLSTVRPTV

SEQ ID NO: 952353 - protein, 93 aa, Homo sapiens
SPNYRTPTVLGSVATPLRILAQQWDQSVVTLVTLDLAIVGRQHRDVDHRPGRQLLDRALGAARQTLIDAASPTRCPNYRLGCDAVKDMLVWID

SEQ ID NO: 952354 - protein, 43 aa, Homo sapiens
MPLTLQDGIARPSRWSKLRNMIVRALCKRVAQERWMEASSALA

SEQ ID NO: 952355 - protein, 68 aa, Homo sapiens
DNYAVHRITPPLFLIPTLPQCTQGPRHLIFLIHRVLSSVIHKDQDTFLFLVTEPFPSVIQQDDDHVPS

SEQ ID NO: 952356 - protein, 39 aa, Homo sapiens
LTLNYVSPDGSYLLPVENHCSTLLLCQALTGHAGTNMSF

SEQ ID NO: 952357 - protein, 48 aa, Homo sapiens
DGFNGTLDRLLIEGLVFESAVSKKGSISYTPGREKTTTIDRAGRATFQ

SEQ ID NO: 952358 - protein, 43 aa, Homo sapiens
IGDICHTWATCLASVARQCSFNAAQRSPRSAALPRSQFQKVSE

SEQ ID NO: 952359 - protein, 55 aa, Homo sapiens
DDSRGPDGVNGTLNTSTLQMLLTLCSKVHNACGLKIHMANRNSENQVRDHNLGNS

SEQ ID NO: 952360 - protein, 39 aa, Homo sapiens
IAYSASTNRHQNTFVHLSPLPSSDRSTIGDIVDQWRDVP

SEQ ID NO: 952361 - protein, 50 aa, Homo sapiens
MLVQPESRLRGRCKRRGPLCWDDDKKALAGRTVSVRFQTLEFRYSLDEAM

SEQ ID NO: 952362 - protein, 74 aa, Homo sapiens
LLLQSSEYPVTLNYCAVCIHHGLCVPALTTINDMHISYYTKLYKDEMQLASAQYRAVALLLRRLGGVCENLYTA

SEQ ID NO: 952363 - protein, 68 aa, Homo sapiens
TLTTCMQSNSKIYNNNESKMSLTMYLGKQYSPFFFLYCFYQQASTSIISNPLLFGPHTTILAHIVQRL

SEQ ID NO: 952364 - protein, 33 aa, Homo sapiens
MGLRHYGSSWLDLSSGTYSIPYPMSFLLIVLRL

SEQ ID NO: 952365 - protein, 40 aa, Homo sapiens
MVIAVVYGTEALNCKKFRRPYIQYPDATDEDFTSHIVQRL

SEQ ID NO: 952366 - protein, 34 aa, Homo sapiens
FTDLEDPSTALQVGSQVQGICRGSEGRLIATRSL

SEQ ID NO: 952367 - protein, 42 aa, Homo sapiens
GAQTWADLAGVKDRLLVGAQKCYGPEASLQDLTFTGESELQS

SEQ ID NO: 952368 - protein, 167 aa, Homo sapiens
RKVSNGMKLMEWNGINKMSQKEWNRMAMKSNVMELQGIDVNGTEWNGIQRNGIEWNGMNGKDSNGNHSNRMHFNKIGSNVMEWNGKESKRKEWRQMEWNGTESNGIEWNGIIWNWNLNGMELHMKWNGMEWNGMPLNYMDWNWTRLEQSGMESDEIEWNGLLWNGVV

SEQ ID NO: 952369 - protein, 34 aa, Homo sapiens
ETCCMGCQVYEAYGQTECTGGCTFTLPGDWTSGH

SEQ ID NO: 952370 - protein, 34 aa, Homo sapiens
MFGRRITYVGIWTIAVQTRVLGGVRTLYSMIRRT

SEQ ID NO: 952371 - protein, 38 aa, Homo sapiens
TLHRASKVKNGKNGWQGGSWRSSPSTGCPELGAFGFLS

SEQ ID NO: 952372 - protein, 71 aa, Homo sapiens
MPIEGLHAARSFLLLRQVDEHLGIVLTDCVSTESGPVLNSSSSRFSSSSEVISLMGLERRLMMVTHCNTVS

SEQ ID NO: 952373 - protein, 48 aa, Homo sapiens
SGSPLDGLPYDDPCLHVTYTDDERTRRTYTPTRRPYNIVVRYRGEDTV

SEQ ID NO: 952374 - protein, 33 aa, Homo sapiens
LALTTYDDDHDDDDLTTDPHYLRNSRRTGNPTT

SEQ ID NO: 952375 - protein, 57 aa, Homo sapiens
RYSETPRRPFDYALDMKTIGETAAGVDGAEALNEGCHGLHISPSRALDFRDFLLKPD

SEQ ID NO: 952376 - protein, 124 aa, Homo sapiens
MSVVTRLECYKPLHGYQGQAQHDEAVDREEGSKKERRKRMMQSPFWFLPHLVEFYSNFSRNTRSKLRIPSCGGGRGAPRKYGRTPGSIHRAIARLQFSSMRQGPAAVLIGWGQRDLGRNYFQYV

SEQ ID NO: 952377 - protein, 51 aa, Homo sapiens
GPTEVAPAQTQTCNSRTHLYCTHTQSHTSTLEHAAPTTQSPVVHIRTHNGM

SEQ ID NO: 952378 - protein, 40 aa, Homo sapiens
HKYDNAAYKSYRSRLESNFRPYGIVSSIKRNLLKIFERGR

SEQ ID NO: 952379 - protein, 110 aa, Homo sapiens
MAKPGTLKSVACYGESISFSELSGEVLETEENWPFAVIQAAFTFLMGSTTIRNIKSHPSTHPQHSALPASPMELKMLSVTHMMVSVPGRSGRWVASVGKLPHMLLETTEA

SEQ ID NO: 952380 - protein, 44 aa, Homo sapiens
LTKRSTQNHKHKLGTWYFHKQLQLKQTSFSSTTFNQRFKHYIPF

SEQ ID NO: 952381 - protein, 33 aa, Homo sapiens
AFPSGDADTIVRPQLRGLSVRCLVCDAEDLVKP

SEQ ID NO: 952382 - protein, 61 aa, Homo sapiens
MQLIAVRWVSATFRSLLSSLTCCESWIPCMLPSLPLLLALPFLMAAAVAAFPRSSRSTAAW

SEQ ID NO: 952383 - protein, 68 aa, Homo sapiens
FLPVHNVQAFADTRRRIQSTRLQPGHGRALLLAQRGLLQGFQRSQATAQAVGLLAQFGQFVLAIALLF

SEQ ID NO: 952384 - protein, 54 aa, Homo sapiens
MKKIHLLLWDAYLAVARLADAQYQSIVNYKKSTAYQTKQELMQSSKEEAKKLKS

SEQ ID NO: 952385 - protein, 41 aa, Homo sapiens
AITGMTQARAAGLAYWRDGDPVEEVEQTGAAPSNPNKGRIY

SEQ ID NO: 952386 - protein, 42 aa, Homo sapiens
VQPHELTAPPEHPDCSSPHSNQLKQQPPPRHNDSTTHQWRTA

SEQ ID NO: 952387 - protein, 137 aa, Homo sapiens
SKRRCCFQREMLFCTLQNSSHHIPGAQREVRNRGWTLALIPQERDTRGNEQCCYQRSRRLTPAQGAPEWALSTALHVASGSPTARKSRTGWVSRRAGQGENMDDRMEGAQEACNPTSFTTGKLKALNDCLKAALSIS

SEQ ID NO: 952388 - protein, 102 aa, Homo sapiens
SDRARYHLVDGDYVVAEIMWVHPYRVCGFSLRVCAETRDRRDKDRRQRDRKKDSWARGTTATKARRQTGSGPECLEALLFIVVKARGQGKECQSSPIIAGHE

SEQ ID NO: 952389 - protein, 60 aa, Homo sapiens
RDWRLILRLDTTRFGLHSQATRFSASHEMGISRAGTGRIPSRGLSLRLEGTRGAKIAGSR

SEQ ID NO: 952390 - protein, 36 aa, Homo sapiens
DTAVNRARYHLVTGDNCWMTMDSNKARTPPILLGTD

SEQ ID NO: 952391 - protein, 49 aa, Homo sapiens
MRMDGRAMRTRIIAGHEISRDRRLLVGSAMDSNRARTPLSLLGADRRIV

SEQ ID NO: 952392 - protein, 59 aa, Homo sapiens
SPLLQAIPFVGHPNAAKWIDLTFHIALLHNLNTFLMVLTSVFGSTPPQWGDITFATRNM

SEQ ID NO: 952393 - protein, 73 aa, Homo sapiens
MEVNTAESGVDNPEASLTHSMPTVNDDNNSNNNTNNKTKVQVTSSAWSVLLATGEGACTLVEIGDSKVTASSS

SEQ ID NO: 952394 - protein, 96 aa, Homo sapiens
YVSGLGGLDSVGDVELGWLDWTGLDRTGLDWTGLCDLELGDVDSTVLSSTGLTLGRAGLRCGVLTLDWTDVDWTGVHNIVRDFGGLLYDVDPAGTA

SEQ ID NO: 952395 - protein, 43 aa, Homo sapiens
MVLQATALGANWANGAVTAQWVIGLLFGQHATMSCKLTAVHGC

SEQ ID NO: 952396 - protein, 78 aa, Homo sapiens
KSHAYSRKAHISTHAHTAHTQTHSTHKRTEHTHTQHTHEHTAHKRTEHAHTRTHSTHTSTQHTHKDTVHMECTHTTGR

SEQ ID NO: 952397 - protein, 60 aa, Homo sapiens
HTVHTHKRTDTQTHSNTHTHSTHTSTQHTNAQHTHTHAHTAHTLAHSTHTKTQYTWNAHT

SEQ ID NO: 952398 - protein, 76 aa, Homo sapiens
AGQSPCYQSKGTYIHTCTHSTHTNAQHTQTHSTHAHTAHTRAHSTQTHCTRTHMHTQHTHQHTARTQRHSTHGMHT

SEQ ID NO: 952399 - protein, 47 aa, Homo sapiens
VLEATDTKSVSLVRPQEGASGGGEVAVLPTPLPVVTGSPFPSSSFPI

SEQ ID NO: 952400 - protein, 125 aa, Homo sapiens
FFYLSLFKTDRSPSVTQAGVHGTIIVHCSLELPGSSNPISASQVAGTTGPHHHAWPVLKLFVERRLTMLPRLVLNSWAYQQALASQSAGITGMSHRGRPIPYSRLGVSNLLASLGHTGRIALGHT

SEQ ID NO: 952401 - protein, 31 aa, Homo sapiens
MAVNRARYQPDCHNPAIALADTEVLVRSGVF

SEQ ID NO: 952402 - protein, 105 aa, Homo sapiens
VTENFSHHIRVSDHEMIHMHYHLSATHGPNSVGGGWASSMMPSDWACYLSPNSVCWTNKNIAMPGRSWTVLKVFRLASPPAPTTNDKSRIGWFLACPSTVRAVLG

SEQ ID NO: 952403 - protein, 39 aa, Homo sapiens
DRGSPWSVKSYGWGGDVEGDVRCGGLQGLIGEEFYGVSE

SEQ ID NO: 952404 - protein, 115 aa, Homo sapiens
YNAKAFSFLPNPNRSLAPDSTNGRLETVSWMNGRTFADAVSYFVKQPAGGIYNGDVNLMRTFYILTAIDANRFFFHRHHVLPSCLYCTMKFVLLSYDFPVKTLFNGFFFFGVIFR

SEQ ID NO: 952405 - protein, 135 aa, Homo sapiens
NPVCAEADPEEGDGQSMPPPVFWFWFFFSERVSLSSPRLEYSGATLAHCNLHLLGSSDSPASASPVAGITGAPHHARLIIVFSIQVGFHHVRQAGLELLTSGDPPVSATQSAGITGLSRTRPSVHTWNINGFSRE

SEQ ID NO: 952406 - protein, 88 aa, Homo sapiens
GGRETTSLLFSTLIALDSFSLLTLYTFPDTELRQREMQPINHSTVPNHITESQTQETGLNSHVFRADSVCCLQPIIPALTVGLCIIAA

SEQ ID NO: 952407 - protein, 49 aa, Homo sapiens
TAGERRRGGGGLVNDITEEQWNRVRQWPGTTVEPEQTEVREAELSNARC

SEQ ID NO: 952408 - protein, 88 aa, Homo sapiens
NKLVLDVSRYAMVGALCVAIVDRPTPSSISHLLSPTLTEGHVFTVNWHCSPTSLMVLRCVYNYPEEIRRHFTPYFATYLIPPLKSILT

SEQ ID NO: 952409 - protein, 42 aa, Homo sapiens
LTPQVVGPLRTCVTYSDSSLNHAKLLTGSCMSVYTTYCAVTA

SEQ ID NO: 952410 - protein, 102 aa, Homo sapiens
VALEDPVSIREKPCVREHRTRLGTVAHACNHSTLWRPTQEDGLRSGVQDQAGQHGKTPSLPKIQKSARHCDMRLQSQPLGRLRQEDGLNPGDGGCSEPRLHH

SEQ ID NO: 952411 - protein, 44 aa, Homo sapiens
NSASVSPLHAKQHASTLATNSILMASIGQRSTQLGSRSSHIRHI

SEQ ID NO: 952412 - protein, 108 aa, Homo sapiens
TRLRGMRSTGPDPTGAGCAVSDARIYPEMEGPERDQLVIPDGQEAAQAAAGEGRNQQKLRGEDDYDMDKNEAESETDKQAALAGNDRNIDVINVDNQTRDTINLLDQR

SEQ ID NO: 952413 - protein, 31 aa, Homo sapiens
MLPGKMEQYKTVRAQKGRGLVDSLKPTEGLG

SEQ ID NO: 952414 - protein, 84 aa, Homo sapiens
TVWAIVFKATGLGLPREDNVHSVIGRDAEKEVVSDLKRPIAVRCVSCLPEYKVIAEDESSLSYQSTLDACNRVDNVLRDYSQLE

SEQ ID NO: 952415 - protein, 47 aa, Homo sapiens
LKKDHHGKRMVHGKRIISPMSDAVRSDENRRLSPVSCMRHDGSPGVS

SEQ ID NO: 952416 - protein, 97 aa, Homo sapiens
VIAVIAYDQARVHAVWAVADRFNSVSLRTATFIVACERICARAICVGSTPENPLLNPPGGALLQRPLEQRQIRQRQHGNALPPARPRTRPASRTPRM

SEQ ID NO: 952417 - protein, 102 aa, Homo sapiens
DPLSDTPDLASPAANAAAGAAGVCLPSSSMSLPTSPGGSWAGMIAPAGTPADIVQRLAVVLDRIVRSDEERQRLEAMGTVPVGGSAQAFNEFIAAETRKWGE

SEQ ID NO: 952418 - protein, 87 aa, Homo sapiens
TKAADRWHVPDPNNAQDLEKKREKALLNDFEQYQQHSGRELNGVPTGEVLLDSFKDAWSRKDYQTIIKVAQKIPDEALQEDEKLLLW

SEQ ID NO: 952419 - protein, 134 aa, Homo sapiens
IAEPSQLIMQGHTMVDRIVVEPKKLSPVEDSQRPGAHLTVKKIFVVALKNTLNNITYRDYFEQYGSIEVIEIMTDRCSGKKRGFAFVTFDDHNSVDKIVIQKYHTVNGHNCEFRTALSKREMATASSSRRGRSG

SEQ ID NO: 952420 - protein, 109 aa, Homo sapiens
MRPIPSLMKYTSNAQLNIFPQDIINVESYKLIVTPAEGEHEGSMQQGFYTTYNFDSAFTVTIQSPEGTVYKNGNGSKHLKAVIYNAVGEVNSYQEYYLIIMGIYISRGT

SEQ ID NO: 952421 - protein, 63 aa, Homo sapiens
SPDHREIQLQIAERSGIRITDEELNQAMGTIAQRNGMSLEQFREALARDGLSYADARDQVRRE

SEQ ID NO: 952422 - protein, 87 aa, Homo sapiens
KTHNNGDELHEHYVKHYSAGKRKGAIKTHNNGDELQEHYAEPLSKRYKRPGAVAHAYYPSSFEKLRRQITGGQEFETSLVNMAKPCL

SEQ ID NO: 952423 - protein, 47 aa, Homo sapiens
TPVVHFYCFWQHACTQHAQAISMPSIQLVMAHPQLGSRSSHFVTPWS

SEQ ID NO: 952424 - protein, 146 aa, Homo sapiens
IRPCRAGAGMPPSSAHVDLASAASAHIPCSLLPCGLRHTDLHLRRDHQSPENIKITSTEEQIAREPGIGWVLQITQRLLARRDRRPQGSHWLTWSPLVLCLSLSLCVLWSTFPLLPCASSLTRDYSVRAIRAGPLCPLPRVSSHST

SEQ ID NO: 952425 - protein, 52 aa, Homo sapiens
LCMEIADMGAWALPQALVMMEYADMGAGPSRSVLVMMEIAGMGAWALPQVLV

SEQ ID NO: 952426 - protein, 33 aa, Homo sapiens
LTAACAAVVMEVVHGDQQQLGVVVVEVCYGDQA

SEQ ID NO: 952427 - protein, 51 aa, Homo sapiens
VRLTSSRHSTRLHWNERWNGTEWNGMELTRIEWNGMEWNGINPNRMEWNVI

SEQ ID NO: 952428 - protein, 33 aa, Homo sapiens
AGSSTAQVICLSLKGVSVSPSESEERLGRGVQG

SEQ ID NO: 952429 - protein, 143 aa, Homo sapiens
MLAKEDSPSHITHIRAHTNVPGTITKANEQADLLVSSAFMEAQELQALTHVNATGLKNKFDITWKQAKNIVQHCAQCQVLHLPTQEAGVHPRGICPDALWQMDITHVPTLGTLSYVHVTVDTYSHFIWANCQTGESTTHVKRH

SEQ ID NO: 952430 - protein, 121 aa, Homo sapiens
MLHQCCHAGRISAVADDLGVGRRFLRVEMKNWEAFMGVLQNEGRVKTRPSHDKTGRTLRVSEGAAAIAGRCNNRTNYRFEVDYADREGFRPNVGIILLNQRNEVFWGKRIRTHSWQFPQGG

SEQ ID NO: 952431 - protein, 218 aa, Homo sapiens
PSTPAENVGTNKTSQLKEEFKPIAREAKNLEKRLDQWPTTINSVEKTLNDLMELKTMAGELQDACTSFTSRLDQVEERVSVIEDQINEIKREEKFREKRVKSNKKSLQEIQDYVKRPNLHLIVVPESDGENGTKLENTLQDIIQENFPDLTKAGQHSNSGNTENSTKILLEKSNPKTRIVIFTKVEMKEKNVRAAREECRVATKGSHQTNSGSSAKLY

SEQ ID NO: 952432 - protein, 40 aa, Homo sapiens
LTSTLHLQVRMQRQKTRQARGQMLRADLVTGLAIRSVPLT

SEQ ID NO: 952433 - protein, 56 aa, Homo sapiens
MHASCLIEVMGAVCELLQQYSPGNLLSLEGVRVSPSESEERLGRGVQGNSEKSIFK

SEQ ID NO: 952434 - protein, 202 aa, Homo sapiens
QDLEAEECRYSETSLLKEDVQTHRKEAKNLEKRLDQWLTTINSVEKTLNDLMELKTMAGELQDACTSFTSRLDQVEERVSVIEDQINEIKREEKFREKRVKSNKKSLQEIQDYVKGPNLHLIVVPESDGENGTKLENTLQDIIQENFPELPRQANIQIQEIQRTPQRYSSRRANPRHVIVIFTKVEMKEKNVRAAREKCRVA

SEQ ID NO: 952435 - protein, 34 aa, Homo sapiens
LYLLSLYGCQGQSSDSLERRGRGVQVHSEHRIFT

SEQ ID NO: 952436 - protein, 49 aa, Homo sapiens
MRLPTCIQPVTEPALETGPSDHKLSGCGYTRPFSNSYGHLMGARWGYRA

SEQ ID NO: 952437 - protein, 35 aa, Homo sapiens
DVNLSRKMGDTDPTSTGVGVPGGWARVDYLCRKAH

SEQ ID NO: 952438 - protein, 74 aa, Homo sapiens
MWFLGFISPPRKEGLALSPGRECMGPIIAHYSFDLRPQLPECRGLRGGHITPGPQLRKGPGGAEEGGTSKKSHG

SEQ ID NO: 952439 - protein, 38 aa, Homo sapiens
GPRISSHQQYLAFLRIVQHVTYKPLSTRSQFSLMGARL

SEQ ID NO: 952440 - protein, 39 aa, Homo sapiens
GSPIDWGDYTQVIHSGGRKMFLVVPPLSQTEGTGYRARI

SEQ ID NO: 952441 - protein, 128 aa, Homo sapiens
GRYPSCVHQRSRGLSGKMVSWARPRPSCSVQPWDSVPCLPAALAPAMAKRGRGTAPAVASESASPKPWQLPHGIGPVGMQKMRVEAWQQPPRFQRMYGNTWMFRQRSAAGAKPSWKTSTRAMLMVARL

SEQ ID NO: 952442 - protein, 37 aa, Homo sapiens
SSPISNDEDVYNKVERIGVIVQVRKKYSHVDLMGSID

SEQ ID NO: 952443 - protein, 36 aa, Homo sapiens
MARIHSLAHITTNIFLYSRSQACCMGSKHGGYRSSH

SEQ ID NO: 952444 - protein, 56 aa, Homo sapiens
LEDPRIGSHQRNANITTMRYHLTPVRMAIIKKSGNDRYLEMMWKNRNTFTMMGEDC

SEQ ID NO: 952445 - protein, 33 aa, Homo sapiens
MHAVLAYVLIYLHNHGPEELVRSEGAQARYAGV

SEQ ID NO: 952446 - protein, 48 aa, Homo sapiens
TVHADYVLDLVQDSNLVLHAAFLALQDLLEECIGMAYQVLRSSLSSAR

SEQ ID NO: 952447 - protein, 35 aa, Homo sapiens
RLGTILRPSALRNEGEMMTSQMKRRKSNLLMGEDC

SEQ ID NO: 952448 - protein, 103 aa, Homo sapiens
LLPSDMSGLLLPRGRERKRKENTGKRIQQHIKKLIHHDQVGFIPGMQGWFNIRKSINVIQHINRAKDENHMIISIDAEKAFDKIQQPFMLKTLNKLGTDGTKM

SEQ ID NO: 952449 - protein, 43 aa, Homo sapiens
TVRCTPRPRLSLLSLRLTLTPIRLSKLPGLSCRKGSQTAPITS

SEQ ID NO: 952450 - protein, 35 aa, Homo sapiens
LGVHRMVVNEVRWWTVCLSRSSPWFLEVGKCYGLL

SEQ ID NO: 952451 - protein, 49 aa, Homo sapiens
QPACSVSKSSFRSALASERMISRLIPAACEGCSMSRGSCLEVGVALFRF

SEQ ID NO: 952452 - protein, 80 aa, Homo sapiens
GEEKNLWARKAEVAVSWDRATALQPEVTGVKPVSHEKNKNKNPNSTYTFHLLRVVRNDWVLKIIHCKINGGTMRVPPVFM

SEQ ID NO: 952453 - protein, 66 aa, Homo sapiens
DIHQKQRTYRHMYLLWLAIYYGVVLVCIMYTGLCLKPFLEHIGPGARIIFFGSTTILMNFLYLMGA

SEQ ID NO: 952454 - protein, 53 aa, Homo sapiens
YVLDRKDAFFTVRCTPRPRLSLLSLRLTLTPIRLSKLPGLSCRKASQTAPITS

SEQ ID NO: 952455 - protein, 72 aa, Homo sapiens
ARICHSIAVSRVQDPVLSPRHLVLWHKQRVLSSDPGNVRNLRRVLASSIQNPLSSLPPLTPSAVLPSQENKV

SEQ ID NO: 952456 - protein, 76 aa, Homo sapiens
GTVLPYLHVYPTANNVIRYYGCCSSKCLVSEGYVASTVIIRLSLPSMVRTIFASQFPTILSPKDALAAVYNEVDDF

SEQ ID NO: 952457 - protein, 34 aa, Homo sapiens
SEPFEEILAQPMLRATSLWRLVRWLPIFLISFTS

SEQ ID NO: 952458 - protein, 48 aa, Homo sapiens
VTFWLSVYSVQSGAQTSRSLAWYAHITWVLWGSGSLSRLRTLRYPTDF

SEQ ID NO: 952459 - protein, 44 aa, Homo sapiens
WAGAQVCRSVCGLRRPVCRPVPGRSGARACLQAAAPVCPARAAG

SEQ ID NO: 952460 - protein, 47 aa, Homo sapiens
YAQPTVLDFNAPVLCINFEIRRLRNSPSCIDGTFIFIIMFRHFIIMF

SEQ ID NO: 952461 - protein, 104 aa, Homo sapiens
TAVLTHEEAVKRAGAMGASALGRSKPQAHKDRGLWLACGCCDHDGIRQRLPWQAAPRHLSGGKRLSQVNVPELQPAQAPMGDNCTRHLSEEANRNCMQRQHEQR

SEQ ID NO: 952462 - protein, 36 aa, Homo sapiens
MRPSARPRFRSARYLCVACACRPHWSRVLSLLLCLW

SEQ ID NO: 952463 - protein, 84 aa, Homo sapiens
PLLSLAHRQFPCVPQLPTLVHSTCHFPGLAGQVMGLAGPGSLGSPRLQGPCFVSSVSCRRHTSGPWSSSQGACAGSVAQEGILV

SEQ ID NO: 952464 - protein, 79 aa, Homo sapiens
PTQTTFHCTHVLSARSQFSSLWAGFHSARSIVHFVPCGSTLPHPGSSSQPWWAVSNQSPFPSSPAGSKQHHVTIAPIGP

SEQ ID NO: 952465 - protein, 71 aa, Homo sapiens
MWQHTPCQGQKFQASVGSQHTTSPFPSSPAGSQQHMSPCTIVRSSPSSAQQGVAAVKAQRGGQPALAVTLV

SEQ ID NO: 952466 - protein, 47 aa, Homo sapiens
PLGYQDLFSLRPSSPKPALASPANMPVLSRSLHSSGNPTGNCTCGPR

SEQ ID NO: 952467 - protein, 53 aa, Homo sapiens
VHSLYHGAYYAVNLLVLLCATHDASLCLMGSALLRALPIKSQCCQSVLAACGH

SEQ ID NO: 952468 - protein, 110 aa, Homo sapiens
AQPTQPIPATQLHPQCHHAHLFPSWHCTGLVWAVAVSSIGISTNIQPIPGPGLQPSSSLHSLACWARCTQGMFSCLHGIHWAPSVGMAAVHQGASSQQSALPGHAPSYGH

SEQ ID NO: 952469 - protein, 136 aa, Homo sapiens
QYSKARHMGHSKHKGQRGQVCSSWAVGRGTLCTIHPICSPHASFRLPTLVAQLAAGKARWSKVTCLSLHLHLGHMSIFLIPTGLGLSLHQAVSPTMPTIQQEVQQYNLPKAAKLTAGSVSHMVQSTCLSEWLAACT

SEQ ID NO: 952470 - protein, 82 aa, Homo sapiens
AAVVRTPSFSPGHSQFPWVLASNSYKTCSYQSGRGQVGGWRAWSRGPQAEGHGCVSSPEESVRCSLTYDFPAEGKQGPGILR

SEQ ID NO: 952471 - protein, 57 aa, Homo sapiens
LPFQGWLGRFGAGGPGVGVPRLQGHGCVSSPAERVRCSHNHHDYPAARETGSWIILR

SEQ ID NO: 952472 - protein, 90 aa, Homo sapiens
DCCRLVVLRVSPSPPSSPFAPRCYSACWVEGRGRAGLWAFRASWQPGRAARPPASGEACSCVRSDGDKEEDTLRRHPSDTRYPKCLERDK

SEQ ID NO: 952473 - protein, 93 aa, Homo sapiens
MDVTRKSLESYAFNMKASVEDIDTSRQDKKMRTNRRFWTSVNDIINWLDKNQTAEKEEMNINRKELEKVSKPIITKLYQSAGGMPGGMPGGRR

SEQ ID NO: 952474 - protein, 45 aa, Homo sapiens
MARQPSPLYLLCFLSSDLCLSPLLRYSGSPSLLSRPNHEMVWAYS

SEQ ID NO: 952475 - protein, 88 aa, Homo sapiens
VSAFIQLKSEAVDLEDNCTLEGWAEHSGLSLQSYDGGTEPRGMSVEGAPVQVLHWTLPIPGCQSRWLHPKPGAKACAGRLGMSWLARD

SEQ ID NO: 952476 - protein, 49 aa, Homo sapiens
GTEVKVRQQLYTYLQKKTLNHYPQPRGPQHPGPTKTPNLAQTSPETCKY

SEQ ID NO: 952477 - protein, 87 aa, Homo sapiens
PSSFSSLDTVSSRGFLASSSYKTCIFRPGLGRFWGSEGLAVGVPRAEGHGCCVFSCKKAVRCSLTYDFPAEGKQGPGILKGAWMKRD

SEQ ID NO: 952478 - protein, 36 aa, Homo sapiens
TLQPNTVFITDSERKTRRNLQIVVTLYSIDNGNMIV

SEQ ID NO: 952479 - protein, 59 aa, Homo sapiens
VTHQPTWGAKRHERSSYSGASQTQVTGSGRGRYRHQVLRQTFQPWKAHDVQALDTQVLA

SEQ ID NO: 952480 - protein, 77 aa, Homo sapiens
QVVYDGSPVRSSHCSDRLYERHLTEELLFSCVTEPLMDSSVKLDRCTIFILYDNYILHSSWGPFYYVSIAFYIFYEC

SEQ ID NO: 952481 - protein, 60 aa, Homo sapiens
YAQPPPLAVVQNLQLLSLDHSQFPWDSWLQTRTRLAFSGTGWAGLGLEGRRETGSWYPKG

SEQ ID NO: 952482 - protein, 87 aa, Homo sapiens
MIQEPVSLRRVSHSVTEHLTLSSGETHNHVPSAGDPYLQALCPKPAQPDLNMPVFYEFEAGTQGELTVVKAEKLEVLHHRKRWWLER

SEQ ID NO: 952483 - protein, 74 aa, Homo sapiens
AHHTLAVSQNSSLLSHDTVDVPWYYFKARTRVAFVSDWLSRFRGCRAWSCRPQAEGHGRVSSKEKQGPGILRVL

SEQ ID NO: 952484 - protein, 49 aa, Homo sapiens
ITRDWPHGKNKILGTKTRLGQEAGKLTEEGSRFDFATMNLAMNLMGARL

SEQ ID NO: 952485 - protein, 108 aa, Homo sapiens
GIRHTYSACSEPVFSVAIILELMGCKIAVGVPSGSFKYFSALVIPDSHSSNLFSRFLTSLRWVRTSSFSSEKFDLLKPSSLNSSKSFSIQLCSVAGEELHSFVGGEAL

SEQ ID NO: 952486 - protein, 69 aa, Homo sapiens
ARYRIFVPSETTSSKSTNRNAERAWRKENPPTLLVGDESHNSKQYGSSSKKLKLELPDDLAVPPLMGAR

SEQ ID NO: 952487 - protein, 69 aa, Homo sapiens
DSQDPVTRFVYRGRVTDIGVWGTGGDGELLDVRWWPEEFMGGVDWPGRESVIAGKGTDVSGADGYTSRF

SEQ ID NO: 952488 - protein, 54 aa, Homo sapiens
MHPDQVVVRGEEGPDRSGRRRYGDQLQLAEQHPCRRERGVGRGLGGVMLGAQTE

SEQ ID NO: 952489 - protein, 77 aa, Homo sapiens
LCTALLLSAIASSHAALHRQEATWFHVHLFSQSESSALVYAGQVGLVGSLPVSAPFNSSSAYTVRSYVFHPHSGRRD

SEQ ID NO: 952490 - protein, 176 aa, Homo sapiens
IGAALLSRSLQAFVRYYVERGEIRRFVIKCRVANQHSNSVAVRNGFTLEGCLREAEYLNGRFDDVNIYGKIYALQRSQQRGAGDALVAVNHLFAAQVNALPGKGFNDRIICDFNPVLNEHISLIRARSLDHHLIVQHDRSAAQPCLTANQHVVLDDAVSFHHGILGNLRAVAHRRN

SEQ ID NO: 952491 - protein, 122 aa, Homo sapiens
MRDRKGSELAVDVQGEDRVRGRTERGGKGGSIWMYGGPMAGYGSLTRGGEGMVMGIVRGSGVWVREGCNPLSGGDERGCGRGMGRPPPHMDYKYEIHKPIHVKRKCITVREYIMSEQIANLT

SEQ ID NO: 952492 - protein, 40 aa, Homo sapiens
FGCEMWRDGYGMGSIGRSGLEDREEVAAITHDSLNIHKPL

SEQ ID NO: 952493 - protein, 30 aa, Homo sapiens
MGGVDWPGRGGVIAGKGTDESGADGYTSRF

SEQ ID NO: 952494 - protein, 50 aa, Homo sapiens
RLRWGSRNTPPVPTLLVYPRIPLLSERLTRIHKPLHVPRLVSFLGKLYSL

SEQ ID NO: 952495 - protein, 51 aa, Homo sapiens
TDRFGARGYDDVRPRPGRRRCDDVVRRTDLDWPTGRVETLLDVVYGYGDGT

SEQ ID NO: 952496 - protein, 51 aa, Homo sapiens
SETPKSTQKQMQPRICQYRIYHCHSEGKEAWCMAGAGFCVNTLLCPIDIQQ

SEQ ID NO: 952497 - protein, 66 aa, Homo sapiens
ADDSRSRLISKHTTVEMAMEQMVHTLSYPDPQDCQGQEDHLSPGVRDHPGNDGENLSLQNVYKKLA

SEQ ID NO: 952498 - protein, 46 aa, Homo sapiens
VSGAGVYEPVHGSGPDIAGQDKANPLAQGSQCCYDVTLRLKPTKLP

SEQ ID NO: 952499 - protein, 102 aa, Homo sapiens
PHVSGAVMNCVVWASPEGRAFSLSSIDHGETGSLRPFTEATGPVQRLHPHDLITSPKAPPFNSIALGVTVSIYELGKDVFRQQQMLRYVYPGTWVKGLIVLG

SEQ ID NO: 952500 - protein, 57 aa, Homo sapiens
MWRSVANGADGDLNPAQQRSLLKIGYAAIDYLIPNEKRRSALVGVLLNPLDSAKVDA

SEQ ID NO: 952501 - protein, 39 aa, Homo sapiens
LPARLFADTPDADSVHLNIWLTSWRGDEVTVASESVTRR

SEQ ID NO: 952502 - protein, 131 aa, Homo sapiens
MILPLPRVKPHSAQALVDLLVLGAASGHEISAASAASLASNRMPLPWPEYSVCSRGPSLRKNNQLNGTPVSPLSAKVNSMTRHTVLSFEQRVMMLGNLRDQAPWASMRPTRWPISPRIAPGFDPGRIGMVP

SEQ ID NO: 952503 - protein, 72 aa, Homo sapiens
ENQNHSSLPDSDGTGGPAGTRLASPSVAECSVGRHRRRCSHGVWQPEVEGELRAFVQGADQHQGEHRSGTSE

SEQ ID NO: 952504 - protein, 51 aa, Homo sapiens
FKLDLSPNRRLCDRFNSYYYNRAKTVDQKIFYDICSSLQAKRQANNKRHRA

SEQ ID NO: 952505 - protein, 76 aa, Homo sapiens
MKSFAVLNCSLSEMGLVPQSTSPIGDAGSDGNQPCCCSANQFVNETDFSLTLGLPEHEVGYVVLDHNGFDFRQAVF

SEQ ID NO: 952506 - protein, 40 aa, Homo sapiens
MLATWSDMKVSKTCGQLDRCPGDVTACRGLRAQSQSYLEP

SEQ ID NO: 952507 - protein, 107 aa, Homo sapiens
SRGPPHAVASVIPALWEAETGGFLSAQEFEARLGNIGKTPSLQKIQKNWLAMVVYTFSPRLRWENHLSPGRLRLRCTMIAPQHTSLGNRVRPHLKKKKRWNQLKFPF

SEQ ID NO: 952508 - protein, 67 aa, Homo sapiens
QVNASLGDTVRTCLYKNKNKKDVAGHGDEHLWSQLLRRLTQDDRLSLEVGTAVSHESHHSTPAWVTE

SEQ ID NO: 952509 - protein, 70 aa, Homo sapiens
RFLHFKLYYEATVTKTAWYWYQNRYIDQWNRTEASEITPNIYNHLIFDKPDKNKKEERTPYLINDVGKTG

SEQ ID NO: 952510 - protein, 154 aa, Homo sapiens
MQGSAIINASLIKTLLKATLLPKEAGVIHCKGHQKVSDPIAQGNAHADKVAKEAASIPISVPHCQFFSFSSVTSTYSPTDYFYLSISSHTRQMVLQTKENYLLPASQAHSILSSFHNLFHIGYKPLAHLLEPLVSFPPWKSILKEITSQSICYS

SEQ ID NO: 952511 - protein, 145 aa, Homo sapiens
LEGKRTCCLHCAMAMGGNLGRNMTEWISQLSSTNSSQKLSKHCSQVDSVRGFGGKFGVQMDRVDQSAGGFEYQGKTEKHAPQKDYSSGFGGKYGVQADRVDMSAVGFDYQGKTEKHESQRDYSKGFGEKYGIDKDKVDKSAVGFE

SEQ ID NO: 952512 - protein, 67 aa, Homo sapiens
SGTPTPLIILVIIETISLLIQPIALGVRLTANITAEPPTHAPNWKHHPSQYQRINRSLLHYIIIHKF

SEQ ID NO: 952513 - protein, 71 aa, Homo sapiens
DCVWINMTVVTSEMVTAESLNIPTLTISSTASASPCAAIYQGVSHPLPGSSSEASLINVDLGVLYHILMVH

SEQ ID NO: 952514 - protein, 35 aa, Homo sapiens
SQSTADQYSLTPAHGGFDMGWRGVISRSPYKRYLS

SEQ ID NO: 952515 - protein, 80 aa, Homo sapiens
QTLNYVLCLAASEKRLHALSQAPDAGGSFLLLAVTLPSIACILICYWSRDRWACHPLARTLALYALPQSGWQAVASSVNT

SEQ ID NO: 952516 - protein, 90 aa, Homo sapiens
SDAELFDTDLPGSLGQSEEKPCACLRAVSHARLAPGPTVPSKKEIPLCGKSSLALAVSSVLSLNRCCSCLFPSMLVERAELQRRERVPEL

SEQ ID NO: 952517 - protein, 37 aa, Homo sapiens
MDGMERNVWNGFNGINRVQENGMEWNAMEWSHPEWNG

SEQ ID NO: 952518 - protein, 45 aa, Homo sapiens
MQESILQFTSNDKLLAVVVGPVEVSAYTIHGGRVDQPYVSGNPEL

SEQ ID NO: 952519 - protein, 50 aa, Homo sapiens
NPILESTINNMRLATLSCMYQDIPDSAAAIKGSFVQRLKSSRLALDTLCG

SEQ ID NO: 952520 - protein, 86 aa, Homo sapiens
MYLEISVEDHDSGCQASELPYKAWVIESVNVNDSTLTYHLRIYHHPTKPQLNAWQPESYFAGFLINNYISPAFLFQTIIALYLKLT

SEQ ID NO: 952521 - protein, 74 aa, Homo sapiens
MKFVSPVGIRLLSVRQDTLNSSVEEETSMLSTYCFTYPGSYTHIAWDRDLSRQRHTQKLYKGYSMYPRHGHECS

SEQ ID NO: 952522 - protein, 83 aa, Homo sapiens
DTIRAYTSTFVSGAWVSVGGSRDGRDAGGVGSSVGGSRDGRDAGAWVPALEAAVMAAMQGVKISVCVQAAGSKQKLSSCDFEK

SEQ ID NO: 952523 - protein, 126 aa, Homo sapiens
SSPQSQDLANESCVDHPGPYMTSWRRKNRRGSLHQYWSQHIDEISTVVTTQSAEVGPAKTYSPGPLEIDLDSMRNLMAILVNSLCVVVARYTLQMEQLNGILLHLESELAQTRAEGQRQAQEYEAL

SEQ ID NO: 952524 - protein, 81 aa, Homo sapiens
SPQSHDLAHISGGHSGPNITELARKNLHGELDKSGLSQIEESTTVVTTQSAEVGAAYTTLTESSDVRVSGPWYVSTCHSII

SEQ ID NO: 952525 - protein, 65 aa, Homo sapiens
MMGLMDVSPILQIEESTTAVNTQSAEVGAAETTLTELRHTVQSLEIDLDSMRNLVSAFTSPAQLL

SEQ ID NO: 952526 - protein, 77 aa, Homo sapiens
MDPVCFNIPEDWDERAKIDITTDSKPEDWDKPEHFLHPHAQKPDDCDEYDRRIVENPQLIQNPEYQVLSGEPSRQYR

SEQ ID NO: 952527 - protein, 38 aa, Homo sapiens
VIFAVKQLEIDAPCYFDIQKIQSVPVLRFTGGIQIFVK

SEQ ID NO: 952528 - protein, 53 aa, Homo sapiens
YRLQLGVGECTAVSPRDLSMNNLTELQSWPLPPPASSWSELRLFWEPISHIIP

SEQ ID NO: 952529 - protein, 66 aa, Homo sapiens
SSGLGSDEIIGCRSCPLSLSRFWVGTQKPLAGPGGAIESSDMQNPEKISQKANPRFYESNIICRGN

SEQ ID NO: 952530 - protein, 45 aa, Homo sapiens
CYVHRQPLAELISEPRSTAVLVGGDDPRNRTVVAHAGDDRGRSVK

SEQ ID NO: 952531 - protein, 77 aa, Homo sapiens
ETCPSASRAVYMLKGGLSRQTKLYDGSQYVTGLPSLIQTGLSVILSPLNTVQTKLLGLLNHLHQFSALQPLLDKNGS

SEQ ID NO: 952532 - protein, 84 aa, Homo sapiens
ELTPTIPPPWEVEVGRSQGQEIETILGQRGEILFSHQKYQSIIRTYWHMPCFSATQDVDVGDSHEPGKQRVAVHQYHAIALQPV

SEQ ID NO: 952533 - protein, 129 aa, Homo sapiens
LHDTRTLRLSVSKMYPRAFEVLRFQDCRRSCEADEGFLLAEDQPVFGVVEICHAGLPPFSTLKSLQVHLGTLQSAPLSEAHGYKTVTGPHGLPLLYPAVEQVRCQAVFSSQVIPGSPGPRGKVELGQAK

SEQ ID NO: 952534 - protein, 159 aa, Homo sapiens
ARSCPAGVVFDRPRFHAYFPEIFPIRIAPVPTYHSVCSPAQHFKETHRTSSTTSITPPSVVTRPAGMVTLPALAYPALFIAFALFFVLPLGFHGLWVPDETRYAQAAQEMLNTDNWVVPHFMGLRYFEKPIGGYWLIAIAQALFGDNLFGTRIASAPPA

SEQ ID NO: 952535 - protein, 152 aa, Homo sapiens
MAWRTQGVNGLLDIIASGPVTPASALQHVIQHDVGQVTGIAGQVPFQNKSQRLHLAAIFKTAGEPVWPVGRVRHLALPQGIKRGLQLIFRQAVGKPAARATAIQAKHQPRCFRRAPVLMGPQVQAAVITMDPRPHALCRRTFRPPDQRTISE

SEQ ID NO: 952536 - protein, 93 aa, Homo sapiens
MVTLPALACPALFIAFALFFVLPLGFHGLWVPDETRYAQAVQEMLNTDNWVVLHFMGLRDFEKPIGGYWLIAIAQALFGDKLFGTRIASAPPA

SEQ ID NO: 952537 - protein, 196 aa, Homo sapiens
MRHEFVATNLQLKMKMAGRWYCEDPVDEELNNRMRRLSASSTDTPAACASELLVLQMSSLDAGVADPDWKELHIVGTWPDITYSTTCVLTCAPDPSTVRPVAVLTQSAVLCLSASWKEKQDYAFACEQMKSIRQDLTVQGIRTEFTVEVYETHARIALEKGDHEEFNQCQTQLKSLYAENLPGNVGEFTAYRILYY

SEQ ID NO: 952538 - protein, 72 aa, Homo sapiens
PRIHQPAVIWTMKSKLRRSQMEMRNLLGIGVKVTSCYALAKRQAALCPCSKDLWNFELERDDLGYVVEEIPK

SEQ ID NO: 952539 - protein, 149 aa, Homo sapiens
AESPEKGAPWITTENMHVSFWSRLSVFLLFLHSAPDVQDWPECTLEENPFFFHAGAPILQCMGCCFSRAYSTPRKVQEDYVGPKERHLRLHLSVLLNHINRVTVVVGFHSGEPHGVPVHYLLLSQILNVLPSAVLMTADFLEWKIPLSS

SEQ ID NO: 952540 - protein, 45 aa, Homo sapiens
WDHSHREYLLTSSQHQYTPYNSCTHPGTHYHHLIHNFHNYGTTFN

SEQ ID NO: 952541 - protein, 95 aa, Homo sapiens
SYDHATVLHHGRQSKILSLKTNKKKKGRKEGGKGRKGLKLATGGFRIEILWGGGPFFIDFPTALFKKVTLGRRSRFKFFFSTENLTLTLGANFWV

SEQ ID NO: 952542 - protein, 38 aa, Homo sapiens
MPQTILEIHINNRVYDLDVRSGHSDSAAAIIGSFVQRL

SEQ ID NO: 952543 - protein, 158 aa, Homo sapiens
DQHMHLLLIITNSNLLTFLYPTKGYLPSTVAFSSDADLIVPLLQTAALSTRILLILAWRRMVYRRMVFAYGFSFNMILMLSVGFFFPLCDASSCVLLEGLFGSLGLLNILAKICINHLVHGKIVITLDEKRLYANCRTIHLNFRKALAVQMQKRPTCP

SEQ ID NO: 952544 - protein, 33 aa, Homo sapiens
YVQVVQQRTFISPIKCIEALKLEENRVVKRVKS

SEQ ID NO: 952545 - protein, 34 aa, Homo sapiens
SITYLHTLRLVDDVRSTSSSPPAPDAFPSSWPRT

SEQ ID NO: 952546 - protein, 103 aa, Homo sapiens
LQYPVFRRILIRSDFKTRDAFELWSHGSLIVTTVERPPAVYFLTAPTAITSLRMHTCPYCSKGRSASTVPDPLSVALQGCILVPGATLSTVFKSGMGGSLVGS

SEQ ID NO: 952547 - protein, 62 aa, Homo sapiens
MGTLPVFPNHATETQRLAFIDHLVENIFQVFHILDFEHMLLIVFLGRHSIDVHLVHQRPEPK

SEQ ID NO: 952548 - protein, 57 aa, Homo sapiens
MEFSNTLSRFGDLRPPTHFLLPSSDWVLLSDDAYQVLVLLLSRWEHDTFSMAVAHHV

SEQ ID NO: 952549 - protein, 67 aa, Homo sapiens
MTVIHHITSSYWYYPFTSSGKLRGSWYSSIKDETMSVLFTMMPNQSLSVLDKEVKWMLQPGTVAHAC

SEQ ID NO: 952550 - protein, 109 aa, Homo sapiens
RAGSGDREELDKVRVSEELRRARQWSSYSLLRLELSERTLRELIRTVQSLEIELDSMINLKARLENSLREVEVRYALQMEQLNRDPACDTWSHELAQSRAEGERQAQRV

SEQ ID NO: 952551 - protein, 70 aa, Homo sapiens
LAFLTYHEASCLQAPPSHLIRLVVPLQQQLPYPPGAMRYLAWRRMVFRRMVYAYGFSFNMILQVYQRVLL

SEQ ID NO: 952552 - protein, 34 aa, Homo sapiens
KSLAVAAVPLSQRIAGFQTLTSDVILLLLMHNRS

SEQ ID NO: 952553 - protein, 94 aa, Homo sapiens
MVYRRMVFAYGFSFNMILKYFSGSFFRTLRWIYTCVVLEGLLGSLGYNKDSAKICINHLVHGKIVVTLEEKRLNAKCRYNSSNFRKALTVQMQK

SEQ ID NO: 952554 - protein, 99 aa, Homo sapiens
MGQRKSCNGHLCPFSFLCTLVGARPPVGPMSLWDPEDVSVPVGGEHRGAPALIQPMTKGRADPCLLGTHLLQEQPAPPPASAPASCMAFSSLLQENVVK

SEQ ID NO: 952555 - protein, 88 aa, Homo sapiens
TSLAEEIITLYCPYILSELNAINLNLRPWTIKHRAIIMRTCDCATNRRHRYLHITLQLLQVALNIFYAHHNFKTMVVIRPNARSYLIH

SEQ ID NO: 952556 - protein, 33 aa, Homo sapiens
MSLLTRSWALGRLHVDDTYETLRVRTITDLLLT

SEQ ID NO: 952557 - protein, 51 aa, Homo sapiens
FASTCQAGNACPAVLNGAAQQQAPGLGFSSSQVHVFSLGPRGEPCEMGLNI

SEQ ID NO: 952558 - protein, 64 aa, Homo sapiens
MANQATQHWLKQGSGCCRVHAAVSSSHAHQRISHTFPSQAIVRAGTMQVCSASSLSHSSTVQHR

SEQ ID NO: 952559 - protein, 49 aa, Homo sapiens
MGNWYWNWNDDLELDELERELGRDDLELELPELDDLELELDDPELDMDE

SEQ ID NO: 952560 - protein, 37 aa, Homo sapiens
KYETECGRGILKCSEYPLLMFAARQDQILGQIQTIRG

SEQ ID NO: 952561 - protein, 134 aa, Homo sapiens
DNQVSAPRSAQSYTAHVAGLEVLRSPSPPCAELQQFHQVAVVSPWPQSFQFDEDDGDGEDEEDVDDEEDVDEDAHDSEAKVASLRGMELQGCASTQVESEITKKYQKQVRLPERRLTPCEVWFIGKEKEERDRL

SEQ ID NO: 952562 - protein, 124 aa, Homo sapiens
SLASTVLWDRECTGRPQTRNQEERFFLAETLKDCLAFHELGIFSKGLGTKGPSSGQDPRQMCRTSNFFSSGEETRLGDSAMAGQGQWHTGPTHSFLQRISMNATHLPFQGQRTGGLHIRPLYLI

SEQ ID NO: 952563 - protein, 129 aa, Homo sapiens
TVLLTETRFGSRTLSVLYGARGRAEVVRRVAACCELSNFTRSLLSPLGHQSFQFDEDDGDGEDEEDGDDEEDVDEDAHDSEAKVASLRGMELQGCASTQVESENNQRRTETGALTRKPADTMAGVVYWQ

SEQ ID NO: 952564 - protein, 75 aa, Homo sapiens
LELRVVEKRVEIESMLSVQQQVRLQLSATCLIHDVAADTSVQFTLGPSDRESLSVEETVAESRRRDTSTLRVPSS

SEQ ID NO: 952565 - protein, 120 aa, Homo sapiens
SRIRRFLTTVKLANDNADYMKMNRTEKPKATRSAASLAILGKTVQVVRQDEIDVVPESPLSDVGSEDCRYCAKKMTTNLTRQDSCQGNSPPFEQGNSEPESPMDVDNSLTIVDKDSEADE

SEQ ID NO: 952566 - protein, 102 aa, Homo sapiens
SIRRFLCGEIFFFKSTLKSNLHILPCKAYPYSQFSKTKEAMSLTCIIFLGQKKCPHGCLSRPDFKPIHPSYNFRPSGLTNIGLTKHEIQKRELKEILKPNKG

SEQ ID NO: 952567 - protein, 158 aa, Homo sapiens
WVCGCLRIPESTVFAELQTRFGLSDVCSVPMTGTRGQVLEVVRSPSPRCAELQQFHQVAVVRWHQSFQFDEDDGDGEDEEDVDDEEDVDEDAHDSEAKVASLRGMELQGCASTRVESENNQEEQKQVRLTERRLTPWEVWVLGKEKEERDRVAMKALE

SEQ ID NO: 952568 - protein, 127 aa, Homo sapiens
SEVTRVTLESTVLNIGGDFKLMEQLATWACGMCWTARASLEDKCLPMAIRSHRNISALKRDLDARAKNECYRATFRLPRDERLDVHTSCTLWTPFNNAAIPGQMFISNNYICFASKEEDACHLIIPL

SEQ ID NO: 952569 - protein, 103 aa, Homo sapiens
MSMLHSSVSDDQLARIATVHSCITVTLGDESISHSLVVVSRQLYSEHLYHTIICASPSPLLSRLFLQRLFYRQEIGKTVPSHHHALIMAENISADDTRVLGVV

SEQ ID NO: 952570 - protein, 74 aa, Homo sapiens
MHARSGAIVHGISASNSACIVCLQLVWVAAIGGPCCCTLGASWPSADAGLAAVWGIIWYCSICLGLIRWPLGVH

SEQ ID NO: 952571 - protein, 93 aa, Homo sapiens
MLERRFVMAYLRAHSASIVCLPAALFNSITLHSKQLQNDCESAAHSAGLLEEPETVCICTNIEWRCKPVLWFCDDLTTNVVPYLNIPNQYCEY

SEQ ID NO: 952572 - protein, 77 aa, Homo sapiens
MLERLQCDGYLARILASAGWSSMEERHLLLTLCRALACPRRTWCPLDKAWQELGSKQHLGLCPNPAQRHSLASKSRQ

SEQ ID NO: 952573 - protein, 36 aa, Homo sapiens
SQRPASVHGIICQHIRASAGTFPATLCGCSLSGILQ

SEQ ID NO: 952574 - protein, 114 aa, Homo sapiens
MPCSQRPPSVMAIFCQHIRAFVMFPDCGHRARQHFVSTAAWLLRQCRGHFSHTSGHTGSPGAALARQQVVSSAHGVNLGQPGTGHEAQFHLISNQSTPQAQFKHFAQGKSHSHL

SEQ ID NO: 952575 - protein, 36 aa, Homo sapiens
VALVCMAYCSTFWLALCVCQLVQCRAQLSSPTRSAS

SEQ ID NO: 952576 - protein, 44 aa, Homo sapiens
LPVCMASFASTFWLSRTFQPPWLACSSVGICSSVTKLGVNPWSI

SEQ ID NO: 952577 - protein, 56 aa, Homo sapiens
RVFAAACFQFLQVNYGLHTFSQGPGSLTSGLSSQHFFPGFMDFPLQRSFSFNRRSQ

SEQ ID NO: 952578 - protein, 58 aa, Homo sapiens
GRLTACSRGAVCWLSATFGFVLPAAIVCLQLLVCLRCLVCCRCLCVAAALCVCRRLVC

SEQ ID NO: 952579 - protein, 46 aa, Homo sapiens
KEYPYSTKMLARSMSPSQMVASTPPSSSSRNIAAASYLAAKSRYDT

SEQ ID NO: 952580 - protein, 50 aa, Homo sapiens
LRIRLLLVGFETLSESCSLVSARQGSSCVMAIGMEETLAQSITLSVLSLN

SEQ ID NO: 952581 - protein, 42 aa, Homo sapiens
MKTTDRLTSMWPADRTLTHLCHCCTVIPRAEHLSAACNLNTG

SEQ ID NO: 952582 - protein, 37 aa, Homo sapiens
ASSAGISRTNRVPDVGRLFRGSQLWFSDKISRYITRV

SEQ ID NO: 952583 - protein, 98 aa, Homo sapiens
IEISTVVGIHSEMTGKTQAESGKIHVQASLCFLRPMKCYSTHTSPSNKNAATCTQYFCPGEPIRDSAPKVFIGHTLPSMYQNSRLPKREHTFMFVQIG

SEQ ID NO: 952584 - protein, 71 aa, Homo sapiens
TPNWLFDDAKRVLEERRLTLPGLDIHDRFERGERATATRETVAGCMPVSTPTQNDVQASASSQTSSQAGWS

SEQ ID NO: 952585 - protein, 63 aa, Homo sapiens
MRRRRLIGSSMTGAEPQRALVEKVVPKDSEKSENNFIVPDISLKGNSGWFTALLLGGVIEEPI

SEQ ID NO: 952586 - protein, 36 aa, Homo sapiens
NWFFDDASFREKQDLCSEEMGTACSGTMTPVIEEPI

SEQ ID NO: 952587 - protein, 31 aa, Homo sapiens
MATQDQSHALTYTTAHGNARPITHRSDETEK

SEQ ID NO: 952588 - protein, 71 aa, Homo sapiens
NWFFDDGCHIAVPMAYTNDYRYDWTPAGKPRYAAGVSLEKAKRQTYTHTQHLTKAVFQCKIPRATRSKNQL

SEQ ID NO: 952589 - protein, 38 aa, Homo sapiens
MWCETRLEMEVEVGACSTLEAMIRNFIFILEISVMRRR

SEQ ID NO: 952590 - protein, 94 aa, Homo sapiens
LIGSSMTNGRADTDDEVLQAEVLMHNELQSGEVREFVAVAPKAEQGYYRPLKKSMRVQKMVISGVPHPLPTLKKSLVGRSERSAFGSFVIEEPI

SEQ ID NO: 952591 - protein, 96 aa, Homo sapiens
YNRARTPNCFFDDVTSVIWMPLWSIFCDLGTAGAAVNKTDPPPQKILPSLCLYASVGVDVDGNKHINKQLYGFPGSGKCHREKQSKKREPVIEEPI

SEQ ID NO: 952592 - protein, 74 aa, Homo sapiens
FLRLITGASGIALKRPKKHKKQKPKKSTPQNPSNIQNEEADPSQREEKQLAKDKEKLKNVCGLSGSFGLIVSDE

SEQ ID NO: 952593 - protein, 69 aa, Homo sapiens
SLIGSSMTSWLGGNESDQLSMRMQVQSLASLSGLRIRCAVTVMEARGYSSNLTPSLVTFICRKRHRRTN

SEQ ID NO: 952594 - protein, 66 aa, Homo sapiens
CTNRARYPLLRLITEVPIHVGDFSRKGFQSLEANLHLATPFKPSASNPSHHDSLLPCVATVMRRRR

SEQ ID NO: 952595 - protein, 50 aa, Homo sapiens
MDRLREAEEEENECAELQEESLPDSKTAVQDFSTAALQVFIIYAFITCDN

SEQ ID NO: 952596 - protein, 77 aa, Homo sapiens
MPFFGGALPFGGGNPCQKLGGSSGVQRGPITSPKGGLKFFPFFEGAPPSTPQRGGSYKKNMWGCFLKTPRGHTTLGL

SEQ ID NO: 952597 - protein, 62 aa, Homo sapiens
YNRARTPNWFFDDAASRVAGTTGSMPPHPLIFAFLFLFFLAETGFRHVCQAGLELLSSSSPH

SEQ ID NO: 952598 - protein, 30 aa, Homo sapiens
MDLSGLARLCSRTLAATSNGTTHDVIEEPI

SEQ ID NO: 952599 - protein, 57 aa, Homo sapiens
NWFFDDASTTSRQNPIYFASSHPTLFLLFAGSFSGLGCKSHDSRDVPPPTNVIEEPI

SEQ ID NO: 952600 - protein, 56 aa, Homo sapiens
NWFFDDAAGEVRDGTCILMYTVGLLTPEPHRELPVVHFFLELDRPLSGWTVIEEPI

SEQ ID NO: 952601 - protein, 53 aa, Homo sapiens
IAASMTHHSHSNAGFIHIRDLHHSSDNTGSLTHCREGQGLNLHPPGYQAGSLP

SEQ ID NO: 952602 - protein, 49 aa, Homo sapiens
MTALFHILNSDLYLIRSIYTRCNLSSSGNVKDLLTIVIYLSKCVIEEPI

SEQ ID NO: 952603 - protein, 51 aa, Homo sapiens
TTRARYPIENMMVNDGLFPKKNIQCTKSQNFAYNFNVFTNSLKPSVIEEPI

SEQ ID NO: 952604 - protein, 53 aa, Homo sapiens
KALAVVGPGSMGLIWPLLSPPTPAEFSTYLNFCRSLRFDDKPDYSYLRQLFRN

SEQ ID NO: 952605 - protein, 78 aa, Homo sapiens
MTLRQGLTVSPGRRSAVAESRLTAAWTSWGSGDSLTSASQVAGTTGMCHHTRLIVFFVETRSRHVGQAGLALLTSGDP

SEQ ID NO: 952606 - protein, 124 aa, Homo sapiens
MRQALHVGQANLERPTSGMSGDSPASDSINARITGISHCIWPLFFFFKNGVSLRCPGGNAGVLSQLMESFTSQFQSILPPQRPKQWGPRAHTTRRGQFLGISSRDTVFTTSARLGLELRISGST

SEQ ID NO: 952607 - protein, 35 aa, Homo sapiens
TANHIPAHFVHASGHMTEGKWQEIQLLKLGPTDRA

SEQ ID NO: 952608 - protein, 43 aa, Homo sapiens
SGHCSRTALTGWPLPFKVLGLDTGPQTLVFVTFSGVSLVELKH

SEQ ID NO: 952609 - protein, 43 aa, Homo sapiens
YESITEGAHAEDSELVKKLTSGHRVTRLIDRASCLLVLEFQEG

SEQ ID NO: 952610 - protein, 51 aa, Homo sapiens
KTHMTGCSKPTEGEGTGTMTQAVFVAGLEEALTPFTHIPLASIEPQDHTWT

SEQ ID NO: 952611 - protein, 44 aa, Homo sapiens
MTGETTKEGRKRTDALPVNMSKQKIQSYIKTILICLDNAKLLIP

SEQ ID NO: 952612 - protein, 33 aa, Homo sapiens
GREKRSAALTRTRQVQVHSDSCGDKPVRWSVTV

SEQ ID NO: 952613 - protein, 104 aa, Homo sapiens
MIRDHWSVVSTQEPDLTLLLFILTVFLHTVHISFSLPTELSLCQAFETFHNMTPSNPSSSVLYYISKCTDADQWDTVLLPAGPLISLPAVSFTCLVSFSVNLAC

SEQ ID NO: 952614 - protein, 31 aa, Homo sapiens
MTSEEFHRPGLGQRRQQRLYSNNKIQKYSQV

SEQ ID NO: 952615 - protein, 59 aa, Homo sapiens
RVRGRRIVVTDIPLETGRCECLDLVQPWRSYRSAEAPHMRVRPNYRSPNEVDSVVTRCY

SEQ ID NO: 952616 - protein, 74 aa, Homo sapiens
NFRLGTCHALHRVAHEMEQVREQAALIISLESWETAGAVPVAQWTLGQLTMFTCVRRVKLRRIYEPDCVKACVP

SEQ ID NO: 952617 - protein, 153 aa, Homo sapiens
WRRAGRFRSLGDGQVDFKSIFSKLAQYDYQAWATLEWECCLKDQEAGAREGAAFIRDHIIPVTDKIFDDFAGAPISTAQMQQMLGIALSPNGAAPMNTLSSAGTAGDDALRHHYLRIDGQRVHCVVGRQRPARAADPWLAADLVCLGAMCCMH

SEQ ID NO: 952618 - protein, 42 aa, Homo sapiens
SVPICRFQVNEDCALDRADTAAQITQRKWEAAREAEQRRAYL

SEQ ID NO: 952619 - protein, 64 aa, Homo sapiens
AAAVSLCGKSYSPGNHRCQSRVQKLKSLELIFEGRKHPAQEKDEVLEDSASLVLPRFSACFYPS

SEQ ID NO: 952620 - protein, 48 aa, Homo sapiens
TWPAADENGGHQKNAGKNTCHPIVQYIQWIILSFRINIPPDHELRLPE

SEQ ID NO: 952621 - protein, 41 aa, Homo sapiens
MFKKLEMCQKLRSQKEMIVKCFEGEGGHSAFQRILGKVREE

SEQ ID NO: 952622 - protein, 139 aa, Homo sapiens
ELGYRSLLRTAFDLPVLRNPRQLSHTGSWDYRCTPLCDAIFFFFKVEMGSCHMARITVVSHCTRPATCSYSSRKWRGREVKDTCQMSHSWRSREASCPSSSWLCQPDSPRGEGLPFLPGSIRVLFVPLIVFGASCSMSV

SEQ ID NO: 952623 - protein, 38 aa, Homo sapiens
RGQSELQLVAYTTAIAMWDLSHICDLHHGLQQCWIPGV

SEQ ID NO: 952624 - protein, 94 aa, Homo sapiens
NAVAAIMLHSAYQEELHRIEQFVELPGDGCQRGRCKPWEGVEPFYISHRLVNWFLVKLRHEKLRHPHGLTVDSRQLWVECPGRQEPGLVSQPVP

SEQ ID NO: 952625 - protein, 42 aa, Homo sapiens
FKLGNEFRRLPAARAKPLSSSCKTARIKDRDKHPLTIKAIHR

SEQ ID NO: 952626 - protein, 42 aa, Homo sapiens
QPVQSARSPGTIINSKWLKDLNIRQDTIKLLEENIGKTLSDI

SEQ ID NO: 952627 - protein, 38 aa, Homo sapiens
CRGAVQDTAGTPRLFSAMASKAMVTCSPVDTITSSSRG

SEQ ID NO: 952628 - protein, 35 aa, Homo sapiens
YLRWILGARVRILPNEEKGPVSVSLSTKTKVLVSV

SEQ ID NO: 952629 - protein, 42 aa, Homo sapiens
MSASTVPCSTRGFPKAKRDFTCRHRRCAAEDNAGLEVATRGR

SEQ ID NO: 952630 - protein, 60 aa, Homo sapiens
SAMDQSKQRNMEGLDWLSLLASIFLHYWMLPALEHQTPSLQLLDSWTYTRCSQTFSHRLK

SEQ ID NO: 952631 - protein, 62 aa, Homo sapiens
IDGLSTRSDLEQNEQQRIDKHVEHWRLGGSVVGLNPHQIGVSLAAQLFEGCEGWNGSAIVWW

SEQ ID NO: 952632 - protein, 50 aa, Homo sapiens
MEGLDWLSLLASIFLHYWMLPALEHQTPSLQLLDSWTYTRCSQTFSHRLK

SEQ ID NO: 952633 - protein, 47 aa, Homo sapiens
MRKMYFAGFSSDISPKDKVSYGSKLTLGKWVSLAITTKDAPAQNPLS

SEQ ID NO: 952634 - protein, 33 aa, Homo sapiens
VGLGAVVAGRRRTSGYARQIRNYVVMKRVVDRV

SEQ ID NO: 952635 - protein, 72 aa, Homo sapiens
EDSPCEAAVQLEKAGRKMWNEKAVLSLLVFIFLAYWMLPALKHRTPSSSAFGLLDLHQWFTRGSQAFHDRLK

SEQ ID NO: 952636 - protein, 67 aa, Homo sapiens
TRSGLLKPINSYNSPVLPVQKPDKSYRLVQDLRLINQIVLPIHPVVPNPYTLLSSIRSSTTLYKLFS

SEQ ID NO: 952637 - protein, 74 aa, Homo sapiens
NAEHALHAVKMRQETDSVIPMADSFKSGSDLKESWLSPTLNDDLDRYIGYATSKRFYDIVREAVPNIVISENKF

SEQ ID NO: 952638 - protein, 50 aa, Homo sapiens
MRAGRRERLMPRRKRTVLPAHPDHDQRPWVAAFGGSGRHSGSGRAAPVHG

SEQ ID NO: 952639 - protein, 42 aa, Homo sapiens
TLRGWDLTGNGHAQRGQCDYMQQEDQSGNFNYEAWASVRAES

SEQ ID NO: 952640 - protein, 47 aa, Homo sapiens
MALALPAALLMGCSSPSGIAVNRGQTVVMDPSVLTAGIFADTPSVSN

SEQ ID NO: 952641 - protein, 42 aa, Homo sapiens
MSGATSGIGGGPRPFIIQGLGSSWGLPTTQGPVGNLQFGERE

SEQ ID NO: 952642 - protein, 42 aa, Homo sapiens
SLCNRVILYLKKKERKKEKKKELTIMVEGEEDEQAYHMAKKG

SEQ ID NO: 952643 - protein, 50 aa, Homo sapiens
RAARGNAVFFSYERPDPSTRTLHGGAPVLAGEKWIATKWLRNANSTEEPA

SEQ ID NO: 952644 - protein, 36 aa, Homo sapiens
MVWSNFRLNPRLVSLNQVIKEIICLQPPKGGDLCLV

SEQ ID NO: 952645 - protein, 98 aa, Homo sapiens
SSRTDSSPASIFNRREYETTYHQQHDRDDDRKARQYPLAQGPVLHSNSSRAIQMEGSIAERVPSLINGLWDLGHAQGGKFSWGGISVAAVTAADGSST

SEQ ID NO: 952646 - protein, 108 aa, Homo sapiens
KPVDAGFGNYFPALTCIDPIQMVLRGKQFQSRLTIKSDLTRRIKLRSSIDNCVNFQIFRAKCIQVGVALLVSKCAMLAIFASLPAKPCPALHPMVDSACEFSSSRRPS

SEQ ID NO: 952647 - protein, 108 aa, Homo sapiens
MQTTGITTVSLGAADNQLGLRRRSLFRAGSSNAHHNDSLLTWSEIAFSDLYREPVLPALPSTLITRVIKTGVFKGKVVASASSATATRPMTVESTSLIAVCVDAAAEF

SEQ ID NO: 952648 - protein, 43 aa, Homo sapiens
TATGEGRVRSLASLSGLKIRLCRELLVEVADAARIHTAFSGGV

SEQ ID NO: 952649 - protein, 50 aa, Homo sapiens
VTAGARSLDVAFISVLLESAQEADLEALQHGQQALVKVLERGLGLLLVDV

SEQ ID NO: 952650 - protein, 46 aa, Homo sapiens
MVCQKRQVLCTSATCACICAISALAQVLYCRRSCPWLRRSFSVWRG

SEQ ID NO: 952651 - protein, 38 aa, Homo sapiens
SGFGCLKVSCWRSWDRGSSTGDTEYSGVGGPAYLRMAW

SEQ ID NO: 952652 - protein, 35 aa, Homo sapiens
LVWWRAFLMFDLTARGPWPDHVRPDRDGQPRISIM

SEQ ID NO: 952653 - protein, 47 aa, Homo sapiens
SCSDRNVTCPVRCRNWLAADCRFLPLSPIYRLKNSTCIADVLVSAGG

SEQ ID NO: 952654 - protein, 85 aa, Homo sapiens
PPELKPTKHDRETQLKHGQMVSLHTCSMGSIYVPAFVTLPSMKCNLQICLDVTGVMQVIDELYCLSVKICLPFSAWRWWGSLIES

SEQ ID NO: 952655 - protein, 73 aa, Homo sapiens
MVTRGTLPRVDGPWGRPYLRAVIGPGPRARRVDQHVPGRRGALLPRARVGRPARPWLTVGPVSKNRLLRMCVV

SEQ ID NO: 952656 - protein, 64 aa, Homo sapiens
MAVWKSQTTASIIACSCWRYATATSMEQFLSHICGLHLSSQHGQILSPLSRTRDQTHSFSVWRG

SEQ ID NO: 952657 - protein, 123 aa, Homo sapiens
RKGDVVIISPKAVWDGISMIVLVFVERERADIVDRFKACDPCDAEVMIGYYVTGDADFILVITAKDMEDYEAFTRRFFYENHDIKGFKTMVVMDRVKAEIRLSYRRLTGQRSANMSVSFSGGV

SEQ ID NO: 952658 - protein, 42 aa, Homo sapiens
MGDLQCLGSHESRPVPVVMTLCPQLRPPPLLICELRSLNAAS

SEQ ID NO: 952659 - protein, 73 aa, Homo sapiens
ASGISELSSAAIADRLAKAEHGWENSTKSLGHWKSGEFTHSGRLSLHELYQALRDEDQRAMRSSSCRSLNAAS

SEQ ID NO: 952660 - protein, 40 aa, Homo sapiens
RIPALRLSERMHMTPTAVLGEKKQDLFDVSCGSVHLMPLA

SEQ ID NO: 952661 - protein, 93 aa, Homo sapiens
ACLSDLRTPASGFGTGDMLDDHEKGEVIVVRSASYSHLLGVVIHTRLGVQLAAIARIPASNWESRSDVEASQEMAKRQKKTQKTESVHLMPLA

SEQ ID NO: 952662 - protein, 74 aa, Homo sapiens
MRQLVKRSSHCLNTTQNGWFKGSDQVSRQCPQSTLSHTLKTYIILTIYIFKIGVPDVAQWLTNPTRNRSLNAAS

SEQ ID NO: 952663 - protein, 53 aa, Homo sapiens
ASGIMNAPSPQNADGRLDGGHRTSQIRHVRQHSEVVVEIDGDRAISVHLMPLA

SEQ ID NO: 952664 - protein, 71 aa, Homo sapiens
MRIVNAQRKQICLASMRMLVQSLASLSGLRIQHCCELRCRSKMQFGSCIVVAVVEASSYSFNSTRSLNAAS

SEQ ID NO: 952665 - protein, 41 aa, Homo sapiens
MPLEKGGGGEGRWEEPRGGSGSHSVPTEPFSGAWSFSGGCG

SEQ ID NO: 952666 - protein, 85 aa, Homo sapiens
PHFIGEEQTLSRKKKIEIEEKQWNCHSHPNFSSHHPDQSAAINIETRPFSGGVVPRHRKRVSDNGMGPRRVPVGARGVPWINARA

SEQ ID NO: 952667 - protein, 66 aa, Homo sapiens
SVHHVIGEGLEKAKRLNNNYKNKEKQMMSLVLLPGPDIHLEDQEKWPENGSLNYNTILQLDPSPVA

SEQ ID NO: 952668 - protein, 71 aa, Homo sapiens
VVPRTEKVLTAKRLALGAPQTCCLGVSPSTGNIIGSGIFISPKGVLEHSGSVGLALFVWVLGGGIPSPVAW

SEQ ID NO: 952669 - protein, 46 aa, Homo sapiens
MSKRNWFVQTGRDRENAYPYEKLEHSAGWLHNYKDIYNEGLLRWRG

SEQ ID NO: 952670 - protein, 68 aa, Homo sapiens
GGATGTEKACILVVGLNWCSHCRKRYRGSSKKLKTELLYDPEIPLLRIYPPMKVTDLKRYMDPFSGGV

SEQ ID NO: 952671 - protein, 57 aa, Homo sapiens
MYDLSHISDLYHSSRQQQILNPLSKARDRTHVLVDASLIRYPLSHDTRSLKCRYARY

SEQ ID NO: 952672 - protein, 43 aa, Homo sapiens
LDKEADSEVFIEPAALQGLQVLAGSWAQQLQILHFHFVHLMPL

SEQ ID NO: 952673 - protein, 37 aa, Homo sapiens
MPTISTPNKQIIYSINPNHNTRAHLNNLYIRSLNAAR

SEQ ID NO: 952674 - protein, 63 aa, Homo sapiens
LLRCSEVPALRLSERHGEAIALELGTGAGAPLATSAVGCDGRRQSPDAPLCSTSVPFTLMPAS

SEQ ID NO: 952675 - protein, 102 aa, Homo sapiens
RTIPIRHDARTESARFKMRKTNANNDKFRFSLSLQLLTNHLKLHHNLMNLEQRRIGKDKGVFVLILVLFRQGVAIFDIRIFNAMEIMFIAPIRSIVRSMSKT

SEQ ID NO: 952676 - protein, 108 aa, Homo sapiens
AEFDLGCVAEEGSGNSTAYVSVDPEDLAAGVRHREAWQTVAHATLHKAFLLHGIQRGASLGENTDTPITAAAVTMARVDFNTFIQTSSFALVVSELEPHRTLIRRHRP

SEQ ID NO: 952677 - protein, 76 aa, Homo sapiens
ETDTERRRRRRRRTRTRDDDDDDDTRRRQTDTDTDTRHNDDDADHDDTDHDHDTHTHDTRDTRHNTRHTTWTHDTR

SEQ ID NO: 952678 - protein, 107 aa, Homo sapiens
NSLNPGGGGCSELRSCHCISSWVTEQDPCLKKKRGRAWGLTPCNPKHLWEAKAVELAVRSGSSQTKPGPNMGGSPVPLMVSFRRDPSKKSDLGRLCEAWATGPVGLQ

SEQ ID NO: 952679 - protein, 54 aa, Homo sapiens
WKWEFGSWPRRECKGTISAHGNHHLPGSSDSRASASQIAGIYSMCATRRASMSF

SEQ ID NO: 952680 - protein, 40 aa, Homo sapiens
WGNRVSLWWPRLKCKGAISAHRNLSISGVSSDSPCLSILG

SEQ ID NO: 952681 - protein, 57 aa, Homo sapiens
NCVVLPVFCVFWSQYCTVLWLASTSQARRNLPTVFAWHLDCAELCQTAVGYIGTRHR

SEQ ID NO: 952682 - protein, 52 aa, Homo sapiens
LPLARRTVRERIKDLPPSKDTVKEFDFNRQGISSRVRGLIYQRAGISLAYST

SEQ ID NO: 952683 - protein, 39 aa, Homo sapiens
SPFYRLTTPCNPGIRVFQLNLDSVTRYRIPLLHIVLRIS

SEQ ID NO: 952684 - protein, 105 aa, Homo sapiens
LNPSAVPACACPADRAPRAETPSRPPNIRLSPVPSWYCATDPLPTEATTTVPQIADIAAQPRKRHRTASRCCHIVPRISPQKKKEKKKKKKERAQILHCRWPTAH

SEQ ID NO: 952685 - protein, 44 aa, Homo sapiens
MVKEPMGHPYHGIRSSHKMEQTFTQATTWKNLKEIMLSEKKKRP

SEQ ID NO: 952686 - protein, 49 aa, Homo sapiens
RILSIRCSAHTDSVSVWVEGWCPGLLTNVRLLTRLLSSSVDSSCTHQSH

SEQ ID NO: 952687 - protein, 100 aa, Homo sapiens
CSNTHTVTTRSHTALTFTLTNVTNTLTHPPFTHISHSHTLTFYTHSTLYIHIHTLSHSRTHVHTCTYSHTFTQHSHIHTRSNKLTFTHIHTHAQVGIKKD

SEQ ID NO: 952688 - protein, 42 aa, Homo sapiens
RTVFIYYFDGYLKSNHMNLGSGMVAHTCNPNTWEAMVGMMKD

SEQ ID NO: 952689 - protein, 85 aa, Homo sapiens
AINHQCQLFKKKQTAAATSNDAESNHITPLIFEIDAVNLMDRGKIEGFCKTYQVNKPMNNQKQKKENPKHRKEFNNKITQLNRST

SEQ ID NO: 952690 - protein, 59 aa, Homo sapiens
SHCHYSYNRLITLREVPEEYSSWLKSSVELSGLTIGNYRWLYLARLVGKSAFPSPDFIA

SEQ ID NO: 952691 - protein, 36 aa, Homo sapiens
SSRIPPYFACLSRQIGGISLVGINGFVVGPMIAAMF

SEQ ID NO: 952692 - protein, 67 aa, Homo sapiens
MPEWPGEVGENPTLTRNRDHHLCGSRGTRSRGGGVGFRRGLRGRHRRVNVCVVCGIPSGRFRGGTVD

SEQ ID NO: 952693 - protein, 56 aa, Homo sapiens
RSQELRFGKLLLDFRGSIEMPGCPGKSLLQGVGLSWQNLCQAAVDVDNVGIQSPPT

SEQ ID NO: 952694 - protein, 80 aa, Homo sapiens
NEFARRIDAVGSKRTMQRLLDFFGIRHIAGIDTIEGKRNRAAAPQGCDALARIRSPRHTDLDDTGHGRIRKHVDRLKFLL

SEQ ID NO: 952695 - protein, 174 aa, Homo sapiens
MIDGIVSARVHVVLTDNDLLKRVISPSSASVLVRYDPWHRYQYVDPADQDPVWPTVFPGLSYDGVSVTAIKAAVSISQNPAQPRLTRFMGLWLLEDNLNQARLLFGGELLVAIGACGVLDRQQWARRQTQALYVLKEGEMSLVERWQGLIAQPLKLVREAKPRGMYRRRPACEV

SEQ ID NO: 952696 - protein, 93 aa, Homo sapiens
NCPDCVFTQFIFEKLGLLRCPEIRVNQLYVIGQGVFADKGVNRLGGRFQSKLFKQAFEGVSRRFHIFSMRADHRMHGRVVDAAANLVVVVGGR

SEQ ID NO: 952697 - protein, 37 aa, Homo sapiens
RYRATALQPGRQSETPSHQNNKRDPIGRACGPPLVPP

SEQ ID NO: 952698 - protein, 141 aa, Homo sapiens
ITSHCRGDLLTDVRLRGVGIGHRLTDLGGLHLAGKGLGGLLHLRIGDDGGKGVCVLVGFLSSRQEALGKLDEVNLVGVIGDILGECWGQIRVLRVCGDADALHKQGRNADACGHGDVGEELRCALLEVDAAANLVVVVGGR

SEQ ID NO: 952699 - protein, 150 aa, Homo sapiens
KGMELNGMGMNGMKLYGIEEKEWNAMDKKGMDWNGRECSVMDWHGINCNATDSNGVKMYGMECHETESNVIECNGMKKMDSKIIDWKGWVSKGIDSNGMESNGTEVNRIELNEWNGIDRNGMERNGMIWHGIESNGLGRRGREFSSSRRP

SEQ ID NO: 952700 - protein, 90 aa, Homo sapiens
MGVDGNGNVVMAAEKPEKIEPLHLVRLSDGSEYKVTPWHEFVLVDGSKRQAKDLQPGDELMPPKGVEGAFGTLHDPDKAYVDAKAPTPVP

SEQ ID NO: 952701 - protein, 65 aa, Homo sapiens
LVGAVQIGSKQAEDMEGLDWLSLLASIFLHYWMLPALEHQTPSLQAFGLLDLDQGLSDLQPQTKG

SEQ ID NO: 952702 - protein, 104 aa, Homo sapiens
SNMTPLLPPSEQVEHVSQFFQIHPKNPQARLIKQAVEIIRAGGVVIYPTDSSYAIGCQIGDKNAVERVRRLRDLDKNHNFALICSDLSQLGRRRGREFSSSRGR

SEQ ID NO: 952703 - protein, 67 aa, Homo sapiens
RIVPSSLNSFKRFKTKEYSQRHSIMPPSTLIPKPGRDTTKKENYRPISLMNIDAKILKVGMMKDASF

SEQ ID NO: 952704 - protein, 61 aa, Homo sapiens
MCSAALSVAEGRSPGVRSKSPKAEDLESDVRGQVASSNGERWRPEDLASLALPCSSARFDP

SEQ ID NO: 952705 - protein, 81 aa, Homo sapiens
MSPPQCNSTQDLMTEIHRNNVEYVPIAAGVVRVGAMKGAQDRKDVPPSLISSVPPEFGKSSTGGVATCVSDRPRISSSSRR

SEQ ID NO: 952706 - protein, 73 aa, Homo sapiens
RPRRLIKSLTSLPPSYFFGLCFLPAGAEIDGGEASDFIWRRHIIGCSIHFGNDNIGIFTELLSQLFGRRGREF

SEQ ID NO: 952707 - protein, 63 aa, Homo sapiens
VLHHTYPSQEKNRSPVLETEILVEKITLKGSMSSTEGPQCKFMTAPPLLSSPVGHAQVGMMKD

SEQ ID NO: 952708 - protein, 67 aa, Homo sapiens
GEAADAHVEAAQAECVADFLGVFVFFGIDGVAAPAHHDLRLDARAQGAGVAQQVEHVVGDALGTAQV

SEQ ID NO: 952709 - protein, 36 aa, Homo sapiens
VYQSIDTRHHEQLLSARVRRLCQMPRGVQRMTAYHA

SEQ ID NO: 952710 - protein, 88 aa, Homo sapiens
IELDKNVMGEATLSALDGKEKGFAVGGQHPDHPPIEHARQISFPGLHDVVHFDFQCLSLLLCRRLFLHRSSMNRTDEQQGRDTRQAGD

SEQ ID NO: 952711 - protein, 34 aa, Homo sapiens
MLPVLHHTYLSLPTSFIIPTPIEEGEKVKAEISF

SEQ ID NO: 952712 - protein, 80 aa, Homo sapiens
ETYTTHLGTWLREWLDQRDGAFLQKGEEDSGVPTPPEATSWLCGLGELLNLSGPVSPAVTWECSEQNCLRGVTVDPTPVP

SEQ ID NO: 952713 - protein, 118 aa, Homo sapiens
QKIHIRIESRYLVTGVAGSRLHCNLRHLVSRDSPALASQVAGTTGMCHYVWLFFFFFFFFGIFIKNGCPPLLGQVCLKLLTSVSLSTSASQMCGDNRAVTHRAWAHFFFFLFFLFSSF

SEQ ID NO: 952714 - protein, 36 aa, Homo sapiens
MACSKFACLSPILLPRAIKARCLRRRMVTEQVSNGK

SEQ ID NO: 952715 - protein, 88 aa, Homo sapiens
SVRVLPKEINIGVSGLERADPPSVWVGTLESTASAARLKPTCRVFRSSSFSCAGCFLTLNMELQVLQLLDPWTYTSDLPGALRPSTTD

SEQ ID NO: 952716 - protein, 60 aa, Homo sapiens
TGPRGPPSFIIPTRKKAERQRTKAAERQETGRRKRRRRKKEKNKKKKGGEGRRRKRKEAE

SEQ ID NO: 952717 - protein, 99 aa, Homo sapiens
MCIRWGHFNYVAHGVMVLQVGEDWMVSPTHYAIWIPPGVHHSSRNRGAVAYRSAYLSVGASAQMPSIPTALAVSSLLREILDELARRDIGEAVKPEHRR

SEQ ID NO: 952718 - protein, 136 aa, Homo sapiens
TGSDVGIPENLSTNLLVNHGWHGTIFELDATECDKMRYFFARTAATRHYHWTREGLTEYYSPVIVQKAISPENINELLMAANQEPEPDLFIIDIDGGDFAVMENLSAIKPRVIVVEFEKRFRERTAWFSGVDAPRI

SEQ ID NO: 952719 - protein, 53 aa, Homo sapiens
NTYLKRKKKEKKEAEEELRRTKKKEKKKEKKKERRTKKMKEREEGGELRMKVG

SEQ ID NO: 952720 - protein, 106 aa, Homo sapiens
SLRKPNVNGTAFMKYSWIALVLLLCACTSGPNHQEQLVEKRLWEYQLLTHLNHFKSYPEDARLQRLTGMVRVAFVVDAKGNLIRHKIVSHTGSDLSSGQWVDAAGI

SEQ ID NO: 952721 - protein, 113 aa, Homo sapiens
KNRARTGIAEASEKVTATIGAAAVGVRPCHGTQRDGVVGDDMDVGDALFQQQVFGFEASGHVGRRQGKRKGGGPAPGELPPLTCGLTLLAVAALLAVRAFVAAVGLFTLAYST

SEQ ID NO: 952722 - protein, 37 aa, Homo sapiens
MPPSKDTVKEFDFNARDFERVRGLIYKRAGISLAYST

SEQ ID NO: 952723 - protein, 120 aa, Homo sapiens
GPDQFQVVGVYRSRYQLQATQADFPDLARDDVLGDRNVLLEQIKHTSGQQGFDTYRMILHAHFSLFTLGRFERLGGTGTGASRWLERLGVGDVRGNARIKHVAQASVTAEGFIARVLGRR

SEQ ID NO: 952724 - protein, 69 aa, Homo sapiens
VAFKAHFFLIRLTHFLAMRLVTLVCLEMSLMLLAVIRPQPFIILVSDLPFPESSTWLPVEPLTDGVVAV

SEQ ID NO: 952725 - protein, 37 aa, Homo sapiens
MLCTGMCCKPAGERVLSSVMHEKTFPCRGTWHMSTAV

SEQ ID NO: 952726 - protein, 56 aa, Homo sapiens
CTLYADVENKRLMVTRRYGEHGGFETTFVLILDKTLPDVLSGETGSDNLLAYMHMP

SEQ ID NO: 952727 - protein, 90 aa, Homo sapiens
RPYHTYHLSPKRFELMKATSAKSQDTKSLCKNHKHLVTPNRQAESQIMNELPFSITTKRIKYLGVQLTRDVKDLFKENYKPLLKVGMMKD

SEQ ID NO: 952728 - protein, 39 aa, Homo sapiens
MSRACFGQYNITPSNDVTVRCDCEAWTVRRDWGVTVRRD

SEQ ID NO: 952729 - protein, 113 aa, Homo sapiens
SFIITSRPSSYLLFLHTYLPILTSYLHLLYHTYPSFIIPAFLYFLFFLPRATMLLTFKTSLYCFLPSKLNLLPLLILASPFLMLILLSSDLLLSNYLVLPLTFLLPSFCFFYF

SEQ ID NO: 952730 - protein, 57 aa, Homo sapiens
RLERTDLLILPAFIFLAYWMLPALKHQTPSSSAFGLLGLHQWFTRVLSVPSMHRLED

SEQ ID NO: 952731 - protein, 57 aa, Homo sapiens
SPCGGQCKACSTSAGRPSPKHSPRLCSRTNFNGWADQARANAPPVLIYPTLSTYKRL

SEQ ID NO: 952732 - protein, 56 aa, Homo sapiens
NEINYNLKYSEEVLKKYSPWLKSMCEFTGLTIGNYNGFYLAGLVGKSAFPSPDFIA

SEQ ID NO: 952733 - protein, 103 aa, Homo sapiens
MRRGWWAHASSPSYSRRLRQEDHFSPGIGGSSELGPHTCHSKPAQLRETPSQKQKQTREPPMSSKIILTAIQFLSQSLPIRHGWLICITQTHMGLSRLFTNPI

SEQ ID NO: 952734 - protein, 71 aa, Homo sapiens
GCSAFLSSRHWFSWQKLLAVGLVQLQLYREPAPVPVPGAARPTAAASALLCAVAGPLTLSLTLPSPLCTKF

SEQ ID NO: 952735 - protein, 51 aa, Homo sapiens
CCRQDLWRLEDRDGREIAVRVRGRIEANTGELLSDAALGGLGIALHSYWHV

SEQ ID NO: 952736 - protein, 59 aa, Homo sapiens
PQYGHGLFATEPFLPEHLAVVRALQSGNLEGAQAALAHHLQISQERALLRVQTIARGIE

SEQ ID NO: 952737 - protein, 49 aa, Homo sapiens
GRLPVAIPIAVVRMDELTCKILTSSIVDTRLVQGGWTDGAGGLHSSVCH

SEQ ID NO: 952738 - protein, 75 aa, Homo sapiens
PGRRSAQKSIFQRMYENAWIFRQKFAAGVGLSWRTSDQVLSAENEDVEFGRPHTRVPYVGHCAHGPCENEGHTSF

SEQ ID NO: 952739 - protein, 88 aa, Homo sapiens
HTLPGEEKKEKRKRKQATRQGEGRGRRRRKKAEEEELRRTKKKETGEGETKEDKEKGAEELKKKEEERRRRKKKHGDGRRVGMMKKEE

SEQ ID NO: 952740 - protein, 55 aa, Homo sapiens
DLDPHWHYPDILSLKKTHAPVEFHRAQWLTNPTRKHEVAGFNPVAFVMLGYWILA

SEQ ID NO: 952741 - protein, 84 aa, Homo sapiens
VTSYSHETSLCDRDNYSLANPVNVPLTTFKPDITFPIRLHNSPTPTLTNKEAFFPYDYAILILAIIPILDTFQLQSIIRCPGKS

SEQ ID NO: 952742 - protein, 92 aa, Homo sapiens
MAGNNVGYFCKNDRARYLYPFVFMRVRSLHIVHQAGLQWYNSQLTAGSNSRVQAILPHTTPEERRTSGMHHHAWVTCVFSVEIGLQEVGRQS

SEQ ID NO: 952743 - protein, 70 aa, Homo sapiens
MVTGAREIKAAVSCDCATEFSLDDSSETLSKEKKEKEKEKEKEKEKKKKKKKKKKKKKKREAVRFKFAAN

SEQ ID NO: 952744 - protein, 79 aa, Homo sapiens
SIGGHFNLTASLFFFFFFFFFFFFFFSFSFSFSFSFSFFSFDRVSLLSSRLKCSGTITAHCRLYLPGTNDLPSSGPSSS

SEQ ID NO: 952745 - protein, 89 aa, Homo sapiens
MVVHTFSPSYLSGAEVGRSLVPGRSRLQGAVIVPLLLSLDDRVRPCLTEKKEKEKEKEKEKEKKKKKKKKKKKKQKREAVRFKLPRKSK

SEQ ID NO: 952746 - protein, 50 aa, Homo sapiens
AALRETCFCKIQKLAGALVAYAYLSLLLVEAETGGSLDAKEVKAAESCDT

SEQ ID NO: 952747 - protein, 45 aa, Homo sapiens
FDWRALTVAGSGHETQVEFWSQVEGSSHLGDGWAAGPSTGDLVGL

SEQ ID NO: 952748 - protein, 64 aa, Homo sapiens
MLIDSVTLTLSETIASLVARWWSLKTSDDVGAKCSYNEEKYKAMDTLEVCMVRESRLGIRLNKH

SEQ ID NO: 952749 - protein, 53 aa, Homo sapiens
ASVIYTYSSRAHCRILNPCSNGQGYYARITSWFLVEFVNHCTMRRTSVPLLRM

SEQ ID NO: 952750 - protein, 42 aa, Homo sapiens
CVAVCALHRSCCVFGFTACAYCYQTGGLLLLFIAMGIFTFSA

SEQ ID NO: 952751 - protein, 73 aa, Homo sapiens
GSSVDAEHRTGLSRVVLDPEFILKGSFWLQFGGEMSVEGKDESEETQQEANAGMQVRDVSLDKGGRGIATRSL

SEQ ID NO: 952752 - protein, 45 aa, Homo sapiens
TKKERIERKKERETKKTERKRKKRKSNAPFQWSSGKIVFHGNPVS

SEQ ID NO: 952753 - protein, 72 aa, Homo sapiens
RSLLKSYVKLLILCGSAGTSRCLRVPRQSQSAAGDKDPEQGVWFPGPTSGLESSLPADSTGASLTRIATRSL

SEQ ID NO: 952754 - protein, 44 aa, Homo sapiens
ILVKLASEQWLMHVILALWESEAGGSPEAQEFENSLTNIARRSL

SEQ ID NO: 952755 - protein, 126 aa, Homo sapiens
ESASVYWDFFEASFGNVDFYEDIAFSTIGLKRRKISTWKFYKKRVTKLLYRKEASTLRVESTHHEEVYENSSVYFCMKQSRFKRRPQRGQNIHLEIQQKDFSKLLRQEEYSTLRVEGRYPKVVPVD

SEQ ID NO: 952756 - protein, 108 aa, Homo sapiens
PRPESVRIGQQQKFIGLGLCATECGVVGFSKTGAEIWRIKSAFSDWGVTVIATALVLVAALLHATWNTLIKFSGERLLVIACMDTVALLFVVLAVGFVSFPPLEIWVD

SEQ ID NO: 952757 - protein, 67 aa, Homo sapiens
FRRGNFLPHACPIKSYITPPYATITAHTTIESRAMGSITLVRPSISSFSTKNDRYPEPQQNSPPMFA

SEQ ID NO: 952758 - protein, 38 aa, Homo sapiens
MVGIERVLSCCDSTTLIAVSLLAGQRKHQDVTRQRDGS

SEQ ID NO: 952759 - protein, 100 aa, Homo sapiens
GSISGVSSLHTLSIPSENSRMRRQDPSSTRCSSSLCQGLGLLHRPSNLPFRPFPARTDESSIRRDPSSWDFGTVGRSFTVCRGMQLKSVPSSEKLPVRPS

SEQ ID NO: 952760 - protein, 76 aa, Homo sapiens
MVYSARELSRQPLYREPNQRSYSYVTDPDGTKIVDDITLPAAGLNTYLFEVVNDKNQIISTEVVETVRRLYIQEIM

SEQ ID NO: 952761 - protein, 75 aa, Homo sapiens
MIPGRSDWVMAGGFIFDEVVVMKLDWLPKIARDTCYDAIGENVLGLPRLQVGSSSLLTEGILFNLFLLRPHRAYL

SEQ ID NO: 952762 - protein, 35 aa, Homo sapiens
ISIVYPDADRLTSSCFDEDRYLPLNVKQLNQSSIN

SEQ ID NO: 952763 - protein, 54 aa, Homo sapiens
MRREIGEVVLAEIAANSPPQFYIGQITRFLRLEACEADDSNAAAAANSALQRML

SEQ ID NO: 952764 - protein, 45 aa, Homo sapiens
SRGSLRDLFEWSCHHIGSRKWDECEHEQWWELMNNEGREWMRECG

SEQ ID NO: 952765 - protein, 85 aa, Homo sapiens
CRAAADIAGLSHPLYGGAVTCSATLQFFDPANPITIVRVFCVLALAVRAIICLEHSEASLRKIFRKKKPPPTPDSARPAPRLLTP

SEQ ID NO: 952766 - protein, 73 aa, Homo sapiens
MGESLVLSELRIQSCHYCGSGCCCRKGLNTDLGIFTCQRHSQTHTHTGTRTHIHTHIEGVSYHQAWDHCNTVS

SEQ ID NO: 952767 - protein, 42 aa, Homo sapiens
MVVRSHLAAALTPPGYMLWTFCFICQQSSARNSTFLPTPAGS

SEQ ID NO: 952768 - protein, 53 aa, Homo sapiens
RPLDGLPDDDRVEWDGRARFTTLFPGFSQGQRVVHRTALNRDRFQGRGPSLGG

SEQ ID NO: 952769 - protein, 101 aa, Homo sapiens
SYLVLTIDPESKGFRIITLRSPLYVRGTFKSPNAGVKAGPLIARGAVAAALATLVTPAAALLALISPAEGEANQCRAILSQMKKCRQGDAPRRMARGVEGE

SEQ ID NO: 952770 - protein, 49 aa, Homo sapiens
VLSTATVCVQPDYQYVRIVWYRHHTLPAYIFCMIQSVVERSLLYAPPIN

SEQ ID NO: 952771 - protein, 51 aa, Homo sapiens
NFQGAVLNADSQRESHKLANFPVKVHLSLCANLASDLLPISGDFLIATRSL

SEQ ID NO: 952772 - protein, 35 aa, Homo sapiens
VCNGAPITSGSRKGMNVSRAKAGLRTRGESGMREV

SEQ ID NO: 952773 - protein, 75 aa, Homo sapiens
VLKGVAGLSLCRNHDKGTDLTPQVEETERQQRTHATTPATEPFQNTEEPYENIRNEGQNTDPKLNPKDDGIVYAS

SEQ ID NO: 952774 - protein, 70 aa, Homo sapiens
MYKYFIKDYPDGVIIEAPLDQDDWGAWQEVHSTVQEIQVVGDALTETNTKRIAKAVNEKSCNCLLLKVNQ

SEQ ID NO: 952775 - protein, 38 aa, Homo sapiens
EGQQYEYYLLSCHSTHSLCHPGTSTFEHRARLGPIYGL

SEQ ID NO: 952776 - protein, 54 aa, Homo sapiens
MVYLVRGSRVRLMWYFEGGGKKCMQVEEALGIEVGVTGSSYKRLLGIDVAALIT

SEQ ID NO: 952777 - protein, 55 aa, Homo sapiens
SDGCDCKEGRVTNLSNLSKTFPVLALNAPIPGNPSVPGKLEQLITLTCLGAAAEA

SEQ ID NO: 952778 - protein, 42 aa, Homo sapiens
VTLRILVAAQPINTVDQGRTTALVGDVRFRRMVLGKMSGRGL

SEQ ID NO: 952779 - protein, 69 aa, Homo sapiens
RDRCGLAMSRCKNFYEAKVQALIHRPVSMKQSRKLRQDERQAGGRRERRLRPGRPSSKLKANIQYIAPC

SEQ ID NO: 952780 - protein, 57 aa, Homo sapiens
GEYDGEKLPPDMSHAPEASQTISSATRAYPGSRPSLPPGIGRRIPPHSHPLSVLRFY

SEQ ID NO: 952781 - protein, 52 aa, Homo sapiens
SSEPIIPSISNALNVISIYSRTDESSSCTAEQAARKFEKLKPGSQIISRKLN

SEQ ID NO: 952782 - protein, 64 aa, Homo sapiens
IRGSIDGEKAPPRYGHTLPRAVSRPIFIWRTRAIPPCSRPSASHQWIVRRIPPPSSSFDVLRLY

SEQ ID NO: 952783 - protein, 72 aa, Homo sapiens
CHAARKLLTLAEHSGSHVSSHNAGITVMSHRTWPKLLSTSLLHKLTAKPDAIGRVLGQDGAHYGLTLSHPLC

SEQ ID NO: 952784 - protein, 66 aa, Homo sapiens
THNQGKYDGEKAPPDMVHTLPEGRLTTHLHLATSRIPPRSRPSAPHQGIGRRISPPSSSIDVAALL

SEQ ID NO: 952785 - protein, 100 aa, Homo sapiens
MPRRCHRTIPPPQSTSISDTHSTDPDSIRSCPQIPPAPYYYHFHIPPYQDESTPYSIFPRGKINSRIPGLHFPSRFPVHSRPLLRLSLKVRAAIDVAALL

SEQ ID NO: 952786 - protein, 71 aa, Homo sapiens
EDPRKQRSHINKEEDRKRVSSMSAGVGELGVRFESCVWRYGVSDPSSLIIRSASEWWVGLDRGPVVSWMRE

SEQ ID NO: 952787 - protein, 182 aa, Homo sapiens
MSKVLSSVTPEKRYETMDTHCQNEMSTGTGQSNTVQNILEPFYVLDVSEGFSVLPVIAGTLGQVKPYSSVEKDQHRIALDLISEANHFPKETLEFGLRHVEDESAMLQRPKSDKLWSIIILDVIEPSGLIQQEIMEKAAISRCLLQSGGKIFPQYVLMLGSLVESQTLLEENAVHGKNVLWI

SEQ ID NO: 952788 - protein, 84 aa, Homo sapiens
SCSNPYGDDCVGRGRDVAAGTLDTEMCSPGIPGHLLLRGGTDWMSGVPYRRGYGRNMEVVLRQVREGSEETGPDTRSGVSVGVE

SEQ ID NO: 952789 - protein, 104 aa, Homo sapiens
LNLTLPWNGAIRSSDLFHTESCAKTPVLPHCTQACKYRQKPPATDRGFSIRSLDTPSSIYQSSPVLENLHTATLKAAFFCTMLDKVQCCSLEMGFITRLTEAHC

SEQ ID NO: 952790 - protein, 67 aa, Homo sapiens
LSCVGVYTYQYFVKATGRLMDDASIAAAGCSKNRPLLVVTEMLGRAMQVFIVNSSFDHGKKLTFSIF

SEQ ID NO: 952791 - protein, 42 aa, Homo sapiens
MRPRYKDAEPERSSLEAKDGSCNELEIEPLHSSLSDRASPYL

SEQ ID NO: 952792 - protein, 108 aa, Homo sapiens
SDAAPLVMACPPRPCSTAFDSPPFFSLSPSFLSLSLSLSLFVCVCVCVCVCVCVLCFLRSFSLVSGVVCSLHLSELLDCHAVPYTPHPAWPSVVTLRVEREGTPTRVD

SEQ ID NO: 952793 - protein, 53 aa, Homo sapiens
MLVKLVSNSRPQVIHQPRPLKVVGLQAWATVPGHQVRTENQSGKLTLELRLLR

SEQ ID NO: 952794 - protein, 133 aa, Homo sapiens
DAAHARLRLARNRATGRLLIVRAGSAAHVSGAHQAHHPFGLACGAGVFQGLAQGHLVWVASAVWCSISVPVLPAQPAQQPVKPQGVFAVVSVKGGTGAFSSDMEQVHPQGVVCIPFRARLGRIPKRGILSQSH

SEQ ID NO: 952795 - protein, 144 aa, Homo sapiens
LHNTTDHSAHPLPLNIGRADGCFGNGRLKVYRVGTVLVNVGMQVHEHSKVSGSASLCPTSFERAHLFAGGAITKCLPGVCVAVPSSHLSLISDPSGPPTLCLCVCVCVLCVCTAVCAVQRVCVAEQCVCVYVHMCVSLSLSCSK

SEQ ID NO: 952796 - protein, 97 aa, Homo sapiens
QALWWHQPAAAASVHHKPKSSMQQGWLVARPSKPCVSVSSTGTARLACLCCSSKPASKPRVLGNTQASQLTQATPAPCNTAGLLTSSVSGGTCSSDI

SEQ ID NO: 952797 - protein, 38 aa, Homo sapiens
MPAYLLHLSLPHTIGPLTPGTVAVYHSILTPHNSAASK

SEQ ID NO: 952798 - protein, 32 aa, Homo sapiens
MAYWKEWGWVRGSTSERGDTSVGVVEGSASAV

SEQ ID NO: 952799 - protein, 74 aa, Homo sapiens
ASNQQLVKLWASTQASFPHSHALHNSGRSSQQASLSCRSMHTVPFVFTSSTWASILRQAIITTHTASPCGILHP

SEQ ID NO: 952800 - protein, 40 aa, Homo sapiens
TNPSVSSSVNMLHPWHHSGPSFNVHRAQFTCARGYSSCTA

SEQ ID NO: 952801 - protein, 53 aa, Homo sapiens
LTAGLCKQGAVPPPFHHAFSSFLQASPSQCGTRCSPIQHPFLGPAQGGIRLSS

SEQ ID NO: 952802 - protein, 38 aa, Homo sapiens
KTPSGGSGAAEGVRCQAITRCNVCRLPRQECKIDILSL

SEQ ID NO: 952803 - protein, 68 aa, Homo sapiens
SPEQLATREILPPRRGDYRFGFKARSTTSTIETGKILWDIAVSGLRHISSLNEDRTCGNIEQQIRQGD

SEQ ID NO: 952804 - protein, 37 aa, Homo sapiens
RIAPSVDYGRDLENLLRCSQEAAVGFEAHSRVLSRAL

SEQ ID NO: 952805 - protein, 35 aa, Homo sapiens
PASLSTFSQTLDYERDATLKSLNEHIENLLSPDGS

SEQ ID NO: 952806 - protein, 52 aa, Homo sapiens
ALLSSYAQLVFQHSESNRKPSTLPQPALVDDSDLENPGGDTMQYILNPICTW

SEQ ID NO: 952807 - protein, 80 aa, Homo sapiens
RNTLLNTQESLAVNSHIIGYITRVASAFRTVYQVGGVTAYFRGVQARVIYQIPSTAIAWSVYEFFKYLITKRQEEWRAGK

SEQ ID NO: 952808 - protein, 59 aa, Homo sapiens
LFRRYGYSGAFYYGKVAYNLVTASRNNKGDIRRFAMTAIESDLLQLAYPPRLDLGPQLT

SEQ ID NO: 952809 - protein, 55 aa, Homo sapiens
SGRTMSTGRCVALCHGQLCEAGKVWAPDLRVRAEDVLHVIDELLSDQVGERVNTR

SEQ ID NO: 952810 - protein, 48 aa, Homo sapiens
MTKQGYLTPPKYTSSPAMDANQDEVYELPGKEVRRLIIKLIKENASKS

SEQ ID NO: 952811 - protein, 189 aa, Homo sapiens
GSRFARLFLSLAVVNCAALCPSDTTLRSGEDEQVDHSTMRSAFRGYFLRPSLGRNGLKKQSSSLRRLMVRLQLVEAITSFTEDRTKEMDSSRKLTKRALKCSSEGFSKGGSFLSQHSMKGMSPRMLGSRYTMPQRETVAGEATARSCTSNIMVIASVSLMISPELRQQLLVVIQHRVHVLNPDGIHLAI

SEQ ID NO: 952812 - protein, 68 aa, Homo sapiens
EDHRQNTLKEYYIGHSDSDFRSECSAGNGIPILPNGNKSEIWNTYGPQPFGEGILHLYIMDSSLSSDI

SEQ ID NO: 952813 - protein, 49 aa, Homo sapiens
TGVRHCTHSGRTFIFEKIPFDPAENVPIISGPLFFTYRECSHFDEEKTL

SEQ ID NO: 952814 - protein, 44 aa, Homo sapiens
VFPLKATFIQSSHLADYLPVYIVDISKENPSGIKPTYLSSLRIT

SEQ ID NO: 952815 - protein, 50 aa, Homo sapiens
VFNLAGIACMYVPTGVRATAKAHSDSSSGKNCWKESTAGTCHIQSAWRSG

SEQ ID NO: 952816 - protein, 37 aa, Homo sapiens
MIQFELVPLMELVDTLMEANRIKGCTDNLTLTVARSE

SEQ ID NO: 952817 - protein, 42 aa, Homo sapiens
MINRARYRSMALSSSDECPLPRSASGHGSGVQSWQRLARCGQ

SEQ ID NO: 952818 - protein, 50 aa, Homo sapiens
DPDTQVSFPLNRLHSIQSSHLADYLACVDLVYPKKNPSGIKPTYLSSCVS

SEQ ID NO: 952819 - protein, 120 aa, Homo sapiens
MINLSSYLSWSWYAVQSRRAFFTNRRPHVAPCTPTSRGMCCGSLLGIVRLPNSSPAAFPIPGLNIYPQNGEGVKQTWDRRSECPGKTNYLAKPLAKTLGREAQNGTVWVFFWASLGKGLI

SEQ ID NO: 952820 - protein, 52 aa, Homo sapiens
PLQVLFAMLTPTLAAVTLMQLLAIDFHDPCVNFFPKKEKAPSGNGGSCVSLP

SEQ ID NO: 952821 - protein, 40 aa, Homo sapiens
PRQFDGISASTFGFIATLRFMWSAISVQHRFQHIAWQSHP

SEQ ID NO: 952822 - protein, 65 aa, Homo sapiens
TTGPAPSGLATTATLSLMSHFRPARMSSRALPDPGHIPSAGLCCSQKATRARIPLSQDAAAFHFR

SEQ ID NO: 952823 - protein, 46 aa, Homo sapiens
STSVLSSSFVSRHTSHTYYTQKCKVPSLVNKIILTERLGFLFWLFG

SEQ ID NO: 952824 - protein, 77 aa, Homo sapiens
TPDRPCDSEQGFITEDLKCCIWWRCRAIVAPGTHMSHAHCCWTTRLLWIRQVQTQMKGCEVTGGNYNDRTLIGKQTP

SEQ ID NO: 952825 - protein, 35 aa, Homo sapiens
PYVLPPKNWKRSPDEVRWLMGFNRDVIHRRSRSSS

SEQ ID NO: 952826 - protein, 67 aa, Homo sapiens
MYGYRVQGPSQWLVSQVFLQLDVSFNEAHLCNEDNGHPLVESTVLIYGEYLVHVPKGLYDKMARYMT

SEQ ID NO: 952827 - protein, 61 aa, Homo sapiens
SPVLSEVRNYYAQKTIALVMERASTVSSFPDVELQTEALRGLAVVSMVNAGKDTNGSRYMQ

SEQ ID NO: 952828 - protein, 44 aa, Homo sapiens
TPPPPPPPPPPRRTYYNCSPLPFVIVFSQNMITGHLRLTVLLLT

SEQ ID NO: 952829 - protein, 82 aa, Homo sapiens
FRGRSGTAHSASVLPVPEGMRMAALNLDGADSDLALWPGSHQPTSGNVSVYCWPYSVRTLAPHCDQLATDSTFSPDQPGTCK

SEQ ID NO: 952830 - protein, 51 aa, Homo sapiens
RVYQGAVTLIITYLIRYERSSVSLGRSLSPRCETFLHICTHAFFKAILFMC

SEQ ID NO: 952831 - protein, 35 aa, Homo sapiens
KVSFTGDCAHGMKIMEMSAKGINLLPGTGGKSPLI

SEQ ID NO: 952832 - protein, 35 aa, Homo sapiens
MHGYSMFGQAVLNTPNLSVISTVLVTPKVVVTTGD

SEQ ID NO: 952833 - protein, 53 aa, Homo sapiens
LKYCNRAGMDTADLEQAVEVMLLCAQALQRYDYAGRDCGAFEGKRPCVIFLSS

SEQ ID NO: 952834 - protein, 53 aa, Homo sapiens
VLLRDCLKFTIELGWILQTYSKHVEVMCFVPKRCNEYDDAGEIAGDLRGKDPV

SEQ ID NO: 952835 - protein, 76 aa, Homo sapiens
NGQEREKNTRHQQVRARWDRRTRGCSGSPWSTLYNGHRCFPTYETPKAKSTFSPMQKTHSSIAPRRRGVSQSGNSQ

SEQ ID NO: 952836 - protein, 103 aa, Homo sapiens
SRNFDTLKEFPGIPRISQFVCEIRRRYCKCIKTLWNTHQGMLLDLYWLSNVVELEVETGKTKKAVWSIMIESSSSEVFDVIYRPLEKQLKHASSFSRVVLEDG

SEQ ID NO: 952837 - protein, 77 aa, Homo sapiens
DAFLEQYTIDQNSYQQNLDDLYHDAFKKRQCISFYNVIDGGQAIPALVLNAVCNQSEYHIRCTVLRGFPYLPPIYKG

SEQ ID NO: 952838 - protein, 131 aa, Homo sapiens
MTVNMKKPKTQIWETMWGESVLGATVAWTPPGSKGDIQGPPPGPGQSPVPEGAPSGSVPCGQNLGSYICLAQAEDLAALVGALRVAHLQGHGGVVTLVGSQLGIIDVPPGPGSRHAHLAGALVRAHLEADG

SEQ ID NO: 952839 - protein, 45 aa, Homo sapiens
MLLHTLAAVELRQLLVIDSQDPGVKVLSANREGSLREWWQLRFTS

SEQ ID NO: 952840 - protein, 106 aa, Homo sapiens
NKYSAAQTDDELRKCAVVQQSEGGSHIIQRMYGCDLGPDGRLLRGHDQLAYDGKDYIALNEDLRSWTAADTAAQITQRKWEAAREAEQLRAYLEGTCVEWLRRYLE

SEQ ID NO: 952841 - protein, 36 aa, Homo sapiens
AARYYGVREMNEPTDDYDVPCGVCIVVVRLTSRAFR

SEQ ID NO: 952842 - protein, 58 aa, Homo sapiens
QHRYYRKGKDENYTKHNIARTNPYTFCINELTRNNFARRAKAKTPVNLRMYVRTAIRV

SEQ ID NO: 952843 - protein, 100 aa, Homo sapiens
GACHAWATQSWVDQTLRNPKECSGGDVQNFVVERQHASVLPCSCDPSGQCGSSPQMLQVFQSQGPGLKVVTASTNARWLQQLVDAIGQATLKGQVPLHNA

SEQ ID NO: 952844 - protein, 39 aa, Homo sapiens
RHIRISSYPVMMQTITDRGLECISHRVWEVVSGNIYAAG

SEQ ID NO: 952845 - protein, 41 aa, Homo sapiens
SSIDITTSEIDLPSEEAGTTQQDEETLWSFNSLMQTVISML

SEQ ID NO: 952846 - protein, 69 aa, Homo sapiens
LQASLGTAGLMGTADHLTGNGVWEGVDGHQRRRYENTEYLNSEGVWIHDRVSIGKSSYSQEGYLDLVRG

SEQ ID NO: 952847 - protein, 134 aa, Homo sapiens
PSHYIIRSFALSSNHWGIFTLAVECALTYLLFIPIDEVINLNLAYYAAVLLDTELIIFIGPCVNLLSSRQRIQCNKNCFASLTDVLGIPFVYPDSCTPDRSVSHRDCKRNRGHNGKEPYRISQEIGNLMKEIET

SEQ ID NO: 952848 - protein, 43 aa, Homo sapiens
MICCIRCDHTFPNQVQFHCVRNLFAIPYIVAVSIDISLLYFRL

SEQ ID NO: 952849 - protein, 133 aa, Homo sapiens
TSCMVTVHTVPSLVSTASPAVTLVIRKASKRDKHATFFSLRLLYYMDLKDDRPYHHLRAASQDLMSNLSQDDLDQSSCGIRHSGSIANHARSAVVRCCVTDGPVLNLGVPPKSVSGQPSSASTEEGKGSTSTI

SEQ ID NO: 952850 - protein, 88 aa, Homo sapiens
MLAVLRTERRCITVVTASTKARWLQQLVDAIGQATLKGQVSLHNASIILTHHELTGPRSAAGERDGGPMHGSKWAQVGQVRCQGLDIA

SEQ ID NO: 952851 - protein, 69 aa, Homo sapiens
ADTISSVPSGVYSQREWSAALARKWVQGDHMKIAHQFFQLVGGSASECDTIPGRQCMASCFFLLKQYDD

SEQ ID NO: 952852 - protein, 33 aa, Homo sapiens
LDDPQELVKGHAYSVTGAKQVNYRGQVVMPDPD

SEQ ID NO: 952853 - protein, 77 aa, Homo sapiens
SHYIITNLNRDEFVLKSNSYNRLYTAVTYCISRSSYSFSYSLSLIYFAFSYRGGVFQSLNSQVPLPCLRVSYASYAI

SEQ ID NO: 952854 - protein, 55 aa, Homo sapiens
IFTVTIYTKRVYTLITRWRSFEIVSAYLQTASIRRRLQIQSDVWMSSETINWPYR

SEQ ID NO: 952855 - protein, 153 aa, Homo sapiens
MAPWLIQCGDLVVVQLMRNRTLRRPVKLSLWMQLMRLFRSIRVLNASPNPGIMPLRMDSSWLAVKCRSLTERWAPRIAPVFNFLTPILLHHDLIFFKFCKFIKHPSGLQDGTLIVIQSQFCRARENPPEDLGELQAGALHHVGLTAALVGTDH

SEQ ID NO: 952856 - protein, 45 aa, Homo sapiens
SRTSTNHWNVIAAWIWGPAENNSGLGWTILNKITAHGSVLSSGVD

SEQ ID NO: 952857 - protein, 38 aa, Homo sapiens
EERWVPALMYKQSSEFEAGKKTSVTLHVHTNIAGSQFL

SEQ ID NO: 952858 - protein, 112 aa, Homo sapiens
VLEDPVSSHHWTRFTCTETLEGLLHYQYITHYCSFFVILRWSFTLVAQAGVQWHDLGSLQPLPPGFKRFSCLSLPNSWDYRHAPPHPANFVFLIEMGFLHASGDPSLKVIDL

SEQ ID NO: 952859 - protein, 102 aa, Homo sapiens
GLMLNGVVDFPGVFQLHIPMYFRDAILKREVVQHRVYAVRLWRTAFLSLPGTNVSSSIDSGYAWPLLSLGFGRMQSHWKVLNLVPGTEYLALLLAQQLQTHN

SEQ ID NO: 952860 - protein, 46 aa, Homo sapiens
GWVWWLTLYSTPVGGCRGRITCRPEFTHSLGNLDPVSLEKSSYSGV

SEQ ID NO: 952861 - protein, 58 aa, Homo sapiens
MVWSRHQQQDIADNFEAFVLEPAIVRIKCHVPPWCVMVLQNVENVCGIKASIVTQLAW

SEQ ID NO: 952862 - protein, 48 aa, Homo sapiens
IQLMWSEMRKRGFEVVYMTEPIDLRTVCSSIKEFDGEEPGLLFTKAGS

SEQ ID NO: 952863 - protein, 47 aa, Homo sapiens
YKLMGYSDLPNSDSRSAGDYSALATAPSPCTVISNGSSNGSLVKTSA

SEQ ID NO: 952864 - protein, 38 aa, Homo sapiens
SSSAHIYICLETKPGNNYDILSTAESMTNSVYYPQTFQ

SEQ ID NO: 952865 - protein, 36 aa, Homo sapiens
MTSYGRLYFILKHSSTGTYCKPYDGHSLLHHLELYH

SEQ ID NO: 952866 - protein, 46 aa, Homo sapiens
MAATPLIHHTTTEACYGGARYGRYGGARYGSARYGGARYGCYGGAR

SEQ ID NO: 952867 - protein, 31 aa, Homo sapiens
MATVSKSPSHDVGPIGGVFDTVAMLRGEMFV

SEQ ID NO: 952868 - protein, 138 aa, Homo sapiens
MLPSHSYYLASVALYSTLGFILLAVECAQTYLLFIPVDNMLNLNSAYYAACARIQNTSSFIGPCVNIVSTNCESKCNKTCFAFAYDVLGIPFVYPEFMYSRRSDSQEIARDTEVITVNSRRISQEIGNLMKEIETLVV

SEQ ID NO: 952869 - protein, 46 aa, Homo sapiens
MGFSEREGSIYLNDFARVVSRDHEAVNGILHFIDRVLLPPEALHWE

SEQ ID NO: 952870 - protein, 110 aa, Homo sapiens
MLHVPTHIDGSSNRSTVHLLFSLLLLHNLLLSLSPAPFQMDIAETAKIFFNSDGYNGHAVRSLTTAVLLLEYTAVTKSCELKFTEYPNHIFANASEMSKSVKLIKISAIY

SEQ ID NO: 952871 - protein, 51 aa, Homo sapiens
AERLVLLLIRGLGICTFNVWESFPFSTGSEASLDRCHFHICAGAVRKLKKN

SEQ ID NO: 952872 - protein, 61 aa, Homo sapiens
LEYPPMLLSGSEVLATSEGRGSRPQDPFLIADQWPALPLKLDSVFEDPLSKKLFFFSGPPS

SEQ ID NO: 952873 - protein, 34 aa, Homo sapiens
AHSGLLAVFSLALHENIMPYFYDLGFYICMVTCE

SEQ ID NO: 952874 - protein, 44 aa, Homo sapiens
ARHYMKTTDNHNNNKRQEEYTKMTDQKTINKITRVCPHLSKITL

SEQ ID NO: 952875 - protein, 63 aa, Homo sapiens
GEKYHANRHDRKAGVTTLISDKIDFKTKDTKKDKEGHYLMIKGSIQGEDVTIVNIYAPNTGHV

SEQ ID NO: 952876 - protein, 41 aa, Homo sapiens
DFEQSGRRFAFSRFQLDFSFELPAFGVPRYFPFTASIRIHI

SEQ ID NO: 952877 - protein, 55 aa, Homo sapiens
MLLLLQRAAAQADCLDNDGAVPLEALNPAALHCSESSPEPCLPVFPALQPLYPPA

SEQ ID NO: 952878 - protein, 57 aa, Homo sapiens
TWKEGRLKEVLTKTIYCVNYAHCLGDGINSEAQTPALPKYSLETVLAMCFKMVGYRA

SEQ ID NO: 952879 - protein, 62 aa, Homo sapiens
MLVLVGCSLSRSSRHTLFSSRSLGPHCVLVWVFEASAYVGIPLCRSHPAAEMHPTDYEAGVP

SEQ ID NO: 952880 - protein, 96 aa, Homo sapiens
YHQIVNIEIRLIIYSLQSKMEKFYTVSKNKTGSCCDSGHELLIAKCRLKLKKVGKTTRPCRYDLNQIPYDYTVEVRNRFKALDLIECLMNYGWRFV

SEQ ID NO: 952881 - protein, 56 aa, Homo sapiens
PVAYARATQVQDPNLIVTYTIAHGNTKIHNPLSKARDQTCILINQLNMGLLTTEHD

SEQ ID NO: 952882 - protein, 41 aa, Homo sapiens
MSCNDQTSRHELSPSALFLLLLVLISMYSRLAQSWCISRCW

SEQ ID NO: 952883 - protein, 68 aa, Homo sapiens
RLFFPVVRLFHDVSGCVHEPGVSPVRSVELELQSGRSCPRVLSLRVERCGLLTTAGGRKISPSSDLSN

SEQ ID NO: 952884 - protein, 49 aa, Homo sapiens
SSSKGIVPWEKRMHEERTPAGAMMKWNEVTDAGEVHHMYCRHGRKVNTL

SEQ ID NO: 952885 - protein, 37 aa, Homo sapiens
MSAAAGVRGVRRVVTEASLRRAVTDVLGGARYGGARY

SEQ ID NO: 952886 - protein, 34 aa, Homo sapiens
VTQRPSGGGGGNIMKREYRAVTAALLRTCRRARY

SEQ ID NO: 952887 - protein, 69 aa, Homo sapiens
SVRAPPNTFRNERLLTSASVTRLRNERLLTAPPYERQRNWRSQGRVKRRCEEASLRKGVTEEGISSIAV

SEQ ID NO: 952888 - protein, 96 aa, Homo sapiens
LRNDHNEALRNSASITPSVTRLRNTPPYTLLTPTTTTTDGRRYPYRAPVVVVVVMLLIGARYGGARYGGAVTEALVTEALVTEGLTGGARLQEALS

SEQ ID NO: 952889 - protein, 53 aa, Homo sapiens
LRSTSDGLPRCAYDAFRNERLRNAASVTSAPVWCRQGVLGGCYGGVVTEALVT

SEQ ID NO: 952890 - protein, 70 aa, Homo sapiens
RLTILGRSLGGARYGRYGGAREALVTEGVRHERLRNERLRNSASVTTPPNERFRNSPTKKRKIAIPRRSL

SEQ ID NO: 952891 - protein, 131 aa, Homo sapiens
RTATPNVLTRPDCYKLGARYGGAREALVTEALVTEALVRRSLRTLRRRSLRKRCYGGAVTEALLRKRCYGSAVTEALLRRCEDVTEALVTEGCNGGARYGCTEALVTEGYGGSVRRRSLRKRCYGSAVTEV

SEQ ID NO: 952892 - protein, 52 aa, Homo sapiens
YQRLRNVLTPPYERLRNERFRNERLRNSASYTPRMVYRDQRFFFSLVALCYG

SEQ ID NO: 952893 - protein, 127 aa, Homo sapiens
MHLRSTLRSPVTTLRNDASVTSYRRLRNDASVTTLRNTPRLHKLRWRSRNERQLQLVESGAVTEGVRRARYAVRRRRYGRAPNWWSLGVLGSVVTEALLRRRSLRKRSLRRRSLRKLLRRARYGGYR

SEQ ID NO: 952894 - protein, 118 aa, Homo sapiens
MTHIWFYTPLLLYVTLVAKDHDDDLLLCSLGFVTLLLEQLHTLKRLSAICAIDQDVAISAREAVSGQFGPISEPPGVIETHLLSHAPVCLNGAHVDILLRLDHFRTHYMVPIQKLLQD

SEQ ID NO: 952895 - protein, 36 aa, Homo sapiens
YNEDVVSVQLGVQRYHPYVHWCSSVCVPLGPIPREP

SEQ ID NO: 952896 - protein, 52 aa, Homo sapiens
PEGRVTDATETNITRRWRTKTDTITGYQDVMPFQPMARIQSREPSSQMSEAK

SEQ ID NO: 952897 - protein, 196 aa, Homo sapiens
RDCRCYHFHGNDGQDTPVLRELPEPVVATFHPHLPTTAGIAAIVLRLGGARDATVAPVYSYYAQNEVVATDNLDYRHHSYKDMRQLMKVVNEECPNITRTYSLGKSSRGLKIYAMKISDNPREHELGKTEYRYNAGIHGNEIARAESCSQLLMQYLCREYRDGNPRVRSLVRDKRIHLVPSLNPDGYNVAAQHGSE

SEQ ID NO: 952898 - protein, 124 aa, Homo sapiens
VLSCIYLLAPGKLKAAETLEECALRSGDRALTLSCQTKVAELLGESDGRRTSQEGPGDSVKFEGGEDASVAVEWSGDGSGTLPEEWLFGKIRDVLRKSSELLVRKLQGTEPRPPSSNMKRAASF

SEQ ID NO: 952899 - protein, 71 aa, Homo sapiens
WGSGPDLRPGPGSHVHECISYTCHVPARPLWSPCFICTWATEDDNPDSVSVTTSERREVLRDRSPLGCQLD

SEQ ID NO: 952900 - protein, 39 aa, Homo sapiens
RIELRYRFVGAGRRAGSVSLRGRCLCVGVYSRGPCGMCP

SEQ ID NO: 952901 - protein, 43 aa, Homo sapiens
DLRIPFVAVVVRVVVGRADVTEREGRVPQVVRKAATLPTTRAH

SEQ ID NO: 952902 - protein, 85 aa, Homo sapiens
MDRSERIRTYNWPENRITDHRIGYKANNLDSVWNGDMHDLFKALQDQERAERLEAEGYTGVAYTYGQALRRGVQRLRAAGVPSPE

SEQ ID NO: 952903 - protein, 106 aa, Homo sapiens
WVVARGVWAGKNRVSLLSPSLECTGVISAHCSLHLPGSSYSPASASRVAGIIGAHYHTWLVFVFLVEMGFRRVGRAGLELLTSSDLPASASQSAGITGVSCAAPTT

SEQ ID NO: 952904 - protein, 108 aa, Homo sapiens
KDPLGWGAWGVGGEEQSLALSPSLECTGVISAHCSLHLPGSSYSPASASRVAGIIGAHYHTWLVFVFLVEMGFRRVGRAGLELLTSSDLPASASQSAGITGVSCAAPT

SEQ ID NO: 952905 - protein, 68 aa, Homo sapiens
MDSHHYLVEDFSEEYQKPRPRLADGLKVREAAGLKDGLRCRSVKGSKVSTDTVETQINLKMSSNTRSF

SEQ ID NO: 952906 - protein, 50 aa, Homo sapiens
MRYEMDHLAAALALMQVSRAEFLMTSSIRELLRLHSSSLPAPWTGCLVPF

SEQ ID NO: 952907 - protein, 145 aa, Homo sapiens
SDLELPGSLVLYRCLATRELYLRVELSDVQNPASAYTENVLHFKAQGHGAKEDNVYEFHLEFLDLVTPEPVYTLTQRPGTTLQYRRTESVVGEHSQSRKSDHCFRLLHFDRWLDESDAAMELRAKDDERLNQIRQESEGSPETLT

SEQ ID NO: 952908 - protein, 37 aa, Homo sapiens
TKNKEMRRNISVILDSPITLSVEKERDKEVSDDEAEE

SEQ ID NO: 952909 - protein, 67 aa, Homo sapiens
EHLTDMVSLLVVQCKEKGLDPEILKTSELMTIGKVGKVIETKDDAMLYKGNGDKAQIEQRIQEIIEQ

SEQ ID NO: 952910 - protein, 125 aa, Homo sapiens
MPTQYTEVARKLVILESGLERAERAGWALRRQHVPKLEKDLHPVTTNLKVTGGQGEKYSQKDDRYEEEIKVLTDKLKEAETRAELAARSVTKIGETAFDDLTEKVGHAKEEHLKYGHRLLASDFN

SEQ ID NO: 952911 - protein, 71 aa, Homo sapiens
MPGPVLGSFQSRLGLGRSCAQACVGPDFGVGPGPCWVLGVWCTRRAGWGLFCLGTLGNAEDWLVAAHLSKG

SEQ ID NO: 952912 - protein, 55 aa, Homo sapiens
SGVLAHAGTGLGRFPYRLGWATAVRQACVGHGLWSGDLEPCWVLRRLGTDGVAGL

SEQ ID NO: 952913 - protein, 33 aa, Homo sapiens
ETKVKKEEEELKKEFIEKEAKLHSEIKETGSRN

SEQ ID NO: 952914 - protein, 46 aa, Homo sapiens
PQNLGAVVVPSGEEQRYTCHVQHEGLPEPLTLRWGGKGGSCSQAAS

SEQ ID NO: 952915 - protein, 143 aa, Homo sapiens
CAWIRESPTGICRAIAPCLPATLELSKGGLAICLPSCGFSSQAIVTLATVAPYLQRGVARQHLGAKSQINLGNGCAGEGRWFRFENRSSFPSCTPSTARSSPTLERFAGDVIEVHKAGDVLEQQNPEYLDDKANTVGRSMIAQ

SEQ ID NO: 952916 - protein, 75 aa, Homo sapiens
RCRYPKPKPIRVRPNSPHFCEDREVRKLRKKSWFMRFKEISCLCNIKVQSEAASTSGEAAASHPEDLANARHGGS

SEQ ID NO: 952917 - protein, 77 aa, Homo sapiens
LLLRIPHSFGPPRGPAYTWKSGAHLHLISRLASWASEENRTSRTPWAIFPWDTISTWATWMLLVTPGLQGMPGERGG

SEQ ID NO: 952918 - protein, 93 aa, Homo sapiens
MGADHEQPRVTRVAVLELLVVSRTRQRQSRRNLVASAQTVQVRAHVAVCSNGSEVGMVPTVDRVQIGGPYAYVPAIVARSTLLYDVAMIVWLH

SEQ ID NO: 952919 - protein, 178 aa, Homo sapiens
MSAMQMKLARAQAVDMLDRFTETVSVLVPVWRQNTLALITTKNISPELIASATKAHQELMQQIVQQSGHPQSLKAGRTTLNNQLQTSNNVARTRSAGHSGLRRPWPERPHRRHGSCASLADRIQPSDPATVAEYGRDVGAITREFTADSLLEQVRNSDLDDAGDQLTQVVNVARNLNV

SEQ ID NO: 952920 - protein, 43 aa, Homo sapiens
QQDQQTQTSPRSPDGSSRTREHTTAPGAPRAPSLPGLPIFTSE

SEQ ID NO: 952921 - protein, 36 aa, Homo sapiens
NPASVQSGIKQLHARITHQMDHNRSECAQGISRSHK

SEQ ID NO: 952922 - protein, 114 aa, Homo sapiens
TSEYADELRRLRCSELRLCHYTPAWAQRVKLRLKKKKKTQFTQTAPTLHIITTSHSSPIMALLLQSQVLYSLFLNLSQQPPEGKYKFPSLFKQASAQVQAHFPLGPHVWHCTTL

SEQ ID NO: 952923 - protein, 34 aa, Homo sapiens
TKTVGRASSLFSGSQSRSAAAQAIATLRSHVHQV

SEQ ID NO: 952924 - protein, 66 aa, Homo sapiens
RPWWPWLRRVAHGLGGGGGADWLPAPRRTRARCLFLVVILWLSSSFDLPVCAFGLAVVFPLHTGYA

SEQ ID NO: 952925 - protein, 56 aa, Homo sapiens
SGPVLQASSQTLGTRQTSFTWDDSFTSAILWVPAGPVRTTFTSADPTGSPWCKHPV

SEQ ID NO: 952926 - protein, 98 aa, Homo sapiens
FGARRRLRNVSQLSCRAQVRQRAVIQRRALQALVIQGETARLDDVQPHAETGGEADGGADVLGNTRLKKCDTHNKRTNHKGSRGFAANRKDLRTWPAR

SEQ ID NO: 952927 - protein, 39 aa, Homo sapiens
AAAVEEEFRGERSQSREPEKPEAGEERVESEQRDGLEPH

SEQ ID NO: 952928 - protein, 128 aa, Homo sapiens
ADLPVVRGTCEQARLRLLCMLDEFAVVELKTNLGFLRRIIGHPAFAAAELDTGFIPRYQDELLPVPGELSDEFWQAAGQAFMQTQPLNDARSPWTDTHGFRAGLPAEVSLHLSCSGQDRLVTLHPGLS

SEQ ID NO: 952929 - protein, 35 aa, Homo sapiens
SFMLMLRGNRSTRRLSFINYSASYTIKVYHNHHPT

SEQ ID NO: 952930 - protein, 57 aa, Homo sapiens
AYSLCERECACVNLCVTMCKGPLMQECCGDQRICVRVHYREGWLAVVQQELGVRTML

SEQ ID NO: 952931 - protein, 108 aa, Homo sapiens
MLRGTSNSPQKGESICPLRYRMVSNCFFTVDADGQEKQREPTRFTVDTDREKSMSFVKLNGDCTYITEAEADTLTVAGAKDGRKHLKATDGDFGDLIDLDHHCLKSAA

SEQ ID NO: 952932 - protein, 42 aa, Homo sapiens
FGSRTMIGETVKKFFDSADLEPIAIGRFFILKYKIYLKKKYF

SEQ ID NO: 952933 - protein, 34 aa, Homo sapiens
YPEAMFALNYIDIRSLQRRLEIARSNVALHQETL

SEQ ID NO: 952934 - protein, 33 aa, Homo sapiens
MAESSLLHANALIIFICLFPLHIGEAIRISLLR

SEQ ID NO: 952935 - protein, 40 aa, Homo sapiens
GIETELSLLLRVYTLPLDNCTAFIFACVVTHLTLRAQSKQ

SEQ ID NO: 952936 - protein, 57 aa, Homo sapiens
MARGKGLRGVNPYEWQGHSKRLGDGDMKLEARSSTQTRHPKPLARLGSREHRGRDHE

SEQ ID NO: 952937 - protein, 35 aa, Homo sapiens
VRRIGSREMGEEGEGFSNIAQVTALHTKTSDTSYP

SEQ ID NO: 952938 - protein, 35 aa, Homo sapiens
LVSGLHVCLCDERHLSYMCHRYFISFARRYFLSVA

SEQ ID NO: 952939 - protein, 35 aa, Homo sapiens
TVEREEDEKDKRKDETEKERRQDGESLIAPPLKLS

SEQ ID NO: 952940 - protein, 36 aa, Homo sapiens
LKDRSITCARHRQVSGHQASIGPAMCVCCEKRPLEP

SEQ ID NO: 952941 - protein, 40 aa, Homo sapiens
DVAGRQAQHTARAGFAAQWWEGRGGAALQVWVWQGSWKRG

SEQ ID NO: 952942 - protein, 124 aa, Homo sapiens
TGVPFRVVVGDRGLKEGKLEFRGRRDESRHCRGTGRCAGYVESASRAVMELTRMRRYLSASPIAAVLCAGALLAGTQAAWAGAQKEEYLADSVRSALSAAVADSRPLRPVFANNDEQLGYLRWR

SEQ ID NO: 952943 - protein, 97 aa, Homo sapiens
RRIGSSVLQGGRRSPGRSTIDSDNYKAIIELGMNFGIAARDSSGAVFEIAAESAPTVALPQYLYGHFLINHRAFERGLSYVIRALAIDPLQAENHVG

SEQ ID NO: 952944 - protein, 83 aa, Homo sapiens
VATYARDYAVWSLTQKMATIVPVITITAPQSRPSLYWAARLYEDVYRAEELADRNEVASPAFMPGTFEALRAVTVRASSPEDQ

SEQ ID NO: 952945 - protein, 36 aa, Homo sapiens
MGIIGKGRNRGKALSNHSTGLSVAHKNERRYYLPCT

SEQ ID NO: 952946 - protein, 33 aa, Homo sapiens
RRKEVRVRRIGSGEDNRLEEDNVLEEAILPILR

SEQ ID NO: 952947 - protein, 55 aa, Homo sapiens
RIPIAEEARSTWLILLSTLLISGSFNLSTLYHKQQEHLVKLSSCPRQASMQGTET

SEQ ID NO: 952948 - protein, 104 aa, Homo sapiens
MGNPRADIKDKTSKSGSEEARYTPKAPAGLRRYADSAFTRRNARGMRRAMTRTITVAALHIPLTGPVQPNIDAVTALVEEAASKGAQVILPPELFEGPYYCQVG

SEQ ID NO: 952949 - protein, 39 aa, Homo sapiens
ALLSTSTATSPYPHTSYYRNHQPTHSIDSPWSYALDRKH

SEQ ID NO: 952950 - protein, 54 aa, Homo sapiens
TYCAEDHLIGQKITYRAEDHLIGQKITIIGQKITYCAEDHLIGQKITYRARRSP

SEQ ID NO: 952951 - protein, 37 aa, Homo sapiens
MPDSSKYSGFFTLYSLRGQLELKPPERDRGRRERAPG

SEQ ID NO: 952952 - protein, 36 aa, Homo sapiens
PFKSPGCNLCYAALKINQFNCSRLSRKESPGGRLAL

SEQ ID NO: 952953 - protein, 44 aa, Homo sapiens
LILVVEMYGGCYWLAGLGLELSCLCSCPSTVEAVKPLTTLNHLW

SEQ ID NO: 952954 - protein, 43 aa, Homo sapiens
LTVLVVELCLRCTLAQVCQDARCFLLPLFLLSLFFLVLFIAST

SEQ ID NO: 952955 - protein, 38 aa, Homo sapiens
HSTDFKGNLALMLTHLKLENFKIWRSTGPTPLAPITLI

SEQ ID NO: 952956 - protein, 52 aa, Homo sapiens
CWHQDTSGHSVSLPFHSPAPGGAQLPFSTDSPVLTCPLLCLYHALHDKVIFC

SEQ ID NO: 952957 - protein, 93 aa, Homo sapiens
EKESKGDIRKARETEPGSSSKATLIGVKADLKTGYTIQCGCFNNSILGSLLFKPDLSCTLGLRRFCTVTQAGVLRYNHKLTAASTSQARVDPS

SEQ ID NO: 952958 - protein, 167 aa, Homo sapiens
GDSTGSQKITYRAQKITIYTNKLENPEEMDKFLDTYTLPRLNQEEVESLNRPITSSEIEAVINSLPTKKSPGPDRFTAEFYQRYKEELVPFLLKLFQTEKEGILPNSFYEASIILIPKPGRHTTKKENFRPISLMNIYAKDMNRHFSKEDIYVAKKHMKKKLIITGH

SEQ ID NO: 952959 - protein, 41 aa, Homo sapiens
ARYQKITHHNLGNKKRDDDNELMTSGPRMRVRDSTLHLKEV

SEQ ID NO: 952960 - protein, 36 aa, Homo sapiens
LISALIIPLAGRLFHFLPLPQLPSSPLSPGGDLLHD

SEQ ID NO: 952961 - protein, 42 aa, Homo sapiens
WYLVILSCIICTKLALKFRLPFQLLLSSTNINLYTIRAPFRS

SEQ ID NO: 952962 - protein, 44 aa, Homo sapiens
MLLSEVGDCGAALLLIELCWSQPRVYLCADGACTEVWLFLAYVL

SEQ ID NO: 952963 - protein, 207 aa, Homo sapiens
LNDTTARSTGNLGPACCRQALQTSFRYGQMNSPFEYEKVRYVYTEARKLQIAEYTPCRRWLASAYIPRRHHFRHVNRNCSTAALAIIPVLTSRHRRLLKGFSIATLAASISDSFATLGPLSSSAVSNPRKVANAFNRQRAPAARQAGTQFQQLIPQVQPEQSIVPMGTAISRQGYAERDKRISRSDMHPPNQLSASSKGGDVHSARS

SEQ ID NO: 952964 - protein, 68 aa, Homo sapiens
VIFCCVEPSPYSYILLVVWHERWSGPHVLSRNIVNFVFRLASQTSYASSFHCFHNPLWARRTSRYCYV

SEQ ID NO: 952965 - protein, 56 aa, Homo sapiens
GPNITYRAEDHFIVQKITDSAEDHLVQKITYRAEDPPYCAEDHLVQKITYRAEDQP

SEQ ID NO: 952966 - protein, 42 aa, Homo sapiens
LGSGRMLFKFTMFTVFFKYQDLVLSCKLECSGQSYLTAASTT

SEQ ID NO: 952967 - protein, 38 aa, Homo sapiens
YLRDVDFLQRRTTPTCLSEVMTPRIELVVAPAGVTLKE

SEQ ID NO: 952968 - protein, 55 aa, Homo sapiens
ALQFCTSYSSDQITFSTLLPLTKPYSSLKAQPKCHLLRDPANILCSPPSEFSTTS

SEQ ID NO: 952969 - protein, 51 aa, Homo sapiens
AGTITHSWGTLYVRQRNAGIQSDVSQMIPSWLLRSGAAKVIFCTIGDLLHD

SEQ ID NO: 952970 - protein, 52 aa, Homo sapiens
VLTITLSCRRSPLALEVLRIALNQPPAFMVEIKELLSGSPERYTLCRREVIF

SEQ ID NO: 952971 - protein, 68 aa, Homo sapiens
GYPHFRASVSVQSSELPSQSEFFVISKHFTATPRIPPTSTVLKTDSINCNFTVEPQTFTTDLPVHLRS

SEQ ID NO: 952972 - protein, 45 aa, Homo sapiens
MVDIWLRHCGETERATERKWAPEMKVITQILGRCHHQKLIYSDVF

SEQ ID NO: 952973 - protein, 35 aa, Homo sapiens
HRAASITQRASKHFCEAYRCIFVPRMQVHRSCHAI

SEQ ID NO: 952974 - protein, 35 aa, Homo sapiens
GALTHNLNDKPVTNDWWGWSTYLLLKDYKPNQSFA

SEQ ID NO: 952975 - protein, 132 aa, Homo sapiens
QLSRGSRADSVVDRDSDHRPAGSGRMLGVAQAWLSKSFGWYYMVVIAAYLLFAPRDGAVKGMYSLAASLAGQLGDSWIAAWQVAPDEDRYALVAVDQGAVLPGCDQVGSAEDTTRKVAQMLGSSISFKDVYL

SEQ ID NO: 952976 - protein, 199 aa, Homo sapiens
SRTEADPELVEPYLIVCHGLQHRLDHASAGLAALWLIDQVGSETTTQEQVLEALTPIGLSSPSSSRTGPHRATSDGQRARVHRLLVEGIDVIAVIALAIRIGGIQGSNVPDSFLVVPPARKLPCESICSGSLAMAVVAQRETAIQSSVEGKLGTRVRRRVRVCMGHSVTDCQENLPSGPSWKRRGGAYDQCMEDIYMHV

SEQ ID NO: 952977 - protein, 105 aa, Homo sapiens
LFTFCIRLQLQTRIGATDPRSNGAGTLTCQLPILEVAQGHVLKIFLSINGTECLHQPVAGAHEGVGAGDAIPPRPAADACGMRFFRACCLRPPHAQTCISAGLMR

SEQ ID NO: 952978 - protein, 55 aa, Homo sapiens
MPPMQCASISFFLQRLSSLVPPQVVFGHASNSRATSQRAHVFIKQQGSTLRGILS

SEQ ID NO: 952979 - protein, 58 aa, Homo sapiens
LRTTADAVTTKVSLHSSWRFPPFFSHACMGGGGAAIGVPTLNMIIGLTTPSSHPESFA

SEQ ID NO: 952980 - protein, 53 aa, Homo sapiens
MALIHLHVRSPCLLCGERNARRSAASGCAASMARRLRRSLKISIFRRRLCAYC

SEQ ID NO: 952981 - protein, 39 aa, Homo sapiens
MRSRRRTGYSFLGLLSQGAVVSKSVHRKEYAALIEAYLP

SEQ ID NO: 952982 - protein, 64 aa, Homo sapiens
QCTFETAPVDTSTPVTNFSEARSSPTTGEGTSMPTSTPSEGSTRFTSMPVSTMPVVTPEASTLS

SEQ ID NO: 952983 - protein, 58 aa, Homo sapiens
SCRFTVSLSAVDVCATPLAENTSSAAYDSDVCATPPRIEHVFRRIQDAVTCFQCLFLR

SEQ ID NO: 952984 - protein, 45 aa, Homo sapiens
MALSHSIAAEARMGVRLFNRTTRSVSLSEVGAEFVETITPAAAPS

SEQ ID NO: 952985 - protein, 38 aa, Homo sapiens
CIVIERGEALANSRVIGVVIAGLLGGWQVGLGAEIDRL

SEQ ID NO: 952986 - protein, 104 aa, Homo sapiens
ANARYGLNTGDVNTVVQAALSGSQATTILEGDRQFALTVRLAPEYRATIDAVRNIRVAYTNANGGNSYIPLSALADITLDTGASYIYHEKNARYIPVKFSAPPP

SEQ ID NO: 952987 - protein, 104 aa, Homo sapiens
ESARHIFSPPVEITSQSWSTAWDSACTGLYCEGLKVGFMNSVKITIPSVIASILIASVNGYALANWRFKGSEVFFSILLFGAFIPYQVMLYPLVIITRNLGPSA

SEQ ID NO: 952988 - protein, 62 aa, Homo sapiens
DRVRHLDLLVCVTEKMSAASFIDRQKSGTIKLPLCGSHILLAILKCTSLLRKGCRLVKQSRM

SEQ ID NO: 952989 - protein, 53 aa, Homo sapiens
SRGSPHSFGLPHSDHLLTLTHSDHPLHPILIPTTCSTLTHSDHLLHPNSFRSP

SEQ ID NO: 952990 - protein, 52 aa, Homo sapiens
CALVGVRRTSRWHNGPACLCDRGILVNPQLQTADPHISAIRRMLPVGRTTLL

SEQ ID NO: 952991 - protein, 43 aa, Homo sapiens
RECRGYYFYAAAARRALNAWDARASDSYVDQGDAQTLDRMNSA

SEQ ID NO: 952992 - protein, 121 aa, Homo sapiens
MTIDIICGFLKERCFRGSSYPVWVVQSGKGWLLSARDNTPQKADTDADLIDTSYSPLTNFQDHINRQGEYIQEIRRQLNTCQRERALTSEVRGPGSTHEQPTCAQIRTEYTPTREGGGVRC

SEQ ID NO: 952993 - protein, 182 aa, Homo sapiens
MHRQCQEKASGRRCGSRLLSQHSGKLQRADHLRSGAQDQPAQHGETTSLIKMQKLAGHGGVRLHSQLMGRLRQKNRLNPGSGGRSEPRSHYCTPAWMTIAKLCLKKKKKKGQGGEGGDISFFWSTLAGGAPQLRYGGCSVYGGCPCVWGALVLQWCTGGSVQPAGRSNRGCSGPGSAPRGAG

SEQ ID NO: 952994 - protein, 74 aa, Homo sapiens
MVVSGTRGSGEEGVCLMGTGYSLQDEEFGDGCTTICVVVLCWRQGLIPLPRLECSGVMITAHCNLKLLGSSNPP

SEQ ID NO: 952995 - protein, 144 aa, Homo sapiens
RASRCGPHGANVTGYLGCCFSRQKPLWLVVPLPKFCSGLLVLFRPLSLTGCAQLVLTGVDPMLAKGKPAMEQRELCEQASMGSGHCTQPGMPAVAVQAAPGASTGTAVAGPGVPQATSTAGTGECGGTWKLRDTRNRRAPKRVS

SEQ ID NO: 952996 - protein, 72 aa, Homo sapiens
LSRIPKSVTQDVGPVVRGKPFPRCSTKTLGGEFPQELRFRQRSCSHRSSDRIRRRPIRAEHQASGQSYVLMD

SEQ ID NO: 952997 - protein, 35 aa, Homo sapiens
MSRTPRGFLPASAGGTTGPARQIACRKLDSFIDTS

SEQ ID NO: 952998 - protein, 62 aa, Homo sapiens
TTDHIHIDGTGIQIRDDEPVKPRNESARIGACVFIIKGFNCIVAHGASTGRLYGRFSKISCN

SEQ ID NO: 952999 - protein, 33 aa, Homo sapiens
VRLLILQEELRLWSGQVGPIVPVASWLLWDAVD

SEQ ID NO: 953000 - protein, 34 aa, Homo sapiens
MSLLGVLLDLDVGGSALALAVSTAQPGQFHKLVH

SEQ ID NO: 953001 - protein, 48 aa, Homo sapiens
MTITVGIPISMLSCVVRISQAFRHKWTGIIPTRTILVPGHSTTGDPHR

SEQ ID NO: 953002 - protein, 41 aa, Homo sapiens
DQEEYRDLTTWRNIIEEVVRKITIEQPQQGVPGRDDQSKRR

SEQ ID NO: 953003 - protein, 115 aa, Homo sapiens
NRGHWEADAGAQRIKQHVKLAQTSHTGTMKVSAAALAVILFATDLCAPASASPYSSDSITLLNCQYCPNIAPSTIKESHYTSGTCSNPTIVYVTRKHRQVCAKPEKKWVREYINS

SEQ ID NO: 953004 - protein, 39 aa, Homo sapiens
VTRLTFRWSLLTRRTAGRLPTVDSVWVTLGRVRLLTRRG

SEQ ID NO: 953005 - protein, 46 aa, Homo sapiens
DTARIREDVARYIDVRRDGGIPAVYPNNVFLSTVGQRCHRDCVLKL

SEQ ID NO: 953006 - protein, 109 aa, Homo sapiens
MPSIPPKDTNPPPRMVFITRRVPLLATSSLFTPCTLAGLIYLQFLESAILPSLLLCVWCYFRRKHLLLVNTFSDLKTQSRCNFQKALTQPTTSSDQYHFSGFLFSHSSL

SEQ ID NO: 953007 - protein, 94 aa, Homo sapiens
TKLDKADVMNWMCKRKIKDFFSIRLDHNMFLTHEETDGSITSGYSHVLHPSPNTLPLGLLAAELAPPPRRVVYNRSSGLVSNAPGVQIRVPTLS

SEQ ID NO: 953008 - protein, 35 aa, Homo sapiens
AHNSEDQLKFVLTVESTVAKCTLVAVPLASSWYRA

SEQ ID NO: 953009 - protein, 174 aa, Homo sapiens
VTFVLNYSITDTQATLLTNYPTTLLTYSVKITQSYSTNLLRTPTLLTYSTNLPPKTTLLTYYANLLYSPIPLTYHPTLLTYSTNLKLKPTPLIYHPKLLYYPSLLAYQPNLLYYANYPTTLLTYSANRSPKATLLTYYSKPTLLTYSTNLPPKTTLLTYYAKLLYSSIPLTYHP

SEQ ID NO: 953010 - protein, 31 aa, Homo sapiens
MCFIRQLIFHFTSKHHLASKPAPDTAMRCWK

SEQ ID NO: 953011 - protein, 95 aa, Homo sapiens
MAFARDIAAADIASLLLHLIAPVSILSVLPKSHATFLRSSCPFQHLDSSFQHLIPPSTISLLLPTSHSPYHISSRLPTSHLPSNISYPLPKSHSP

SEQ ID NO: 953012 - protein, 77 aa, Homo sapiens
MSVPSTSHPSFQYLMPPSNISLLRSKHPITTHSQPPITTHSQPPITTHSQAPITAQLASSHHRPSPRRASQPPIAGA

SEQ ID NO: 953013 - protein, 105 aa, Homo sapiens
VLIPTSRFLLPTSHDSSNISSPIHHLMSPSNISSAPSNISSPLPTSHHSIPTSTSTTTISCLHSTLSLPPLQHLMDNIPTSHQTFQHLIHTYHHLMPHTKHIIEP

SEQ ID NO: 953014 - protein, 148 aa, Homo sapiens
GSSSSLRSNVSSPFQDLMARANISFLLPTSHDFFQHLIAFQHLMSPSNISSLLPTSHPPFQHLITPSNISSPSHISCLHPTSHCPLPPSHGTFQNLITPSNISSLLPTSHAPSNISLHLPTSHDSIPTSHSSNQKLITPSNIIIAPSK

SEQ ID NO: 953015 - protein, 58 aa, Homo sapiens
EHLEDVEEYVGTEEVSLERAEYSVVNEKKGYSLCRVMLPKKYASAVPSKHNGMRGRPG

SEQ ID NO: 953016 - protein, 193 aa, Homo sapiens
WTVCMHLATSHASFQASHRSFQTSHCPFQRLIRSFQHLIAPSNISCGPSNISWRVQHRMAPSNIAERPSNFSSRPSNFSSLPPTSHRASQHLMPPSNFSCPVPTSHGAFQHLIAPSNISSRLPTSHPSFQHLIAPSNISSLLPTSHHSFQHLITPSNISWLLPTSHGSFQHLMAPSNISSLLPTSHPTFQHLI

SEQ ID NO: 953017 - protein, 151 aa, Homo sapiens
ASETQSEQSNFAVDSPEALEFWMKLKIIYVTAPDKRRRELVAAEGEYEMTCILGDGETEAWRGYINVLRLDSPVVSGLCGGGGRGPPALPSNTMGHCSQSPLTTSCCSSNPSSRAASFGTPLHPPPNSLNIFFIHTRIMHHALRTVNMSVH

SEQ ID NO: 953018 - protein, 102 aa, Homo sapiens
ENVTAKLQATEGHSPRPAEAHLLPGTAAGTTGRTIFLNYQHSTTRTSTPAPWVLTSDDGGPRRLFVTTPDPARPLTPGHVDAPLPPTRHNCERGLLYDVDPA

SEQ ID NO: 953019 - protein, 131 aa, Homo sapiens
PSHPINIQHLMDPSNLSSLLPTSHRTIPTSHSAFHIIIAQSNISSPLPTSHRSFHHLIPPSNISLLLPTSHSSFQHLHLSFHNISCQLPTSHAPSKHLIAPSNIILAHITLLQLYFSLRPADVGKGSAACL

SEQ ID NO: 953020 - protein, 55 aa, Homo sapiens
HTNPNISCQVGVSKGTCSMLARRMQHVGTAQHMQHVGKARMQPCMRQGVHAAELG

SEQ ID NO: 953021 - protein, 69 aa, Homo sapiens
RRYQDSEQSKQQAQMVSGGGVKRQGDEKDEHGRSFTIEFREEAYHSRSKSSNCLLEEEATDEEEDQNSL

SEQ ID NO: 953022 - protein, 47 aa, Homo sapiens
MSYYTLEASYTSDRTQISLGLKPKHRSLKLLRSPMCGKVENYWPRDS

SEQ ID NO: 953023 - protein, 165 aa, Homo sapiens
GKALLHVGATIWRSLSVLPALGYSRHMGFGELKSPAGLMVLKINLADKSYIEGYVPSQADVAVFEAVSPPAADLCHAPRWYNHIKSYEKEKASLPGVKKALGKYGPADVEDTTGSGATDSKDDDDIDLFGSDDEEESEEAKRLREERLAQYESKKAKKPALVAKS

SEQ ID NO: 953024 - protein, 53 aa, Homo sapiens
GCPEDPRQSSTIRFRETIHYYKNITERPPPGFSHLLPGPFHKHMGNYGELTKN

SEQ ID NO: 953025 - protein, 33 aa, Homo sapiens
VNGLRWMARKLCRLGGEEPLLLDDEGFQLSVWS

SEQ ID NO: 953026 - protein, 70 aa, Homo sapiens
RSVSRAQTSSICPVITAGSALNAVLPAFILQIHAGRRHPTDTRGLLLTLDLVSTKVMHCKNVNVLGNTPT

SEQ ID NO: 953027 - protein, 40 aa, Homo sapiens
CSRGSPGKALHCYSVGKIECVSAETTEDCIAKIIELEKLM

SEQ ID NO: 953028 - protein, 48 aa, Homo sapiens
STREDKMLWLHCDLRYKQTTVVGNGRAPGQSHVQLSNGIDLNLLSVKR

SEQ ID NO: 953029 - protein, 36 aa, Homo sapiens
YSKIPASLPIDQVLLSCAGSEWSAHGNAVHLMMMSA

SEQ ID NO: 953030 - protein, 39 aa, Homo sapiens
NCATVRKIFSECYSGVLNPYARVLVGALKTTVLQSTGYC

SEQ ID NO: 953031 - protein, 50 aa, Homo sapiens
MVRATSHSPHHDFRQIGSSHSCFNAQPPIIKAVYTSCATKLVKIALAHTF

SEQ ID NO: 953032 - protein, 38 aa, Homo sapiens
SVEHYNWTWSHHEVKSDLETRERSEGWIGVIARSFRNG

SEQ ID NO: 953033 - protein, 33 aa, Homo sapiens
MLVCLRLLLLSIYGVLTRVTPRKAIDIIAQTIP

SEQ ID NO: 953034 - protein, 39 aa, Homo sapiens
VILSMIIALIVTARSNNKTKHIAEENLIDAAFQNLKLRS

SEQ ID NO: 953035 - protein, 35 aa, Homo sapiens
CRGIGSQHEEVDAAVQRSNLLTTTGEFPITIEYTR

SEQ ID NO: 953036 - protein, 52 aa, Homo sapiens
APCCYIIGGSVLPTQGRMWRSALQHLVCVVLSVGKLFIFHHGLQVVAAVQGT

SEQ ID NO: 953037 - protein, 94 aa, Homo sapiens
LLSHVDILYKPTKHMGNTHTYYTAHELESWAQLYAILIRAELGQPGNLLGNDHIYKVLVTAHAFVINFFIVLPIIIGGLGQLTSTPNNRRPRYG

SEQ ID NO: 953038 - protein, 46 aa, Homo sapiens
TLRSGYLLPDTEAYGDRIERLLRLSLNIDPDAEVEEEPEKNEETRK

SEQ ID NO: 953039 - protein, 47 aa, Homo sapiens
SVTDEEVDELYREAPMTKRGISITSMFTLHPETVEPTDKDDVKELIA

SEQ ID NO: 953040 - protein, 45 aa, Homo sapiens
TCTGMSLEGTLTVPGTGAGGTLTVPGTLSWGDTHHAGHRELGVTS

SEQ ID NO: 953041 - protein, 53 aa, Homo sapiens
DSIGSQSNLHGASSECPPAPGAVVSAPQLPGAVTVSVPPAPGARHGECPPSSR

SEQ ID NO: 953042 - protein, 47 aa, Homo sapiens
VLTCTVGVGVGVTVVVVVMGVRFVLCVPVGVGVGVTVGVVMMGVVVG

SEQ ID NO: 953043 - protein, 46 aa, Homo sapiens
HTTLVSTPALVVPHRAPGVRHLHRWVLGLGSPVVVVLMGVDSGVCV

SEQ ID NO: 953044 - protein, 55 aa, Homo sapiens
KCSTVVMLLCPPGKDLNAPDLYIPRMAFITYVLLAVDGTQAQHLGGEPLLNAGYR

SEQ ID NO: 953045 - protein, 40 aa, Homo sapiens
AVTVSVPQLPVPGAVSVPPAPGARGECPPAPGARGECPPS

SEQ ID NO: 953046 - protein, 47 aa, Homo sapiens
MQITEISLRRRFCETTATRIAVVSPAMEPPSSSDLCMRKATASPGNT

SEQ ID NO: 953047 - protein, 67 aa, Homo sapiens
PSGMLRHIVHEGRRTRSLRPTWLFQAARTRSERAFDTEIAELVKAGNAEVHWVRTLSQPGTAKAGRD

SEQ ID NO: 953048 - protein, 44 aa, Homo sapiens
AGGVVLKYIARAKARGLGVIFITHNVHHAYPVADRFTILKRGTS

SEQ ID NO: 953049 - protein, 70 aa, Homo sapiens
PVRFRSTFRDWAGDFTDFPRELIEAALAHTIGNAVERAYRRSDAFAKRQTLMQAWAGFCLKTAAPLKPAA

SEQ ID NO: 953050 - protein, 87 aa, Homo sapiens
FASCSVTRRVIPIVRSPLARRPSVQRRLGSGQNPEASDAFWAACCDLSTSGDTFSLRPAGSSSFFAAEAGAETAPPVSARTSAINCG

SEQ ID NO: 953051 - protein, 106 aa, Homo sapiens
MPHSLRHGAQSGVGQVDLIAVLFGVLDEARHAVGGQVLAAQQRHGHVRHLADIRKVLSGLNDSLRYSAGAVAMPLWWIKEGIAVRRRARNVLDANVPPAPVRFPMG

SEQ ID NO: 953052 - protein, 40 aa, Homo sapiens
GDLEDPPAQQMIHQGNRIHILLIAILFNNILSGRSEPYTN

SEQ ID NO: 953053 - protein, 68 aa, Homo sapiens
MQRMSEGVPSVTSGTQTWNGAIPSLIAIAIMIITREVLIGNIGYGSLSGEYIVEEYSYYKDYRCGCSR

SEQ ID NO: 953054 - protein, 45 aa, Homo sapiens
MGDETPEEVVFSLKASRYATNCRDIGLAAKDSIQRFVNSEIAELG

SEQ ID NO: 953055 - protein, 34 aa, Homo sapiens
AAITLIPERYPMHPSDIWPASSHMTKKRRRYLMH

SEQ ID NO: 953056 - protein, 64 aa, Homo sapiens
AARSSTPPAMAGFRSTPSDVRKVMLEVAPVSELPLTDAKVRAAALIMLVCARGNMNWVRVQARA

SEQ ID NO: 953057 - protein, 45 aa, Homo sapiens
MRDRRRRRGVVFSLKASRYATNRRELAGAKDSIQRFVNSGIAELG

SEQ ID NO: 953058 - protein, 107 aa, Homo sapiens
KWVTPSTIPHGQSLTLAPRKHRHSAGQPRLHAAAVLMGDRPQVAMHNSLVTGSCDSSQGVYSPAPRPVKTALPRGGNLGALTRSLENAGRTASLSARAGAKLPGYDE

SEQ ID NO: 953059 - protein, 40 aa, Homo sapiens
MVEEHGNKVVRALVPLSEMFGYVGDLRSKTSGQASYSMEF

SEQ ID NO: 953060 - protein, 37 aa, Homo sapiens
QRRAVVRVWQANIGKTIIAHVPITNGEVQETGDFELD

SEQ ID NO: 953061 - protein, 33 aa, Homo sapiens
KHLREARCPAGDLVCFDFEASAFLHHMVRNLVG

SEQ ID NO: 953062 - protein, 35 aa, Homo sapiens
VYPADATGLHHPRLSTPMPRRRLSGCPRCVVHAGI

SEQ ID NO: 953063 - protein, 55 aa, Homo sapiens
VCGSRQVALGVTATAADRAELLVGIQRIGRCGLAARDHGLAVVIQHGGFRRFAGT

SEQ ID NO: 953064 - protein, 43 aa, Homo sapiens
PADVLLGRLGSWSIVRQQYVLHSRHQLISTGIHGMRVALQCTS

SEQ ID NO: 953065 - protein, 37 aa, Homo sapiens
TVIPGACAVGGTISITWKGPTGRFELALVQLPRVAQE

SEQ ID NO: 953066 - protein, 58 aa, Homo sapiens
TLAGIPWVHVACGLVFDQSPLRCKQFGIWLRYDSRERHPQHVPGNTVDLTTAWRCHPV

SEQ ID NO: 953067 - protein, 42 aa, Homo sapiens
VECLTAWRLALAGRDLLHLHDLNGVGSGAVPGTPVSVHMGNS

SEQ ID NO: 953068 - protein, 73 aa, Homo sapiens
PELTLNPLRWQTDTTQKLLTVMENLELVDELVFKIIISSTEAWTNNALSEGSATTLEDNNGKKPCKETWLSAV

SEQ ID NO: 953069 - protein, 115 aa, Homo sapiens
PVRASFFVLDSFLLSFLQVGAALLNPILGLGMCSPCISAPQGAPRVAHLLPWLSLPCLEGACVMMQPETRLGELFPPPYVVYNRELGVMPFRSLTSLNTTFSQSVVPGSDCISII

SEQ ID NO: 953070 - protein, 61 aa, Homo sapiens
AVSGDLSFPSDVLCTQPLPPAYFFMAISEPLLRAMFLWKLRAAGEPGSISPIQTYSALNFL

SEQ ID NO: 953071 - protein, 88 aa, Homo sapiens
REIPWVLGDCASIYTRGQRSSPAQDRHAWAQGESSTAVQCATVFTTVKGAVLIQSCLFEESCVSTNRRALVLWLGSARGKQPRVLPVV

SEQ ID NO: 953072 - protein, 49 aa, Homo sapiens
ACSKALVRSVYCSWTCNSRVRPTCGIVGERPNIDTIYVIWVHLRKVCSS

SEQ ID NO: 953073 - protein, 86 aa, Homo sapiens
MEHSSLLCHVHIINTFPLWLVSSAANGPQNVSSFSHTQHPLCMTSHFLEFYKKSWSCCHEYLFEADYNYFFHPGGPLRVTEARYFD

SEQ ID NO: 953074 - protein, 61 aa, Homo sapiens
PVSGEMADTLTSEVDHKKRKIREEIEHFGIKIINSQTVTLMRDEDFKLQDQALKESIPFAV

SEQ ID NO: 953075 - protein, 33 aa, Homo sapiens
TAELQDDVGRSVHELERACRVAEQAANDLRAQV

SEQ ID NO: 953076 - protein, 82 aa, Homo sapiens
MQGGRATTYCAGRSVLILLSDTGLGKEVCFAVQKDTSPITIHHLKLNPWIPPCTVGGHIPPIPYSFLITLHGRQPNATSLYY

SEQ ID NO: 953077 - protein, 77 aa, Homo sapiens
GPDFVEARLTRADSFTLETLDIRPEGFSPSSRYSFRHSLFLKIHCSLQYSFFSLRMLLYQSSFDDSTASVVCFSPAT

SEQ ID NO: 953078 - protein, 105 aa, Homo sapiens
CRVTVYSTDEDKFQLILTIVGTIAGVVILSMIIALIVTARSNYITKHIEEKNLIDEDIQNLKLRSHRLHQSMEHNGASSLRSGLRPPRDRLDANIPIPDDSRHCT

SEQ ID NO: 953079 - protein, 56 aa, Homo sapiens
PYGNRGAQPLEAAGLPLMLGLQANRYELRQPQRRTYSAALLHQSQPGPEKGLSCGR

SEQ ID NO: 953080 - protein, 89 aa, Homo sapiens
CSCVLHVLSRTCRLACVAAGQLAARGVQVPGGSWLGGTYLAVTFCPLSLQVTLSDSWGKKPWSRHATTTFPSWGVLSRLSGKTLGLVGY

SEQ ID NO: 953081 - protein, 118 aa, Homo sapiens
PVTTLTVTLWLLRVSSVYGLCRAMEPWEDLYLQCCLPLSPRPLITATLSKSGNTFRPEVHLLPPPSEELALNELVTLTCLARGFSPKDMLVRWLQGSQELPREKSLTRASRMQVWEVP

SEQ ID NO: 953082 - protein, 78 aa, Homo sapiens
FGASDGPGAWGALFLNDYLLCLGVAMGCSFQQPTWGPLLRPPPHIHLLPCFALLGAPSYGCFTHWRMYRLVCPHIPGI

SEQ ID NO: 953083 - protein, 58 aa, Homo sapiens
DPPCYVARTDALQVRFQRDDARNPFARVGDLERRQLSALLGVDTYGYVEAAQANGAVF

SEQ ID NO: 953084 - protein, 37 aa, Homo sapiens
GLRASGDRPSWKWSMHTAEARLAVETALAPSASTELD

SEQ ID NO: 953085 - protein, 38 aa, Homo sapiens
TLEAPPQYARGARICLCRNDGHYVRLHLYSSLLYTERA

SEQ ID NO: 953086 - protein, 53 aa, Homo sapiens
MSGPRAEPQEVVVDRPGGARRGHGEACADQLRPSLHSSSLNSTYPISLTVTTT

SEQ ID NO: 953087 - protein, 57 aa, Homo sapiens
GSCRSVWMLGGGDKVTDQQDPKAEEFFLVQNKMKSLPCLTSIPHSTLAPFRGTDARN

SEQ ID NO: 953088 - protein, 46 aa, Homo sapiens
MRVPHEECVPAGVSLHSRAPNPSGSADFSTGMLSPVREHTDTNAPR

SEQ ID NO: 953089 - protein, 57 aa, Homo sapiens
MDPIGQGCSSSWIVPGASGHKLALDIEIHAYRKLLEVEEEKSLGEKSERCKIRVLWE

SEQ ID NO: 953090 - protein, 46 aa, Homo sapiens
LMQLEKKLHSLQPHSFIRSLPHHWSINLQGCLVTSDSCAGTHLFVF

SEQ ID NO: 953091 - protein, 36 aa, Homo sapiens
VRPQVSSPQRLVPSDRGPERGVSSPCRATDTFVGNT

SEQ ID NO: 953092 - protein, 100 aa, Homo sapiens
RSPGRRALEQFATVVEALLINLNKGFVNEPFLLQRLAYWAIDLYAMVVVLSRASRSLSVGLPHWPRIEKMLCDTLCIEAASRIPQGMAALQSDPWQPELY

SEQ ID NO: 953093 - protein, 34 aa, Homo sapiens
HTRYWCHGGGEVVGEWTITPYALPPEIESDPVSL

SEQ ID NO: 953094 - protein, 61 aa, Homo sapiens
MGYTRVYHKCSDDILLAFTLLLLPGLFYYRHGDVVCCCKVFTSSFPGLFISLSGYILTYAF

SEQ ID NO: 953095 - protein, 35 aa, Homo sapiens
MSAGSCCERIITIIVVYISCLPCLSAIYLGLKSGV

SEQ ID NO: 953096 - protein, 129 aa, Homo sapiens
GSFRIISFTYTKFTTVFIPLPRLPLLTVAVFSLSSRAAVSRGSVRCNTLLNTDAAGAHPPGRLSQQAWVQPRHLHFRQAPRWRLGPLVQEPHLENDGFLSIAISALLCRWLLFEMNWFGSDTVSVLFAS

SEQ ID NO: 953097 - protein, 34 aa, Homo sapiens
SEVPDGYRICPYVQPSTPASSLSSLRSHTGDAPF

SEQ ID NO: 953098 - protein, 120 aa, Homo sapiens
MLHDTRILGTLISDPKSLSYLDFSRILNFLSFRNIVAQPLPWAPLKGSEFWSSGLLPCFPAPLGRTYRAAFDFLLGFPARASPCMPCASLRASILDYISETSGSAWRRGPTDLSLLRSAF

SEQ ID NO: 953099 - protein, 210 aa, Homo sapiens
RVVEQLIKLPQRFVLFCDDLSFEAGESDYRVLKSVLDGSLEQAPENVLLYATSNRRHLVPENQSDNENWKTIDGELHPNEAVEDKIALSDRFGLWLSFYPFNQEHFLDVVEHWIGELASKAGLQWQRDEELDILAVRWATGRGNRNGRCAYQFARYWVGLKLLELSTMIDLQQSGVGLNGYAMLHAQLESLLADERDFIANAAQLSAFLF

SEQ ID NO: 953100 - protein, 49 aa, Homo sapiens
THPRIARDFQDIQDDCHSLRLVTSRGFWVSTFVACCVLSCDIQLRVTGP

SEQ ID NO: 953101 - protein, 50 aa, Homo sapiens
MSRYNDFPIQRIIIFTLTFQAITAIFLLRRLGYSPCLGLTFRVCILVLWL

SEQ ID NO: 953102 - protein, 69 aa, Homo sapiens
VVVSVERLDLTACGCGFSNEAKVVERAGASVVPVEPELLGKVVDSSPRSAVVSVAGNPVWVEARAAGEG

SEQ ID NO: 953103 - protein, 53 aa, Homo sapiens
DLRAEVVYAPLRLIGNMQVQEYVSFEFGQLCAGGQFSLYGFVESRRGDSCCDV

SEQ ID NO: 953104 - protein, 42 aa, Homo sapiens
RLTGPQVFLVILRVEGRRLTSSEDFYHSKRRLIFSQEEALIR

SEQ ID NO: 953105 - protein, 177 aa, Homo sapiens
QSGFSIPPTWKDGRMNSNVIPSLRMSGRSPRCPGILEQTLSRLPFQLYFQALQQMLSLYKPTSNTRPSAENKAQAPQCFSHVAPLPCWDFPHQGGVCSPGAHSPGICFPLSFQAGVEVINVLSAPSHGVPWRPTWGHKDQAGAFYLRSLKSEDVKVKNRVWGNFQQWETQVTKDLTV

SEQ ID NO: 953106 - protein, 81 aa, Homo sapiens
IPARRPVIVAAASRSFLQATVEVPCDLMKSRTSGKGFGRQHHVWFLCRLWSPSPLGSRQVVLVACAQRVATEGTGTLLEAD

SEQ ID NO: 953107 - protein, 92 aa, Homo sapiens
MPSCTSDGTLSIHEDKFITSLLTMAFAPIPQRLVAVMCYEMGSSKQVGMTQGPGDQDRPPLSITFLALSSAKLPTGLLPESHRVCPNSLRPL

SEQ ID NO: 953108 - protein, 67 aa, Homo sapiens
SSVTRPGVVLHACSPRCPRGCGRQLTCASDFAVTVSYDHTTALQPGRQQDPVSKKITFVLTEIIKLF

SEQ ID NO: 953109 - protein, 146 aa, Homo sapiens
GIDTNASHATHRYKRRATSKGLTKIIMLLREQDKGQKQTYWEVSSKDHKAKDKSRTTDKGLMYIHACIVLINILNNRKQGSRAENQSDHRYIRAEVFSTLVSLWVLQETRVYLSPYLNRVRQTFPEQPFIDLPPGIHSFPRVLLLI

SEQ ID NO: 953110 - protein, 68 aa, Homo sapiens
RRQCIVFSVISRLPEVYCPSVCPLSMVFWLSIVTLDGADSGDVSHDPGPCVRVVLTREFRLCSLGLTE

SEQ ID NO: 953111 - protein, 68 aa, Homo sapiens
LLETKANFSLPEKCDYMIGDYYGELEKEAAQSIVTKYKEEVRKLLPPSDKRTYRRNNRVPRPSGRATE

SEQ ID NO: 953112 - protein, 48 aa, Homo sapiens
MVGWRSDHGLGCLQCSPFQISLCVLRGDSGAATMVRLVWQALGRSRYW

SEQ ID NO: 953113 - protein, 39 aa, Homo sapiens
RLRVSRAAYGTVPQTLGQHAGAAHSMLGLQATRYAAEAA

SEQ ID NO: 953114 - protein, 83 aa, Homo sapiens
MAGVFHDRLASSVTQILHSSRDLRTFTDHVYVQLKFTALGGLILTSSDFGMCRHSDEGEFSACGEVKNLISQSLRRRDVYPEP

SEQ ID NO: 953115 - protein, 40 aa, Homo sapiens
SLASRTNRSRSLAAKLARYIADGGPVGGRPIALQEAHRGV

SEQ ID NO: 953116 - protein, 48 aa, Homo sapiens
MYSCAVNSTVLSGSLVLMNRRVSYVKFALQILMDLIVIKAKDTCIQNR

SEQ ID NO: 953117 - protein, 67 aa, Homo sapiens
MGSEVFQDSRILVEDGSIERAGERGGPLRAGLAEELCFIPQREGAREGSEAGSGWMKVVLLGHSLVI

SEQ ID NO: 953118 - protein, 49 aa, Homo sapiens
TGVFRYPELAWVLRCGLPDRFVPRRERTAVSQAQDACGPLILIPLRPGL

SEQ ID NO: 953119 - protein, 111 aa, Homo sapiens
DTGPTDVDTHHSDTTHHALNTSHILHTCKSHHRHHIRTTPHTTHTTHHMPHITCHTHQTHTQYTTHLTHIKQTPHTPYHTHITHTTHAPYASTHRDTYTSHTLTHTHPTCH

SEQ ID NO: 953120 - protein, 80 aa, Homo sapiens
CEPEDSAVHAYNSPVLTVVCQVSGRVWGDERRTDPSVQLSCVVLAGAAHVLESEKKGAVASDALVWHIQNAWVTTEQQER

SEQ ID NO: 953121 - protein, 94 aa, Homo sapiens
CPLRIMSLCMLLAGPTVPGQPGLYRPVLAFGLQKGKQLMDHAARAQKMCSGLCPRRPFWAFNPLRPKLLVLSAGLTLEPAGGSPVASAAWRFAN

SEQ ID NO: 953122 - protein, 70 aa, Homo sapiens
MPLQHTCVTVPAWCGMKRRPILTIITLEDSSGNLLGRNSLEVLCKCLVLGETGAPEEENLRKKGEPQREL

SEQ ID NO: 953123 - protein, 107 aa, Homo sapiens
RIRECRQRRDSSTQRRPGTEQAGDNGTSLSPQARERPWDTSKRLLCLDDFYGLCFTTVFVLGNHAWSAFSGPEIRADLQWSTVGSRSGLKAHLKPPPFSSTGYRSSN

SEQ ID NO: 953124 - protein, 32 aa, Homo sapiens
MVVELVKFIHPYFSWTNTVGQSLVAGLGSVLG

SEQ ID NO: 953125 - protein, 101 aa, Homo sapiens
WHADTPSPPSRSTETPLLSGHSACAVWRPEDPHLVNFVFLVETGFHHFGQAGLKLLTSGDPLTSPSLGLGRELLRPATISKFLTNFLVWSLGVCSVVVRRV

SEQ ID NO: 953126 - protein, 33 aa, Homo sapiens
RQTSRLICQMPENDNLVKELYGKLDEDIQKERV

SEQ ID NO: 953127 - protein, 47 aa, Homo sapiens
PPIAFQSELCWVLALAFAAFRRPEGSELLSLDPVLPFPCPLFSVAEP

SEQ ID NO: 953128 - protein, 43 aa, Homo sapiens
MITEEPSSKMDNAKSRVYFACKDKLLKVSTRPYPGYRGSTFSN

SEQ ID NO: 953129 - protein, 96 aa, Homo sapiens
ALLKQITLGLCLWSCLEEGTILQTPEWKIHKQLAPLHLEKLQTLNSNAMKASGRGAVSCKATGLELLKAVGAYLLHQHDLDVRHGVKRKLFQSFKT

SEQ ID NO: 953130 - protein, 67 aa, Homo sapiens
MAQYIMSSTRNTSQEEVNINRKKRISDTTRHCSPRTLIPRPPATPSRPLALSSLSQTRYLGESIVVP

SEQ ID NO: 953131 - protein, 51 aa, Homo sapiens
AETISAILELVIGVEARLAGVEPGAAIAVPRWATLLVNAADSPCYRSSKFC

SEQ ID NO: 953132 - protein, 39 aa, Homo sapiens
DRVVGAEKSRCSVSYVMYYELSYGLRHLRCITQAETRQK

SEQ ID NO: 953133 - protein, 42 aa, Homo sapiens
GQQGPALLINLVDIHFVMGRLHGPWRIAHVLEHLGLGARRVH

SEQ ID NO: 953134 - protein, 35 aa, Homo sapiens
MAYVHTAEKFKEASSLSDRTGDGKILYSQCGHSAC

SEQ ID NO: 953135 - protein, 82 aa, Homo sapiens
HSMDPVRSPYSLSLASQIDQDGSSMAVLLVWVCLRLHWLQKVTLATLIVLIHRPHAHGMTYGPRPCRDTRIFAYTFLIDPGR

SEQ ID NO: 953136 - protein, 137 aa, Homo sapiens
SYLYDAVEGNIKEGRTINLSNALIVIIHLYDLPFDSRKSVMLVRAREGICILVTLTRPWESSPSIHLINEVLQQILKRSKRFVFTLSAVIIGLIIVTALATTAGMALHQSIRTAHLVNDWQANSTQMWNTQQGIDQK

SEQ ID NO: 953137 - protein, 58 aa, Homo sapiens
PLVSTGIQRLEHGKNYETCLEVQACYDLQVCLQIAFYLGAEEVIVEVIIEEIVWFYGV

SEQ ID NO: 953138 - protein, 36 aa, Homo sapiens
MSNLDHATSQMKAFLVRLGKVAHAYNPSHFSVAEGG

SEQ ID NO: 953139 - protein, 48 aa, Homo sapiens
DKLCKYVHGTAFASAQEGTKEGEAVTPWRSTGLGYFRSSLVVGYRRCA

SEQ ID NO: 953140 - protein, 43 aa, Homo sapiens
YLPLLKEPTSYHSSPGSLATTHFTDSSTAQASVEASTRFHSSP

SEQ ID NO: 953141 - protein, 32 aa, Homo sapiens
TLSRIPPISFRDLNIYDADCIIAFNSTARFKK

SEQ ID NO: 953142 - protein, 91 aa, Homo sapiens
MYKVIAEEDTCLPQCDSFCRVYLENMTPVRLMAARPIPATLGAINNVTELVTAGESIAQSMQKVLADTHWPGLYKHLLSYQLDRPEDDFAE

SEQ ID NO: 953143 - protein, 48 aa, Homo sapiens
TSLSSALSSCSHTTPACGALDPSFLPGTGAYDRHGFVMSGLFVRVHGS

SEQ ID NO: 953144 - protein, 41 aa, Homo sapiens
TFSLSHVVHGPPSMALAAIAPCSCSTSVWGARRCARLPQLA

SEQ ID NO: 953145 - protein, 67 aa, Homo sapiens
PWEGGEDAAPVAPSVPAYGDPELPTPGEVSESAQEPGARDVEAQLRRLREERTCKVCQDRAVSIVFV

SEQ ID NO: 953146 - protein, 73 aa, Homo sapiens
VALWCPGESALCSVPPGGGLVRMPYDLRALVPPRLGALPGGSLDHTVLFYGLTCFREQGASFLLGNWLSPTRG

SEQ ID NO: 953147 - protein, 63 aa, Homo sapiens
TSSPPFHIHIFIISHFTISTSQAIIIIIASTPPSSSLTHASAQAHQSLIACSIHQPHSHTAPT

SEQ ID NO: 953148 - protein, 73 aa, Homo sapiens
MRYSIERVRHWHGLLTENPSKLKPLLSLPSTLYQIKRSPVKGKNLFPFYEKGRNSKAPSGNSKGPSGNSKDPS

SEQ ID NO: 953149 - protein, 44 aa, Homo sapiens
MKSLCCYVVSITILKPPAAQYRVKKKYTKAKATFIQRSILVDAL

SEQ ID NO: 953150 - protein, 63 aa, Homo sapiens
RVSSRPMHGQGRSAHDLIHISVLCHEISTQATEPAINVQITQHPEGCTAISTLCWPITTIIRQ

SEQ ID NO: 953151 - protein, 140 aa, Homo sapiens
LGLSSCWRLRRAPSRQLIIVCIVETGYPMWDRRVLNLTGPRELPTLDSQKRWGYRREQPCPGSAYSQLPSGMLSWDPSENMKCHCSAVCLPVSPSLLSVHHHTFSSLSLVQFLAHHLSIYETAYKSLCLELKLASRKPQA

SEQ ID NO: 953152 - protein, 106 aa, Homo sapiens
MGPTQCNIERQVQHTWAHYSAPQSTACADAKHWLRWANGIIVLGRTHDLDGWPNENLVCMANAHYHCKTGLLPQAIPIQGRKTIIKDGIGNACDDHDDNNKIPDDR

SEQ ID NO: 953153 - protein, 63 aa, Homo sapiens
MSIDSLPICQAMSDILLVGTVRKLEDEISELHVTGQGMAVSPTLRVQGSIRPNALLLINYSLL

SEQ ID NO: 953154 - protein, 41 aa, Homo sapiens
MCYVQEVAAMQCAGVFIPYPPNFHRVQRISTIDPAKTASSS

SEQ ID NO: 953155 - protein, 54 aa, Homo sapiens
IELGTFPNHITYSPEHLITIYTPSKQVFNQYTTTNQRPVSHTKPPVPIGILPNQ

SEQ ID NO: 953156 - protein, 34 aa, Homo sapiens
ASDGVDAAKVQVVYSSITIIYTPGTNADVLQTPA

SEQ ID NO: 953157 - protein, 53 aa, Homo sapiens
MRDHADAYTPGQYFYPRGVGSEKLERIARLENKVKTLKRGERGAVRIPPASSG

SEQ ID NO: 953158 - protein, 84 aa, Homo sapiens
TFIYHNLVFLCRRCGSHTGAIIGLMVGGVVHTARARHQQVMLKRKQYTSIIMMMVEVDADVTPAARHLSNAADQNGYENGIFIE

SEQ ID NO: 953159 - protein, 47 aa, Homo sapiens
VLKVVGRSNLYGRNPVPLQLAIGAEDKFTGVIDLVKMKAINWNEEDA

SEQ ID NO: 953160 - protein, 72 aa, Homo sapiens
SIPAQNIIFISSSKPHLSPPMLSSTRIEGNQPERLNAGTYFLFYTLVGSLPLLIALIYTHNTLGSLNILLLT

SEQ ID NO: 953161 - protein, 44 aa, Homo sapiens
DTSDKASLISSRYCFDPVHSKAWSIVFSMSLQFASVSNPFAHQF

SEQ ID NO: 953162 - protein, 72 aa, Homo sapiens
RKLPCAMQAHQLPAIQADQPHRARVLVASRRPYRHGTAQEVLACIADIVGFLAHRPEEDRAETPARRSSPGN

SEQ ID NO: 953163 - protein, 134 aa, Homo sapiens
VREWCGAANKVVDCAITWFAVGLFGQVVRSLDHLVALPINWNQQIHAVNQKAWDKARYERAHPWGFWVSRVPLYCNFNCSVIGSYLGEGLVKTGYGQGETLASSTPAHKSQIVEPCYLVFHNSRGIPELSRHNF

SEQ ID NO: 953164 - protein, 35 aa, Homo sapiens
ERRKNLYFVSVSLSVHNTFSMRPELFEINALAASR

SEQ ID NO: 953165 - protein, 44 aa, Homo sapiens
SHRVHKIAQGADMMTETTVEMKIVSAVSNTLDNKPLEHALHTAM

SEQ ID NO: 953166 - protein, 56 aa, Homo sapiens
LDVLCRQVGQHPLVLLAAQDEAVDVDRLGQLVDRAAIVSLLSSQLPRRPPARVLAE

SEQ ID NO: 953167 - protein, 41 aa, Homo sapiens
AHAVVPNIEYTLSPTLRNPDGRSCCRSQWTKLLQVRVDEVV

SEQ ID NO: 953168 - protein, 68 aa, Homo sapiens
QHVVTTKYNDHSLPYQIASSLYLTDDTSWLLLLHYLRHMRYTLDDQRILMVLRSKYSFHNQWGVLSWD

SEQ ID NO: 953169 - protein, 69 aa, Homo sapiens
QNFVSDLLKIRSWLDEVHTPRIRQIFMDEVVAAHAETPDHTPRSLWTKLLRNNFVHTDFHCDLSNQNAA

SEQ ID NO: 953170 - protein, 57 aa, Homo sapiens
AHRRCFCYLHVVPGLMPHCHEGPFRLHSGAALGHRFMGGGGGHPLFWFRLTTDEHTL

SEQ ID NO: 953171 - protein, 76 aa, Homo sapiens
MIIDCVLELADQEDLQPWSSVSMVVMRMLILAGLVDLHLGPQTWCCGISRRLPWFRITSRDCSVPSSVDAMSLSLS

SEQ ID NO: 953172 - protein, 34 aa, Homo sapiens
MGGRDGRSCCCTRRGPILFLTFPYEHACLEFRRV

SEQ ID NO: 953173 - protein, 54 aa, Homo sapiens
GRSTAQQDHQHQEGSIMRPPLCRMRETQFCAVRGGVELAVEPAEEALLVVVVSL

SEQ ID NO: 953174 - protein, 37 aa, Homo sapiens
AHAECHTPWCQVIVDEVVAQQLRPLRFRIVVWLLGVC

SEQ ID NO: 953175 - protein, 42 aa, Homo sapiens
HCAYPTERTANNVHVNTTGFKEIAREFADLFSATGYGLSKNA

SEQ ID NO: 953176 - protein, 62 aa, Homo sapiens
LSTRKPHAASREVLMDEVVAYPGEVMVDEVVANNLSTMICNNFVHSDLWERGGVCSLVVRRV

SEQ ID NO: 953177 - protein, 80 aa, Homo sapiens
GSPSHAEGPDTSSGQVLVGRRLLQVTVDEVVAAHAENPYHMSYVWRFGDHSGRSCCNNFVHSDLRASISRTRGVVASRRV

SEQ ID NO: 953178 - protein, 67 aa, Homo sapiens
MFALVLNAHYSPSNGSGASKRRARDRTVRVAYSAIQVLRIERFGNCAFRKAIWSASMLRLDRIRCSI

SEQ ID NO: 953179 - protein, 155 aa, Homo sapiens
AKVWMSGDIARGKLRRQLDITRPAGRSMYSRLAGSGVRQSLAAEASRICCGLRYGEAALAMVGNMAGQGEGGQGKATTVRHGKPRNMNEASILRERPGLAKPALMTKRHYSLFPNFALTVNYKRSWRAGHVRGTMSTVRKSQKDLSAGTVSLALA

SEQ ID NO: 953180 - protein, 34 aa, Homo sapiens
RCNTIHFFNVRSGMDEVVAPRVIPLVTQIRVDDS

SEQ ID NO: 953181 - protein, 53 aa, Homo sapiens
AQYLSRVCIKTTVDAMTRSVYFPKRAKREFSFAMGGWSSETGEASSYLQYWVS

SEQ ID NO: 953182 - protein, 67 aa, Homo sapiens
SLVTSVPRPGQLAHGLMTETLVGAGFSQDNGELGLLFSSGGSATSGGSSDSDSGGSKPKRRTSLPFP

SEQ ID NO: 953183 - protein, 66 aa, Homo sapiens
MLTGYVNCLFPMLGFRRVHAHAEVSTLHEVTLRSVWTKLLRNNFVHSDLQQLLSIVTFLRVWSLGV

SEQ ID NO: 953184 - protein, 67 aa, Homo sapiens
VSIQQSGLLKDAQELLWRVPDNRMPSRQPVVYIFRSVLELQAQFKQGIVVCFQPNDVGCMKRGASCH

SEQ ID NO: 953185 - protein, 34 aa, Homo sapiens
HTPNIHTVDTLRNTLYTPDIHILLKITVMSGLNA

SEQ ID NO: 953186 - protein, 82 aa, Homo sapiens
SADLHSSARSLESSATALRVRLQEFDGALKQLQRHRLFHAAALRFSELNAGCTEFVYVVHHIERYRIFKCIAFFIADVETPF

SEQ ID NO: 953187 - protein, 53 aa, Homo sapiens
MDWRGTALEWAGVVRDGGLTQSGPMAQLLAQNQSPWAEVFSITSFAVNLANPI

SEQ ID NO: 953188 - protein, 42 aa, Homo sapiens
SEYFAWGTGSNVAPTRNIQRITITVVAASPFARDGGSRSKTS

SEQ ID NO: 953189 - protein, 44 aa, Homo sapiens
DTRRVSIRGNNDIIMDKLLRNNFVHTDLTLRSVLDLRTCGSTDA

SEQ ID NO: 953190 - protein, 112 aa, Homo sapiens
RHGRSAPVVPVQQHRTEAGHQLVGDVTRARMICGRPSPAPRSRARTRRCASRPSGAPTAGSSSSAAFHRGRDATASGLQLGLCRETSSAPGRAALPVHQSRLGGGIPLRSRT

SEQ ID NO: 953191 - protein, 84 aa, Homo sapiens
IYQIPTTSSIAFATTSSIRISRTRGVWWFGVCSNNFVHPDLRKSKGFKSSIVWSFGVCMHTPNNHTAHAEHRFHMSKSGWTKLL

SEQ ID NO: 953192 - protein, 129 aa, Homo sapiens
LKRRRSDDSGRSIMWTLSDIAMLDVAQVGHIDHEYEVLRQLLVAAAYGASTDSVHHPQSPGRSCSRWQGGHLSWPQIHGVGMPYTAHLLSAGIVEVLTTEARSLHVAPEGRDEGDCVHNSQHRDYPTLI

SEQ ID NO: 953193 - protein, 70 aa, Homo sapiens
LEDPSHAEYIPVSQGSLGGRSCCATTSSTPICNNFVHYDLTLRSVWRLGVCSNNFVHNDLRRLGTRRVQG

SEQ ID NO: 953194 - protein, 69 aa, Homo sapiens
MYLQHTSSSASFWCFSFWCFLFLMITSSIGSAISSSSPFETFPLSSIFVADCLLPYYQTGTSKPTLKPV

SEQ ID NO: 953195 - protein, 42 aa, Homo sapiens
AQLNIKLHHSICVDEVVAATTSSTGILLSLGSRACAVIPELE

SEQ ID NO: 953196 - protein, 59 aa, Homo sapiens
MLSFSTENPALLTCHRYIFCMARMYDLLLILNRSQKIVQRFCITVRDRIPGVFWRRDVN

SEQ ID NO: 953197 - protein, 60 aa, Homo sapiens
HAERPYRSECRAFVCTVSVDEVVASTRLNVHNPLVTQIMWTKLLQVRIDEVVADRNGRSC

SEQ ID NO: 953198 - protein, 36 aa, Homo sapiens
MSSCMAEILQGGLISPSISGLGGFASNFPGSLPTPL

SEQ ID NO: 953199 - protein, 34 aa, Homo sapiens
MPVWAFGVAVWSFGVCSNNFVHRDMKKCVGPRRV

SEQ ID NO: 953200 - protein, 39 aa, Homo sapiens
VLVPRAGTPLVLDTSVYMRAAWGCPGWILQLRQAPMMPV

SEQ ID NO: 953201 - protein, 92 aa, Homo sapiens
MDEVVDTAENPYRRKSGWTKLLRNNFVHSDLISRSVWLFGVCSNNFSILIWCVGDKAGRVLRGRYGDSAVHAHAECPYCTRRVPTREIRVDE

SEQ ID NO: 953202 - protein, 55 aa, Homo sapiens
MSLHPDCLICSMECRERITTESDLGSAPVLRIHDLFQQNPVPDWPTNSFSKQVSQ

SEQ ID NO: 953203 - protein, 38 aa, Homo sapiens
AGPADGCATARYSPGNSFALVTPCMTLKATPCVTLEFC

SEQ ID NO: 953204 - protein, 49 aa, Homo sapiens
ECGHKINGRNNYLNSRGISGLFSGHYYDRFSFSTAAEVAFFYNCVRRFR

SEQ ID NO: 953205 - protein, 30 aa, Homo sapiens
MIPRACILRVNRKSQRRNASQYATLDAAPN

SEQ ID NO: 953206 - protein, 31 aa, Homo sapiens
MVFLTCADALTGIGLRAGLHQCGNVMLGHLS

SEQ ID NO: 953207 - protein, 36 aa, Homo sapiens
GPAGGSRGQWPISNRSPFNVCAFQPVVFPPRHLRGM

SEQ ID NO: 953208 - protein, 143 aa, Homo sapiens
AVRKLRPLRLILRSVWRSACVHTPSTIHFLKSGLYGRSAHAEYPHLRQNPFHYHIHRRKSNFLPTTLSRRGRNGRSNNFVHRDLTSCVMDPRGVAVWGLGSSATGSGHKRAATTSSMMISRSVWALGVCNTPSIHTPQVWVDE

SEQ ID NO: 953209 - protein, 46 aa, Homo sapiens
SGVSITSFRTSSLQKKHTTHQQPLPISHDLPRMKTTFVIMVSPPPN

SEQ ID NO: 953210 - protein, 53 aa, Homo sapiens
MVVHLLRYSPGEQLRIGDTVQTEGDSSVTLEFADASLLQQRKVFPGCALDQTQ

SEQ ID NO: 953211 - protein, 39 aa, Homo sapiens
SIRRGVGGRGVDTEMNQTVPVLFIISSPQNDARNDPQNA

SEQ ID NO: 953212 - protein, 70 aa, Homo sapiens
KNELATRECHTHKPHSPKCLICFSYFSTKVWSLGVCSNNFVHYDLQQLRPLLTSEQTGVTQRVQYGHSAC

SEQ ID NO: 953213 - protein, 54 aa, Homo sapiens
MKSIRVEKRRSEGEKIRKKYPDRVPVIVEKAPNSSDEETGDIKEVPGCASESHS

SEQ ID NO: 953214 - protein, 59 aa, Homo sapiens
MDEVVAHTPNVRYLSKEISVDEGNNFVHSDFTLNNAASMVQQLRPPRHDLKKCVEPRRV

SEQ ID NO: 953215 - protein, 73 aa, Homo sapiens
MAISRTRGVGRFGVCSNNFVHRDEGGDDVSPCAMYGVFGVCSNNFVHSDMTSRSIWRFGVCSMEPRRLCFGVC

SEQ ID NO: 953216 - protein, 34 aa, Homo sapiens
ECFDITENRCPGKSSGSRMGYTEGPCFTVFNNVH

SEQ ID NO: 953217 - protein, 41 aa, Homo sapiens
MTCTPSGYGIHEVPEELSGQTNIHLSKNFFLTNRAQNGGSS

SEQ ID NO: 953218 - protein, 63 aa, Homo sapiens
EEGKASSGAAPSGNQGVSKQFFPWGLRGSCQEWNLKMLQRKSVDSFELGEIRVVETESLHFGL

SEQ ID NO: 953219 - protein, 96 aa, Homo sapiens
PSDCNNFVHSDCSPLVWTLGVCMHTPNVHTEQVVMDEVVANFVHNDMQQLRPLRPAIKSLVFRRVHHWDLEVLGPSACACTRRITILLQVWVDEVV

SEQ ID NO: 953220 - protein, 73 aa, Homo sapiens
MLYQSKGTYIHTCTHSTHTNAQHTQTHSTHAHTAHTRAHSTQTHSNNAHTCTHSTHTSTQHTHKDTVHMECTH

SEQ ID NO: 953221 - protein, 44 aa, Homo sapiens
YVILHTPAHAEYPYLCHQGGLYGRSNNFVHTDLGLARSVWSGHS

SEQ ID NO: 953222 - protein, 51 aa, Homo sapiens
MAGPLHFVPLMILRSVWSLGVCSNNFVHWDMQQLRHSDLIQKQTVWVLGVC

SEQ ID NO: 953223 - protein, 56 aa, Homo sapiens
SDLTVKEFVTCETVCMYECGYSGVCSNKFSTLICKNFVHCDLPNIQTEQYGGSACA

SEQ ID NO: 953224 - protein, 47 aa, Homo sapiens
SAATSSSQDFSVLAASVVHTPKAPNTDASPIDHMDEVVADRCGRSCW

SEQ ID NO: 953225 - protein, 67 aa, Homo sapiens
LSGYSACAATTSSIAHCNNFVHQTCNNFVHSDFSAEYRYSACAVWVFGVCMHTPKIQTPQVLMDEVV

SEQ ID NO: 953226 - protein, 63 aa, Homo sapiens
DAYSGPEMHRHTASYANEELSADGFIKHGIFIFFTFSDNTMDANTSCGRSEWPHDSVWSFGVC

SEQ ID NO: 953227 - protein, 50 aa, Homo sapiens
TLSLDVGVWTTVCTRRNDQYYIIWEVVMDEVVGNNFVHHDFKKCVELRRV

SEQ ID NO: 953228 - protein, 82 aa, Homo sapiens
CLSLERCDNRGGEGKLWSRSLRLLQESLNRLFPWGFSRKLSRWNLKMLQRKSVDFFEPRDEYTMSGDWDARFTSASDVVGLT

SEQ ID NO: 953229 - protein, 68 aa, Homo sapiens
MDVVTREEGRQALEPLPQAIQESLNNSSPGAFEEVVRWHLKMLQRKSVDFFALRRITMSVDCAAVTFG

SEQ ID NO: 953230 - protein, 73 aa, Homo sapiens
ECHHFLRSLDGRSCCATLRPPGFDFKKCVVIMATTSSIQTFHSDLIVVWTLGVCNNFVHCDLIVKKCVEPRRV

SEQ ID NO: 953231 - protein, 50 aa, Homo sapiens
MLGVCMLVLGVCSNNFVHRDLTSRSVGTERVQHADITKPHELKIGVNEVV

SEQ ID NO: 953232 - protein, 72 aa, Homo sapiens
HILFSELKKSLLASLAWSGTILILSSKSPGEELFSDSWMPMRERLQSLPSLLCFHNGPAIGTVSLTILLGTV

SEQ ID NO: 953233 - protein, 38 aa, Homo sapiens
NTSSQRSDFKKCLDAGVCSNNFVHPDLTSRSVWGFGVC

SEQ ID NO: 953234 - protein, 60 aa, Homo sapiens
LQRRGSYGLLRSHVTKLCATTSSITTSNIEVVNPIVVWMLGGNNFSILTCVTKGLGPRRV

SEQ ID NO: 953235 - protein, 71 aa, Homo sapiens
GNSYTGIAIPGYRYYRSPYDRETAIICCTRYNAHTALTEKPFYPQDKVLDWKKLLLHTPISHTKRDSLEPE

SEQ ID NO: 953236 - protein, 49 aa, Homo sapiens
QTLVTQISVDEVVRNNFVHYDMKKCVVAHAEAPYMSKSGYSEIRVDEVV

SEQ ID NO: 953237 - protein, 61 aa, Homo sapiens
MVLRRYSSVGGSACAATIYRPLGPDLKKCMGSRRVHAHAEYPNFLRSDGQKLLQVTVDEVV

SEQ ID NO: 953238 - protein, 38 aa, Homo sapiens
RSCTRVEQTCEVTVDEVLRNNFVHSDLILRSVWFLGVC

SEQ ID NO: 953239 - protein, 91 aa, Homo sapiens
DSEDPQREGQTVSWRLCEVVSAVAIEEVKLGALCEVVSVVVITELELRGPCEVDLVVVMKEVKLGGLREGVSVMEIEEVKLGGLCVVPRRV

SEQ ID NO: 953240 - protein, 61 aa, Homo sapiens
SRTAHAKPNARVERSGWTKLLRNNFVHYDMISRSVWRLGVCSLDPLTRRTPKPPQVRMDEV

SEQ ID NO: 953241 - protein, 36 aa, Homo sapiens
TRILLARSIRWYDDVAGSRRITMKIFVDDVCGVPKL

SEQ ID NO: 953242 - protein, 37 aa, Homo sapiens
MDIRRSVWTKLLQVRVDEVVANFSIVTLSKCLVTRRV

SEQ ID NO: 953243 - protein, 51 aa, Homo sapiens
MDEVVAAHAEATTSSITTSRVLLGVCSNNFVHKDLTANTGYSACAIRSLGV

SEQ ID NO: 953244 - protein, 73 aa, Homo sapiens
MRGTNCTRRVTIQIEIPMDEVVAGRNGRSCCRSEWTKLLLHTPNHQTYISVWTKLLRNNFVHSDLLSLDARRV

SEQ ID NO: 953245 - protein, 43 aa, Homo sapiens
HAEAHTLLEISVDEVVANFVHWDLILRSILEARRVQYGYSACA

SEQ ID NO: 953246 - protein, 56 aa, Homo sapiens
MMFYGPSAGTTSSITIYMEERKGIIGSVWSLGVCSNNFVHMRFDNNFSPSLTSRIP

SEQ ID NO: 953247 - protein, 60 aa, Homo sapiens
MVFVDEVVARSGLRSCCCTRRWIHTFKDARKSEWTKLLLTRLNAQTPEMGILIKIDLAVH

SEQ ID NO: 953248 - protein, 122 aa, Homo sapiens
MSIHYLLVAPKWRAVTQYLLCLFIILCVGIRRVQQQLRPSRSQPLVTGLCIGVWYGYSACAVWMFGVCSNNFVHTDLILRSIWRFGVCSLEARRVQYGPSACACTRRGSRPLVTQVLMDEVV

SEQ ID NO: 953249 - protein, 88 aa, Homo sapiens
GTEAQTLSCGLATGMRSRILYAQRLLASSVWLIGNQGGRSCCATTSSTLTCVTKGVDARRVQQQLRPSRSTVGGVLGVWLVRGMDVRR

SEQ ID NO: 953250 - protein, 93 aa, Homo sapiens
RLSHCTRERHTKRNWNKPSKRNVLKLYLISALDVELVLILTLYEVNCSPWYKYNTLYIILEFNLEYVWLGHFGAKVRHVLVEDKSVVWVLGVC

SEQ ID NO: 953251 - protein, 143 aa, Homo sapiens
DCQTMRGEVNSTLGTAAYMAPEVITRAKGEGHGRAADVWCLGVCMHTPSDHTAHAEDPHPQITMQIGGNNFVHSDLQQLRPLRSATTSSILTYFKKCVVTRRVQQQLLSIMICHRGGMVWRLGVCSNNFVPPTCLNVWSFGVC

SEQ ID NO: 953252 - protein, 57 aa, Homo sapiens
MLLLEILMDEVVRNNFSIETFLRVWIFGVCSMVIRRVQHAEAPNDSSSEDSDAETDG

SEQ ID NO: 953253 - protein, 54 aa, Homo sapiens
GLAQISCRSLDRCDNRRREGNALDAASLRANPGRLYTSSSPGDFRRRVVNDGHL

SEQ ID NO: 953254 - protein, 31 aa, Homo sapiens
MRLIFSNGLVLGVCCTRRVTKPPQIAMDEVV

SEQ ID NO: 953255 - protein, 43 aa, Homo sapiens
GGPAHAYVKLNTTVWSQIPVDEVVAQQLRPKRFSDVVWALGVC

SEQ ID NO: 953256 - protein, 39 aa, Homo sapiens
DRHTDSLKSGWTKLLLHTAEGPHHTRARRGLPRRAPVHS

SEQ ID NO: 953257 - protein, 33 aa, Homo sapiens
RPRESRLTSEIIMDEVVRNNFVHGDLYGYSACA

SEQ ID NO: 953258 - protein, 81 aa, Homo sapiens
LSEGQCGMPCYAYFGLLKSVVLNGCRNMLWFMHQCELWSTVVGHIALKGCKVVGAVRSDEKVAYLQKLGFDFFLIYAEGES

SEQ ID NO: 953259 - protein, 84 aa, Homo sapiens
MDRSVLHTPSVQTIVLQSWVTEPRLRLKQNKTSRHQLAGPSTVVFTANRSQPGRILHPFSSSSATLDQPEKYNYTQEVGAFGVC

SEQ ID NO: 953260 - protein, 56 aa, Homo sapiens
MVKSHIWPCYMDSPSRTQLSYFSLQQDTTSGDSEFSEIIYVLQTNCGFVLQLSLLT

SEQ ID NO: 953261 - protein, 44 aa, Homo sapiens
CVRPAGACAHALLMPLAQVLIGLQQIQEEVQLLHHVVLFLLTLL

SEQ ID NO: 953262 - protein, 57 aa, Homo sapiens
RQFVTRIDFKKCLVTRRVQQQLRPPGAVGPSACAVWALGVLHTPSNHTAHISVDEVV

SEQ ID NO: 953263 - protein, 49 aa, Homo sapiens
MDLRATTSSIVICLEVWIFGVCSNNFVHSDLRRLGPRRVHIRREQQISI

SEQ ID NO: 953264 - protein, 56 aa, Homo sapiens
NRRCSASNGPHALPVTAVGPPGSLLYIRGSIMSISRPEDSLQERHPKVNYPEGNDN

SEQ ID NO: 953265 - protein, 79 aa, Homo sapiens
QTLVHRYGGRSCSAHAENPDFFKSQVDEVVAHCDSQQLRPPRHLTQVWSLGVCMHTPNNQTAHAESHILLERSQWTKWL

SEQ ID NO: 953266 - protein, 45 aa, Homo sapiens
MMCRREEGKEGRGRKGISGDVESVAFVLNLLGVADRKNESFFLLA

SEQ ID NO: 953267 - protein, 53 aa, Homo sapiens
LKIGDFGMLSMCSSCVCTEFPYQNLPIFTCTRRAPTLHTPRLQTEQAIIADLH

SEQ ID NO: 953268 - protein, 69 aa, Homo sapiens
MSFPVDDHTNTTEVGSSNHHTQIACIKFDNVDYLASPYLNLHSIVHLNDRIWVADGTSIMSHQVRNSLH

SEQ ID NO: 953269 - protein, 41 aa, Homo sapiens
LHRESPHCTRRSTYFNNPFIADLHVHTPRNHTEQTIIADLH

SEQ ID NO: 953270 - protein, 79 aa, Homo sapiens
LRTRMDTRRVHRESYCTRRKRNRRSSRAHAESPYHNRRSSREDRRFWSGHSRVCSMVDSDVCTGQGHGYSRVCKDLACA

SEQ ID NO: 953271 - protein, 46 aa, Homo sapiens
RRIWLGLGVCMHTRRKHTEQSIIADLHGRSAITRCSEWALAQTKIA

SEQ ID NO: 953272 - protein, 51 aa, Homo sapiens
MATLLLVKIGDFGCSVWFFGVCMQHAESPYCTRRASKLTHAEYPKQYRRSS

SEQ ID NO: 953273 - protein, 41 aa, Homo sapiens
LRILTRERQTIVADLHVSHAEPPKLHTPSNHTEHRGVADLH

SEQ ID NO: 953274 - protein, 38 aa, Homo sapiens
MRIPAHASITLHTPKDQTAHAEDPNRNRRSSRVKIGVC

SEQ ID NO: 953275 - protein, 43 aa, Homo sapiens
PVKIGDFAFVKIGDFGLDTGVCMHTLRIQTAHAEEPDHSRRSS

SEQ ID NO: 953276 - protein, 135 aa, Homo sapiens
MAIMVWFLGVCNVDREDRRFWVAQYGDSACAVWTFGVCSVDSRRVQYGLSAVCSVDFRRVHVKIGDNGLEPRRVVKIGEIALVTIGDLDSRRVEPRRVHAHAEGTKLHTQAGQILMAMVAISMDIRREYGGSACA

SEQ ID NO: 953277 - protein, 33 aa, Homo sapiens
HTRVSHCTRRKSDCTRRASHPEMGQESNIADLH

SEQ ID NO: 953278 - protein, 81 aa, Homo sapiens
MAILTREDRRYWPSLSLVPRRVQVWALGVCSLDVSACREDRRFCMGIRRVHVKIGDFGLEIRRVHAHAEYQTEQTVVADLH

SEQ ID NO: 953279 - protein, 49 aa, Homo sapiens
MAKLGRSGLDSRRVVKIGDIGLGLRQCAVWTFGVKIGDIGMLSLEPRRV

SEQ ID NO: 953280 - protein, 48 aa, Homo sapiens
VKIGDFGLSGVQYGFSAVCSLDVRRVHVKIGDFALVQIGDYGLDVRRV

SEQ ID NO: 953281 - protein, 45 aa, Homo sapiens
ECDNRRSSRVKIGDFGFRRVQSGDSALYMHTPNDQTEQTVVADLH

SEQ ID NO: 953282 - protein, 38 aa, Homo sapiens
MAWAFGVCSVVPRRVHAHADLHVHTPKNHTPFQGVTEL

SEQ ID NO: 953283 - protein, 68 aa, Homo sapiens
RKTRRRVFGVCMHTPRVHTEQSELAIFTCTRRITILHTPKIHTLLEVNAYIADLDRRYRVRGGLVARR

SEQ ID NO: 953284 - protein, 34 aa, Homo sapiens
IGDYALLSLEARRVQYGVRQCAVWMFGVCNADLH

SEQ ID NO: 953285 - protein, 57 aa, Homo sapiens
MIPKIGDYGLLSVDLRQCAVWVFGVCSLDLRRVHTPRDQTEQTIVADLHECKIADLH

SEQ ID NO: 953286 - protein, 39 aa, Homo sapiens
MYALMKTRDFWYGGSAMCMHTLSVHTAHAEASRAKSPIF

SEQ ID NO: 953287 - protein, 49 aa, Homo sapiens
LVTDSATYCPACHVWVLGVCSVDIGRVQYGHSACAVWRLGVCSMGFRRV

SEQ ID NO: 953288 - protein, 81 aa, Homo sapiens
MQVGLQRTDAYRWYRCENRGGNGKLCEPRPQVIHGASKLLFPWGIHEEVVKMEPEDATEEISGFLGARRIRVWRLGAFTSA

SEQ ID NO: 953289 - protein, 76 aa, Homo sapiens
DGPMLPVEKHAGRRAVLLTSRETAVTGNSSGSRMGYTERLLLPCFNKSTMLQCMIPNLPSTLTVKVFQNAKISQKL

SEQ ID NO: 953290 - protein, 60 aa, Homo sapiens
WLSRGSLYRGIPYCTRRDPKRNRRSSRVKIGDEWFHVWTFGVCMHTTNDHTEQTNIADLH

SEQ ID NO: 953291 - protein, 62 aa, Homo sapiens
MRSVERPYITHAHTAHTQTHSTHKRTAHTHTAHTRAHSTQTQQHTQHDIAHTRHTQLDTHAH

SEQ ID NO: 953292 - protein, 40 aa, Homo sapiens
EDPNYRKNHQEETHGHMNITKQLKHQVRPEQSVEKTRMSD

SEQ ID NO: 953293 - protein, 65 aa, Homo sapiens
MASMVVDPGVCLAYAEAPYRIRRSALRSDIADLHDRRYRFTRRTSKLHTPKDQTPRARNRRSSRG

SEQ ID NO: 953294 - protein, 73 aa, Homo sapiens
LVKDLHEKHDGHQNITKSSSMRYDRDNCGNKPYVHNLGNVYKLYPALYSSTFPEYKFNYIILLNTTDFTESIP

SEQ ID NO: 953295 - protein, 76 aa, Homo sapiens
HAYEIERDIYPHMPHSSTYQRTAHSNAQHTRKDSTHSEDTAHNRAGHAPTCTHSTHTSTQQTHQDTVHMEGTHTTR

SEQ ID NO: 953296 - protein, 65 aa, Homo sapiens
YGTYRVSFVLNRRIALMRCEREVGYLTVADGQGVQPIGASDIRSVDVVDGEWRTLIGLAGVRLAL

SEQ ID NO: 953297 - protein, 48 aa, Homo sapiens
WWCLLGEELRYSCHVQHEGLLKPLTLMMGAIFSATVPFVGIVAGLAVL

SEQ ID NO: 953298 - protein, 61 aa, Homo sapiens
CHENCAYRSTVSDQQRREGKLRWPLPQGIQESLHTLPLEDPERSCQAWNPEDSTAGYPVEF

SEQ ID NO: 953299 - protein, 40 aa, Homo sapiens
MDDVAGTVSPVICLVAVRVRAGGSAISGRGNLLPLGKHWI

SEQ ID NO: 953300 - protein, 64 aa, Homo sapiens
GPCGHLRCKCIISTEASAHLVFISFSAILLSCIDWLIKINSDKKIASHDVQKHRNGNRKRSGAP

SEQ ID NO: 953301 - protein, 69 aa, Homo sapiens
LIGGIRSNHDEIEDYYSLFLLVFEMESSSVTQLECSGTILAHSNLRLPGSSDLRLETIILSEVTQEWKS

SEQ ID NO: 953302 - protein, 96 aa, Homo sapiens
QYLSMWTHEHRDQPKERVGVRPGIAVTHAARFAYQLPKDQLAASIYALWKRELPYPSYRPHWLTCRLEDWQTGAGVEISSETAPCPDNAGTLSDIV

SEQ ID NO: 953303 - protein, 143 aa, Homo sapiens
FGGIRKVTDYSSRGSLIPIPPDWEKPPAVIDRPPHTESSNWHLVGAALGQSFQRKEQAAIFAVLQPLLVIPRQTGSGVDLQKTPTDLQQRGLIVRRKTNKQKGIVRTSTKSTSTPKPHPKVNQCQRPKLDTSTKMGRNQRKKG

SEQ ID NO: 953304 - protein, 54 aa, Homo sapiens
GIEVLPGIHGIIMFIYVLVAKSDLEEPYGAQERKEHPEAGTRAARLGEDPEIQV

SEQ ID NO: 953305 - protein, 38 aa, Homo sapiens
SARDSINRGFCEMTTIYEDEDVKKAISNDFLENLYNDR

SEQ ID NO: 953306 - protein, 47 aa, Homo sapiens
VRLAMPYKCMLLTDFILKFPHCAHQKYVLQAWQKADIDTHIQPRGYP

SEQ ID NO: 953307 - protein, 115 aa, Homo sapiens
SPNFSCTGRNLLAEIERISVIQKAPTGHLGWVPLWDKASREKEQAAIFAVLQTQLVIPRQTGSGVDLQKTPTDLQQRGLIVRRKTNKQKGIVRTSTKSTSTPKPHPKVTNVKDQR

SEQ ID NO: 953308 - protein, 99 aa, Homo sapiens
GWYSVSDRLPSSGGPMIPIPPDWEKPPAVIDRHLIQRAPTGIWMGAALGQSFQRKEQAAIFAVLQPLLVIPRQTGSGVDLQKTPTDLQQRGLIVRRKTN

SEQ ID NO: 953309 - protein, 109 aa, Homo sapiens
LGTICDEDAEEKLSRSLYSWCMAMAKADGSHAAHSFVRLWGPLCWRALSPAEGAKRLPSDGLIETRLGYFWDSSLPDYLCDLPPLEHMRPVSSSLAEVLRHKSRAWEPA

SEQ ID NO: 953310 - protein, 41 aa, Homo sapiens
NSRGPPSISWRKIIDRRTSQSPPERDLRYRRTAAEMPVHND

SEQ ID NO: 953311 - protein, 87 aa, Homo sapiens
MTGDGDGLTQDLSLWRHDSRRYNLPEVGSCGGAFWRKKLKYSCHVQHEGLPKALNLRWEPSSQSNVPIVGIVAGLAVLAVVVIGACW

SEQ ID NO: 953312 - protein, 73 aa, Homo sapiens
LVETMAAGDGDFQKWASVVVPSGQEQKYTCHVQHEGSAKALTLRWEASSQPNIPIVGIIAGLVLFGAVIAGAV

SEQ ID NO: 953313 - protein, 61 aa, Homo sapiens
GPELVETRPAGDRTFENWAAVVVPSGEEQNTHAMYSMGAAEALTLRWEPSSQSRVPILGIA

SEQ ID NO: 953314 - protein, 54 aa, Homo sapiens
TAPQTPARVRYIIAKGWSLRAGRRLSLTLGRRLETTICLRAGSCSCRRSAGVLT

SEQ ID NO: 953315 - protein, 60 aa, Homo sapiens
AKTAPSQGEGLGQTLLLHMAGVSLLLSRRHHHRRSLLEGPIPCRLGLHELRVLGLVLSIP

SEQ ID NO: 953316 - protein, 97 aa, Homo sapiens
MRRLFFSLLMLCVLPAWADSHDQLYKVAGWADQRAHFNDALSAAQQRYRNSLPPAVYQALVDNSNKRFAPQSVDQRAEAQLPKNLADPKPALAFFYI

SEQ ID NO: 953317 - protein, 89 aa, Homo sapiens
MRGCSFLCGGVLIGGTLVLRQLSREFLLKGQDTVKGRVPFNGQDPVKGQVSVKGQDKVKAQEPVKGPVSTKPGSWPIILIRCAMLNPPS

SEQ ID NO: 953318 - protein, 44 aa, Homo sapiens
SCDVRSNPEPTVYDWSTTSGTFSTSAVAHGSQLVIHAVDSLFNT

SEQ ID NO: 953319 - protein, 109 aa, Homo sapiens
ADLQVIELENYDQHDYLVLATRGGLVKKTRLDLYDTNRQAGIIAIKLREGDELVSAMAVSEGDHIFLFSHADQSLRFVADDEQLRPMGRGTSGVKGMSFRDGDYLINAA

SEQ ID NO: 953320 - protein, 37 aa, Homo sapiens
DCYIRAQTAAPRYSAGPVAPTSASRRYVVRLTRLGGV

SEQ ID NO: 953321 - protein, 42 aa, Homo sapiens
ESLTCFPNMPVRRHWVGIDRRFWVSSWALNVAPILESDKCKP

SEQ ID NO: 953322 - protein, 57 aa, Homo sapiens
VVTCRRQGRFLGPGSMPIVLLAQKAGREVLDRAVLGERVAALKLQTHGCLVGLVVEA

SEQ ID NO: 953323 - protein, 46 aa, Homo sapiens
MLGTNWVGLDRNAGAFIGGTFASHHRDFLPQLFRDERDDGVRHAQH

SEQ ID NO: 953324 - protein, 47 aa, Homo sapiens
MRALIRLSNEPLIRLSNDPHPAYPMALIRLSNGPHPAYPTALIRLSN

SEQ ID NO: 953325 - protein, 65 aa, Homo sapiens
MNDGEEIFKVYISLNRNGLLFEIIRMSSNLINLTLLKTMSLFSLLQTHFFLIPHKYCLGKFTHSH

SEQ ID NO: 953326 - protein, 99 aa, Homo sapiens
ASHWITDGEGGIVRDKVIKYILYNPLVIKQDGNKMLTSKGIRDHNKLNSGPLLGSAGRQNRDAQSISVPSVMLTPASAHGPRPSMTSVSRRHSDCDCRL

SEQ ID NO: 953327 - protein, 96 aa, Homo sapiens
TSYWDHRERPAGRVREYLKTEDAKVGEDACVIDTLTHDHVQQLPDRVHQGTSRLVKVVLLEDLAEQVGLCIPDTIHRILDLLAEGTHPGLIDDRGK

SEQ ID NO: 953328 - protein, 59 aa, Homo sapiens
DLTEEGQGRRAMKKALVDQHCLRLLFCAQVAASPLPPLCCPDSTGRAEMQDFFTPPPPL

SEQ ID NO: 953329 - protein, 43 aa, Homo sapiens
KREEEKNGFHPNFIHSLDSSHMMLTALHCYRKGLTFLLVLSSC

SEQ ID NO: 953330 - protein, 38 aa, Homo sapiens
MGAFCLSVNVLGMCVSVRRSVPVCISVPPCAVQLSTSS

SEQ ID NO: 953331 - protein, 45 aa, Homo sapiens
AEFTLVSVDSVTQCLRRHPLHGQPAVGCLLVVIEVVAVPGQPEVC

SEQ ID NO: 953332 - protein, 61 aa, Homo sapiens
LGPWAQNFFARQFLLPHEGEPVKRRFWRPKTPSKAAGLWQPGAALPCVALWGILCGSTGTE

SEQ ID NO: 953333 - protein, 78 aa, Homo sapiens
GYRSTNERHSWWNTHGQSESHAQMTVAACPVEYITALQLSSSPVTVQYAKNIPRKQRQHHPKLRAVLLVIPEAVNRPV

SEQ ID NO: 953334 - protein, 131 aa, Homo sapiens
SSSGMGCVADSHEMWLNLARDPRSYGCCLRQRPLSVEPGDIHPSVSGCRQQEMAADYTQQEKGHCHPTGCHEKEMTSLPLLLQQCQLGKWWVDVHKRVDHRACSFSSGLLGPQESLQPLAKDRLTQENKRP

SEQ ID NO: 953335 - protein, 64 aa, Homo sapiens
CWVTLRIPQTADPLLGCREGGGRFVGCSYRDGPKKCCAAVLFDLRVSWRRPALGALVPGRARLS

SEQ ID NO: 953336 - protein, 40 aa, Homo sapiens
AGSLDSRTPPPGMQAAGGVGLPSHAARTLHLTSRKAAACC

SEQ ID NO: 953337 - protein, 49 aa, Homo sapiens
VGFALNDGAAHGQHEPSAESGSRALQLAELEEGVSLKLEVAGPRGLWLR

SEQ ID NO: 953338 - protein, 109 aa, Homo sapiens
AALISLYPLDARAHELIVKLCSRPRWYFMSVATLFCEDPQLAFAIDFLTGYTALTWIAKHGDLRALQDLVSGAKKAGIVLDVNSEVQLWIIPRWHLAAIHGPPGGPAGT

SEQ ID NO: 953339 - protein, 66 aa, Homo sapiens
STRLYSPGYLQDRWVTCSARGSPTRSQMRDPVPLIFFPKHFGVWPKTCTNCGKPLAHFRETARSTG

SEQ ID NO: 953340 - protein, 43 aa, Homo sapiens
WVLRLPSEPEAVPLVSSSVRGTGGSSAIMLRTEGDWNEGLAAR

SEQ ID NO: 953341 - protein, 39 aa, Homo sapiens
RFLVFLNFLIVNNDQTKLTAVSTSAGSSSPVGSEIDKCM

SEQ ID NO: 953342 - protein, 43 aa, Homo sapiens
AVLVTIQTLFHQSNATPPNGGTNMLPICNTENDTPEWYLSSQF

SEQ ID NO: 953343 - protein, 64 aa, Homo sapiens
EHSETFRSTGIRAFTNWQPFILNYLSTPSPNAYTESLNSLIRVMNRLGRGYSFEALRAKILFTE

SEQ ID NO: 953344 - protein, 194 aa, Homo sapiens
ENDSLAGAAQRGSETAMNDEVAAFVNKGKQHEYITMPFLDLPPKIQERVVCSITAAVKYEVPANIVLAVAEQEGGKPGQWVRNTNGTHDVGPMQFNTAYLVELRQYGITPQDVAEVGAIPMIWLRGVCVVTYVMIKVTFGRGLRITIRVLRNIMLFIAPLSLSVPVSGKTGSSLAFPRLTPYKRVSRVWQLIRH

SEQ ID NO: 953345 - protein, 58 aa, Homo sapiens
TASLFLCEIVSSNGYLMDLPGGTVHTSPDTMLFPQSSQPADQEIPSGAYTTRVQAQNW

SEQ ID NO: 953346 - protein, 184 aa, Homo sapiens
HKACHSEYLRPVVSSRINREFLVAKVHEVIISQHSSNHDSNRDHRLVLRKRCELSSAQLCFMHCPPVIGWHKQPDQGTHTNRHEVARLPVRYRYQAGPSHQCGSTDSEAQSPRAIPTASIVPRIRVTQPMIGCRTFSTLHPCLSKQDATVSTRKGRSPVTDLNRIICPFDHGGSTMTSRGAAQS

SEQ ID NO: 953347 - protein, 178 aa, Homo sapiens
CSLMSPCHQQWMLFTAGFQHGQGQTEHDGDQRWYCHCRRNHSGSRCDQLLIWMPIPSPGLHTKERRVSVISEAQFVDLYLGDGLADARGLPGQARRVEAPLEWRADLERIRQLCAEKYAATLDPEFALLEDGVVLRVTQLIDVTSKPDFCPQQVVGSNSSGGHARPARSHAECSDERH

SEQ ID NO: 953348 - protein, 110 aa, Homo sapiens
MRIPYRGGCSRRTYVVGQAAVAHTCNPCTLGGRGGRITRSVVRDQPGQHGEHPSLLKIQKISRAWWQAPVIPATREAEAGVWLGPGISRLQWGSDHATAFQPGRKNETSS

SEQ ID NO: 953349 - protein, 108 aa, Homo sapiens
MSSAETGRSWALVACNPMSACRLSPTCPAQVDAGPPVTRALPSLPEGLPWGLRESRPTHLGPEKPVGPGILRKPCRCDPGPVPGQERGKAMSLVLPGPPGKWRGKGSP

SEQ ID NO: 953350 - protein, 39 aa, Homo sapiens
MSPRSDHPRSFICWTEIKHASSTCNGAKSLVGPRGATCE

SEQ ID NO: 953351 - protein, 39 aa, Homo sapiens
MILFQHPKYDISNMTSIASDVQVRRDMSGELDKCAPLCS

SEQ ID NO: 953352 - protein, 64 aa, Homo sapiens
CLHKGCEFRDSQTTCAVTGPEFMADPAMVAALAASVSASIGHWTLDTVELSIYGEVRGDWQLYD

SEQ ID NO: 953353 - protein, 109 aa, Homo sapiens
HKDAGFHTGSHGWELVVAMIWVGLAAQDFSQSLWHCSSSLFAACSTKSYGCCHRSRDLSSVLQVLPPTRNMHLVGCLCRLLFYSLTFPRVGDILAIRKSGSYIPLTPAF

SEQ ID NO: 953354 - protein, 49 aa, Homo sapiens
GNIVPRPDPVRTVEEALLRSSVPVMHNAVYLLCTAVRFYCCCWLTDCNM

SEQ ID NO: 953355 - protein, 37 aa, Homo sapiens
CAPTSSLSVVYEEDGSFKEYRFFGRNPDAVIVDTCRY

SEQ ID NO: 953356 - protein, 105 aa, Homo sapiens
MLLVQLARHRCRYDARAKPGPVLKLLETLNTDMSWARPGDRAKLDEAVDSLEEATNSTEWREWNTNSVSVPFDVTRLKYPIRKAWSDSPSEPNALDGMSITMLRV

SEQ ID NO: 953357 - protein, 35 aa, Homo sapiens
MSNRGGWSSIFLSFSLWVMAVVHAFPAHGPPQNAT

SEQ ID NO: 953358 - protein, 87 aa, Homo sapiens
ILTRARDRPMRSHAALWHRYRDREHRLYYYRTYLTPGLDHQLAVNQWPWSPATGGKRMAYAAGEGQNSTRHNPIAQGQGSADTHNRP

SEQ ID NO: 953359 - protein, 163 aa, Homo sapiens
MDSRVTLVSDDRSRLLLPDTLLWTRCGCMLGIHTGEWTAHIFEYAMSFEGNMTKCRELAAANGVGVLHPPGALATDPPGLIVCDVDSTVTRTVAIDLLADCAGKADEVREITARAMVGELDFTQSLYARVRYLEGLHIGALEEAWKATVINPWDSRANGPLAH

SEQ ID NO: 953360 - protein, 79 aa, Homo sapiens
DAVRLIDETPGIHDVVVSPVYITAPIGGVEQDDFLNLIVVATSDLPPSVLLERAHIIKAAHGRDHTIPNGPRTLDVDLI

SEQ ID NO: 953361 - protein, 73 aa, Homo sapiens
DSAAPADLIFVDLYTDVGPSSAHLAWRFLENCQGKLNRGGWLMINQWSATDGKPLGAALLRGLFRHHYWECPV

SEQ ID NO: 953362 - protein, 126 aa, Homo sapiens
ISRHARQGVDGLSDPLMEPLRGDGTIDGPQVGGEQRQDPVATVCAEKTKRRVGVDGFSQLLWCCCQRVPPAGLRCRQYLLYRTTRCRFGGRTGARGGRGCVRLGTLIRQMPSAVCGRGRQPGVRSV

SEQ ID NO: 953363 - protein, 99 aa, Homo sapiens
ESLVRRALEHERTPRLPQDMTNIKASILWPETSSTKAKTLQRIFSAKLGVVSNRSSRQKGSLVDNQLTQSTPCVLENCKGRARSMKKWTQRHGLTIISL

SEQ ID NO: 953364 - protein, 49 aa, Homo sapiens
GGSDEFFLMRLQDFHAFQPGSLVSVFFRGDFAFFLEHLHDAFEVHREHG

SEQ ID NO: 953365 - protein, 98 aa, Homo sapiens
AIVYIIWLPVLPILMTFIHPYSMLSPTTGCTEQQRMGPGRGPIPGQRLEITPVQRGTTLGLLRGLVSVDEVLLQVNGEPLWIKGRLFQVVQGELFQVK

SEQ ID NO: 953366 - protein, 67 aa, Homo sapiens
NSGQVAEASGNAYQNRNVSRALVLKITQPRVCLYSNTKGVRHSYNEDWNVLTSFTLLHDLLVTIFMY

SEQ ID NO: 953367 - protein, 140 aa, Homo sapiens
SALEVVCIDKLDMWGDSIPLHSIALIPFHLIPFNPIQVHSIPFHSIKFQSIPFHSIRVHSVPFYWRPFNSIPLQSCPFKSIPFLSIRIHSIAFHCIPFESIAFHSIPVHSIPLHSFRVHSILFHSNPFHSIPFHSIPFES

SEQ ID NO: 953368 - protein, 55 aa, Homo sapiens
MSRLTRNSGFAATCWRDSSDCGELLLKSTGGARRLANPGRTSGGECNGISQFDCE

SEQ ID NO: 953369 - protein, 86 aa, Homo sapiens
MKHLADGVSLRFDGADATMYLIDTMNQRRVHGELVMEMGEAGEVGISPTSEVMTLGKRCREAHQTVVSNSEDLGLASLEQAESRLA

SEQ ID NO: 953370 - protein, 103 aa, Homo sapiens
MQHRQPSTNEHQHSHRQCISAAPRIWTLHYLLATPRRHNSHSVQQKKDSLERGASQQRTARPRSCRLDSAGQCPCDFAVCRPHPPPCYVIVDRPDIGLPFWRV

SEQ ID NO: 953371 - protein, 76 aa, Homo sapiens
PSASINLHAILRSCVPLVNNDPVARNIVKDSDISVRFDAAGITPLTLIFDHGTARSETSNSSKADLRLGLVSPEHV

SEQ ID NO: 953372 - protein, 43 aa, Homo sapiens
RAGTNLKLPNVKLLQKNNSYIFDTHHVASLNAWNDKNTQINVC

SEQ ID NO: 953373 - protein, 43 aa, Homo sapiens
YVTTYSSPSCQLCHQYLFSFLSVMSPVLFSFPSVMSPVLSSFL

SEQ ID NO: 953374 - protein, 47 aa, Homo sapiens
PVAIRTKIHNRKCDWIRLLNVLPPCRSCHGRLYVGCALITSYLGSFI

SEQ ID NO: 953375 - protein, 83 aa, Homo sapiens
GTKPEVAKYFQSLIFDKANKNIKWGKDTLFKKWCWDNWLATCRRMKLDPYLSSYTKINSRWIKGLNLKPETIKILKETLEKPF

SEQ ID NO: 953376 - protein, 74 aa, Homo sapiens
MSSVDLCYANDQIHKSVSLVTLPGMSACLYCITPFVGQLDCFLMTNGPRGVVHFYGYSVVSTLALLVSIAFPIP

SEQ ID NO: 953377 - protein, 78 aa, Homo sapiens
PEYFQVKLIFDKANKNIKWGKDTLFKKWCWDNWLATCRRMKLDPYLSSYTKINSRWIKGLNLKPETIKILKETLEKPF

SEQ ID NO: 953378 - protein, 83 aa, Homo sapiens
LVLVSILTGLAHFRPASLCPVHPSHSWQEILQARCPSLAQIFHRISLALPLSVFLPLPLGCHFLCHSETPELMLFPGLETKLR

SEQ ID NO: 953379 - protein, 39 aa, Homo sapiens
MDHIVHIIMSICTMLCNKDHVIHDLFRAVYPFPGRQKIH

SEQ ID NO: 953380 - protein, 45 aa, Homo sapiens
YARQRLQLLAHTAPSSRAVCRLKCNCSVLITSASCSWARNGVSVW

SEQ ID NO: 953381 - protein, 40 aa, Homo sapiens
QYEKINRPGMVAHACDPSTLARPRWVDHLEIIVFNDHACT

SEQ ID NO: 953382 - protein, 34 aa, Homo sapiens
LVPCRFLLRRLRRARWDCAHFERTQFHRCLLDKA

SEQ ID NO: 953383 - protein, 34 aa, Homo sapiens
MIEVLRFPTFRNLFAAQVIALIGTGLATVALSLL

SEQ ID NO: 953384 - protein, 50 aa, Homo sapiens
PLFQSSSEKDDSSAASWPVPTGLGGQGDLSACFGLVSGSRLDFDIAVNLI

SEQ ID NO: 953385 - protein, 40 aa, Homo sapiens
SSSYLFHLLSSSWLYDLTSRPQKSHTVQRLQQAGISLSLA

SEQ ID NO: 953386 - protein, 34 aa, Homo sapiens
MCAGAQRPYTDCGNRSLFAYPSEQQPCGSEEGLQ

SEQ ID NO: 953387 - protein, 51 aa, Homo sapiens
FRPPPHPADKDTLQSSKQPSKARLEEYYLHTTETIKSPRVEQRLAKQPYYL

SEQ ID NO: 953388 - protein, 67 aa, Homo sapiens
DTLNINISIIKSLDSHFCSCMATSTYDRRYKRYRYTTSSSYTEEYVVKNLCSLLTTMVLAFTPLGTE

SEQ ID NO: 953389 - protein, 76 aa, Homo sapiens
CEFSWACKGPTAAETLGRSEAEWQQVLGCKNHKTTVMGPRGVGFPTDEQNQSVQKQAPTLRTTDLMKAQRPFNGIF

SEQ ID NO: 953390 - protein, 30 aa, Homo sapiens
MARCCAGQAGALGTGALLKLGCISEEAQES

SEQ ID NO: 953391 - protein, 64 aa, Homo sapiens
MSTPQITKSELHFNKIRRYSYAQSSLRSICCKPNVDLFSFSTVPFFYSVSLNSSPWGGGVGECA

SEQ ID NO: 953392 - protein, 34 aa, Homo sapiens
CNTRLVTESSSGFVPTPVIQSARGILLESEPCQA

SEQ ID NO: 953393 - protein, 58 aa, Homo sapiens
EILGMWGLEEHTGSRVLNIVAGFSVAELQIFQESHESPQEAWLLPDKRQLLLQEMGKD

SEQ ID NO: 953394 - protein, 63 aa, Homo sapiens
NCHDKQHDHPSPTTTPSRSITHHNHPSGKHHSQQWCMEHKQVVEVDVEAEVGWGEVRVVECVG

SEQ ID NO: 953395 - protein, 67 aa, Homo sapiens
LRLTRGSSHGRALARRAPQALEVGCRHVNHKRACLLMGKLNTDWELRNLCLFCEDVNRHLSYVVDMC

SEQ ID NO: 953396 - protein, 66 aa, Homo sapiens
MRPMSAQFIKLDSEYRPTHPIGCFIVDNKSGKQLTLYHILEQLSSLALTETDFETPLDSVQLLSIC

SEQ ID NO: 953397 - protein, 43 aa, Homo sapiens
ESSLGARILGSFSQSSTDWLCDLRKSLPLSQPPVSRRPRSIPF

SEQ ID NO: 953398 - protein, 116 aa, Homo sapiens
YTQTHTDTQHILTHTHRQYTTHTHTIEPTYTHADNTQNTTHRTHANPQTQTPDNTQRHTTHPKPIYIHNTHNTQTPISTPITTTTTVTPTPTPTGTETPTTTPITSTTTVTPTPTP

SEQ ID NO: 953399 - protein, 67 aa, Homo sapiens
FDSSLKGIQQDVDRGVPSSFVVPFHQHCIQGIPWACCTSSDHIDLIFREVQLPHELVPGVKGHDVCK

SEQ ID NO: 953400 - protein, 52 aa, Homo sapiens
FHHFTRIKASPYNGLQVPTCPSFTQSSGLPRQCPQFPVLSASVSWQTSPDDL

SEQ ID NO: 953401 - protein, 111 aa, Homo sapiens
MTDLFWHKIVTSGDFDKLVNELLAASSSTNALSPQIFKTVMSCLLLNFCNGLLNIHSFLQFLVHHDEIFACFMTSITIKSHEFTPMLMDPLFQYVIEIFIFSLVQGISIFH

SEQ ID NO: 953402 - protein, 56 aa, Homo sapiens
MRCSLISAPALVVLACCLHVGVCTWVSCMWVSCALVSLCLHVGVHPHVSRVRTSMC

SEQ ID NO: 953403 - protein, 59 aa, Homo sapiens
RLIRFLYQSIFLEWLLKQILSCRKKWFIKTSDSFFWCIYLLTVIERQLRSRRYGTRQVS

SEQ ID NO: 953404 - protein, 73 aa, Homo sapiens
RQRETDPKAFHRSLSLPLPSQAITGPQAYKGTVISREVPNAHSTGLLPWATLELCSQILVQCFLATLTGVQMA

SEQ ID NO: 953405 - protein, 42 aa, Homo sapiens
GVSVSGVEEFPSSFSAGEDPEEGGVNLGWGDSISNRVRVGKA

SEQ ID NO: 953406 - protein, 82 aa, Homo sapiens
MSIGVPRSLGVEYEVINELCSVDPSSSCIQNMLVRSRCLICSEKIRKSAIVTNSITGSERIMRVALWSSFVPFISDFYLSPS

SEQ ID NO: 953407 - protein, 35 aa, Homo sapiens
MPLRLLLLIALRDYVHRVILPSEFLGPPATLRCTV

SEQ ID NO: 953408 - protein, 44 aa, Homo sapiens
RWTWQRLQPTWNDLGDRFDSVGAPQCVWLRGLLLLRLPEAPRGN

SEQ ID NO: 953409 - protein, 62 aa, Homo sapiens
PTVQSDLNPWLPTWPWHVLNVPEPTASSLQVTLTGLLTTLHGVNAAHNYPLPSPLLLIFLAL

SEQ ID NO: 953410 - protein, 142 aa, Homo sapiens
PSSFPYPPGVIPKLDCPTPRPGGGRRRLLGLLLCLLLSIHMQEACIEHLLDPQPKAQGYGNLIRPLPSTFTVCRREEADGLKFQALEVERRKGRAQGIQERGRLIRLGECGGASRVGLEDEARSQDWDPVLPCPSPAQAVKQ

SEQ ID NO: 953411 - protein, 173 aa, Homo sapiens
IDPLWPMNAPQKSACTCTRSTGGRRVIARSRNRSVARPGQLIEYSRSTVIGRDGRSTDDPLEVRRTCIRGATTVTVCPALFEECALQPHRHLRAPEGVEVLIAEEDDVHVWAARYSGSGSSRYSASKVSRVRLMSWITTPSSDACCIRSYSAGSAVSTSVKAGSEFVDVPRLE

SEQ ID NO: 953412 - protein, 63 aa, Homo sapiens
SGESCPGKLIVIHGKAGLFLEGQIHPELEGVSIVISEKGASSPLITGFTDDKGAYSVGPLHSD

SEQ ID NO: 953413 - protein, 96 aa, Homo sapiens
RGMNNLPRAFPLLKAGALGINQSLGVIKPRMCSGPKKEGQLAATASVNTSWWQQQHAELWSPPEPASILRSQPCMWEQRSMQYTNNQLITTCSTEE

SEQ ID NO: 953414 - protein, 36 aa, Homo sapiens
LERELREHQERHLEQRDEPQEPSNKVPEQQRQITLK

SEQ ID NO: 953415 - protein, 106 aa, Homo sapiens
VPVALGVPVECREHDGEDSGSIVTYEAHDVLIVPERESTLCHLEMGARDTLGQLAEEGFHHFVENKAPYVHRQKPYCLRPWNLGAVFLRPWPLQGTYKGQDKACPT

SEQ ID NO: 953416 - protein, 43 aa, Homo sapiens
YAHYLLCKMADDRGVFPGQWALSGGGVEPGERIEEALRREIRE

SEQ ID NO: 953417 - protein, 82 aa, Homo sapiens
RFREQGTFTDFVIKCDDGTEFHCHKVVVCAQVDAINAGMKNGFKVMSFFSHENVPVMQIVADRNKEAQTGEYLLPEKKSSIV

SEQ ID NO: 953418 - protein, 86 aa, Homo sapiens
VIGSGCLIAGGAVVLGGTEVPPGSLVAGVPASVRRPLTEEERAGLIANADIYLEHVQDACRDDSRLSPRPLGWSAYGAVAKLVKAV

SEQ ID NO: 953419 - protein, 33 aa, Homo sapiens
MGILLCCPGWSQTPSLNEMEKRTPTQEFPPSQY

SEQ ID NO: 953420 - protein, 53 aa, Homo sapiens
VQTASIFLICFLVPYALGLTLTTKLTNTNISYAQEMETVCTILPAIILVLIDL

SEQ ID NO: 953421 - protein, 115 aa, Homo sapiens
TQSFINDPRSNDSNLRLIHIPVPADGSYFAGVFLHRHPAFAFPVERVHKLPVFAGRGRSQPRQRGADGLADFHVRGQAMPGRGNLDPSEQSGRIGRDRRNQGLHLDAIAAQRADR

SEQ ID NO: 953422 - protein, 51 aa, Homo sapiens
AQKPPRQVPLRLYAGNNLNAANDNRAAALVVRVYTLKESTAFMQAPFDAFV

SEQ ID NO: 953423 - protein, 83 aa, Homo sapiens
NYSRAACIIMRGTLTTTFFLGTTYDALSPELYTTYFVTKTLLLNLPVLMNSNSIPPPPLRPTHTPAMKKLPTTHPSIADMICL

SEQ ID NO: 953424 - protein, 38 aa, Homo sapiens
FGFAHIAAGLALSANSYAKEIKISSNNTSYSDADVQKL

SEQ ID NO: 953425 - protein, 126 aa, Homo sapiens
MDSFFLPLLCPRQITFLAKAEYFNGTTLVGRLQKWFFTSSGSRPVNRTSASAGQDAMNTAVEVLNDGDLFGIYPEGTRSPDGRLYKGKTGVARIALASGAQVIPVAMIGTGDVNPIGTWFPRPGKV

SEQ ID NO: 953426 - protein, 72 aa, Homo sapiens
MDECEQALAAEPKAKDPGGYLPKSTSPLDEFKRKDFNEDTLSVALPYYWEHFDKDGWSLWYSEYRFPEELTQ

SEQ ID NO: 953427 - protein, 56 aa, Homo sapiens
MLLFVSVVRLVVLTHYVLVLADIVRLAGLYLAKVLGPAWALPKVTKVLNAVIPENF

SEQ ID NO: 953428 - protein, 36 aa, Homo sapiens
MEFNGMESSGMEWNGMEWNGMESTRVQWNGEERNGM

SEQ ID NO: 953429 - protein, 69 aa, Homo sapiens
HYNMWYDMQYDMHYDIWYDMRGDMQYDMWYHMQEDMHYDIWYDMRCDMQYNMWYNTDMMLATAAVTPLK

SEQ ID NO: 953430 - protein, 133 aa, Homo sapiens
MPLHSSLGDRVKLYLNDNNKNLARCGGQAAIPASQVAEDYRHSLPSPAYFCIFSKNRVSPCWPSLQKIQTISWAWWHASVVPATWGAEAGEWREPRRQSLQGAEIVPVHSSLDSAKLRLKRKKNSTEISHAPL

SEQ ID NO: 953431 - protein, 87 aa, Homo sapiens
MCENDEEEKEKRENVERTMGDEKAHHDGMEKNSEGAFILVSIFLELWPTAPPFSSDYVFSAFKSSLVVLSKRVVPDKRIVSPKEWEI

SEQ ID NO: 953432 - protein, 72 aa, Homo sapiens
MGQGLLPSTLGPGRYGVETPLCLRWVQVEVGQGLLLSTLGPGKCGVGTPLCLLCVGKRKRDQGLGAVAHACN

SEQ ID NO: 953433 - protein, 53 aa, Homo sapiens
MEMDICEGEPNWLHVSYYISATLKQRHLVEALVRQVRWASKLWATGGLEVGRM

SEQ ID NO: 953434 - protein, 52 aa, Homo sapiens
TIMRKPISRLAAFIGLGVSLVASSLAAPAVARAEGKIRIAEQFGIVYLLLNV

SEQ ID NO: 953435 - protein, 88 aa, Homo sapiens
MAMKRSGESIDISNDELAPVELKVDVTTQFNLDIQADEFGGIKDLAELNDWNVAEGKGRDVDIGGGDDEIRSGQRRLVCLVAGQHEVL

SEQ ID NO: 953436 - protein, 121 aa, Homo sapiens
MMLLEVDASVRLQLRASMAGYSSLVLWRGDLTCVDQSGVKLLASSDLPALVSRELLGFTGVSHCTRPKTCQVVAIFIYKIYSRHLFKKLRVQPPPCKNHINKFVYNLKHCKHSEVTFLDKN

SEQ ID NO: 953437 - protein, 109 aa, Homo sapiens
MGFLCVDQAGLKLLVSSNPPASAFQSAGITGMSHRVWCILYIINRHEGLAMLPRPVSNSWPQVILLLRPPSVLGSQAGATVPDPKPSFIIPSTDLYQVYLILCCLLKCP

SEQ ID NO: 953438 - protein, 188 aa, Homo sapiens
MSGLEYRLGYTVVVRLLLELLALSDLPAATCQSAGITRVSHLSQPEATFKSNDKGWWHDMLITHSLHCSIPRYAWGGLLLTLDTTSPLSATHNVSVLFPQDVAHGLCLKVLPLCYFPPYHSYLQFHQEPKTVISLILQEDPLFSVPYTSPCHMATPSGISQHLLPALLLKGLEKTAQFCWDHSFVLSA

SEQ ID NO: 953439 - protein, 37 aa, Homo sapiens
KIGLLTSGGDCPGLNAVIRGAVLNGVKKYGYEFVGFR

SEQ ID NO: 953440 - protein, 36 aa, Homo sapiens
AFCCWNSENAGNHRPYCLLMIRKLLVYRRAPYHVAP

SEQ ID NO: 953441 - protein, 163 aa, Homo sapiens
MSGLHTGISLDTTDHTDVLVSAPELNNVISLDYDSPVVKVYYTYVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANSDGSERKVLINTDLWPNGLTLD

SEQ ID NO: 953442 - protein, 69 aa, Homo sapiens
NKLVTDKTITYDQNAYEVFVTVADDGKGQLVATVEDADTERVFTNTYTAPVPPAPTATSATLEFTKELA

SEQ ID NO: 953443 - protein, 59 aa, Homo sapiens
KANLKDPSVRKEFCRANISSSSLFVRVSSKLSKKVLLELVLLAGPVVVELFIFALERFL

SEQ ID NO: 953444 - protein, 59 aa, Homo sapiens
SIEEKILDMQKNKAELAQSILSADHEGDIKLSEDELLGLFDKFYDINTIIIQFYNSITL

SEQ ID NO: 953445 - protein, 79 aa, Homo sapiens
PQFWCVYFGKFLCGQIFSEQLTNTSLNPENSLVGDGSQVNDTVSNLVSKLTTGKPAASASASEREASSKRIGNASGVSE

SEQ ID NO: 953446 - protein, 36 aa, Homo sapiens
MASGFLISGFSLGAGVTAQVYALIEYLTRGTSAESH

SEQ ID NO: 953447 - protein, 40 aa, Homo sapiens
YVRGYMIGEHGPSGFPMFTGVNVGGVGFDGLAELFDTDPM

SEQ ID NO: 953448 - protein, 37 aa, Homo sapiens
IPLFDIPMWAAIYYRWRLLWFYRCCLEHPQEDLNVTI

SEQ ID NO: 953449 - protein, 40 aa, Homo sapiens
HCNRAISHIVKHAKAFSLRCVFPRNFNSGHSLSQGVRRET

SEQ ID NO: 953450 - protein, 95 aa, Homo sapiens
LRPKSSRFDRVLTVKSTGLRHGGGDSAPPVEERRVGLPDYVKTKEEYPSSSFSSGGSGISSNMIADKGRLRVRMTALGTSSGPLSQYFPKLIIPL

SEQ ID NO: 953451 - protein, 41 aa, Homo sapiens
RGSPHPAIGACREEKDLTPSLSPQIKVLRSVKYPTEKHREK

SEQ ID NO: 953452 - protein, 42 aa, Homo sapiens
LAAQARVASTSVRCRLGSTAPAPRSCCSIRVETAAGSLLQRD

SEQ ID NO: 953453 - protein, 52 aa, Homo sapiens
DVVRSAQRLRAVELEVHLDEGARPGGAGLEVMEPQHAGLGGDDRLELGEECR

SEQ ID NO: 953454 - protein, 39 aa, Homo sapiens
LVSISRPEDSDAEHQRMTRCAEVVLEKLGLPYRKVLLCT

SEQ ID NO: 953455 - protein, 110 aa, Homo sapiens
GTPEQYTVNSIADLARQWLGDDSAINRSFRPSFGRKLAVVTCTVIGTCNSNVKVIIECGGCSRESTLLGRGSVLIVERSGDLAMGGRDGALPKQTVLSARDQCEGLRLHM

SEQ ID NO: 953456 - protein, 69 aa, Homo sapiens
VPLASKYQFEFPQFLTKVNIAAQCESERKRKLLAKKLKSLRAESQQNAPKPKPTVKIIDDYVVNQSTQQ

SEQ ID NO: 953457 - protein, 41 aa, Homo sapiens
ARYPFAPYRRLFQKKKFFTSCCRKYDITNSVYAFIRYSDVG

SEQ ID NO: 953458 - protein, 126 aa, Homo sapiens
LARYPSGLSPLRLDSSQALTAALEQAGGQQPDEGSGGGLIDRARAEYDKYFTPGGSERRNVFADRDELEEIRSNLAKGQERLAEVDEVVDSLSRINEQISHDQTGVASKKTDCQKAEAALASLTEL

SEQ ID NO: 953459 - protein, 42 aa, Homo sapiens
VPQRHGEVAVHPLVLRHVGLEAVLKPNICRVRLRSQISESNG

SEQ ID NO: 953460 - protein, 35 aa, Homo sapiens
ANHLPKSVFHLCPWETEGQAWIIMNRAMPHDTEEA

SEQ ID NO: 953461 - protein, 87 aa, Homo sapiens
SGFAIVPRESQPAHYEKRKDDDPDVYSDFESDHVALKQKQEIISDYNMRMAVLEGSECLNAAKDLAKFQAGEQQRSTGKIPIGLGGK

SEQ ID NO: 953462 - protein, 42 aa, Homo sapiens
ANILPKSVFPPRALGRQMGPSLDYHEQGNAQTPRKLWRVEPV

SEQ ID NO: 953463 - protein, 46 aa, Homo sapiens
GSSRGPRTFAQKLELTTHHRIIQESDPIVYRIGAKNLLVRSQTLSY

SEQ ID NO: 953464 - protein, 67 aa, Homo sapiens
YPYTARSPPGSKEVSCVDAQVHFQVRTGRSVGRNMNPGLAMSWCNYISKLNQVLAAASETEPSTGSN

SEQ ID NO: 953465 - protein, 36 aa, Homo sapiens
MVRACFWSSSQPFWGAGTKTAQNVGFRSLENIRSRL

SEQ ID NO: 953466 - protein, 50 aa, Homo sapiens
MSWYHSLIFNREQPQRNAAHAGSSRAWRRDDGRDYSVRKIRFSSGPSTLN

SEQ ID NO: 953467 - protein, 54 aa, Homo sapiens
AAAAPRNKDGKGKVCPDSCATAHFFAHLQEFLILLGLAWRVGQKRNGRKRRDPE

SEQ ID NO: 953468 - protein, 111 aa, Homo sapiens
SEGSDNGEEVTDLRTIGVKLAGHEGKRGKTTSPLTFMKHLLCAGRSAGGAPLCAGLSAGGEPTVCWPLCWGHAHCVLAALLRVHRVESLPGLHGSQLQPLVACSKTCGSLS

SEQ ID NO: 953469 - protein, 84 aa, Homo sapiens
DVALCARYRAPFYYSTERTALCATAVVIPSAVTGTRRASSFDYTLVPPGNFLPLLLTHSNMPAHAIPPTHWTCTCCAHALSGIW

SEQ ID NO: 953470 - protein, 89 aa, Homo sapiens
DRARTHCLKAWDVEKLKGKQGVFLTGKWIKLGYKDGLRSPSLICSKAEASGRLENPDFFFFFFFWRGSSRSVAQAGVQGRDLGSRPSNM

SEQ ID NO: 953471 - protein, 81 aa, Homo sapiens
LFARQWLEESSYPVNTYIKKTERVQSGILRSHLKELEKQEQTKPKPSRRKEITKIRAELNETNKQKNIQNMRTRQVSDPEF

SEQ ID NO: 953472 - protein, 42 aa, Homo sapiens
LNWALSETTISQANSNKPQLITQTLSIIQYYVEHRMSSTLEF

SEQ ID NO: 953473 - protein, 65 aa, Homo sapiens
AAKSILEDTPLVKSSDYRVPVTIVKTFTVDPRPSVLQAHGMITCNQNNFVHDCINITIKQHTVTT

SEQ ID NO: 953474 - protein, 72 aa, Homo sapiens
AYVHRPLEHNVVDCCQRCSPWHVRWWPSLSTLLRHVTGKPTTETPYSKLEPKTIFPRDFLLHYEMRQVVDCF

SEQ ID NO: 953475 - protein, 77 aa, Homo sapiens
PRLRLLSSSTHRFIDEEDAGHLQSKGNKSRTWQKQKESHLTREYYVFSEVRNEINRPGTVAHACNPSTVGGRGRWIT

SEQ ID NO: 953476 - protein, 59 aa, Homo sapiens
MDSEREREKRRELRAKLGFEVRVGKIEVWELTERISGCRDRVESRLACPSSEERLDEPY

SEQ ID NO: 953477 - protein, 45 aa, Homo sapiens
VITPCIASSSLSPYITITLLKLYFYLRHILLHLIITITIITIITI

SEQ ID NO: 953478 - protein, 99 aa, Homo sapiens
MFVTIHPQTLGYFHFLGIMNDVAVNTQVYLVWTSVFYLRYRPGGMAGSYGNSGLTFRGKCQTIFPSGCSSVYVPHQHLPRPSKKHVRWGLKGDLHFPKK

SEQ ID NO: 953479 - protein, 33 aa, Homo sapiens
LEHEEEMRRDEVRTMRLNKELLDEEEDIDPFYA

SEQ ID NO: 953480 - protein, 101 aa, Homo sapiens
SSPHYTHKLHPLEPIHFTFYFYLLQISRIHALSSIPTAADSFVAPKVSFLGVFIEAGCHSITQAGVHQHNHSLLLQPQPPRLKLSSHLNLLICWDHRCAPP

SEQ ID NO: 953481 - protein, 72 aa, Homo sapiens
QQMLGHSGWASIHLQCQHSSQHPAVAQPWLHTPCSLNHINHHTHIQPGPLVGCVAVVNPPASPLWPGLQHCG

SEQ ID NO: 953482 - protein, 84 aa, Homo sapiens
STLCTIFVVLIRLIHFMSKHLPLLIYSHALTFSSKPGHTDFNATQHVSWWQQQFVMGFAFQQSAPPTFPILVPSTISKGASSQQ

SEQ ID NO: 953483 - protein, 112 aa, Homo sapiens
LSISTSTIDLHIARHGVRSAGTKCDRHVILLLLSISYKFPAQNYNRKVQNQDASNTLITGSPLNISPIQGCTHVRENQTTKLKKTLRIPVIGTRMQKNSLCTNEEDLTDVHQ

SEQ ID NO: 953484 - protein, 35 aa, Homo sapiens
RYNWASLDGQDSNQNIHSNGAQTDGCQARQSPARK

SEQ ID NO: 953485 - protein, 80 aa, Homo sapiens
SIFIPIPQHSLLTHHSSISCCCAAIHIPWSITAFMQQCTSTQQHGSSFNSTQGQSSTAHMHHAQCRMVKVSGISYMGASG

SEQ ID NO: 953486 - protein, 67 aa, Homo sapiens
MDGLNTADGLRKVICSTVFELGHQSSALSLGIGLELYADSPKYRAYSEYNLGYTACVHACVCVCVCV

SEQ ID NO: 953487 - protein, 36 aa, Homo sapiens
GHLTLDLERTWNEHCNALDLNMYMELEPELKQDVHT

SEQ ID NO: 953488 - protein, 47 aa, Homo sapiens
ESTDHGLSIVLLGFSQSCSATEIRASGLSKKESYFNAFFTFHSYNRR

SEQ ID NO: 953489 - protein, 71 aa, Homo sapiens
AVNTDVWSAHQPGTVCGPTDMALIYLSSHVLLLNEQISEVVTFALFAYRLLLLSGLSILFPDASDYYNVSP

SEQ ID NO: 953490 - protein, 66 aa, Homo sapiens
SYGVYHIGQDGLDLLTFRSARLNVPECCDYRYEAPCLALRLTNFLSFQLTRGCAVLAEYGLDLLTS

SEQ ID NO: 953491 - protein, 71 aa, Homo sapiens
MTCLLSYLTSHLSAVYPDVESHAYKKSYPMTNFCFLAFPSTALSAVDDIQALVSGWLLSVKKSHSPLYQCL

SEQ ID NO: 953492 - protein, 34 aa, Homo sapiens
MGLSSFLHVSYVSRFALTAFIGLHIFPVQDILID

SEQ ID NO: 953493 - protein, 61 aa, Homo sapiens
GGAPDLGLYDRTAPVSPLRCSNLCASMCSAVLGMVTVCMECPVLVDAQWIRGLQQASMCIS

SEQ ID NO: 953494 - protein, 117 aa, Homo sapiens
LLTLQITQNVSGLRSQWIILVIVQSIQALQHRVGKLANQRQTDALAFILLDELIEVHAQQIKRSMQMMDCGRMKYLQHMDDIHSVSYDPCFRRMFQGFEISIRCLPEMESASHFRTI

SEQ ID NO: 953495 - protein, 105 aa, Homo sapiens
DLLKQRMLCTIVLTSKRNSSGTFIVLIRRVDGNSDIKVYMHREQAYQAAIVHNVDSDDLISMGSNDTVRLLKKSDIPYWSLLGESSANSLKDVTSHYETGGHPLS

SEQ ID NO: 953496 - protein, 43 aa, Homo sapiens
HKFKKGDEYDVCAICWDEYEDGDTLRNLPVPCLSRKCETLVNK

SEQ ID NO: 953497 - protein, 137 aa, Homo sapiens
MLFRGSLESDMCMGGGNVCWCMLNRLTLETVRKYFPETWIWDLVVVTSAGVAEVGVTVPDTISEWQAGAFCLSADAGLGISSTASLRAFPPFFVALTNAFTLCFVATASHSRPRSTRTFHKCIRVSVQLEASPAFLS

SEQ ID NO: 953498 - protein, 60 aa, Homo sapiens
PGGAICGIAVSFGALISPGGCSASRPSWLCAGGAPGVSGSALGWGLTPAALGSGRESAGS

SEQ ID NO: 953499 - protein, 182 aa, Homo sapiens
VLRILELNCVWEEACTLVHVEEPHTETRYDRTYLRHRIWDLVVVNSAGVAEVGVTVPDPITECKAGAFCLSEDAGLGISSTASLRAFQPFFVELTMPYSVIRGEAFTLKATVQNYLPKCIRVSVQLDASPAFLAVPVEKAQAPHCICATGRPPVSLGSNPKVIRPCESHCERRGTRVSRAVW

SEQ ID NO: 953500 - protein, 220 aa, Homo sapiens
QADADFVRFCRTMADICMCRLGGTWASSQHGSQAPRCSCPRAPGGSCVASYDVEQGVTFYCGSQPAPVEEVGEAPHLSVHTIMGKGYAPTSERVICHRVAQGHGISHGCHPKKALSRGALPSPEAVIGDALLRLQTTRVGSQPPTTGQLYVPSEEQEQGPKARSQCGTEHLLLEMPAPHEEGHSGEQALVLIAGCLLVTGCPIREEEISHTDVNLASKKI

SEQ ID NO: 953501 - protein, 125 aa, Homo sapiens
LQADAAGWVDWTKKLCNTVRYPNVFGIGDCTNLPTSKTAAVVAAQSRIVDKTFSVIIENHTPTKKYDGYTSCPLVTGYNRVILAEFDYKAEPLETFPFDQSKERLSMYLMKADLMPFLYWNMMLR

SEQ ID NO: 953502 - protein, 73 aa, Homo sapiens
GSVIECLSSTSPGYRAHRTRLKAKGADKVTFYTRKAALKAQNALHNMKVLPGKHYPYTDETCLHSAEERMRVE

SEQ ID NO: 953503 - protein, 42 aa, Homo sapiens
PLYRLMQRLNSRTCRQHEQAQRGYHCPHAYTSQARSGLRRAS

SEQ ID NO: 953504 - protein, 161 aa, Homo sapiens
MAPSTDTDSSDSLASMNYSYHYDTTAFLIVTACGRITDVECICLHLYIPVTCVIVIIPLAWEFKSSMGKIVAGLLLLLLLLLFLRWSLAVRPRLECNGAISTHCNLHLPGSSNSPTPASQVARTTGVCHQAQLYLIVFSVETGFHHTDQAHLELLTLSDLP

SEQ ID NO: 953505 - protein, 48 aa, Homo sapiens
MCGDHLELELRQSCLELAIVLHLTVMTMHWPIVLHLTAMTMHWPSFYT

SEQ ID NO: 953506 - protein, 50 aa, Homo sapiens
LKTYGLAMMTAAGSNRKAQLNARILAAGWGGLRRQHGVQSNLNRAVRAVG

SEQ ID NO: 953507 - protein, 49 aa, Homo sapiens
TSLFYRSDLRSGSRFGADRPATSTRPAKRYVLEARLSNGCLRACVTCNG

SEQ ID NO: 953508 - protein, 55 aa, Homo sapiens
RSAVRQSRVSSVIQRSGVFDSVRCLSSAPQVSGAHQLTHQCFDLIRIFGVPHTHQ

SEQ ID NO: 953509 - protein, 36 aa, Homo sapiens
MCAARLRYLQPVYVSYNSWVRADGQRAKAKACKKYM

SEQ ID NO: 953510 - protein, 45 aa, Homo sapiens
KQTPCALLFRLSKRTFEPQPSSPSSLAQSMSTHLPLQLPFGGAEG

SEQ ID NO: 953511 - protein, 41 aa, Homo sapiens
IPSVDNAASCPGIPHLSNCTQAQAASFHVDSQPVGPEHRHT

SEQ ID NO: 953512 - protein, 60 aa, Homo sapiens
RPGVYRSDSMGRGASCDGVGGVAGTVALVDQEARPALPEYGRDIGETSWLVSRKKTKLAL

SEQ ID NO: 953513 - protein, 144 aa, Homo sapiens
MPSLIIQPTFKGVRPRRNNCLGPSPLAASPAFLGKGQVPQPLLSVSLPLLCFSGDRASTPTPSLRVSTPSLLFWGQGKYPNPFSPCLYPFSAFLGQGQVPLNPFSFTLSGKSRFSRGQGQVPPNPFSFTLSGKSCFPGAGASTP

SEQ ID NO: 953514 - protein, 63 aa, Homo sapiens
MSRSDGCRELPLCLLIRIVMPIANPCAEFTSLLTFLKIFYDHKRLLELSLVKIAPLVVTNKHR

SEQ ID NO: 953515 - protein, 44 aa, Homo sapiens
MKKQNSCMGAGVLFLLNVYRLLTIIKVKLVTQIISWGLSIVPEP

SEQ ID NO: 953516 - protein, 141 aa, Homo sapiens
TFILFTGTPSAPDIEFMKRLTKVVNIVPVIAKRDTLTLEERVHFKQRITAEPAVQRHRRVTPLKEFDEDSEEPAVEPEKFRENDPICCGGAVTQKYPGSNGKEDPWGGRPGGVPSKLKTTTQCEFGLTLRDLSHQDAPSCA

SEQ ID NO: 953517 - protein, 70 aa, Homo sapiens
RRWRVPACPLRGDTDPPLIHLDSIPITDPDPSSCSSRHRRASLGEQWGCSGRSFLRGPALQLKAEEFPSH

SEQ ID NO: 953518 - protein, 112 aa, Homo sapiens
SARFASLLLYFIPDTPLPQALTSSLETPRSVNIVPVIAKGEHHPGERVHFKQRITEILLSNVIDVYPRKEFDEDSEHRLLNEKSGEHDPHLLWLASDHKYQVNGQGGIPFGT

SEQ ID NO: 953519 - protein, 138 aa, Homo sapiens
GSGRLFQLLSVTPFFDSERELPDPLLFPSEAMPRPASARARCGHPLTCAHCLPLPSEMNPVPQMEMQKSPVFCVAHAGTIFFFLSRHSRTVAWAGVQWSDLCSLQPPPPRFKQFSCLSLPSSWDYRRLPPHSANFLHF

SEQ ID NO: 953520 - protein, 83 aa, Homo sapiens
EQVLTLFNSMKAERKEATEEKFETSRDWVLRFKAGSLHNIKVWGKAASSDGEATAHYPEDLAKIIDEGGCTKQQVFNGDKTAF

SEQ ID NO: 953521 - protein, 114 aa, Homo sapiens
MTFLPRAYGQLILLTLDAMLLRFVKARVRKPALPTHSTRTSISRQWEMLKLLPNRAPGLTAAGLLQQLEEAGHRTTKRTVERDPNELSSLFPLHCNDKGSLYGWYWQPGRAIVR

SEQ ID NO: 953522 - protein, 76 aa, Homo sapiens
MKRTMGVNSGPASAYHSRTRQLRDKGGSGVRGALGLGPEVRSALAFTGKRRACLCKAGCRPSSTRKAAHGDASTGE

SEQ ID NO: 953523 - protein, 69 aa, Homo sapiens
STVSELFACNRFIRWTFGPFCREKPDDLLGWKRWLLTDPEDLVGLEALAVNRHLSRPFAVLSGLTGVKT

SEQ ID NO: 953524 - protein, 64 aa, Homo sapiens
LSPVARGWPLDLSIGHELNSCLGDNLEYINTIAVQPVSNTSLKNHVSKPPEDVQRVDPKRLLEL

SEQ ID NO: 953525 - protein, 36 aa, Homo sapiens
MTFFLSFVRQSHSVVCSSDNLHSLQSSPPGFNVILL

SEQ ID NO: 953526 - protein, 66 aa, Homo sapiens
RQATKSSFRCGCVLHRVRGVDQPFAHGLCENIVPWLSESGASSRPSVAVGVEVDQRQGCPKAPGLG

SEQ ID NO: 953527 - protein, 41 aa, Homo sapiens
MARPYVSSVLQVCGRYISRWTAVRAGEELPLTRRIPGAAVG

SEQ ID NO: 953528 - protein, 36 aa, Homo sapiens
MRVHVVGLPDTLTKQQQSERVVSGPPGTQTQLLTLV

SEQ ID NO: 953529 - protein, 35 aa, Homo sapiens
DLRFRAMCVPCPYSEAIVIICFIIEEYKREKNTEA

SEQ ID NO: 953530 - protein, 68 aa, Homo sapiens
EAVIGEQVAYRVRAVEIGNTSFRFDVIAMTGQLCGIDTSLLCCGELTGGEPLSRIEWTYMPGYELNRI

SEQ ID NO: 953531 - protein, 39 aa, Homo sapiens
MRLQLDTARITPDLRREECGEAENCRDALLGNAYEGNGS

SEQ ID NO: 953532 - protein, 54 aa, Homo sapiens
MSRADIVLQVHIALTFHVSLHVDMIITILGGEGTQVYYHQLDVLTVCTVYIART

SEQ ID NO: 953533 - protein, 73 aa, Homo sapiens
ELEDACTPSDVRTQPGESQVHMSMDVVMGPCADAGVAEQALVLLSCLSDVGQDPDILSNTVVPAWGRQLTAQM

SEQ ID NO: 953534 - protein, 41 aa, Homo sapiens
MSENTFYGAAGVLTDPQLTHILPGAELRILEVRMRTGTTRP

SEQ ID NO: 953535 - protein, 40 aa, Homo sapiens
MAARATCSTVYWSTGIAMNAALPESSLKHIISEVGKYREW

SEQ ID NO: 953536 - protein, 57 aa, Homo sapiens
MRIQSRCKLKGVCGNTKKPESFTEMRRSRTREHRGADTTAGTQRLGNMRGFEPAVRR

SEQ ID NO: 953537 - protein, 59 aa, Homo sapiens
RYLKETKEVVEESENGRDAPANGNAENEENGEQEADNEETKKRKKVGRNEEDGLTTVMV

SEQ ID NO: 953538 - protein, 160 aa, Homo sapiens
MRLTRSTVIALVTTYTQIGFGCRQAIGLRPDGLSGSFLYVAHFTSRSRDLVQEIRPALERLSDVTRETVHLGMMDGTHVLHVDKVDSPERYGISSRIGSRAVPHLTSLGKAILAAESPQFVDAYLRGKGRTASPYRIQNVEDEESGDREDAGKGIQVTEL

SEQ ID NO: 953539 - protein, 104 aa, Homo sapiens
DRLCRVHVGDSRRIPPKGVTSPYGPSRPALQVIFAGGQDRYSTGSDSASFTHTTPVMWLKPELEGPPLEAYTIQGQYAIPQPDLSKLHQLVMQQSHFPMTHGTR

SEQ ID NO: 953540 - protein, 70 aa, Homo sapiens
MIVSPRYGVLIVNMPYCVLFTNTDIVGRIWIVKLGYPSGTKIHDCRDPFDVYSIEVQLLRQLRAFLPNWG

SEQ ID NO: 953541 - protein, 77 aa, Homo sapiens
VTLRIPGCRVHVEIGFCVKALLRNSTYVCALIPVLGLDVHLQSIPCRGPVPTLLTHKQVLTTVLESFTASWRSVRDR

SEQ ID NO: 953542 - protein, 56 aa, Homo sapiens
MSSTPKLKQSTPWLPSVRYRLSIVPDQLSISESCRWGHESSYPPEPGTATTIKVAA

SEQ ID NO: 953543 - protein, 49 aa, Homo sapiens
MIRPEHILKTQVSYMKKGPNARGPHSCYEDTSKLHEEVAQVPVVPTPVP

SEQ ID NO: 953544 - protein, 61 aa, Homo sapiens
LLAYERSPEAAGEGRTNRTPKMGEVKEIVRKILVGGKLCPSNERIIKILGKKEIRPVFLIL

SEQ ID NO: 953545 - protein, 42 aa, Homo sapiens
MSRACRLSKCGPVCRSVKWREGIIMMGEVCYVVSMVVDMARD

SEQ ID NO: 953546 - protein, 59 aa, Homo sapiens
RLDAQQPLAVGQRNGLLNLAQPLIGVAPRTVPNETKRTMDHGSRTSAHSGGITSQLALE

SEQ ID NO: 953547 - protein, 63 aa, Homo sapiens
QRWDGEERALLEITRQKEQGCDAKCICCIKHTTPNGKKETLVCKEPLPLKRRRSSEHPLAYST

SEQ ID NO: 953548 - protein, 57 aa, Homo sapiens
MCHWARGTIQCMTIGPRVGPSHAQVTAPVSPKAFTIFSINSSPKSHLTTIHKKFRGS

SEQ ID NO: 953549 - protein, 60 aa, Homo sapiens
LPKIFEHTLRSVTLTARVRGFILEVSETKNPPIPDTVVSFKLFSGTFDSLQALGDAHKIL

SEQ ID NO: 953550 - protein, 136 aa, Homo sapiens
KDAGHSKFAGAGSSALASQEASSEAVLVRIYVVRMAPLPQCSAILTLGTAGVSPADVKPISGSSVQNNNSCMFRFSQPSRPSARGNSGRKDDGVYSRDPTMETQPVFDGDEITAPHSMDYTLGDQTDSKLNNTNIR

SEQ ID NO: 953551 - protein, 91 aa, Homo sapiens
HQATLQESQDVANRFARLRGAEENNVHNVNDHKFIARFFKQPIFCSHCTDFIWGFGKQRFQCQLCCFVVHKRCHESVTSSCPGADNGPHTD

SEQ ID NO: 953552 - protein, 88 aa, Homo sapiens
MDGRSSSSRKLDLHCQTFKGAISVVLLYKMLAEFFQLSLQVGVQISEFSKEEPLNLINRIISPITVVFDLSSFHLSIILGLAIGKGTE

SEQ ID NO: 953553 - protein, 92 aa, Homo sapiens
WRQRLALLVPAGVQWQALGSLQPLPPRFKCFSGLSLPGSWASGCVLTRLGYFGILSRAGVSPCGPGGSQHSGTRGASIAWAIAICKGPELAN

SEQ ID NO: 953554 - protein, 95 aa, Homo sapiens
MARPRTELNMYQMDLIDLYRTFYPKTTKYTFFSLPHGTYSKIKHIIRHKRILSKCKIANILPNTLSDYITIKIEVKTKKRAQNHTITWLGLAIVQ

SEQ ID NO: 953555 - protein, 37 aa, Homo sapiens
GFDSKHIQHHAFSSSWLCNVHTFKAAFVRAAFSHQQQ

SEQ ID NO: 953556 - protein, 48 aa, Homo sapiens
PGNGAVYLRGQKEHTFTIQAYRLCAEGPDGANTKNVPQEPLVHSARSH

SEQ ID NO: 953557 - protein, 133 aa, Homo sapiens
MVLGKNWIYIFRRKKLDPYLSPYIKIKSKWITDLNLRPQTANLLQENIGETLQDIGLGKDFLSNTQQAEATKAKTDQCDCIKLKSFCATEDTVHKVKRQPTGWEKLYETTHLTAIITGIYKNSNILRTKINNR

SEQ ID NO: 953558 - protein, 36 aa, Homo sapiens
ILIAMPMSEDNHVTEIEKCYLCELCPYACALPICNG

SEQ ID NO: 953559 - protein, 56 aa, Homo sapiens
RSIAVYEVLVADVHLDRSSMSPLTSWLLNDTGLKDSGTSCISFSSRWDLTWPLPYA

SEQ ID NO: 953560 - protein, 145 aa, Homo sapiens
MLFKITRACIVHGRRRRAWLSCTASTVLRATVSGFSGGKRLGNLNTGRDTVGFSWRGMCLSGSLYEADMSGSPFGFSCLRDSRPAWNTPSTPQPSRCHIPSLPQAHRGLFLSQGLLAHPLGTHSPKPSKGSQCPRAWPFHGPANL

SEQ ID NO: 953561 - protein, 63 aa, Homo sapiens
KSLKLLLLRMKIINIWSNKYTKFFPKKKKNPSEKNVFEFYHVGQAGLELLTSSDLPTLALQYA

SEQ ID NO: 953562 - protein, 34 aa, Homo sapiens
PMRDASIKAQTLKPDQLPSLKGEKGETLDGSVAH

SEQ ID NO: 953563 - protein, 82 aa, Homo sapiens
HRSRYPSDAELCAYYINLTYTGILMFKFQNNEGKCDLWIFLTLFPSILANKCSLTITDLFLYFVVETGFHRFSRDGLDLLTS

SEQ ID NO: 953564 - protein, 43 aa, Homo sapiens
MVAPLHSSLGDKARTRLENYTNKNKPLFFSQKFHIVQRLTGIL

SEQ ID NO: 953565 - protein, 133 aa, Homo sapiens
TLNYAELCGSFVLFCFVLRWSLILSPRLEYNGVTLAHCNFRLPGSSDSSVSASHIAGITGVHHHTRLIFVFLENPVFYKQGFTMLARLVSNSQPQMILLFHTHRVLLQVGATTPSLIVVLICTFLIASDIEHL

SEQ ID NO: 953566 - protein, 57 aa, Homo sapiens
CGPLLGVLHAFSRAGRMGRLVPRQHCPHVAFHTRCPRPAHTGFGSQCMAASRHGSRS

SEQ ID NO: 953567 - protein, 57 aa, Homo sapiens
LQKAKQHVHHAAKHGMQSIKCTIHHCTQQSGPINHSTAPFTLSCIPTFTMGVISHSQ

SEQ ID NO: 953568 - protein, 137 aa, Homo sapiens
ISRTRQTLNYVGFKTSVVKITVDLLQIARERDTEVEPEDVTELLNLIKLVGEELLLMDGQIKWFPEMESTPSGDEMTTKDLLDKAVAGLEKIASNFEGSSAVAKCYQMYCILQRNLSRKKSTDAAFITVLINCHSHI

SEQ ID NO: 953569 - protein, 124 aa, Homo sapiens
MRDASINSHSESYISSNQGSMGSINDPSNLFCIGSKSLFGGAGCQMIPPKRPSDSTPADYIWNINSESSPEGFNYIKGNGHIRTRESGASQALLTPPLLYTKPLELGRQSLAKGLIWMEASRMG

SEQ ID NO: 953570 - protein, 68 aa, Homo sapiens
CRLEDPMRDASIKIISGGKNKKREARVWWLMPVIPALWEDEESGSRGQEIETILTHMVKPRLYYKYKN

SEQ ID NO: 953571 - protein, 108 aa, Homo sapiens
ADLEDPMRELHQILNMSTIPSLLSAELSFFLLGNEVWLCVTQAEGEGLISAHGSVRLLSTSDSLASASQCSRGPRAIRHHYRAKFLDFKQRGGTTRRARLGRELPTSM

SEQ ID NO: 953572 - protein, 41 aa, Homo sapiens
TASSFAISFSVIMPYGPNIQQGNASAIARHSGHGAILSGSR

SEQ ID NO: 953573 - protein, 67 aa, Homo sapiens
GAYLYTNDIQAESQITNAILFTIATKRIKYLGIQLTREMKDLYNKNYKTLLKEIRDDTNGKTFHTYG

SEQ ID NO: 953574 - protein, 64 aa, Homo sapiens
RRSRGSHVIANTCPSLPSLASATSTFWYTYLSGPSPLYHYTFNQHIFIENLHELGIVLGVGDNI

SEQ ID NO: 953575 - protein, 98 aa, Homo sapiens
MNERMNESTRVHRMESNGMECNGMDQLEWKGKSGINDEWNGMDWNGMEWNQPEYRRMEWNEKQWNGIITNGMERNGKDWNGMEWNGMEWNQLHCNTVS

SEQ ID NO: 953576 - protein, 68 aa, Homo sapiens
RSGMISAHRNIRLLGFNRFSCLSLPSSWDYMMSATYAYTKFFVYFKLEEQKFLPMFGPGLGGETPWAL

SEQ ID NO: 953577 - protein, 60 aa, Homo sapiens
ALPTQHSRRLCVTGSRVVCSQRCVQAPSTLVVLTCGPIAFFISNHCMHGTASRHGGILSA

SEQ ID NO: 953578 - protein, 55 aa, Homo sapiens
MRGLHQMSPFAMTAPNSRGLCTGEGAVSSACEAPDSRVLMGPLIFISILLMEASR

SEQ ID NO: 953579 - protein, 86 aa, Homo sapiens
RERMFTGDIISKTEYRAGLCVALGNLSSRPILDRRARYVMPESHTRVLDKYEVFAAIVSRKLVTGRGTHGKTITDAINIGIGGSDL

SEQ ID NO: 953580 - protein, 79 aa, Homo sapiens
DLEDLMRDASIKVTEEELVPFLLKLFQIIEKEGLLPSPFYEASIILILKPGRDTTKKENFRPISLMNIDAKILNKILAN

SEQ ID NO: 953581 - protein, 41 aa, Homo sapiens
TDASGDTGQVSVVLEKEQAQVSETHKQGLIWEVQEKKQRQV

SEQ ID NO: 953582 - protein, 40 aa, Homo sapiens
NPAVKWSRQKEGNPSYRMRYKFNHQYMSRIKTYYRGDLFC

SEQ ID NO: 953583 - protein, 46 aa, Homo sapiens
SRNSPGDSSLTAQGGGSWQKSVCWSGARAAVVGCGYFNRGGCGARR

SEQ ID NO: 953584 - protein, 63 aa, Homo sapiens
QDFRAHSQPDEPFWWADTTQLFLREHPQSSIIRIGLRVWTRCTQFILMGVIAIFCGIPSVGMA

SEQ ID NO: 953585 - protein, 38 aa, Homo sapiens
CVISSNPSVLFIIIIIFFSFSFFVMPYREPSSELNASV

SEQ ID NO: 953586 - protein, 47 aa, Homo sapiens
GRDFMSKTPKAEATKAKIDKWVLIKRRAPATAKISKRRGDTEGTRHF

SEQ ID NO: 953587 - protein, 35 aa, Homo sapiens
RVHGMLSSSDLRTRRYYCARGVEGGYYYAYRGQEL

SEQ ID NO: 953588 - protein, 77 aa, Homo sapiens
MSVMHVDGCMTEAISLEDQIIHSTNSQLGTVADTHTYTHTHTSQTRRLRVEYTCVYRVFYMLKCSLSGVSPVYELRA

SEQ ID NO: 953589 - protein, 62 aa, Homo sapiens
KPNSEYSAVSQRDETIYVKVFLHSLPSKRILDMSTLVFSYNQATVAQTISHDSYAGTRVNYY

SEQ ID NO: 953590 - protein, 34 aa, Homo sapiens
KDELYKGSGQDSRNVHQQHDDGSARGVDFESLGQ

SEQ ID NO: 953591 - protein, 81 aa, Homo sapiens
HSYDRCSRMWDSYLVYLEHVRVEEDRLCRTEVEQSGVPSIKETALFHRGLVFKKWNLTVLLLPTPPPPPHSPYSQSTTAVA

SEQ ID NO: 953592 - protein, 37 aa, Homo sapiens
MAVLEEEDLGGWKVNMFPRISNVSHKKVVLPLVQRRQ

SEQ ID NO: 953593 - protein, 68 aa, Homo sapiens
ISCTCDPPASVSQSAGITGGSPHAQPVACYILEWLITGRPIVSVHSLVKELKVDIGFEMVPNPADPLQ

SEQ ID NO: 953594 - protein, 58 aa, Homo sapiens
MATFQSGITLKRKPPLLAASEPSLRWTAKKPSFSELIDTLVTSTSGTSDLICPDFWSA

SEQ ID NO: 953595 - protein, 148 aa, Homo sapiens
MVFVHAYLIWIRGQKRRGGKFSYLLGVYRSGNLAHQSPANIHSGHIKGKRGCSENAEGNRSEGSWHWAPPSGGTGLISLVAMVTTMMAQGLRKHAQHLQFIFCLRAGRATKQFHKEAAERGVGCLCQAAKSFVFSLLWSPMPQSEYWP

SEQ ID NO: 953596 - protein, 85 aa, Homo sapiens
RSPAVRVNRIRLLQANYSCSIIGSSNTSNININLTSTLIILTILILLTILEMVANPRIGDHSKYDKSSSEVDKFSAKQGIKTTPC

SEQ ID NO: 953597 - protein, 86 aa, Homo sapiens
RVVHILAPGRGYKYDRMKTCLLMRAGSQRPRASKAVQRMEWQVKVQELDPGGEKSLCVNWGALISNVLIDRTSMSDFVVVCRRCHR

SEQ ID NO: 953598 - protein, 149 aa, Homo sapiens
LAVSPDRRPFQPLQPPIEGDVRRVSQSLLHETGLVPVVTRNLLDMGTRCMNVNIHLTTGRSLKSPTVSTMIHYLGPEDSLRPSIWLGWLSNGHYDAVFDHSKPNPEYDNWCKQTQVQRKRDEELAKSMAISLSKMYIEQNAALEMVANP

SEQ ID NO: 953599 - protein, 105 aa, Homo sapiens
MISFDSMSHIQDMLMQEVGFHNLGQLCPCGFAGCSLPADCFHKLVLRVCGFSRCMVQAISRSVILGSGGWWPSSHSSTRQCPSGDSVWGLQPHISLLHCPSRDSP

SEQ ID NO: 953600 - protein, 168 aa, Homo sapiens
CVNGIITNTLMPSNSSQAYSSSITQKSKSNVSSETSYVPSAYEPVKSKASHFLDEWGYRHRVNTPITNGKNWPKQRDCRPHTSLKSNRADIKPQSSEMISFDSMSHIQDMLMQEVGYHKLGQLCPCGFAGCSLPADSLHKLVLRVCGYIQDAWCKAISRSVIQGSGGW

SEQ ID NO: 953601 - protein, 70 aa, Homo sapiens
VRGSRIGDMSRNTRGQPYVLRSLQAKLGCEEKQVSPSRVNKIIKMQKLHIHAVREAAKGFQQLFDSCTIQ

SEQ ID NO: 953602 - protein, 77 aa, Homo sapiens
MVPRHSSRTNFGIFSTAQGFTMVGQAGRELRTSSDPGASASQKAGIKDVSHHAGPHGYFYYYLDYTGRMGRQSGVPS

SEQ ID NO: 953603 - protein, 220 aa, Homo sapiens
GVLEDPGMTTYSDMEVPTYRCPYNTVYKNRKGVSSRDGENFGKQVTSVLQTQGKSWKLDMPEYFSRLGGELNQALQNTRKSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKADENYYQKKHGGLFYQIEMVANR

SEQ ID NO: 953604 - protein, 48 aa, Homo sapiens
LRRRHYEMICCSGHEALGFILLFTVSGLTGIVLANSSLDFVLHDTYYV

SEQ ID NO: 953605 - protein, 148 aa, Homo sapiens
MSIHGIYSCSVRALLNIVVQPGYISVLIVVEKESLLCSSLGSRVGIVDLLVVLGLTLLIRMIRASPSIEEKEVYDGHYTGPPFINRVSHQMSRLLGSPPSDTEGLVKSLPSGSHQGPVIYAQLDHSGGHHSDKINKSESVVYADIRKN

SEQ ID NO: 953606 - protein, 56 aa, Homo sapiens
ATSRTQGKIKLQMQEFSGGDTFKKHTTGKDIVGPPTMVKFQKLLQLLRLHFSLLLH

SEQ ID NO: 953607 - protein, 87 aa, Homo sapiens
GTWYRYLCASKQGYQFIYVLIALSSKAGIWFKQRLASMPDEVSTAHLSVGDHKLRDCNGKSGRKQKKGMEGQLVMSFADSDPPYMKL

SEQ ID NO: 953608 - protein, 54 aa, Homo sapiens
LEDRGIQALLNNQLPGGKNRARTHYCKTTPQTLIREIRSMLKTPPAMGDQSFNH

SEQ ID NO: 953609 - protein, 46 aa, Homo sapiens
MVLCWGSMCGCIGCQIEGLSLAVQAGELTAASTSRAQVFLQPQHLK

SEQ ID NO: 953610 - protein, 105 aa, Homo sapiens
MDEVLVVQTEDQTSHNIPFIQNRIQSKALILFNSIKAEKVRKLHKKRLTLAKGGSGGSQEETISTIQKYKVKHASADVEAAACYTEDLAKINNEGGYTKQIYKWR

SEQ ID NO: 953611 - protein, 36 aa, Homo sapiens
SGKWMRYIIIAIPSGAKYVAELLQTLTEGNMKLICV

SEQ ID NO: 953612 - protein, 43 aa, Homo sapiens
MRYLALSTMNLPVYTYHHSQVLSSTVISYEICCTRQSNLSWGI

SEQ ID NO: 953613 - protein, 80 aa, Homo sapiens
KWNRHLSLMVLQELQCGYQGKAISNLTKECFSINFQRTWCPGVGLLADVSQQAKKDSKQVRVILLIWFRSVSPANSHLEL

SEQ ID NO: 953614 - protein, 101 aa, Homo sapiens
SAGYQMIRFRLPSQQGRDSKIAIIIKFSLCIYLFTYLLTESHFFFFLERESLSVAKAWSARALSGFIASSASGVHPKFSLPQPPKYSGIYRLVPSHLANYG

SEQ ID NO: 953615 - protein, 33 aa, Homo sapiens
IHGIRYHYVQCAKTTIIEISPKFTISIISNNAC

SEQ ID NO: 953616 - protein, 104 aa, Homo sapiens
AFTACIINVILSFLGLGCNVFLHLNDLRSFHILNYISVISATSAQFRTLAGEVVSSFGRMKALWLLCCQGSCACFFSSLGADVPSVFKVAALWIFWYLLFNLCS

SEQ ID NO: 953617 - protein, 61 aa, Homo sapiens
MTILIASMMWTMNKNAKGSNYVEKQDNDGGKKFLDAGAQNSSLDCSYPAKSFRPVNFSRFF

SEQ ID NO: 953618 - protein, 47 aa, Homo sapiens
MAYSAHSPFLLLCSGRAILTQLGNLASLVACPRHSTFILFQMDSQTM

SEQ ID NO: 953619 - protein, 77 aa, Homo sapiens
NHIISGHMSDKAKILNPAEEKYFHTVNQEFSKVILELDAISDLEKGLLLYNYDSNTRHWTRPPTVNNGKKRKYIKQY

SEQ ID NO: 953620 - protein, 57 aa, Homo sapiens
KSSAVMGMCAQDQRPVSLVHSQCGPLSDDRHKVMVERVYISWDPVFSCGSPCTIAWL

SEQ ID NO: 953621 - protein, 47 aa, Homo sapiens
VVGRSISVVGAVVGTARLKGISGALGNFSAWVSQATITQLINQSSCS

SEQ ID NO: 953622 - protein, 81 aa, Homo sapiens
SHLDYSSRFEIVSSISISTCYTLYLFLDRVSLCRPDWNAAGDISRLTAISTSQVQAIPMPQPPKYPGPHTCAIMPGQFSYF

SEQ ID NO: 953623 - protein, 118 aa, Homo sapiens
SRSLYEQVVAASILGHFINWLSDEQAVSNEGGQDDYAKDRDAISGHQKGPAYTEDTAVGDGWNFSRAEQYPSLLMIFFLPHSAPMHVDLVRSEGHLHPQGLDGLEHVFFSELHLQARN

SEQ ID NO: 953624 - protein, 34 aa, Homo sapiens
TVVTLVNTPLCCYPQLKSAIASTIPPFLPSLDVN

SEQ ID NO: 953625 - protein, 64 aa, Homo sapiens
RKRKKHRSPSSGERKGNSPSTNEEKNLVESAGEADPKEVKGPETKREKNQYKEYHETRETLWEH

SEQ ID NO: 953626 - protein, 75 aa, Homo sapiens
RVDHASPTHGIPALWWEWIDTHQTCMQKTSYSSSSAYDFYGSSVIRTGKYTINHSYGWSVASSVVNYHHQVIIFS

SEQ ID NO: 953627 - protein, 104 aa, Homo sapiens
PSYRSICTEVNNTTGITHSEKNDKERGIPTSLHLTPKPMAAPCHRVCEHLLHSECAKYIKKHDGLTEQQVQITEIKVICKKRLTISHMKILVYNYKRKPYIIKK

SEQ ID NO: 953628 - protein, 122 aa, Homo sapiens
NELHRFLTITTQDKKQIRYSRNGSKHDYTGSTLSQLLKPTERKDKRIPSSKQAPTQVIVQQLTAYRRDHYGMMLVALPHRWIKHHYFMIRGHWPWLLQHSLAQSQAQTWHFHYQHLEAELIA

SEQ ID NO: 953629 - protein, 59 aa, Homo sapiens
TKYSGLSDGYGSPPTCTGETYSDCLSGMYDHRYGDSKFTVQSTTGHLCPHYRGLPYKCD

SEQ ID NO: 953630 - protein, 41 aa, Homo sapiens
MLIPFNIPVQPFSICSTITGHIAAVSGHTGASHVFLFQGMQ

SEQ ID NO: 953631 - protein, 61 aa, Homo sapiens
ASPVVLCAQQQHHTFRSSLITSHVSCHSSDSTALRSAAFHQHNSQAHQRHPQHKHLTSLSS

SEQ ID NO: 953632 - protein, 50 aa, Homo sapiens
SVWEGHYSSWQHRILNPLSEARDKTHIFMDPIQFLNPCAMKGNFPKLVRI

SEQ ID NO: 953633 - protein, 116 aa, Homo sapiens
RLFTGLDYVNNPLYPTAKILGTAQMQERQQSSNLRGITYDSCELHEKDRGIHSPPPLQKEVQHFSYVSQKVSGFSAVSFNFLCGHQDWPKDKLTRLDLKISTSFIATSRIGQCLIP

SEQ ID NO: 953634 - protein, 76 aa, Homo sapiens
ISKGLQKFAQQWMHMPCRAPQQASFPRSSPHPLSPPIQELTTYEQTHFSPSLVISTLGLITEVTAPAKWSGKFLKS

SEQ ID NO: 953635 - protein, 30 aa, Homo sapiens
MQISMRQEMELAMKMLETDVCEKQDALDIS

SEQ ID NO: 953636 - protein, 120 aa, Homo sapiens
MCIYQRFRVGFLTGLSDSYILTDWPSFQMDTEDAVRNTWRSWGHRDSGHHDEAWAHNLSNYTLPAFYMGNFSIPSGIPDLPQDTFIQFPGWTKGQVCTNGFNLGRYWPARGPQLSLCVPQ

SEQ ID NO: 953637 - protein, 100 aa, Homo sapiens
MMIELTEVLGGVKRRGPGSKSPVFLLSYVTLGVWYNPAELLLPYLKNVGFHPSLPTAVWITEKAPNTVSDHALGMLEICDSEMHGVTRGQITYLRGSELD

SEQ ID NO: 953638 - protein, 70 aa, Homo sapiens
QQFSQLKCKTGDKPVLRVDTSNDSLGTTSHSSLKTQPFLLAATLPERKWWSTISTEQQQYIGSTDVLWAD

SEQ ID NO: 953639 - protein, 71 aa, Homo sapiens
TFGSVYSDRVYVIRRTRAKQEQAGAQCKHIAIGRKPSSSGLQLYKPGPGPLQRTSSSLVAYASTAGGLQNR

SEQ ID NO: 953640 - protein, 52 aa, Homo sapiens
SVDESSGLRCGWCTGQLSAFRTGRSSRVDSSGAYSTAAAVRRRFIHVFHFSG

SEQ ID NO: 953641 - protein, 36 aa, Homo sapiens
APLSSSIAILRGPRGSLPAFSCSKSGTYGSLAISGL

SEQ ID NO: 953642 - protein, 48 aa, Homo sapiens
KYGKREQDYYHYIDKGPFEQGKTLKRMAREAEKVQQLTDDDSSRDTGV

SEQ ID NO: 953643 - protein, 102 aa, Homo sapiens
VFLRLTFTFDIDANGILNVSVCGQRVSGKENKITIIKDTGRFEHEEDIERMVQEAEKYNAENEKQRDKVSIPKIHLSPIPFNMKRTVEDEKLSTARLTMRTN

SEQ ID NO: 953644 - protein, 52 aa, Homo sapiens
KTHFAYALNLPVCRNSWDRAKTNRLGRSSVFYCFNSKLFYGPYPLTFHLQCS

SEQ ID NO: 953645 - protein, 79 aa, Homo sapiens
VSLPVDKSTGNRELDSLSSNRQGAAFEQGKTLTRMVQDAEKYKAEDDKRRATLSSMNSLHSYAFNMKATVEDDQTSRLM

SEQ ID NO: 953646 - protein, 122 aa, Homo sapiens
MTRAGRYGPTLNVVVQGPDSYQAEDEKQRDKVSSKNSLESYAFNMKATVEDEKLQGKIKDEDKQKILDKCNEIINGLDKNQTAEKEESEHQQKELEKVCNPIITKLYQSAGGMPGGMPGGRR

SEQ ID NO: 953647 - protein, 52 aa, Homo sapiens
MTYVSSILPGTFSGAHKAEPADNTHLRVCKAVNPGRTSTLKEDYDEAWTVTL

SEQ ID NO: 953648 - protein, 36 aa, Homo sapiens
EDRSNPRRQSVAVTLMVAPLPSSLGHRARLRDSVLN

SEQ ID NO: 953649 - protein, 96 aa, Homo sapiens
VKWYKLSEMESGPSPRSEMQWSHSQLMATSASQVQAMLLSQLREEDGTTGTYHHAQLMVVFLVEMRFRHMGQSGLELPTSGDLPASVSQSTGITAV

SEQ ID NO: 953650 - protein, 72 aa, Homo sapiens
RSSKQGKAMRAGLAQICYCKNSCITTKSSVCAIYNNPFKAITYLGLEVHSPHMYFKVRALSISENQTVQVCS

SEQ ID NO: 953651 - protein, 56 aa, Homo sapiens
MVVGAVHHPGQVIIAEGSHTGMGVLSTCPELGLGEAWGEMEEVFLEVVTLEQVLDK

SEQ ID NO: 953652 - protein, 48 aa, Homo sapiens
RIRYSAGLLMLTMSVDYEQNAKGSNQPEKQGNDGGKKFQDAGDRISSL

SEQ ID NO: 953653 - protein, 84 aa, Homo sapiens
LEPHVIDTEHHFKYRLSSKVGEIKKLWFHRSASNESKLHDQVNPKRMLRSLKNTAESGGRRREKQRIEGKTPHRSAISVLKQEP

SEQ ID NO: 953654 - protein, 34 aa, Homo sapiens
TFSNPVITKMSAFKSTRRDNVYELLARVGAPTIF

SEQ ID NO: 953655 - protein, 171 aa, Homo sapiens
MSGWTPKALRHGLHLCICSIQSPQLPSWALLVQSACESLPTEGTKLWWVHDSGVCMMVASSVEAPTPIFSFCTALVEVFQEALLFWQLSVWTSRHFHTSSKIYMKALKPLGYCSMDSLAEDYVEAVKPYSCTLCSSDAICTLCIFQPRSEQELRLLGCRQQYPEAAHSNRA

SEQ ID NO: 953656 - protein, 50 aa, Homo sapiens
TCLPPTEPSIHMTIGDGMTPSVVHECRIPITWHCHILLRHKQPQKHRKQG

SEQ ID NO: 953657 - protein, 35 aa, Homo sapiens
SRVCKAWLTQIHKSRKNLIINDDVLSHSPLDTHVL

SEQ ID NO: 953658 - protein, 37 aa, Homo sapiens
MEAAVASAPALTRYLLQPSDLTAGGLPGFCCPTCQKF

SEQ ID NO: 953659 - protein, 34 aa, Homo sapiens
DHVGGRQNSPTSHESLEVIIALPDTKTLRAPRVE

SEQ ID NO: 953660 - protein, 82 aa, Homo sapiens
PSGRCGAGAGAARQCVLTSTVEFQNVAALNRTIERSRCGLAPFAVAAIPTMPYRPEAFHIKRCMPSAPYVQVNTMIKQHTAV

SEQ ID NO: 953661 - protein, 127 aa, Homo sapiens
AFTDQCTGLQRDESRLLSTSGTGLSLTLSDSCERVTVSLFGVWLLSLSIMSSSAIHIAECVRISFLYQTENTPLYVRTLCLSITHQQTQPVSTYGHWEQRCYRPCDYAHPLESVFSYFGYVRKAVKA

SEQ ID NO: 953662 - protein, 38 aa, Homo sapiens
LISIKREDNYDPIVTIAGIISEWCFRSLRSLVIHIGTN

SEQ ID NO: 953663 - protein, 47 aa, Homo sapiens
RAFSSVSLFDVVILHLLHFLFSSAFKNLCKPSFWPMLRIVGHKQHFD

SEQ ID NO: 953664 - protein, 68 aa, Homo sapiens
SRCRNKKGAMVYHREGEETVDSNGGHKNAESLGLKYEMVVCCVNQSFLKNEEDYFGSSLTNFDMQVKA

SEQ ID NO: 953665 - protein, 58 aa, Homo sapiens
RIPSFSTGIYVTCTALYANYTSLSKGLISTLFFMSSSNTVLLVCRTHAYSVIPSFVAL

SEQ ID NO: 953666 - protein, 48 aa, Homo sapiens
FPCCACPETKTARDAVSSSQNRQKNNLCDLLIAGPQVNALQSPEAFQQ

SEQ ID NO: 953667 - protein, 140 aa, Homo sapiens
FVPSRDLLPPANVVTFTVQAPSRFSCALSLTNDSGVARVGLRSRPRAESGSGQGFSICGQQDLLQLHCACSFWDSVTTSPFPGLTGLVQNRLPAVAFLGRLHLRPIVFLFAEAKEWTGTEIRLSSPSCSLRSVAISMSRA

SEQ ID NO: 953668 - protein, 106 aa, Homo sapiens
ACMWGNLGHGNSPVLRFRDSPASGDPACSASQCAGITGMSHCAWPVHLTFEFSYLIRLFLAMTDSQISLVFDDLDSFEECRSGILVRVSLFWNLSGVFLIRYTFLA

SEQ ID NO: 953669 - protein, 48 aa, Homo sapiens
TARDMSPVLSKKILSGCRDSVLRYIVHLDNKEWACPEEDYHDSPKSAR

SEQ ID NO: 953670 - protein, 40 aa, Homo sapiens
AGSVLDGSVHAGSVTAGQCHTPASVNRAARCKTRGQCQPT

SEQ ID NO: 953671 - protein, 42 aa, Homo sapiens
NSKWGYLVAWVRICFVVAVVWVAAVVMVRFPGPGTYAYCGCS

SEQ ID NO: 953672 - protein, 44 aa, Homo sapiens
MAAPETYGSPQARDPMELQLQAYAIVTPDPSSICTLCRSWPSLR

SEQ ID NO: 953673 - protein, 67 aa, Homo sapiens
RVIRRSHQTMIGFNHITNNQIRIFIRFKIGSNRKVDVIMQDIYSTDRELKRYFNFRVEFLKTDLKFF

SEQ ID NO: 953674 - protein, 44 aa, Homo sapiens
SNNHKMPINLSHAYRLITEYNSKSILMKLDLRLHFGLNLEAVKA

SEQ ID NO: 953675 - protein, 45 aa, Homo sapiens
MRPAVILHFLRKLCLVQLRLWCIHADVSTCLKLSTRLSLGMHRIH

SEQ ID NO: 953676 - protein, 67 aa, Homo sapiens
PGSADPGVLGPSAPSLLKSRTGSDRGGSTLPEDALPQDGWALCLRSGVGGQPSAAAHTLPSPDLHRG

SEQ ID NO: 953677 - protein, 35 aa, Homo sapiens
STPSNHIQCAIKSLSRITEIQQCGGLPCESGLAHA

SEQ ID NO: 953678 - protein, 43 aa, Homo sapiens
SIVSPPLPLYYLSLLKMIQIGLDIGWLTPCNTQHFVEANAVGD

SEQ ID NO: 953679 - protein, 32 aa, Homo sapiens
MSANLNHSQQTCFNIVSHGQQACGVTELAIRQ

SEQ ID NO: 953680 - protein, 40 aa, Homo sapiens
DVALNGICCTLSHERHRPMQRDSASRQEYRGPAVNIKANQ

SEQ ID NO: 953681 - protein, 69 aa, Homo sapiens
RIAPTEQQSLCDTSLDCCLDNQQESMYRNPLMGEDGLRPISLAPIKPASLFDTSLDCCFDNNMSQCIKS

SEQ ID NO: 953682 - protein, 122 aa, Homo sapiens
PKLQCQQERDELADEICQQHVAKEPWRYTEKRRLDGPHSPELEERTLEEDQGNTAADQLSRLKKANLQIDQITTDLNLERSHAQKNDNARQQLERQNKELPVKLQEMECTVTSTYKGLHQRP

SEQ ID NO: 953683 - protein, 36 aa, Homo sapiens
YRCRAWCPADNQNFPQTLLLYGPWVSLCSVNAILDH

SEQ ID NO: 953684 - protein, 42 aa, Homo sapiens
MCEFMTINSFPEKCSQRRTWLMPVTPSTLAGQCSRRNRRGLL

SEQ ID NO: 953685 - protein, 73 aa, Homo sapiens
APIRPLSRYSKSMQFTEHRNMIDPGISSSVTYKHQTLFQSQRTTIGHFVLFTFNKPALEPQTSYFQYHPFLAL

SEQ ID NO: 953686 - protein, 97 aa, Homo sapiens
IAGAFTSEQYTIIRITGRRYTGNQFPIDTDSGAVVSTRETVYRLWDYKARLPAPGNTLWPAVVVHSPEVRSSTSLATVVTPISTKNTNFVGHGGACL

SEQ ID NO: 953687 - protein, 52 aa, Homo sapiens
RFLVLLALIGVILTAPSAYDKQTYKSLIAYSSISHIALVVTVIFITNPLKLH

SEQ ID NO: 953688 - protein, 48 aa, Homo sapiens
EQLYMHWRRFTNSYTITGRSYDTNSYDQCTGLSYYTNSYNHAVAVVLT

SEQ ID NO: 953689 - protein, 82 aa, Homo sapiens
AYIVRSIGSVVGERIALGEEKALELGKPLTSASTASEGARIQESLFSLMQMAKTSSGARQAARQGPAVHLGDDPPDQLGPTW

SEQ ID NO: 953690 - protein, 41 aa, Homo sapiens
LAGLTSADLTGRLLNHVTRAVQSLWKWGFKTMPFRLCAMVA

SEQ ID NO: 953691 - protein, 125 aa, Homo sapiens
MVKATASALKCAGSVRRWPYRRGSSWKKQHEAQARSREGNYTSRSRHSRNPEAANFDRGLNQQLLRKPCAKAFQRISELQRTCGRTYSGKLAKNSGKAEYIEQVVYTCEAKVQKMFKKTLDGELE

SEQ ID NO: 953692 - protein, 38 aa, Homo sapiens
AYVCGSYGPVLNHCGTRAAVLVEVGLQDHAIPAGAMAA

SEQ ID NO: 953693 - protein, 49 aa, Homo sapiens
LHVGVAPHVSRVAQACVGVLLSSLVGGSDPRGHACLLRAQTPTCRHPRA

SEQ ID NO: 953694 - protein, 51 aa, Homo sapiens
TTDPKMYFHHVTDRSSRKHELFYKRYPALALNRWSVMYLVSDSAAQTRAMK

SEQ ID NO: 953695 - protein, 57 aa, Homo sapiens
SLPVGFYPSSWRTTIPASGFVDGVSPPRFSTGYFPLRNRIGILVETHSVAHRTPDHC

SEQ ID NO: 953696 - protein, 37 aa, Homo sapiens
ASFTLTAITITARRFTLTAITMHWPVVFTLNSYLPCT

SEQ ID NO: 953697 - protein, 63 aa, Homo sapiens
LPGDTRLMRMPPVVHDWMSAAGGRRSANGKERLQTDLPTADPKALVWISALQTIQKPTVATTV

SEQ ID NO: 953698 - protein, 54 aa, Homo sapiens
HVVEGDSFRRNYAARARPQMLMLHRVMRCSMSIARIVLPRYSYEMAGATVDADH

SEQ ID NO: 953699 - protein, 139 aa, Homo sapiens
RHQLPITSQIHCHKIDITSHRQSSTSRAYDEHSNYDPQHDPYRPNQESYHSQRANYSHQTQDDRRDVSRSGADNRGYGGSQGGGRGRAVYDKDGRGPMTGSSGGDRGGFQNFGGHRDYGPRTDAASESDNSDNNTIFVQ

SEQ ID NO: 953700 - protein, 55 aa, Homo sapiens
LSRGTEGTQITTTISIYVNELTSLSQVEVIFSIVLADIARAEMLLEEAKRASKSA

SEQ ID NO: 953701 - protein, 40 aa, Homo sapiens
QRFTALDPSPNGKQLATVSWDTFLMLWNFKPHARAYRYVG

SEQ ID NO: 953702 - protein, 55 aa, Homo sapiens
MLKPRLYQEYKNKRGVVAGAGNSQLLWRRDGSLELEEVGVAVSRDRAAALHPEVT

SEQ ID NO: 953703 - protein, 71 aa, Homo sapiens
SPTNNINIIQHQHNSSSAGHNSFNMVFAGTFVQSVQVMASAGSAMSTSVAFEATQHHTRNHVAASPPSTHQ

SEQ ID NO: 953704 - protein, 152 aa, Homo sapiens
CPCTLALKNNEVGETVAQLVISELSELTSDPAAHPPKCAGVIGCKPPVPYLRCTFRLRKPRHREDRSLAWCQDRPVLRQPFLQDAPTVWALGSSPAFPEAVVMHQALLLGAAVEGCVLGCGVYPLLGRWLSPTSCLPVTKEGAKVPYSQVLV

SEQ ID NO: 953705 - protein, 38 aa, Homo sapiens
YEQAKSTSSNSQRKGNATATRHAQQVPGNTTDRGHPLS

SEQ ID NO: 953706 - protein, 144 aa, Homo sapiens
YSTVSACGHRVRENENKITITNDQGRLSKEDIERMVQEAEKYKAEDEKQRDKVSSKNSLESYAFNMKATVDDEKLQGKINDEDKQKILDTCNEMINWLDKNQTAEKEEFEHQQNELEKVCEPSHHQACTRVQEACQEECPGVGG

SEQ ID NO: 953707 - protein, 49 aa, Homo sapiens
GTASVHFHLGLHLHCLGRLLLSTGLRVISVLLVDGGFRYLSFNAYSWLG

SEQ ID NO: 953708 - protein, 146 aa, Homo sapiens
DINVSASYTRVGNYKEAYYHYSDGGCKSKEDIERMVQEAEKYKAEDEKQRDEGVIQEFIDVHSAFSMKATDEDQKLQGKINDEDKQKILDQDVMIMINWLCIGIRQLRRQNVNINRKSWRKFANPIITKLYQSAGGMPGGMPGGRR

SEQ ID NO: 953709 - protein, 103 aa, Homo sapiens
SEISVLDNPGSLRGFSIYTTVPGSFFKAWRLGEARTGGMGCGEVQDNKTAHQDGGCADKLKNVTLTLRNLEVPPPRRLRGEEPHSGKFRARMQDTFLNQNLTA

SEQ ID NO: 953710 - protein, 120 aa, Homo sapiens
MLARLASNSWPQVTHPLGLPKCWDYRRELPRPTKYVSNYGDQKKVELLNDKPRIEFCILYELTLHDHISRKRKTDKICHHQIVLPDMLTIVYTTVKLRSLRMNDEIKISTYWGKLNISGL

SEQ ID NO: 953711 - protein, 53 aa, Homo sapiens
RVSDAMYASLGNGYFERVRLTFHKIGHGHRAAEETGLHLSLPRTCLGCSGMPK

SEQ ID NO: 953712 - protein, 105 aa, Homo sapiens
QLGVGSDMDLGEIKELISTTPEEGTEDNLIEMSVSEPVPDNEEEDVEEAVRENTLTLGNLAEGFCLFKIALDFFYDMYPSTMHALKLKQTVEELVLYRHIFREIK

SEQ ID NO: 953713 - protein, 120 aa, Homo sapiens
PVETPDANPATIRSKSSTIFGIPIACTPQVAYKALVCKLVCKEWCIMRVAAVDSALKELLERCAPDIGDRLPAERDIAAQMGCSRQTIRIAFTKMEHAGLIWRHVGKGTFRGPAPLDVPL

SEQ ID NO: 953714 - protein, 37 aa, Homo sapiens
RYERWVSEHSFIVFTAAPQILHYCLSSASRQVSSSIR

SEQ ID NO: 953715 - protein, 118 aa, Homo sapiens
RTLINVASSNYVSLPPWYHSYLLFIPTYILQISFCLHCVCVCVSYRFEGAHQLETITPMFITCRRERFISYKGLQPRMVAIMTGCRSVPYCQGKRQALPGREDEDRTEKLSELTTYTY

SEQ ID NO: 953716 - protein, 35 aa, Homo sapiens
CSVSPRRTSVDLPVFEMLLAPIPLLGLTSGGTALD

SEQ ID NO: 953717 - protein, 71 aa, Homo sapiens
ISVKECAFMAATQGLTLPPAIIAELMPLEVQMNFIHENFLLVLTRELGVDIDRNPELSGMVRSINKFGQLP

SEQ ID NO: 953718 - protein, 88 aa, Homo sapiens
IQNMDKIGNKSRLCKFYHTTMCIYEKQKTRTFAVQSTVTSYVITQTKVMKSQMKMAGASVYHSNNTAGSSQEDGSTKDITNNAELPEG

SEQ ID NO: 953719 - protein, 70 aa, Homo sapiens
GQQERPRMMGTYRGDPNWFMKKAQAHKREYTESQLQEEKACHMDLSDGTATEGPPSAGMTGYGRPRQIIS

SEQ ID NO: 953720 - protein, 38 aa, Homo sapiens
SQVTWTSQEEIGPRGPTDCGWVTEVTMQWIVHVLLLDD

SEQ ID NO: 953721 - protein, 33 aa, Homo sapiens
MESPSCPSPQMCAYPVQRLLLTASLLTFWNPPT

SEQ ID NO: 953722 - protein, 57 aa, Homo sapiens
QHHILTDGSPHQSQTQALVLEEESEWLDRQDKPTSSRDWCDPTASPVPGDACRHPPP

SEQ ID NO: 953723 - protein, 66 aa, Homo sapiens
LFPSREGVVLMGKNIMMRKAIQGTVENNPGSEETAVLIIRGNVGFVFTREDLTEIRDMLLVNKVPA

SEQ ID NO: 953724 - protein, 38 aa, Homo sapiens
PCSDSSRISKPRTENQKLPESADCFCIVSTGQPGEPGS

SEQ ID NO: 953725 - protein, 46 aa, Homo sapiens
DSGCVCIDCEQTTYMVLQPAFWVAHNLVISAKMDISNKGTFSGPLQ

SEQ ID NO: 953726 - protein, 68 aa, Homo sapiens
RSAHGLAVFESEHLPTHGGSLRVYAQRLDTGKHDVTAEVARTLDEEQQAGMTGAAFYERFQQQAERIK

SEQ ID NO: 953727 - protein, 35 aa, Homo sapiens
QIGENKYRFGDSQQLRLVRILRRTVMVRDTELKFV

SEQ ID NO: 953728 - protein, 53 aa, Homo sapiens
AVFRRLRIRNCGDIFLGLMASGSDLALLPFYGLKSCSHASPWEAARVNIPFAQ

SEQ ID NO: 953729 - protein, 75 aa, Homo sapiens
DARLKEPDTAWRASQSSAFFLTAPPQPAKSAASGCTSRARVTVPIEPHSCPVQAALGASVANTHMHTYNALRLQK

SEQ ID NO: 953730 - protein, 44 aa, Homo sapiens
MSEDNATEEEILIYLEKTCDWLSETEHVCVHARLIVDSLPPLII

SEQ ID NO: 953731 - protein, 41 aa, Homo sapiens
SEVQKYIDYVRDVAAADELLLEQRLDISRWVPEAFGTSDAV

SEQ ID NO: 953732 - protein, 69 aa, Homo sapiens
ALGMKKLELCKLLVGSKTVQLLWKAANYHEIQQFHFWIPTQENQKQGPGIDICISMFTAALFTTAKKWN

SEQ ID NO: 953733 - protein, 33 aa, Homo sapiens
VSPGQVSSSRTRRKPLMSSLNALAQGQLILILE

SEQ ID NO: 953734 - protein, 66 aa, Homo sapiens
SLHFGLVNGVIRDGTAPSWISAWRATPPWKTCDRSYNPKHQAQSDDSLTTILENNMAFSQAVSGLN

SEQ ID NO: 953735 - protein, 66 aa, Homo sapiens
GLLHDIDHADRMPTLLVVLNPEQVLKNEKYVMKITGDDDAGKAQLDNFINPKKAYPVIATTSELMT

SEQ ID NO: 953736 - protein, 101 aa, Homo sapiens
MRIWFNDEPLQCAEATSVADLLTQLEQQQPGVALALINASCRMNSGKIISYRKAIKSCFFRLSLEADMLRIADKTFESHLFTGTGKFAAPDVMVEAIRASG

SEQ ID NO: 953737 - protein, 41 aa, Homo sapiens
SEDSHAEECCWRLSELLHKAMNPNSPSSSSCTAPPVKAHQH

SEQ ID NO: 953738 - protein, 161 aa, Homo sapiens
YLQFSTKTVSTQSHTNTVINIFQHISKQASQTSTRQAKSFLIPSSHNVVCQFSSLKSLIKQSKHNFKTFMQLHHKSKKLTRFLNHQHAKQKSVFAVCTVSQPSMDCKQWGVQGQQSSSRFKFIHGKQQFSITHFSVSLNCTVFHHPVYNQCTINVLGLAIC

SEQ ID NO: 953739 - protein, 72 aa, Homo sapiens
PCACSFKYIDSLLSSPLLSHVHAHGHGLLFLFFPGSPLMQGEVGLYLRHLGSIETPLLDSPASACQVPAITG

SEQ ID NO: 953740 - protein, 148 aa, Homo sapiens
GVIQMLRQEMSSHTECDGSACQRTGDAGMARQVDVRFCLPPNYLYPPERHIAEAYLLRLWSYLAWGCKGKGYPQVNCCSPVYAEFCCEEGETLPSWILPKYFVFPSVTTVHRLYGRNVFVFTPAVILYTKVVLRECADVRDKRMKSCW

SEQ ID NO: 953741 - protein, 36 aa, Homo sapiens
RIPLEEEPESSAQRVNLEQIVDFGHVNRHGNCVRRM

SEQ ID NO: 953742 - protein, 102 aa, Homo sapiens
MPRQFKKDLDSYLKTRSPVLSLSGLRSNLQVSNEPGNRYNLQLINALVLYVGTQAIAHIHNKGSTPSMSTITHSAHMDIFQNLAVDLDTEGRYLFLNASVEV

SEQ ID NO: 953743 - protein, 136 aa, Homo sapiens
TGLSASPCGCVLGLASFSPVPSCSSVLASVAPPALVSRGVGLTALRHCAAPAPQFLLLATGRLFCELRKSCCLVSPAPQLCEILAKITERFIKLNLMVNDDTEIKPVRIFTVGTLRPRKLGASSSNSSACTAPYGS

SEQ ID NO: 953744 - protein, 112 aa, Homo sapiens
WENSLTLLPRLESSRGMSAHGNLDLPGSSDPPASASLVAETTGTHHHVQLILKFLVKGRFGHVTKAGLGSRGLSNAPAWASQSAGIMGVLSYHAQPCATLMWRGLSRLAWWL

SEQ ID NO: 953745 - protein, 107 aa, Homo sapiens
DISTLRDPLYRSSGSNKAIQEPKGVFITEMDADFGKQVTSVLQTQGKPGNSICQTYFIELVRVLKQALQNTRKSCVSSAWAWASEGMKSTADLHQKLGKAIEMVANP

SEQ ID NO: 953746 - protein, 210 aa, Homo sapiens
MGISKHNHAFQQSPSLTHSSITQKSKSNVSSETSYVPSAYEPVKSKASHFLDEWGYRHRVNTPISNGKNGPKQRDCRPHTSLKSNRAVIKPQSSEMISFDSMSHIQDMLMQEVGFHNLGSFAPVALQGAASLLMAFTSRCCVFVAFPGAWCKPSVDLSFWGLEDGGPLLTAPLGNAPVGTLCGGSNPTFPFCTALAEILHKGSTLKQLLL

SEQ ID NO: 953747 - protein, 106 aa, Homo sapiens
WRQINTEGPRTDVRIIKYTRTVKEIHQEMDENFCKQVTSVLQTKGKPGNYDMPEYFSKLGVVLNKALQNTRKSCVSSAWAWASEGMKSTADLHQKLGKAIEMVANP

SEQ ID NO: 953748 - protein, 137 aa, Homo sapiens [sequence omitted]

SEQ ID NO: 953749 - protein, 48 aa, Homo sapiens
VAITAGHRTHAPNGKRHPSAISTIKLHSTLIIFTILLLLTIIEMVANP

SEQ ID NO: 953750 - protein, 97 aa, Homo sapiens
IAAGKRIVPGNPIFKPSDLVKITHYHKNSKGQIVPMIHYLLPGPSHDMWEFKMRLGWRYSQMLSAVILYLLTNLSLTLPPLYPSQPLVIFCSTLYFS

SEQ ID NO: 953751 - protein, 65 aa, Homo sapiens
ISPRGGGGAWVSRLSLCVPVGVGVGVPVVSGGDGCRGWGLCAGGCRGKGSPYMMVVLGVDVGFCV

SEQ ID NO: 953752 - protein, 108 aa, Homo sapiens
EDPQAFTACIINVILSFLGLGCNGFLHLNDLRSFHILNYFSVISAISAQFRTLAGEVVSSFGRMKALWLLCCQGSCACFFSSLGADVPSVFKVAALWIFWYLLFNLCS

SEQ ID NO: 953753 - protein, 64 aa, Homo sapiens
GAQGGAVALNEEFLINYFTDKAASYTEEDEYHTAKDCLLVYSHEETESLNASIGCRTFIEGELD

SEQ ID NO: 953754 - protein, 76 aa, Homo sapiens
GALKMDYEEVGVRFCKNDGVRKNARNTHYPFLLALQHVMLPEFQLPAYLTDVKAFWFDCIHLSNHVLYHVYLPISQ

SEQ ID NO: 953755 - protein, 134 aa, Homo sapiens
MSMRRADAPSMRTTMMPCRLLLKATDAVHARRAEYFDGSEPVQNRVYNSLKVWSMHRRPGEMSLELTFQSTKAVYDRLLDLLFATPQIVINYAMFLEEHKYFERRFIGVRALPSRCSSGPTCPTSGAAILFHNR

SEQ ID NO: 953756 - protein, 194 aa, Homo sapiens
RSESGSTHASPDHTEPSCHFTSADHLITHRKFRSENAGWRYRLLGSRAVLPAKARPAARSTVVARVPATRRSVRAAAAAVVVAEPTQVDYSSRFSVFPMEACDLLGGDACIGEMYPEAKLAAAAPEAAGGVHGVERDYLSYDDPKTVFPGEACDDLGGEFCEAPYLDGVFQAAGATPESWQIHPCLSRNELVSQ

SEQ ID NO: 953757 - protein, 201 aa, Homo sapiens
GWYACRYWSESRVDPRCRDCLTREQSRGRNGVWDNLGELSNIAQLTGLDAVKLISLIVRAVSRARVHKRNCRRFAQHLKLIGGLLEQLRVSELRKYPETREPLEQLEDALRRGYLLVNSCQDRSYLYLLAMGWNIVYQFRKAAERRSTITYASSRSSRSSDNARIRDRLEYIERTKVNYFFDEDDKKVQDARRILTVHESY

SEQ ID NO: 953758 - protein, 124 aa, Homo sapiens
AIMSSFQHDFSFAIHMSVHYLGFPPGIIITQFSSFPITPLFAPSFHAICQLTHFPSFFSAPKLCAPSMLPFNLAHSPSRMSFSPFPVPQHTLIKCIIPDLPFPTTPNVPHALSCLTLGPILHFP

SEQ ID NO: 953759 - protein, 89 aa, Homo sapiens
TQEFTTQQLSVLRCRVYSPVLFYSNKLAVSLTKSNSSMNCDTKLAGVLHIFKSENYATLSPYTLCIIFSIDYHIFNNMKTVLLYLDNYS

SEQ ID NO: 953760 - protein, 69 aa, Homo sapiens
ELLKVHKKEGTLFCRKDILFKITTTLGGWGIKEEYKKSEEDGGRDATLSSCEKPINLTARCDGSDASNI

SEQ ID NO: 953761 - protein, 160 aa, Homo sapiens
YLRIEVSFDYVMPMVYFNCLCCGQEYGKTRTRLLSLMTRACVRKEDIERMVQEAEKYRAEDEKRREEVSPKNSLESYAFNMKATVATIRNFNAGLTMHDKQKLLDQCNEFIDWLDMNMTAEKEEFEHQQKELEKVQQSPIITKLYQIAGGMPGGLPGGRR

SEQ ID NO: 953762 - protein, 36 aa, Homo sapiens
MSTGEKRTRLLSVMTGAVGGKEDIERMVQEPDNRYK

SEQ ID NO: 953763 - protein, 107 aa, Homo sapiens
MLVFGPHWDTGQSFCDSHVCTLINLYAFSLCAFFFLLRWSLALSPSLECSGAISAHFKLRLPGSRHSPASASRVAGTTIACHHARLIFRIFSRDGVFTVLARMVSIS

SEQ ID NO: 953764 - protein, 40 aa, Homo sapiens
ICGDTVIVNGGSDSGDGNGSGNGGDDGDDNGDDGGDDDVI

SEQ ID NO: 953765 - protein, 110 aa, Homo sapiens
HNCPTSLYGRAQWYLPISRQGLAGLELLSLSDPPTLTSQSAGITGASHCSEPIGLFIYTLSCNLHSHSADRERLLLPHTLRNPRHRRSANMLTSSCTGSASTPYPELSSH

SEQ ID NO: 953766 - protein, 63 aa, Homo sapiens
MDSKGYRVRILALVVRILTAPTMPRTDGSCSLSRQVLGFAADQSAQAMEGQSYCSVLMQHIHA

SEQ ID NO: 953767 - protein, 55 aa, Homo sapiens
MRLRHDVGTQSSVFRHPASTVLLLDMTYKVEDEAQLNWYGSKSADHGKHISRDDS

SEQ ID NO: 953768 - protein, 97 aa, Homo sapiens
MHCCNYLRTCPQRNAAQCVRRTRLNPNQIRKPHEPQLHKCTTHSQVTAHPPATRRSYSSTTLVSHSFRALGGEPEAEGKERVVVLVAHVQGQMSPPI

SEQ ID NO: 953769 - protein, 70 aa, Homo sapiens
TAPLSYDHASFQSMGFIATLLQPLIGLMTSVYILQNLSLTLTNGEDMSPVCRYICARYPSQVGTCPIYLD

SEQ ID NO: 953770 - protein, 126 aa, Homo sapiens
MPLTIHTAELIHQAVSVWPKIPTINHIISMNQSAVVIPDSQISYQAGYSKGLYINAQEPRITGPIFLWAPVKPLLHSQTTQNGVGHQRILVKIWPLAFTSKSLYPSDLCGYQKQPSDPGHQRLQFR

SEQ ID NO: 953771 - protein, 41 aa, Homo sapiens
MPELIPAAYSFLGTVRREGLILSPWLEYSVIIIAHCSLDLV

SEQ ID NO: 953772 - protein, 119 aa, Homo sapiens
VFPSLIATIKLVFSLALHGWFNVIHYINRTNDKNHMIISIDAEKAFDKIQHPFMLKTLNKLGIDGTYLKIIRAIYDKPSANIILNGQKLGAFPLKTGTRQGCPLSPILFNTVLEVLARA

SEQ ID NO: 953773 - protein, 36 aa, Homo sapiens
YIRVGSSSRGSFFVWVVLRWVVLQVGLLLAGVISKK

SEQ ID NO: 953774 - protein, 37 aa, Homo sapiens
YPWVVLTGLEEAAEAETAQDNSQAQDQEEKEEAEKEN

SEQ ID NO: 953775 - protein, 103 aa, Homo sapiens
SQYCTFAFPIFLSALRGLSLVDSSSSGTIMPEERMTEIERETETEMRDRYLLQLNENAPERERGTRDHCPTPSVFNGDEERYRYWEYAERGYKRHRARREKEE

SEQ ID NO: 953776 - protein, 61 aa, Homo sapiens
TLEVSDKQPISTINQQVIITLTVNLNIGMLISERLKKSKMELGKSYPACLPYNITSVHHQY

SEQ ID NO: 953777 - protein, 45 aa, Homo sapiens
VIISPLTFPRTLIIFTSSNSTDYPSKSLSALIQAYVFTLLVSLYQ

SEQ ID NO: 953778 - protein, 126 aa, Homo sapiens
FLLKPCGAYRLSCEVSGFSIDAYKLNCVSCQPRGKGLEWVASIYSRRGYVNYAELLLRAVFTVSGGFPEASVYLPMNFLRDDDTAVYYCVRQGIQHYDYRLDAWCQREQPVVVSSGIPRPAPRSSP

SEQ ID NO: 953779 - protein, 53 aa, Homo sapiens
DLEDPAVTGYRGSVCMASRSVSMIAETIVEGGSRRSRCTCNRSQVTAGREFGG

SEQ ID NO: 953780 - protein, 57 aa, Homo sapiens
AGVKKAHRYRPGSVALREISSVYQKSTELLIIANFPSSVWCEEIAQDFHTDLRFQSA

SEQ ID NO: 953781 - protein, 35 aa, Homo sapiens
GGVVSFYYPLYGSPAPNISSTTEYSPPNDDELNYT

SEQ ID NO: 953782 - protein, 38 aa, Homo sapiens
VCTKRGLLPAHPPLTAELTVSGTNTRLLTYTAKPSTHD

SEQ ID NO: 953783 - protein, 100 aa, Homo sapiens
PSRSRARDVLSAGPMRSKHMVYKPPPGGDSVVCCATNVAKTSLTIPGIKYVVPGRTVMTRYYDRVTGVSSFRVTWVSQASADQRAGRPIRRTKVRAPKGT

SEQ ID NO: 953784 - protein, 114 aa, Homo sapiens
PFTCQTSNACILQASSVEEQNPPVSRRAHSSLDLDIQYEYSREMRGLTILLTFWVYTMEVSERLHSVYTGLLAAKRSSRRRFLASYDVWLFRIIVKQNSPSSGLFTLLSREREL

SEQ ID NO: 953785 - protein, 82 aa, Homo sapiens
GFWHIHVDSITMNGEAIAMLLRAARPYVDTGTSLLPGPTSPIANIPELTSEPERTQTGDMAGSACSAISGSLPPDNRIFPPF

SEQ ID NO: 953786 - protein, 53 aa, Homo sapiens
PYHDQHKLCPTIAQPLYYTQHNLCPNNQHNLCSHNEHTVLPLQPSTTSHSKDQ

SEQ ID NO: 953787 - protein, 66 aa, Homo sapiens
MIPGPQFITTSVFAAPRVARPIPHGGQHAKDSQVQQQLIAPFAEDGSDRTLGAQRIQLIDGGYERT

SEQ ID NO: 953788 - protein, 97 aa, Homo sapiens
DYPSWVALLVRDMRQTVAVGVIKAVDTEGCSAIRQPARHSSSPFNVSPVTPVPPECLHSCRREGSCISGFQGYEPTPPQSGAALDSWVMSSSRQVRR

SEQ ID NO: 953789 - protein, 60 aa, Homo sapiens
LGDPPMYLKGGFFLRIHPDGRVARGPGEERPSHQATTSSRQERGVVSIKGVCATRNLAIK

SEQ ID NO: 953790 - protein, 73 aa, Homo sapiens
MNLIQHLNTLGYRQVDVKDEKQLLINLKTQIEQANGLSVLSENEWGQILNHLKAGNSFNCAKVLRHRFPVNFD

SEQ ID NO: 953791 - protein, 84 aa, Homo sapiens
IIHNRQHNLCPNNQHNPCFYTQHNLCPNTQHKLCSHNEHKFCPYNQHNLHSTAHHILCPYKQHKLGSYQQHNLCPSPQYGAQGY

SEQ ID NO: 953792 - protein, 60 aa, Homo sapiens
LPDELIKAAMLDGAGYLENLLAIVLPLSTPILVVTLIWQFTAIWNDFLYGVVFSGADSKP

SEQ ID NO: 953793 - protein, 40 aa, Homo sapiens
TGSGKKSDPHIKLQLPCKRERQLCLSTGVCANRYLAMKEG

SEQ ID NO: 953794 - protein, 34 aa, Homo sapiens
KAHIEGSLLVLVPAHQALFPAARAPPWPMVFACS

SEQ ID NO: 953795 - protein, 45 aa, Homo sapiens
RGSPCAELPRTESARVTIRKTIDTIIATRVIEDDLPLLYSDRDFD

SEQ ID NO: 953796 - protein, 52 aa, Homo sapiens
EQGSICKGIRRNRSASKLREDVPNQKSDPSDTKVKDFATTQVPIEASSETTT

SEQ ID NO: 953797 - protein, 44 aa, Homo sapiens
VYIGSSDRRAASRCVRLPPDPPGPTLRRRASRTRDLWICHFRGL

SEQ ID NO: 953798 - protein, 42 aa, Homo sapiens
MGDVGALALGGALGTIAVITRRMILLAVMGGVFVAEALSVMA

SEQ ID NO: 953799 - protein, 37 aa, Homo sapiens
GYIHRDIDNTERTQMDDMLVRCSAISSLPEIVFTING

SEQ ID NO: 953800 - protein, 186 aa, Homo sapiens
PTAPESHIGKDEEIPDSSKISLGCKKTGSKKKSSQSEGIFLGSESDEDSVRTSSSQRSHDLKFSASIEKERDFKKSSAPLKSEDLGKPSRSKTDRDDKYFSYSKLERDTGMYLPDVDQKESDGGKDLTLGLREALELIYPIPGQNDLIDYDSDRRYHRSSPYRERTRYSRTYTDNRARESSDSGGV

SEQ ID NO: 953801 - protein, 107 aa, Homo sapiens
PLLVHQHNLCPTTSTISSPTTSTTSATTTSTTSAPYKQHNLHSTLPAKPQLLQAAQPPVLKLLPATSGTSPTLPKSTNQELPGTTATQTTGPRPTPASSTAPKVTEL

SEQ ID NO: 953802 - protein, 42 aa, Homo sapiens
HTDRPLEAVSLKSLQKCEIALEKLKNEMGVPLPHRPRCHRPK

SEQ ID NO: 953803 - protein, 95 aa, Homo sapiens
WTDWSILLLVAAATVTQREFRLKQSGGEVKKAWDYCESLLQGSEYTFTVYYVHWLRQAPGKGPAWLGLVNPEDGGPIYSRIFLGRLTITAVRRVT

SEQ ID NO: 953804 - protein, 70 aa, Homo sapiens
MLPFQRLVREIARDWKNNLRFQSATYRCYCREASEAYLVAFMKDTNLCAIHAKGVNNYAKRHPASTPNTW

SEQ ID NO: 953805 - protein, 89 aa, Homo sapiens
GSYLLILWRSVILRRYQKSTELLIRKVPFQRRVREIAVTVKNNLRFQSADIGALQEACEAIWIGLIEDTNLCAIHAKSVKIMPKDIQLS

SEQ ID NO: 953806 - protein, 57 aa, Homo sapiens
PVLLKPLARMALYLRGERNLIVTGHGTVALREIRRTQKSTELLIRIVPFQRLCAEKL

SEQ ID NO: 953807 - protein, 41 aa, Homo sapiens
MCVCKHWLSRDLMALVLGWYTAPEWHMLLGRDTSNAPVVVS

SEQ ID NO: 953808 - protein, 42 aa, Homo sapiens
WRLKPLAVVRPLSVRGDRNLIVTWPGYLWSLRENLDGLSASP

SEQ ID NO: 953809 - protein, 98 aa, Homo sapiens
LGTLRILAECRVMWKRRQLRGARRLHASGQIIRQRTAKKRDLGFAVRIPVSPEVDRIKSLLRKPQCLHTRMRRSLLPEPGRVLLLGAHPPQFMIMGDI

SEQ ID NO: 953810 - protein, 118 aa, Homo sapiens
MACRGAGVQGGIGQLQRRDPLAGHTTQMCEHRWAHPGLGDVVELGNSPMGRFNGAELNGQRTAVCQVGNISEACNGVVFLLGYIYVFDLNVQAQGCFEYTNTSINPPQNTLKAQLNIR

SEQ ID NO: 953811 - protein, 72 aa, Homo sapiens
MECVLVSAGMQWLLSISPGNALGWKDANSTEFDHTSVHPVVGLITEVGRRHRAPVETPYLKPPDLVRAPWRP

SEQ ID NO: 953812 - protein, 89 aa, Homo sapiens
MSLGGGEGKLCGLTDFISLMLLRADVGGKFEHFHNLAGFINDGVVGGLKIDGLSLMRSCAQIARLKKFLPLNSAKNLDFLDKNYRNRTF

SEQ ID NO: 953813 - protein, 78 aa, Homo sapiens
YVVVDITCDVMRGYSMTRGSFGKQSFEFCEEYGCNVGNLKELTEGHHQEWSLRFNLTQHGIPHPARILIHNEDRGTEL

SEQ ID NO: 953814 - protein, 81 aa, Homo sapiens
EDSLSTNVHLVHHQAVGQVDFLVGAQAGGGEEFVIGCTEHRVGLRAVVEAQHVFCFYFAHSADVDPLIVHTFISNDWLLLC

SEQ ID NO: 953815 - protein, 166 aa, Homo sapiens
TVYPDPPGKIRYQRFKDYGCIACHQDVNIGGNMFQKFGVMGDYFKARGKPLESDLGRYLLTQDEEDRHVFKVPSLRTVARHWRRYFHDASAKTLEEAVDVMFPYPVGAQTVPGRQGADNPVSQDPDRRMGGDSVMRALSRRGTSQILLGLITLCLCSNLVNEYLTS

SEQ ID NO: 953816 - protein, 72 aa, Homo sapiens
ALSRMWSSAMVSTLLAKIFMSPWIHKGSFPTGFSSQKSHSFSAEQKYGKVRLGAVAYTCNPITLGGRGGQII

SEQ ID NO: 953817 - protein, 44 aa, Homo sapiens
MATFATPSIGGVHSRETLSQSHLSMGAQVIVKPCQQDYDLVSSI

SEQ ID NO: 953818 - protein, 61 aa, Homo sapiens
HECTRHSGSNFAGVRVAITSCTRYSSTASAMYKPRISLRAAKIACWLTRRSVLGFATSSAS

SEQ ID NO: 953819 - protein, 39 aa, Homo sapiens
SSTECSKRRIFSSVRSFASNTAMNAHPPVLEAERTNRRE

SEQ ID NO: 953820 - protein, 44 aa, Homo sapiens
KPIALPLSKPGRQVGRHAVQALGGTGTGALFRHSLENAQLTELH

SEQ ID NO: 953821 - protein, 46 aa, Homo sapiens
LTTPYTGTCYAVCYGLLYYVYVYYGLLTHDTHLTNLTFTFVTYTYY

SEQ ID NO: 953822 - protein, 164 aa, Homo sapiens
RPSVRDARIWVGLYALIIGTALYLGSWLPLMLVGLPSLYGAWLGYLFGISQHVGLAEDVLDHRSNCRTIYMNRVLRFIYMNMNYHLEHHMYPMVPYHALSQLHEEIRSDCPPPYANLWQAYQEIIPTIWRQRSDPGYFSNAPPVARELAPAGLRSNPNNPSDLQ

SEQ ID NO: 953823 - protein, 84 aa, Homo sapiens
IVARFPYRLLLNHSADVFMRYLPKTRHGQDIRQAHAPVRGITVGNSSDYHHGVNRGEPLTMISAAMIRKNAPQQLWMVCRVVRI

SEQ ID NO: 953824 - protein, 59 aa, Homo sapiens
LLFLCLEQAAAAFQHMAVLIPYISPSGSVQHSGSVECIQHICAPQGSFAHLVMAKHAQF

SEQ ID NO: 953825 - protein, 92 aa, Homo sapiens
MLLQTGSLGETEAPGDSYSKPVKGRVWGSSSGIHSQLQPLLDVHLDLSSAIFVKRFEGTKHCVQPDRAADEVSKSMFHFHLSSVANHVIEMS

SEQ ID NO: 953826 - protein, 42 aa, Homo sapiens
MIKLCRDYIRITFLILKFLKTVSGSIFVAPFSTYHILGYLKG

SEQ ID NO: 953827 - protein, 53 aa, Homo sapiens
EPPPCTAPGMKAPFPSYIKVFNLTTCNHQVRSRRLELFQNNTERTPGQTVFVA

SEQ ID NO: 953828 - protein, 35 aa, Homo sapiens
PVTTQIASVCKCMHRQATAWHAVLMPYASSPGLLW

SEQ ID NO: 953829 - protein, 69 aa, Homo sapiens
QLYAYYSSHSQFVFTQRKPSWEWRVEHAEEHSQIVEGIMPAVDHLQLTAGWHQVATYSQIHVYGPQVYK

SEQ ID NO: 953830 - protein, 123 aa, Homo sapiens
SAYSYRSSDPDMSGLSAHGLAFTNAQCSYTTAPHAQAQFVASCNKDTLSIVYLQPTPPPVLSTGSLTQEASTTTTECVLSGPDTPRTLALPQGPEGVDCGAKRTNSPSPKGPGSLGLLRRLLA

SEQ ID NO: 953831 - protein, 32 aa, Homo sapiens
RYKTEVKWVWCNYCVSQGECVICVLEDDTISR

SEQ ID NO: 953832 - protein, 145 aa, Homo sapiens
MKDVAYISELKHKKDNKLGLSSPPASVCKDFRDTILTDNYRELSQRGQVTRVTNASTSKEPGRIKRRGERWVPQARTPGTECLPADSGVCSTKYRAKACSIFTVIRSLWSMAGAMAPLPSKFQFNLELRYQLSIRGTEARIRNSM

SEQ ID NO: 953833 - protein, 137 aa, Homo sapiens
ILVLTDEQRLYISKLKTKKAKKLGLRSPPARVCEDFQDTIITGDYLGIYPQEDRSIVGRMSLLQRGQEEQRGEVEDGSPQGLHQGQNGCLLLWSLLQQVSGKGLLHLHCDKILWSMAGAMGLFPEIQCNLELRYQLR

SEQ ID NO: 953834 - protein, 135 aa, Homo sapiens
MRYSRTDNTSVKLRIQIIYKTVAFYIPITSRWKATSKRQSPDQNLTTHTQRERENGEEKEKSPKNISNQGGGKALQGELQNTDDDKPDGKTFHAQIGRIHIIKVAILAKAIYRFNAILTKLPMSFFTELEKSYSE

SEQ ID NO: 953835 - protein, 80 aa, Homo sapiens
SDIQIISQTQAIFANPRRVDIHIDISKAISNINKPNNELTYFLPNPVLCQSMLTLSSQNMRHCPWALSLPHPLTSHQHEL

SEQ ID NO: 953836 - protein, 87 aa, Homo sapiens
DVTTAIPQKPSAWDDFDYEMLLLMEKMTTHDHRDHPNRCPNTKPKHPSSSGSLSDADLADRRIRWRSEKRGSDVLCRQPPRKTGDAA

SEQ ID NO: 953837 - protein, 92 aa, Homo sapiens
MSCQSVSQSVSRVRVARGTQRFPSPYLPPHNTVVPVVPFHGLDSFRKQVSTESSEVTRVLMPAHKSMVLHCTDYTAFDFEATHIISTILPSI

SEQ ID NO: 953838 - protein, 141 aa, Homo sapiens
LYHATDREIATGCPGGGGEMVSRTECTLMTRSLVEMLREEPEGKVRKPVITGVDIVMNHHLQENKFSEKKANRMYIKDYMKSIKGKLEEQRPERVKPFMTGAAEQIKRILANFQKRSSSLFGENMNPDGMVALYGYLVGVG

SEQ ID NO: 953839 - protein, 64 aa, Homo sapiens
MCCNAEEWNGMEWNEMAWKGMAGHGVDRHGVAWIAVQRNGMGWSGMTWTGTDWPALEWHGLACT

SEQ ID NO: 953840 - protein, 75 aa, Homo sapiens
PDIACACDLLSIYGMLEFCDHCSKKFPVPWTLSLQEESNATGAKMMNILRPKMILYETVFYLDQNMNSCEISAVR

SEQ ID NO: 953841 - protein, 35 aa, Homo sapiens
RGFPVDDLSEHYADLRMYVAPEPHQQANQYWLARK

SEQ ID NO: 953842 - protein, 66 aa, Homo sapiens
YQDTYRQHLHGVSCLYMLSSVSGWLSVIAGHQGSLEKREEELREQIYLLLLFVETESHSVTRLSQC

SEQ ID NO: 953843 - protein, 34 aa, Homo sapiens
MRARVTSSPAQEDRAKDLQDVSLITTKVGGPKTI

SEQ ID NO: 953844 - protein, 35 aa, Homo sapiens
MGLFTSVECIRNLVTRTSVLFSPDAVLGRILVEQP

SEQ ID NO: 953845 - protein, 49 aa, Homo sapiens
SRGSHSYHGASSSDPECRLRQLTCAEKSQTCCCESSGTEGCTLQSHRDR

SEQ ID NO: 953846 - protein, 62 aa, Homo sapiens
MHTPQPIMSVSVAEHFSVEHFLTVHPLKTYGMLHLHGGHNHEGISRFHFVSSFDEHLFQWFQ

SEQ ID NO: 953847 - protein, 39 aa, Homo sapiens
MIQRVSQFYLCSLAGAHIDMVRRVCKTQAAETSGPLVTA

SEQ ID NO: 953848 - protein, 62 aa, Homo sapiens
AYATINFLKWFIDEQVEEDAMFDSIIQKLRRIQNDNNALFMLDSEFGNGHLRRKRKHKGTLW

SEQ ID NO: 953849 - protein, 41 aa, Homo sapiens
MAENKNKNKHWRYCCSGPSDICLYETAEIWLPTENDIGMGT

SEQ ID NO: 953850 - protein, 82 aa, Homo sapiens
DQRVYSPSNTNYLTPTPHNHQQRHLSSEPLSRIKTLTLYIIFLTIFFIITFTGTELIIFYIFFETLNPNLGIITDEGTRQNA

SEQ ID NO: 953851 - protein, 111 aa, Homo sapiens
QAAEIILNKPGFKYKAFCNQVSSLGLLSFRFFMPPLPVLICQIICWFGPSYLGDVEDYLESKASVTKRREDFLYVPCLDKYQGKIGNEFNADSCVILGGGPFDQAGLGIIN

SEQ ID NO: 953852 - protein, 96 aa, Homo sapiens
MEGYEGELVAGTSLIILVHLVAGAECSRPVCGDVEAQGKYKVLKNVLSQFALKFPESFEDRFLLLFLRQSLALSPRLECSGTIWADCNLCRLGSSD

SEQ ID NO: 953853 - protein, 42 aa, Homo sapiens
MDTIYELLTRMASLGLTLLIFYYYLSPSLGHGVLLAGSSSPT

SEQ ID NO: 953854 - protein, 77 aa, Homo sapiens
RGSHANNLQCRRWSAGNLLGYKDADSSSAAPMFVYSGVCRMGLKITRKTQGPPFSQISLKIEGFSIVSGQVTMGSLA

SEQ ID NO: 953855 - protein, 36 aa, Homo sapiens
YTPPHNPFPIHQRTSTQNIQLRVSIIPHHSLSSVLG

SEQ ID NO: 953856 - protein, 78 aa, Homo sapiens
RYVGVELERYLNSVAAFSPTLGVTTYLLYSTGFFLVSTELFLFGLTVKFTRGFRGFCGSPFTVEPTDFYFWTTQTTHH

SEQ ID NO: 953857 - protein, 34 aa, Homo sapiens
MWDVSLVFMVPASPVNYNLWVSAGPNMKYELQLA

SEQ ID NO: 953858 - protein, 49 aa, Homo sapiens
MAAVVTDYYNLCNLTNWLCYGLYGRTAIIHPMWVIEEYAKILRTWVWFN

SEQ ID NO: 953859 - protein, 94 aa, Homo sapiens
SGSTVSRFKAGCMVAHDGGACMQAHCFSEFFDNGPIVGTKAVFSGGQASLGHRQGGMAIQGVFSPLLAMFPRCSISQSGSVVAGSFKFAVSQAH

SEQ ID NO: 953860 - protein, 34 aa, Homo sapiens
MISHCWVVHSVGCCMQHHLSGGAGSVVANHSNAF

SEQ ID NO: 953861 - protein, 53 aa, Homo sapiens
MGDRSVRSSVRSQFICLGIYRSVGVELERFLNWWLLLGLLWFGELLLNTTAEE

SEQ ID NO: 953862 - protein, 44 aa, Homo sapiens
LFTCVDSKHTGALCPTMRQLLQQWAQGQHELGYKKAAEAPQEAE

SEQ ID NO: 953863 - protein, 46 aa, Homo sapiens
WVSISSCSSQAMRSVSSGIIITLFPFKPWFMFRVVLVTLLIHSILM

SEQ ID NO: 953864 - protein, 51 aa, Homo sapiens
SSASSHNSIKQVKHALAKACVVHACPHFSTAALASLMWQHHTGGFTGAASP

SEQ ID NO: 953865 - protein, 51 aa, Homo sapiens
KPYHINNGCYSQERRCLFNTAKTTATPAVRTAYKFCTKIMQSLGLKEVKSK

SEQ ID NO: 953866 - protein, 37 aa, Homo sapiens
YVRVVVLDVYQLTYVPNCEYYVTDYLLPYVKLNDTGY

SEQ ID NO: 953867 - protein, 84 aa, Homo sapiens
SQLVRCYTLSTGGTVSCDSIMVDQSCTDETMYPSPIELQKSNQTDPYQEDTLKSRDLQKLRISSAYYAAAYLGTEEGVPSYEYT

SEQ ID NO: 953868 - protein, 32 aa, Homo sapiens
SGLEAREGHSRDPMWVTAPVLTEEFSFRPPGY

SEQ ID NO: 953869 - protein, 47 aa, Homo sapiens
YEILSTEHLWTISPSFDAYKGNSTHNTLFKPVAMNDAATSFLFTFIL

SEQ ID NO: 953870 - protein, 38 aa, Homo sapiens
FYEDPTGYRGQPRLATPVTVVFLFAVALSLELRNINWV

SEQ ID NO: 953871 - protein, 44 aa, Homo sapiens
QCGQRKSLVLVHVRYGLVDYMLCEVIILTRSILVHIFCTSTRLR

SEQ ID NO: 953872 - protein, 42 aa, Homo sapiens
APVSVHSHPHTFLVFVCQLQKNFQIRISACSSSIKDMGQHSH

SEQ ID NO: 953873 - protein, 42 aa, Homo sapiens
SAGDERHPLNRAGCAFHKRCPYATARCSSEEPLLRPLDNRQV

SEQ ID NO: 953874 - protein, 139 aa, Homo sapiens
YPGTKGARRTGTEPKGMPKSLQVFPRSRSAGAGANHRVLRSPDVQGSRKTGRSGPEPRQGGTTLFTAASQSGLGGCLDLERPEARIAQTPKAGLLISDLRPPEAASSQSSYANRSSFDLLPREFRLVEVHDPPPPFRPP

SEQ ID NO: 953875 - protein, 40 aa, Homo sapiens
MGYDWTPLSQIRPVRNCYWQLPLEPRVVPRDSLVPRPFCP

SEQ ID NO: 953876 - protein, 42 aa, Homo sapiens
KLNSEQPKAICDGFIVVKVTKTWCSMTIRVHPWRRSSYLSFD

SEQ ID NO: 953877 - protein, 34 aa, Homo sapiens
KLNSEDTSLQDSTYDLPKAHVESPIAGSIVLVGT

SEQ ID NO: 953878 - protein, 75 aa, Homo sapiens
TNNSSTAAITNFTGVSILSPSYKPSEYFESPFTISDGIYCSTFFVTTGFQDFTSFLASDLSFICYTFRGTELSFV

SEQ ID NO: 953879 - protein, 48 aa, Homo sapiens
MSVRRIYHSRLVYEYCGKYYLPIDGGFDSGFRGVISGVRKEVSSLLML

SEQ ID NO: 953880 - protein, 44 aa, Homo sapiens
MCGFDSRNFNTSRMECVSITLSSRNFCSIHVPLYPGRSVWEIPS

SEQ ID NO: 953881 - protein, 38 aa, Homo sapiens
SRNVLEIHGWHFSELLKKFIGEQNHVSWGPTGCLRWGT

SEQ ID NO: 953882 - protein, 107 aa, Homo sapiens
AFIWSLELFLINELLNMRNINFVIAVVRNEHTVPKRLYRMMRSCIYYLSRIREDPLTSRPAAPCRLGTGPLVDNRSRLGEPRGLCKPQAPPPIFQAHSTDSNSAFGT

SEQ ID NO: 953883 - protein, 51 aa, Homo sapiens
VKIVCTGLTYYSLEPMSNAPIGVGQVVLAAGRLKKTEAGYRYNTASHVILN

SEQ ID NO: 953884 - protein, 105 aa, Homo sapiens
LPHVTIRGGTRPRLVMRFIDHQQIEDRDGSEMVVARQRLHHRERGAPGPGFVLGIEHGGPDARIHPCKLGEVLAGQFIAMSEDAGLGIWLANKLPATADSMMVLP

SEQ ID NO: 953885 - protein, 72 aa, Homo sapiens
MTIIECPFSLRDIILFENYPPPSLTPEAYTSQINRTGNDQRCPCPRTQFDARKMHDTEAGSGGSHLYSQHFG

SEQ ID NO: 953886 - protein, 63 aa, Homo sapiens
VLHLITRMSHQQQMTYNSGIYFLFYTLVSSLPLLIALIYTHNIPSAHYNILLLTTHMPRELSE

SEQ ID NO: 953887 - protein, 75 aa, Homo sapiens
DAYHTVSGVVQSWLITTSASLVHAILCLSHIEELALQVCITILAHYVLPVDTGFRHVGQAGLELLTSRGPPTSGS

SEQ ID NO: 953888 - protein, 57 aa, Homo sapiens
MELVFLFFFFFFFCLLAISRAAPVAYGGSQARGLIGAVDTGLRQSHSNAGSELRLLR

SEQ ID NO: 953889 - protein, 86 aa, Homo sapiens
VVVCLGRSRWSPQGAQAGLGEQLVTVAFGGCACPATGKGGCQSLALAAGQWLWQLVAVGVVAVLVQHFGQGAAASGASSQRRTCQA

SEQ ID NO: 953890 - protein, 116 aa, Homo sapiens
MVQEAEKYKAEDEKQRARWCHPKQSLESYAFNMQKPVLQMQHTSQARITMQANRRFWHSVNDMINWLDEDIRLLRRQQFDHQQKELEKVSNPIITKLYQSAGGMPGGMPGGEEVGT

SEQ ID NO: 953891 - protein, 112 aa, Homo sapiens
VSLDISLSLWYTQLSLRVIRRSPGIIDNEQYYTTDHGRSTSEDIERMVHDAAVSHTAADEKQRDKVSSKSSLESYAFKQCKATVDDQKLQGKINDQDTQKILAKCNEITHLG

SEQ ID NO: 953892 - protein, 71 aa, Homo sapiens
LYPLITARRVNASNTPLTAVTSPADAHNHYINIAPGRMACCHRLPGNIQRMARKVFPTAIPFWHPFSRIHQ

SEQ ID NO: 953893 - protein, 160 aa, Homo sapiens
WIVHDTNELVAAHIKVKMQTIHLIERYAIGDLSEDMQQLPGEKADITAAMNQVKHNLSTMNTEIKQLAQAAANGDFTARGDAEQFQFDFRIMVESLNTLMATADGNLQSLSALLQSIAAGDLTARMSGQYRGVFAQMRDDANATAEQLASIVGRIQIAAD

SEQ ID NO: 953894 - protein, 79 aa, Homo sapiens
NNSQQWYSQALIHYDQHGSFDLLRFQNWDGSPLLRQLVVPRSREVTILIAELQCGQPIRHSALQTTTPGLKRSSSLSHS

SEQ ID NO: 953895 - protein, 146 aa, Homo sapiens
MTLTIWYHMMVEEANGERRKDGLIRRIILTSVEIKETSDPAIVICWHAMLNSIVQMRPIKWYDHMYRLPERGYIIHLDDFHNLGSYLQFPGSADTATQRHPEENADGKCPQWLEQQEGSTADGFICDLAKTQLSDFLLFLRPTNQD

SEQ ID NO: 953896 - protein, 182 aa, Homo sapiens
MKKEEVVLIGTGTYSGYGISLPACNASRQDYHLWTQGMPYPLSRYSTQHYLCPSTHFTGKEVRQWAHAHGIHWSYHIPHLPEAAGSIEWWDGLLRSRLQHQLGSNTLPGRVTILQKTVCALNQRPRYGIVSPIARIHRSRIQGVDVKVAPLTMMHSAKCLLSVPTQYGSDLLVIYTPEGRRC

SEQ ID NO: 953897 - protein, 85 aa, Homo sapiens
VASFTWGDRPVYPDSRLIIVELFHHGKGERLSSLEQALTQDMGLPTCCNASDKTTIYGLKECLIHYHGIPHSITFDQALTLQVKK

SEQ ID NO: 953898 - protein, 84 aa, Homo sapiens
MGATLTHSLDLCCMPPQMTNLYSHHILPQRIIIQFKHDAAPNSASPVLSCRATLESTGSFYRVYKNLTVANILIEPLTSHHTAK

SEQ ID NO: 953899 - protein, 51 aa, Homo sapiens
MKLKESSAVDHAYHPSTYVMPRRADQQFETPLANMVKPRLYYTYKYRHGMV

SEQ ID NO: 953900 - protein, 81 aa, Homo sapiens
TTDEHPYSSMTLDHVYQWRKAFRRNMAENWTEMRMKSSWMAVLQHNEGETAIYEATRWDVTDGCLDIVRGSIPQSSCYCCD

SEQ ID NO: 953901 - protein, 32 aa, Homo sapiens
MQDATPATSSQVALPGYHRDHELHALATNPYY

SEQ ID NO: 953902 - protein, 67 aa, Homo sapiens
LVFPIWTVAGRTPLCIPYCQWQLGLFPSFWNGGSFLIPCPDPLSIKAPVPSALACHMLLAGSIAVAS

SEQ ID NO: 953903 - protein, 111 aa, Homo sapiens
MHSIGRTLGAAGGEGRGKSGFASPLDAGKAHVLSNKAMQVLQAVSTPRAFIYMDSTTPRFQTMILEELHSTKTGSINGVNTMRIGGSSSSTVWLHLGQKGSRGADAITCCC

SEQ ID NO: 953904 - protein, 46 aa, Homo sapiens
MTCNCIWMNTTFFSYTMQHAYDVMNTTFFSGDPTRCLTLQCMQCLC

SEQ ID NO: 953905 - protein, 187 aa, Homo sapiens
SSFLPPFIASRSNNNGISRSVWQYRRYIDHDQRAIAYAKLDYRRLEPNNAPLFKGVVEPLIPLLMLGPDGVIFHIVQLAAVYRNGLLLYQAYGRAIIQLRSSSLLNPRLSQAWDAERDLFFYGFGSRKVSGLFEESRRLDTCHLLFFPEKGSDRDCIQSRRFPFSRMSDATDGMHIFRASLTHRIFI

SEQ ID NO: 953906 - protein, 36 aa, Homo sapiens
FSPYIWEYNKYAYIYHCHMPYYWNIQRESSVRENRN

SEQ ID NO: 953907 - protein, 42 aa, Homo sapiens
MKRSRSTIQRHNLRVYLELITCGELYQVKELCIEQLQFPYFP

SEQ ID NO: 953908 - protein, 119 aa, Homo sapiens
LLPDTRTRKGCPLSPLYSTYTALEVLARAIRLEKEIKGIQIGREEVKLSLFADDMIVYLGNSTISVQKLLALINNSSNVSGYKINVRKSVPFLHTYNVQAESQFKNTISFTVATRKCNT

SEQ ID NO: 953909 - protein, 89 aa, Homo sapiens
NGIDPHSLFWIKTRLPLRLCVGCFRGRAPDASVGRQVSYAVNGSSAFFYWSQVDSGVIAVARLASSAVVEVDVDPLRKLTLHLRTGHYQ

SEQ ID NO: 953910 - protein, 133 aa, Homo sapiens
MPLNLTTPYHMRYRVFKLSILMPINSLPCPPGMNQMSATTALQTFDIHPFPGSVGAEIIGLDLSRPVNEQDFARIHRAHLDYHVIVFRDQRITPEQQIAFSRRFGVLQIHVLKQFLLANHPEILIVSNIIENG

SEQ ID NO: 953911 - protein, 108 aa, Homo sapiens
TFKRLRLEIDFLVKKKRKKYHQKVLFKNEVYFKATQLLKDLHIYLLLPSSRFYLPRSGISTTPQDFRLISYWVLNDNKEQKPDHDKTHKANHTVVGFSATPARYIWAT

SEQ ID NO: 953912 - protein, 58 aa, Homo sapiens
SLPKLRVNDSGLTRGSDIAIGVYDRFRCVLASVIDEYYLYFVLLKVFKLSDGFVKNWY

SEQ ID NO: 953913 - protein, 53 aa, Homo sapiens
QWTHRSAQIICHVEKTSYIVSLELGKELLSCSITSSNPVLVSWGGLRRSSSPM

SEQ ID NO: 953914 - protein, 66 aa, Homo sapiens
GRIYRHPPQGIPKNSSPTTKIPLSGKHCLASLNMHLKQRQLRFTMLPYWTTPLPSLRPLTNTISKV

SEQ ID NO: 953915 - protein, 51 aa, Homo sapiens
MESFKCGSRWRSTLELQGDFVAKLECGLHLAVDDSSPRCNLNLTLVNSPHG

SEQ ID NO: 953916 - protein, 34 aa, Homo sapiens
SFITEQIPRTFTNISVTFSPTNGKDHVKTSIKLG

SEQ ID NO: 953917 - protein, 33 aa, Homo sapiens
LSQERIRPLKVLGLQAVSHGARLCLGFLLNIMF

SEQ ID NO: 953918 - protein, 41 aa, Homo sapiens
IPRRCGLVEPGYRGCGNGLCSIFVVTNSMRLVRWHPGMSDS

SEQ ID NO: 953919 - protein, 49 aa, Homo sapiens
MPPESSSPSDLIYGLNDRPKPLPAFLAALQHVLAAFVGIITPPLIIGSS

SEQ ID NO: 953920 - protein, 57 aa, Homo sapiens
GRLLTAPPHYSARLNGHPVLTVCFSSSTVPHPPSRMKVLLPFHELLLHFLLGLVTIL

SEQ ID NO: 953921 - protein, 53 aa, Homo sapiens
LEVDSEDPPPYMEITNGFKINTDEDYTSLNSVNGQIEGLISPDGSRTNPARNC

SEQ ID NO: 953922 - protein, 45 aa, Homo sapiens
SCELYICFTSYSDIRTNYNVYSHMGESDAKKMGTEPRHHVTSWIF

SEQ ID NO: 953923 - protein, 34 aa, Homo sapiens
ERDSNIDIVQFLVKYRKYLTAISCLIRVTDTRFT

SEQ ID NO: 953924 - protein, 58 aa, Homo sapiens
YFWQAITSTYTLKLGSIGPRLGTNSRVGIIIPIPAIPPPPDKCHAATSYSIHSPSNIK

SEQ ID NO: 953925 - protein, 38 aa, Homo sapiens
RSITSWKPCCDYEHYSDITYWGYPNKEYEVVTEDRIFL

SEQ ID NO: 953926 - protein, 40 aa, Homo sapiens
SPVPEPSQQIRAGEAPEWMIQQIGPKLDGKIPASRAQEFS

SEQ ID NO: 953927 - protein, 101 aa, Homo sapiens
TGVSHQLRLVRILRSTDYGSRRWRMDGLGINFEMKNDPCRARGRTNIELRAKFILPEGASQGMTPFRSRGQKVQTIFPGSFPLLVPAPVLVQSNHSCTSMP

SEQ ID NO: 953928 - protein, 62 aa, Homo sapiens
RRGLYYHRLLFLNTKLTAGHSGIRLLSQHFVEADGRRITRRSAARRPRPANHGQYPRVEPGT

SEQ ID NO: 953929 - protein, 43 aa, Homo sapiens
MVRSIACQPTAVTRLTHVNSKPALKGYLSSKFDTSWSIACFHV

SEQ ID NO: 953930 - protein, 77 aa, Homo sapiens
MAVLVFETEAVLVVVTGAGSSSMNRRLCCLYQLEVLRGLCEWRLCCLKREEIVLDCKGQRLVAGCRRQKIVLDNAII

SEQ ID NO: 953931 - protein, 35 aa, Homo sapiens
MHTTCFLAWVLTTSLMSAGKKYNSGGICPVTHHRQ

SEQ ID NO: 953932 - protein, 50 aa, Homo sapiens
SISSRIPLYPGEGSSYKCEFRSIRSRKRLSPRPLLHDLAVASTQRGTDAR

SEQ ID NO: 953933 - protein, 91 aa, Homo sapiens
MLLPIMLCDFEQNEYKAPKYPRKSFISTISFDLSPVLTYHAELPDSRLFFPILVHYDLHRIELLAFWLCSSPYYRPLDCDFRSPHLRLSLL

SEQ ID NO: 953934 - protein, 35 aa, Homo sapiens
VAYISRYFFSFSRHRRSICFWCFSSRACAIHLLQL

SEQ ID NO: 953935 - protein, 114 aa, Homo sapiens
MPRYLNSAPYSTICFILYPRILAFTSFSVVCSPDICNPLISQGISKTWLFYYVRFLQREGCIVVKVPADHIKCSINTLLLHHRDALTAQGRGLDISCTRETFMTKMVKVTHNQC

SEQ ID NO: 953936 - protein, 57 aa, Homo sapiens
RLSTNCRGKRLCWSAEWRLCWIVGAEVVLVVGTGLEVVPGPEVVLAVEAEVVLACRS

SEQ ID NO: 953937 - protein, 86 aa, Homo sapiens
VIWHVFGQITRGGSLVVRTSVILTIICGSDKITQAGSAAVHVAYGVCTGVLLGNITACTAACQMVVFHLKSTPWIKGQKGLIKVIS

SEQ ID NO: 953938 - protein, 153 aa, Homo sapiens
DISMTRDGCVANGRTQVLQLETWGSCIMYQVARSVANLSANLRGSQSFQENQLSGKSCRLPYCSLNYPVTLLPRWKKPGGSDGGGGNKTHSLWQAPPGKEGSEGVARPDILEFLGHFGLGFGPSSPETSYGGWGSMDLNCSQRSPSITFFTGK

SEQ ID NO: 953939 - protein, 77 aa, Homo sapiens
AVSLKLYRELSWVKGVRRIKLGFSLLKLYCRAVLDLQKSCKGCNRQFPCPSPRFPIVNIFHYYGTFVTTKKPTLVTH

SEQ ID NO: 953940 - protein, 65 aa, Homo sapiens
VSLREHEVLAVMGSGGCSLSASCTRSPIIRKKSLRRTLSERALPEGLSMKKHKLNPASNMYFPRD

SEQ ID NO: 953941 - protein, 34 aa, Homo sapiens
LIQEGAVSCLDSGEDLIGVRDASNLTSVVSEDAC

SEQ ID NO: 953942 - protein, 43 aa, Homo sapiens
GDPISIPTPILIYSVTLKYIFLYLPGYRNNLPGYSPPYPPRDT

SEQ ID NO: 953943 - protein, 70 aa, Homo sapiens
MDNRSENKNHPGKTTPGLDGFSSKCIHHSTSHFCHTEKDAVSQSYKSSVTIVYQMCIAFQSNNHFFTQRI

SEQ ID NO: 953944 - protein, 107 aa, Homo sapiens
TQLRDTGRPLRLPRNAKCYTPVWPRPTRSRSGIPNGNAPALVASLLPLRESSLSARTAWLLTFGGAELPTQSRAGLTGASLEAFPQLCKNLAQLPGIGVGDPRDTGF

SEQ ID NO: 953945 - protein, 56 aa, Homo sapiens
LYPVRTLGYAGWLPEQTCRKEEALRCTPSDQAVLNRAFFPCFDTACCEIQCIQLLL

SEQ ID NO: 953946 - protein, 67 aa, Homo sapiens
IKLVTRMNRMTRDSHCPVPNYRSENHEPRDTALGRNQLRGKKTLLTLDSRSGHGERDMSRCKGYRSS

SEQ ID NO: 953947 - protein, 110 aa, Homo sapiens
KLPATEASMIVRPKPNVLGILFSLKGSIAKRIAWRSLLVTLLASVIVLVETLHPAYFSKVNATPFTLLGLSLSIFMSFRNNACYDRWWEGRKQLGQMVIDVRSLIRETQV

SEQ ID NO: 953948 - protein, 165 aa, Homo sapiens
MRIPVSPISVQQGCIVRGYAYRCRQAPPNRVAVRTRKTLRNGFDGGPAKAQELSDLTTLIATLDKRVGDLLASQTERLIKRCQLSGWCKQTNLALIGQISLNSFCDNFLCLEEIFHVVRLRKFDQRNAEESSHEILMTLTNTLLKSNAKLLYQELCRYRPPEGFQ

SEQ ID NO: 953949 - protein, 64 aa, Homo sapiens
LEYPLYLPRPFREFQNAHRQLDDKTAQVEDFLQFRLWCKWPTDVIVANTPSDRTSFRDCTAGAI

SEQ ID NO: 953950 - protein, 31 aa, Homo sapiens
PLGPNWKQELVNHEGLPICVHTNVVTVKFVV

SEQ ID NO: 953951 - protein, 54 aa, Homo sapiens
TKTQPTDSNVNLLWQHLHRHTQDQYFAFFNPVKLTLSINHHRPGVLDQPGQHSE

SEQ ID NO: 953952 - protein, 38 aa, Homo sapiens
AHNIFYRNFFCSRMRSLSFCLALLGRICRLNCNMFRRS

SEQ ID NO: 953953 - protein, 41 aa, Homo sapiens
LYLICYYKIFKALLVKLLKSHESRHPVNRADDPRYSRVPVT

SEQ ID NO: 953954 - protein, 47 aa, Homo sapiens
TFYDIGVRRVARYMTFHVIDIPVCWRVAALYDIPCYVIFRCAGAWPE

SEQ ID NO: 953955 - protein, 92 aa, Homo sapiens
LPATDSASHYLAEAEQLCRNIGIIDHGTIVENTSMRNLLGQLHVETFLLDLKNNLSVAPQLLGYPSRLVDSHTLEVQVGKAMGITTLCVARR

SEQ ID NO: 953956 - protein, 185 aa, Homo sapiens
TCSYWARVLLATLLLATLRSGHAPSGHAPSGHPPCIACKTVIRCAARHMCSVYVADSLNWLRSSIEIELNSANDNPIIDAKKNVCLHGGHFYGGHIAFAMDSLKALVANVADLLDRQLALLVDVRYNTMACRATSQAPPVDRAMINHGFKAVQNRRQALEPPKLLKNTMPASVYSRSTECHNQDR

SEQ ID NO: 953957 - protein, 117 aa, Homo sapiens
PRRIDPLQFAYRPNRSTDDANLNHTALTHLDKRNTYVRMLFIDYSSAFNTIVPSKLETLGLDPALCNWVLDVLTGRPQVVRVGSNISTPLILNTGAPQGCVLSPLLYSLFTHDCVPR

SEQ ID NO: 953958 - protein, 103 aa, Homo sapiens
MNWGGISIDESTGLMFVNDMRMPLRMSLVRKEDMGKYKISTDEVPGFMGHGTPTICRPVRWSNTLIFMQSALGVPCNRPTFGTMSAIDLKTTKVGMASTNGNS

SEQ ID NO: 953959 - protein, 69 aa, Homo sapiens
IQRSQNNVLKNINRGLYKLLDLSVTDSSWPIHYYYFNSKSGCIIKSRNRTATLEAIDIKPFASGRSRVQ

SEQ ID NO: 953960 - protein, 122 aa, Homo sapiens
PSLLEYPLLLTTRRCRDLSLAGPARIAEDQCVKRTALVGFLNWLLKLPAPALICRRRLGNWSRTFSLKARAASSAASPKSAQVHVHLTGNHFRNLLQRFPAAGSAARCPWQMPTPGCLGQKG

SEQ ID NO: 953961 - protein, 55 aa, Homo sapiens
MRSWILSELTGTQNSALAYYSRHEKARGLGGLLPQINFRSEPEHFQIRTNRRGQK

SEQ ID NO: 953962 - protein, 37 aa, Homo sapiens
YDGQITLIPNPEKRYYNENYMASISDEYSNTHILLTC

SEQ ID NO: 953963 - protein, 194 aa, Homo sapiens
TTLAARTTYSRATMNQPPDINQYRPPKRHVGWIAVIIVTALVVALVIVARRVTTEPANPVTPTPSPIATSASSTPTPIPASATAVASSLPFSSKDDDTEGRWSIDHVEWGPNTVTLTDDHSAVTKGSLTDYTFFIMENQSTDIHQASQPPYRLTGTGVSQGHKVHGTITIDCPRTDATVMLTHGSGMSSPISAL

SEQ ID NO: 953964 - protein, 75 aa, Homo sapiens
MIRLECRTMLIPPGQSQLHGNFCLLSLGSFLCLNPRIAGTTGACYHAQLIFEFLVETGFHHVGQTGLKTAHLKLS

SEQ ID NO: 953965 - protein, 62 aa, Homo sapiens
RHSPCDTGLWNDAQVGSVAHITDAVTSLAARLLSSWCHAGGKASTEKWWPGFHGGVIPPEKG

SEQ ID NO: 953966 - protein, 54 aa, Homo sapiens
QHIITSLSSTITSITTSIRITITTITSTTTITIITTTILFTITTNKNGHAPPPT

SEQ ID NO: 953967 - protein, 56 aa, Homo sapiens
GAVCLPMSAESSVRVHVLQSGEMAGLELGAGGLVLGYLVACAALSSGGLQLILLGA

SEQ ID NO: 953968 - protein, 40 aa, Homo sapiens
VIFLCCVNEPSSETQAAPCDNVPSRISGVIQDFRGSVRDR

SEQ ID NO: 953969 - protein, 183 aa, Homo sapiens
NWCAVTCRGYWQISVDSITMRRRGHLLCLRCAGNLLTPGTSLLTGPTSPIANIQSDIGASENSDGDMVVRLVTHQQAVPDIGFTQSMESSTPVATQWLTSCRGKGSCIRWLPGHEPPQRNSGGALGTWVMSFLRPSVEKIGPKKLYTDNPFISNQRCAERRERENSYKKNCIQTSFCFQPTCI

SEQ ID NO: 953970 - protein, 38 aa, Homo sapiens
LPSCFRSLLTAESVTDNTFSSTVVHWSDSSESRYGLKP

SEQ ID NO: 953971 - protein, 81 aa, Homo sapiens
MGLLARHLRSYCTMVPLIRKKSLRRTLSERGLLKDFLKKQQPQPSQKVLPPVKGSHTGEMNSPWKNYLNIGVLRHYRASEL

SEQ ID NO: 953972 - protein, 136 aa, Homo sapiens
STRKYILAKKLPSGMTHHFHSLSLSLHTGSLNWVPVTCRGYWQITVDSIIMNGEAIACLEGCQRICYHTAPTLLDLAQSSPYCQQSMSDNGAQRRTHDGDIGGQLAQTIKQPAPTIVIHPSNGSPSTPVPPKCPTS

SEQ ID NO: 953973 - protein, 45 aa, Homo sapiens
NGNRHHVRLPVYVMNDVNATKVITTTATLGHLALMVDRRRGPEKP

SEQ ID NO: 953974 - protein, 67 aa, Homo sapiens
PHSMLTGCCYRRRLLQITVDSITMNGRGIAALRAAERYVLTPGISLLTGPTSPIANIQSGIGASVER

SEQ ID NO: 953975 - protein, 82 aa, Homo sapiens
MACQLTTMCHLDVSLGSAFSLDVGKCGLVAPVSREVPVSMSGLGALSAGDVASSVRGDAVHGDLPVTLDGNRHPVQTSSVER

SEQ ID NO: 953976 - protein, 71 aa, Homo sapiens
SQYLDGTGTSSDFHVYVEGVMPPNDHHCCHIWSSVLLMCRHDEEVLRNHVPWFHDVCQMTGVAAVREEMLG

SEQ ID NO: 953977 - protein, 191 aa, Homo sapiens
PRREQVLLSMGYRSFGAVGSVYRRRRVMGQWANGRVMAGIAWIVVAAISALNVALVVETVMGAMIPEVKFCGDNREMSDKLRRVTTSNPTPTPAHELANDLATAFRGHPAGVAILTTMGVAGPEGLTVSSLASVSVVPAVVSVSLGHDLDDSGRSYRGIARHRPHAVTRIALASLMTSLCQGPVTLRARVG

SEQ ID NO: 953978 - protein, 37 aa, Homo sapiens
PASSSAISALLTVLALSIFPGPPRPPLLPPICAIKGP

SEQ ID NO: 953979 - protein, 40 aa, Homo sapiens
VLKRLSNLWVPSVYCSSLAAATIDRFNPEDSSTYQSTTRQ

SEQ ID NO: 953980 - protein, 53 aa, Homo sapiens
WCESRRSPGHISLSYLAGPHNTSHSARLPLHIKRSNTLRLTHRSTLSLDNEPH

SEQ ID NO: 953981 - protein, 97 aa, Homo sapiens
MSELTSIEEAFLALPCMRSGQQRVLRSDASHACALVLQRVALEILEQRGHQQADHDTVHHDTVHHNTVHHDTVHHDTVHHETVHHDTVQQENSAPRN

SEQ ID NO: 953982 - protein, 63 aa, Homo sapiens
VSTFRTRKHGEACLVSDEEEKTLVECRSCLTCKSDVRPGYSALKDNSNHLVSWFPSESFPSGI

SEQ ID NO: 953983 - protein, 37 aa, Homo sapiens
HHLDMAKSIYIPYITTLPSTHHPEVTSTSTTSITPQT

SEQ ID NO: 953984 - protein, 45 aa, Homo sapiens
ALNSARIYLSPLTRLSNLLVPQSTAPVLPAPTTTCFNPEDSSTYQ

SEQ ID NO: 953985 - protein, 55 aa, Homo sapiens
VVWGTGLIDGDDDVGRLLVAEQLTTMLPSEFSLAPSVALGCWRMGLVVAGQQTRC

SEQ ID NO: 953986 - protein, 40 aa, Homo sapiens
HETIHYHLGGSVYAVPTWLAQLHLESCRFLMAGLKIRGIP

SEQ ID NO: 953987 - protein, 71 aa, Homo sapiens
GLLYPLSGLRVARACRSSSSHEECLVAYSVVLVESNVLGVPAIASDRRPTWSRQGNSCLKKKRVKSIQEDL

SEQ ID NO: 953988 - protein, 86 aa, Homo sapiens
MSLSKAAIASFDVDAQKSFTPLCPNELPVSGVDGIGAELNYMAFSAGHRIGRLDAQTPQAPWVVCSAQLDAETHRPGTATHCTTTQ

SEQ ID NO: 953989 - protein, 46 aa, Homo sapiens
YVIAHMIINDEYGLEVLVMVMVRRVYREEDSYEKDYGMRFACVRKY

SEQ ID NO: 953990 - protein, 35 aa, Homo sapiens
MIGYVALDKLLTFGVRSLIRYRAKIPELNLIGVWK

SEQ ID NO: 953991 - protein, 80 aa, Homo sapiens
MIDIKPVCDPVWYMMNIISHQYRRGEIDARNAVMLEGDTSQRSAGVQCFNNPALCGKTSWFVVDADNHRVNTPHLWIDTS

SEQ ID NO: 953992 - protein, 128 aa, Homo sapiens
DPLHPAPQTTYLESLNGSSVRILVGEAISTYNSVNVGWEFHSQHNTFWFLGYPYIILGQSSPSVTQFGTRAHKFTHRGDKEATQLLACVPVHERNNRVTRFTVTDHHQTVKEVTGWATDGDVLRSLVS

SEQ ID NO: 953993 - protein, 35 aa, Homo sapiens
MENTKARRGGGGPDPSVIFAAESDRGGTGYIALQT

SEQ ID NO: 953994 - protein, 155 aa, Homo sapiens
MAKHGSELLLMMRIEELLDGCALANECVTAILRPRGEMSQRAVLTFVGDPFHKVAAEYYVLHVKASASSTSFMDILTMEDSSHGEVSAVGRVQARHHVLGIEDLRATKLEPTALGGVHQALGLCTLLISKIREEYPVIRIMITFSVVPSPKMCLD

SEQ ID NO: 953995 - protein, 44 aa, Homo sapiens
TRCMDTEPRCQHRCDYRTRGIVACRSKNEAEAPKFTLTQAYHYI

SEQ ID NO: 953996 - protein, 113 aa, Homo sapiens
GYGGSLSLLLTSWLTPKSLCNPMLPYQASTKTLLYRVPLPLCTVCPLIKFWETESFSSPDMSAVAMDRTHCGVTLLAQAIPPASGVAKTRGVHHQNLTNIWYIVRTLVSLTTG

SEQ ID NO: 953997 - protein, 44 aa, Homo sapiens
GSIGFLRRTIQKNRPSHLFLSQYDSCRVIIDKITRKSCATLCLL

SEQ ID NO: 953998 - protein, 70 aa, Homo sapiens
VSGIMAAIMRVVSGAVRPVHSYFRQASSCVCFSVHTSLVVMDQNSFLSVRSLAYGSNIPRYLSPYCKVSR

SEQ ID NO: 953999 - protein, 47 aa, Homo sapiens
LTLEDSRPLSVGLTVVTAGSGSLRMCAPFPVNTQWRVMPDLYFYRDP

SEQ ID NO: 954000 - protein, 79 aa, Homo sapiens
IPRLSVTRCQWTGTRLGLFSHDNSVPAVLALFAARGALVAGSGKVHLSKALQRERAGNRLLTSFHFLIEGAGSSLVWAH

SEQ ID NO: 954001 - protein, 69 aa, Homo sapiens
RVSVPDDKVLMHCSEIRNLLARVSLMFPSAKSLTDPLLPDHGSTMITTAVLSSDNGPLSKRPWSGRLLD

SEQ ID NO: 954002 - protein, 78 aa, Homo sapiens
RDPRSSDVLRDLQKVLTIETVYKQLDKYLQLRNVIKRLQEAKHSELYMQVDLVCNFFVDTVVPDTSGIFVAPWIWLFP

SEQ ID NO: 954003 - protein, 46 aa, Homo sapiens
AGKWDLLLASRGKRLGTLLNILNDIGQPPRQKNYLVHDVDNAEAGE

SEQ ID NO: 954004 - protein, 56 aa, Homo sapiens
TRSEYDLTCHLTWPREMPQVSPSPGLPSMWGDALFNGPPDRDLVWLATWVSMCPAW

SEQ ID NO: 954005 - protein, 55 aa, Homo sapiens
MGQSRYLLGAVNAQPKGLLGHAYKIGGSTEVLAPVPLRHIGQAEAQIGPHTLTDN

SEQ ID NO: 954006 - protein, 67 aa, Homo sapiens
MGGLGCADSTCPCRSPGADGCSDGLVFLVYLDPAASSVCVLWLTMLPAGTATLLAAALGEECTWCIR

SEQ ID NO: 954007 - protein, 40 aa, Homo sapiens
MLWGRLLYKSPITVLVTGLRNCRAPVKVNENVLHESICGY

SEQ ID NO: 954008 - protein, 45 aa, Homo sapiens
IPTACCMCRGCCTLLGEILMPAEIPQCVRQVTLVPHQHHVHVILS

SEQ ID NO: 954009 - protein, 39 aa, Homo sapiens
RTRIDRWIALSQENGGVTGTSPHCKIPLKGDIHMNVSTR

SEQ ID NO: 954010 - protein, 42 aa, Homo sapiens
YYPLYLLHNELTRNNLCNGEPKLMTPENQTSYLRTAKRAHVV

SEQ ID NO: 954011 - protein, 82 aa, Homo sapiens
RPDVVCGIPELSDLENLKYVYDALEASGYTANATTYFTRLIESSLGSVAQSSINVIHNLAQMKFTGSNARLPLSLASRAHAT

SEQ ID NO: 954012 - protein, 131 aa, Homo sapiens
RGSRVCRVDPKNLPRVCTLVLSVSSDAGLGQTFEQSQCAHCAVPMVPLKASARARVLREELALYWKLVEESTLTNQMRLVLVKRESGRPLYLRLVTDHLRLFTLYEQVSERLRTLPCTVPLLLIHSLAQAH

SEQ ID NO: 954013 - protein, 33 aa, Homo sapiens
SRVCYTWPDVAHAGNDQIRTPALINFRMVVAVP

SEQ ID NO: 954014 - protein, 38 aa, Homo sapiens
VPFVIVYSDTSNTWYEAQSQITENLQLSYTYNCPHKDG

SEQ ID NO: 954015 - protein, 66 aa, Homo sapiens
MSRIVRYGCPHYVSAYNIARPTRERGTTMVAYRRGRTGPWSGTRSMVKTSLCRYSKRDSRLVIDAH

SEQ ID NO: 954016 - protein, 37 aa, Homo sapiens
CRSVAATPRCRTSALLNFLMVARLCVPVADHWDDERI

SEQ ID NO: 954017 - protein, 161 aa, Homo sapiens
IPRRVLVGGYECILGTVVDDNNLLVVRDSGISGKERSQGMTSVDGLSSWMLFSLMRNLWENANYKEHTQSRMMDVSIRLGGILTERRTVNNPKDGSFAQWVPQPSTYTNCLNLRYLSYLRRITMATTHHQRGTPNLSHEGLNPGSRTLLVGEQSYSWVNSD

SEQ ID NO: 954018 - protein, 68 aa, Homo sapiens
DFKVRFWKSNTIEYFRAIPNNELWQSTSLRITDEVSRGQNELYHTMYCISHMNCHMYIQLTHLRVEEQ

SEQ ID NO: 954019 - protein, 34 aa, Homo sapiens
MAVSRPVRMSLRERPMPDNLPSLQTRATSSASES

SEQ ID NO: 954020 - protein, 44 aa, Homo sapiens
MPKICFFIFGEELQLEKRDSLAALYNSHCSPVSVCFLIKSFWNT

SEQ ID NO: 954021 - protein, 46 aa, Homo sapiens
TTCISAGACCPSRLGVCCADLAPLLSCWLPLTQPGCTNVFAARAGP

SEQ ID NO: 954022 - protein, 34 aa, Homo sapiens
VLSGLLQPSPIDDHPPSYTLTLGDKKGGKEGARM

SEQ ID NO: 954023 - protein, 46 aa, Homo sapiens
MYAPDRPWIKLSLPQLARSSFAVVYILLQVHRPDADYRSCPIQPTV

SEQ ID NO: 954024 - protein, 86 aa, Homo sapiens
IESVCTCVYTLTGTLLPVCTNATESNFIRLSQCRSQVESIPITACFRHRKKGCGRYSKEAMLSSFSIISKTKKPNLSPSFVFQNKK

SEQ ID NO: 954025 - protein, 70 aa, Homo sapiens
FVSWACVLVRVVLDSIDGEDDVCGSAAGVAEQLTTYVPSEFSLAPIVASVSVVLCRWWQLSEVHQCTTVP

SEQ ID NO: 954026 - protein, 63 aa, Homo sapiens
MCSVHCHAWVVGLLSFFYHNCASSAHGNFVDYPWAVVGNGRANQEPTNKMRLREPKPRMARWL

SEQ ID NO: 954027 - protein, 91 aa, Homo sapiens
QVTENSSDLSLGHVTRALCRGIVLNHALHGYPIQQLQEWGVDEGDGHVGVLLSRNDVLKQEVARGLTLCPYPEGRMWMQLSSGSSGHSFRS

SEQ ID NO: 954028 - protein, 93 aa, Homo sapiens
LIIQSPSGWSVVICVTPASPAIITNSPGRPIIICITPGRTVIICSSTRKSIFIGTTSGPSVIIQATPGDTIIIRSKRRLSLFIVTPQAPQPST

SEQ ID NO: 954029 - protein, 109 aa, Homo sapiens
MILDNVNPNDLFPTEKKGLSVLGTIEYSVQGSTEFEGAFIATNERIILNVDMNGEFYYRSIGYDEVEKITYEDGRIHFTFNIGPMPMKDIQKGDAEAFVQFVKDKINIQ

SEQ ID NO: 954030 - protein, 77 aa, Homo sapiens
VDILTANEKNIISKAWDNRYGVLMVSELAEALSGQKLGNELYLGSNVQEEVGLRGAHTSTTKFDPEVFLAVDCSPVD

SEQ ID NO: 954031 - protein, 122 aa, Homo sapiens
VLKDYRANQDFWVLTASKLPESVFKDMMHSLYANAILNLGQWRKACDIYVKQGDWESMEWAMRNYRNLAGIKRIYKEDPNSPTLTYLLHYFVNGGYGWEYNYESSLKADRRRGREFSSSRRP

SEQ ID NO: 954032 - protein, 112 aa, Homo sapiens
PRRHQRPSSVNHAGGCDVLGLSRQHGEIVLNHLVGQRLINDRRKSRERQRLARIQHPSPVHRHRFLILGPNMFDEKTETEDLNQWNRLERLFAIASLINPIDHPSYNAWCAS

SEQ ID NO: 954033 - protein, 57 aa, Homo sapiens
MSSDYIFSPEKVADMFEAIAHTMPPYQQIYEACRGDSSRPDMKQEDYHLAALVSCRR

SEQ ID NO: 954034 - protein, 132 aa, Homo sapiens
VREETAASACGTYGFSREQEQQEQLIYSDEGIVGQAAQRDRLIRLDDVPVDYFKVSSGLGEGAARSVLVVPTSDDDRVNGVVELGFLRPLDERDIELLELIAGNIGTSIEAARYRQRLQEVLAETQQLNEEL

SEQ ID NO: 954035 - protein, 57 aa, Homo sapiens
AHGYFILQQLEIESRDQALYGPHQRTGSTDPKGNSGTGDYMGATCHASIGGTNVRSI

SEQ ID NO: 954036 - protein, 52 aa, Homo sapiens
MEQYHTEELTQCCRCTLCTAKSVSSDMPKRQILGSGKLELSCMEGSCTCSFH

SEQ ID NO: 954037 - protein, 77 aa, Homo sapiens
MGIGNIFLNITGTKTQVITALRIKMPEVSGEIAFNFSAILAAAITSDKVDVSKKADAMVVLVSNQRLMKNTGINFVD

SEQ ID NO: 954038 - protein, 49 aa, Homo sapiens
IGTQCVSRMWNVSSDESTWEVKTRRLKVTQVADSGQRLVGQDSGRGALV

SEQ ID NO: 954039 - protein, 56 aa, Homo sapiens
RLEHPGLQVSGTHPAKSVIANVWGPRKLDGVVKAVATTVHEHQRALGFQVDQVCGT

SEQ ID NO: 954040 - protein, 120 aa, Homo sapiens
ISSSTVTNLISLINQIVEDAAMKISDMPLVNSVIERLHASQSRLLNGDNSALAVLRKLNSLNRAGEVVFSGLMCFGVYPQQFFPQLFIDVAKHPGQQKSADPEVRFDHRKVCEGHIKGRR

SEQ ID NO: 954041 - protein, 61 aa, Homo sapiens
RLEDLVASEAEEEAAKEDSEAEEEAAEEDSEAEEEAAEEDSEAEEEAAEEDSEAEEEAAEE

SEQ ID NO: 954042 - protein, 37 aa, Homo sapiens
IEPGRYVSARLTELGVPMSVTVMVMLYIDYEISHVQM

SEQ ID NO: 954043 - protein, 71 aa, Homo sapiens
NKHNICSHNEHNFCPYNQHNLHSTDHHILCPYKQHTYGSYHLAQSTAPHNHAQSTAPYNPAQVDSSRRRPC

SEQ ID NO: 954044 - protein, 44 aa, Homo sapiens
IGPQCSKKSMHKDTRCTLVIGAEVDREEVLRNQALVPDVVKDGC

SEQ ID NO: 954045 - protein, 33 aa, Homo sapiens
EHTMGYPYPGPKVCPPSGMPYPYSQISRTLGSP

SEQ ID NO: 954046 - protein, 41 aa, Homo sapiens
GLSGRSTKALGTESMSSGSSQRRPCHRLHIAPGLWLDPSSG

SEQ ID NO: 954047 - protein, 47 aa, Homo sapiens
GKELARARARAGELLAQVGLENCADRRPHQLSGGQRQRVNIARALMN

SEQ ID NO: 954048 - protein, 66 aa, Homo sapiens
RTHTPLVTTKKRDVRSAFISSGLFSTKNLVSYLRLQKENFQECDRRADTDEDVVAWEKSRGLTMQG

SEQ ID NO: 954049 - protein, 55 aa, Homo sapiens
MRTVDILNLSDNQPIEKYHVVFFPACILLYDEAWGMVYENVGAYVTQTIWQLIPV

SEQ ID NO: 954050 - protein, 92 aa, Homo sapiens
SYKHLHSRYQYWRVSPMDPTQHATYSLPPRDQDTETTAVGATHCARFLEPSPSIYRQDAAGKKTTANSRRLMVRTDDDIYQNLLAPKLRGIR

SEQ ID NO: 954051 - protein, 64 aa, Homo sapiens
MPIGLSQWAVNFLTSQEGGRSSWFHSLEWSKGSTHIGLSEHTQSVYPFHVHFHSSRPGDFPSAE

SEQ ID NO: 954052 - protein, 68 aa, Homo sapiens
FAESQDNATAYQPVRRSKYYVSVKTEQQINMMSTKYNSRDVQTIASLTDKLIMPSDNPNVTSKTVRRC

SEQ ID NO: 954053 - protein, 116 aa, Homo sapiens
MLLEKVSVKDIEQLVADGTIYGGMIPESKGSNKRAARHHTRSNDRRWYPFKNENRDFFDGNDNYIYLCTIQCRNIEKERMIVALFPTYQRFPLAVQQAEGTTVVDTNGKTYLDFGS

SEQ ID NO: 954054 - protein, 70 aa, Homo sapiens
YRNLVFINALNDTAGSRENLSRLSCSVAAVVINAPRTIQCHVCCKAICDHVKHIWFGTPEGEFVSMGCYL

SEQ ID NO: 954055 - protein, 30 aa, Homo sapiens
MTGPNVSVVETGNGKSLREREKTWIPDDER

SEQ ID NO: 954056 - protein, 70 aa, Homo sapiens
MNEFLIVLTQYLRLMPSVDTTELCLNSTLCDRGLMPLVTAVGVDAVLVLFSKGAEGQVSETGSLSLQEEQ

SEQ ID NO: 954057 - protein, 46 aa, Homo sapiens
MPKNSIYTLEQILTRLSILYSLLALIIAVFLGEYPSRSLTMQVLRS

SEQ ID NO: 954058 - protein, 53 aa, Homo sapiens
LHINSSLYQEECYGLELCLCKVVYQNGCWKSLPTTTAGTLEAWSRVTTVKGVR

SEQ ID NO: 954059 - protein, 46 aa, Homo sapiens
QVNSYDNIKDVTIHKVEAGQNVGRGNKENIDLKERPDMVAYACNPS

SEQ ID NO: 954060 - protein, 107 aa, Homo sapiens
MYVTTQESSELVDNYVIMMIPFRDYSSNSYLQLIREDSINHCKNEDASCLSAKSVEQYYGLGKLEKGEPLVAKSNDNAKSLTRNPGEESEISPPDSPQNQAHRSLVP

SEQ ID NO: 954061 - protein, 103 aa, Homo sapiens
YRWNAHPRDTADIGRVVSTMEEWHVLQLRTFLLCHSQLLITFTSTLTELKEWLLPVLSSTSCFFLGDNVCQKWEREGQKVCYTNSTPPKMDWRFFMETKNGDR

SEQ ID NO: 954062 - protein, 94 aa, Homo sapiens
SVPSETAMTSSRHTPFGGFKESGNGRELGEDGLKAYTEVKTVTIKVPQEELVKSSMSREAQITDPANSTIHLRPSALPKLVLRAIEHLFLMFQS

SEQ ID NO: 954063 - protein, 96 aa, Homo sapiens
PARSPGISYYTSQESIVDVRRCCEKMLNQNNWKLFTVNDVSYMLQKIYVICLAEPRVPLCLDKAVRTEAEGEEEGRATVNQDTRLDNRVIDLRTST

SEQ ID NO: 954064 - protein, 96 aa, Homo sapiens
YHLAVPGYSYTTGRTNFDPSSSGNLNDSVIRHARVCSEVNKTCVLNYSHKTHTTKMENEECNEQRERKKEELASTAEKTEQKEPKPLEKSVSPQNS

SEQ ID NO: 954065 - protein, 108 aa, Homo sapiens
MESGARYQASREGPLSRMRIITTDQAPPNAFTLSAFAHDHSTTLERRYQQSPVTNQYTLASMAPRSPCRLGGCRPPMCGSRDWDKAGVRSNEIRERYGGAGPGGGGYA

SEQ ID NO: 954066 - protein, 57 aa, Homo sapiens
SSIRGALENLFSTLVSTFLCKLLSLNHHTQDLLIHICWKVEREARIEPPIQTEYFRS

SEQ ID NO: 954067 - protein, 88 aa, Homo sapiens
RISPFLLTICCHHVCLAPGSCAGVPLNTVRDVLGPGSVAMSLRYAHLVPTNGEKPLAKLNEKPALRLRCAYSGAAFTLPDIIPITPHN

SEQ ID NO: 954068 - protein, 69 aa, Homo sapiens
RIYSASSRDLGSRSMVDRRTCKRRGLHNKKNWRRTDLWLATISRYRNNYEKVWHNRHITVRVFQENDLV

SEQ ID NO: 954069 - protein, 51 aa, Homo sapiens
GENSVGDPLLLLVGVTGTPVVCVLLRILLSTTASEIVIFHKLVTSDARSTF

SEQ ID NO: 954070 - protein, 115 aa, Homo sapiens
EGTPFRKRQSADYSTASHGISASTVTGHESQPTQGAAQVDDTSGQEPSRSDFTDLNADMLHAIMELVSDGIWDWNANTGFVYRNPGYTKCSGTPITPWKNSVYTWENVIHPDEYP

SEQ ID NO: 954071 - protein, 101 aa, Homo sapiens
MLQGSATAQKDSDPEPKEVVDISSDSASSSSSDSDDDIPIGLLYRKPIKIHPRSNKNKKKPSQSSSNEQVGHIITQKLGEMAEYERRHSLIVSSAIKPDNF

SEQ ID NO: 954072 - protein, 34 aa, Homo sapiens
MDAVTEIYVLLIIMEVAQSRKLQYANYSLTYSDG

SEQ ID NO: 954073 - protein, 36 aa, Homo sapiens
RILSSREEAQEDNEGICWSWLVISSLGYSHTLGYRA

SEQ ID NO: 954074 - protein, 66 aa, Homo sapiens
QRTLCVVYDGGLRTEGRLVVPDDLQLRRELISEAHRTRYTVHPGTTKMYKDLKRNFWWKRMRRDIA

SEQ ID NO: 954075 - protein, 70 aa, Homo sapiens
VCVRTFSDFLVRLLRGTPMCSIHACSRFAPITAMVASYPTHSSAASHHCSVTYHSWTTTDTGWAPELARL

SEQ ID NO: 954076 - protein, 66 aa, Homo sapiens
MCGVMNRHNRKDIPKGINGHDFILVAIDYFTKWVKAQSYAVLKATHVAKFIPNNIMCWYGIPHSIT

SEQ ID NO: 954077 - protein, 88 aa, Homo sapiens
ISCGAACLTRRERGSMLKEGGGEDDRGRVDLPSHHHSRYTSGPLHQTQNPPESRIITTNLATFTAPYRSNPTASAAPQASHLRYTSRF

SEQ ID NO: 954078 - protein, 74 aa, Homo sapiens
LAALRILVGHCSCAVLQEDLSFQLSLKCQRRAPGSPETQAWRLILREKGGSSLADDLQAILVQQSYQDVERAPM

SEQ ID NO: 954079 - protein, 32 aa, Homo sapiens
MRPVYVVQLWGFKMVQLVKAGMNFQSVGCLAS

SEQ ID NO: 954080 - protein, 65 aa, Homo sapiens
MMVHQLLSLSLFMNEKIVVSSWYIGAAFHSLKKLSATILSRRMIWNRRLRSPLSSSCTFHRHNTT

SEQ ID NO: 954081 - protein, 74 aa, Homo sapiens
LSLLNSSFLKPFILLMVCKQHQNVRSTSMYMTFLALIRPQRPHPQGTCRDFGRSLRWHGGGSVCCSTLRFSLGD

SEQ ID NO: 954082 - protein, 65 aa, Homo sapiens
RSSRILEIVWCYGYAREAGMNLGMSETPVRRRPLVANEWSISLVKTRSRILVANPTSMDHVAKSY

SEQ ID NO: 954083 - protein, 46 aa, Homo sapiens
LTDELSELGRANFNERISVRLNKFKPTKGYDRVGEEALTEEEGDIE

SEQ ID NO: 954084 - protein, 50 aa, Homo sapiens
TGSPECVVLWISTNITINVHPRARDTNYVQTRGNRYSMYVYVRIRTTHTI

SEQ ID NO: 954085 - protein, 90 aa, Homo sapiens
LVVIRIITFSQVNRCFPGSDGRTEHFVPAGVAVDETGVGFQSQIPSLTSSMMACSMSALRSVKSLLEGSWPDVSSIACSLRGLALMASYC

SEQ ID NO: 954086 - protein, 51 aa, Homo sapiens
SNNVEKVNPGKCPKNHKTMSPENDVSLPESDVIPVNFLVNDRKPISYVHNT

SEQ ID NO: 954087 - protein, 50 aa, Homo sapiens
MIYRALPAWSLLVCFKTWTITCEKFDKCSDTIHSKEWKPKVRSIANSDNS

SEQ ID NO: 954088 - protein, 70 aa, Homo sapiens
RIRNVWCYENRTVVKHIYIVFGIRPNYDFWHSHGEKPFSSVEDVVDDHDNDNDDDIDDIDDEIEEKEVPQ

SEQ ID NO: 954089 - protein, 107 aa, Homo sapiens
MVGAALPGGSGFHKPTDCPPAKSPREAAKLLIPLGPDCRVFLIVNSCLGCFSLLKLETQGASSTHCLPPLPAGVSGPRVSAGSPGGWGPMKPNIKSQECHVHGSAYG

SEQ ID NO: 954090 - protein, 121 aa, Homo sapiens
YRILGIVWCYGPILFGYLNGPIYRGVSFLFFPKRRMPFMGETFNKTKSPTINSRGLRLWSAELFFLFGAVLIRSRIKATFSVVSLTSSGPNKILSSGSAQHIGDLQGLPYRASYGAMSMVD

SEQ ID NO: 954091 - protein, 50 aa, Homo sapiens
HTQCKQLMHHAFRAFQWPVVFTRQATQLMHPCIPGIPVGLSVLHHSRHTA

SEQ ID NO: 954092 - protein, 76 aa, Homo sapiens
RISELCGVMPKNIVLIKTTSSHCIAAFFELSGLNEGTPLLIASTPVIAEQPEANALNKIKTPYPDEKKCSADACSR

SEQ ID NO: 954093 - protein, 73 aa, Homo sapiens
AVHFSYFSPTLSGFLCSPTLLISISPTLHSPCLTLFPYLFFLSIHGIALHVSPAPALLHPSAASPSGSRSSQL

SEQ ID NO: 954094 - protein, 118 aa, Homo sapiens
QCHCKVFVIAIWSRASEARTKGDRFSSLRPYGAACIVCACWLRSFDEVIFHGCAALRIHRIYPSMSLCTMLGAVIPSFGVPSSVHMPLMVILLGLASGLNGFASRKSRRGREFSSSRR

SEQ ID NO: 954095 - protein, 36 aa, Homo sapiens
DLQILFRETEGEEYLNRGGGGCSEIVLQPGHRARLS

SEQ ID NO: 954096 - protein, 109 aa, Homo sapiens
STLAKAPKGSAVFLSNSGTEANEAAIKICLARKNGRIIALNHAFHGRSLGGLSLTHKIAYRQPFGPSAVDVTFIAPEDPDALASELDRGHVSGVFMEPIQGEAGVVPVD

SEQ ID NO: 954097 - protein, 143 aa, Homo sapiens
MELPPNAVTYYWTFKIDGQNKVTETKDPSFPKIAGEYVSLTSKTEMPPIHDFYIQDKDRTTDYLEEFINKDKLLMVISYRLDRANQEAFKAIKPVTDKAMKNGYTVIGLTSQMEKAPYIVKKYELNFNFYYNDATTLSTRPRI

SEQ ID NO: 954098 - protein, 36 aa, Homo sapiens
LRTLYSATLESHHNPSLNGCKLYVPLSSCFDRLSSQ

SEQ ID NO: 954099 - protein, 160 aa, Homo sapiens
ESLHGFSCGTATLLNRTFILPVGAVLYDPDSWDEEKQEYTRISEPAQVKPSTPPPSGKRPHTYAQTPPVHPVLAGFLLLTSNCPSPAALPYAEYDPPLSTMTGEPHASGAQHRVGLADSLRIVILFFPLAAQLGNLKGKLSSFHTWVWAIALLGIVTAVD

SEQ ID NO: 954100 - protein, 81 aa, Homo sapiens
DPCLARWSRHDHCGRAITPRTANPFTSPSVPTATYEDIIPVLHMYKLKLRDGEELDHKACKCPLPYVERVNLRAWGSPWIR

SEQ ID NO: 954101 - protein, 142 aa, Homo sapiens
DISRAGLSFSMQTAKDVTVTIGGKTQKITAVGTVADALKAAKVEVDSSDAVNPGLGTPLSDGMKITLTMVDQKSQKRRVAVPFSTKKVEDSSLPKGEIKVITKGVNGINEETWTVVFKDGKKVSEKKVSSVDAAANLVVVGA

SEQ ID NO: 954102 - protein, 30 aa, Homo sapiens
MALVSGTESCVVGKATLVCAEPSSPNGGPK

SEQ ID NO: 954103 - protein, 139 aa, Homo sapiens
MRRRVEASYVGVYACLLSTALITAMLFAFMMMTGLGSLGSKVGSAVGLSPSYAACKAQYQKSIETGSDVNPKCQEVMEKAGELMMPTIFQVLSVLGKIPGLKRFVDVEASIQERTNEVIHEVVGAFDDFVKVPVDAAAN

SEQ ID NO: 954104 - protein, 139 aa, Homo sapiens
ILDREVGNHKLHKQVAIVAAGNLETDNAIVNTMSSALISRFAHFEVKLKNDEWLDWAASVGIDFRITSFLGFKPDLLYTFNPDATGPYAAPRTWDMLSRVVNGNPIDSDDIPLLASMVGEGVAREFITYTKLYKELPVD

SEQ ID NO: 954105 - protein, 61 aa, Homo sapiens
MHKEPRKVREFRRREQEILDTALKLFLEQGEDSVTVEMIADAVGIGKGRRGREFSSSSRRP

SEQ ID NO: 954106 - protein, 90 aa, Homo sapiens
YIALISYTARNLARRSAVDFPWGLPHDVIWGNSIMRGNGGADGRGCLCIASWLRIIGALHQQYERFRVLAFHRESGDGVRPHLGGRCLST

SEQ ID NO: 954107 - protein, 70 aa, Homo sapiens
MARRTRGKTGAPVLSSLEGPFLITGDVRDDAKAMGCPRGTDPEAGLQGRVRPEMKLGDLSQGFSLIQGHA

SEQ ID NO: 954108 - protein, 52 aa, Homo sapiens
SRLLLDRTKDDECRNETDKRICLKEGVRLLDIREQGPEFAAQFIFIVESEKG

SEQ ID NO: 954109 - protein, 65 aa, Homo sapiens
MVSYIVKVTDSIRFLPKGKRAQIVTVTRSTHSRTHALNTHMAASQTTVCYCILDTVHSLLLFEST

SEQ ID NO: 954110 - protein, 61 aa, Homo sapiens
GAGYQKCWGGLSTLDLAVRWEKPNVRQWDASCVPIIKLYCDEIAIFLQIQGSSDNCPWGRR

SEQ ID NO: 954111 - protein, 39 aa, Homo sapiens
IFGRHSAPCLPGLVSPHSCAPVIPHASGSHSAGLPGVSP

SEQ ID NO: 954112 - protein, 101 aa, Homo sapiens
RRPDLVIIGALIVANKTLSPQYFIWWAAPTAMILDRVSAEAKDPGDSDALSWARTWCWIVAVLMAVTTFMTQQVYPLHYQKILGGSSSTGWLLVSRNMRRR

SEQ ID NO: 954113 - protein, 74 aa, Homo sapiens
MAPNSGIGGFTPKPIKARPEILNINFTKICSNKCHNVTDEMWHNVMYCNLELRHPTKWRKFKNGCVIVSRAKVD

SEQ ID NO: 954114 - protein, 55 aa, Homo sapiens
VECLVVFKSSIRVFFFKQAIFFVVISSMSCLHHLLSVPPRRIAPLRPAHAVAFSV

SEQ ID NO: 954115 - protein, 102 aa, Homo sapiens
AFLLLVYPMSEYEGALDSAYYHAESSIQLTNGNEVKSLLQMLLLHAIPEPVISDKKAFDVAKRILKLDPNNNVARNVLKDTAKRMDNIVVDINELNKHRDAR

SEQ ID NO: 954116 - protein, 146 aa, Homo sapiens
ITRKKQKKIRRVQHWCNCKLYVKYAWYEFRAMVKDKVNDYGKKILELLEQKGSVSMNDDIFPLVEKEFEGQVIGAELYELAHQYISQLLYGVHTAGVAVIAVPKFAAGQQFGQMVVADVIYTKVNDTPYDFMQELRNSYGRRGREF

SEQ ID NO: 954117 - protein, 44 aa, Homo sapiens
MLLCEADGRRIAWALEFKATSEPVITMCTLRLGYIRRTLSHTKN

SEQ ID NO: 954118 - protein, 43 aa, Homo sapiens
PRAVCMASSASTFGLWYNAALVPAYVTPGAIHLNPAFGFSETL

SEQ ID NO: 954119 - protein, 135 aa, Homo sapiens
LTAPWMQGATTLIPGRRQSAERGYVSCPSHTCSAVAGLEHQLRLFADPITVTPSSPCALGPAGQDVSKLQALTELRGSLWKVTELCAQNRVGGVCAEVALCVGTVCDTNTALDRHLSRDLLASNPKGTTVAVHET

SEQ ID NO: 954120 - protein, 51 aa, Homo sapiens
LRRESAVAPRCYLPQRVVSPGLGGVVRLGSDLLGRCARQGGLIGLPTSVIE

SEQ ID NO: 954121 - protein, 94 aa, Homo sapiens
MGTNGVKLYAVEENRMECKCKERNGLEWNGIHWNGRECSVMDRPGIKWNATVSNGIKMYGMECNETESNVIECNGIKKMDSKIIDWKGWVSSRR

SEQ ID NO: 954122 - protein, 107 aa, Homo sapiens
MHDRYTCAVGFLVISSDSHRCFDSEFFLIVVRKTLDLPFEQFLSAQFGGNKYIAIVYAAITTVHLQSFTIIPNRALAPLNTNFPFPLSPASHSPFCLSECDYSRFLR

SEQ ID NO: 954123 - protein, 35 aa, Homo sapiens
CTGLMALADFSSHRDGPAERQARILQSTCSEDPVN

SEQ ID NO: 954124 - protein, 112 aa, Homo sapiens
STLKLNNVVQLVYFATMQSRGALLSLVLMIGFYSFFINRGKLAKRFLIFIVSALLVSATNIGLSYVTSIYISSGKATVLDLNKGQSYAETDSSVIKKTGELHLIETTPSGST

SEQ ID NO: 954125 - protein, 44 aa, Homo sapiens
LEHPLIGSSTISDFRFEAKVLIVENFNKLEWLYGCPTLRIEETI

SEQ ID NO: 954126 - protein, 38 aa, Homo sapiens
MAHVVSPELVTICLYPGIGSRTGNLCVCQLTTHAHVPL

SEQ ID NO: 954127 - protein, 117 aa, Homo sapiens
MSKPFEHIKNMELIKEETDWLAQHTNEYETKTYQEHMERYESLTNRFEQLEGYQYESKIKTVLHGLNFTESDFNKPINDFSGGQKTRLSLAQMLLNEPDLLLLDEPTNHLDLETTVD

SEQ ID NO: 954128 - protein, 173 aa, Homo sapiens
MGSRPSSPWIALRSTDHFWRAAAQFECAWSASLFPDISIVSALGKSAGPGEENYNDATGQLLTEMLHNLDFCDILVIGGDLDPRQECLELNHSELQQRDLDATKFYCRLLPSTVWAPIEPLLSRVLHQIRIPQLASGFPLAPRYRIKCSELNGALTLAMSSNLEVSIPSSKNQ

SEQ ID NO: 954129 - protein, 41 aa, Homo sapiens
GAHTHIQLCNSRLYRANLRLGCTPRHIVHILIVYSRRGREF

SEQ ID NO: 954130 - protein, 82 aa, Homo sapiens
VALAVVLGTISAHCNLCSPRYKIVSCPRPPAYRRITGMCQQHLANLVFLVQTGFLPVGQAGLEFLTSGDPTVLDSSVLGVRA

SEQ ID NO: 954131 - protein, 65 aa, Homo sapiens
STLEWKRRVWYSTHCKGPRSKCGIVDYVLVSRSVHRHFMYRVVNMEQLPVGIFNLLSVSCLIRNR

SEQ ID NO: 954132 - protein, 78 aa, Homo sapiens
ASTDLFVQTARHNTSIHRLITQWSWRFFISRHRSLLCDVVLHKKLTTSCSAYIPPSSANPDEGYKVSASTHVKTLGLP

SEQ ID NO: 954133 - protein, 85 aa, Homo sapiens
STIKGIQISKEEVKLSLFADDMIDYFENPKDSTRKLLGLINEFSKVSGYKINVHKSVALVYTNSNQVESPNQEVNPFYNSWKKST

SEQ ID NO: 954134 - protein, 52 aa, Homo sapiens
LHYRSRGALVLKFDYPKSTHHSCSAYIPPSSANPDEGYKVSASTHVKTLGLP

SEQ ID NO: 954135 - protein, 38 aa, Homo sapiens
GRDLDLAIFSGWPQHGRSPFLKEKACEPQNRRESEGPP

SEQ ID NO: 954136 - protein, 109 aa, Homo sapiens
SRNPKLICQICILRLGTFLKSKWASKAWKWTCAWRLEGCGDSPAGYSPAGQSLHQKMDSSPLANVRGAAGHPPPRLGGQKPKAVQVCGTLELERWRRERRNLVVVVVGG

SEQ ID NO: 954137 - protein, 77 aa, Homo sapiens
RYDTYEASDLHSSDGYGPEYCPLDGELTRDRIRVRKLYRKYNLSAPATMSMDPSDEGDDDSDDLMGVPRRELLAQIF

SEQ ID NO: 954138 - protein, 102 aa, Homo sapiens
MPNRDLNAVRKITRIRKPPRVPQHRKLLLHPGLAQGFSTQIQTPVLDVPRHHQALAAKEIRYSPRTDIPTSRATHLGAQILTKRNNAGQCTPGVLRKHSLMG

SEQ ID NO: 954139 - protein, 49 aa, Homo sapiens
FIQKLREGGYSYEDLVEGLHDRTLYYALTANPSVSETRRTEEGGPCEEA

SEQ ID NO: 954140 - protein, 43 aa, Homo sapiens
EPYDILVLSSSSIELLLLPSCTGTHDLVITRRVHTGIISFENA

SEQ ID NO: 954141 - protein, 38 aa, Homo sapiens
MWRVHPGWTPKSTSSSSTMEGGLANEHLVQKDPEDHSP

SEQ ID NO: 954142 - protein, 43 aa, Homo sapiens
MVFLNVDVPVGCESFIFPVFLSLWYSCYCQHLSFVCEIVYPKE

SEQ ID NO: 954143 - protein, 79 aa, Homo sapiens
TRILKQMFSEHIEDEKNTESQERFILTTDDASLDRDDKQNQNCNAARKRTTVNRIEQHKKYQRVRERIFARETGQNGYL

SEQ ID NO: 954144 - protein, 46 aa, Homo sapiens
FHAFSRSDKDALKPCSPSKKRTASRKGRHRRCATGSDDERTTIKKG

SEQ ID NO: 954145 - protein, 50 aa, Homo sapiens
MHPLESQSVADERSPIIVRDSGIQGVEELQLEVAALMLRAGCRNPVWFYF

SEQ ID NO: 954146 - protein, 36 aa, Homo sapiens
ARCTSYMGQTPGTPVDPGRKTAHRRTEEIEGHMTPG

SEQ ID NO: 954147 - protein, 102 aa, Homo sapiens
PILVSVISLNALLPVHIHIVNDYHISQNLLVTISNNAAIQFGNDGNLAITNYLRSSVVYGCRRGLPNNLTSSSIETLNLRYHCLPRTAKTDYVAADASEDTD

SEQ ID NO: 954148 - protein, 47 aa, Homo sapiens
YLWPPRVDAPMFIMGDEPLVSSDNQTSRLISNASCTTNSLSTPWPRV

SEQ ID NO: 954149 - protein, 56 aa, Homo sapiens
LISEIHPSSNKMSARSREVATPTAITPSHVAAAAYGGFTYSRLQAHPVELSRSSSM

SEQ ID NO: 954150 - protein, 66 aa, Homo sapiens
SLIDKEQSHGELEVVVRKPPYCWLPTLMVLWLWRRHLPGIYHSSCVSSDNLANSHCVAVLLHLCFD

SEQ ID NO: 954151 - protein, 45 aa, Homo sapiens
TPPILRLQIYPKLYPSIYGERISEDSDNVRIENARLEPFSSTSIL

SEQ ID NO: 954152 - protein, 36 aa, Homo sapiens
ITPKASAVLRKEERVVDAKWRIRGATNDRDVLTSYL

SEQ ID NO: 954153 - protein, 68 aa, Homo sapiens
CRTSTERGGYSATMYTRITARSDVISLDWPSLSIPEDIDMALLTIKPLVNWHYVVPGRVVRLELIADP

SEQ ID NO: 954154 - protein, 69 aa, Homo sapiens
DIKSKLEKVGNLIIRPYSSKNFAAHELSKLTHDWAHSSSCCINHQCYSTLHTTDFKISQSRQSGLACPL

SEQ ID NO: 954155 - protein, 47 aa, Homo sapiens
EYCDIKCTEYSVDMWSSGCMLASMIFRKEPFFHGHDNYDQLVRIAKV

SEQ ID NO: 954156 - protein, 76 aa, Homo sapiens
SLVSKVKCEASLPGKDYQPTCLWGFLEGGKDSCQGDSGGPVVCKWTAKELSPGVMAVPKRTSLEFTPRVYNICEMD

SEQ ID NO: 954157 - protein, 50 aa, Homo sapiens
MIFYSIYARDYTGTEHIQSTINMSLDSKTVIYTIYTLDYSNHIFLKAMYT

SEQ ID NO: 954158 - protein, 46 aa, Homo sapiens
MGALASTNSYKVITEDCEVQFPLAHCLIWGSQSPGGCSLSCRVLCS

SEQ ID NO: 954159 - protein, 117 aa, Homo sapiens
MTCSNKTWMRLHRDDPKYRDGVEAFLNFAEFSIKRDKMSGPCMKCENLYIEDRTIMQTHFIVFGIRPDYDLWYFHGEKRPRSNDINDDTDDADNDTDNDDIAKHDDVLQQDDEIENH

SEQ ID NO: 954160 - protein, 93 aa, Homo sapiens
IDHLAQKATTNITGVWLQFYHPGQRIYVRVASRVFMVLEKLGDNQMSLIIVWICGVRVVCWQDMIFRKEPFYHGHDNYDQLVRIAKVLGTEHL

SEQ ID NO: 954161 - protein, 94 aa, Homo sapiens
MFYDEAYYSLSDLNLCDLVLLIFRECSSAALCEVVIRCDHMKIAQRVLPAWWEDSASECDTIPGRQCMASCFSLVNQNDDVTIDLNSFKSYFYN

SEQ ID NO: 954162 - protein, 84 aa, Homo sapiens
MTQSIGHPQDLMIKGDLSRFRGLDVLQDELDAAVQHLDGAVLCYQVFSLSGVLSTACCCHSGYVVYTNAFRFLCGQSVGQLSKQ

SEQ ID NO: 954163 - protein, 58 aa, Homo sapiens
TVLSTYQRLTGTEGYCSLFHYLRPSVKKGQAGLEFPLQPSVNESNRIHEDAGSIHDES

SEQ ID NO: 954164 - protein, 37 aa, Homo sapiens
SEETGHAIKCMQLTDCILYSCRTVPTRKYVRQAWQKA

SEQ ID NO: 954165 - protein, 45 aa, Homo sapiens
MDLVTPVRRQAMPFKCIQLTDCILKFPHVPTIKYVRQAWQKADVN

SEQ ID NO: 954166 - protein, 44 aa, Homo sapiens
PAVMSIDQIQAFGRVDLALMIGDRSCLSSACSCADRIRQHFRTV

SEQ ID NO: 954167 - protein, 37 aa, Homo sapiens
LTGIKRADKPLVGGFLDPKIEPGDVVTLYGTDQDLQR

SEQ ID NO: 954168 - protein, 65 aa, Homo sapiens
VAFAAVGQLLVGLCGRLEDKSLQLHALDMAWPVVLTSVPGPFDQSPFLINYLIVQPGATEPRNSL

SEQ ID NO: 954169 - protein, 50 aa, Homo sapiens
MLGEQAMPFKCMQLTDCILKDFRISAHQNLCPTMPGSKADLQNLIVPATG

SEQ ID NO: 954170 - protein, 41 aa, Homo sapiens
MPYKCMQLTDLILKVSAQCPPEVCPTSLAEGSTSSTHLLSR

SEQ ID NO: 954171 - protein, 55 aa, Homo sapiens
MSVSARLVGHLLVGTVRTLEDDIFGLRALDRGMACAPHVECQVPSTQMPVFLTQL

SEQ ID NO: 954172 - protein, 50 aa, Homo sapiens
MAYLQHIRLLAHSTVSPMLVQAGLAHSRTSRCICRALSLPNSAGHHRRAA

SEQ ID NO: 954173 - protein, 53 aa, Homo sapiens
MPFNVHAAQLIASSSFRTVATISMCDEPRRRPTSVLMSCPGYRTLLRHPSRCY

SEQ ID NO: 954174 - protein, 31 aa, Homo sapiens
MEGWCRHVVHNAGRLSHLAACLGQAPGQPPP

SEQ ID NO: 954175 - protein, 118 aa, Homo sapiens
EFRRQVGHGLGVDVGLTNRRQAHDGFLQRHGFRGHELRVQPSRQFLLLGRRLEEGPGTYVLIPLLHALFPIRPKGDGAMRHFGVPSALTTGRPGLVMSAVNAVYQKICWAMLPWDGTG

SEQ ID NO: 954176 - protein, 74 aa, Homo sapiens
LYNQLCTPSVCLTARRSKIWQKPLMIFIGSLRFKFRDLRKGVVRDTAESNADINGGDGTFLTVQGRQQLAHLHP

SEQ ID NO: 954177 - protein, 39 aa, Homo sapiens
AQCVASLPQFGFGRHFHSPPTPFYLPTLHTHYHVLYWTP

SEQ ID NO: 954178 - protein, 66 aa, Homo sapiens
VSVTPWRRFCCSSVPLIVFQTTNSVSWAGLAFFVESLPRYLSFPVCGALCDKYPAVRILHISQVYR

SEQ ID NO: 954179 - protein, 50 aa, Homo sapiens
MLSTATLIEAANEREEATAIAVALRLALEAPGAGVQSQAALITPDRGLAR

SEQ ID NO: 954180 - protein, 50 aa, Homo sapiens
ITTIINIKPPAITNTKPLFVCSVLITAVLLLLSLPVLAAGITLLLTTNLI

SEQ ID NO: 954181 - protein, 80 aa, Homo sapiens
APPVVLLRFVCAVSRVCAVCACVCCVFVCVLCARVCAVCACVCVCCAFVCCVLVCAVCACVLSTPSYTTPTGYPRSNFVT

SEQ ID NO: 954182 - protein, 65 aa, Homo sapiens
MKLCGIHLPEEVHPCYEEALLGSSDEYAVLIKAADTMSAFMKCVTEKAAGNDEFNAAYDSIYKRW

SEQ ID NO: 954183 - protein, 135 aa, Homo sapiens
MSGEGQAQEALPQSGALDPELKVSPKEAGSMGSRMAELCQWEITDPEGNKIKGTMADICPGEETGVPSEESGLLALTATRREFFPTAPEKPLCLLVHGPLDHFFPESKIPCPQGKQASQYFHSRRCQRTTRTFRA

SEQ ID NO: 954184 - protein, 47 aa, Homo sapiens
TKSCTRMRQTEKLKHEKKKAGCEIRRRSPQLFPGAKQGKNRLISLSR

SEQ ID NO: 954185 - protein, 57 aa, Homo sapiens
TNNPSSIQIPNYLLEQHMKANYGTQWLHQREVWTSVLTVRVSYSHSVGCSPVENSAF

SEQ ID NO: 954186 - protein, 41 aa, Homo sapiens
MDLASVRRQATLQVLQLTDFLLKFPHSAHQKSVRPAWQKAD

SEQ ID NO: 954187 - protein, 66 aa, Homo sapiens
GFGRVDLHLMFRRQAMPYQEQCSSLIASSSFRTVAHHQVCPTEPGQKADFKYLILHAPGATGDFVH

SEQ ID NO: 954188 - protein, 52 aa, Homo sapiens
TLLYIVLMSALPACSDILLVGTVRKLEDELQCSCMHLNRHGLSSSLQCNVHS

SEQ ID NO: 954189 - protein, 51 aa, Homo sapiens
IDQNQALVDGPCTPVRRQAMPFKCMQLTDCILKLPHSGHQKYVRQAWQKAD

SEQ ID NO: 954190 - protein, 185 aa, Homo sapiens
RCVCVLEQIAQKLGLPQLEEQRWARHPLVYLMEAADDICYALIDLEDGLEMELLEYAEVESLLLDLVGDDLPQTYRQLGPQDSRRRKLAILRGKAIEHLTNAAARAYVEQQEALLAGTLPGDLVEHMHGPAKRCCNWMPRTLARKKIFQDKRKTLLEIGGYTTLEILLNAFCGADLKQHGGRTPV

SEQ ID NO: 954191 - protein, 64 aa, Homo sapiens
VIVSVELILSTMIGAEMRLEALGDLGLAAPRPAEEHMRRLTCSRAGSSGEASMPAKPVGAPKNT

SEQ ID NO: 954192 - protein, 33 aa, Homo sapiens
LIEGLPADCADFLTELTAPVNASRGWTDDTGCY

SEQ ID NO: 954193 - protein, 54 aa, Homo sapiens
VEEPIEALMSSSASALSNGLTVPEGRLTSACDRRQMAWFTRRRGDTSTACRLTV

SEQ ID NO: 954194 - protein, 37 aa, Homo sapiens
LPGSYTVRSYANIVPIAILVFAACDTVVGLALLVSIS

SEQ ID NO: 954195 - protein, 113 aa, Homo sapiens
EVRYRFVNITQPEVGVLVGKRPVKFLREWADTCGPEHVRVIPGLTSCDGGIYAVDSSYPRCTVCGPLPLKCHVSTKTGDAESVLMGKRRCPRGLINQRNGYEMRLPTFGVPMY

SEQ ID NO: 954196 - protein, 85 aa, Homo sapiens
RRISAGAGGCAQLWREEGGILGRGSRMNKALPEGESELVSGFNIEYAAGPFALFFIAEYTNIIIINTLSTTIFLGTTYDAFSPEL

SEQ ID NO: 954197 - protein, 90 aa, Homo sapiens
MQVGVLIYAGLCGGECFMLLILTLVLLWGDRLVQLGVRTSVICWGFFEVVGVELERFSLTWWLLLGLLWVYDFYLSLTRFFPMCPKELFL

SEQ ID NO: 954198 - protein, 64 aa, Homo sapiens
DRYNRRGFMIHGHRVLDPELCSNSVVQWTVGSHQDITEDSFTLFWLLETRIDRGGGDWRPNLIT

SEQ ID NO: 954199 - protein, 41 aa, Homo sapiens
VRYRSAQCQYAILTSWSRHMNIVVEEETDTTGGCGNGLLHS

SEQ ID NO: 954200 - protein, 58 aa, Homo sapiens
LVRYDINTILTRPPSATQTIIPKPTPQTPLPTSSPNDISYFAYTILRSCPLTNYGGVL

SEQ ID NO: 954201 - protein, 54 aa, Homo sapiens
SHPPEDRSVELFSEAHFSRYNCIFILVVQPSSRTVDFPTPSSNLNNDRVPTLEI

SEQ ID NO: 954202 - protein, 75 aa, Homo sapiens
YELAWPCPQYPPVKAHRPQTGLDGTEAGSLIYLALQLGCFALTKFSLGFLLGHHHCAHCCALQRLMGPETFINEP

SEQ ID NO: 954203 - protein, 82 aa, Homo sapiens
MNYRIDGCMECRELNRINPNEWNGMEWNDNVMEWNESTRVQRNGMERNAMKWNHPEWNGMECNGMEWNGNKQSAMEWSEMEW

SEQ ID NO: 954204 - protein, 37 aa, Homo sapiens
DSKRIPHCSGHPREQYFMYSCDGRHFWCLPAALTQDQ

SEQ ID NO: 954205 - protein, 46 aa, Homo sapiens
IILLQATGGPPLTGGHHIDAALRAYTDRIAHYSQNSWTHAILQTQP

SEQ ID NO: 954206 - protein, 63 aa, Homo sapiens
GSGGNSLPVVPDTRKAEVEGSLCPQGVLGCSALMRNRVSALSSASNIGDLPRERGTTRLSKEE

SEQ ID NO: 954207 - protein, 65 aa, Homo sapiens
ALWSPPQHITKCCTSSSRTEQDTMATHIISRVKLTCLTTVNRSSVPYIVGVNKIQRLGEILRSQM

SEQ ID NO: 954208 - protein, 35 aa, Homo sapiens
LHSAHSQHGLTYSQQHMGSGQLVLVATQPQHISIG

SEQ ID NO: 954209 - protein, 43 aa, Homo sapiens
CLLWYSSVNFPYRFMLAHILPPDPTDFDRPESGPGDHRRITPP

SEQ ID NO: 954210 - protein, 64 aa, Homo sapiens
ALVVSSAGAVRVLVVPATREAEAGGSLESRSSGLSALCRIVLSALQFGINHGDLPGAGDHQCCL

SEQ ID NO: 954211 - protein, 57 aa, Homo sapiens
LGNLVVPAPGAHHIDAELSADTQIGIAHYSPELLDSSDPPASASRVAGTTGTRHRAR

SEQ ID NO: 954212 - protein, 79 aa, Homo sapiens
PLTLVYSSSRKQQNVDQAVATAARGRGCCVTGTVCYVRERRRTRERLVAMACEASVAVSDILVSNAAVNPFLGSLLDVT

SEQ ID NO: 954213 - protein, 36 aa, Homo sapiens
RRLPAVVYTPPADSSRMWPRRCHACKGEGLSVTGTV

SEQ ID NO: 954214 - protein, 44 aa, Homo sapiens
NHRIFVLLSYLLDCSLAVKHAYANALSSDSDRNYRTFELLRYAL

SEQ ID NO: 954215 - protein, 61 aa, Homo sapiens
ITSVTSTPPIHKKSMNYDKELVNNVYLCFTLNMGSVVMSALVLKHFFTTNDYDVIKTSEMD

SEQ ID NO: 954216 - protein, 61 aa, Homo sapiens
PTGAPISCGDQWFVRFPQPEDGGASPALVSEARGISVGSRLPAFVNCSSRHICLFSQITRG

SEQ ID NO: 954217 - protein, 42 aa, Homo sapiens
HRGSRALTPHVMVLLAQHLARHRLRDASFWNHCPLPGGQETQ

SEQ ID NO: 954218 - protein, 46 aa, Homo sapiens
GSPDFLTGAVCAVCSSVCCVLCVCVCAVCACVCVCVPCVCVLCVHE

SEQ ID NO: 954219 - protein, 33 aa, Homo sapiens
PLPQSAWKCTEWNAELILCGLQPLPRLQHPLRI

SEQ ID NO: 954220 - protein, 46 aa, Homo sapiens
HQRQLCGGALRLSPAWRQALYSSSWLAGDIFLLIFLLVLLILLILI

SEQ ID NO: 954221 - protein, 35 aa, Homo sapiens
LDGSPDSMRVLPGAYARACCPSYSGMLTVGGIVLM

SEQ ID NO: 954222 - protein, 43 aa, Homo sapiens
AGAVAPWPDVRPSRLALVLAASRQRDLPPLVLPPGGTCSLPAP

SEQ ID NO: 954223 - protein, 38 aa, Homo sapiens
DGGVTIGTRFITLTGLCRRCPASYPSVVGVRRQASPSS

SEQ ID NO: 954224 - protein, 64 aa, Homo sapiens
EDPRSLGNQVTLLIILYTPGSLAFGDSSGNCKWQCGKIIEPSEYTCVNSGQNTKFIPCGDIQCI

SEQ ID NO: 954225 - protein, 80 aa, Homo sapiens
RIPRSPRNHQTQAENRTLSELAAHDPLTGLGNRRSLQALSQALASRPAPRRPYAVLMIDIDHFKAINDQHGHARGGAVLA

SEQ ID NO: 954226 - protein, 38 aa, Homo sapiens
RQGIEPQKQSPRALGWACSMSAHPICANLGATSSHLHD

SEQ ID NO: 954227 - protein, 49 aa, Homo sapiens
VIAHDIHLITKGFIIEDQHARMYSLDMSAIINFNDNFLSINFFNIERVS

SEQ ID NO: 954228 - protein, 74 aa, Homo sapiens
AAAVASSRLPPLPSDTSLHSRVLCVLCVCVCAVLVCVLCSCVCCVLCVCRCGAASRLRAFSAGNCAVRFAAGGS

SEQ ID NO: 954229 - protein, 43 aa, Homo sapiens
HMINTTSTSEELTIAGMTFTTFDLGGHEQARRVWKNYLPAINE

SEQ ID NO: 954230 - protein, 43 aa, Homo sapiens
RSLGKSYISIPILKSTHTYMHPRSYTHTTHSTRMNTAHTRAQQ

SEQ ID NO: 954231 - protein, 48 aa, Homo sapiens
QLNDSWFHTHIKVNHQPPAHHTLSPISTNPTSIANPTKTLTKTSTPDP

SEQ ID NO: 954232 - protein, 79 aa, Homo sapiens
AVKVYIRGSRKIHLAIILCCVQSVVSQQCATFQPKVALLSSTVINLFRSYLPFHTFSHVAPPEFGFLCELILFAKDQML

SEQ ID NO: 954233 - protein, 37 aa, Homo sapiens
ESSAPYRRPLSSDARSMTGNISSVSYHLLLILEQVGH

SEQ ID NO: 954234 - protein, 66 aa, Homo sapiens
MVALHRPALGAMTVGLAVVVALGGGTGGEGEGEGDKDKKGCGLPGQPKCAIDETGTPYGKSAYGEL

SEQ ID NO: 954235 - protein, 57 aa, Homo sapiens
GLSLEAEEHQCTHLAGAMDAGAVAGSTPGGKVARGACLGPRCRGTWQAAVEWRGEAA

SEQ ID NO: 954236 - protein, 38 aa, Homo sapiens
RSLGHSLRCYLMVSKKKWLVMDKFSTASPKVGGFSKVS

SEQ ID NO: 954237 - protein, 36 aa, Homo sapiens
MFNTTTNPSYSFTHSTNPTSIANPTKTLTKTSTPDP

SEQ ID NO: 954238 - protein, 58 aa, Homo sapiens
MHFNAAHSPVSTVTWPVLSLQHHAMASHLCSPSHHGSIPLQFMVGHPLSSRTLPGHAT

SEQ ID NO: 954239 - protein, 45 aa, Homo sapiens
GRYGFQAETKRGAEETLGAKSEGRGEGALGHGWNYEIWHKVSCTL

SEQ ID NO: 954240 - protein, 45 aa, Homo sapiens
DPFMNLVIDECVEIGLVDNSNNIGMVVIRGNMYYYVRSLGVDTVG

SEQ ID NO: 954241 - protein, 150 aa, Homo sapiens
TDCETPHNQFKLFMSGLIYPRYKPKKIALSKTEQCLDSLALRQIPNFPECILLKTTKVENGRQLTWKLSLIPLSLSLSESVIRMRGKCSLPMYRTFAVDGVLDSLRVMALKNIWAATEDFVSNFSFQATTHSGSQQPSAPREAVGGKYVD

SEQ ID NO: 954242 - protein, 57 aa, Homo sapiens
GILLHIVQGKVSRKNGLQATGQRRRTNQKIRRRRRKKKMKIRRKRMKMKNKWVSFND

SEQ ID NO: 954243 - protein, 79 aa, Homo sapiens
GDILECCHRRGHMLDIESFSSQTGLESDMALLCSWPPTCGITRIRGNSYQSLTDPIELLDRLLIVSNNPYSEKDTKQIL

SEQ ID NO: 954244 - protein, 64 aa, Homo sapiens
MSEDPGRTGRILHRWSLNAENTSPITFNFKNKAERIPGQNISQGEKVPQNRDLVTGEGSTVVGG

SEQ ID NO: 954245 - protein, 113 aa, Homo sapiens
KEYRQMYRTEIEWEDGRKAGTSMYLQNQIGVVIRIQRYNGVSPKVRKVLQLLRLRQIFNGTFVKLNKGSINMLRIVEAYIAWGLPNLKSVNELIYKRGYGKINKKRIALTDNA

SEQ ID NO: 954246 - protein, 49 aa, Homo sapiens
PLSSYDIAMYRLNRWGCRSGLLLLQTNWVAPIEFMGGKVEGVRFFGFGQ

SEQ ID NO: 954247 - protein, 44 aa, Homo sapiens
MGMETYHISNAGVRYEVFSLAMCMSWSERNRRYAVRIHKNREVI

SEQ ID NO: 954248 - protein, 35 aa, Homo sapiens
MLAVVVRSFFIAMCMSWSYRNQAYAVRIHKNREVR

SEQ ID NO: 954249 - protein, 78 aa, Homo sapiens
GSGSGQYRDLPYYITDKFRFRIGTDTTSLIDVTPALYAARCCLVQSCYGTNAIRVPLLPQLLALTVRCEYHRSPTLSR

SEQ ID NO: 954250 - protein, 39 aa, Homo sapiens
MSVRIHMNREVRKQVLVKSCKPVSAVKPVIVQRNTAANQ

SEQ ID NO: 954251 - protein, 114 aa, Homo sapiens
MTIDQIVKAYARIGKSYFIEDEYQDADPFLYSKISGQSTDIPRCAQDIAMPGQRNISCKEQEAAGLSTKPLIWTLCREEQTATAVVCSKRVTYPAGPMIRSYYTKTSHESEPRN

SEQ ID NO: 954252 - protein, 34 aa, Homo sapiens
RASVCFCFLLLLPCFCRFLLLLLPASAASCFCPS

SEQ ID NO: 954253 - protein, 44 aa, Homo sapiens
SSTASASAHDMLAHLPAVTRPVYHFPVHTHLHVLPASASRALGE

SEQ ID NO: 954254 - protein, 37 aa, Homo sapiens
HRVRFCFCRFLLPASAVPASANPLLPASALVFQVLVR

SEQ ID NO: 954255 - protein, 39 aa, Homo sapiens
VLLFCRFCSACFCFAPGFCFCLFLLLPVPASAGFCFCPG

SEQ ID NO: 954256 - protein, 53 aa, Homo sapiens
LTSVSYTLETQHDTRPAIINNILFPKPYLSGRSRKQPSREGQKQEAGFGERQK

SEQ ID NO: 954257 - protein, 65 aa, Homo sapiens
SARPFCFCWGWWVLIFPLLFFPFFFPSLIFCFLLLPASCFCQESCADVVDPAQSLAWQGVLRLRN

SEQ ID NO: 954258 - protein, 60 aa, Homo sapiens
SHDLEEIGQLLINSSDEEEEEEEEEEEEEEEEEEEEEDFEEEEEDEEEYFEEEEEEAEAE

SEQ ID NO: 954259 - protein, 48 aa, Homo sapiens
PHKPVKFRDQRIVARQVGMAVDGRSRRHKQEAEARRQNQEAETGNRVW

SEQ ID NO: 954260 - protein, 46 aa, Homo sapiens
GPYQRRCRLGRVGFHEQLAIGALLDLDFAFDVLPLADEAGGRLRVD

SEQ ID NO: 954261 - protein, 35 aa, Homo sapiens
TRTLTRPAEAGSSRSRRAEAGSKGLVADRKRQKQE

SEQ ID NO: 954262 - protein, 54 aa, Homo sapiens
PRPEIKKTRVKLPSGTKEGYLPQANRAVFVFWLVNSLVDKPILKAGRAYHKYKA

SEQ ID NO: 954263 - protein, 135 aa, Homo sapiens
DPRLLFCLEHSQYERACKLLLAARKYQRTPVELCLGQNIALTEEIAEKMTVAKDSSDLPEESAAGAALADSRLLLRQGSYHLATKKYTQAGNKLKAMRALLKSGDTEKITFFASVSRQKEIYIMAANYLQSLDWQ

SEQ ID NO: 954264 - protein, 43 aa, Homo sapiens
QLRGGAGSLLVGVLESFSSFWASAYKEVIVFTFHYPGSGLAFV

SEQ ID NO: 954265 - protein, 33 aa, Homo sapiens
LPALPVVLVRRVLVMGQKQEAAILLKQEGHKQE

SEQ ID NO: 954266 - protein, 59 aa, Homo sapiens
FLLLPLLSSAKVAASCFCPYFCCFLTSASMRSVGFRELTSRDESQLTPRVLVGVPELDI

SEQ ID NO: 954267 - protein, 35 aa, Homo sapiens
RSRKQGLGEGRSRKRQKQEAADRQKQEAAGRQKQE

SEQ ID NO: 954268 - protein, 42 aa, Homo sapiens
LTKTWQKQEAENHIYILENNITGVKDMTDAIVPCGQQAGQHR

SEQ ID NO: 954269 - protein, 34 aa, Homo sapiens
MTLRFITLTVLLSEVSCPPTPACWECDARAISLL

SEQ ID NO: 954270 - protein, 51 aa, Homo sapiens
SPALAEAGSSHLQNHEGMKQRSHIKELGDGNSFAKNGRNAKPDCIITCDGK

SEQ ID NO: 954271 - protein, 77 aa, Homo sapiens
LHQTLVGRSMEAGTKYEAAVSRKTEQNAREALTNTLAEAGSSMMNKHEEFRWMILRIRRMADRMDANAINVPGISMT

SEQ ID NO: 954272 - protein, 49 aa, Homo sapiens
MGYLILMLCKCKHFRIYGKLLDATENCGCNGLRKIVDDEIRLKNWAIRG

SEQ ID NO: 954273 - protein, 49 aa, Homo sapiens
RIPLGNRVLGAQCATSLLQVLEARRQWTLLRQGSAQLHVSPSVWVPETQ

SEQ ID NO: 954274 - protein, 94 aa, Homo sapiens
IYKASGDRDIWFHKTVLGQPEEKALYWFCSQFEGLDRGTLLLSKTKPKIASKTLVGAPTQGSLLHGARQTTWTGVHVAVCQTPGHHLFFLQPSS

SEQ ID NO: 954275 - protein, 34 aa, Homo sapiens
MFALLPFLLLLLLLPASALPASAASCFCRFLLLP

SEQ ID NO: 954276 - protein, 58 aa, Homo sapiens
PRNSDFSRPGAHLCAVCAVRCVCAVLVCVLRSCVCCVLCVSQRGCITYECFLGWELSM

SEQ ID NO: 954277 - protein, 59 aa, Homo sapiens
MCFCNLNCSNTDAGSPALNQQSLSRCKSCTIKHITPDSEISFRQRCRLKQTQTIRYPQT

SEQ ID NO: 954278 - protein, 35 aa, Homo sapiens
ESEGRACTQREVFWAFAAGHLLQEEVVVIVGLRDE

SEQ ID NO: 954279 - protein, 78 aa, Homo sapiens
GSTSANSRRVYKSAETWECELSGNKQQVVWESFQKSHVGYAGMGPGCAEARGINMSWSVSVASQSRCAVSRTVRARLN

SEQ ID NO: 954280 - protein, 55 aa, Homo sapiens
ISSYRFCFCRFCFCFLLCCFLLLPVTLSYHFSSFFLASCFCFLLLLLPASAPPHA

SEQ ID NO: 954281 - protein, 60 aa, Homo sapiens
TSQTGCCVCCAFVCVLCSCVCCVHACAVCCVCVAAVDAYKYDVLFMDGTLRCNDLPQVDA

SEQ ID NO: 954282 - protein, 49 aa, Homo sapiens
WTTDGHHLYILTLTDEQFLVQDQFPVMPVSTLCAEARKRRRRLLTHYVK

SEQ ID NO: 954283 - protein, 49 aa, Homo sapiens
MAEAGSIRDTALAPSTMKIKIIAPPEREYSVWIGGSISGLLSTFRQKQE

SEQ ID NO: 954284 - protein, 38 aa, Homo sapiens
GSDGHDGDDTMVVVMTVMMVVAMMTMVIVVVVVMMVMM

SEQ ID NO: 954285 - protein, 48 aa, Homo sapiens
DASRFNGKTSVQINAMSYRLGTVENAMKLLRAQTQWIQDKGAVLSVFC

SEQ ID NO: 954286 - protein, 57 aa, Homo sapiens
CFCSQDQRFSCQLTATSASQVKRFSCLSLLPASAASCFCKMAASCFCRFLLLHLSCL

SEQ ID NO: 954287 - protein, 34 aa, Homo sapiens
VRFCFCLLLLLPLLFCCFLLLPLPASAASCFCLP

SEQ ID NO: 954288 - protein, 76 aa, Homo sapiens
PTTEKLETALSSQRWLVLHPAKEVDVVLETLVVVVEVVSVGMTTSVVEETSVGRGEALVGSRGEMVDTGGSGDGYN

SEQ ID NO: 954289 - protein, 33 aa, Homo sapiens
VPFCLCRSASACFCCFCFCCFLLLPNVLQVLGE

SEQ ID NO: 954290 - protein, 34 aa, Homo sapiens
LLPFLFCCFLLLPFFCCFLLLQLPASAASCCFLL

SEQ ID NO: 954291 - protein, 64 aa, Homo sapiens
ACLIGYTNQRVYQMEVVIRHNWFPVDLVHRLSMLCGDLHIQVGQLKNQLELLFQECSVVLQIEF

SEQ ID NO: 954292 - protein, 41 aa, Homo sapiens
MSQPWSLRPLESRRSLETLGLRDSFSASQSPGHELRTLRAV

SEQ ID NO: 954293 - protein, 38 aa, Homo sapiens
PLSPLFFCFLLLAFPASACFLLLPASCFCQSYLPGLGE

SEQ ID NO: 954294 - protein, 35 aa, Homo sapiens
TSSTRSVFTENVPLKSTDPNSSKPGCNAIKVSLET

SEQ ID NO: 954295 - protein, 37 aa, Homo sapiens
LLLLLLRFLLLLLPASALQDPAPKIHLIYCPRMAEAG

SEQ ID NO: 954296 - protein, 65 aa, Homo sapiens
GGPQKLIRYIDDQVVSTKGERFKDVRNPQAEEMNATYINLKPARTYRFHVRHSPDSALRLLGSDP

SEQ ID NO: 954297 - protein, 49 aa, Homo sapiens
MSYLSSSKGGSRSSVIGRTLSSISFLTSTSISFSSSTLARLLFTILSLR

SEQ ID NO: 954298 - protein, 100 aa, Homo sapiens
VPGDPAWDDLRADRDRFTVRRASLCVAELHVYFTLELKQMQDKYSKSGIACFLTEDDSYSGPQGRREYEQPLSGESSGNSVQLALEGLFGEPLESISTRV

SEQ ID NO: 954299 - protein, 81 aa, Homo sapiens
ADGICCRATTEECGNCTTRSNRSKPINKSSRSVGKSINALESLDVAPGLEELEMGAQRVQVDDKAMINCRADLNQLVPFKY

SEQ ID NO: 954300 - protein, 46 aa, Homo sapiens
LGSRRRDGDRGRSRNQQKQKRQNQEAEKQEAARSREAGSCVRAECR

SEQ ID NO: 954301 - protein, 81 aa, Homo sapiens
IPGRAFNLRGCYPSWTFVKLIIHVEWTGKHPYRETQGHHSGQGESETSEREGRTYVGVVNGAEMNWHPRELKEIRADPLQS

SEQ ID NO: 954302 - protein, 113 aa, Homo sapiens
SSISKSKRKSRDGKNQEAQTLILFMHQTHNPSFIHGKKISTIHHTYKEQIHLPSMDNTDIYRAHKFLQVFACRQMSNSSISNNSNHVHHAQQQQCQVQSLHMHFSYPNPSKQM

SEQ ID NO: 954303 - protein, 43 aa, Homo sapiens
MQQTQSLRLRTSPIQDLQLALSTTAASTPGGAVFSRAHVPPHL

SEQ ID NO: 954304 - protein, 59 aa, Homo sapiens
MQIRAPLALALTIYPMRIDESIHLQLRHKYGDQISRFRQCDPPISITDTLQLLLLLDSV

SEQ ID NO: 954305 - protein, 41 aa, Homo sapiens
VFLFCLPATAASCFCRFLLASCFCPSPDPDPGQKQEAAGSG

SEQ ID NO: 954306 - protein, 138 aa, Homo sapiens
LEDLRATLRIICADGAHAASLVVYAPVGCIGCSQGPWRLAFQVDLHVSDLALPLCRLQTGIQGAFGMPPGTVARVHIGQVIMSIRTTLQNMEHVIKALRRAKFTFPGRHKDVVLQPPFSHLCPKPPDSGSLPLSLHSR

SEQ ID NO: 954307 - protein, 43 aa, Homo sapiens
LSVQPLHYVYGHADLTLLDRTTVVTELTIGDGLLLGLTGALCT

SEQ ID NO: 954308 - protein, 63 aa, Homo sapiens
EHKEVVEAVTYCRDTTHGWFWGIVGYVEPPRGLRAPSRLSLLSTSVMKCIRRFYKTWHTSQKK

SEQ ID NO: 954309 - protein, 80 aa, Homo sapiens
AAVSRNIRLFLVSPLLFLVLLHNWGFNYTLVLKVYFDYINLTGGVFGRKIELLRRDDKYEAEIAAVNTKAFIENDDVFAL

SEQ ID NO: 954310 - protein, 72 aa, Homo sapiens
IHWPSFSTQEPAYNDATASKGGRLDVGKHFSTEDMYSGRENMKECTSSLAIRQYAGQNHSEMPSHTSENGNH

SEQ ID NO: 954311 - protein, 116 aa, Homo sapiens
YLVQEEESSSSFQGVFCLLACPQFGSPSSMLLSYTFSLTHFCSHNTHIGLLHLLKLLFLKISSNNHVVCYAKFGKYNVRTTARWLAEVFQRKREGFLCGVLTTSVSCSPLRSFIVN

SEQ ID NO: 954312 - protein, 49 aa, Homo sapiens
SAPLPASATRPCFLLRFLLLLLPASAASCFCLLPASALSKENKADFKLY

SEQ ID NO: 954313 - protein, 35 aa, Homo sapiens
MTASFTNLCQQAELDVYDLMRHSDLGGRLQTRLKY

SEQ ID NO: 954314 - protein, 51 aa, Homo sapiens
MFSLIRRLCDLASTLLDRSPTDAALCILLQVAAPMRACVLEPGRSVGRPVC

SEQ ID NO: 954315 - protein, 45 aa, Homo sapiens
YPRPETEEEEGLRITEVLPTWQKQEAGSGRSRKQKKRWRQRQKQE

SEQ ID NO: 954316 - protein, 38 aa, Homo sapiens
NQLVPVHGIPVDTNIFSSQLASHFLLPVSALGHVLGEG

SEQ ID NO: 954317 - protein, 35 aa, Homo sapiens
MQLSTRSHSHTFAHIKPILTSASAKAVISKDLQVI

SEQ ID NO: 954318 - protein, 42 aa, Homo sapiens
YFNIRLFFMPCPSQLEEDEEGNQVNSAGQKQEAGRSRKQAEA

SEQ ID NO: 954319 - protein, 56 aa, Homo sapiens
KVEHKKKRTFRNFHLPRLCDLAPAAGRSPTCMQLMHPVQVRAIARRARTWGSAAGQ

SEQ ID NO: 954320 - protein, 38 aa, Homo sapiens
MSASALLLPASAPPSPRPLALGGAEAGSSRSSEVAEAV

SEQ ID NO: 954321 - protein, 72 aa, Homo sapiens
TRGFDAGRGTNSWRSSVAPISDESSTPGYYTTCQFEPGLLSSRYKAWLSEPSTECHTTDASTLHTSNICPEP

SEQ ID NO: 954322 - protein, 45 aa, Homo sapiens
PRGKSGGTTVQYYRRYYQAVLQAVLQCGTTVQYYRRYSQGSTTAP

SEQ ID NO: 954323 - protein, 79 aa, Homo sapiens
EDSPAVYRRYYMRYYRRYYRRYYRRYYRRCYRRYYRRYYRRYYRRYYRRYYRRYYRRYYRRYYRRYYRRYYRRYYGRYY

SEQ ID NO: 954324 - protein, 94 aa, Homo sapiens
KDLRDRTAGHKEEPSIRDEDRRSQEEPGFGSGCRRTVDHPGRTGGVSGRRLIPGVGMAAAGLLIILVDGEVSVGGALSRDGDGCRRTVDDPLQS

SEQ ID NO: 954325 - protein, 45 aa, Homo sapiens
LDFPRRYYRRYFCRDYWRDYWRDYWRDYWPGLLAGLLVGTTGGTT

SEQ ID NO: 954326 - protein, 45 aa, Homo sapiens
EDTTTHKTGCEGCRSSRQIVVTEEAIFGSQEFKKNQGTVLKLTRA

SEQ ID NO: 954327 - protein, 40 aa, Homo sapiens
PARREKSSEVDIKWMSEFQHAGGAMGSQDKWRWLAMIVRG

SEQ ID NO: 954328 - protein, 81 aa, Homo sapiens
VLQIWDQKRNIRALMGIRSAILHQRGHGSCEVSKLVPMCYIPSILLTASSRDRIRGASCGHSICSSPGLMRSSWLPVRDPS

SEQ ID NO: 954329 - protein, 102 aa, Homo sapiens
LTLSVLLSDPGPGKYANRAALHKTDTYHLATGPELSVHLEGTPKLCVHRDQEGLLALEVHSKFLTILETIQMDGLPKGAHSRTLKDPTVHGQVEKPPQQDPG

SEQ ID NO: 954330 - protein, 68 aa, Homo sapiens
QLGTAQAGTTYGRHSPRNSTEHMLVTEDPYVLSLPGSYEVRSSIPPEFRVRANVMTRVLWKEDCPHTA

SEQ ID NO: 954331 - protein, 59 aa, Homo sapiens
TDPQADFILTIIIINFEMFIITIVIIITLSITLCIIFTNTLSINLSIIISITLSIILTI

SEQ ID NO: 954332 - protein, 90 aa, Homo sapiens
LGDGLDLRSQGVSIRAFSTCAVETAKLGASGLLQGASFPAVIRLIPHTVLTFVFLEQLRKNFGINSAILTSRGNGWAARPDTLGSSKESQ

SEQ ID NO: 954333 - protein, 70 aa, Homo sapiens
PVCRRNGGHTESSEFLNVLSPGRHIPNCDKKGFYKKKQCRPSKGRKRGFCWCVDKYGQPLPGYDTKGKDD

SEQ ID NO: 954334 - protein, 64 aa, Homo sapiens
WVQVVLSWNDRGNVKMLKTAAEIVLTNESSSTKDDDYLPSNTCWDGVILLVVRMLHVMHILGSV

SEQ ID NO: 954335 - protein, 53 aa, Homo sapiens
INPLKILNKTNTNSLNTSHIKINNYNKTLRTKMNENLCASFIDPTILGLPAAV

SEQ ID NO: 954336 - protein, 73 aa, Homo sapiens
MHEPVSGPYNCRGPGDTRMHRALSGGKCEIRPQAGPPGSPLQPVGSSKLSLSASDPTPALAMLSSLRRYTAFL

SEQ ID NO: 954337 - protein, 69 aa, Homo sapiens
PRLSGPQLCWSPSVWSGVVLGPQLCWSPVVPGPQIVLVPSCAGPRLCWSPVVLVPGCAGPQLCWSPVVL

SEQ ID NO: 954338 - protein, 70 aa, Homo sapiens
DGYCCISCQGKVKPERISWRPTGSKKKNEPEDEEEEELEEDEDEEARRMNDDRHKWAILLMSAWNQCVVR

SEQ ID NO: 954339 - protein, 40 aa, Homo sapiens
TGKITILDDELKRRDNRSEERTTAQKLLDYKTIHPDLQPP

SEQ ID NO: 954340 - protein, 30 aa, Homo sapiens
MPNYSADTQIGIAHYSPELLDSSDPPASDL

SEQ ID NO: 954341 - protein, 53 aa, Homo sapiens
NSTPDSVRTTHTPPMKKFPYHSTQHYLYDMSPYPLQFSSIPACKPVRVPQLDI

SEQ ID NO: 954342 - protein, 43 aa, Homo sapiens
PRRNDDTISSYNHHSNIALESLVAISTHSSITRFIKGSNPLNI

SEQ ID NO: 954343 - protein, 97 aa, Homo sapiens
SYPGIQMYRTEIRMARMATKAHTSMYLQNPNWRKSSESAGINYSEPKGTKGVAASSTSSNLQRNLCAAHTGYALTMLRQVDSYIAWGYPHCKSVNAT

SEQ ID NO: 954344 - protein, 68 aa, Homo sapiens
CTVLVSSGTGSGDDEAIVFCEFFDHGPFGSKSRLAGAGLLGRGGCDGIKGVSHVSLFHVRDTIRVLVR

SEQ ID NO: 954345 - protein, 51 aa, Homo sapiens
TVCSVNAGDCNGYRDISYSNARVSGTKFFHSDVYEIGRSVNGEGSVARNSV

SEQ ID NO: 954346 - protein, 42 aa, Homo sapiens
MGLETCHISYAKVSGKKFYHSEVYTLGRSGIGGMLFEFIITG

SEQ ID NO: 954347 - protein, 56 aa, Homo sapiens
IHCNSRRLYVTTGLLNRIVSTGFLIKKNSQQNQSDNSLKLAYQSANKQNVWLSSWR

SEQ ID NO: 954348 - protein, 55 aa, Homo sapiens
MTSTSRPSKSVVTMAVLTCGSDIARNLDKAERESLLLRATYLNKLDSPGYASIKL

SEQ ID NO: 954349 - protein, 36 aa, Homo sapiens
ITKTWNSTQHILSPSTLLLTSLSYEFDTGRLEAGSW

SEQ ID NO: 954350 - protein, 45 aa, Homo sapiens
TGCSGTELCYGYWLCIVYWFPPGKRENSKGRLVDSGQWIRVLVTG

SEQ ID NO: 954351 - protein, 37 aa, Homo sapiens
DGSPRITAYPESLLSLFIMLFIYFKLAGDDFMSIYER

SEQ ID NO: 954352 - protein, 65 aa, Homo sapiens
MCTHLVVHISDVDVQSDSDGGVWLLCFKDVTVIISVVANNNLLHVLIGGGPAYQSRLAGSLWNLF

SEQ ID NO: 954353 - protein, 35 aa, Homo sapiens
SSLSYEFEQHTPRFLLADTSTDWRYQITNQYRCIT

SEQ ID NO: 954354 - protein, 89 aa, Homo sapiens
MLDDTPSPIVTPDALTSSQTDIAGSRDLSTSQYSGVLLVSQCCSKGPHEEQVMRDSPGKHFCTTEQHEAHVALDTAGPIGQQEYLRRDL

SEQ ID NO: 954355 - protein, 47 aa, Homo sapiens
GTAYPRFRYDQTLYTSLLKNFLPLTLALLIYMSPYPLQSPAFPLQTN

SEQ ID NO: 954356 - protein, 53 aa, Homo sapiens
MLWSIQSSPYESTVYPRFRYDQAQYTSYDINFLPLTLALLILYVSIPITISSI

SEQ ID NO: 954357 - protein, 43 aa, Homo sapiens
YSTQDIFVTKTLASMLSWYFEFEQHTPDSAANHYRENQPRKPG

SEQ ID NO: 954358 - protein, 35 aa, Homo sapiens
SQTLKLHRRSHSHNRPRTYILITILPLQTCTGGNQ

SEQ ID NO: 954359 - protein, 80 aa, Homo sapiens
MTRYPLGYRVMISGRSSHAYSKKAWNLIASENICYPAKLNNGHVEDLVQRGVKRIFDPCIRYEQVSVADADAHFNCPVVA

SEQ ID NO: 954360 - protein, 43 aa, Homo sapiens
SARLIVRKQGLSYQPDGVKGIKGPHWFLDPPKATASASFMTPR

SEQ ID NO: 954361 - protein, 46 aa, Homo sapiens
LKSWRQTTACMPIVLVIKFPVKIFDNGPYRYMQARYMQARYPGTCK

SEQ ID NO: 954362 - protein, 41 aa, Homo sapiens
LEEVDSTERIFKTDNLTSFIRQLNLYGFWNTSLPPLCLLCA

SEQ ID NO: 954363 - protein, 33 aa, Homo sapiens
ALSLLGTWDLSTKLSGKQWGLRSAQQASALLSR

SEQ ID NO: 954364 - protein, 31 aa, Homo sapiens
MVVFAPLACTPPLCSPAVHLLCAVHLLCASP

SEQ ID NO: 954365 - protein, 41 aa, Homo sapiens
TAGRQHSRWCYNFYCTLQCTTVAEVPLLLSTSSVLSTSSVL

SEQ ID NO: 954366 - protein, 70 aa, Homo sapiens
LLGCLVILVGLLASGYRHRHPHHLQLARLPVSCLSFLIFISILFLTITFFFLLLFLPFFFLLLFLLQHSP

SEQ ID NO: 954367 - protein, 47 aa, Homo sapiens
VQLAAEVILKDPRFCSGCFLSSAPHQYPSSPMTLIPMKTRDEAVLRD

SEQ ID NO: 954368 - protein, 64 aa, Homo sapiens
IELVPVIPIQSNATINGQTDVGVYAHLDVHSRSNSMPRAPTHRGMQRDIISSAVAQPRAANHDL

SEQ ID NO: 954369 - protein, 34 aa, Homo sapiens
KRPLESGIEGLKDNLLAYGTSSLTATKQLHRPSG

SEQ ID NO: 954370 - protein, 39 aa, Homo sapiens
YNRAPYRIETSCGKQYKRPQITPCKLAVVVYLYTGLGFD

SEQ ID NO: 954371 - protein, 78 aa, Homo sapiens
DFPYRVLPRFTSLITTTESTSHSPPRLHFCDHHHEGITSHSTPSFHFFDSPPLKNTSYAYSQASAFIDSEADRGPLSQ

SEQ ID NO: 954372 - protein, 57 aa, Homo sapiens
RFCFCLLLLLCFLLLPQVLVRFLPSQVMIQSGLAIAPVLPASAVSSGSSSGSSSTFA

SEQ ID NO: 954373 - protein, 32 aa, Homo sapiens
TVCPSQDLLTKTCSCFCLLQMAASCFCLLTKT

SEQ ID NO: 954374 - protein, 39 aa, Homo sapiens
LVKGILLPLLSVTTKWDSYSDNPLLLFTITLLLSDTLYG

SEQ ID NO: 954375 - protein, 50 aa, Homo sapiens
HPYCFCQMRLSSYCIWRRNIRRKEQIWAASCFCRSTANTTLNRARVSVLI

SEQ ID NO: 954376 - protein, 34 aa, Homo sapiens
LLLLLLLLLPLPASAVNTKFKTSSDVGHGFLSYG

SEQ ID NO: 954377 - protein, 35 aa, Homo sapiens
CLVVSRMDVPERKTVVVLSPQFQLLVVSSFLGPAR

SEQ ID NO: 954378 - protein, 46 aa, Homo sapiens
GEGQKQAAGLCFLLLPLTKTLLPASAFLPFLLLFLRFLLLPCQTVS

SEQ ID NO: 954379 - protein, 110 aa, Homo sapiens
GGGKVTLNYHLTWSGLSYATGGMKSRKSIIHALTELRNMAWGLQDSSGPQANPLLPRQLLVQFGHIVIPLGLVTRASHRGPELILFTEGRHLEFATVVSRSVAEDGLVTL

SEQ ID NO: 954380 - protein, 35 aa, Homo sapiens
MPLLLLCSASALPLLLPASAASCFCRLLLLPLTKT

SEQ ID NO: 954381 - protein, 44 aa, Homo sapiens
MSCGFLLLPSCFLLLPLSCFSASCFCRFCFCCFLLLPNGRFLLL

SEQ ID NO: 954382 - protein, 38 aa, Homo sapiens
FCRSCFSLLLLPLLLLLLPASAFLFCFLLLPPLQVLVR

SEQ ID NO: 954383 - protein, 61 aa, Homo sapiens
LELYLRIREWHYISILNKIATILTEQQQGGRKFVSREEASHTTFPGSLIPSLACHLETETE

SEQ ID NO: 954384 - protein, 38 aa, Homo sapiens
LRIPRRCATVSVGGGVDAFYRPGQVAHADGGELRGNVR

SEQ ID NO: 954385 - protein, 50 aa, Homo sapiens
MCRWVDRSFWGLAHLLQLQLGWVSSVAGVIYINTQTKFDDPVDPVSMVRA

SEQ ID NO: 954386 - protein, 42 aa, Homo sapiens
KEASSCMQQSVDRLLGKQRGRWTHPRMTTTSRKSPLVHLESE

SEQ ID NO: 954387 - protein, 55 aa, Homo sapiens
ASCFTSRVRIFSIGYGSGCTNCCFDTSFHVGIRRINNHRHNCTTIIECDPSCSFL

SEQ ID NO: 954388 - protein, 130 aa, Homo sapiens
WHGDTAKIWRQYYRYLVKVYVPGKGIVRNLVTDPYSVSLNTDSGRSYIANLQNARLKPDGWDRQDRPDRVRQPTDMAVYELHVRDFSINDASVRPAYRGKFMAFTEKQSDGMRHLEALSKAGITDIHLLP

SEQ ID NO: 954389 - protein, 78 aa, Homo sapiens
WTSRACAQQHHVASPPLGALAQRDEQVGTGDALGQRLAQETAGPHHRHAVGEDEIGLGVALAEFRRGIQAHHMIDVGR

SEQ ID NO: 954390 - protein, 46 aa, Homo sapiens
LKHVGAFRIGRESVVVGGGHPYSHSRFMEGSSTIRMPRRYSDYADA

SEQ ID NO: 954391 - protein, 48 aa, Homo sapiens
QLGTRHDTFTVLTADQAPGVFASTVLPQLAFVDAAVGYDPNNVTVSFT

SEQ ID NO: 954392 - protein, 192 aa, Homo sapiens
YLPAANPSIQKWHNIPRLTVSMCATEICQSSGYLRGPALQRWGLERKRGSIWTEDAHAQVVAEVSAQATTQSPKVRPPKRGAPRLRGGDFPPSRLLDTEASPALPEQPFLLALFPTSRLQSRELPGKLVDPSGGWATLLESIRQAGGIGKAKLRSMKERKLEKKKQKEQEQVRATSQGGHLMSDLFNKLVRA

SEQ ID NO: 954393 - protein, 110 aa, Homo sapiens
YSGAPCLVQRGVILCWLLLLTLWLPWINHRITYAPVAEELAQQLPNKSYCIEAYIGPSQRSSFAYFGKIQFATFSDHECGYMLLQSSRRHILKTELPAPYQPEQWDQVWS

SEQ ID NO: 954394 - protein, 77 aa, Homo sapiens
RHIQDKEHPLRPGRGSSLQASSLEDGRTLSDYDIQKRVDPAPGPVSEGCLLISSVMAFAVPSDGITLHYSHWPLIDW

SEQ ID NO: 954395 - protein, 51 aa, Homo sapiens
MRRRRRQPLAAGEGASGHRVLADRFTAIQQAVAAPASRPADALRALFDEVE

SEQ ID NO: 954396 - protein, 113 aa, Homo sapiens
TGVVKYILEIDEAECEISLLNVRSTHIGGVSAFRWALWLHCTHLKCHRLQFLELLKTRDTLMDATCRTRRTTLFSPGFILHFSLVRLQYLRIHSKEVKLSPQSNLGRALALIR

SEQ ID NO: 954397 - protein, 31 aa, Homo sapiens
MGKRCRGQCHQHIQQRLLTGLGNDEAGVVVM

SEQ ID NO: 954398 - protein, 48 aa, Homo sapiens
LSAYDKQTYQSLIAYSSISHIALVVTAILIQTPWKLHRRSHSHNRPSG

SEQ ID NO: 954399 - protein, 57 aa, Homo sapiens
GIMSHQMKDSFSAHKDLSHFAQLVLGLIEDKPTDVYGNKLVRHFNLQSPPGLLVPGD

SEQ ID NO: 954400 - protein, 73 aa, Homo sapiens
MSLLWCPAPFLAETSSGGGGGPHTLLPLHPARCCCSVPAVRALVGEDVATLRPGGDGRLPGFAESRLWVWSER

SEQ ID NO: 954401 - protein, 81 aa, Homo sapiens
MDLGRSDTRIRLGRKLLADEHLPERWGGASSSPVPATLISRPPADFSSASGSLLACERPPQIGEVIRTVLWDSRITHNREL

SEQ ID NO: 954402 - protein, 122 aa, Homo sapiens
MHSGHYSARGSASCTPKKPSPAVKLHATQPPLHIGATLHLHVPKYTDAPLSTFRRVPPWREWKGSLGPCLLTNISVDARRRRSACLSGRGAAVLEASDFNLTTSHRGIIWGADFNLEPLTAS

SEQ ID NO: 954403 - protein, 82 aa, Homo sapiens
GSLVRSDIRLGKGVTMACCGPRLSWWDLSLWKLLRVNPGLLSGGRRTLSMCWEASWGGGGQCGRLSSQLVLNGPGTDSRDSV

SEQ ID NO: 954404 - protein, 46 aa, Homo sapiens
PPLNTVMLIDELIKRKDYSLQLYPGQAHGPRGDAMIWSLQKARWEF

SEQ ID NO: 954405 - protein, 72 aa, Homo sapiens
AYSTQSWLPMPTGPESGSQIALTRQPNGSNGSLVGDYQTDNGMWLREPQTSLAYAYARGSPRAETDTLGGPS

SEQ ID NO: 954406 - protein, 71 aa, Homo sapiens
HRSTGGKGYAHGDTFGRIGQLFSRFMDDASAHYVENLADAIEDPERQLDVSFELPARLEMTSLLQFIAGGL

SEQ ID NO: 954407 - protein, 57 aa, Homo sapiens
WRVLLDEALHHLPGIVGREQGIGWPGGAEGIPEAVVDEHLAIAHAGEAAAGTAVGVV

SEQ ID NO: 954408 - protein, 33 aa, Homo sapiens
MFSRMPDMRAQNIGHNDQRRCVCDRNREHATGA

SEQ ID NO: 954409 - protein, 56 aa, Homo sapiens
YRTATASQCMHDVLSSLLSAAAWSLPRLVKISLGINYLCVKFMGIIHCINQTNNKG

SEQ ID NO: 954410 - protein, 79 aa, Homo sapiens
KDKIDLKSHIYHITTDTQIHTQYTFPMIMYNRSTHLSLSHCSPMYAAPIHLDLAELSLTEMRHSWEAPTNTRLFGPFIR

SEQ ID NO: 954411 - protein, 127 aa, Homo sapiens
MCQPRHKRTDTHAHTCTHSTQTHGTHTHTHAHTDTHTLIPPPHPHTHYRLTHTPHTHTPHTGSYTHHTYTHTPITPTHTPTHIHRHIHPTPHYTYTHTKYRHTYPTTPAHITHHTQTHLNTPIHTPH

SEQ ID NO: 954412 - protein, 140 aa, Homo sapiens
MITYKKQNGTWPKNVAQLAQPFPDNILGETAPGMTRMFPALLAMHQQGEMGNGKNRNEGARAISDSTQGKNAAFVDTLGGKPFLQDRLEIIVDKRRHKLALISGNTIIRNYEVGLGGDRTPEGSFVISDKVVNPNGRSNG

SEQ ID NO: 954413 - protein, 37 aa, Homo sapiens
PDHDDGIAVNYDERDVILVAVSRAGKTPTCIYLALHY

SEQ ID NO: 954414 - protein, 36 aa, Homo sapiens
LPDSLKMWKSFALAPQGTPVRIGKELLPETAVIPEA

SEQ ID NO: 954415 - protein, 91 aa, Homo sapiens
VPFTSGAARSARVSISSASPGDADGAHRRKRVRPSGSGRAPKVKGSGQAVMAFVLAMWVALSSTRLWPWTAASFAPTGAAATGAEVSSSRI

SEQ ID NO: 954416 - protein, 84 aa, Homo sapiens
YGQVEAVRQAALRSPVGYTDPSPRVSSERARGPRTNYYAGVPANIAPHRRGSSYRFLYNFYRSLAPWSPVGSSSFAFVIFDLID

SEQ ID NO: 954417 - protein, 161 aa, Homo sapiens
FVRNRCRVCLSSRVCRTREVFCGPAEYYRFLCVTYPRYRLRYQKLRCCMPDRNWSSPCRITVSLRCNELISDIPFKHTAIGQACVHCLIEQPDTLFRRNLIAQMDCRIFIHREMQMKHVHLWCSRVGLELWIVLQNSEYIPGSGKVGGHLCQLLIKLHCRS

SEQ ID NO: 954418 - protein, 63 aa, Homo sapiens
SIPRPYVEPGLSHLSYSLNARLTETTATFGSLKPPVRRSHTLMSNRFPIDVFICLCVSIGPYR

SEQ ID NO: 954419 - protein, 85 aa, Homo sapiens
VESHGAPAALLGRDSSRYCCSHLLGQGQPVATPEVMAGGEDEPPEALGGQPPTLSACHLRASQVWLQHPLQEVFLFTPARSMWSE

SEQ ID NO: 954420 - protein, 37 aa, Homo sapiens
WSARDIGLSCFHIEVVNPIVDLASRIGLRVLSRGSEG

SEQ ID NO: 954421 - protein, 67 aa, Homo sapiens
VPVIIEEVCGAALGNTSRGLQVCKTLYSQQCCALTQTGNCQSPQAPSIIFHSYTMLLMFLYLLTTLS

SEQ ID NO: 954422 - protein, 71 aa, Homo sapiens
IQRMTSWRCTRWYDWLVTSCLPLPLLGTSLHISFHVLQHHVAVPIEGLHAAQEFLILLRQWMSTCARPDGG

SEQ ID NO: 954423 - protein, 73 aa, Homo sapiens
RSSRDASIYNLVLSQTVSLSIFHDRFAPFPLVELVSLKQNCVGEFAIPFSLEFTFICPHQLQGLLYISIGLIE

SEQ ID NO: 954424 - protein, 70 aa, Homo sapiens
HDTIELGTSIRQIESWPLTRAHGSTALVRTVTLSPGTEKVHGTLSSPSLLVSNDDWYTGLPSLRLWQEMA

SEQ ID NO: 954425 - protein, 92 aa, Homo sapiens
MTLQDSSFVLIFLLLLLQQSAEPAAGAVKSWCAAEYGYSPTSMYTGKLANTLCEVVFQVNFPFSSLITLLSRSSSASIPTLSKIFLMSLALI

SEQ ID NO: 954426 - protein, 79 aa, Homo sapiens
CTYTLTSVLYFLKPHSEQARIVLIWYSLLFHCCPETRMPLLADDGPGPGNWVHPELCEGLGFHAQQAPAHPPPPSPLSE

SEQ ID NO: 954427 - protein, 58 aa, Homo sapiens
LFTPSKRIASYPAISQYFDELSILLTILFEYQCSFIRFIVILTPAICSGPPIPFGPYR

SEQ ID NO: 954428 - protein, 75 aa, Homo sapiens
VDCCDLRRISLTMRVLGSHRFCDSEEIFILVLIASLVNNLHSTHTPTSSILTPVPVIHSEFRTFVLYLFISMVSI

SEQ ID NO: 954429 - protein, 65 aa, Homo sapiens
ISIRSYESHSWFMSFKYLWLLKSPCLTTGRLSNKGFDDHRNPKPSYFMSAAESCPLANLTAIGFD

SEQ ID NO: 954430 - protein, 91 aa, Homo sapiens
MNWNGMEWNDFGIEWNWTRQWNGTGTGMEWNGTGMEWNGTRSEWNEEGLMTGFDGHQTLSSNPVIKPFIKPCHQTLLNSLFKVLFNFPLGF

SEQ ID NO: 954431 - protein, 92 aa, Homo sapiens
VIAFGQCPWLMPGSSMAMMPEDLWSYHVAGAERGHGWTCLPFPSVHLNTTDLDSNECVYEFALFEFVPLIYQHFWCLPVIKKRVVVEPVGLM

SEQ ID NO: 954432 - protein, 122 aa, Homo sapiens
KPVINTLSSNPIIVSCGWCQAGPRYRTWLLPADDQPSLATQRYLNTVTVFQIDPSVLLEARMARPCSWDLNEGQHLYTLDGGDIIHALCFSPDRYWLCAAPGPSIKIWDLERYEGFDDRVPS

SEQ ID NO: 954433 - protein, 74 aa, Homo sapiens
QYPNLVLSISNKRIVRCTLMKQDKYHLRLVLAALRLGPAMPPFFNFFPQNAPAAGTLSTCTKLLKMCCKVSSFQ

SEQ ID NO: 954434 - protein, 66 aa, Homo sapiens
MRGVTVRRRPVCCWHESAEATSVVLMAPQPQINSGSRHGATQGVACQAMRTLAARPSWQASGRPAP

SEQ ID NO: 954435 - protein, 84 aa, Homo sapiens
SNPYLQLGSSVWTVKVLQLLLNCLMSMMCYYRFGQVYTEAKRSPGFDRVRNADIGIQDFELDFLQDSIYHRTLAGQDIQRHGSE

SEQ ID NO: 954436 - protein, 40 aa, Homo sapiens
MSPGTLHFFFFFFFFFFFFFFFFFFLFLFLFFFLFFFLFL

SEQ ID NO: 954437 - protein, 73 aa, Homo sapiens
VVSTRIPYHPTLIFISRRGGANPGSRTLTLLPPSLSFSSSLVPPPFVVQWESDQVGASGLWLATRVLHWGRVE

SEQ ID NO: 954438 - protein, 34 aa, Homo sapiens
DKPITLLTPPQTPHSNLKSEDNQYSYPFTIIGPY

SEQ ID NO: 954439 - protein, 65 aa, Homo sapiens
DPRHETLVINPHRNPSQTLIKPVIVKPCFLVWVLGYYTKLYDDLIYWGARRFCVSYALIFSCSVS

SEQ ID NO: 954440 - protein, 43 aa, Homo sapiens
YIIKRGGIMRLEDFERTLKVTYMTLLQDHYILTTTTGEASGLP

SEQ ID NO: 954441 - protein, 52 aa, Homo sapiens
IEPVPSIRAKYLVQCHTNFKPVKWRNNMFKNCICMGGNMYLYDWYEDRTFEM

SEQ ID NO: 954442 - protein, 35 aa, Homo sapiens
MNELVAGPNTPVGGGWRPQFGGFAQRGGMALGKCS

SEQ ID NO: 954443 - protein, 37 aa, Homo sapiens
TRKRLSREEQLYNHHLMKGTLNWVILASQWPQLALIE

SEQ ID NO: 954444 - protein, 44 aa, Homo sapiens
MSSGSLFITLFLNWCCLCFIAFAYSLKSRDRQIVGDLTGAPPWG

SEQ ID NO: 954445 - protein, 33 aa, Homo sapiens
RFTFKEVCSVTHTGEMQGVEEARRYCDVLTSVI

SEQ ID NO: 954446 - protein, 82 aa, Homo sapiens
QNAIVWNITRIACLKEFADHAAEIELLSTNDKNEMGSSPISINFEVPFGPSGLKVRYLKVFEPKLHYSDHYVLKWVRYIGPY

SEQ ID NO: 954447 - protein, 55 aa, Homo sapiens
IQSRIITLNSGLYVSLLLASEYIESPFIISDGIYALNIFCSHRLPRTSRSLLGYR

SEQ ID NO: 954448 - protein, 58 aa, Homo sapiens
GSQLIRYCGAVRLRLWGHELMRTDFRFISGSQRFVIIFYFYGLLMREVGGSLCFGPYR

SEQ ID NO: 954449 - protein, 52 aa, Homo sapiens
CSIHKVKLPAGINEFSRALKHGKELVNCFKLAHKYRPETKQEKKQRLLALIR

SEQ ID NO: 954450 - protein, 44 aa, Homo sapiens
VIQRPDQHIEMVIVVHAILRYTRSIHTFFFSCMHLPVRSIHTLL

SEQ ID NO: 954451 - protein, 35 aa, Homo sapiens
VVLHYSVLGTARYLSILCIYWLDEVSLVLFFALML

SEQ ID NO: 954452 - protein, 68 aa, Homo sapiens
MEIPAEISILLLGVAHFKGQWVTKFGRQKDFPEDFYLDEERTVRVPMMSDPKAVLRYGLDSDLSCKIA

SEQ ID NO: 954453 - protein, 62 aa, Homo sapiens
VVIKLVPSAYLDDLCHSIFLCALVLLYILCKYHGIRVQGERKCLTFYLPKFFIVGLLWLAYR

SEQ ID NO: 954454 - protein, 56 aa, Homo sapiens
STSVAEQYGASVQRASTAERHACWGYVVLLRLLGVCCVALLLRLLTLTDARLLMLR

SEQ ID NO: 954455 - protein, 38 aa, Homo sapiens
MASIEPTSHTAHTFLLGYVVLLHVCVQVGACVCTCVLR

SEQ ID NO: 954456 - protein, 118 aa, Homo sapiens
MNLSYYYKRGEIQTNNCYDLLSCLLLMVLPDYTSLCESPVRECSWCNLCRVSSWNLCSHPEIQNGQLAWFDCFPLISWVLNSIQAYFEDIASLVPDYFNKANNRNKVSHTNFLVSQCI

SEQ ID NO: 954457 - protein, 79 aa, Homo sapiens
PERCDRSRRTHALIRGCSFMKPILPMILAAFICHLPRCLRARDFADGGLYLEGPGLPGSMLSLTMYAMDSVHLLQHNHR

SEQ ID NO: 954458 - protein, 33 aa, Homo sapiens
DIGPVSGQSAVGSPAGGLLCWKKTEVLRLLSLL

SEQ ID NO: 954459 - protein, 71 aa, Homo sapiens
FSGAGWDANNRLETTPTGYVWKSVAGPTTFRYIGTHSGDQWREVCEDAPLLMLLMLRLLNSVTDAPLLTAY

SEQ ID NO: 954460 - protein, 53 aa, Homo sapiens
MIHSIWYLDKGQRVNKIESFGKPGKLQSAGQFRAVIDQLGPYRGGSFIKSTVQ

SEQ ID NO: 954461 - protein, 49 aa, Homo sapiens
KHTLHTQAPTMTTRMHSTHEHSTHTNTQHNIPPQAGPLRLLSSVTDRLL

SEQ ID NO: 954462 - protein, 34 aa, Homo sapiens
ADPLKGRRATPPRAAPDKLHPSPKCNIGLKLGTE

SEQ ID NO: 954463 - protein, 32 aa, Homo sapiens
MAPSESARIRTPPGLRTRASFTQHTFGFVRVV

SEQ ID NO: 954464 - protein, 38 aa, Homo sapiens
MAASLLVAFVFEASTPRPLAAVAAPLVCPRRNKSVGLI

SEQ ID NO: 954465 - protein, 98 aa, Homo sapiens
RQDPMSSSDSSDSSFFSSFFSSDCSRCRTSNRGCKVLVCSRDGYSPTSMYTGKLANTLCDVVFREVSIQLTDNLVEPVVVRLDTHAVQDLLDVLGPYR

SEQ ID NO: 954466 - protein, 39 aa, Homo sapiens
SLGILQSVTLCLHAVSLWKQSTTRSSTKLTQSHKIIYHV

SEQ ID NO: 954467 - protein, 48 aa, Homo sapiens
TAKGLHRTTHSNSMLYMCYFIVVLEDVEDFQILAIKYEEATLLSSVEI

SEQ ID NO: 954468 - protein, 66 aa, Homo sapiens
RCPLRSDGSPAAVLDATRETSARFLALVVSDHTGTVLLRQSGLNLCRQCFRQYAKDIGFIKLVSLN

SEQ ID NO: 954469 - protein, 68 aa, Homo sapiens
MRPYSKIQMTTKIRMVWKTRQKAKNRKVIYVHLTKYARITGSTIERQCYKTYQVNTLKTKQVIMEALK

SEQ ID NO: 954470 - protein, 33 aa, Homo sapiens
ADVCDVLLYEWGFNREYYSIVNVKESCGALMRP

SEQ ID NO: 954471 - protein, 80 aa, Homo sapiens
YRKSRYQARAFALSSTTVTSLTIQLSSPADISVGCIIRLSHPWPSYNILCDDFYHFSNLSWVGAGMDAKEASVLVAVVVS

SEQ ID NO: 954472 - protein, 56 aa, Homo sapiens
MCLTVNGNAYSNRRIYTAVLQVALACDIDVALELSAIEQHKECSPVANALPYRGGI

SEQ ID NO: 954473 - protein, 63 aa, Homo sapiens
DGTVTDGTLALTSWPMITVDYTNAFKIDLAHHWPSYYISQMNWFPVANNMVQYVSMTNRIRWY

SEQ ID NO: 954474 - protein, 51 aa, Homo sapiens
HPPSPGLAARLTINLIDQPNYNTALFDTAGTPDGNLLLSINNPFLNPRGVC

SEQ ID NO: 954475 - protein, 65 aa, Homo sapiens
MEIVRRDRPIRAGAPYIGPSRACVYWLWFYKIRHRYDWAFYTIFAARVLQVPLYFAVFIKRHVAS

SEQ ID NO: 954476 - protein, 68 aa, Homo sapiens
MLWSCCAGGVLAPVFDATAEPVAKTTMAQAAPILRDWKDFMTMPWEKGRKQGREQVQSHDLTSPTWRL

SEQ ID NO: 954477 - protein, 54 aa, Homo sapiens
MEHLTLFLIKKTHKHDPQPEDPNSRPSSPKPAQPALKMQVLYEFEARNPRGRGV

SEQ ID NO: 954478 - protein, 78 aa, Homo sapiens
MASQCRMQVPAFPGSKQVHRILHGGQSLPCKQVAACMLLPEGNPIVLEHCGGQSSQCAGATAVKRLVAQVFTTALALL

SEQ ID NO: 954479 - protein, 62 aa, Homo sapiens
HCQIAALVDREARRGIKAGIGANPIGMPGTQYSASQQGQRTGRADLLDGLGSTGRDFHIAHV

SEQ ID NO: 954480 - protein, 38 aa, Homo sapiens
MTKSSRYPRYASEIGHLANNCPALRKSEIEYYAMLALI

SEQ ID NO: 954481 - protein, 104 aa, Homo sapiens
KAISVVFSKTGFRNIGQAGLKLPTPSDPPASASQIAGTAGVSRHTRPGSDFCLRWFDTDLVPAPRVGRQPPLSPASFSCFLPTAGGSERWDDFPQVTTGFWPLS

SEQ ID NO: 954482 - protein, 48 aa, Homo sapiens
VAHEGVEEGYRGKYGPYYKDFRGIHSRTMGMKLWYATTDFRALTVDIP

SEQ ID NO: 954483 - protein, 49 aa, Homo sapiens
MGHDQSNNVLHLALRKMYVTSSCCVKDYTQIHKWRLSYSLRKCSVGLIE

SEQ ID NO: 954484 - protein, 77 aa, Homo sapiens
LVMSRRLIHHYFSFINRECLTKNYNVIGLFCNIIFSKVNSSTLITFGMIFIFPFSCVKLFSTKLIYIRYSSSFWPFI

SEQ ID NO: 954485 - protein, 100 aa, Homo sapiens
RAGTLISGHAGMDEYMQEVHEELTRGVELGSYLRERSGRIGAWMSVSWKLRTFLWPPRTHTPAAFPGFKNYPETFLKVSTDGHLASQSQRAQVSPGNLHT

SEQ ID NO: 954486 - protein, 55 aa, Homo sapiens
DPGLDYCAVQSMFKPLFVVIFRVSWEFCTTQVSFSFIGEGVIKTLFTPASIDLAY

SEQ ID NO: 954487 - protein, 101 aa, Homo sapiens
MRARACVVNLSVLKLIYASSPGGLLRLRTCHIYILIVLRLSLFEFLSPQIKALYRFALVPASAASKEYARFPCMSLLVTVIDRVCACVCVCVCLILSWPLS

SEQ ID NO: 954488 - protein, 44 aa, Homo sapiens
VFTRGSVPSIRAKLLMNRQELTWCLCSLARNPNAFTLIYPLALS

SEQ ID NO: 954489 - protein, 54 aa, Homo sapiens
MLRIGTHAFCIALYLCALGEIIHNLNNEQDIRKIGGLLKTIPLTSTSLTIGPLS

SEQ ID NO: 954490 - protein, 76 aa, Homo sapiens
MPYPLHHSALSCSDVRSSIYLITRFVVWAPEPGMPTSLLLHIPLFSIFGPANHSGSFPHSSFQKFVCFWAPNWPLS

SEQ ID NO: 954491 - protein, 68 aa, Homo sapiens
MIEFDRWYPCDKGQSRRRFAKHRRVMDGVSPTSQATALAPNLRQNPFHYHIHRRKSNFLPTTLSWPYR

SEQ ID NO: 954492 - protein, 69 aa, Homo sapiens
YPRIRATVRVRESHPPRYPSPPLGDRERNPLHGPELCIRVSEDSPWCVLLILNLMPLQVPFTTASLAYR

SEQ ID NO: 954493 - protein, 37 aa, Homo sapiens
SYSSYEKTSTTHPSITYISMSPVPITSLQHSPLGPYR

SEQ ID NO: 954494 - protein, 30 aa, Homo sapiens
MLPIPHPFPIHLTLDKGQKSSGAMLALSTS

SEQ ID NO: 954495 - protein, 121 aa, Homo sapiens
YPRYGGKLASCVSEKDLCGRNKESLIWLTHDARTMRYPDPLIMVNDSIQIDFQTGPITDFILRSTLVTLVLVFVPENLGRIGVITNRERHPGSFDVVHVKDANGNSFATRLSNIFVIGPYR

SEQ ID NO: 954496 - protein, 37 aa, Homo sapiens
IANKETNSELVCQVPWYKLGSGFFPDSSNKSPVGPYR

SEQ ID NO: 954497 - protein, 71 aa, Homo sapiens
LQIELELGTLDKGQSPSSLWLVQHTGSEVYREWVGVWWSISVCHADGGRGDRRQGGQSHKVHLCHGVKDGS

SEQ ID NO: 954498 - protein, 88 aa, Homo sapiens
MLRTCSDDVDGRCSSASVMDLQVAQLLAERASNETSKFMELVGSEAQFFLSKVGRSSISVLICDSFMPAMRLIFHTRAFSLALYLALS

SEQ ID NO: 954499 - protein, 61 aa, Homo sapiens
MATMKKFSSWQSELHRNWNSLSPFRYGQQFHSLTKPVDLAVIVWHLPHKTQVAATFFGPYR

SEQ ID NO: 954500 - protein, 55 aa, Homo sapiens
MARTPLDLIFRFVSAKKLDIRGVLVSRCLSPGCWSPTEKFPIPSQPICSVLGLIE

SEQ ID NO: 954501 - protein, 84 aa, Homo sapiens
TIELGYARSGPNRTVLEITELEPPRSVTQVSFQINVLLGLFDRASVIRVSPYLMESAELISPGWSALKRCLLLLSLCDIVFPYR

SEQ ID NO: 954502 - protein, 74 aa, Homo sapiens
RIRAKLRRVHKNLIPQGIVKLDHPRITWISLVILFECVNLVRWQTEAPPAPGKKLPVLQIKVVVLPLRMPSAGG

SEQ ID NO: 954503 - protein, 65 aa, Homo sapiens
YDSELSTLDKATRSVFASHEEASFTEFPAILQCYTLEQNYAKIHFTIIFIGVNLTFFPRHFLGLI

SEQ ID NO: 954504 - protein, 48 aa, Homo sapiens
RAGTLDRAIGCRSQLYVWDLLEYVGVELERFLKLVAAFRPTMGVWPYR

SEQ ID NO: 954505 - protein, 40 aa, Homo sapiens
ELCTLDKGNAAQNPPGTDLLTALCQESQCFHSYLPFGLYE

SEQ ID NO: 954506 - protein, 44 aa, Homo sapiens
YPDKGQPDSNGQSAKRCFLVMDAYEEVPRLKLDDQQCCVNCRLV

SEQ ID NO: 954507 - protein, 71 aa, Homo sapiens
LDKAKLNHWWNPIYYRKYKNQLGVVAGACIARYTVRLNHVNRLSLASGGGRELRSPPICTPACVKISVPQS

SEQ ID NO: 954508 - protein, 111 aa, Homo sapiens
MASTSEQSEKDLWWAQGGIASSGDLMMPASIRYPDPLIKVSDTIQIDLSDWPDYCISSSSTSGYLLCGLFRDNLGRIGVITNRERHPGSFDVVHVKDANGNSFATRLSNIF

SEQ ID NO: 954509 - protein, 34 aa, Homo sapiens
PQRKLRWVDHLKPEVRDQPDQHVVKPRLYLALIE

SEQ ID NO: 954510 - protein, 58 aa, Homo sapiens
MRRVLLHQQVTLATLPIPCAITSSMIFPFSSLITLLSRSSSASIPTLSKIFLMSLALI

SEQ ID NO: 954511 - protein, 96 aa, Homo sapiens
SQVSSDSSDSVLLLICSSPLLQQWAEPAARGCETWCSRNGYSPTSRYTGKLVNTLGYDVFHVCSIQLTDNLVEPVVVRLDTHAVQDLLDVLGPLIE

SEQ ID NO: 954512 - protein, 42 aa, Homo sapiens
AECAQTGHEFLSSNDLSASAVSKTLGLPSVSHYDLALWIKLI

SEQ ID NO: 954513 - protein, 102 aa, Homo sapiens
MRANRDTSSCLIRIIWESFIQVLYWSSDQSGIEFFIFSISFSYSTILALERDTHVRTRFHIFFFFGIHRGVIFFILKHGNLQRIKLLLKVIHQASLGHIGLI

SEQ ID NO: 954514 - protein, 49 aa, Homo sapiens
MAIIGGFIHRCRLFSGYTLDETYAKIHFTIIFIGVDLTFFPQHFLGLIE

SEQ ID NO: 954515 - protein, 68 aa, Homo sapiens
VNLLPITDLLVLTYDVCARSLNGDSLGAPTVRDAYQYPDDVDNLRSYILPPLFLEPGDLRLLDVGLSE

SEQ ID NO: 954516 - protein, 51 aa, Homo sapiens
AKYPRISAHQELTLATSMSYSFFTAVFNLGACGLIGGAILIKSDPSNACNA

SEQ ID NO: 954517 - protein, 102 aa, Homo sapiens
VFTNKPIAECLLRVHAVQAGGGRSPSISLCDIVLKYSAYVRVSLGGSKSSRVVGFPKSLPPHQNTPRVLLGGPNISSALGPVGQEMVIYHPALARSKGHHVA

SEQ ID NO: 954518 - protein, 78 aa, Homo sapiens
YPSVAKERVFIEASRLLFCPVCDVVIPDTLCDVVFRGRHEASPPASSGRQAHCQASLREGEREREDSLSRAPGLGPYR

SEQ ID NO: 954519 - protein, 79 aa, Homo sapiens
MELVPGDTPLPTPTGCIPICRRPQHSVPHHQEPPSSDEAVVDRHGPEAASGEWEHGAWAQNHENIGRILAGTLAIEGDP

SEQ ID NO: 954520 - protein, 56 aa, Homo sapiens
MACNATYAVNHYHEKNSYLAILSLPTNLLDYNITATELIIFDIFFETTLIPTLALS

SEQ ID NO: 954521 - protein, 45 aa, Homo sapiens
NIRVPFDRGDLVGGTHWNGDACVCNLTNELIERPGSKPMDTECSG

SEQ ID NO: 954522 - protein, 35 aa, Homo sapiens
TNSSWYRSHFCIPLEMDLFEYRLLLLRIMQFITGD

SEQ ID NO: 954523 - protein, 60 aa, Homo sapiens
MIESSWYRQHGEASRVGGTAGARHQARLVFVFLVETGGFTMLARMVSSPDLTIHFLGPYR

SEQ ID NO: 954524 - protein, 49 aa, Homo sapiens
MVAVALVLHVTGICSSTSFIDIRPRKTAVTVRYLADGGVSQAGIMFLVY

SEQ ID NO: 954525 - protein, 108 aa, Homo sapiens
LRTELVPSDKAKRAYDVRVLIRSSVGSSVSYVKRNSATSLDCAPTNRERELGETVVRQVSFTLLMMCCCHGNPAQYERNRRFRHLVYVLWLRSQWGEATICGIMTERL

SEQ ID NO: 954526 - protein, 34 aa, Homo sapiens
VYTSSEIYDQDHSGTSTVCFECEKTLVVILLEAR

SEQ ID NO: 954527 - protein, 40 aa, Homo sapiens
MHPNLPNSLSPRGERGVNSRRIRVPAVHHGSSEDWLSCHL

SEQ ID NO: 954528 - protein, 39 aa, Homo sapiens
SARSDCSPGSLYLVMSLPMSLLHWMEENQAVASSHPLRG

SEQ ID NO: 954529 - protein, 134 aa, Homo sapiens
LEDPRWPTSGRKHNPQTLALKCMQLCQSRWLQGLMLSSAAGTAPSPRHGPQKSDTCSHVALHNQYTAQHTSLTDTVSLWDPVSMSMGLGPDVDRKTPGNPRPFRSPPRKVTSSTHFVGSAAHEVAARSVLSPQM

SEQ ID NO: 954530 - protein, 79 aa, Homo sapiens
MTCLGIPGLHFSVVHARHIITTHHHSPSKERMLQNDILASTMDHADQSVAIRDGILCPRSSPGPLVGSLTHSTFARAVT

SEQ ID NO: 954531 - protein, 36 aa, Homo sapiens
TACSVENAWEIVMGYGDSVVSPYATVSGKNPLFIGR

SEQ ID NO: 954532 - protein, 60 aa, Homo sapiens
HVYTVELTDLYRLINLIPRWNSYLQYKVKISNKFYESIADIRYQLQGRFLFEGLFHFVGS

SEQ ID NO: 954533 - protein, 76 aa, Homo sapiens
ATKWEAARVAEQLYSLTCEGLCVEWLRRYLVKREWRLLQRADPPKTHLTHHPISDHEATLRCWALGFYPAEITLRG

SEQ ID NO: 954534 - protein, 59 aa, Homo sapiens
KPDFRNSMSKSMWMFPSPDLTAVPAMTYVTQYEMCGCQVTQQDAEAMVQIPQFAVPRLQ

SEQ ID NO: 954535 - protein, 74 aa, Homo sapiens
CHEVGSTECVQSFGVLVKGGRRSFHTRTTQIKIWMPGHSRPYAVLIPSTFVVQRRTETRNSVIIGLYAMFLLFN

SEQ ID NO: 954536 - protein, 39 aa, Homo sapiens
CPTSDLINYSMHFRKIALATCSREACTRLSRLSTVKADD

SEQ ID NO: 954537 - protein, 35 aa, Homo sapiens
PPCMYQGGEVEHERTFYDPKMVNYDLGSANPEVNS

SEQ ID NO: 954538 - protein, 61 aa, Homo sapiens
MYRDRACMYPCIFRALHLPGTEELILRRLCIKLWFAHRFQIIDRSIPPDTWGYRVFEVRNS

SEQ ID NO: 954539 - protein, 33 aa, Homo sapiens
VIYRATVARVDAGKGPFDTTALDSCETKVAGHS

SEQ ID NO: 954540 - protein, 126 aa, Homo sapiens
RIIGHDEDWISVEGTDAEEIPVVAHVSADTKEWVEKLTEFVSDLMPFFTFRYDVYSSYIGVVWLYIVAPLRISVVDQFVIERLSTELGIILARTKLPGLTPSDFTKQCLPGGLCVGEQSRLKLKRI

SEQ ID NO: 954541 - protein, 73 aa, Homo sapiens
NYIKLHIGTKQKAHIAQTFLSNKNKGGGIMLPNFKLYSQGYSNQTAYYRYQNRCKSNGTEQRPQKYYHTSTNI

SEQ ID NO: 954542 - protein, 72 aa, Homo sapiens
HKRKVDAKIDGHIFFRMEQIKKTKSYTVKGLGLKSVKFTAPPHTPTEHVHPVRGNQSLPVNHESFTKVWYTE

SEQ ID NO: 954543 - protein, 88 aa, Homo sapiens
GGPEDKQQILLLSLHGLIGCISRGHSGSPYLADILTKVAYGSSTVWPTSPTTISFPSSRMMFFLSSLRQKSTAFLRFFTSSGVEDLRT

SEQ ID NO: 954544 - protein, 101 aa, Homo sapiens
MCYFAICCCLLLVGSSLPPALLKRQSSGSGSGWFPQGTPQWRASQCLGHCVPLRPCTRAGCKPRGLTVPRVGEQELVCNKPSWMQEPSVFMQRSSMSWGRR

SEQ ID NO: 954545 - protein, 83 aa, Homo sapiens
MMFTVVVEHTAVCSQVSTAQVKLRVAVVTPISTGSADPQKLISNEVLGPGHAWVLSGLGSSILRSSVASKFWKVVLNLRLSGS

SEQ ID NO: 954546 - protein, 70 aa, Homo sapiens
MEQQRIRLTFIVDSLKQLWQPLARFDYAAAPWSIGFSRCDSRDSSDQVIVAKGMRAVKGKTWAHVLGEVY

SEQ ID NO: 954547 - protein, 124 aa, Homo sapiens
TLKDFSHHSVIQGQIERESFSSSYNRKIDDGDGNALDCKDHQPVPQVNGFLISSWLQSFSISLDDQGLVHLIHKYLEHPLLLQPRHRYFLFDNRVLVDHQYNIYLYREGVLRTASEPYHVDNVI

SEQ ID NO: 954548 - protein, 36 aa, Homo sapiens
WLDTFAQKRRMPSMPESSSVAPGLHGAYVSGHYVSG

SEQ ID NO: 954549 - protein, 45 aa, Homo sapiens
YSELEFIDGIVRHTTSGHGRTRTKSSLYEKCICYLLHASGHYVSG

SEQ ID NO: 954550 - protein, 37 aa, Homo sapiens
MCYYPCRSGHYVGHVAGHVVAGTYDEFELEFIDGTCT

SEQ ID NO: 954551 - protein, 38 aa, Homo sapiens
MIPCIVPGDFCVFVIVSRTSNIRPPARLQAPHFWHFVG

SEQ ID NO: 954552 - protein, 38 aa, Homo sapiens
VLRCSRNSGFTWVYYVLYVSGHRTRSGRIYVLPTLRSG

SEQ ID NO: 954553 - protein, 44 aa, Homo sapiens
WTVADTYWRITYRVGNIYTYVSGGRTRTGTCVTYPFGPATTCPA

SEQ ID NO: 954554 - protein, 49 aa, Homo sapiens
AGLYRIDRLIALSRFRARRHYVSATWPDTYCRHVRTRPIDEFELELRVR

SEQ ID NO: 954555 - protein, 64 aa, Homo sapiens
DIPRLGKTGLSLPTTEFGPHYPSILHPERQQQLLWSIPFSFIEKKFAFIVHFNEFLAASGYVSG

SEQ ID NO: 954556 - protein, 112 aa, Homo sapiens
WRTRRTRGGDKMKPRLGTEVRQAARARMVSGPGESCKPGDARGWSASAPGNTHSGHYVSGHVAGHVAVSVCVLCARCVCCVCMCVRVLCVCVLCARVCAVCACVLCVCVCCA

SEQ ID NO: 954557 - protein, 105 aa, Homo sapiens
MQWALRNGVVEGITKRSLKAHTETDSPKHLQCPPLGVGLWVILDSSYSNPSNSCETEAPSYEDHILRKPDTQTKPSLRIPRFPKGFSTCSLSPHFTFPEHIFHEL

SEQ ID NO: 954558 - protein, 49 aa, Homo sapiens
GPYCCVTRGSDGWRPHTTPLSGIGFLADFGVGSGECLRAYARGTLYVSG

SEQ ID NO: 954559 - protein, 38 aa, Homo sapiens
TEEVLGSLHSNSARPEPGGPSQPDARVLCVPNTRYVSG

SEQ ID NO: 954560 - protein, 77 aa, Homo sapiens
TIDQRSEMRSLRITHITLYPHCESVLYERAVRHLSHGWSWRNESGLLSLTSWDRHLLESLTLAGVSMNIEDCAYVSG

SEQ ID NO: 954561 - protein, 45 aa, Homo sapiens
VYALTGRRIGHPSVLRSRTLSVAKVLVNVLVSRAHGGRGTESSMA

SEQ ID NO: 954562 - protein, 79 aa, Homo sapiens
GKYVALFQTISKRELILRRWALKLLFASTDFTALTVLYPRVVNRKTPVGFRRPGIASVFKPNVGTAHECKTSCDVRSTW

SEQ ID NO: 954563 - protein, 62 aa, Homo sapiens
MDEVVAGHVIGVLRCSRNRGYAVRIHKNRGGEKKGLGDKTCCVEFRGEYVRVRPQRSGYVSG

SEQ ID NO: 954564 - protein, 59 aa, Homo sapiens
ILPRIIYIQDKMTGTLENQFTCPFCNHEKSCDVKMDRARNTWSHLLYRWGTEVGTDART

SEQ ID NO: 954565 - protein, 33 aa, Homo sapiens
PVDEQKSHREGPRRVLRRCDFCYISGTPITCPA

SEQ ID NO: 954566 - protein, 55 aa, Homo sapiens
TRYRIDMIDSSFSIPVGWSVPGQNPRLVERFVWLIPDNERDSGMLTSYVSPTCPA

SEQ ID NO: 954567 - protein, 50 aa, Homo sapiens
WRTYLDRWVVWSMVLPEIRGYQLLKASYYGPYSSYVIGHSASELQGSTCP

SEQ ID NO: 954568 - protein, 83 aa, Homo sapiens
GHCPLDRFSANSVERDITAHCQSAPYHVYGFDPGPVSVLVVIVPAILQKCPVHHSELDFIRRTCVSSTCSAMGILSSLPGVVL

SEQ ID NO: 954569 - protein, 47 aa, Homo sapiens
LTFVPICPAVKAIIYQYMEEIYHRIPDSDPSSSKTMQIISTIRTRMF

SEQ ID NO: 954570 - protein, 62 aa, Homo sapiens
VLKNVCNQVEEPTITVMYRNPVIIEGWCCILHDPDDEWVKKKKARIPTLPTIRSLPNRDTNV

SEQ ID NO: 954571 - protein, 95 aa, Homo sapiens
CNILPMECNGMEWNVMVMVKELDINPQENGMEWNGKEWKGDNQNGLEYNEVNGIESNQSECYEMKWIRNGMECNGMEWNAMEWNQPEYNRMDTNV

SEQ ID NO: 954572 - protein, 40 aa, Homo sapiens
GTPPSTELHLHSNLKYPSKLYPFRFYGGFIAQIWLIKPLA

SEQ ID NO: 954573 - protein, 56 aa, Homo sapiens
MEPGCSDSVHKNNSGCFAETILSTRGVAEAVCLEGSPMGAESPHSHGSGHRRRGVG

SEQ ID NO: 954574 - protein, 94 aa, Homo sapiens
VSERIYSYPRNKINTTTLLEEEAETCQVVRDKPSRELHPSLNSTGNPKKGNLKSFWVGELGAFHQQGAVVKDIVENPSSLDRVFPLDILVCNMG

SEQ ID NO: 954575 - protein, 75 aa, Homo sapiens
EYPPEINTEQYTTFTSHKEVIATNGSLQLELQYLIIERQLRILTRFKQYISHYADINKIASFKLSSEARKKIFYT

SEQ ID NO: 954576 - protein, 125 aa, Homo sapiens
SLHVCKHQKLKKHIHQICTSHDILRIIHLTTKPHKKRTRTPSYMIGIRCSPVPYLATVHWIKGQPRQQAITSEDTDQYDLEALYDVTQCHVPHSLLQGGLILLEWPVQLLHNADRQHNIYSVSIV

SEQ ID NO: 954577 - protein, 88 aa, Homo sapiens
VGGSSTLYTDVHRLPRKTACGSWVGVPQALREHLKNPEIAQKIQKLMDVGSCCKFGDDIVIPPSLHASCSRIRRMDGITSCISCTSRI

SEQ ID NO: 954578 - protein, 34 aa, Homo sapiens
TGGKSMTTKPISVETPIVFMEMCPKMIELGTRAR

SEQ ID NO: 954579 - protein, 148 aa, Homo sapiens
SVSGCGQEYGKREEDDYQYSDKGRRARKTWKVWSRKLKSTKLTMRSRGTQVLIQDITVHLLCLHQCKATVENETPSRQASTMRTNKKHLDQCNEIINWLDKTSSTAEKEEFETSTERAGRELATPSSPSCTRVQEAWQEECPGVGGGY

SEQ ID NO: 954580 - protein, 112 aa, Homo sapiens
VPKTLDGALDAQSLSNVDNFLAKKTEESADARRQADMLQNEAQTLLAQANSKLPPAPKISAHSTHMKHNQSIHRSIKLKNSARLEGEVRSLLKGYQPAKWLCIAHACNRGGY

SEQ ID NO: 954581 - protein, 66 aa, Homo sapiens
VEKSLIGMTKVKVGKEDSSSAEFLERRRAALGKVPSEDCKSSYHVQDPDVREFLEKEELPRAVGEE

SEQ ID NO: 954582 - protein, 109 aa, Homo sapiens
MYLREEVTFYLTLLRFAKACLFLINKLPSIDQLSLQIMGGEAVRQHILSCSIHGWHQLNKIDSSSNCFCCFHLPSPSYKFAHHSQVTLFTESRWGGVVQHILYVDYGWH

SEQ ID NO: 954583 - protein, 66 aa, Homo sapiens
LCDYLFEDSSQLNTSEEINDYVNEKRQRKPEPAVSHIKEAQKFQELVKMVSSLAGRAPADTGWVVT

SEQ ID NO: 954584 - protein, 190 aa, Homo sapiens
KSTRNTSQIRTLSNSRGDREAFLPELVDESCEIRATAFNEQVDKFFPLIEVTQVIISRKAPEDSYSSGSQLFKIDDEMTFNNETSVMPCEARPSFTYGSALISPGMDDLLERRSKDSLVDIIGICQSYEDATEITVRSNDREVAKQEYLLDGHLREGGDCYTVGGPMLINLMVLDRPCWVSKEPESLISV

SEQ ID NO: 954585 - protein, 36 aa, Homo sapiens
DSEDPVKATAWLYLTYRRQTEGYCARTYVIDGLYAV

SEQ ID NO: 954586 - protein, 52 aa, Homo sapiens
CNSYPRCRALRIIVNAVFTIAVGTCTPYYRERDLGLDRRDWDKNDPTGDVSS

SEQ ID NO: 954587 - protein, 95 aa, Homo sapiens
GGALAVLSDGAALPRCCYVDGGYVRGVTAWLTRLDGLFVVGLMSWRVGYLISGAADTDIADTVVSDCVNGCCVGICSGVSSTDEQEGYNSYAHSA

SEQ ID NO: 954588 - protein, 101 aa, Homo sapiens
YVLCWETHPHSTGECIKTRLINQLPTGEVHQFLSLYFLFLGNGVKLYRPVGGRGHNLSSGQPPPPRFKQFWCLSLPGSSDNGCPPPHRANFFGIFIRAIQP

SEQ ID NO: 954589 - protein, 49 aa, Homo sapiens
MILGAEAQSPLVGLEADLLLTLLRPLHCMTKGGGNSQKNMDQDLKKCGR

SEQ ID NO: 954590 - protein, 42 aa, Homo sapiens
TDNTNLTYIPVLPMQSPKQTQLPFTLQISLSCLHSFLYFLTV

SEQ ID NO: 954591 - protein, 135 aa, Homo sapiens
YEAMQERREAENMAQRVRLLEDGGGSSPLGPPQLLLTQDFVAASGCRFFLVSPNRKRASSNNQDSKRRGHTDFNLGLFHLFDRRDLPYLSWVTKCSQFLLTILYFIFRPTISFAELMITSTGRGWYSWSKLLLTR

SEQ ID NO: 954592 - protein, 69 aa, Homo sapiens
VGDFISKRKKKYIDDHGSQIFMTDNNFKSLRLGAGVHTSNLSTWGGRGRWITGGQERETSQELETIQPR

SEQ ID NO: 954593 - protein, 102 aa, Homo sapiens
MKVLPVSRGGLDDRFEGPYRLGHGGLAVAFRIEKSAGAHCSLSDSLEVTAYIHEHKCGQTSHSEIFVISQGVVAYTCVPVTQEAEVGESHEPMTEPLRHQPG

SEQ ID NO: 954594 - protein, 31 aa, Homo sapiens
MADYYAEKPAPIKGMCWQTVKLRAAGVTYLF

SEQ ID NO: 954595 - protein, 41 aa, Homo sapiens
MSLNWTWLPPYSTEQVNKRYLYEEFCCAIILGLISETNDGR

SEQ ID NO: 954596 - protein, 71 aa, Homo sapiens
ADHRGVIGMKTVDYAEIIPKRNDLRLVCAGLPKNSPGCRYRLMLSVSWYTALMVPSPPLYPSLSTHQQFNS

SEQ ID NO: 954597 - protein, 62 aa, Homo sapiens
TEVWEERRAAETVTTGGIIFQTHLKEKYSKQQSSHVGSGPKGKGGETPSHVSVKVGRLGYSS

SEQ ID NO: 954598 - protein, 80 aa, Homo sapiens
YTHQRIYPYLVLVVHTVNLNIRAPGTEQGGVSLLEHPQGDNRSDLCKLKSVVTSIRGVKNHRAGCLPCMQHIKYTTKLTY

SEQ ID NO: 954599 - protein, 114 aa, Homo sapiens
ASGKSSVAVAGGRKYKAGVKKVLHYKDRVWVERSAAETVTKGGIMLPEKSQGKVWQATVVAVGSGTKGKGGEIQPVSVKVGDEVLLPVVWRHQSQSRCTRIISYQEMVTFLDSS

SEQ ID NO: 954600 - protein, 138 aa, Homo sapiens
MKQVHCGFHLKMKDSDQGQWLMLSTLGGQGRWVTGGKEFETSLIRTWRNPCLYEKYKKRLGGCGRYVPVVPAIWEAEAGELLEHQRWRSNESRSCHSSLGDRVRLSQKFFFLEFKMRKQREPFPLCGNTSWESLGRFS

SEQ ID NO: 954601 - protein, 71 aa, Homo sapiens
LESENLEILESAGTSEYFGQYPDDAHKKSYWSISDFGLLALGLVRIMQLVRVVQISFSKTLKYETLLVPRI

SEQ ID NO: 954602 - protein, 61 aa, Homo sapiens
PTLLTLGHAAGSEIEIWIPKHNRSLDNKVSQEYTMTQQYRNLRKLFFRFLSTMYEVEYNSG

SEQ ID NO: 954603 - protein, 57 aa, Homo sapiens
WKQCLVWWPKREGKVTIWAHGNLNLPGLKVILRPQLLKLAETTGTSHQAQLILVSRW

SEQ ID NO: 954604 - protein, 39 aa, Homo sapiens
IWITADQNITKVNSTEMDIKSDLVRPDGGGGHLYNVSRS

SEQ ID NO: 954605 - protein, 109 aa, Homo sapiens
QAAHITVDNKNNETQLESPETKTEHSWSIASKKKVLCDSESELIVFLNKQCQVRLIEDYLKESNNQYPKVKDKERILKSMENEKKEIMYNVSSDYIWQQTCQWKKARRQ

SEQ ID NO: 954606 - protein, 44 aa, Homo sapiens
RSGYGMKQMRRLEDWTTADFRTKKKKRKQVGSPDEPDSKPPYDS

SEQ ID NO: 954607 - protein, 45 aa, Homo sapiens
AAHDGTLSRPSFLGMESCGIHETTFNSIMNVCTWTSVIDLVRQPH

SEQ ID NO: 954608 - protein, 53 aa, Homo sapiens
LLSLENQLLLITADNATQINVILGAVFALVFLVSSPLACHMALVAPAPLNGQL

SEQ ID NO: 954609 - protein, 58 aa, Homo sapiens
PVQHGNRVCQVACVTCVAIFVVLHRSPHLGQCLTWWHTATGPQVISLCNTSHSSNSNH

SEQ ID NO: 954610 - protein, 47 aa, Homo sapiens
SPSENLDMPLSFSAVSILSSHKIANFQHNICSTSPHHSSLCSKSNAA

SEQ ID NO: 954611 - protein, 47 aa, Homo sapiens
VLQVARIGVATGRISLSFLTSTLISFSSSTLARLLFTILSLSVSIIG

SEQ ID NO: 954612 - protein, 109 aa, Homo sapiens
LPVLQPFYQIVHIHLIYSSAQCNLANSLPFYQRFPSPNSMVSSILCFCDLSTAVVPNLLCTRDRFCGRPFFHGPRGVVSGLNCSTSDHQALESHKECSHAQFAIGFVLL

SEQ ID NO: 954613 - protein, 53 aa, Homo sapiens
YRKQLYQVTVFSRQQCIVRTKLYYQCFFIVETHMLKFIGHNDKEIDIGVKEIS

SEQ ID NO: 954614 - protein, 68 aa, Homo sapiens
VQATSQTNTISTTYWLIENFSVDSGGHGGDMYLYHLLSCTHKQDHIGHCRKQTLEPALLQKQCPMGKE

SEQ ID NO: 954615 - protein, 108 aa, Homo sapiens
DLCPDQHADENKAFNFIGNFKESRIKTLKQFVGRTITGDEDMALPDTILEDKAQPKQWLPKGGSGSVKAKTDWSRAKVMATVFGEVQGILLVDFLEKPRKILLIIRGF

SEQ ID NO: 954616 - protein, 37 aa, Homo sapiens
FLRASRLYSANANGAKRSLSQLRELQIANLPYPPYEA

SEQ ID NO: 954617 - protein, 36 aa, Homo sapiens
PSDACVVQALELPADAEAALLEMTPGSYTGLAESLA

SEQ ID NO: 954618 - protein, 33 aa, Homo sapiens
LEYPFSDRSPVMRPLSYGGGGAIRETRSVSDQR

SEQ ID NO: 954619 - protein, 68 aa, Homo sapiens
GLLEVPSDRSAFFFIIIILIIVVIIIFCVSEVISLCTYTIYNGILIKVQESHLDLSTREKLVFFDAPP

SEQ ID NO: 954620 - protein, 33 aa, Homo sapiens
PQRIPFSDRFSLIALSLDRVSLDRLPPEYEKVY

SEQ ID NO: 954621 - protein, 96 aa, Homo sapiens
GLVRGRRPILYQHYSDFSVTLHVIFLSYQAFGIIYPYKKVYYSGEKEALGYHMVRLETMTFIGFLGFIGVSTPYIYRYRIDVDTRSIFHLRYHNHR

SEQ ID NO: 954622 - protein, 50 aa, Homo sapiens
GEGLHRSSQQFVNAMKSKVEKQNSLVLKNMLLHVHITEPPYSTTPRYIPY

SEQ ID NO: 954623 - protein, 36 aa, Homo sapiens
MWCVWNTPALVTLPIISNGTFKINKKRNGGPEAAPF

SEQ ID NO: 954624 - protein, 42 aa, Homo sapiens
PRVFRSLSCLDSCFRPSSLDMYAKMMCGIFMPPVSRREINQI

SEQ ID NO: 954625 - protein, 115 aa, Homo sapiens
ARGRLCTIPFIWQSSSGGLAWWMWLLIAFETLRSDLVFTTCVLLFGRLIKVDHLWLRRGVLIESQIMPLHSSPGLQSVTLSLNHNCYRLFIVSFLDPLLSYASNVHVSCGIAYRI

SEQ ID NO: 954626 - protein, 35 aa, Homo sapiens
ILATPTHAAQHNTTSTHQVIYPMYQHHTHTTLAHT

SEQ ID NO: 954627 - protein, 48 aa, Homo sapiens
RRQLHPPHPSSAQHAYAFPLLAQLICTHVFAGPIQSISIQAKHCMCTS

SEQ ID NO: 954628 - protein, 49 aa, Homo sapiens
CLACVISHTRIPIFGDYPVIIALLALSSQPRVFPVLPCQVLEGVIVSVC

SEQ ID NO: 954629 - protein, 79 aa, Homo sapiens
RSLAAIPFFAASYTQPLFIILQLDLTTTSPTAHQSSLSLTARSCGPRSALYQILHCLSHLLYMRQKVLDYCFFFQPLTH

SEQ ID NO: 954630 - protein, 54 aa, Homo sapiens
LVTKYFSSYYFMFTSLLIFKKLSMKSFEKEDTTLFFSRCEIAIMFLMDLNILVK

SEQ ID NO: 954631 - protein, 60 aa, Homo sapiens
PLIEYSQVSSVMRLGHWYMVAAGRQSVSAYHYTVCPHTLAAKGQGTVWSPARYLAFVQPI

SEQ ID NO: 954632 - protein, 137 aa, Homo sapiens
QKRKPHSHSEDALILVYCMSTATQELFHRLDGLSRNPHTICRLSDDNATLQHILSLAHKSASSCRCPLSRSQRRRVPSQEPVHGQSGHLRRFPRHSQSGSDLAELRCVNPLLVSSLVSFPIMMVFSREADRIISGHC

SEQ ID NO: 954633 - protein, 69 aa, Homo sapiens
IPLIGDEYYLILSKSTLDELCLPTFFLTWTCLRLMRSRSSSSFDALQRTAEMCSEDDWHDWQMPLASLM

SEQ ID NO: 954634 - protein, 131 aa, Homo sapiens
INLSVLLCQYSYAYTYLPSKRDIFLLVEIHTYTSNYDICKEITTCEETQDSVAQTPNVPYLGSRCGGCEEEYITKLRRIEEVREICNGYLIDCMQRVLINFCCNLCKEISQKPCSIKVIMNGLYQVDTAFL

SEQ ID NO: 954635 - protein, 77 aa, Homo sapiens
SHTRIPRRSSISSRCANWMSYNKNYTFLSAIFAVRFWYLFSHWDDCFFFLGDASRGLKFSSHLLSEILYHDRTYSSN

SEQ ID NO: 954636 - protein, 38 aa, Homo sapiens
HRSWQMVCPNIHCHRKIECRDDSNQAYGIPLLNQCMAR

SEQ ID NO: 954637 - protein, 36 aa, Homo sapiens
MARCNTRKHIPRTTTHPPDPKRPSITGIILFHYAQK

SEQ ID NO: 954638 - protein, 33 aa, Homo sapiens
TIFAQAGTTLKCAPCFLSRQPRSTYASLGGGEC

SEQ ID NO: 954639 - protein, 113 aa, Homo sapiens
YGINSFVMSLSLDPANISVLVIACTCCDSNSVCIYAERNFYDGMTDTWSVTDMREATRLYLPRTESRALNGHTPQFKRFLIRFTIHHSAKQPRDRQGYRFTIHFINGETLYIH

SEQ ID NO: 954640 - protein, 56 aa, Homo sapiens
VHKSKARKILTQAVRYTERPLPLGRRNTNKVVTSPLQAWPEGEEEELEGDEEGEDE

SEQ ID NO: 954641 - protein, 61 aa, Homo sapiens
MAQAAECRAQVLDVVQNRPRVPAVDVEDIGEAIFEDPSNGDLIGLICLLLLRRRPNSGVRL

SEQ ID NO: 954642 - protein, 92 aa, Homo sapiens
MVREIQSAVSAGVMGIDKFSEEVRRGMSEVQQVGEQLSQIIHQVQALAPRVLMVDEGMQAQATGAEQINHALVQLGDASSQTVEPLRQASFA

SEQ ID NO: 954643 - protein, 52 aa, Homo sapiens
WAKVNIQLGGKGKPGPNEGQWRDQNCLKKSSAGGNYGQVISTSFGGPEHQKD

SEQ ID NO: 954644 - protein, 98 aa, Homo sapiens
AHWDWVYDHRTSWAAAAYGCAGVSATIYFKVQKHDGHDEIITRVPLKKMVERIRKFQILNDELITILDAYLKSGGGEGALVEHVRCFQPSIHQSLASS

SEQ ID NO: 954645 - protein, 54 aa, Homo sapiens
ITAPAHKGMMRLLSFCELLRYCPIWVQKPVSGGRPPMKRRVDGIKGVSHVRLFQ

SEQ ID NO: 954646 - protein, 87 aa, Homo sapiens
PRLHVFVTRSLLGHSRRLLPYASPLNIPSPHSSPIDISYSPTRFLRSVPYLLGLLPHSFIYQPPYYLIILAMAIPVMSGRCDYGLSL

SEQ ID NO: 954647 - protein, 91 aa, Homo sapiens
WSSLARSPDERLSVNTGLTNEDDSLTIFGGGRAGPGSYTLLSARLGQLQVPGPVWPSQHGEVGLGPGLGLARCSVLGAVSGGHLQTSARLA

SEQ ID NO: 954648 - protein, 64 aa, Homo sapiens
MFGRTQTTTYLPSPKPIKIKNYNKTLSNQMNENLFASLLLPPTIPSAYPAACTVSFIFPHSIDP

SEQ ID NO: 954649 - protein, 69 aa, Homo sapiens
GRLLQDPLPVVAIRNCLEDRSLSLQEEFSRDVKALERFLQDYFDGHLKRYLKSDPIPESNDGPVKVVVA

SEQ ID NO: 954650 - protein, 37 aa, Homo sapiens
LVDLIAGSPSKSRRVTMPPMNNAVVCKQEADAAPWMY

SEQ ID NO: 954651 - protein, 59 aa, Homo sapiens
ITCDWDVYSYSLSSGTPLPLMIISGNHRTLVLISSSEVQSMKFAQRLAMQKSHGDLTGK

SEQ ID NO: 954652 - protein, 102 aa, Homo sapiens
MHHVRMHASHCSFVNLTVLLASKILLILKFKDNLSSRFHVKNKRARGWVRWLTPVIPALWEDTVGGSFVAQEFHDQPEQHIETLSLRKYHKNKIESLWRFHY

SEQ ID NO: 954653 - protein, 57 aa, Homo sapiens
LGHTHIRKPTTTLIHTHHTTINKPGYSNPPDDQRTVYTGFRHKTKTSLAHFLPQGTP

SEQ ID NO: 954654 - protein, 53 aa, Homo sapiens
NVHWLTFMPWSLRIRYHTEPLTQSGEWLSGRNSKLTSSEIIDLGYLELIRRDE

SEQ ID NO: 954655 - protein, 54 aa, Homo sapiens
GHVGQKVTLHDSLMEEAMPPLTGPAGEGTESTRTSLDVDIVMNHQLQEPSFTKA

SEQ ID NO: 954656 - protein, 102 aa, Homo sapiens
VRRRSTVVRVSLRLTLSRVTYAVTVLNLHRLQRASVSLCTLGIWSCLSYPEPGFPGPCNTQAALMPLGTWRSSQEVQACARNLWLSQSSKAGAVPLPPTDST

SEQ ID NO: 954657 - protein, 58 aa, Homo sapiens
FGLSLPQCSWWPTCMLIMPGSDLRAPCPPSSMAQLEHSEPIEAEPVALSPVPDLKSTP

SEQ ID NO: 954658 - protein, 55 aa, Homo sapiens
ASITGILSHSFYSKDHIIETQHIIHKRRKPIPGFLITNNNFPRIPLTNNNSPPAY

SEQ ID NO: 954659 - protein, 52 aa, Homo sapiens
MTHIRDPVECGVVFTAYEPPGSSLSLSLVQPEYQVRGALDDIFKNQQKGLST

SEQ ID NO: 954660 - protein, 37 aa, Homo sapiens
IIAGVTNSSQVPVAQFSHAQQTTNCSILFQCINNLPS

SEQ ID NO: 954661 - protein, 33 aa, Homo sapiens
PRLRNTTFWTLWIEGSDFFDSLLQKLQVTYKFK

SEQ ID NO: 954662 - protein, 100 aa, Homo sapiens
ALYGTHRKLWYSSWGLPLSHRWALGAAGDQVRLRGDIDLGHVSVLTHDWEMAVYLTGQCVSCQKHDPFFSFVDKYLNLYHPAPNLLLHHRFLDAVTTVEF

SEQ ID NO: 954663 - protein, 142 aa, Homo sapiens
MVELRLLQNVELDEYQSPSLSNALYSSEHALHPNESADETVKVDVHVFVCVPHGNDVIELAVEVESCVFDCFSISYLLMAPDWSVSYFFVSFLPGLNLVPEVVELLQVSFPEPSVIHERNHATAGLQCEPVCLQVLVFVRSI

SEQ ID NO: 954664 - protein, 53 aa, Homo sapiens
LAQVMKAGIQQTNTKHQNQSNSKRPQAAANSITFCNQQVPAPAAHQQQPTTSV

SEQ ID NO: 954665 - protein, 100 aa, Homo sapiens
LSTRGRKPYEMCYCQRSFRNQSRLAVTGEFTVVEKPYRCDQCGKAFSQKGSLIVHIRVHTGLKPYACTQCRKSFHTRGNCILHGKIHTGETPYLCGQCGE

SEQ ID NO: 954666 - protein, 43 aa, Homo sapiens
RGSPPHWICGDDNCPPSSFKYGVYSLPRWGTGGISISHFQGGE

SEQ ID NO: 954667 - protein, 42 aa, Homo sapiens
MADSRVYKAAFELRSFQFGSFQVGSFQFGSFQFGSFQVGSFQ

SEQ ID NO: 954668 - protein, 47 aa, Homo sapiens
MANLTQGEEQGYLRVTTVDSHTSDSDVPSGVTEVVVKLYDSDPITDN

SEQ ID NO: 954669 - protein, 51 aa, Homo sapiens
MLALGLLQCSEARTTGDISGGEAEPRAHDSDSTTLTEHTLTEHTRLKHTRL

SEQ ID NO: 954670 - protein, 76 aa, Homo sapiens
MAKAEGHETRGHLQIQNFILQNGLKVGAGDNVIVQYYLRGLRQGLHGTNEVHNGLRIIALQQVSRPAVALPANQHT

SEQ ID NO: 954671 - protein, 111 aa, Homo sapiens
MIRRRETITYTMLRCVIQEPTYRDNRVVYGGGAAEIILMPLAVSQEADKCPTLEQYAMRVFADALEVIPMALSENSGMNPIQSMTEVRAGQVKEMNPALGIDRLARGALAR

SEQ ID NO: 954672 - protein, 149 aa, Homo sapiens
MRHIKLVNAFTKQQTTNGKINWEWYGLKQFGEDRSLNGKLEDTKYGKAKKRLEKIGKLEDHKHTFRRKKINLNLTSRQQKYQRQARKQKAKGKMYNLRRKLEDRNKIANARYRQEFQIATETTSYDKSRRSIEDRQISRQTSDTIALTK

SEQ ID NO: 954673 - protein, 91 aa, Homo sapiens
LYIVEGISSGYTYCTDSHPDSILTSKSFLHSTVHRPTCVDTNIKATPITDRTYYKDPLLCTNMQLENQRRETNESKDATKNQRKDLKSSAK

SEQ ID NO: 954674 - protein, 133 aa, Homo sapiens
WDQLLHSPFSHPAQDQPRSPVPSAIFRPIPYVLIAQTNPVAGSQSLSSGAVATTTSSAGDHNGMLSVPAPGVPHSDVGEPPASTGAQQPSALAALQPAKERRSSSSSSSSSSSQLWKGELCKGSSAKGSSAKG

SEQ ID NO: 954675 - protein, 65 aa, Homo sapiens
MVSSSIAGLLVQEMSSCSRFKTESNHGSSPNDEVTDGEDESCDSAGGHEEDEDDEEKNCSHKDDS

SEQ ID NO: 954676 - protein, 71 aa, Homo sapiens
QPNDIASRHCFGCSLDQWRSLMELLVNNGADVNYQSKEGKSPLHIAAIHGRIRHAPRSYIQNWQRDLIVPT

SEQ ID NO: 954677 - protein, 50 aa, Homo sapiens
PYRDIQYIYGVSLLIFNIETKKEKHIIFYRVLNRDTMPYGSVPVFYINLL

SEQ ID NO: 954678 - protein, 38 aa, Homo sapiens
NLVDILAAGQAHRALSQSGRVGGRMQSSSLKQRLSTTR

SEQ ID NO: 954679 - protein, 101 aa, Homo sapiens
MRVQHVPWFSAGFDRHITIFSPEVRLYQVEYAFKAINHGGLTSVAVRRERIGAGNCFTQKKVPDTDILDSSTVTHYIQITENILCDDRNDSCADPVQRARY

SEQ ID NO: 954680 - protein, 68 aa, Homo sapiens
GWCVRKSRLSEYGMVPSHSEPGLRRSDSLLSFRLDLDLGPSLLSELLGVMSLPEAPAAETPAPAAGCH

SEQ ID NO: 954681 - protein, 38 aa, Homo sapiens
LKNKVVRLLVAKSARFLKSRKGVGGYRQQDGCHSAAIG

SEQ ID NO: 954682 - protein, 51 aa, Homo sapiens
MSAIELRAALTPVQIFPLFLCSRFFLSTFSPNGFGPTVGNGNLIYTSSWAG

SEQ ID NO: 954683 - protein, 73 aa, Homo sapiens
LCKLLSQGPNEMYKYNEENYGVKTTYDSSLTSYTVPSEKDNQKSIVRESCGAAPLAREIESSTQYRLRAAIGR

SEQ ID NO: 954684 - protein, 34 aa, Homo sapiens
WRKYLYQKIMFGKRRKIREANRLAEKRKAHDSGE

SEQ ID NO: 954685 - protein, 114 aa, Homo sapiens
MNIDAKILNKILPNRIQKHIKKLIHHNQLGFIPGMHGWFNICKSINVIHHTDRTKDKNHRIISIDAEKAFDKIQQPFMLKTLNKLDIDGTYLKIIRPIYDKPTANRLPLGVPSS

SEQ ID NO: 954686 - protein, 62 aa, Homo sapiens
MVLPAVNPGFEHWVSKGWSPCLLLRRLFTASEVARLAEKGQVTHAHVQSPLTNVGIAPCCHM

SEQ ID NO: 954687 - protein, 79 aa, Homo sapiens
MQNDVVTYLDMTDVYILTTRSHVQEWEVLYIKWRGGRRLRDIILFFYFPEGWQVSQQREKVLFAHGLLGSDISQLQAAI

SEQ ID NO: 954688 - protein, 41 aa, Homo sapiens
TIAWVTRDPVLLTSDSCRQHEDVIQHCQRVKPIIDLVHKVI

SEQ ID NO: 954689 - protein, 57 aa, Homo sapiens
GEYSRSAMLSRKVMYNEDVLSALNSNVEKKEEGDGSRYVLQNHVGGDNELAATGASY

SEQ ID NO: 954690 - protein, 151 aa, Homo sapiens
MPRVALLLDPSSTLRTSGVSRRVLLSRVRPGFPYCSQPNKLTARYRNVTGCFAGDWACRMDSRRMRRVQVVQADGVDPVGIRQVLAGFANSAAAVPRLLDNVIRLLIGGAIQRFNDLLGHQFEHAASKVFIGVNAIWQCQQAGTKGSRSSE

SEQ ID NO: 954691 - protein, 61 aa, Homo sapiens
GKGPELTMQKIGQAKGGTRAQAKPWGQVQIYQSQDPHRTEPEPSQYLPSANWLPSWEASAG

SEQ ID NO: 954692 - protein, 81 aa, Homo sapiens
RDPAYVELPKSRFESGLPGQCTQGLSGHYWICSCLTVGNPKKRGLPDETQVEDSIPNMCSAVILYTGIAFKKNVALSPILK

SEQ ID NO: 954693 - protein, 70 aa, Homo sapiens
HVCHVRKHMVPTPRHAFTCETAEKSFKRSMSLKGALTAALQGEKPYRRENCNERFQYKYQRRSHMSILIG

SEQ ID NO: 954694 - protein, 118 aa, Homo sapiens
MRGEYALALMRVSTTTDMITTFGASAECPTNSLNASSDITTSKAQPLLIKTCDFAVCFQNQEPLRVLGNTRRGFFPGSRLRRLRRRWFRFESSGRRRRGEHCARVRVGMGISGAVPLK

SEQ ID NO: 954695 - protein, 40 aa, Homo sapiens
MGYSPNEPLNFHAMYQPFREMIHEAQQAMDIQFHSPAFQH

SEQ ID NO: 954696 - protein, 37 aa, Homo sapiens
HAWSDRSRSSVFCPGAEALPNATTLHCPGSVRLLSLD

SEQ ID NO: 954697 - protein, 66 aa, Homo sapiens
QPCEWQGNFGARGQGQVNQGFELPNDGFFSLSADVGIQESSNVAGAVPDRTSIYFRQNGQPDPRET

SEQ ID NO: 954698 - protein, 79 aa, Homo sapiens
YRASNESQPPAAGAATYVRLEKQVHGQGTKEQQAQTESSASSILEALKENYKVHPAHKVAMILDPQQKLRPVPPYQHEE

SEQ ID NO: 954699 - protein, 76 aa, Homo sapiens
MSAPCARSRYAFRLWQLVNFTFAYHFSRRTDFGRPRPGMHFSAVAPLLKVSGYQLAFNVLNFFSRNLDNVLVGKYL

SEQ ID NO: 954700 - protein, 125 aa, Homo sapiens
MRDVMECGVCRSIRRHGPERIGEGGCILKTVQHVEHAEAFTGVRRNGEHAHLHTGFQLLVGIRHVLRQRLLAGREKQQAPLLHLSARLSFIIRPGFAGAIAEHVHRLADNARVAHADFIQYQEAV

SEQ ID NO: 954701 - protein, 33 aa, Homo sapiens
LLDIEHFFKDICPPFTVLHLCFSFFSCTYQEKK

SEQ ID NO: 954702 - protein, 61 aa, Homo sapiens
CIGVYETMTERRFGYENFNDEGDLGVKGDERRNVKERDVEPRIPYLQTTLDLDIAAETLRC

SEQ ID NO: 954703 - protein, 59 aa, Homo sapiens
ALRADAVGGHVERSSAGSAIWLRQQQRRDARQQFQRPQRLDDVVVGAGAQAFDQVVLAG

SEQ ID NO: 954704 - protein, 38 aa, Homo sapiens
PTNDGEIQNQDGPDLSLFLKKGYVREDVCAGSVREDVC

SEQ ID NO: 954705 - protein, 67 aa, Homo sapiens
SLCHFMSPWYSLSSSLAKVHGVTAPGSRERANINTSLCESFSRTILRVQVEVVLELFEPFKRVERLR

SEQ ID NO: 954706 - protein, 43 aa, Homo sapiens
MLATIYAVNTLDRYVSSSYTYSLMELRSCYGYIRSVTPGLVNM

SEQ ID NO: 954707 - protein, 134 aa, Homo sapiens
MIDILKKIEEGVHRGAVVTNPTKNHEERVRSLALLSGVEDPSITAELSGVGMQNVAWDPTIAVALGVGWVATPLDLTPKPRNLHMPQDRKKWQKAKKKKKFRRGFTNHQYFCPYFREPPDSYNNFDQGLKGKMA

SEQ ID NO: 954708 - protein, 58 aa, Homo sapiens
RAHILEKYALFMVFMDHHASIFVLCNSLYRPGISGAECNLLPMPSAEPVWLSGCQAVS

SEQ ID NO: 954709 - protein, 36 aa, Homo sapiens
LENKYSAKVSAQLVKEAAAIGYKRKRTKEFKKFLVP

SEQ ID NO: 954710 - protein, 57 aa, Homo sapiens
LLTHTDVACKVERYKNNKNSSVKKAKGFMLMQSSTEFVKPQYASLSLPAVAAHASNI

SEQ ID NO: 954711 - protein, 46 aa, Homo sapiens
MLGLLERQAIFYSSPANPGCGRRSNAMSVYFWVPRKSRIRSEFHNR

SEQ ID NO: 954712 - protein, 44 aa, Homo sapiens
GNTSSPGPHNTIIFAGYTVIVAHVQLSILIRPDLAGDLQVLSYM

SEQ ID NO: 954713 - protein, 128 aa, Homo sapiens
DDRKAFVERHALQDDQGNRLNVTLSRLRKTMESRLWKLSGGDIIEVSSVMGHTPGVADNHYLKINDEIKVDGATFVGEAFPDKLRGINVIPTPPGGCKDSLYGSLAPKDGVNHCSEFIHCLGCPSYAI

SEQ ID NO: 954714 - protein, 113 aa, Homo sapiens
DLALVSARSWVIYYDAGHCLYIGPGFQVTGFAGAHANAEHHDVHQHHKPEHQPEQATEIYGGVNLDWKTEVDISYPLNGGGRKRGVLTPPVLKTATSAETRNNVAMVGKRQAC

SEQ ID NO: 954715 - protein, 33 aa, Homo sapiens
SALVYENSNKALDKAVLKSKDVKLAEAHQQDVC

SEQ ID NO: 954716 - protein, 131 aa, Homo sapiens
MAHELYLEYPLLSSYRSDQMTSRRYRSPFLIFSGLSGLVRSWLVSMRMPAPPYRRAQLVASLTMAGSCRRSSSARITSASSHLRVRHSRVMSSAVVVNDRPGKPAGLIRSIQLLEVFRNPYWNWLCERLAF

SEQ ID NO: 954717 - protein, 168 aa, Homo sapiens
MRTKTRPEDKRMATQEVIEIYLYSKSGSLGNIEHLHRRDGMHIFAPSAYPDATHRARIKIIDTNGEFQLLIRLAGIVSHVEALPVSVEPGFGPGVHRHVGRILGVEIATDVARRDAQAAAAGEEHVGVVLTHSLLGGKRLEALSFTVVVPGLEGIFINSSPIKARRLS

SEQ ID NO: 954718 - protein, 110 aa, Homo sapiens
VIHSWASIRYKTLLKRDTCTRVYIAALFTIARTWKQSKCPSTDDWIRKRWYIYTMEYYSATKKDDIMPLASNMDRTKESHPECNEPDKTKKIPYDITYNWNLISSTNEHL

SEQ ID NO: 954719 - protein, 33 aa, Homo sapiens
IPSPTPNLTASTTSSVITSGPGFYHVSHRLTFC

SEQ ID NO: 954720 - protein, 41 aa, Homo sapiens
TVMQQTPLVQPLCSYNLKPSDIHYTLPTPSGSLVPKNYTAS

SEQ ID NO: 954721 - protein, 80 aa, Homo sapiens
AHLEPVYCIQQLQHSSTTYKREMAFKRYVRRKQARNVPGFTDYCDLNKDKVISLPELKGCWVLARRGRSSKEQKTQGQVE

SEQ ID NO: 954722 - protein, 39 aa, Homo sapiens
TDFIHTSGVSRPTSAFKRCWFVIGITADDSSHCFITLTH

SEQ ID NO: 954723 - protein, 111 aa, Homo sapiens
DHHRDWAAGTCWPYIFTCTGAPRLLGTNEIPTPLRSRFSKQGSSRADVRDHQLAVSRLKILSEDVDGDCREQEPTYEGGDIRIGSRHRVTRSSERAGWDRAGPLYLDYDCW

SEQ ID NO: 954724 - protein, 77 aa, Homo sapiens
LRYNDDIRGLGCGCRHISALLQLLGLKDQVNTVGLPSEPRQGLEPHRPRILEETEWPPCCAMLAHCATLFISSRVAG

SEQ ID NO: 954725 - protein, 114 aa, Homo sapiens
PDPAHKWWWAYSILRSQYLSKVSPRPPCTGVIVPLAAERWNSRSSVDTVPAAPLCRGVSSVARLRGTEAEAPQGGRMFLIFVQCWAPQEGKGSSRTEEISELMAGAGPELVVFA

SEQ ID NO: 954726 - protein, 59 aa, Homo sapiens
FVDAQPVYNVSAGVLKVSIHIWVIFSLVGLGVQWEPRVSQHEGAHSGDNTTAQLLKRLL

SEQ ID NO: 954727 - protein, 55 aa, Homo sapiens
IAATTFTAGDEPFKRYVKREASPEMLPVFHRYYCDLNKDTVISLPELKGCLGVSK

SEQ ID NO: 954728 - protein, 72 aa, Homo sapiens
MPLGKLVHATGFLQNAIVHLCLRDSEIISLVSCQTLHKSGRNPKYTYHRLHGGIPLVEDILLGDNLNLLDIL

SEQ ID NO: 954729 - protein, 123 aa, Homo sapiens
ASRIVTDTRMDMSVSNCCAAGTKDFSQVNEQHVPGSSFTARVTGDDSMLQCPTVKVGSAADIPINISEADLSLLTATVVPPSGREEPCLLKRLRNGHVGISFVPQETGEHLVHVKKNGQHVGS

SEQ ID NO: 954730 - protein, 57 aa, Homo sapiens
ANHLNAPSLPNKLSPKCSGTFSGSANATSTAHRTHYKHSVHAAFDHHHGSSYPHHAT

SEQ ID NO: 954731 - protein, 126 aa, Homo sapiens
MDCAKTFSSFNTARLTLLAFLNHSKAFHNALKYARTKENSNMQRQILMRTGRNSPCEGSMPGQARPRPALDFYSVLNKNKTVKHTIHHANAIHARTLGASSQNEVTCVQESMYENCHMSSNSFVAV

SEQ ID NO: 954732 - protein, 64 aa, Homo sapiens
LIQISLSVSCLRYRIEEEEEAFTSLLKSNGKLQTHASECDSLKFYPLGTETVSSFKPRDIPNII

SEQ ID NO: 954733 - protein, 59 aa, Homo sapiens
PAEALVWCFAQSVRHSGGAYNATLSVHQLVENTDETYCIDNEALYWHFASRTLKRLCSG

SEQ ID NO: 954734 - protein, 173 aa, Homo sapiens
ENRIPRIQLTTDVKDFFKENYKPLLNEIKEDTNKRKNIPCSWIGRINIMKMAILPEVIYRFNAIPIKLPMTFFTELEKTTLKFMWNQKRAHIAKSILSQKNKAGGITLPDFKLYYKATVTKTPWYCYQNRDIDQWNRAEPSEIMPHIYNYLTFAILEKMGKTEEKKTKSTIKD

SEQ ID NO: 954735 - protein, 115 aa, Homo sapiens
ECVSLLKSEETPGCSRCSPDALRGPPTLLHHLLMSSYVAGYLDGGSGPPTDTLAVGDHGKAMPSGAIPVPASGHDTLPQQRLGQAPSRGRDDVLESPAASRPLPEGHPQGLPGGW

SEQ ID NO: 954736 - protein, 76 aa, Homo sapiens
MDMVSNQHPMVWRTEGSSYERNTVGNPRSATSVMAEPRIKGKPAITETSISIISKINDVQADFQKPGPFSLLTLVG

SEQ ID NO: 954737 - protein, 43 aa, Homo sapiens
DSTDPIPLFVMGANDEKYDNSLKIISNASCNTNCLSTPVQGHP

SEQ ID NO: 954738 - protein, 42 aa, Homo sapiens
VGRHDVKDLTKILRNLRLQIKHFESLEAELKKMKSKNNDRSG

SEQ ID NO: 954739 - protein, 37 aa, Homo sapiens
TDSNHCSSRSAGLRSVDTWLRVLAKPQNTAEVQKVQL

SEQ ID NO: 954740 - protein, 47 aa, Homo sapiens
LILNHCSVNSHGRDTVLAYSNSVRRTPRLKSSGVGSIESQNPNWGKS

SEQ ID NO: 954741 - protein, 55 aa, Homo sapiens
LRSYTVVIAMGEYVLLTLSNSTHDSKLLSGSIRGQNRTGQKQQPSRNNLLSQFQL

SEQ ID NO: 954742 - protein, 99 aa, Homo sapiens
SHGCNMRSMTTAQDISNASDSNAETLAKVIHDNFGIVEGLMTQSCITWHPEDWGWPSVKLCVMARGLQEQFIPGLYWRLARAVGKVIPEAVNREAQLAL

SEQ ID NO: 954743 - protein, 37 aa, Homo sapiens
THCTFGSIKSKARLQVLKCCCRRGFSQLSLLYVKRSY

SEQ ID NO: 954744 - protein, 54 aa, Homo sapiens
MRTYDNSLTIISHASCNTNCLGPWARSSHDNFGIRGSDSLTTVPMRIHCHPRRT

SEQ ID NO: 954745 - protein, 48 aa, Homo sapiens
RPLFDIGITRQSLLKSEETTWCSDVAQDALEWALRRLFTTFLNSQSYL

SEQ ID NO: 954746 - protein, 42 aa, Homo sapiens
ELHMKVTLEVGKVIQQRRQSKGLTQKELGTKINEKPQVIVDY

SEQ ID NO: 954747 - protein, 52 aa, Homo sapiens
LNWTGAEEKKSERRDKEIELVIHRLEATWAAKEESETGCRRAAYKRYYGDKY

SEQ ID NO: 954748 - protein, 43 aa, Homo sapiens
DLNQLSSTSPGSEDLDGRNELLYDYFTLACAQHSARARWDVQV

SEQ ID NO: 954749 - protein, 67 aa, Homo sapiens
HAASKKLVIVGMVLWETCLLIVFSKDQFRRSTSLLVFENYIADIEVDGQQVELAWDTAGQEDYDRMR

SEQ ID NO: 954750 - protein, 50 aa, Homo sapiens
QIDVETSKKWAAGQNEQHSITKNTANAGPGRQSELHLRQGDPGRWARLIQ

SEQ ID NO: 954751 - protein, 83 aa, Homo sapiens
LRGDGYVVVTKQSSSQHACRDGRGAVIEQEGRSIATGDRNVKAQSQTDRVDPGTLRGYYNQSEDGSHTHPEEMYGCDVWPDGP

SEQ ID NO: 954752 - protein, 65 aa, Homo sapiens
ASYVVTNQFVSRQRRREYEDGAGRMDRAGCADIRPDTRFQTNDRLPSELRNWRYTTERRSHIIQR

SEQ ID NO: 954753 - protein, 46 aa, Homo sapiens
AAEHQVYKHFTDIVYNWSLGLFKDEDGHTVAGPMGNFFYAAYPLTE

SEQ ID NO: 954754 - protein, 34 aa, Homo sapiens
KLIHLSSRAASLLQLEFSRLEPTCCIRKKLVIVG

SEQ ID NO: 954755 - protein, 85 aa, Homo sapiens
VATLDDTQFVRFDSDASSRERSAGAWIEQEEAEYWDRADTRSPRPTHRLYRENLRTALRYYNQSEAGLTSSRGCTVFDVGPEGRL

SEQ ID NO: 954756 - protein, 56 aa, Homo sapiens
MKCVKYLLYVLLLAFCCLCSGTDMPWVVGAQLVPESDHNPGGYPCALLYATWYINT

SEQ ID NO: 954757 - protein, 65 aa, Homo sapiens
STDVNTLGILSYRDYPGLSAMGHTCIHKAYLNVDSRHSISKQSAHPAKRSLACMEAAGLAVTQGH

SEQ ID NO: 954758 - protein, 74 aa, Homo sapiens
RRIGFGSEQLDTNDESPVAISLSYIFTYISQPLTKDVNLTGITFIKLATTGTRLAQIQTVGTNRQRLNRVLMGP

SEQ ID NO: 954759 - protein, 36 aa, Homo sapiens
LEDPLGALETSDTEFMPAGNPFCGKRYDKRLRMLNG

SEQ ID NO: 954760 - protein, 47 aa, Homo sapiens
QQKSTDPSYKVKAPPDIEQNEKATSAIFFFRVLAAKSVINHVFPAGV

SEQ ID NO: 954761 - protein, 45 aa, Homo sapiens
VDIVTVLRVWVSFNSNAGLKGTGSLRVDYSLLDLFLPLVAAARTR

SEQ ID NO: 954762 - protein, 127 aa, Homo sapiens
PGSSEANLPNPYLSYPQYLPLLPIILFWISNMLIFILFLCTLHPSLSLLSLRLTLTPVGSANYLGCTAARLHRQPPLLQSSQNFILICYLSQHNSHKNTCALPADRVRLISQTSIPYKATPFLPRHG

SEQ ID NO: 954763 - protein, 53 aa, Homo sapiens
SSLTDPRWWALVSLASYGIAEAGELLAIRVCGDCPCAEIVPLQSSLSHRVGTE

SEQ ID NO: 954764 - protein, 73 aa, Homo sapiens
VLCTIPGSSEGVWDLPYREKHLNLVHHLPLVHNYVCHEHFCELVIVLQIENISLFVPLILDTIIFMVFSSSSS

SEQ ID NO: 954765 - protein, 42 aa, Homo sapiens
VRLGALNSSRGYYSILMNHCQYPSWSERACQSCVHFYPYLSD

SEQ ID NO: 954766 - protein, 70 aa, Homo sapiens
YNLLFSMTAGPCESLRSSRSHSGSLLSDLIIAELKVCPTPSESPLSLLLLLSDRSRDGFRRSNFLIVVHG

SEQ ID NO: 954767 - protein, 41 aa, Homo sapiens
DSEDPYEREERNEIKAQTSGNEIERKRRNGEEEGNGLTEEL

SEQ ID NO: 954768 - protein, 43 aa, Homo sapiens
DGAMNQCEPMVGCNNETGRRTNAESKEEDNFETNYTSFLYNLR

SEQ ID NO: 954769 - protein, 99 aa, Homo sapiens
FLLRTVCKAWTSLTDEVTNLNDYRESVFKTPAQLYHTWIAMTERTRKHLRSDAEVDGEDAAGGRRWAQVQKQAESNSIMKEKMIKIPDDLQKTELFSIG

SEQ ID NO: 954770 - protein, 107 aa, Homo sapiens
LNSLAGGVSPISSNLVETRAFAMILGRGMINGTILSNMASTDTPHGPPWTSVQLTGRNTHICPLQASSEGQSLSFLDDMLRSLESGSTFAPLRVGGIYLAVSTGPAQ

SEQ ID NO: 954771 - protein, 121 aa, Homo sapiens
DYRTEPRYHLHIPIQHDYMESILENPVHDLGSMGPSRLPFHGRTRLEGIHMVRSSPAKTQAYPQPHISKSTETEATTVVTVAREATDIEKQALPTEGTRKANQGLKAILKPSICTVRVGPL

SEQ ID NO: 954772 - protein, 92 aa, Homo sapiens
LLCLWSSLAGSPGDTYEQYMPKTSPAQYAYYYTLLIQLLDQRNKLPLGLHAQSYSIVHFNNRVYDLDVGSGHPDCAAAIKGSFVQRLMSYVI

SEQ ID NO: 954773 - protein, 94 aa, Homo sapiens
LRQLTIKAEGRSPDLCHLVPTWIRQLCLSSYRNLLCLQRKDEETDLERFRDMLKTTLLDGDFTDVAQAGCDLHELRQSVRLEPPNVLGLQGVSH

SEQ ID NO: 954774 - protein, 69 aa, Homo sapiens
CLLVVSARIPGDTYGRHTLSIGAWMATSDRIYKDNTIMTLINRKQFIVYITRIETYNKKHYYETTRNIS

SEQ ID NO: 954775 - protein, 102 aa, Homo sapiens
MDNRSDLTKHTYAITPMKRPMEEDGEEKSPSKKKKKIQKKGTGRARWLTPVIPALWKAEVDGSPEVRSSGERSSQLDFLGRVKTWRTFLSRKRIVNAPISTL

SEQ ID NO: 954776 - protein, 91 aa, Homo sapiens
MKRPMEEDGEEKSPSKEKKKIQKKGTGVSHCAWPCCSFLCVHVYFMFSSHLYVRTCGIWFSVPVLICLDNGLQLHPCAAKAMISFLKKYLY

SEQ ID NO: 954777 - protein, 34 aa, Homo sapiens
RTPRNGTCVGYPVSRVHDNASGAPRGVEGVGNLR

SEQ ID NO: 954778 - protein, 103 aa, Homo sapiens
MVFIGVNLTFFPTTLSRPIRKVCSQESEVMSVRQYVVWKYVVRKYVSQPYVVRKYVVQTYVSGVCSQKYETDVCSRTYVSEVCSRKYVDGTYVDGQYVVRKYV

SEQ ID NO: 954779 - protein, 136 aa, Homo sapiens
IFRDYILRDYILPGLHTSGTTYFRDYILPGLHTSGTTYFRDYILPGLHTSVTTYFRDYILPWLHTSGTTYFRDYILPGLHTSVTTYFRDYILPGLHTSGTTYFRDYIYRYYILPLPTYFGRIHTPDDQNTAATYMG

SEQ ID NO: 954780 - protein, 89 aa, Homo sapiens
YIRVTSILPGDYILAGDYILPGDYILPDYILPELHPSGLHTSMITYYRTTYFLNTYFRNTSFLTTYFRTTYFLTTYFRTTSFLTTYFRG

SEQ ID NO: 954781 - protein, 44 aa, Homo sapiens
RFLPCIYRDTTRNRAYLTNWTVGTNDWYTTRRYDFGLDDDTRQL

SEQ ID NO: 954782 - protein, 39 aa, Homo sapiens
NCKANSKPALAQPIYRHLQQTLIEGYKVSASYPTLRRSG

SEQ ID NO: 954783 - protein, 35 aa, Homo sapiens
MSQRVNCKARSTAKRVNCKGASTAKTRQLQQRVNC

SEQ ID NO: 954784 - protein, 35 aa, Homo sapiens
YKSPLSPRKITVTLQVTKRDPGRWKQPRAGSPLET

SEQ ID NO: 954785 - protein, 65 aa, Homo sapiens
MQSYTILDITVIIQDLYPTTSFSCSKVLVDADFYSLSPSSDFHACCQADPSWFGNVSVTEQQEEL

SEQ ID NO: 954786 - protein, 52 aa, Homo sapiens
LCSEGLTIYKGQRWYEDRVWLSVVCKPIYVGAHVDGGNMDVEASVRKEKSGG

SEQ ID NO: 954787 - protein, 71 aa, Homo sapiens
MRGTATILPLAGTAPALPTLLSPKTYPLGLDDYPRVFTPFSNRGGTWYLLMLWWHCVARCADSGCADASWV

SEQ ID NO: 954788 - protein, 63 aa, Homo sapiens
LLNPASMVPHTFVITVTGGEDLRHIDIAVQLKGALAPEVLVFQVDVILRLGAETDVFAANQRE

SEQ ID NO: 954789 - protein, 62 aa, Homo sapiens
ADGSTQSSSFTELKTRRLELTGHITTKEGILQHKSFRNLHAASPRLVVRITSSPYLQSGMQH

SEQ ID NO: 954790 - protein, 111 aa, Homo sapiens
YAAQTQDSHYIPHNGVNQQEAITLLNIYALKTGAPRHTKEIYLALKRELGSQYQSIAGDFTHPIFSMGSDLPYKHHQQQTPSDFNLLTHDQMDPIDIYSTFHPRAAACPIL

SEQ ID NO: 954791 - protein, 38 aa, Homo sapiens
ENIRSGGHQRIASHGHVGIAAYQLAMRYKENSKVDSIG

SEQ ID NO: 954792 - protein, 133 aa, Homo sapiens
SAITMEITTKTLKCFSLKSVYQCSNLNQSTQHTKAQKNGKAVLKIIQGSLSMSILFLFLIPKEAILSIKRLISVMTCNSIEFNHHLSKYLTFDFVRSAGRKDQRARSKFRQAFIKPAGCFITDKGGSSSQLTE

SEQ ID NO: 954793 - protein, 36 aa, Homo sapiens
EDPPQMESPQMESPQSGIHLACWFMRLGASRAGDST

SEQ ID NO: 954794 - protein, 105 aa, Homo sapiens
YYKAVLGLDDEESASKSVKRIYYLDVHVHGHSYCQKVERNSVTDKQESTAGNRNYLWEGPDIQVSINFTIAITSMFTEIRETMITEAKTFQLRDEESYLSKNSED

SEQ ID NO: 954795 - protein, 60 aa, Homo sapiens
MISAEKRRNTRFYKAPGKFTKAKKLEGVAVRPDLMMAAKPCFSHRAETQHVPGDSNCGGV

SEQ ID NO: 954796 - protein, 39 aa, Homo sapiens
IWLYEHPNTFDTVDYTEEKSFGMNTGKVHKSKQTDKALL

SEQ ID NO: 954797 - protein, 84 aa, Homo sapiens
RESQLILDCPLISEFPGNSYLPVGMARIYRSKNDTKSPLSCRLQRIMNEINEDMTEINLTDIARLNEVNGLNINNFQIQITLHI

SEQ ID NO: 954798 - protein, 32 aa, Homo sapiens
MSRERARPQDELIIKGEEWENEAHPPRMRLHA

SEQ ID NO: 954799 - protein, 38 aa, Homo sapiens
CRIPLSSVPLAPQPRHSHSVLILRFLSFTRAVITSSPT

SEQ ID NO: 954800 - protein, 85 aa, Homo sapiens
RASLYYRPFVDMPSDDQCCPLVQLGLSCVSRILYLSIVPTPYLACAHEMYKVWGTLTALLAVVVCCHKRAGQAVTHARPGQVSAH

SEQ ID NO: 954801 - protein, 51 aa, Homo sapiens
MQQGNSTATHLRGQALHSGLTKFFSIMPGMTATMAARPNSALHKGLQLRVH

SEQ ID NO: 954802 - protein, 56 aa, Homo sapiens
MGIPRTEENTEGMDGPHLSNLRTEENTEGMDGPQLSILRTEENTEGMDGPHLSIPR

SEQ ID NO: 954803 - protein, 40 aa, Homo sapiens
CRYFTLQEQIEIVASGDHLAHKAYTIYLSAVCAYSYPELI

SEQ ID NO: 954804 - protein, 40 aa, Homo sapiens
MLQMAFHDRVLDHPTFEDMQVLDVREKQRPKFPEAWKLNS

SEQ ID NO: 954805 - protein, 38 aa, Homo sapiens
MYKRKPCIRHATIKTKAELNLKEFYTSNDCFVNWAPPE

SEQ ID NO: 954806 - protein, 63 aa, Homo sapiens
APACVANNLHTSLHAGRMGLSMSVVTAHWIWNAMQLHPLSLSKTTNSRARYSKKRPVKSHVLM

SEQ ID NO: 954807 - protein, 65 aa, Homo sapiens
MAIRTGARRVTVVRIWILPACQCAKATGKRVVVKIREVGNMLFYWNLLPTDDVLHTDPSSFIFPS

SEQ ID NO: 954808 - protein, 54 aa, Homo sapiens
MLRYVVLSIDRCCLSTSNNPLLDMLIYRCRGTIYKAQIDHDDMRGLIRHLKDGD

SEQ ID NO: 954809 - protein, 56 aa, Homo sapiens
DGRLRYNCNSEIHCYLAASTLLLYTLKVRVNEVLLWGLEGWNLILGVLFNVRSGLA

SEQ ID NO: 954810 - protein, 54 aa, Homo sapiens
KDSELCLTVAINQHLYHGDLMRRRESGAINPDEFEFIPTAPDSAIPNNGPLEHS

SEQ ID NO: 954811 - protein, 120 aa, Homo sapiens
MILPLLYSTYAIAWSRWSLSLKDAMCRENTRTPVQTQRHGPAGTTNNESAPFNTSLCKIGCLGEAGTSRQSQQVIPLLAHKSYPQLPTLIKYYGVTNLPGPSPKLHTSHLERSSYRYRAT

SEQ ID NO: 954812 - protein, 41 aa, Homo sapiens
VKIDIIEDPLLLYDIVHVGIGVHWAERARSPAHQEQTDQST

SEQ ID NO: 954813 - protein, 33 aa, Homo sapiens
FSRRSDERRHRVRLKPAYGSSRQRTDSALPPSG

SEQ ID NO: 954814 - protein, 172 aa, Homo sapiens
DYDLQIPDEHRCYNPLTKYWLTESNEHIKQILHHDEVGYISGMQEWFNICKSMDVIHHKNRIKNQNHMIISINGEKAFDTIQHPFMMKTLSKIGIQGTYLNVIKAIYDKPTANIILNWEKWKAFPLRTGTRQGCPLLLLFFNIVLEVLVRAIKQEKEIKGTQINEEEVGRVC

SEQ ID NO: 954815 - protein, 42 aa, Homo sapiens
SQTRGSLLLSLEKEMCQKMEDDGSTVLGLVEILCREGPCVGV

SEQ ID NO: 954816 - protein, 105 aa, Homo sapiens
MPMLSTLDNRARFCLKQIKTRQNSRRSPRTNPSSHWLRHTVPDQEPKNKCNKTKDTYIRLTLNYKASTQQAACLSHTCKDPKDAELCLGRETPEKTLVAVQSEPD

SEQ ID NO: 954817 - protein, 95 aa, Homo sapiens
PETNSSLDDECKESPEQQQPYAKKSKIAIIREKHTALMTPIVFALEHVRSITADPEETPHEKWFQDKYGDAIKNALRITEDSIEPSQAWEQLDSI

SEQ ID NO: 954818 - protein, 33 aa, Homo sapiens
MLHKSKEIFSNTVAIQKYKLVQSSQDKQYGNRL

SEQ ID NO: 954819 - protein, 68 aa, Homo sapiens
IIDLYRGSVTSLRSIGLSEDVISFYVTEKIDGKLLVQLTDEILSEDFHLSTLQVKQIMQYINGWRPKI

SEQ ID NO: 954820 - protein, 84 aa, Homo sapiens
SHANPVWILMELCPLGAAEVILASTDIQFGSRIFDTCYAYQLSTALASLESKRFVHRDIAARNVLVSSNDCVKYRRLWIIPIYG

SEQ ID NO: 954821 - protein, 63 aa, Homo sapiens
DAIVNLGVTCAVVLRKLRSSRAHLHEFLEFTGVWDWGLMNGISHKLSPRGDADYCLVLVNLSF

SEQ ID NO: 954822 - protein, 48 aa, Homo sapiens
LILRALFYCTEKPQLASWGMRAEMIPKAFESSVKSGVYSRNPFPAIYS

SEQ ID NO: 954823 - protein, 69 aa, Homo sapiens
DLVPSLFTHEMVALLLITRCNSSTGANVLLYYVVLHPCPPPYPCVANSYLRTNISAQYNYIYLQYEESL

SEQ ID NO: 954824 - protein, 59 aa, Homo sapiens
ILEDPLYLRAPDVAKISLEVIHGPLVREPTVSNTLLTTPDRLLANIISHNYYSYPTLST

SEQ ID NO: 954825 - protein, 86 aa, Homo sapiens
LDSNFLLLIVHSNRTGFLMLTERKILGSIRLLQRPNVVGPYGLLPPFADAIELFTKEPLKPATSTITLYITAPILALTILFYYDTA

SEQ ID NO: 954826 - protein, 45 aa, Homo sapiens
HAMNCLKRRRILRYSTPYVGSLSPDSIALSLHLTNIPRLTITVLP

SEQ ID NO: 954827 - protein, 44 aa, Homo sapiens
CGRLYTDPPDFPGRTSLLDDLASWTRTIRSLAKYKRVLLGPLPP

SEQ ID NO: 954828 - protein, 125 aa, Homo sapiens
RIPLYREKCGLRSNYPCILAALWQKPLGTEEMRVAYVQKCKAQIILSRHPLPVCCQPSKKHVKATPSFERTEKLEKRGTLKGGLRLPEHSAIQDILAWVLGTRTLAFEASVVRSCCCPVVASPEP

SEQ ID NO: 954829 - protein, 90 aa, Homo sapiens
DPPVIRGASITWHHRPDMSVNRNSLLEESSETDTDVAGQWIEKAENPESMVFAKAKRKSISLMSAYGTGTVALTCYPCHFGRLRHEDHEV

SEQ ID NO: 954830 - protein, 36 aa, Homo sapiens
GSPMSLVFGNVLRVALECRAEGGVAPKTRTVRDITP

SEQ ID NO: 954831 - protein, 70 aa, Homo sapiens
LDEEEETENQRGKRLVPILSLSWEERWVHHTVGWCIFACLHLQLHWHHGTHVYNLSDAIWVARLDALDLS

SEQ ID NO: 954832 - protein, 33 aa, Homo sapiens
ELGPTSSQTSGRWCGERLHVIVMLTRWWRMVSA

SEQ ID NO: 954833 - protein, 61 aa, Homo sapiens
SSLTPQVLRRDPICDYNPCSRCSMPTGAVRQCHISMLLITFLTLKASSSLPPSPGYSSPGY

SEQ ID NO: 954834 - protein, 49 aa, Homo sapiens
CIGELYPGEETKLTRTQSAFSPVSFSPLFTGETVSLVDVDISQRGLTSP

SEQ ID NO: 954835 - protein, 66 aa, Homo sapiens
VHNRPQGYILITILAVSQARIYERSSQICFIILSRGFQYSTPTNSFLMTCNWLRYPRLTPHYLPYW

SEQ ID NO: 954836 - protein, 73 aa, Homo sapiens
VVEGILTDIITDKLYNNDFSVNLYAQDIQVSSSGHLLVDYDPLYFQTGFEMVLHGCSLPGRKALGHLDLGRDF

SEQ ID NO: 954837 - protein, 98 aa, Homo sapiens
YYGHAHEFPSMTALSLAITLICIPVTGHQKLGVTITSSMMAKQGLHLSSLSTLFLVFRLHCFSAGRMTHFFVISYPTWPFQLLESPLCDADRAIDLLG

SEQ ID NO: 954838 - protein, 79 aa, Homo sapiens
MSSMNLLEQFRFIRAHVRSRKRDGDLYILAQNFFYEEDLSLKSYTEYKSVTYSDSSESKIVTLFFTLCAQTPHVCDLLI

SEQ ID NO: 954839 - protein, 161 aa, Homo sapiens
YKLLEDKLKKKHLMQKLANWQMSFIYSTCKAKVSKNPEKPKNRQVRDALYTHTRGQGPFHWSSTFLFFVHQNQHALTTLEKVWGEGSLRARSSHNATPFVPATALLETYPTAVNQKTAKASGTKLVTNALLIIVHMWNLPFKPPFQGENSHYYILPPFFNL

SEQ ID NO: 954840 - protein, 49 aa, Homo sapiens
IPILLHNEFDYITLQGAAKAKTRQTPAPPYYQHNALAKPFIRKLSTRAI

SEQ ID NO: 954841 - protein, 92 aa, Homo sapiens
QLDLHLGNLQANCLSQTCYADTQAFTPSPKILKHVLRNFKVDGKVSVNGETVHREDEKERECPTGGYLPDPVTSVPEWFEVCGPEVHRVSTG

SEQ ID NO: 954842 - protein, 30 aa, Homo sapiens
MRKFKRKSLCKQPPRSDLNYPRIHDLVIND

SEQ ID NO: 954843 - protein, 79 aa, Homo sapiens
CPRNGNVTRCFGVLEILVLPPFVTCSNSTLPLHYHFLDFFLVFIFRHIILQLVAGGKFHRSATFGLLCSSLAPALNQRF

SEQ ID NO: 954844 - protein, 36 aa, Homo sapiens
IPPHIMHKSAPYRRLLLGSLLFIAVIALLGWDTLKS

SEQ ID NO: 954845 - protein, 37 aa, Homo sapiens
HVDREIYRCGASMIMALISTSHWLNIVSGSSKRYGSE

SEQ ID NO: 954846 - protein, 31 aa, Homo sapiens
PYRLDENWILYDTTDNQLSCWTEKLQSQTCT

SEQ ID NO: 954847 - protein, 107 aa, Homo sapiens
SRYLFSLQSQISFSFFFGNRVSLLWPGRELQGLISASGQPLVPSGVQVILRASASAISGDYGLGAPSAQLILVLPVRRWGFLHVWVRVGLRTPRPQGDPPTFVQPIM

SEQ ID NO: 954848 - protein, 76 aa, Homo sapiens
IWLDEGKRDTLVPVLKDTRIELVRDKFGDSRKDAGPKNLVQVGAGSKSSPCALTQPLIIVQQLIFGNTEQSTAFVN

SEQ ID NO: 954849 - protein, 59 aa, Homo sapiens
VESTLPVYPSYELSPGLYSCPAQKNKSAPCPSIIPSHYSLSHETEKPMTPSCCLLDETM

SEQ ID NO: 954850 - protein, 103 aa, Homo sapiens
MRLENRRKAISKKNRDLNRGIQFAWLDPWQALMGILWMRCEGELKRGLWIKSKKKSRSLPSSMQPSDGKETPGRSWDSLSGDAEPDAPLHLVPQTQLDGVGVA

SEQ ID NO: 954851 - protein, 112 aa, Homo sapiens
MAKQQKLLVHLHRRRSSMLILTIADQLFPTRAAIWLMLPIHSAPTDRGVIRRVLLPSSAPDIAETLRLVLGWAWTYVIVAELIGASSGIGYMIINSQALMATGQIIFGIIVI

SEQ ID NO: 954852 - protein, 50 aa, Homo sapiens
SSVPPSGHAAKGMFITDTMSSLEKYDDGRVMLGDAYPKEDMKHGRVISCS

SEQ ID NO: 954853 - protein, 54 aa, Homo sapiens
LVEPTNDVNVRGSPVATKNVESVDAVGDGRREHSKYSAGLEEGKIETQKIVISS

SEQ ID NO: 954854 - protein, 69 aa, Homo sapiens
YWVIRSHRPVWESCMGKPDSGMERTTAHFVLQRLGSTLTNLLLEIIDRYSTPRMPWHDNCLCSLREGGS

SEQ ID NO: 954855 - protein, 48 aa, Homo sapiens
MLPFDGSSRTFRWKQLQAGEEGGPYSSFSSMGASTAACSFACSSSKRS

SEQ ID NO: 954856 - protein, 75 aa, Homo sapiens
DHLGTECVIEDGKCCSFINLATSFFFHKILSSFSFRDIFLLSRFTRVFDVTLFGEQHLSLFCATLLPGRTYRSSI

SEQ ID NO: 954857 - protein, 52 aa, Homo sapiens
LCGQVEPSHIAEIRTLTKTIAYPPQSSAGPNGYSLKDEDVLQKLPVCTTGTL

SEQ ID NO: 954858 - protein, 89 aa, Homo sapiens
MDGIKISQWLGLQDFDLIKKFFGARARYAKVLPGAVERRMTKFYAHEKLVKEKSLVHDDGGYLTWVRDMRKHGVLSQAIQQPPFLGRDL

SEQ ID NO: 954859 - protein, 87 aa, Homo sapiens
LRTVTEAVTTVTNDEAPEYDTGRCNSEHFVHERRLVDVQNVCFQEKVTQGKRCSGNLLQEQLQHAHPQELARLTNGSRYPQLCIPGQ

SEQ ID NO: 954860 - protein, 36 aa, Homo sapiens
MSSTSKSPTITRDKHQAQQHWQLNNAYAYATTPHGE

SEQ ID NO: 954861 - protein, 70 aa, Homo sapiens
VDGSSLRAGMLARKGRLKILSVFGPGPSLRPQNVTAGGRAVATHNFCHVLSTSPTELGSRNSEYGEDWKA

SEQ ID NO: 954862 - protein, 38 aa, Homo sapiens
EHTHRLYKVLFNMICLSIYCYMSDDVLMCDIILQAVKV

SEQ ID NO: 954863 - protein, 69 aa, Homo sapiens
LEDPGRKTWRSCVLGQVEPRHIAEIMNSSLDQSQWYLPQVLCWTQGQILKDEDFLQKAAGGTKQLVLRS

SEQ ID NO: 954864 - protein, 38 aa, Homo sapiens
MKLKCGPYNEDERDIEDKKSDSRDTEVTDELDSRAARS

SEQ ID NO: 954865 - protein, 36 aa, Homo sapiens
IPIISLTNGIGPRYYIVGNQELTAMIHDGTGRGDIR

SEQ ID NO: 954866 - protein, 65 aa, Homo sapiens
YEAYWEAQETYNHGRRLRGSKQIFTWRRRRERETAKGEVHTHTFKPHQILWELTHCHENGKGEIW

SEQ ID NO: 954867 - protein, 33 aa, Homo sapiens
MRGDSKIPSQLYKKHVSLNVVFTVLSIAIIYGP

SEQ ID NO: 954868 - protein, 105 aa, Homo sapiens
LFSLTPTNIYKHEHHPEKYGLIKMNYIRQQGIILEKEIYDLSDREFKIAMLRKLKEIQDNSREIIQNSICINLTTKIQRTKSEILRVREMQWHILNERIRDLLSN

SEQ ID NO: 954869 - protein, 52 aa, Homo sapiens
LTAGSAEEKKCFEFPLLTRHDVTTCFKLKNLNVVYDSRTKKYNAILITCENN

SEQ ID NO: 954870 - protein, 139 aa, Homo sapiens
RWSSKVSNNSGSSSDFKSSNNSQPPDNPELQKIHIFQKSMPFRDNSMSSNEDSKLFQLKSSSSRHTPDLPATYWIFHTKSRLFQRKLYALPTKAMSSRKSTSSTGLQVFQTIHVFQKILVFPYIYSFQNIRVLQEIRVF

SEQ ID NO: 954871 - protein, 35 aa, Homo sapiens
MPATTQGRSNIHQIKSKRQLEPYVEPFIHGPIIKD

SEQ ID NO: 954872 - protein, 40 aa, Homo sapiens
MQIVMALHSKAVGSSMLPGNAQDVDWVACRIVNSFMQSVS

SEQ ID NO: 954873 - protein, 34 aa, Homo sapiens
CCQSLDCKLFKEQRRIFSVSCNFSKVFGSTLYPV

SEQ ID NO: 954874 - protein, 74 aa, Homo sapiens
DTSLSSVSNHRLREMHHAVTMLIRVKTSDDQTSCHHLLKKDAEHASRCKLLQLLCSTLKVVSFLLFFDILRTYR

SEQ ID NO: 954875 - protein, 65 aa, Homo sapiens
MRTPPESTTCITTCVTPPESHHLSHTYLSLNCLIMSERSFDFNSTHLRIYLSGSVKSKDLSDIIK

SEQ ID NO: 954876 - protein, 36 aa, Homo sapiens
SHVNMQYPTTLASFWLELPLSDYSPLIIRCSSLSLT

SEQ ID NO: 954877 - protein, 67 aa, Homo sapiens
TLEDSWQAKQDNTTCEGIREFIRSIPLQKLWLPPPLEVQLQSRKIFPLGFLFDTPLSLDLTTGEKPA

SEQ ID NO: 954878 - protein, 39 aa, Homo sapiens
RKGPADRGRRQELHGGLKELYKRPGWLLQNSLQSVLHVL

SEQ ID NO: 954879 - protein, 44 aa, Homo sapiens
MAIEEAGKTVGPRTQQLGAGAGGPLLDQHPRKQCPRALPDQSVH

SEQ ID NO: 954880 - protein, 105 aa, Homo sapiens
MYPQFRELGAAYAMDPKSDAGIYWTGLFGSNKVERRPNPANNDGVQIDNEIKVLQGDNCAELNAVIPGLLLVGLTLQSKTIRSKQGVNPIMNWLQGSSEMAERVR

SEQ ID NO: 954881 - protein, 50 aa, Homo sapiens
TTNTFDVRSAWHFGQFLASRTAGVGLPIRPSPLKCGIPRGFIKVQSFILR

SEQ ID NO: 954882 - protein, 41 aa, Homo sapiens
KDPPSAKHKMIAPRCAIAAGKLAMRGPSAAASNTLSLACSR

SEQ ID NO: 954883 - protein, 67 aa, Homo sapiens
RLSKKATEYGQKIIADLNKLTLDLVANGNLNSKAFSKFSAHSSDQAKLLRVLTALDYMFEHKDKDQS

SEQ ID NO: 954884 - protein, 31 aa, Homo sapiens
FVNHGDSSSPSPRRIHPVDEHQEERRSQQSG

SEQ ID NO: 954885 - protein, 118 aa, Homo sapiens
DDECTSVESWPVSPGTSIEPETIPSTPVKPQLIPVEPQSSIRPDLPPTAPIAVAIPDPDAQSSRRKISPAAEAAALKALGDATPDFTAFVQPRKKKKSVLNNMNRIRDAVARQVIPVC

SEQ ID NO: 954886 - protein, 146 aa, Homo sapiens
SALDDECVKMQTSRKVKASTASKYPIESIVGQISLVFYLPEDVHVGATRSEVLFAWGAPRSYVGDNTDGSLLWLYEGVIGKEQTITENTQNSLFKKRSFHMLVNNTYTSDSLSGSNSSVGYVWLSLKHGKVTHLGMIAGHGLASFC

SEQ ID NO: 954887 - protein, 84 aa, Homo sapiens
AELCAREPTAYARTTGDPRRSAKPINSASFMLMLPDPSKSANVGLFENLNDNSKSLQMNAPYSHCCYRARRNVFQFIFSFLHIR

SEQ ID NO: 954888 - protein, 130 aa, Homo sapiens
MSAAVANIDLSLSVEFTDNTSCSIWVDELYSCMKARLRWISLNERVLLARGDALDLNWQKPLRIYSVREVPVPVLLMVHRTNRVLLNTTCDAFYVEIDELKTLVEPGKVLTDADSLEAYGKDWTKHFAPA

SEQ ID NO: 954889 - protein, 149 aa, Homo sapiens
LTKCFPDSVLASSIASRPSRTERGVCSVRNKVAGSEIPVNFAEIVFMHQRLLEKKARSFVDMWKRLANAFGEQFCTHLVGSTLVNRNNPSTTLSSDQRWIGQTQAAVEGSQFAVKIHHCPKLRIQPAFDRWFSNHIDLNPFATGVSCPE

SEQ ID NO: 954890 - protein, 56 aa, Homo sapiens
DVRRTVRRCAHDLHRPLCGGLVVAVLHHRRFAAGFLLGLVPRPQDFFLVGAGADAA

SEQ ID NO: 954891 - protein, 218 aa, Homo sapiens
MWYPGCERNAAYRTRFPANLDADSFQFSLRLLDCSHALRGNASWDALRTASKGGRRASRAAFPRRAWERSGPWILTQGPFALRQCLRRFGFQLAQRTVQRTEQRLEAGGSDVFIDPHTMHRAFAVHAQFNIGRRLGIGTRTNRVLVVVHDLHANRQAGHQGFQRTVAFAFPVQVGFALTPAGNFDLDKAVAVFFLQAMADQRIRRVGLQVFRCGRRRS

SEQ ID NO: 954892 - protein, 98 aa, Homo sapiens
PLLRNVSTQRVCPSGPGCSRSSSARCALRQAQLKPTRKNATGEDRKGNSIKASTSIADNPAPGGNTGNHRNASNPSANANIPVFMDHPFPVIHSVLAG

SEQ ID NO: 954893 - protein, 90 aa, Homo sapiens
WKLPPGVQTHEDSLTVRLHRTQHRKTSTTLGWLDKSLYRVTESKESHDSHGHQQLSSRDGVDLSDKDSTIYLVIPAESGEELMDSGSSGL

SEQ ID NO: 954894 - protein, 55 aa, Homo sapiens
MLICMGCFEDTISGIRGVSKPSGLGKMVDDHDGGPTFSRQINEGKRHPSSWRVIE

SEQ ID NO: 954895 - protein, 56 aa, Homo sapiens
SRTSQEIWVYAKCLPDEDGPEFPLNCSQYCQDNPTAQPFPKDRCYSFTNGIHSCVT

SEQ ID NO: 954896 - protein, 76 aa, Homo sapiens
GARKATKADTEGKTLIDYLMPGRIPHTFLHNKQATEIRIPLLKDELWTLDSLFLKTSHETKISYSKKPQPSTYVCS

SEQ ID NO: 954897 - protein, 33 aa, Homo sapiens
KRYQYETEKVLAAVYKALSDHHIYLDQNPTLDR

SEQ ID NO: 954898 - protein, 45 aa, Homo sapiens
TTPIASIVTGVEEGRLIFDNLQEVLLPEPHLARHPGYSSSRSTMQ

SEQ ID NO: 954899 - protein, 85 aa, Homo sapiens
NDTVQREKMVRYLLVSAAPDGGGGLHMEDKSTGVGTALMYVSLRILGVGPDDPDLVRARNILHKKGGAVAIPSGGKFWLAVLNVS

SEQ ID NO: 954900 - protein, 159 aa, Homo sapiens
RVHDEEVRDVGCCVPFVAKTPKVKGNTSHNDKWDRIKLKSFCTTKETVIRVNRQPTEGKKIFAIYPSEKGLLPRIYNELKQIYKKKTNNAIKRWAKDMNRHFSKEDIYATNRHMKKCSSSLVIREMQIKTTMRYHLTTVRMAIIKKSGNNRCWRGFVTT

SEQ ID NO: 954901 - protein, 46 aa, Homo sapiens
RTILASKVSALLLHPAQASIAHSRIGLTGLPIVPATAHNASARVTQ

SEQ ID NO: 954902 - protein, 45 aa, Homo sapiens
TDVVFGYTTAMAIEAVSCGMGVRVEVLVSVLVGFAMAAGLVLPVN

SEQ ID NO: 954903 - protein, 35 aa, Homo sapiens
PEQSMAIEEYPEAWGSRVEVLVSVLVGLAMEVGLV

SEQ ID NO: 954904 - protein, 66 aa, Homo sapiens
SIPWVVYAWPYIVGGAIGGDVDRRVYRLQNMFLYRRYEGTPGPLSYEAVASYCAGEQVGGFSCTMS

SEQ ID NO: 954905 - protein, 74 aa, Homo sapiens
SFRQHLLSGDSPDSIYCTGDFTGQRDPYIYCTGDFTGGNIIPINIITIIINITIIIIITTIIPISSSIIIITIM

SEQ ID NO: 954906 - protein, 118 aa, Homo sapiens
MPGSLAWSRYTSRGSRFRGRYIELSNEVVRLIGVYRYTEQAPLEGYEDTDQSSFECQAVARSVLASSCVDLTVEVYGLNIVGYSNPSLGLSYCVSKYVNATIVVYFVSTVVCNNSGEF

SEQ ID NO: 954907 - protein, 39 aa, Homo sapiens
MAIEEYTDSIGGIRRLSLGECYGEVSDGRRIVAAGTNLE

SEQ ID NO: 954908 - protein, 40 aa, Homo sapiens
FYCLCTLSANVMVNGKPVNLGFGIQLDKKIMTDYAPRAPK

SEQ ID NO: 954909 - protein, 36 aa, Homo sapiens
TGTTILPPSIPTKTLTKTSTPEPHASGYSSIAIYCI

SEQ ID NO: 954910 - protein, 35 aa, Homo sapiens
GNARLAIEEYPEAWGSGVEVLVSVLVGFAMEVGLV

SEQ ID NO: 954911 - protein, 104 aa, Homo sapiens
IVRIKSGKRNMSACVKWVLTIIPVYDYMQNVHGKEIEQKKTTVKVPGKRPPRATSACAPISSPKTNGLSKDMSSLHISPNSDTGLGDSVCSSPSISSTTSPKLD

SEQ ID NO: 954912 - protein, 90 aa, Homo sapiens
MIDVNAKQDFLALYSLLRSCIIVVQMMILYPSRYLSRMVWVYAQSLAGYNKFLENALRDTRQLDTLGTYSYGMPVTPWDSGLVSSCPVKS

SEQ ID NO: 954913 - protein, 35 aa, Homo sapiens
GKEINSIELCPEMDITYMTTKQTKCKGIQLRKNSL

SEQ ID NO: 954914 - protein, 72 aa, Homo sapiens
MCFISPGPLEVIGQDRAVVLVFTPSVQISRLKNTIKSLKQQKKSKWNISWKKNVISFPRDMTAEFGGHSDIE

SEQ ID NO: 954915 - protein, 68 aa, Homo sapiens
SISDLHRLTFEAIYVFQEFLHFTLGDQPGFRYITRRLCARVTGRDCWKPCEWISLRKARRKRKVGKSS

SEQ ID NO: 954916 - protein, 61 aa, Homo sapiens
GTVDLEVKEGDGGYDGGDYAGYVLFFVNSSTYGPIWVKYSRLSGGLGLSTGTRTGGMRISS

SEQ ID NO: 954917 - protein, 68 aa, Homo sapiens
IVSRERCTGYDRCGMSRQVVTSQSSGDRSEPKFGSVMATMALAGRDHQEPCMFLIAIYKAIKVVCLEK

SEQ ID NO: 954918 - protein, 142 aa, Homo sapiens
HRHWDTHIFQHQHGDAHYSSTDKGHRHGTLTIPALTRGTDMGTLTIPAPTRWHRHGYTHYSSIDKAHRHGYAHYTSTDAVDAHYSRTDKGHRHGEAHYSSTDDGDAHYSSTDMGTLTNTSTDTGTLTIASTNKGHRHRPLEV

SEQ ID NO: 954919 - protein, 73 aa, Homo sapiens
MQYSVWALIGSRLSQPKRQETAKASLKLRGKLLSPHPSESLLEPPGELCSLDRPAAIGHLPSLGPQHRGAQVT

SEQ ID NO: 954920 - protein, 76 aa, Homo sapiens
PCDPLLTWLGNDSTAQTTWTLSGNVTKSLPASALSLMIPGDMFAVSRLGSPMSPHSLYSDRSSSGDSSPSRDSSAA

SEQ ID NO: 954921 - protein, 49 aa, Homo sapiens
MKGMGGDGDDMEIFMEEMREIDEENLGSYQLQELSSVSIMGELSQITID

SEQ ID NO: 954922 - protein, 37 aa, Homo sapiens
DRRHMQILHSHATDRILEQLPKEFEMELIQAIPFQIH

SEQ ID NO: 954923 - protein, 105 aa, Homo sapiens
PENRSRSVLIPGPLTYCQTETSRTILFPSLLIFLPPQVLFSSPQLQMTSLSNLHPLCGSFPTNIRIRTNLSHIQKRILPPYFPLEVGSSESQPPSLLTWVPSIES

SEQ ID NO: 954924 - protein, 35 aa, Homo sapiens
MKGGLRWTRKYLHIKTREKHCQKLLGDDCIQLTEL

SEQ ID NO: 954925 - protein, 107 aa, Homo sapiens
MLPNDYWLTRSVLHVHFTYAYRLYRRPLLTRPYERRTHEDTDNRLKRSLQTMTDGVTTDRFFLESTLSLNRPLDDEQDLPAPRIHTTYDRALLLRLKMNGELNQLKV

SEQ ID NO: 954926 - protein, 47 aa, Homo sapiens
RTHTFFHLIISENLTKYGRLFSQFGQGHESIFTGVKGSVVGTFVMSL

SEQ ID NO: 954927 - protein, 108 aa, Homo sapiens
VRREVREGMQSQLGYTSNKIKTDKNSVGFSQLECDQQQCQPAPQVTWASDGQKRQMRPGQQAQRQHANTGRGNSCGMARHHCLGTAFSTQTHINTRGSSTESTIAGRA

SEQ ID NO: 954928 - protein, 62 aa, Homo sapiens
DVWARLTQRLGGPRRLDHVTVTLRRYDGTTDDTRRQTLSTLRRRTLTLTLTHTRTTNTGNGD

SEQ ID NO: 954929 - protein, 104 aa, Homo sapiens
GSSAQECVCPVGTGEYRQALAALVNPSRKRHESRSLSYSSMLRSLTTGSAVILRLAASCLDLILPGDSTRLNGVIWSSDTEIRGGSWSQLCDLGQLLGVKEQAV

SEQ ID NO: 954930 - protein, 43 aa, Homo sapiens
ALAKAPACDLQQWRAGYRVIVFFSQAFSYNASGVTAARNSSIH

SEQ ID NO: 954931 - protein, 49 aa, Homo sapiens
WWLVTVNTTPGGYSRTTHDTDDDTGHTTSRTTLPRLRGTRASTFVHHWS

SEQ ID NO: 954932 - protein, 52 aa, Homo sapiens
TLVQKAGGFGGGNTRCLQDEVYLFSEVQWPVPEGESNSGEIIEVRDGNCYYT

SEQ ID NO: 954933 - protein, 48 aa, Homo sapiens
MDRAGSHNPKRINAGTEKQMWPGLDDSCLYSQHFGITGIRGILYDVDP

SEQ ID NO: 954934 - protein, 32 aa, Homo sapiens
LFMELRRQDVLVVNNNAQQETRTDSLGNFSLK

SEQ ID NO: 954935 - protein, 37 aa, Homo sapiens
ASGGNAASGRACSHQAGHAAIRQGMQHPGRGIPLEVA

SEQ ID NO: 954936 - protein, 60 aa, Homo sapiens
SARNPRQYDIATVSDTAYRTCNVISSTFASRANNTYTNSFSVLVSVPLQDSAASLARYNP

SEQ ID NO: 954937 - protein, 54 aa, Homo sapiens
TAFLIPLPASPLPHGNVHTHSHSLSLTLISKVLTFTLSTDSHSRYSIYRGSSQS

SEQ ID NO: 954938 - protein, 37 aa, Homo sapiens
MIELGTTIYDCVCVMFASIPGFQRILYRILTEQGGMS

SEQ ID NO: 954939 - protein, 49 aa, Homo sapiens
STRNDTEEYLYVSRTHLPEDVQDSLNDYLDAIEHNGHSRPGQRPALRGP

SEQ ID NO: 954940 - protein, 40 aa, Homo sapiens
LAVVLHGPSCNTGRRKHGPSYYTGRRFNGTSYKLDVVNTG

SEQ ID NO: 954941 - protein, 70 aa, Homo sapiens
FRSNTYTSCLGEAELDKFFFCNSPYEYVIKQTIHGCGYFKKDKIGRTRSRTITLLFTTVTTFPYSLVQQN

SEQ ID NO: 954942 - protein, 50 aa, Homo sapiens
MLDYFNTQFQSCFHIFGYLFSNAPLYWYYYVHFHAADNLIPVRAEMCRGS

SEQ ID NO: 954943 - protein, 40 aa, Homo sapiens
GVVSADEFQRGDQLFRMRAVKDPLQIGFHLSATVVPPQYG

SEQ ID NO: 954944 - protein, 35 aa, Homo sapiens
RSRGSLQAPYQLQSGGFQEPEEDLEVEEVEGPEGP

SEQ ID NO: 954945 - protein, 42 aa, Homo sapiens
ALSVRQTNKLHSARRLHADTLSVVRILAFPCNQFGKQEPGSN

SEQ ID NO: 954946 - protein, 77 aa, Homo sapiens
RPHAKSILSQKNKAGGITLPDFKLYYKATVTKTAWYWYQNKDIDQWNRTEPSEIAVRACALTGVLMEPSSSVVPPKF

SEQ ID NO: 954947 - protein, 54 aa, Homo sapiens
MACYLPLCSRFALGFYSDYPAEDAVHAALVAPPPKRVGVPRPPLQGQGRVHPTR

SEQ ID NO: 954948 - protein, 37 aa, Homo sapiens
FDPRRTRDAWDPRYHSSRSGRMRATEPSPGTSAGSVV

SEQ ID NO: 954949 - protein, 34 aa, Homo sapiens
VTLPRTTWPHNAPSEREFPRPGTTRYAVLTRANI

SEQ ID NO: 954950 - protein, 57 aa, Homo sapiens
AVLFCLRDFLFAAYAFIADISSLILRLPVSSYRFDALFIPVLDCSPSYYCETYMPVL

SEQ ID NO: 954951 - protein, 87 aa, Homo sapiens
LRHRMFPPCDAHVGTEDLPVHASHGIARLPLILSTNTTVKAAASRSFLTILGLLCPVGCQQQCFPLGLTWPCWPSHSCFIRGLSASS

SEQ ID NO: 954952 - protein, 79 aa, Homo sapiens
MSCLSYLRGPLGVPKSVDRVLPGRWACNTLPSSSCSLQFFSDLLVQVDKAPSTMHVNSTHCDNEATLLTPCLTHSLEGH

SEQ ID NO: 954953 - protein, 61 aa, Homo sapiens
PTVNTFLSLFRSFDFYRRITMVLESHMNYISRTLPILLFPIWMSECWRHLTLSVHDHSFLH

SEQ ID NO: 954954 - protein, 69 aa, Homo sapiens
TLLLVNLGSIYYHISSAYTVATMGSSSDKALPAKRGKGWSAQVLEGPAEGCNVMEGGHCARRLFVISCL

SEQ ID NO: 954955 - protein, 61 aa, Homo sapiens
LSGTAPAFKPASLAQAMTDLRQEGLSSKRHHNFMELTPTPTEPVWTNNVDLAAYVWPASEQ

SEQ ID NO: 954956 - protein, 124 aa, Homo sapiens
PCSKTENPSSAPAGRWDTPDGTRLDHVLLVFVLYQTLHQVPRVYLVICHIVTEVLNYGLTGLISKASIIISSDSNSVRLPTISLRSTTEYIQTVLKALQLLSSLCVLTAPFSQINQALILEGRI

SEQ ID NO: 954957 - protein, 65 aa, Homo sapiens
VYSSQRQRHRRRVISAFPSEGNNESEWSQIHENIIRKSSAKYSAPSASHGLIISLQLLRGDMEQI

SEQ ID NO: 954958 - protein, 76 aa, Homo sapiens
MIAAYPSEERISSPATEQIWMENDYDELREEGFRRSNYSELREDIHTKGKEVENFERNLEECINRITNTEKSLMDK

SEQ ID NO: 954959 - protein, 167 aa, Homo sapiens
VELHRSRQKTVLVCAVATALRNMALDVRNKELIWHNTPMRRPMSTALPVREQRATTLASNGHARTDHSDSLSACTLHECDYQGTWMNAKGLNGMPEAIDEVGRASPKSKGRINTLQKVGPGLHLQVLQQACGSYRRSEGVSTKKGWMVHNTHFVALRLQTIEEGTGK

SEQ ID NO: 954960 - protein, 99 aa, Homo sapiens
RDSDYPDAYTTGNILSSVGSFVTWSIIEFSLVIYKLETQHINTVLQYIYSVFLNYHYYILCYRLTILFHTVHRAREGVENYILSLLIQLIDTPERSSTI

SEQ ID NO: 954961 - protein, 34 aa, Homo sapiens
CITSRTQIAPPTGFARGCVREVVCEDVCARMCSA

SEQ ID NO: 954962 - protein, 75 aa, Homo sapiens
DLEDPAYLELTKTHSRGLRLVRTPPLDQDKSRRLVSASVEIIHIMAKGHDGRSESEVFLCSDKGVEVKGATYYSC

SEQ ID NO: 954963 - protein, 113 aa, Homo sapiens
GIPSVLNFSTTCRAKKMPMSFSLTQMLLVSAAYLAALFGVAWISERGMIPRAIIRHPLTYTLSLGVYASAWAFYGTVGLAYHYGYGFLSSYLGVSGAFLLAPVLLYPILKITR

SEQ ID NO: 954964 - protein, 108 aa, Homo sapiens
KGRYQSNRYRIGTRTHGGCERERLDTVPAIVYVTRFTLEPAFDRGWSTGRGTRGQCIVPTMFFLLSPVIAVERDEGSRPLFKIGALMAPTRNLMTDVVSYPKGDTRVN

SEQ ID NO: 954965 - protein, 111 aa, Homo sapiens
MASTAVRSVIQAAAGDLQAAQVAGVDSHGHQREGNTVQAWQILHVAQHEFVILGQRLDRRQLNIPRVYQQQWLFVGGGNAQHGFAVAQHVLEQLWLGLDQVQGIAVVEQVA

SEQ ID NO: 954966 - protein, 33 aa, Homo sapiens
GSEVTAYSCSPAALACERQFWPFFAVQKGKNSS

SEQ ID NO: 954967 - protein, 30 aa, Homo sapiens
MVNNNELVLRIASDSRYLNFARFAATSADQ

SEQ ID NO: 954968 - protein, 59 aa, Homo sapiens
EDPEVTRVRQQVITAQVECAFADRRADREAGDRALGDRQGIAMADMTPQDMASKLLAAG

SEQ ID NO: 954969 - protein, 41 aa, Homo sapiens
QSSPRAATEGGLKPLTTNAWGMAYGAAMLATYCALRVIPFE

SEQ ID NO: 954970 - protein, 52 aa, Homo sapiens
MLPISKPVSRLLVEKPEPPPLALSVGRLRIGSVDLGLGHLAFGGQFETAQAR

SEQ ID NO: 954971 - protein, 172 aa, Homo sapiens
MTVFGLTLSFVKDSNRPTRYPELNPRYPVHNRIIFLRHPPLDYHSPQSFGNTSTRTILRRNRIDKVLRHHPLASPLNNRPHRFTTKPQPVFIFTNPDPQLRCFTAGMVQPDQAGKTSTYPLPDREHDVAAIRYRRQSLPPDLRVLLQRGRRFPGHVASQCRSDTSERLNRVL

SEQ ID NO: 954972 - protein, 72 aa, Homo sapiens
VIHPVIDLRSGQIREVFEDDDKVRIALRRGRIVITALQIQTKIRERLKRIKDKLDRGEKLPVASLFHGGTRV

SEQ ID NO: 954973 - protein, 64 aa, Homo sapiens
VASTLVEQRVVLTELSDSEATPCDGVPPFPSLTADRSLTGVCDEQSAACVLVTSVLGLTQAAVH

SEQ ID NO: 954974 - protein, 105 aa, Homo sapiens
RYLILLPVAISYVGISKRAIAKSKKDANREHSFWRLLSKFASPKVAPVSVFLALIAFGGGLWYSQNLKIGDLDQGAPELRPDSRYNKDNNFIISNYSTSSDVLVV

SEQ ID NO: 954975 - protein, 33 aa, Homo sapiens
EVPRVTQQTSTNAKPLIVLAVSKEERSDKEEVS

SEQ ID NO: 954976 - protein, 96 aa, Homo sapiens
VGWANQDVEVTKNIVYEVTCQYTIFPLVSEQIGQLKTSPILCCHIGNPHLGKLMYRGILQHPLCNAESLGKGQWFLLEDTSYFCVRVNIQFTADGS

SEQ ID NO: 954977 - protein, 105 aa, Homo sapiens
SVYDCPGPPVAIREGLITDRCKCLARVLQAVGANHFGERQGLVADGGVEHSELEGAAQFAFQRSGVLLETFEFAQQAQGFLMKQLTLAGQAEAATATMAQHHASE

SEQ ID NO: 954978 - protein, 70 aa, Homo sapiens
LEQRHDFLANREEVRRVAKHLAHRNGQELQQLHERGRVVQHALLQCGNGRAVELTQGMGHTAFDRRARVV

SEQ ID NO: 954979 - protein, 40 aa, Homo sapiens
SVDVCLAFPGQVVGGSSSRNRLGAQSMTSPYCLRLAAKVK

SEQ ID NO: 954980 - protein, 67 aa, Homo sapiens
HPLSVWVTHEFKPAFGQRGVTGRLDQDHKQIKSKIKSGSLRIVVTVDRKLPLLLLLQRLCQLNGLRG

SEQ ID NO: 954981 - protein, 63 aa, Homo sapiens
SIFDVLLQGGLPCTGVQAQSMFFFDSLSANMLVGLRHQHIGQVWLGIIRVLRVADPGGPVGWG

SEQ ID NO: 954982 - protein, 178 aa, Homo sapiens
VPHVLKWRWSSCIPLVLVVGTYDLKTVVTVSVVQFSLFFVDFWFQLARWIDSTILDALYGWGWGWNRPHSNFDPVMGLNNAFGDMLLNFVMATMFLILPAFWVTALAWTGIRAGNFLQGLASGTRDAGQAGGKGAGALISAAKKYVPSDSIVLKPRVRVIVVRGGMVKQAIPVITRVN

SEQ ID NO: 954983 - protein, 80 aa, Homo sapiens
MRFTYTRTAFARQRAFAVQVLQQRQRQPADIHQPLVQHVRDGLALQGLVELGERYQHAGMALTQVTLQAFAMLNERTRMN

SEQ ID NO: 954984 - protein, 37 aa, Homo sapiens
MGRPQFKSMTRRYEQSADNTSVAFNACQELISNNLST

SEQ ID NO: 954985 - protein, 230 aa, Homo sapiens
PALWYVGCGQGQRGQRRVQGTDSYNAVGLALDSSFSQRFSLGVRNNLSRDHSTNVQGARNSVSVSVGLPANVQMSLSATAQTPGYRDVIDTVTPHVNDVDGSRFKNQYTVGFSWADPQLGGFSIGYNRGADFKSRITQNIYGTWNKSFRYASVGVTVDSQIGQSNSADDRNDDGLGIRLQVSVPLGRDRSLSAFARRQEERSSIGTAYDERVDETLNYQIRSDRDFGGHR

SEQ ID NO: 954986 - protein, 81 aa, Homo sapiens
PACVSICMHRRTQGAGLAGWMPTQLVNLALSEQGLAWLVPSVMTLVVAVVIDRMLGKRSEADRLKPLTYTLQLKSPGSNDP

SEQ ID NO: 954987 - protein, 173 aa, Homo sapiens
SRVITKSPRTCRLKKTLNKFRRFTGRAEGMSISFEAHLLGDKIEFDEAGGTLIMRKFANPARRSTKTCSCLIRVVLRHEIVINENVARLFKQDSGKLREIQVMKLSDPPCLDIRTYCMIDSILRHFSTPINSGLIGTVLRFLHDRKAFVIRMIYMDGDSNRNGIHAIPRGGYR

SEQ ID NO: 954988 - protein, 61 aa, Homo sapiens
TVVLFVGLLFASRWLLPRLFREVAASHSAELFVLLALVIVLLTAWLTHLLGLSPALGAFLT

SEQ ID NO: 954989 - protein, 79 aa, Homo sapiens
IRRHQRDQEHYPCVESRLPIFSRENTPYISGVSVDVDVDTRVNIEVHPGIGETLQPNSGPPITEAYLPVVLYQSTEMCD

SEQ ID NO: 954990 - protein, 138 aa, Homo sapiens
TFSVTASSARAKENVWLLHDTTKAVHGHRCVDKLPKDAVSHLTRSARTRSAHSAVRPQAMQSISSRFMVGLPPLYRWRISAQRSGGYDGSVDCCQGATGLSCQVMEYQSRKPSLPLDIQVGANTARQIQRAGNPYHQE

SEQ ID NO: 954991 - protein, 40 aa, Homo sapiens
ISIKPVDAVVGDPVSIVVGLVVIYLCYLLEQRILYGGLDG

SEQ ID NO: 954992 - protein, 43 aa, Homo sapiens
GYEGTALRLQRIRMAQAIRASDTNEQHACRIQHAYKGIGRRSS

SEQ ID NO: 954993 - protein, 37 aa, Homo sapiens
IFGAQYRLRSVLMRLLDSHAHRAQRFVYLIPVLIAVR

SEQ ID NO: 954994 - protein, 39 aa, Homo sapiens
MTLVELLVALLILAIGLIGAAVLQLSALKYTNTRYTFGY

SEQ ID NO: 954995 - protein, 74 aa, Homo sapiens
MQVIDIAAVLIIGPNVERTFCLHLVSSNMHYYGDVQLGNVMQQTPVLNPWWLWPLQAYCFNFGSTHGIHHFVVK

SEQ ID NO: 954996 - protein, 36 aa, Homo sapiens
LSYRVGCTQGFSYINGPIRDLLLGKDPGPENPLAHN

SEQ ID NO: 954997 - protein, 97 aa, Homo sapiens
TLVTCDRWPGPGDCPGPPVAFVGLITDRCKCNAGLLQCCRRQYTSANGKALYARGGVEHSELEGAADNSPFNAAVLLPRKPSSSPNRPEFPDEPAHP

SEQ ID NO: 954998 - protein, 60 aa, Homo sapiens
FLSHTRIFKERSNQRLEINIHHHQDGMLISIALTKKQQIVVEPNWDRDLLTSLRTRDKTS

SEQ ID NO: 954999 - protein, 69 aa, Homo sapiens
FSSYEGYPIERSQLHHDTSKSMGQPHVKSITRRLEQSAENTSWLFNACQSLFAASEHRIMRVREEYPSL

SEQ ID NO: 955000 - protein, 140 aa, Homo sapiens
AAFLRDIFCNDIPLIFRRELYASVSFLAAWFYLLCLVPEAAQRASNSADAVQWLSMLRLLAIRFHWEMPKFVYNDDVHSAQCVAPEPIPRVRVPTPTGSPAAPSMTSSTGMLEGALPRPTEKLRNPRSYPARRNGTRLNF

SEQ ID NO: 955001 - protein, 59 aa, Homo sapiens
RKLSGKLYLVDWQEEKVSKTGAEGAVLDEAKNINKSLSAFGRTGGRVPGAPEFRKIIGS

SEQ ID NO: 955002 - protein, 79 aa, Homo sapiens
QDLTRTPNTGPHYINTPRTHKTDRPDGGAHIGYKDRALERRGLLVSHVSSKRLSAGWEITPLCRQISRLGPEFGSLFTG

SEQ ID NO: 955003 - protein, 85 aa, Homo sapiens
RTPTQHFRRIKSANATGGIPYTSALSHAGPADCYSNQLHFPFSIEQMKSPFEIKNAFRLRLHEEKCDLHYSTTLKRNLNFLGVRG

SEQ ID NO: 955004 - protein, 85 aa, Homo sapiens
MWSPGLTTSSKVVVAVVHSRNCSLLETERQVIYVESWCTKMENRTLCPLLPKNMVYWKEQEHGRQPDRNSNPVLCHLLGNLGRTG

SEQ ID NO: 955005 - protein, 39 aa, Homo sapiens
PDRNKNGRNEVSSNKHLLYRLTSVPMHCFNALDDMLATL

SEQ ID NO: 955006 - protein, 59 aa, Homo sapiens
RQFSASPNTELDFGGAAGSDVDQEEIVDERAVQDVESTVTNLIHGNLGTLIQGSSTIQM

SEQ ID NO: 955007 - protein, 53 aa, Homo sapiens
MFDTADKVLGDNHNMYCTEIKAHNIKAELLLTEKAGTQNYITSLPIKRRGYRA

SEQ ID NO: 955008 - protein, 42 aa, Homo sapiens
SSISVTARSTFDLKYIRAIEFSGVENVAHFLPLMGYIYEHNV

SEQ ID NO: 955009 - protein, 79 aa, Homo sapiens
EVTLEVSTRNAFTYAFRIRKDSPEQERVIFAGTQLVDGLTLSDYNIQKESSLQLVLRLRGGMPIFVKTLTGKSITPVNV

SEQ ID NO: 955010 - protein, 35 aa, Homo sapiens
LRIVCLETEHPQQFIRKDDRVWAKDLNYLNLMVEA

SEQ ID NO: 955011 - protein, 60 aa, Homo sapiens
TLRILAEAFSNTNPESRPRSWFVQIVLCMFCLILVLLVTATGTHGIFHRKGSRMPMALGP

SEQ ID NO: 955012 - protein, 51 aa, Homo sapiens
MNLMFPVNNTQSVGVLHNERESPDEVTEIRQRGPTPHEGFMWHDKKVWRGY

SEQ ID NO: 955013 - protein, 35 aa, Homo sapiens
VKGSLVHADFLYLSATSFLRYCSVSANSIWNELDS

SEQ ID NO: 955014 - protein, 69 aa, Homo sapiens
MSTDEGGYTKTTDFLSRRNSFLLETDAIQDFHSYEKSVPGFKAGWAQWLTPVVPATREAEAGGREGTEL

SEQ ID NO: 955015 - protein, 85 aa, Homo sapiens
VCGRLWQDPLPVQPGPALHIKRRLAREKSLGMALRYTIKDVCRNGKRKGLKRGMDAIDDISEDPLTALWRMDWKVLEQNREAGEG

SEQ ID NO: 955016 - protein, 69 aa, Homo sapiens
DSEDPPPFHSRQAKSQIIMNILFTTATKRIKYLELQLTREVKDLFKVNYKPLLKEIRDDTNKWKNIPCS

SEQ ID NO: 955017 - protein, 69 aa, Homo sapiens
KSQDTLTMSLPIMEPLMDDARWNARIRYHNLCHHHLLEVKISGLLNHRDLPCSLLLRHPLRMSLTRGSM

SEQ ID NO: 955018 - protein, 48 aa, Homo sapiens
KKEDGVSLLYAQDGVHMATFSSSLTTSDLYGYKTILAASALPEYLRIH

SEQ ID NO: 955019 - protein, 43 aa, Homo sapiens
PSGPAIMTLGDKYDLSPHQQIPSRTPFDLADRGPPELVLSASS

SEQ ID NO: 955020 - protein, 207 aa, Homo sapiens
SADPEDRLRGEPGTGYERFSPTVRKLERIPKRERATVQLRHKKQQHHEVEIAHECGTANGLDQRALTANEMVTLIFANGCNRFVWKLRVDAISPTVGASNSSRLQALNSFVTGDHDTFNDFGRRESFAISKPVSSTPAGTAISPNHNRLNITVMATKPSRSRPLKDSCLVVVAVMLFPFYTIKHDVQPTAVVQRCPDDRCGGLNHGF

SEQ ID NO: 955021 - protein, 225 aa, Homo sapiens
MPECGSETQRSSSKRSEFCPACSTSGWNVDDVDLCLVDQADHVATVIVVVTHGRHGREQHRVAPAEASAYGKLRIWMRHADEDDKTRRVNLYLLNQATDKPWACRSAGFAGPAQISVALSWRRVITVRYLMPPFPTRSGFSSEAVSRSPVPMNTAAPPNSRAFNEGLQNLALDVQAILFGFDQLDLSLVGLPVAPVAARINGRDAHALLRRPRSTEGVSSCWSSI

SEQ ID NO: 955022 - protein, 42 aa, Homo sapiens
GADDSPAISRSLMRARSVFERRAFHRLEHFRAGVLERDIQVR

SEQ ID NO: 955023 - protein, 224 aa, Homo sapiens
MCVTVAPSKTSSDRGSAKEATIKRCEDNNSTIAAYLAGQVDLIASGNVVMVAISERNPKRVPALKVKLKDSPVYVGVNKNEPAPLEKVNQILVAAKADGSLEKNAMQWLKEPLPADLLTRSSTMAYQFDFVPVLANTDLLLRGALFTLELTAIGATLGVALGTVGAVVRAWKIQPFAWLFGVYVELIHNTPFLVQLFFIFFGLPSLGLKITEMASRVLAMVINW

SEQ ID NO: 955024 - protein, 61 aa, Homo sapiens
MLCDVMWGISRNTDFMTGCRGHSEQGALGQYTMAHQNPEPDKVNQNREMDIYKRSEGGSQT

SEQ ID NO: 955025 - protein, 68 aa, Homo sapiens
LLVLVAQMPAERQRSRRPGSIPALPLTGGLGLVALAPLCLSFPILVLREMNGGLRQALRAAQPESGWR

SEQ ID NO: 955026 - protein, 41 aa, Homo sapiens
QDVVMPKSQHFERLRQEDRLSPGVLGCSALCRSGVRTKFGI

SEQ ID NO: 955027 - protein, 67 aa, Homo sapiens
LRVLHNKCIQGFYPGLNDKEILTSLIPINDRLDKKMWHIYTMEYYAAIKKNEFMSFAGTWMKLKRRR

SEQ ID NO: 955028 - protein, 77 aa, Homo sapiens
LLTNTECTAHQTSTEDGITIDISLAKKKTNCKKEESKGNTSNSTIQIEWAQDSKLAGTARVALQEAHNERVDYGLLE

SEQ ID NO: 955029 - protein, 71 aa, Homo sapiens
MSSTPGCQAPSVSPMSVCVLDLKVGKPEFHGLVECTDELCSSVQMLIPLQFKFLVCKMIKLSHDVTRGVGG

SEQ ID NO: 955030 - protein, 38 aa, Homo sapiens
AAVGEKRVFKAASCHLALPNGEEKGMAPKMALQLHTQY

SEQ ID NO: 955031 - protein, 87 aa, Homo sapiens
TESTLTLLLNPHSTLNFHNRGQRVVEYKIYPISSHLMGYTLTYRLYVGTCAYFVTFIMGLLKMAVYEADQQVVRLIRVYRLQNRLLY

SEQ ID NO: 955032 - protein, 73 aa, Homo sapiens
LIATSRHRRIQTRRRYERYGQTQASISLMDTLYLDTYLIKTTKGQNGGESPDFHESVLLYMKIKINASILHLL

SEQ ID NO: 955033 - protein, 70 aa, Homo sapiens
SPSGSLQYCLRLGATAIVYWLNSSADVIDITSYGDKGCRVALWEEVRYGIFNLRAKAYYHCARSEGDSHC

SEQ ID NO: 955034 - protein, 50 aa, Homo sapiens
SDRIDNLAEDNEENRGWGWAQWLTPTIPAPEEAEAGESRAQEIDTILANT

SEQ ID NO: 955035 - protein, 128 aa, Homo sapiens
MGPCRIHTVRVWGGYKKYRALRLYVAEFLLGLQNVSTRNNNGIIDFVYDASHNELVRTKILVKNCIVLIDSTPYLTVVRFPLCAALGRNKGAKLTPEQEEILYNKRSRILQKKYDQRKQECPNQQSPG

SEQ ID NO: 955036 - protein, 131 aa, Homo sapiens
ARTLDAPPSGSLPVHADYCTPPRPTGCLFIPLERSSHLKRTVYEYQRILCSRSLRENVKIGAKLLHDVRQDLADVVQVCARAKKQTNYLRTLINELVKGILPRSWSHYTVPAGMTVIQWVSDFSERIKQLQ

SEQ ID NO: 955037 - protein, 40 aa, Homo sapiens
IPRMGLCGVFICGFGAWPTLASCDLAMIAVLEIDEMIENA

SEQ ID NO: 955038 - protein, 91 aa, Homo sapiens
HCATPAGVLPSTTLSKRHTGVGKKPTACSASDNRADSQIRSSLRECGWCTHFMGSTPLKKKRQAATIKTKTKSIIPCNPTILEQYSWLVVK

SEQ ID NO: 955039 - protein, 34 aa, Homo sapiens
SRFFTIGFRFSVFVAFLSRTRRFRITSTAVTAIQ

SEQ ID NO: 955040 - protein, 70 aa, Homo sapiens
PEYLDKIDVITQADICAERSGPDSMTCSDFWNLMRTKFQVDKSQTIHKFDVGWPDSDERPHSGLQMLQTN

SEQ ID NO: 955041 - protein, 61 aa, Homo sapiens
VCLDLSGLIGCSLFSWESLLREEQDSENGDAGNNAPLIPQATDFLTFFCRFSGLSLEYVAS

SEQ ID NO: 955042 - protein, 67 aa, Homo sapiens
YAIYTTVDEIYLGDTLQASRYSRTRQRTFTGVQEHIAVHLPACVTNSNKAELMKACDSLDLVMRYLH

SEQ ID NO: 955043 - protein, 45 aa, Homo sapiens
MTDPLVGPAISLAYQAAESVYLEDGSHINSQHETSLVIGEALVIY

SEQ ID NO: 955044 - protein, 117 aa, Homo sapiens
LRTQAAFLRLVSGVEAVGEFQRMFDQVKSGQRSLDSLTAWISSNTQVSAVYRDELVKLAASYSSSSQKAADFQALLGKSKEPLDKAAAGARALADSQSASSAAVSGGAQAWDKCVRS

SEQ ID NO: 955045 - protein, 146 aa, Homo sapiens
RCYGRASWSSSTLSKEERAQVWGMTFALDDGKNSDSPLAHLQSEFAGLEQRLNERLVERLQLERDPARRDLIYGFPQQFGALKDCLQSFLEGVFKPNAFEERVLLRGVYFTSGTQEGSPIDRLIGAMAQSMNLDRQHLARQSGTGR

SEQ ID NO: 955046 - protein, 45 aa, Homo sapiens
SCVRWPVSSACSLDLISTVVTPSRSHTAPALFSAHAQLIFARRTG

SEQ ID NO: 955047 - protein, 87 aa, Homo sapiens
KDEKDESSFLYKMRDSPSIQGTAWCANAPRFTIQLEEAVSEFTLGSQTAWISYDVYLVVARKAGLPTLFFSCDLTSQFTCAISSLLF

SEQ ID NO: 955048 - protein, 42 aa, Homo sapiens
LKDQADCCHSRYGIHGKPMCVESFSDYPPLGRYKLYRAYEDR

SEQ ID NO: 955049 - protein, 38 aa, Homo sapiens
DPEQQQAGGADQQRDGAVGLFDLVERRFDGVFVADVEG

SEQ ID NO: 955050 - protein, 46 aa, Homo sapiens
MLSGFMESPETTSHLEGQMDSQSRTGFHGTQTRSTERVPETRNSVI

SEQ ID NO: 955051 - protein, 50 aa, Homo sapiens
MGRHMPDCEVIDDREDVYQILNPWSSADTTDIWNAIDADKSGQSARKTSV

SEQ ID NO: 955052 - protein, 54 aa, Homo sapiens
RAKIKNALTQFLPQGTPTPLYPHTRLLSKTSAILIQPNSPGQYGGDTDARHSIN

SEQ ID NO: 955053 - protein, 44 aa, Homo sapiens
DTTVKPIRRFTTVPWCWRNIRSPRLKSGIIFSFKRSLPKPRTTW

SEQ ID NO: 955054 - protein, 66 aa, Homo sapiens
SSPDWHTGRANDRVDRQGRISIIIFCINNVDGHLYKLDGRMPFPVNHGASSEDTLLKDAAKVCRDI

SEQ ID NO: 955055 - protein, 81 aa, Homo sapiens
PFRIAGDLSDAANARQVLSDNGSPTLICRCSRFFGYRYTSAVKQSVLFKVNESGTDALLREGIVGRLEGFNIHESAHVKKR

SEQ ID NO: 955056 - protein, 69 aa, Homo sapiens
DLVMLTLLDIIPVHPMLCGELLRLSTFGSLSWFVMGKHLVAVGVIKAVDKKAAGAGKVTKSAQKAQKAK

SEQ ID NO: 955057 - protein, 66 aa, Homo sapiens
GRLYNLYLSPSLHYSRCEQELGREGGKSQKLMSSTAGKRHTRGHRLLEGTSQIAKSLPHYAWAIYY

SEQ ID NO: 955058 - protein, 42 aa, Homo sapiens
MGLLGRTANSIYSSLRNLHNCFPQVAEHILQFPAKQVLGLPM

SEQ ID NO: 955059 - protein, 59 aa, Homo sapiens
PGAVILISPTGYILITILPSTTQTTNALIVTSESSLKDFKLYSHRTNHILYLLRNHTYP

SEQ ID NO: 955060 - protein, 38 aa, Homo sapiens
PTITGRCLDLRVPTHGDDDTPWWHARVYKVFSVVCIVL

SEQ ID NO: 955061 - protein, 89 aa, Homo sapiens
SKANDYCTRSFPSLVGGICLMQGDRDREDVTSITSWVVQTRQYLERVDAENREISQKNQRLTRLYNALSLCNQSIVRSSSEQELFEPVR

SEQ ID NO: 955062 - protein, 63 aa, Homo sapiens
MGILLVVFIICYTLSYNIERDICEVLEGVSSREVILLLAVKRFKRSGTVAPCRSEFDRDKIVK

SEQ ID NO: 955063 - protein, 121 aa, Homo sapiens
TVLVVQTATRRRYRLRDGPYCSMRIEDNPLDLAPKRILQALGAAELVDELLRQVLHMLRVQQFLCLQSRKLVVGLLARLPVQPCFRVAQVTLQRGRKKDFSLRWERAAQPPMAIKSARAVR

SEQ ID NO: 955064 - protein, 43 aa, Homo sapiens
KASEDTLLGTEYKSMQAVDMLYELKSWFYNIANALDATDTVHF

SEQ ID NO: 955065 - protein, 87 aa, Homo sapiens
MNTDESRIVADPNRLSLFAKNTPEVAVAPTHQTYVIALQERIALGLLVTICPPGAITMMPTDRLVTTERYTYFTFLQTLLHVLYIDC

SEQ ID NO: 955066 - protein, 118 aa, Homo sapiens
MNNICKIADYGSTRIDSKTIEITQTRQGAKFPIKWTDPEADLYGRYTIKSDVWSFGILLTELVTKGRVPYPGMNNREVLEQVERGYRMPCPQDCPISLHALMIHCWKKDLKNAHFEYL

SEQ ID NO: 955067 - protein, 34 aa, Homo sapiens
RTLGPYWFFISKRHLSNIQYQNSCTIDFSFSQYG

SEQ ID NO: 955068 - protein, 44 aa, Homo sapiens
LSPACAQVALNVDSGRASGPECRGRLLGGTHGTPSLCQYGGTEL

SEQ ID NO: 955069 - protein, 120 aa, Homo sapiens
AVHLYLVVDSSRTPTPPVVTVHATSAAACLGRRSGCRVTFNVFGVEMRADESSSTDEADCPNFSIEAGGQLLPPPVDSGLSFNKIQVVCIAQRRRSIEYHDKAHEIPLLFSREQCQSASL

SEQ ID NO: 955070 - protein, 32 aa, Homo sapiens
MVVHPINYPDSDTQYIPPAHHLSLHSKGVHLN

SEQ ID NO: 955071 - protein, 75 aa, Homo sapiens
MKTSRVPLIHTPGFCDLCQRPVDVAAQRVVGELQLGVDQIVYRVHIRYMSYIGAICTSSGSTMSKIPTGTVGQTF

SEQ ID NO: 955072 - protein, 73 aa, Homo sapiens
AVTMLGIIIWYNVSTNDSQNLVFFNNPPTCHIESTTGGDELAVFISTVGRGLNSRSTPICLAERAYRSNLDYS

SEQ ID NO: 955073 - protein, 143 aa, Homo sapiens
IPDVDTMRCRTQTWITSVYIGQKLSERLMRTNGVQSRIRGILERAGAGTDGGSDAEVTDADWKKCDLIAKIKASCPQQSHISPKNYYKGTSAPRFWIYLHFQDKLTAQTITESCHHYLYNLVKRTPTFGSKVYAPDQCSLLFI

SEQ ID NO: 955074 - protein, 38 aa, Homo sapiens
MSTVPEAAHRWAHRIQLCVGTMASGWVSGRLLYRTRGS

SEQ ID NO: 955075 - protein, 44 aa, Homo sapiens
QLHEIRPRSEEQRPPAKSHVREPSWKQFSRPKLQMTVCPSQCIS

SEQ ID NO: 955076 - protein, 104 aa, Homo sapiens
GSCTDVMHVEGGHAVDVCMECMARQLRDPSHCQTRAEASGCWKTRLKAGMIPSKPPEASPVIRSHNRPRAYILITILPSKLITTNGAHSRIISASLKDFRLYSH

SEQ ID NO: 955077 - protein, 133 aa, Homo sapiens
TLRGLITDTVIHRGRSCFKAGHGALASRRSRRCRRVRIIYFSTMFLDSPRRVAISCWVSPSIFCQMKILRQLSGNSASARSMASANWIALHVMLRVATCEACCDQPPAASTPRGGLRGGRHPPQYCARFDAGR

SEQ ID NO: 955078 - protein, 71 aa, Homo sapiens
LLSRELATRLDNPAKSVSTKNTKKLAGHGGGRPFIPATQEAESMNNYLTHRRRRPQMSHSSYHLHSRPGTP

SEQ ID NO: 955079 - protein, 34 aa, Homo sapiens
TLLRIDRNRWTPQWWSPTTARYLVVPKRVSLSLP

SEQ ID NO: 955080 - protein, 215 aa, Homo sapiens
PDHVVSLRKWSGSIAVSRPGSGAHVAFLVSCQRGPGGTGYRTISRAPAPSPACGKDQRVAHHGESAAFARPFGKPQVFVIQPQPEHLQQAGKLLWSDAGAGFGQQFRGDAHLLQHPRVVETGSARTAEGRSGVMAGDGTFTHARASSMEWRMVAITQWGDKADIRQIVGRDRMSGRKSATVLHSPESPVNPKPCCLKAFSAFKQSGTLFANNIRC

SEQ ID NO: 955081 - protein, 233 aa, Homo sapiens
ARHTRGQIDQDHDLKHTFGRRPRAASVTEVDRKALLGHKNGSITSHYSTPVLQHLIEAANKVLATDSREPVLTVFEEEIEMIPRKVPTYEKAEQVRVRQVIEKYGRDGVIRTPAPYHPVYADTSTGRYTQGFAPGARCNDAQECGTVTHEVSCKVTEPILAPSGVLQTYHKIQTREKKPARGGLNISNATWSLSLRLALRIRQCPIGNRHQILRHKFRTLRRQVIVLPVHHLA

SEQ ID NO: 955082 - protein, 130 aa, Homo sapiens
MPDRVRGQTRQHRGQGVFRNGHADQLDSSLRCAGAMANAWGGTAELDFRWQGDGFDARQLDGLLHVVHRHYRVIVLIDDHGHRVVTARKRKADSEVIFRNAPGGLVDNFGFENHHIINELIQALNENKML

SEQ ID NO: 955083 - protein, 153 aa, Homo sapiens
MQTHAKNHHEDHRCPTPRRLHANPALIPNTPDTTTADSQMQVAQPYRTQQRHGDADDGWHVAYNGGDQGDKRRGNREFQTQPIQPGNAFTEHDAGEGEDVPDGIERQADAQGVPAVEGLAVILADQGEEFIGQQKAQAHAPPGFERRQRRAHV

SEQ ID NO: 955084 - protein, 159 aa, Homo sapiens
GGSARLLLIQHLTWMIITRNRTVDQRQQLRTQRRQNEILAIAALFLRPRLDKATLEQQRLVIGSGLLECVQVASVLAGCRLLGRFWFGVFARGKAAFAVLHFMQQTFDQIPIVSRHPDSSCRPMELARLGSDTFRHGPFNQTDRRHFSELSRGSPPQLH

SEQ ID NO: 955085 - protein, 62 aa, Homo sapiens
TGAGGMRLSLSRLLVIPDVDNLRRRLLPPIIRKAKVIHAQLVNEDEIRRLILADVRESNAMV

SEQ ID NO: 955086 - protein, 47 aa, Homo sapiens
RARKRGMHAQNACQREPNDGALRGDQYVKISSPSKALGLQRSSVRGE

SEQ ID NO: 955087 - protein, 85 aa, Homo sapiens
DAELSADTLIGIAHYSPELLGSSDPPAWATERTPSQKKKNTLGSSYWWCRGELGYHFLCSHCMLCYGCAVYHSGVYCLILSRGIL

SEQ ID NO: 955088 - protein, 71 aa, Homo sapiens
TDRCCGHARRGAACLSREVLEKIGIAMDKVDTDAHGRELSNPAAAGQYCGDLGQWIPMASSTFDPGALELA

SEQ ID NO: 955089 - protein, 86 aa, Homo sapiens
DTNVLQIIIVRWRYCATQLLERGEKRPRRTLYPWQSNWLRQVGAAREIAHLLLDAKQDLVRRLMAPSLFQPTRRLRDKETDGQHEH

SEQ ID NO: 955090 - protein, 75 aa, Homo sapiens
MQRRQRVSTLQFAWCGPARRCSMRMGDNLDVACRCTQVARGIFLLYGDVARLNAAGSHIRPVLQQMADRQSIRQL

SEQ ID NO: 955091 - protein, 117 aa, Homo sapiens
PVARSTVVGADIVSAYGGTVKVLGLVENSSTTAIVEKIRNNECYPVGRACSPLAFLRHDLAQHLPCLAGQALELRVFFRFCQALLPEPILPANPLIAHQPAFLLGKTFRQIEAARAG

SEQ ID NO: 955092 - protein, 125 aa, Homo sapiens
RRRSGQFMRKCVLRDRYFPYHRRAYHTFMITLSHHHFPYLLPNPGCLMTLQSVAKLANTTFLSRTGNINRLNYPSPPIYPRSLIVPPILYSPLHNIRSLRSLPYHQINWPPMVLNLRVHRLRRIR

SEQ ID NO: 955093 - protein, 80 aa, Homo sapiens
MHPCRLEPSRSMFLVIEPLNWITVISSTLCLITEKGKNLELFPMPLEESPSGSHMATFISTGFTLKTQIGQAWWVMPVIP

SEQ ID NO: 955094 - protein, 39 aa, Homo sapiens
MPRWAPGKRQSSGQMRAPIRTKANFLYGKAMSAASNYTE

SEQ ID NO: 955095 - protein, 125 aa, Homo sapiens
GWSNPHGSMVFLAVEAAQVTVDWEASRFELIAQTAHLAVRLFGFDQSDRAKAMAAQADVRLQQAALVKHSPYLQVQVFEFRNTISRHAEYLQLLIASAFVKGLNANCRASGKVNSTGRATEVSRR

SEQ ID NO: 955096 - protein, 75 aa, Homo sapiens
GRILPWPIGESDLIIGANNRSAVATTGLSVLSLLCNSRPSSKPPPQSAATEAIVREMFRIAPSLFRNHDALTQAA

SEQ ID NO: 955097 - protein, 36 aa, Homo sapiens
GRIRLDGYSLGALNVFTIYGCVVSVLVLGSCVMLIN

SEQ ID NO: 955098 - protein, 95 aa, Homo sapiens
MAAQQNVYGAISGGPMAILAGTLAVLLGFALVPVLVRIGHREPVAVAPTKEAGVIAMYESMMKVITGYGLISGFAVIGLTMWVSYWISDTFTKGR

SEQ ID NO: 955099 - protein, 65 aa, Homo sapiens
DVDTRVVLPIECPHSYELSYITRDVWALVSCAHIRLKNRCNSRYVKTNTTFTDYTYRGVYVLVEC

SEQ ID NO: 955100 - protein, 40 aa, Homo sapiens
GPATGIRDLLYSAGTAKSVFILDWGTHTRTHTHTDPEEGG

SEQ ID NO: 955101 - protein, 46 aa, Homo sapiens
HRPAAFADMTEGTRSRVLSLSFFHHAITRLHPSPEFLYHKINPQSP

SEQ ID NO: 955102 - protein, 50 aa, Homo sapiens
MTSRGDRHRDLNIYGVVASTNLFRNIINFGYLIEKVLLELQNDDPAFREK

SEQ ID NO: 955103 - protein, 123 aa, Homo sapiens
MGITIRRKLAALASLFDHLLESNALSGGNPVHGVKRPRIESNEGKTPALGDHQAKALLEEPDETTFGREWRDRGEYGLSFTISGLRPVKTAALLAGNATFQERPWDPNTLKDSRAKGRQGCRY

SEQ ID NO: 955104 - protein, 59 aa, Homo sapiens
MPVNFHAMSSPSLRIYTEAQRPLDIPLPLARAVQHPPDRIHTSKATDDPRMCASEIRPQ

SEQ ID NO: 955105 - protein, 91 aa, Homo sapiens
MPRTTGSSYHRSPFLDQIDILTLANRCTNYCELHPPHSFVAGLNGTVEGKRVIKKYKCGPLAAPLPRTTCIPALALFALSIPLSSSLLPKP

SEQ ID NO: 955106 - protein, 46 aa, Homo sapiens
FIGSPQISARSALKVLRFMGEPPCPDYFAYFLKCLHDSEFNPRSTE

SEQ ID NO: 955107 - protein, 80 aa, Homo sapiens
RTPGDGLSDLMKKDTTLVKSGELRAENARQMAGYSTILEAERRPLGLELSKKSAFDESSMGRQEPVLINQGEQFTVLPEG

SEQ ID NO: 955108 - protein, 62 aa, Homo sapiens
DGIGATAGTAPCRFAVNLQVLDPTAFLNVAYLQQRRFFTVQAVIEKDSQYRPIAHSFQSGFI

SEQ ID NO: 955109 - protein, 35 aa, Homo sapiens
NSDARSAARGLRMSVRRLYHSRAFFVLSLLGSFYN

SEQ ID NO: 955110 - protein, 43 aa, Homo sapiens
LITCSTYTHMYRRGDSLVLYKNILTVSDPEVSWLYPSYHVSCL

SEQ ID NO: 955111 - protein, 43 aa, Homo sapiens
ACADYRGYPARSTTPWRRWGKEGLTRITQLSIYLCADPTYFFY

SEQ ID NO: 955112 - protein, 90 aa, Homo sapiens
MYRASVPENEDNHTADCETPVAIDLDLLGHMELTKRDQKLFHAVKETLVRHSILREKPQTHSEKLMGWTLFADCNGVHVTTDLPILLWLS

SEQ ID NO: 955113 - protein, 74 aa, Homo sapiens
RLRGIMSGRTCLGRSRVGVTQLENITITFAMEVVSPLQWNHSKRGCEDLFAFQATAKSRVYRAWGATELPEGTE

SEQ ID NO: 955114 - protein, 65 aa, Homo sapiens
IDPHKLPDFVSYSEKKRTRGERFLDKIKPRSAAMRTTVLVVFVVCFSLFMSLWFFWRTLFLPEIQ

SEQ ID NO: 955115 - protein, 36 aa, Homo sapiens
GSYELYKAVIALDKTLIQARDVKLKSMLFNLTQSSG

SEQ ID NO: 955116 - protein, 35 aa, Homo sapiens
VEPQQLGDFIQAEARRLGRFHESHPCHVRRAIAAN

SEQ ID NO: 955117 - protein, 47 aa, Homo sapiens
KQSTPSLGGIIMDGLQSSGTTSSRFSAMLMATIQEQGPGLLGSLLKL

SEQ ID NO: 955118 - protein, 46 aa, Homo sapiens
MSGELTNECEAYYTIDRLDFKSTASKILLTQRWEAIDMGLRGAPNV

SEQ ID NO: 955119 - protein, 41 aa, Homo sapiens
KIHGLNVPFDAVVVAKSTVEGVISLQRETGMRAAERLIHFT

SEQ ID NO: 955120 - protein, 58 aa, Homo sapiens
YTILPYRIHTREPRVTLDKKIHLFIPPMLSIQTTLQIPWQMALSLYAIPVGKSLYSRI

SEQ ID NO: 955121 - protein, 36 aa, Homo sapiens
MDHGPGGWYVSSLLPSLLYPGTVLPTYIMLHVPTLY

SEQ ID NO: 955122 - protein, 113 aa, Homo sapiens
YWKRQHRLVKGIIQKELTGKGCADRNRSSHSKLQVSSGPVIWSFSLQAVFWLEGGVHKGTRPYLPRPFDYPLSLSNPLCSTCFHSCPSCKAILVFKTTVELEKGRWQYIKLKL

SEQ ID NO: 955123 - protein, 144 aa, Homo sapiens
VKIPAYPDTKHEDPAAEYRGGLGTYLRAMLKIVLRTPYCGLAENKLTQGAHAYEPMTAVSAATAVKSSTLQLLEGHDILATEGMHICRAQRTRVVDKDKTITESNDTIYSVTGGNLKASNGGMEGHPSDCSGHKTRDELKLLSG

SEQ ID NO: 955124 - protein, 83 aa, Homo sapiens
MGGGGTLLLNYGDRSRENKVVVVPAALLGPAEAHLPQNGTDGVLMQGRAWRRISGIDLIRGMRSLLGFEFHPRAYLGDHLPLH

SEQ ID NO: 955125 - protein, 57 aa, Homo sapiens
MTGAVAVIELMRRRADGWKAVRRSGTKPVSLLRNTVWCEGETFNEDMHGVESRGNWP

SEQ ID NO: 955126 - protein, 84 aa, Homo sapiens
RRVGIEGSETKATVGVKATVWVAEQRLAHSEKVMWSVVAGRSKSIRGAPASGKLRVHPIVDTGYRPPAGPETRKDASQEEGDDR

SEQ ID NO: 955127 - protein, 75 aa, Homo sapiens
KRASTESGTLRERETIMNAVVGESKDGMWSGTKEHNGGDKTPGPQTRRQRKRKSTNTAEVALEEYEGYGLHVGVP

SEQ ID NO: 955128 - protein, 79 aa, Homo sapiens
MIRVACFAEKVVPAGEAFACSIPTWAINIVIVCTIAVSGLATLMLRDNTWFTSDLDYTRGREAVRLTESVDLPLLCRLL

SEQ ID NO: 955129 - protein, 119 aa, Homo sapiens
MRVVYGRYSTMTVQLYGTAKKHTAQDIPQKTDNDEEGYKWEKERNYSLELRPKELRGAARTPIGTALLGALCTSYGNAGTKVRLLPHENKERAGERKGTQGMKIQQEELRTSGSYPDYS

SEQ ID NO: 955130 - protein, 34 aa, Homo sapiens
SFCTLLLALLLDTLLLAFAPFGGQKERVQKAGQK

SEQ ID NO: 955131 - protein, 66 aa, Homo sapiens
MSSGTDRLLATGPYIERQLGHQLRGGPHKALSTNDMKVQIRGIVHCGRKRVGYTQQLSNRTEQNVV

SEQ ID NO: 955132 - protein, 137 aa, Homo sapiens
TDFMYRTGWVNRYLQMAISGALCREPPARALKVGTDARGVERRTKIGLARKKSAMEKGGCLEPSKCRERAFETATTGHGFSAGRGRPCMEGQVGPKRKLYYEVRLCRWARVEHWCYMRVRDTRNRGKCERWKRKNRE

SEQ ID NO: 955133 - protein, 115 aa, Homo sapiens
MLDNGHIPDNIADIIAVLNVSAYCYLSYAVTTLLTPLSFDKYEFGFRLPLRTVMLLAILQYFLHLHVFIMQWRLFLIISNPLQMGDYLILSPVYFTYFFSIHIKPTEIAVHSGAN

SEQ ID NO: 955134 - protein, 154 aa, Homo sapiens
ATLTTRPGDYDKGKNIKQGIQKARKELIRGHGKRGCEKGPGIEKSDKHGKKKKAGCVDAARWTSALPHAATENRADGNREKMAKKLQTYTKYNLQLGQGHSTTEEGLLDRTDSYTIRGVKCGAACTLEETGVTNVLRKTCGYGHNYGRADQRFV

SEQ ID NO: 955135 - protein, 105 aa, Homo sapiens
VRLLAAAHGLVLWLLYPNHALRRAALLLVQASWAVNQAAGMADGKLLTTIGGYMATGVQREVIIAELQLGYCPGVIVRNLDLLRGLHVPLGWQNLLSRSCMARGG

SEQ ID NO: 955136 - protein, 63 aa, Homo sapiens
MGGKGYYAGYYGLYTYRHYEYGYCTSTDVDGCGYQERHGAYDGGENRGNGEKLYGYVERMRLR

SEQ ID NO: 955137 - protein, 145 aa, Homo sapiens
SGGRDIVWRANVPRNSCVIDGEGGRRLSNSVGTLGGKRVLRYERRLADDYALGLGDRWGRAMQLYACDWGRQVGRTWHGGEKGWRRDDVADLRRIAGEATNGETGRGMDGYVETARTGGVEMIWGDCGGCKVAKHDERPVLAEFR

SEQ ID NO: 955138 - protein, 131 aa, Homo sapiens
MLYPWGGYNCGIFKFYSAAADKFTAGNAAGSGYCGGRLAFDGYAITAATYAGRAVAGGTNAAWSGAVVVMQGTCGAGTFVGTGQEGAVRACGTYLGTGQTRAAEAVNGGTPAVGGLGVYYVAYGYVGNNTR

SEQ ID NO: 955139 - protein, 51 aa, Homo sapiens
MQKSFLIWVNEERSYTGDLHGARVVTLNEVFERFCRGLKEVERLIQERGQK

SEQ ID NO: 955140 - protein, 36 aa, Homo sapiens
VLLATSPSGHADSMNSVCCTSWLNKSLPVDPVSRQM

SEQ ID NO: 955141 - protein, 56 aa, Homo sapiens
VHKLQPFTIMAANATYPGEPLSRKKLYLCYTISLQTLLNYKHSAATVTNHIFILFL

SEQ ID NO: 955142 - protein, 144 aa, Homo sapiens
SRPASPLLHAACAYSLVALRIYLRLELYRSVYTWRQTDFGWNANLITADILMTYAIDQTNPEGTPGAIVVSWEGVEVATFTHRDSAEYFVDRDLANRRESDQPDAEEEPMRYMLSVARHYLTGKITTEHAVYALRDRPVAVASK

SEQ ID NO: 955143 - protein, 51 aa, Homo sapiens
MSRAESWNLLCHGHSLSLLFCGYQALGFGFWVHRITLCAEHLRSIESHYGL

SEQ ID NO: 955144 - protein, 45 aa, Homo sapiens
YATALYPGLQSETLCQKRKKETNPDDPLAIYSLSLKHLARGQQGG

SEQ ID NO: 955145 - protein, 47 aa, Homo sapiens
DSREIPHPMLTQQVQQSTHQLSHINCNTKATVYRRSNFDNSLDHTLI

SEQ ID NO: 955146 - protein, 52 aa, Homo sapiens
IPPSARIDMLCLMDSVIEQGKYNKLQLISNHEKYRKMVMPYIKIGEPSGKDN

SEQ ID NO: 955147 - protein, 41 aa, Homo sapiens
WAMHSTSTHSWGPGVPPTTPYPAPHPYSTYTTDTPKYSCVR

SEQ ID NO: 955148 - protein, 100 aa, Homo sapiens
LYHLVFTPLDHRVIWTFKPCYTKYSLEKIVSAVKDIPDENMKVWKDDNIENTIIVIEKAMKVINPKQYIPAGENCPDVVHDFTGFTTKLTKANMKEIVNT

SEQ ID NO: 955149 - protein, 51 aa, Homo sapiens
ARVHADSAVALTAPVYPALVIRFSSVGLPFFVTPLTGKIINLEVEPSDNIG

SEQ ID NO: 955150 - protein, 67 aa, Homo sapiens
MSEVRPITGSAVLITVGGDGGCDARCLGEPFLDPGKRQLLSGKSLRLSVKIEAVTSDSTWATQSLTE

SEQ ID NO: 955151 - protein, 85 aa, Homo sapiens
HVSNWSYSCPPTPQSRKQQIRATVLDPHHSSQQSQILNPLSKARNPNMHPHSTLNRYVYHCSHDRNSNTVIVKGIHCGRLNGEAK

SEQ ID NO: 955152 - protein, 35 aa, Homo sapiens
MTSVTLTAFTHNIVDKIVKLLVNKPGPPTLHNGLV

SEQ ID NO: 955153 - protein, 44 aa, Homo sapiens
TETRKGQEGEHYQRNNITEFPGGKGHRVLDIYNGLQRYFSTTGT

SEQ ID NO: 955154 - protein, 35 aa, Homo sapiens
RTDFKTDLRFQSAAIGALQWVLAKLYLVGLVRIYQ

SEQ ID NO: 955155 - protein, 112 aa, Homo sapiens
MRYVNIIGHRLYSDYSWIHIPNILDKNGSHSTEMGSPVQNLYLFGTARGKYNKRCRASMVVYGVDAEYLMNLHNEALDKVKIYELTSRTASVASFFVLQIIEHIRTVEGVTP

SEQ ID NO: 955156 - protein, 68 aa, Homo sapiens
QKRVTYDVVVLTRRNLGAPNLSESRAVKEDIEGAGKRNSLIAAICAGPTALLGHEIGFGSKVTNRTSC

SEQ ID NO: 955157 - protein, 39 aa, Homo sapiens
DEQPHSRRLRWDNHLSLESQGCGGAIALQAWAQGSGTLS

SEQ ID NO: 955158 - protein, 51 aa, Homo sapiens
MRDEAILHVIRYYTREAAVRELERQLASICRKAARLIVSEEKKRVVVTEKN

SEQ ID NO: 955159 - protein, 73 aa, Homo sapiens
QISLITRDSDLSSTHRQSACKLDFMFPQRLSRCLRLRTLGCWNRTLMTFDCHFVCSVETPICLLSIQYLLLPY

SEQ ID NO: 955160 - protein, 57 aa, Homo sapiens
VGEKQRRRLERMLGCVEWKAMVPYYTAEILKGMDYSDSATEPCLGEGVSGTQGAPVA

SEQ ID NO: 955161 - protein, 70 aa, Homo sapiens
MTVRVPLVPEPPHGVHVWPVSRRGVKQERWGVPGVRTWERDGWSSATGGFIAKEHLASASRRTAEQNRQA

SEQ ID NO: 955162 - protein, 70 aa, Homo sapiens
LADPYWQSWTVREYYGFKLPNHRAAKRLWKVCVEHHTFYMACFLHEHAPKAKFLNLGVKFPLIVCAPKSQ

SEQ ID NO: 955163 - protein, 34 aa, Homo sapiens
GSTSRRGALTAYLYGHTTDGLGESFPEVAVNFLC

SEQ ID NO: 955164 - protein, 38 aa, Homo sapiens
GGGGRANGLSPNLQSVLLDRSHRQHIFYVTALPVGGGY

SEQ ID NO: 955165 - protein, 111 aa, Homo sapiens
PKQKQHTNACLQLLRHVPVLSYTSKQCCSVSFFLSDYIVVFCSHILPSLMYRIFQKMDLTHSPFDSFPCKIYFCAEIMSNGCHIRVGVLPFDGYVSDRAIFAVKQCVCVFY

SEQ ID NO: 955166 - protein, 70 aa, Homo sapiens
LIESRYLGGTTQNDTSMVAIETLSRFTLYHPECIIVAFLLSSNVETSTACSSFSSIKNFLKDGLDSSHTF

SEQ ID NO: 955167 - protein, 49 aa, Homo sapiens
SSFPSYAAWFDYNSVHAIELEGLPEFFNGKQKSTHPEIYPWLVLLAYRS

SEQ ID NO: 955168 - protein, 89 aa, Homo sapiens
MPVKRNILQPVPPYPDYRLLCNKLKNCLPDSKKPSPNSRSPLAVRLGTRNQKSCLPALVWKIETSECKIWRGVSGETGGRVALRTRNPQ

SEQ ID NO: 955169 - protein, 69 aa, Homo sapiens
MASWCFGANEAKPDGEGACSLQNIPGVVYWGYNSLKFHPVIICALDNPVKNDWCGDTFLLCQILLHVLG

SEQ ID NO: 955170 - protein, 110 aa, Homo sapiens
RSRVSPSRVLPTGRLSMTHLQQPAQPINLAHKASLIDQQWSPRVVAEMNDYQFKVVRIEGEFIWHSHPETDEAFLVLEGTLRIDLPEGPVYVKPGELYVVPRGIEHRTAH

SEQ ID NO: 955171 - protein, 46 aa, Homo sapiens
MTGCATYWVVGREASVHAWAFRPTIINVNSGNAATSNSKAGWFISI

SEQ ID NO: 955172 - protein, 48 aa, Homo sapiens
IAGSHAKSFCVAGFWFNPPQLPAMTGLRLDDDVTDERLTVLRDGTTTL

SEQ ID NO: 955173 - protein, 78 aa, Homo sapiens
MTGQSFVLSVETGFLHAGQARLVLLTSLIHLPRPLACAVTYQALAPLSRSECPRFSNRNWDPLASFLASTPLAPQALV

SEQ ID NO: 955174 - protein, 51 aa, Homo sapiens
ILYEPEQALVWKDGQLVQELIKVQSAHCSSLAIKEYNMLKSAGLFADMKMP

SEQ ID NO: 955175 - protein, 55 aa, Homo sapiens
GEPGYTLRQTYAKIHITIIFIGVNLTIYTHNTYSAYPGMPRTYTRDSPQIAYTHI

SEQ ID NO: 955176 - protein, 42 aa, Homo sapiens
WVAATVYIRDEVDLMLYLGIFLLYLPKKKYHKKNLECTHKQI

SEQ ID NO: 955177 - protein, 69 aa, Homo sapiens
VDMIRIELVYLWVSSIRKGPQRWGEPQAGEQVSEHISCTEPLVTILLDHKQPVCNIISLHNVAPFSRTL

SEQ ID NO: 955178 - protein, 47 aa, Homo sapiens
QASPVVQAVAQPWAQATAGKPVQCRGSHSMQHISLHRAQQCGQAMHS

SEQ ID NO: 955179 - protein, 55 aa, Homo sapiens
TNHTSSSHITNTGTHMPTHAQTCMLTPSNMAANGALAVVSENGLVGMTDSERVPQ

SEQ ID NO: 955180 - protein, 61 aa, Homo sapiens
ADLQVTPYANPSRIRKHILFNIYMIAAVCLNPKCIFYNSPMVQVIIIIFIFVAKEKKTKHE

SEQ ID NO: 955181 - protein, 81 aa, Homo sapiens
QDYPRTPNNQKVSILQWTLAGCSVIQFQYYLPGDNIRIHRLKAQSPRLPPFFRHQSQAPDSGTSDHLLEDEFPILPPWAYG

SEQ ID NO: 955182 - protein, 51 aa, Homo sapiens
HEMYWDLPHLGLRGPRERSRAKLVLHVVVEVEGVSGYLSTYGHIYPSAYSD

SEQ ID NO: 955183 - protein, 79 aa, Homo sapiens
SNDAHFIFIEMVSGSLLKVVFPFVINNVFHEGVSRNDISIQSSSFPLYSFIYLIPYGCSIYLYFWGGTGGRGTRRLGIS

SEQ ID NO: 955184 - protein, 88 aa, Homo sapiens
RILPYANDYQCYHYSRAQVKSELTTLSSYGNANADGVAVWWHVSSYRQVQLKEAKKSNLGYGILLKATKVSRNTTKLMGQVRASRVPR

SEQ ID NO: 955185 - protein, 39 aa, Homo sapiens
SDLRSQENLIMYLAEIMRYSCPELEDSQRASCCIHTSEA

SEQ ID NO: 955186 - protein, 42 aa, Homo sapiens
AIYDPSRTPMLSDKVKVKRTLPNHSATTRLEAPQGLAILTNT

SEQ ID NO: 955187 - protein, 39 aa, Homo sapiens
DPYRTPTLRHNFLEKSSSINYYVNSSCVWKSGYIIYYSN

SEQ ID NO: 955188 - protein, 41 aa, Homo sapiens
MGVRRPGCFLLVRKRDSSRDSGLEKHVGPAGRPLLIARWRT

SEQ ID NO: 955189 - protein, 73 aa, Homo sapiens
AQGGSIAETHLQAGELTKFQRSGACDWCLKKGGSLGDLKPSNLWDSDVISREIVLGLNYRTPQLVSTGRNLIA

SEQ ID NO: 955190 - protein, 69 aa, Homo sapiens
PDLTRTPNDVPSPYEVIGFPTIYFSPANEKLNPKKYEGGRELSDFISYLQRRSYNPPVIQEEKPKKKKK

SEQ ID NO: 955191 - protein, 58 aa, Homo sapiens
MPCYFFFNFGRDEVLLCCLKLEANLELLTSSDLPILVSQSVGVTGVSPCVGAYGEGTE

SEQ ID NO: 955192 - protein, 132 aa, Homo sapiens
HHHSSATVDSTRVKREHMHLRQSSCRRLLFKGKLEERRLNNATSQAQHQVQAGLFLDVVSDRVLAILHLFAGKYQTLLLRWDTLLVLNFEALTFSMVSLGSTSMGDGFASEGLHKDLHVCVSSAASLKQMRW

SEQ ID NO: 955193 - protein, 104 aa, Homo sapiens
GVHAKQLCEEWRKCMPIPISVIRRILREKQVGCRQQWLPRNKSMGHKTAVYSSMEEQLAAAVRHVSCFAARAEVRPGRAVFPTLRWVVYLAGRRKPLNDVDRGA

SEQ ID NO: 955194 - protein, 40 aa, Homo sapiens
PNYPCYTCYTEASVLEMKLNVDVMITDRDIDLCRYKNFHV

SEQ ID NO: 955195 - protein, 50 aa, Homo sapiens
SRHRTRYLGITAHPILESISTIGFTNSMLAQDIPMDAAAIKASLVQRLKS

SEQ ID NO: 955196 - protein, 116 aa, Homo sapiens
VIKIHTYASSGSVTVTESNWLFSIVGRRFSTVWQVNLISSVEKEAEEENKKKKRKRDMRRRLSLDLTIHGFLRVELGDPCLMTIFGSQDVVAQALGGRVIGPGGGGLHRLGGLAGK

SEQ ID NO: 955197 - protein, 51 aa, Homo sapiens
GVIKDPLELSFHYCSGFQGSDADLVAKLSRNYLKQGYIEKTGPSQRKALRG

SEQ ID NO: 955198 - protein, 49 aa, Homo sapiens
MSEHYTDTHAHTAHTHAQHTVNTAHTHTHSTHAATHTYTHSMRSPIRKT

SEQ ID NO: 955199 - protein, 37 aa, Homo sapiens
SRSVNTRIIEWSLHCAQSRRSLHDRVHLGDRSCTLPA

SEQ ID NO: 955200 - protein, 38 aa, Homo sapiens
VRIPGFVSAQVKGKIFVGEVNNLKVRDVHGDEEVSALG

SEQ ID NO: 955201 - protein, 70 aa, Homo sapiens
INRSCGSLHDLALLLVSLFESPLCRDIATGLNLWQSNGDYQRTTSERSQAQEYPIRTHLEAYVGTSSNRI

SEQ ID NO: 955202 - protein, 67 aa, Homo sapiens
RGLVVERAEMWVVGIELGLPWEVVDGSTKADVVDEEVQAKCPLSLASYGNVRRFSLYGIVAAGRGTD

SEQ ID NO: 955203 - protein, 64 aa, Homo sapiens
MRDVLIQHSRIVNPYLLIWTSRIGLRCYPKCNLFRWVSLLDQLRILVRFDWRSHRHAVNLRGTE

SEQ ID NO: 955204 - protein, 89 aa, Homo sapiens
GRRTVRLRIKQRHCRKVFHDPGTTSLYSLFESTSAEIKRTGSLKPFWFWVPNGNGRLSTHDIGEKQAQDINTNTLEAYVWVRARNFGKS

SEQ ID NO: 955205 - protein, 88 aa, Homo sapiens
MQSTLALTSGRASMLDSVLVVISILYRPRVHNVFSRGAPSWVTSSAIIRRTPSQTLNVTCACRLGPPCELCMTQLNYTEQTAREQSRI

SEQ ID NO: 955206 - protein, 52 aa, Homo sapiens
SRIHTYAQSDDQSVFYTISSSSSARDLLKLHAPASAEAQSAFYSHAEDTSFT

SEQ ID NO: 955207 - protein, 111 aa, Homo sapiens
TSSVDHLGMIWTIILRFAIQDISVGIDLGYGRAPSLVPENRQPSYNNVNVLETSTISWKDGLAFHALIQRHRPELIEYDKLRKDDPVTNLNNAFEVAEKYHKIPKMLDAED

SEQ ID NO: 955208 - protein, 145 aa, Homo sapiens
MATYDSTSQYSLYPIGHPVHHGLTTVAPWPAAYPAVTSYPPLSQPDLLPIPRSPQPLGGSHRTPSSQRNTDFSNSVASYENEEPACEDADEDEDEYHKPSYLVVLPDSTPATSTDAPEAPALSTPGIRDSRFSMESIDDHVTILR

SEQ ID NO: 955209 - protein, 64 aa, Homo sapiens
MVFREGFSRRSWNFDCLADTRDLWAVHIFDVSLVTPDDGLRQVYTKICIPTLRRRTQVARGSER

SEQ ID NO: 955210 - protein, 51 aa, Homo sapiens
MISLSCPHDPPASASQSAGLTGVSHRRSRQKVYYHYLTGSPRTREQISGDT

SEQ ID NO: 955211 - protein, 122 aa, Homo sapiens
VGDSKDPTRKRFPNGNYSPHKRQGGINLLINVENDNGSYFNGRGCSANVILVFFEKGMDLAKSALDLTNKLVDKRVNSQRSEGKSNSQRVRSIFESVAKQKADLFRLLLLCPASSPKTLRVG

SEQ ID NO: 955212 - protein, 67 aa, Homo sapiens
IQRIYTYAFTYLYDNILLHLQEYYFSFIIDIHSYALKKIIAISLHYFYHIMRSSNLSLYKKPVSGGH

SEQ ID NO: 955213 - protein, 40 aa, Homo sapiens
THYQEIANALESRIDDFKIHIFGLVQRIKIMSGVQVPEDV

SEQ ID NO: 955214 - protein, 34 aa, Homo sapiens
GPSSVNLVLRWLGQEAEVRNQRWEDQCGPVRSTE

SEQ ID NO: 955215 - protein, 58 aa, Homo sapiens
KLMCYAGKRHIGGTIIRGTGQLPKPPIMVGITMKKIITNAWAVTITCRCGHYREDCWL

SEQ ID NO: 955216 - protein, 50 aa, Homo sapiens
QVDRLHNSTSASHTLCPKLYLLATAERVFGCVWKNQAVSHPSVPLLKVCL

SEQ ID NO: 955217 - protein, 68 aa, Homo sapiens
MIGHARASGPGRHQRGVLNPNSRQMRSGWWSSTSVGLSFVPEFLGEALSPSRGEGHQGPLVSPEDCVV

SEQ ID NO: 955218 - protein, 77 aa, Homo sapiens
QRALGTGSHRNQCLPGDLAMEMSTQVDSVTSPYALTWWPQSRLYEQPRFHTTDHSRRVQADLRTQSRRVGVLSTPLY

SEQ ID NO: 955219 - protein, 46 aa, Homo sapiens
QPSLLEVEPSYIIKNVKAKFQDNEGILLISRVDLCWDIAGRLTHSY

SEQ ID NO: 955220 - protein, 41 aa, Homo sapiens
MGASIIRGTSQLPSSDYSGYYYEEDYYKCMGCDDYVVDVVG

SEQ ID NO: 955221 - protein, 69 aa, Homo sapiens
VFHLSRRGRCTGSPSNLVPEESVYGEKRVSDYREGDDKIEYLDAWNPFRSKLAASILGGVNQIHIKPGG

SEQ ID NO: 955222 - protein, 30 aa, Homo sapiens
MSSMFSSVASLAPTLSPRLDPLSSLRISLV

SEQ ID NO: 955223 - protein, 44 aa, Homo sapiens
MGEYEISWSRLLYLPCRDYSNAHFSAREDARLYYVHDEPLLRYL

SEQ ID NO: 955224 - protein, 33 aa, Homo sapiens
SLALSKEAFVPVLVIQNDHWKVGSVPTGHLLAA

SEQ ID NO: 955225 - protein, 48 aa, Homo sapiens
ALFRDNTRQPLRIFQNKRVSIKAERQLVNSFLLDKLHVIFSTYPVGPH

SEQ ID NO: 955226 - protein, 34 aa, Homo sapiens
VLSNVAVCTSVFSNAVPGHACRCSVNAGRVHSRC

SEQ ID NO: 955227 - protein, 36 aa, Homo sapiens
DLVLSLAQSKEASSGLVIQNDTGNRFSPTVIVAAIT

SEQ ID NO: 955228 - protein, 72 aa, Homo sapiens
QLVRVPRSGQPDRRTLPNSSRAAGTTVTHMTLGMRRREDIGKFLPVHLEKGILKNDPFQILDRTVWDTLIRE

SEQ ID NO: 955229 - protein, 51 aa, Homo sapiens
HNIQVTKNLQELVHMILWEGLDTAYACYDDLKRRSLRDSSPTPRKDCLAGC

SEQ ID NO: 955230 - protein, 69 aa, Homo sapiens
MAGDGKMLKLSSSSLGNKSETLSLLQIQKLARHGGACLYSQLLERLKRRESLEPGRWRLHVGPTITTLH

SEQ ID NO: 955231 - protein, 83 aa, Homo sapiens
TDLTHMQFLSATSETIPIRSDCLRGRADYSPIRLLDINTYKLMCNVRYDITEFFSQHGNIIIFHISFLQAFLGDRYYRIAALR

SEQ ID NO: 955232 - protein, 106 aa, Homo sapiens
DVNIVNMPEIYTFFFGNRSQSVTQACTQWHNYGSLQPHNPRLNYSCPSVSQVAGTTGVHHHGWLFLRKKMFVERVSPYLAQACNKLLGSSNPPVLASQNPGFKDMS

SEQ ID NO: 955233 - protein, 47 aa, Homo sapiens
NDTYPHLGYHQPDEANQPERLNAGAYFLCYTLSRLPSPTHRTDLQSE

SEQ ID NO: 955234 - protein, 63 aa, Homo sapiens
MPVPLGCRHEAYQHRAAAACHLARDSVGLADLVRPVASTHGDDGELVQDDGPTDGGGQLLGAL

SEQ ID NO: 955235 - protein, 158 aa, Homo sapiens
KRCQLCNLLQKVTSSQSGFGTFTAGLRNHKACTVLHEYVQSRLNFSEGVWYLSSSREEDNAPVEGVEAFCLIHLGSCVPQSVGITLDGCELRNLSGFAVGARAMSAKNSALAEAAKYSDVLPEISSSSSPSMWLYKTLEDFIKAKLAESLQGVAKESR

SEQ ID NO: 955236 - protein, 62 aa, Homo sapiens
VDSFNLSTLITSTRTHLDYSCQHDPWTITMIDRPHYSRDQPENPLYDLDRNGEVRELGLQDF

SEQ ID NO: 955237 - protein, 40 aa, Homo sapiens
LSLVISASPRHNYLPDPGGWARSDWLYQMHLDRQESWLSG

SEQ ID NO: 955238 - protein, 79 aa, Homo sapiens
IYGSLSYERISVTALFRTRYKRSPASASRVARDYRHATTMTRLIFVFIYVADEVFAIVWPRRGLATTCTSRLILPDLKP

SEQ ID NO: 955239 - protein, 67 aa, Homo sapiens
LSAVNAPPSAVSRLFACAEGRAVNIAGLPQTCVHVWKRELRICVYIIDYARESQISLFYFRSEKPYR

SEQ ID NO: 955240 - protein, 106 aa, Homo sapiens
MWVGKRPERLEGVGVAPLCSDQYRKNFFVEEEDEKVDIDFGLVEEFHDSHTLILERQEILIVKLKSLHVHTQELGIYFKLSCLISRRDVKDDVSEVRGGKIFNFHQ

SEQ ID NO: 955241 - protein, 77 aa, Homo sapiens
VSSAFPAGEQYMPRLHQSKRATILNGPNKLTNGSSYPSDNSSKPILEAITTVGLTTSMLDQNIAMEQPLLKTLMFND

SEQ ID NO: 955242 - protein, 97 aa, Homo sapiens
RTSRCVFQRRGGFPEAVISKAGLGCDSEARRSPRDESCLNFGASHLLREIPGFSRHMHISQKTHTVMDTQIQKILVGLGVRPTAGTARALVFLPPER

SEQ ID NO: 955243 - protein, 68 aa, Homo sapiens
MYDMAQNPLLGAAFCQGNLCSGNQTSAPMRLGSGLQREPGSRLAQAPHKRPRRLWADSGSEGTAASLH

SEQ ID NO: 955244 - protein, 75 aa, Homo sapiens
MGVLLRLQKMVILLAPVVDTSVPCAIYKLASAFRNLELIKLSTGESIGSTLKSVWTSEVFQTAPGLHSHQYYTCE

SEQ ID NO: 955245 - protein, 36 aa, Homo sapiens
WVYYEEDYYKCMGCDDTRCRCGRYPEDCWWPMKIVG

SEQ ID NO: 955246 - protein, 71 aa, Homo sapiens
VSSASLVMGPVSRVAVLCLRFVVMGPCSGCCSVCELRGDGAVSRVTVLCVSIVMIGTLTRTGASTRYETRE

SEQ ID NO: 955247 - protein, 32 aa, Homo sapiens
MPWACARIHVVSMWSITTVSIALAWEGILSAV

SEQ ID NO: 955248 - protein, 130 aa, Homo sapiens
AFPAGISSRPPEAPLQTGISSRPPESRAPDRHFLKASGVSPPDRHFLKASGVSPPDRHFLKASGVFPPDRHFLKASGVSLPDRHFLKASRVSLPDRHFLKASVVSPPDSYFLKSSEVFPPDSHSLRSLEA

SEQ ID NO: 955249 - protein, 78 aa, Homo sapiens
YPLSDALFVAGVARGVLSTRSLGLGWGGGPLRAPSRLPGRLAPSASLALAPAAAAAAAAAAAAAEELEDDDDEQDLRR

SEQ ID NO: 955250 - protein, 46 aa, Homo sapiens
MLLRSSLRIAGALVNPGHPRYEVVSGKGMIRVSWGRNDLTYSQTLN

SEQ ID NO: 955251 - protein, 93 aa, Homo sapiens
MSQQPLQHQQAAVSYSARQQVFKPSFNSTHSTGNTSGGGGGAAMSHIQQEVKPQTTPANNSTVKSTNPSVLSSLITETSHQNLRILRLGPSDI

SEQ ID NO: 955252 - protein, 56 aa, Homo sapiens
MLCGPPMNLEGAVGTLLWSPRRRTSLLRVVMSSLLGDDVVDGLVLPASDEQGEGYR

SEQ ID NO: 955253 - protein, 49 aa, Homo sapiens
WPVVDNVASPKTQSWHLNCDNQQMPHPGPHRWMIGRALAVCPKSWEGYT

SEQ ID NO: 955254 - protein, 73 aa, Homo sapiens
APVLWTVVSPLAVAGDPMCLADLPVTLPASPDCTIVPGTYGVPTAMDRAGAREHVCQDGLIIHRTVYRRSNFD

SEQ ID NO: 955255 - protein, 82 aa, Homo sapiens
LRGSARLIAPRFPTAVNAQTGYMHMWYISPWNTTQPCQEHDRLGVVASAYYSSTLGGQGVWLAGAQEFITRPDDRVRLHLKK

SEQ ID NO: 955256 - protein, 40 aa, Homo sapiens
YASVTAHPILESISSTRVYDLECWSQDDPDGAAAIAEHGG

SEQ ID NO: 955257 - protein, 198 aa, Homo sapiens
RLRPIREYYKHLYANKLENLEEMDKFLNTYKAPKTKAKEEVESLNRPITGSEIEAIVNSLPTKKSPGPDGFTAEFYQRYKKELVPFLLKRFQSIEKEGILPNSFYEASIILIPKPGRDTTKKGNFRPISLMNIDAKILNKILANQIQQHFKKLIHHDQVGFIPGMQGRFNIRKSINVIQHKQNQRQNHIDFSIDAERL

SEQ ID NO: 955258 - protein, 68 aa, Homo sapiens
REDIIAGYGSYDTKIIQVLTFQTRDVTAAANQMRNFRVLILLMPSLRTVGEIFDSWGLDGDSYELEGH

SEQ ID NO: 955259 - protein, 49 aa, Homo sapiens
AHTRTHMHTQHTHKRTAHTNAQHTAHSTSTLHDAHSHTERTVTRTHIAH

SEQ ID NO: 955260 - protein, 51 aa, Homo sapiens
RSCVYQLSSYQQEVNVRIPDGSKMRVFSHQRILYIDLLLVIKNSSLMGARC

SEQ ID NO: 955261 - protein, 36 aa, Homo sapiens
LRSSDQRHCVTLRWTAVFDNQQEVNYRNPLYGTKTA

SEQ ID NO: 955262 - protein, 95 aa, Homo sapiens
MGTGHQLLPANQAQSSPLSDFLPEVQDVSKLMAWAQLTFSERQDVVGDDYMGLRSDVKSLVDQCGFSDMPSHVNGGRVCYYSGALRPYIHPRPQR

SEQ ID NO: 955263 - protein, 69 aa, Homo sapiens
AHLPHNVLLVWAVVLFVLCVRVLCVGVLCARVCARVCVYAVRKCVLCVSVCAVCACVCVCVPRYLIEQV

SEQ ID NO: 955264 - protein, 43 aa, Homo sapiens
LANHIAVLPTIRCQPHPDLPTTHLLPTNHRLANHITVLTTTSP

SEQ ID NO: 955265 - protein, 36 aa, Homo sapiens
NHNLLAKHITYHITVIANHITVLPTTSPHITVNHIT

SEQ ID NO: 955266 - protein, 50 aa, Homo sapiens
TFSYTSGDIRKHTTNNTDINTTHEQTQTHIHMHIDTQAHTREHSTHEHST

SEQ ID NO: 955267 - protein, 54 aa, Homo sapiens
KPATEFEGVDSELSSQPLLKKPLLSMLSSHTLKLARMESLTVSLISCTWLLRKL

SEQ ID NO: 955268 - protein, 39 aa, Homo sapiens
SVDISALPISAYTTSPFANLITVLNHIPSCQPITVTTSP

SEQ ID NO: 955269 - protein, 44 aa, Homo sapiens
YPEKASELKYSTYVTVAANTPRYMAVSTGHILIRIDFLIWGPGL

SEQ ID NO: 955270 - protein, 60 aa, Homo sapiens
SCYPFCSSTSAQHTHKDTAHTVTHSTHTRTQTHTHTAHTQAHRHTNAQHTHTHASPQLHT

SEQ ID NO: 955271 - protein, 135 aa, Homo sapiens
LLENLAYMKSSGTDFEPFVRNDIPLEKHVASLAKPGTFAGNDAIVAYARYHQLNVLIYHLNCPFVADSWYREKQRAGVQIVCRYGEHHDSVRRILDNSEAPAYLQTDVSKASAYSRYSPPYWIQIESCISGAKNQ

SEQ ID NO: 955272 - protein, 64 aa, Homo sapiens
EFPPVTDTSMYLSPELLAVGLVHCLLDQLYAFTIMCASMGHRDPIWPRNHPPLRKSLLYSLVDP

SEQ ID NO: 955273 - protein, 70 aa, Homo sapiens
VWGGWLAGQPLRDRGWAGAEQALREGLLGTPETRGRHGRLGWGQSKGPERGRDLLKVILPVLADPVRHNR

SEQ ID NO: 955274 - protein, 69 aa, Homo sapiens
MFTKLFVPVLRTEVGANRPAGSRMHAVVWAQKAFPRPILRSPRRRIRVQCDSGAGNPQQSRRTHVRDKR

SEQ ID NO: 955275 - protein, 42 aa, Homo sapiens
MLPQNYYARGSSLASPSRCRLERYQARLELWVSKSSTLPRAS

SEQ ID NO: 955276 - protein, 39 aa, Homo sapiens
TLHLVSRWLPSVDLNVNSNEGKQKKRGGGGGFGYQKTKK

SEQ ID NO: 955277 - protein, 33 aa, Homo sapiens
VRSPARRLYLAGGLCCFVFLLDLFARHARLLVD

SEQ ID NO: 955278 - protein, 35 aa, Homo sapiens
LQETDYTTLIKATNFIGGLQYLYIETIRLLPYHCI

SEQ ID NO: 955279 - protein, 59 aa, Homo sapiens
LFKASRLVNFMENSTLIPFISITSVLPVLGLHVFVGPAVICPLPMILSTISLLSLLTLV

SEQ ID NO: 955280 - protein, 42 aa, Homo sapiens
LRLFPGTSTVTVRADAYAKEAVRMALVNLGAVAAPAGNMPVV

SEQ ID NO: 955281 - protein, 42 aa, Homo sapiens
MAAKHSKLTCRFCRKSFSKRAQVKRKVQLFEMNARTVVPELD

SEQ ID NO: 955282 - protein, 58 aa, Homo sapiens
IDLYAELSGTTSHFDTITDPPVVLVTAKVKPCAHCVSSALDLLFAFDEACWHRRGAGR

SEQ ID NO: 955283 - protein, 70 aa, Homo sapiens
DISKHNRSGARLTGMWELNQQVLLAGQLLTFSVILNVSDNQRRTLAVDPFICEYNATRVPPLYDRGNLYR

SEQ ID NO: 955284 - protein, 30 aa, Homo sapiens
MSLFGYDYQREMKWPPGAPRLSYQLTYTML

SEQ ID NO: 955285 - protein, 39 aa, Homo sapiens
MSYSFFTAAYIWCLLALTSHNEHKCVVVFYPSSMARLQW

SEQ ID NO: 955286 - protein, 37 aa, Homo sapiens
LGTYRSGVTVQHLVLGVVHHVAIVDFITVWIEHWDEV

SEQ ID NO: 955287 - protein, 50 aa, Homo sapiens
TLAFIRRRPVRIYIGICLEGNRKGHGFVTAYTLELSRADKLMDAASSEIR

SEQ ID NO: 955288 - protein, 114 aa, Homo sapiens
MCPQLSLEAVAEEKLMEPYFPKTLRELEVVEGSAAKFDCQIGGYPDPEVVWFQDYPSIRESRHFQIDYDEDGNCSLIISDVCGDDDAKYTCKAVNSLGEATCTAELIVEHHGGR

SEQ ID NO: 955289 - protein, 81 aa, Homo sapiens
LLLPVSTSLDRMTGCGQNAGHLGLGQTGSQPRLGNSLNEGSVLFSMDGLRHERALVERPKKLYPVLRYLKTRYSVFFIDRG

SEQ ID NO: 955290 - protein, 128 aa, Homo sapiens
AEKLESEEDVQAFSLRLLLSEKPHVTYFSKTIRDLEVVEGSAARFDCKIEGYPEPEVVWFKNDQSIRESRHFQIDYDEDGNCSLIISDVCGDDDAKYNCKAVNKSWRSHLHSRAHCGNDGGRAKGEDE

SEQ ID NO: 955291 - protein, 119 aa, Homo sapiens
LQDLRSSAAHNENFLNTSWSSPAGMGSGLCDPSDESPSQEHHWTLSSWNRIKAVLSVACVQVFQTLGEDWYVLVGVAQDQILNPRSVAGGFVYTYQLVDHGEKLEFLHKTPVEEVPAAI

SEQ ID NO: 955292 - protein, 105 aa, Homo sapiens
MWVRRLLRTTIVVMSELITVYLAPVTDEAVYAPSPSRCYQETGLLLNPKFLGETYIRRVRMRPGVACSVSQAQKDELLLDGNDIELVSNSAALIQQATTVKHTDI

SEQ ID NO: 955293 - protein, 86 aa, Homo sapiens
DVEHAHVLFLAAFTRVCSLTKVHNLSRFDSLGQKLWFLFKVVMLHTKLSQKKPGVVYVEVIRVVIADHPALPRAPGFFRVLAYAGG

SEQ ID NO: 955294 - protein, 66 aa, Homo sapiens
ELGRSRTRYQPSTARYAVSDHTITRQYHQATWKLYEHYTYREQSFCQCQLDNCGLLSVTDTGDAGK

SEQ ID NO: 955295 - protein, 38 aa, Homo sapiens
MMIQPEVAVQDDSIRSPHFRLLDEEGLLFNYQVMFAGM

SEQ ID NO: 955296 - protein, 36 aa, Homo sapiens
AAQHIMPDPQPTKRSQGLNPQPHGSYSDSFPLHHDG

SEQ ID NO: 955297 - protein, 36 aa, Homo sapiens
LRRLRCVRGAVVVGGARRGSVGAVGRCRVRVGSGGP

SEQ ID NO: 955298 - protein, 38 aa, Homo sapiens
MGYEMMSSGAVNGYCRIRLRVNPAHGRQYQWIGAGDML

SEQ ID NO: 955299 - protein, 72 aa, Homo sapiens
LEDPRYNAKAIIMVMLCMMLIQCRAPKLSVCVPDCITSRSRCYASGEHTDIFECTELIKIMHNISLMIALAL

SEQ ID NO: 955300 - protein, 97 aa, Homo sapiens
DLEDPRYNAKAIQHIAEATLDICGGGAPRARIEDRDIAEDARHQFTAFCSLPPGRFRAQAQAAREFQRAPPEVLGFGVITLTPGRARSSQSRIALAL

SEQ ID NO: 955301 - protein, 83 aa, Homo sapiens
DPRYNAKAIRIMPSGRTRRVKPFLRSCSQPRVVPTAIFHPNRGMQMVGEHDVSKDGMRNTFARRAPCGKKRIDFTDQKIALAL

SEQ ID NO: 955302 - protein, 98 aa, Homo sapiens
GYNAKAIASGSLFRRVVLRGINGTFGARAATEAAGGSVKRSDPAVATMTAPGFALGKFADLKRRLWFLVGALIVYRIGAHIPVPGIDPVQIAKLFETQ

SEQ ID NO: 955303 - protein, 66 aa, Homo sapiens
EYPKRQIEDRLAWLIRIFVWLVFFFLGLDPGLKMERDKGNSSRWKEDSPKFHKAAENLDGPWWFLN

SEQ ID NO: 955304 - protein, 35 aa, Homo sapiens
LCWKLDRRTCLTTTSERVTCTVLVLEVDQIFDFDA

SEQ ID NO: 955305 - protein, 63 aa, Homo sapiens
MRVSQLGMYVRVAIETVPCELVQNFDPYYPIILGGLGNSEGNVGHVPMHLKQHRWYKKTLKIT

SEQ ID NO: 955306 - protein, 160 aa, Homo sapiens
AWQGPMHLRDDRILMCLESNAHCLTIVSNRGAAGQVLHEAAAQVVQWVSFADSDIVPPGSTWVFPTLGIMHHNKQATENAKEEVRRILGLLDAYLKTRTFLVGERVTLADITVVCTLLWLYKQVLEPSFRTGLSQLQALFPQLHLTKPQFRAGLGEVKLC

SEQ ID NO: 955307 - protein, 111 aa, Homo sapiens
VISENRLPLTSENKWCQFSAGVQFAENNGFQLYPCPCRRQDLIPLYGCIVFHGICLTGNFPTDLPLIMWALVTQTICARHSGQSQHHSLRLAPRPPSTPVTLTPFSLHRDH

SEQ ID NO: 955308 - protein, 44 aa, Homo sapiens
DPEDYTVRRIAPVHCQRIDTVTVKRIAPLTVKRIARVTVKRIEP

SEQ ID NO: 955309 - protein, 34 aa, Homo sapiens
MVHGEVYNFGIVIILTVYLFVAIAIQAPYTWETV

SEQ ID NO: 955310 - protein, 49 aa, Homo sapiens
SDSRVSQRIDRHLSGGLTAHCKADVNRHCQRIERHCQRIATPLSRRIAT

SEQ ID NO: 955311 - protein, 37 aa, Homo sapiens
NICRVDIIPASSCCLCSYRLNVQTTHNLYSLSHPACV

SEQ ID NO: 955312 - protein, 106 aa, Homo sapiens
MPAIHHKGRFDLRYCADQFLESLHWVIPLDYINEISLDCPGLEWSTDTGQHITENDYYTPTGEFRVDREGSPVLFNCLMYYIVTIALDGLYTEAKRPPGFDRLRHA

SEQ ID NO: 955313 - protein, 45 aa, Homo sapiens
TAEYRFEQQNFDRCVGYRGGIIAPPNIAQPFAAAINVVGEHSLRP

SEQ ID NO: 955314 - protein, 46 aa, Homo sapiens
LELELNFSVLPLLCLMLCEVLLEEFCKLTEQSCSNVPWDVAALPGV

SEQ ID NO: 955315 - protein, 100 aa, Homo sapiens
MRGGRPRLCHTVDATIYGLCMWSSVCEINKVQAGLEVVVGVLKEESALPQILGFPDVRPLEDARGAFLSTLLRHIICSLCRFLWDRLNKMIRMIKCEQKD

SEQ ID NO: 955316 - protein, 151 aa, Homo sapiens
RVVLETTGSDCTEASQSRAAFPVLRGTSISSTGPACLQSQQMIPVAVKRIPAFWTVSFGWQLPKIDAPLKLTVCRRRNPQKLIYRLRTTLDYVLNVVTLKQKHVLCGYCYEKVCKETCRNQTTAREARRGAYKGSHHRDCGAVHRRDNRSE

SEQ ID NO: 955317 - protein, 41 aa, Homo sapiens
HEDSLFYIYGSHFFGHRLPRTSRHYWLTFLTICFIRQLIFH

SEQ ID NO: 955318 - protein, 50 aa, Homo sapiens
PIYMRIGLVGHVRLKSGRVGEAEQQPFVRLQFQASSQEGSLLTAWVGAEQ

SEQ ID NO: 955319 - protein, 95 aa, Homo sapiens
GIFSLSFWPKDQASKMYLISNKWRPGHDGFSQTADSSIGASCSFPGRFISLINLEGRSGRVSTGHRDRQHPLRKQLHWKVPGVPGHIFARSSSSP

SEQ ID NO: 955320 - protein, 96 aa, Homo sapiens
TRGPHWIADKGDGGCEVLQKTRFKCLFLFYQQRRNESRVEENAHLRQSVTGQLYTQDQPVIDKSKPWVLLLERQRNNLAFQGRRKARDILQALGSS

SEQ ID NO: 955321 - protein, 65 aa, Homo sapiens
MDAGYRDQKRRSSVAITAIAKYRWNFVVAQCMLVLLRMRRAVACLTRAETGFNVWKYTSCHIHKV

SEQ ID NO: 955322 - protein, 103 aa, Homo sapiens
SGVIHSSWWVRGLAGFRREAADLCGRCYQQINAMRTQMSEQQQDLLQRAQEQSFHSVEGDQSGLLLLAQAACIFFLFFFFFFWARGENPPFTGTRVQIGTRGK

SEQ ID NO: 955323 - protein, 70 aa, Homo sapiens
EVVSPISQGSCADELCRMSRGAILNVTQLVQKRTADHCDSYLICWLGLIPESTSVSAQNSDTPLLPPAVP

SEQ ID NO: 955324 - protein, 31 aa, Homo sapiens
MRRSLIVIAPLSPKPLTIQGCTDQTAGFQAV

SEQ ID NO: 955325 - protein, 42 aa, Homo sapiens
IELGTCQKLRALFIYLPIHVADSDGGRGSLLRDLAEAAPAGV

SEQ ID NO: 955326 - protein, 113 aa, Homo sapiens
EVVSPICYAGDTPCYLDATTPALDLILGGRDAIIRFVVECLIEEDDTPMQGFTRSSACQQQLGVRKRRFFSVFSVPMDCSRLANAPSGLILAARMPLPGATMLVSDVRQFLLL

SEQ ID NO: 955327 - protein, 101 aa, Homo sapiens
FLINLAYSNLCYFHDGAKVNIHSHISTPDFFLYNCVCVCVCVCVEEGSGEKSDNLSVRKESSCLDKGRSLSVAIMTGGKCGPESKARVGPPGGKERTEFAL

SEQ ID NO: 955328 - protein, 38 aa, Homo sapiens
RLGVEFMFQEPRPSQSQGFTADPKPLSTSAKAVVNIAD

SEQ ID NO: 955329 - protein, 107 aa, Homo sapiens
NWKNLAGIAHLLSSPGLVYETVTTYGQARQWLTPVIPALWNAGAGGSLEVRSPRPAWATKARLRLQKKKKTCFSDFHCVTIDEPLMIHNYKLGVVTCSLSILQVGLI

SEQ ID NO: 955330 - protein, 69 aa, Homo sapiens
HTAEVRTVILQNGKFCCLILLLKASSQRGTWLYEVSVGPYWEVISHLGYSRVRDPLEEAVYLFSDLKLH

SEQ ID NO: 955331 - protein, 54 aa, Homo sapiens
MIQHSRKADVSGNQVCSNTTNSLVLGTTASAWSTDQYSEKCINTAMMITLSGAG

SEQ ID NO: 955332 - protein, 87 aa, Homo sapiens
MADDVLLIIGGSDKITYDSDRYQITHIFVQAGEMYIESVVILQRLYIRQQETGSHDYLYPTGNWELKGEARSLLMDHLQVKRLRMVG

SEQ ID NO: 955333 - protein, 32 aa, Homo sapiens
MYAAAPLLSLQLGCSVAEKCPRRPRGVIQKLS

SEQ ID NO: 955334 - protein, 48 aa, Homo sapiens
VFSRLFVRRLEPSRQLFVPKLVPRVASMVVLRIPGSAMQAGLAVLSAV

SEQ ID NO: 955335 - protein, 33 aa, Homo sapiens
DGALQFPCQGIGTSEFMCRRNQATSSIRACMWG

SEQ ID NO: 955336 - protein, 139 aa, Homo sapiens
PAWAVQPDADQSQRRVALGAMQWTINSHFLNALKMMMHGSWSTSSGASWNGKAFSFPVSKGSLSSTAQKADVKYSGSVHFTGVGGRMDLTLADPEIVVNNGDDHVIMSVKSKTMVGQSVDYGRITFVDMTGSITQGQND

SEQ ID NO: 955337 - protein, 38 aa, Homo sapiens
MRPDIINSDLAATAMRGLSLVPYSLRIDSDSNYHIVFI

SEQ ID NO: 955338 - protein, 51 aa, Homo sapiens
GKLKRSRRSADRPILPSPSTEAHYFISATMHPQSKEFVYNPKRVNLEVCYP

SEQ ID NO: 955339 - protein, 47 aa, Homo sapiens
PPRAGGHAEIVLCLRIPSASGRRSAVSDMAPDVPVTSVIRRQATSQM

SEQ ID NO: 955340 - protein, 70 aa, Homo sapiens
MTSCTMTSLSDDVTVAMTSCSDDVTVSDERHCSDGRHCQRLTVMSAIDRHCQRLTVTAAIDTVTVSGLNL

SEQ ID NO: 955341 - protein, 151 aa, Homo sapiens
TWSAAICNLTHQSWLAQRMKKAAGVDSTLGSELHLKMNIGHTYHLCNIKEIQNRVLNTMLAKTGIHHYSDNNCKACRKYYRVCTLAIVNPGDSAIIKRMNLGGRGCHEAKIAPLHSSLGDRERLHLKKRIKENNNNNVTIKSWFVNMCLHH

SEQ ID NO: 955342 - protein, 229 aa, Homo sapiens
MFGASGKKFVEGVDNDYHDDNMSYSQSSMFPHRSEKDMLASPSTSGQLSQFGANLCGQQSALGLPMRGLSNNTPQLNRSFITMCISCFRSIVTPTPGVPTMSLHTPPSPSWGILPFFPRNMMIHSQVGQGIGIPSRTNGMSSSGLGSSNRSSPSIICMPKQLVYFFFFTVNSMSGFGMNRNQAFGMNNSLSSNIFNGTDGSENVTGLDLSDFPALADRDRREGSGNQLH

SEQ ID NO: 955343 - protein, 107 aa, Homo sapiens
MYDDYSWIGVCAGHFMAASLGSNLLFEQQQMLVFWKLSSLNEVFTANARERQTDDELDTDDRVHLQRNAHPELDAGISYTCFKYQDCDSFLFAGPFQIQLLLQEVGN

SEQ ID NO: 955344 - protein, 137 aa, Homo sapiens
PASSWCHLMIWAVLEGFPSSYKMVCEEPSIRSGGPVSNSYSWPECHPRRSSKREMRRSLPVVLGSREETLLFVPLLGLSDAENLSAGRVFCSPISSKIQADQVAAHDLCSGSWNLTLVALGPVSMAAEHLLPGPPPI

SEQ ID NO: 955345 - protein, 66 aa, Homo sapiens
IDISTVRTAGVAAAAAAAGRGPIVCVDVLATRCVDMTRGTCDISWSHSTTLVVKEQLGGSHRALSQ

SEQ ID NO: 955346 - protein, 57 aa, Homo sapiens
MDQVGVTDSARLGLILDFLPPPQLISSRELVAEAPIWSQRATATIDVDGPSTLIGNE

SEQ ID NO: 955347 - protein, 62 aa, Homo sapiens
MIVSFHEHLMVLSVPGISPTGSHSHSYLPCEEVPSTVLISIRRYRGSNFDNHSVIASFPCCE

SEQ ID NO: 955348 - protein, 32 aa, Homo sapiens
MQLQTHSAVCKHTIAAFKHTVQLQTHNAASNT

SEQ ID NO: 955349 - protein, 48 aa, Homo sapiens
MSDLSRTIGLYKLLSICLYFLELFFIIKDFRDSHSEGFYQLTHAPSPK

SEQ ID NO: 955350 - protein, 65 aa, Homo sapiens
IVCLQLSNVNRTLILFNVSKKMTQSSYKCETQNPLSARRRDSVILNVLYGPDSPTISPLNTSYRS

SEQ ID NO: 955351 - protein, 193 aa, Homo sapiens
MVKPVPRGKTALCLQLLQWQKRPSFYSMSQRDDTVSYTMLNLEKPRRVPGAHDSVILNVLYGPDAPTISPLNTSYRSGENLNLSCHAGSNPPAQYSWFVNGTFQQSTQELFIPNITVNNSGSYTCQAHNSDTGLNRTTVTTITVYAEPPKPFITSNNSNPVEDEDAVALTCEPEIQNTSYLWWVNNQSLPVSP

SEQ ID NO: 955352 - protein, 30 aa, Homo sapiens
MTCLVKKRPKAQCYTQHCEVDWFDFRGPEL

SEQ ID NO: 955353 - protein, 98 aa, Homo sapiens
PCVRDMDEAGSHHSEKLTEEQINQTLHVVTHKWEIDQEVFNWWPLVVPRGTLGSSHPCADMTRVERAPGYLDACSPGYTCSTHLSLQRDGSCHRTVIH

SEQ ID NO: 955354 - protein, 63 aa, Homo sapiens
INDDSHSQSRLSLLSNFSSSYHIQVITAYFSNSISLSVIPVSYYIMLTSNSFLHISELDRAAD

SEQ ID NO: 955355 - protein, 41 aa, Homo sapiens
LTSTQSTLYHLCLKDQCRVLWLMPVIPATWDAEAGEWRGPG

SEQ ID NO: 955356 - protein, 75 aa, Homo sapiens
RGFTGAELSHTLTGSELKHALSPLHSVNCQQMLLWTWGAPCWWKLCLWTGGSGRYSTWIRGELMYEANSIQPKAC

SEQ ID NO: 955357 - protein, 37 aa, Homo sapiens
RLTATLPLRYKSFSSLHRSPSGWRITVRAATSARGII

SEQ ID NO: 955358 - protein, 69 aa, Homo sapiens
SCFAYSSPITLTYTYTHCPGLRHRYDVIHMTAYSSLASTWGPCVNKRMADSEGWKSLCPNDIVELLNQP

SEQ ID NO: 955359 - protein, 54 aa, Homo sapiens
MNLKHLVLVMGQACLEEHRIHPELRVQEGHVAVHLHEEVDALVPLVEVGVIMRQ

SEQ ID NO: 955360 - protein, 37 aa, Homo sapiens
RLGFMSLKTRTIYIALLHRDVLIPYIEFVYPIVDMDH

SEQ ID NO: 955361 - protein, 55 aa, Homo sapiens
SRSEVGKGSGHELALRPGRGSRFTIRYSVPVLNHPGEAAQCHLQEHKALVTCHNL

SEQ ID NO: 955362 - protein, 69 aa, Homo sapiens
LEDPITELELKNYKITLMKKSLPVFLVYEMLTLRNWDPFKLHAAGSYYDDYMQCGPKGNSEGTSCRLYL

SEQ ID NO: 955363 - protein, 92 aa, Homo sapiens
MFVYVDSRGVTAQRVTIQLQENKLNMRTDSTLCSYLPASPVPELSPVSLYQTKLMTHNGLFSAIPYLMAVSADDATSSQQTPQAQLHRYNGL

SEQ ID NO: 955364 - protein, 35 aa, Homo sapiens
SHGFCALSPQAGMCSGHASPSTAPSASQVHVLLPP

SEQ ID NO: 955365 - protein, 42 aa, Homo sapiens
PCRIYLGGLQLIWGELDSDAPVGAKATILHLYSSLVLFAVFL

SEQ ID NO: 955366 - protein, 36 aa, Homo sapiens
ATLYCIFRTILADSNNSNFSSIKTIVKVIDIRTQGT

SEQ ID NO: 955367 - protein, 33 aa, Homo sapiens
QQWVNILAQVVQVALGPAHQRRFQLRLEFANQR

SEQ ID NO: 955368 - protein, 39 aa, Homo sapiens
PKLSFRLHSSHSKYPRHHLITLEAALQKHRPLSLHIIPQ

SEQ ID NO: 955369 - protein, 70 aa, Homo sapiens
PVRWDMQAPTVSRGVRLADSNGDKKKAMEDLTGITNRKGGQRWHCTPNKPAAAHATWISEPRPEGNPEPH

SEQ ID NO: 955370 - protein, 106 aa, Homo sapiens
QASEELNEISELVILFHYIRPFRNYPATPNCSTEEHSISHCCNVKMPAAFLQILWSTSMAGTLHKGESLIVKHPDDAKSLTRNPGEESEISPPDSPQNQAHRSLVP

SEQ ID NO: 955371 - protein, 70 aa, Homo sapiens
LSIHTSIVGFPFRLRYRHQVARQASVPRSYPSSTNARRLPCRLITGRHQRVSAWNHRAGRPLKAGIQGNV

SEQ ID NO: 955372 - protein, 137 aa, Homo sapiens
MERRDGHICKRRNTASFTFVRILCLHQCDAGRSEEIGITSKPGLSSNISSMMYKLSLLPVEDHVFFELLTILSSTSHEHIVRVGLFGISWVRHGIDQVLQPMDIYQEYNKSVSYYFLYQMTQQLYIWCAQIVFILPI

SEQ ID NO: 955373 - protein, 113 aa, Homo sapiens
MTASAMKTGSALCRSPKPLSTGQQGLVAGCGFWCGLSEANSAEFPKPEDIVCLGWGPCHPWECCPLCRLLLEPATPLRWIFIRGLQGPPFSHVFLRCKLQAPAIVTDVCSLTP

SEQ ID NO: 955374 - protein, 45 aa, Homo sapiens
MSYGVSVCAGSALPQHRRRAPSAPSTPDLLSPTQVSQPRGSCAAG

SEQ ID NO: 955375 - protein, 69 aa, Homo sapiens
ALLTALEHPKGPEDLTGNTTHREGRPEVALPPPNKPAAAHAHGQEPRPDRQPRATLTAQRLTCRSSDGL

SEQ ID NO: 955376 - protein, 68 aa, Homo sapiens
VVDMTRIVILVPRKLRLWTSNAGELNKSVTLTDDDSIVVIFNRLISVQLMRSFNPELIRAWLRRRSRY

SEQ ID NO: 955377 - protein, 120 aa, Homo sapiens
ASLSVYVVTVAVETSTDVPTLVPVTEFWQSNVANCSNHVQVRLTPSCKQSGWFCGSLLVSVHHFPFFWSVNLLLTCGCAGVSEPHSGLGGCLIQESFTAQLNSFKFNSAEVFLLSNEICS

SEQ ID NO: 955378 - protein, 101 aa, Homo sapiens
VRACQRVVVGGGGRHPPHPVAFQTLNMTGSGLFSNLQQYDLPYPEAIFELPFLFHNPKPFFILAKELVPVNYKPNVTHYFLRLLHDMGLLSGLYTHNIDGL

SEQ ID NO: 955379 - protein, 105 aa, Homo sapiens
PQFAITGFACSGTISLSVSPHDLKLPQRQKITTVPSTEALELGTYCNWSHWVMKNACTHSDPGTLSRATKAAGGWVANMHAMQPVPLTTLGPMFHRCSTKHLLPG

SEQ ID NO: 955380 - protein, 51 aa, Homo sapiens
PVNNSLPDQEVELTNCEIKKAPGIIFLSRSPIRDLGSLFYYHRHPVRVSPS

SEQ ID NO: 955381 - protein, 42 aa, Homo sapiens
MIINDEYRLVVLVMVHCPESILLKRIAIRRIMDAVACVRKYL

SEQ ID NO: 955382 - protein, 45 aa, Homo sapiens
SGTMLNYYKEQKVCGGALNNLRESPHSSFSKPRKLVNTINPGARY

SEQ ID NO: 955383 - protein, 39 aa, Homo sapiens
QAHGGHRGGSLLQHVGGDHRGHSEEGGEEQPVTPAPALS

SEQ ID NO: 955384 - protein, 80 aa, Homo sapiens
MRVSCVLRLLALIFAIVTTWMFIRSYMSFSMKTIRLPRWLAASPTKEIQVKKYKCGLIKPCPANYFAFKICSGAANVVGP

SEQ ID NO: 955385 - protein, 105 aa, Homo sapiens
DPSLSCKKLRMALTILFNIVLEVLARAIRQEKEMKDIQNGKEEVKLLLFADDMIVYLENPKDSSRKHLELIKEFSKVSGYKINVQKSVALPYNNSDQTDKQIKNL

SEQ ID NO: 955386 - protein, 37 aa, Homo sapiens
MGANDTGHKGLTQAKAPVSRHVCPSFSESPTDSQMHV

SEQ ID NO: 955387 - protein, 61 aa, Homo sapiens
LEDYIGYGIAVVRPQLDDNLKTLPSVATPLHPQLDASADDNIKTPAERLRGAIPPSADDNL

SEQ ID NO: 955388 - protein, 78 aa, Homo sapiens
RDTVSEMLGLEVMRSGTLELSHQTLCFNSAWPRQVVPATLAAGCESLGNVLPKPLSQNIKITREVCPSERCLGPALKE

SEQ ID NO: 955389 - protein, 114 aa, Homo sapiens
CSRGFPLDERIGVFWLACIIVDGHSVKELCKAFAQAKHHATAIIAKTFKGRGITRGRRLRSLGNGKPLPKNMAEPIIPGDLQPDPEQSEESVQPPPQKDAPLVDIANIRMPSPC

SEQ ID NO: 955390 - protein, 93 aa, Homo sapiens
MAFSVEAGQCTLDATLHVTIALEEPLSPLKLVRHKKIYVFQGEAAEIRRDQLEAAQEAVPPCKTPVFPCEEAHLICRDTMGDWLSAVAAIWQN

SEQ ID NO: 955391 - protein, 47 aa, Homo sapiens
CAVTLVGSRQVGTVKVQSCRIYVQRQPRSPSGYTGSSQDYSSFFSAT

SEQ ID NO: 955392 - protein, 68 aa, Homo sapiens
LTPSSSALCQCTVTRSLQLPALCLGPLMFLPLPASQAAFSSAQQAGQHLRCFFSYGAHKLPLLLQVHG

SEQ ID NO: 955393 - protein, 55 aa, Homo sapiens
MALAYHIYDHYTMTNPGWFRPLVNRLRSSAFRSRLRLVNDGVEDSLAIGPPSKRK

SEQ ID NO: 955394 - protein, 74 aa, Homo sapiens
VPEVSLWSATNAPFLVHAFAAAHQKVIAASELFAVRHCLLGLDKIEPAFLSLALFMKISGHGEQDANPVQLVWG

SEQ ID NO: 955395 - protein, 61 aa, Homo sapiens
DLAGYSTAVSSTRRQLIAALFVGTYLSGQKDQQPERNELERFRKSEIARLETLNVSIKQSE

SEQ ID NO: 955396 - protein, 41 aa, Homo sapiens
GLCRLASFSHDETPPSQKVKKNAKKNGVRGMVYLRLMRTGF

SEQ ID NO: 955397 - protein, 54 aa, Homo sapiens
RVELTGAQCGPARGDHREQRVGHVLALAQLFALALAQPGQAHQRQDAPAQAPAK

SEQ ID NO: 955398 - protein, 49 aa, Homo sapiens
TAPRCIAVDVEMPAVAGTTVVQHTLAGIAAIARSGSSVQWITTISSVAG

SEQ ID NO: 955399 - protein, 80 aa, Homo sapiens
EVARKYCRASRSDSVHEPGSRSRQSEICTLDLQSVGVQALLAWYTTAVDLSKLLHNERALSELEERLRSVLPHHPATKNL

SEQ ID NO: 955400 - protein, 36 aa, Homo sapiens
PTWLESLCCSGGSERFILRQGILRKHIIPVIATCAL

SEQ ID NO: 955401 - protein, 128 aa, Homo sapiens
TDRPARWCHPPQVLKTAAAPAAHGLPAYRAAGNRRSTPSSDTVPSCFLQFDRLGPGLGNQQRGRFGQVGIDKGAGPARTPDQGRPCSQSAEVLAYGCAQYAIRFHQGSQRGNFAGPARQGAGPWNLAA

SEQ ID NO: 955402 - protein, 37 aa, Homo sapiens
APLSSASSTHFYRKLWPESHIDGTLRRPPRPFRSWQR

SEQ ID NO: 955403 - protein, 47 aa, Homo sapiens
KGTAGAGTVGLPPLAALMLDAQRQSAIAIALERGQIADIDHVALDGV

SEQ ID NO: 955404 - protein, 35 aa, Homo sapiens
MTRSSETPPVRFRCRRGCRRQSGHGPECERSVMSF

SEQ ID NO: 955405 - protein, 111 aa, Homo sapiens
NSWTQSGGGNSSPSHHTVPASSRVTLGVRHLRQHLAVEIEDRRRQQGAPDRAHPQQDDGQQRDDDQRDDDCVHFLCLLSRISLGTRRTGRGDSLLESDLAGLSRLWHWAGR

SEQ ID NO: 955406 - protein, 66 aa, Homo sapiens
QWTVVCRRRAGGVITEVIAVTTEGLIMTPIVEGGDVVSLLKDRVLGRVVAEDVFLPGTTKIRIVTR

SEQ ID NO: 955407 - protein, 52 aa, Homo sapiens
RSFRSRRCTSGNVQAAADMSWVRALVCVIQHGNCRGMHGHTTHVRKHRNRIQ

SEQ ID NO: 955408 - protein, 53 aa, Homo sapiens
LLTVGKEGRTGHSLDLRWLKERMYLVSAIFLASFNDTFVHVTDLAGKGNHLPC

SEQ ID NO: 955409 - protein, 36 aa, Homo sapiens
HFFKRRVEAHPISQGGYKILHDAVLRPRAAAIFTLP

SEQ ID NO: 955410 - protein, 41 aa, Homo sapiens
MRRRYEIDESRQLVVSPGTAAANSAAPLCSMYLHGPACLIS

SEQ ID NO: 955411 - protein, 45 aa, Homo sapiens
MTCSARFTLTLLMKEEAVVTDSAPSQTATDWRSHHRRLSSQAFYD

SEQ ID NO: 955412 - protein, 46 aa, Homo sapiens
MTAYAAYIISSPVALPASSMMLAFWRSVRPPPTRASSFTTAQHDNL

SEQ ID NO: 955413 - protein, 42 aa, Homo sapiens
MSVRKAALGRPSAASRRLDLAYNCIDLSIMLHNERALSELEE

SEQ ID NO: 955414 - protein, 53 aa, Homo sapiens
RQLGLLFTWYDSLTGVPVSQQKLLLEKCQVLFNTGSLYTQIGIRCDRQTQAGL

SEQ ID NO: 955415 - protein, 70 aa, Homo sapiens
MFLLHIQRCQCFLRVEIMLGLICLISRRYMMRMVAPRCATAGKTQNDTRTVFKIDTDALMFAYRMVDRIT

SEQ ID NO: 955416 - protein, 35 aa, Homo sapiens
SFSLPIKESEIIVIILWPASLKDEVLNDYATCRTQ

SEQ ID NO: 955417 - protein, 37 aa, Homo sapiens
LIATIIPRVVAATAARTLRLRGGMKEAVALVICYIGS

SEQ ID NO: 955418 - protein, 33 aa, Homo sapiens
MYFSNVAGYPVRLSTITWKRAPIRHDPARRQSP

SEQ ID NO: 955419 - protein, 57 aa, Homo sapiens
EGYDPRVLLKDVMISSRTYLSGRSHAVGWLMHSVFPICAAFKLQAHFQVKPKVICQQ

SEQ ID NO: 955420 - protein, 43 aa, Homo sapiens
CRTYFWWCTVLESLRAALSELPALKGMACLLTVSSGSIDHSPV

SEQ ID NO: 955421 - protein, 48 aa, Homo sapiens
YTVTIVRTYFWWSTVRKLADTLGELHALKGMACLLTVSAMSIDQKPCS

SEQ ID NO: 955422 - protein, 160 aa, Homo sapiens
PSLPRGYVHPVRRGGQRQRHAAAQGLQSPQSALQDALRTPAAGRMSLSFLLLLFFSHLILSAWAHGEKRLAPKGQPGPAATDRNPRGSSSRQSSSSAMSSSCASSSPADFLGKPRKLFCSKQFSMGPPGGPDPQPFLQRGHRISISKYYTLRGGGTDPNN

SEQ ID NO: 955423 - protein, 83 aa, Homo sapiens
KLSPVIPVKPMWDHPTRSIREVLKRFEEAAFTCEYKHDGQRAQIHALEGGEVKILIRNYEDNTVKHPDIISRIHKIKLPSVTY

SEQ ID NO: 955424 - protein, 93 aa, Homo sapiens
LNLTIAFTLSLLGTFIFRSHLISTLLCLEGIILSLFVITSTSTLNSNSIISITIPITILVFAACEAAVGLALLVKISNTYGTDYVQNLNLLQC

SEQ ID NO: 955425 - protein, 34 aa, Homo sapiens
EEYVTDPEQRWDHLVLNMTLSRRLDERPSVPTQR

SEQ ID NO: 955426 - protein, 37 aa, Homo sapiens
GSQALSSRISVFTFSTVSLYGLCCFLLQPKCRCTRGI

SEQ ID NO: 955427 - protein, 76 aa, Homo sapiens
KKGGAKSGMGKTAVFVLAHCNSGAVTGQVSVLVMCHTRGVGVFKISKEYERFSKYSPNVKVAVFFGGLSIKKDEEV

SEQ ID NO: 955428 - protein, 74 aa, Homo sapiens
SRSLKWRLSAHEIEELHRQWKELDEQVATHQREELSLAATMQKEEAAVEQLREQLTGARMNRFDGLTSNVVAFR

SEQ ID NO: 955429 - protein, 41 aa, Homo sapiens
RSRSQVPVSVQESPPVSKRESKSRFGDEEFPPKSPERGKER

SEQ ID NO: 955430 - protein, 49 aa, Homo sapiens
SSSAPFRPRRRRQLDVDAHGVRFILRAQAERIVPQIFAGLDVVLVRVGP

SEQ ID NO: 955431 - protein, 106 aa, Homo sapiens
APMSINITWDQIHMKLKSNIHARHHEGATSIYTQYSLRNGIQSHGVVKTPHTETYYKQEQRKQSSKNLNEILGKHMVQHNTINSKTSLAIHGFQFMNLLNSILIYS

SEQ ID NO: 955432 - protein, 62 aa, Homo sapiens
SSSVPNGLSSIGAVFANHRRLHITVFPDILRLRPSTKPTPISMSSIIFIGRLSNFLPTILSR

SEQ ID NO: 955433 - protein, 61 aa, Homo sapiens
RLRLSASLILPLKPLMRSTALFMLEGVRDSRAYLADIPTTLLLPRPPALYFSASCAQCSSR

SEQ ID NO: 955434 - protein, 45 aa, Homo sapiens
MILDRRGSGPPLIWGHLLLGLVRRCLETLLSSGVISSLVWSQRGW

SEQ ID NO: 955435 - protein, 55 aa, Homo sapiens
MSNADIHSLWSVSGIPKKSDVNADIHYIQAIKIETGISKDNSINSFEEIGFNGNF

SEQ ID NO: 955436 - protein, 77 aa, Homo sapiens
CGHGLSMEVLCCIGSSHLTSAWIRDDFYGWYLLQIFGQPMAVLPLLMLSTGSIQRQSTQRRLHSAATSGSAINCGSD

SEQ ID NO: 955437 - protein, 75 aa, Homo sapiens
MLKDLGLATEAARQAHQPVILGAVAQQLYQSMSQRGEGGKDFSAIINSYRKPKVNTCGEGASSLATGFAGSGKHK

SEQ ID NO: 955438 - protein, 69 aa, Homo sapiens
SWHQVITTVINIKPPGITQYQTPLFVCSVLDQQQSYCLRISVLFCSISYCSRDRGIRLDVDAAGTCNAW

SEQ ID NO: 955439 - protein, 37 aa, Homo sapiens
DPSGVDLRNAGDIGISNADVADEHIFSYARVKGPIFN

SEQ ID NO: 955440 - protein, 35 aa, Homo sapiens
RSFEFFTSLRRTFQNTGFTLVLAAQYWCILVSGGS

SEQ ID NO: 955441 - protein, 49 aa, Homo sapiens
GQRSAEMEVGERNTPLRSISWVLAILLPQPPECWDYRHVPLSLANFYIL

SEQ ID NO: 955442 - protein, 48 aa, Homo sapiens
SPVHIFLNQLYPTNTRLHLYHWFPKMASKKINSSICLQTNHGMPAFNK

SEQ ID NO: 955443 - protein, 42 aa, Homo sapiens
MRASVLHLALVSDSCSAQRAGLQVCANTPGNGLIFKKKREFR

SEQ ID NO: 955444 - protein, 39 aa, Homo sapiens
SSNKQPGAQRHLLHTCSSRPTYTTISTRVSIGRVHPADT

SEQ ID NO: 955445 - protein, 150 aa, Homo sapiens
LRIREESLKERNDGLLDGKATVLFSWEAQNWRRKCHHLGEDCDTRIEGTQADTRESDQMWLARHVEIIRKYVLDDLIVAKNLMVQCFPPHYEIFKNLLNMYHQALSTRMQELASEDLEANEIVSLLTWVLNTYTSTEDDEERGAGPVKWM

SEQ ID NO: 955446 - protein, 48 aa, Homo sapiens
RGLLSLMNIVSITAVRELNEPTDDRMLHVVSASGSSEYTSGDSGIPMD

SEQ ID NO: 955447 - protein, 39 aa, Homo sapiens
MNVHRSRKYKGRCETRNKKLRSLKTTIILDSNFNVGGPQ

SEQ ID NO: 955448 - protein, 116 aa, Homo sapiens
STRQFARNHWLEQPAQGACKAREAEVGQDVQKGLVTEQARQHCRDFAVVVRSDGIEFAHHALLLETARVSKRKCQGAVLNKGPAKNSPVNRPAIIRTSHLGDCDARNCCCTIVLIV

SEQ ID NO: 955449 - protein, 50 aa, Homo sapiens
RKEGMEWNGMEWNGITRLQENGMEGNAKEWIQLEWNGKNGINTMWNGMDW

SEQ ID NO: 955450 - protein, 53 aa, Homo sapiens
TLIVISHDRDFLDGCGLRHLSTSTMRKLKRYSGNYSSFERQRAAQLELAQGMM

SEQ ID NO: 955451 - protein, 82 aa, Homo sapiens
EIPDASCQDRAMFRSGAMCFADRVELEPRSLVVSSDVGLWGEAKGEVSTYDAAVCVNSVSKDDSCCVLLKVHHLHTENHPDD

SEQ ID NO: 955452 - protein, 106 aa, Homo sapiens
LNDRGACIAGKPAPTWTASRQRALYFIRDKQQGGEIFIRPLCVRLLLRFFFVCGSVEGWLVNVVIASCDHLAFKFLTFELFTFDFRRLLHTLQADQLFVLGQLDQG

SEQ ID NO: 955453 - protein, 60 aa, Homo sapiens
GTDSIECADMSSVDLDISPCQMYDVKIFSHSGLSVYSTDVPLPAKALCLIKSQLFILVFI

SEQ ID NO: 955454 - protein, 43 aa, Homo sapiens
THCPLAGQAGGIHIVTPGLRRVLLLLGLGAFKRKVLIAEEPSI

SEQ ID NO: 955455 - protein, 37 aa, Homo sapiens
HKGIPTPYIPIRSYYRNHQPTSFHAIAPGCTPNRYTL

SEQ ID NO: 955456 - protein, 51 aa, Homo sapiens
GNVDSWEGAVLRRKSSPSGPMSELLKFQATIERRISVSNLMSLGSVRARWV

SEQ ID NO: 955457 - protein, 46 aa, Homo sapiens
MNARTEEQANKQQFVGTDRKQKSRSQWIWVKEASKKGTERYRFGSE

SEQ ID NO: 955458 - protein, 133 aa, Homo sapiens
YSRGPRRLLPPTAAACAACRTGTILLGVWYLDHQCCGTVDFYLSALACSWITYNYFNVLELREVDFGSSWIDANIVHMPIGDIPPFLHWKTFFPPPFFGGKRFKTLGFWLMGYVNGRRYQGKRGRPWIHPDSS

SEQ ID NO: 955459 - protein, 55 aa, Homo sapiens
KRGIIVESSLEDSQIGDGCSPYTCGIELDSMRNLKASLENSPEGVWSARYALQIE

SEQ ID NO: 955460 - protein, 40 aa, Homo sapiens
LLAGYSERQPQAALAVVLSEMTWCLAPVSALVFTYYSILS

SEQ ID NO: 955461 - protein, 34 aa, Homo sapiens
FASNYELNAVLLSGDSTPGFRFPREKYSFYSSFD

SEQ ID NO: 955462 - protein, 43 aa, Homo sapiens
RLVVLLHSIGSELESTEGAFTSGVRGGEASEKVLGGGSILAEL

SEQ ID NO: 955463 - protein, 63 aa, Homo sapiens
RRTYSQAGLGPGDGAGQAEPEDDAETIGWKAGCCRVPEDDVVTPGTSEDSYKSGLTTLVATSV

SEQ ID NO: 955464 - protein, 45 aa, Homo sapiens
LAGSDLDTSEHQQDLGLQAVNPVPGTPPLSSWISSQLLALEKGGK

SEQ ID NO: 955465 - protein, 36 aa, Homo sapiens
AEYALDAILGVSYLDAMDNITRQNQFYDTHMSSNKK

SEQ ID NO: 955466 - protein, 67 aa, Homo sapiens
EHHRGKMLEKRLMIHGRAQWFTPVIPALWEAMAGGSRGQVIKTILANMVKTPSLLKMQKLAGPGGAL

SEQ ID NO: 955467 - protein, 148 aa, Homo sapiens
TTEYTTGRQLTCARRQRAGFDVEQELARPMDIDRLSGRGLSLVRQLSSAVGWSDGGRTVCVEFVSGGSGIIRRFLIKEQQVAEIHMDPEVLSGLQEVMESEYPTLLDTFLHDSEERVQALRKARDDAKTLGRIAHSFKGSSGNLTQVV

SEQ ID NO: 955468 - protein, 84 aa, Homo sapiens
MPLFHKFTEPYYCKQGGRMEDTSFSGQLPDSLYFEIGYPGLSEVPLRRLKFFICVLASFVQVLPGDGSASFALLDTSCALILLI

SEQ ID NO: 955469 - protein, 142 aa, Homo sapiens
ADQRVFGEFPLKLPTGLAKNFHQAVAIGGFLYVVLEILMVIGSSKPTFCHFCYWRTAWDATHTSTSGISLACASHCRNSHGECTVPWLSRARISASHPVHKPVTGGDLGLKLKIELVIADLLDAVQLSGLAGQCLVGGDSGG

SEQ ID NO: 955470 - protein, 56 aa, Homo sapiens
MNCNSIYNLPCLTFIIYRLSSLCHLPPVSTETTADCTVGIEPVKPILNWLGTELKL

SEQ ID NO: 955471 - protein, 40 aa, Homo sapiens
MSFDHLSRSKGALGSENGAVACSRTRGMPSEVKAGAQGPR

SEQ ID NO: 955472 - protein, 139 aa, Homo sapiens
LVVIVQKKIKNRTPSKMNPMTVFLSVFIETFIERQRKGMDRKLGVFSIIFRENKDMKLYREEQFGPLIPVVPFDSLEEPIEYLIESTHGQQVSLFSNDSKELASLIDPLVNQVSRVNIKSADMAGCGSSIFRYTDSGGV

SEQ ID NO: 955473 - protein, 95 aa, Homo sapiens
GRPVWPGGCCERPFAIPGLDIVLLGSIHRSISHSRLAHVLLRARSLAVCRVQLLLLVPPPALRLLLGHLLWDLLTRSFICAPSTGTAALIKVRPH

SEQ ID NO: 955474 - protein, 136 aa, Homo sapiens
GAQFVGHVAQQLALAADQALQACAHAVEVVGQHAELVAPIGQLRQAVLLISGLPQIMHRAAQTAEWAGDGQGHQQAEQGQHHQGNRQCTERPQQAAAVPGVQLRVRNTVDQEEVPPVSALVYSAVRRRQGRDSGGV

SEQ ID NO: 955475 - protein, 45 aa, Homo sapiens
TGGVCVVNVGVATCAVRCAFDPGDASECHAETGFVGAAVQLAQNT

SEQ ID NO: 955476 - protein, 235 aa, Homo sapiens
CASWRVSLPFQTHGYWAGYHPTADQRQRVLGCLHPQDVMLAIARIRHARDKILFAVEIDGFSLRQLQLLTHRLHQHFKARSGHQRLRHFIAGQGLNQLCFFDCKLPLQCFGHTVEHRLGDCTGLEIAQQRIHLFVMGLVLRLEPRAVFVRDVVLPEFPDEHGLKLMHRIIQADHLIVRSILHRLADVAETNEPGLLRLARQVKPLFKAVTIGQPDFHFFRALRASAFCVAVRSSR

SEQ ID NO: 955477 - protein, 31 aa, Homo sapiens
MAREPCVVGLAFSLLFSFGPGCCVFFECCQS

SEQ ID NO: 955478 - protein, 215 aa, Homo sapiens
CRRCDVHPSQSATLCQHRDQLKDADAYHMLIQIGRHQTLAGCIKAVCPGVPFVNQTSEEPETLANGFLFQRQYLARKVGDPLNLIRFIHPCLQYETRSMLTISFEVTNTARSLLEERACSRKPQTITQRLKAKSDSPAAPCSIAYACVRIRRLVAEVAVSKVARSLNSSVIGFSSPPSDLTSAHASSIRRSRLCLMVAVRRASSDAPVLLGPPVY

SEQ ID NO: 955479 - protein, 236 aa, Homo sapiens
MGRSTGQQALLIDNRVRVSARHDQRLAVADLNGQRRIAPRLTSKRAVDSYLAGSKKAPSRMITSAADGRQLELVPEDEEQAQKIAEKNGSRSWDVAPLVTAAAGSGVVVANPDRLGEWDQLVQVGIYALDALAHVGFGHEHHISPLQRHLFTPVGAGLEVLAEVQEVSAVGALGIFAQQCNHAGVACRVHPAGADDGLFQGVGRGDRHRGRVVYRTADDDRVARCLVDVTVTRGSD

SEQ ID NO: 955480 - protein, 69 aa, Homo sapiens
CSPFDEYTKGPTSAHALFTTCVKHGSSNSIKARKPKVSPRRQSARENRLNKQNGRANRKIVTSRSSQYA

SEQ ID NO: 955481 - protein, 143 aa, Homo sapiens
LVATESMHSACLKAHPRVERDEGRIKLDAGLLQERRRFLDHGHVHFLEDLVENLLLGELQRGGDESKPELPHFLEGVFVLQNMIHASGEVVRELGELRVQSPDDFQTVLLGIEKISIRKGEVSHSLCDEVRHVALNEIVGERP

SEQ ID NO: 955482 - protein, 56 aa, Homo sapiens
FGWVVLLHNHNNTGIGAPLNEQPLFRAKPPGNWKHAALSRSRKASATVIRCNCSGC

SEQ ID NO: 955483 - protein, 38 aa, Homo sapiens
SRYRVLDIEDGLGTGAALGSNVIRNEQLPCSTWPMWTG

SEQ ID NO: 955484 - protein, 58 aa, Homo sapiens
MGDAILHVFAGTEHTEVVLHAALQLATQGCYIFAISALVQSVQTRQGSFDVGVGERPT

SEQ ID NO: 955485 - protein, 80 aa, Homo sapiens
MYKTKLCHHPRATVNNSLGISQGGELGQTSTVKTFTHIHLPGVWIPRVQSLMGRPRGDQVSSGVTIYKAAGTPGTYSRPQ

SEQ ID NO: 955486 - protein, 209 aa, Homo sapiens
HAVRLSQADDRASGLFMGSCIFAGLVVQWPLGWLSDRYDRALLIRCFALCLAVTALPLAIMTQVPLEVLFVAGFFCSLVQFCLYPLAVAFSNDHVEGDRRVSLTAMLLVTYGIGASVGPLLAGVVMKLFGSQMLYAFFSLCALILVWRIRPKAVTNLHQVDDAPLHHVAMPDSMSSSPLVAALDPRVDEQVVQDQMQVTVPDPEPAPEN

SEQ ID NO: 955487 - protein, 188 aa, Homo sapiens
LGLPLGATLVAFRGLAIWQAIIVAILGAAGSFAVVGIISIAGRRGRAPSLTLSRAIFGVRGNIGPTLVSLMSRLGWETVNTTTAAFVLLSLSSILFGSAVEAKSVPVLTLIFIAIFVLLTLAVSGLGHATLLVIQKWATYVFGGLNILVGGFLCATIDWSAVFNATPAPVSAMIIGVGPWLGYRIGWP

SEQ ID NO: 955488 - protein, 105 aa, Homo sapiens
TDAAGWPDDKIHAVRRQWCPLRSCCQADKPAIKPMPNRYSIRLAYPACAVAHASVAAGCWLTRGYDAEALRQYCDRYRMQPVIPLRSMKRKTKPGLPRLFDRVRS

SEQ ID NO: 955489 - protein, 43 aa, Homo sapiens
YGRTAESIGATVHRQVVGASNSARKRSLIPSYFQILACKTPIQ

SEQ ID NO: 955490 - protein, 104 aa, Homo sapiens
MDLTVLVAQVAAVVVGDGVAVAGVADVDCGVELAAHGDLGLHQLRAQALYRPLAFLQGGDDHLFHFFFADLARGRQLVLGVEHRFAGAASRGQQGQRDQGASVA

SEQ ID NO: 955491 - protein, 99 aa, Homo sapiens
RDIYVPQRIGIEPYSADLSTVLSLAIDPQHGGSNHKEVEQQSTVDETYSYSDEEGHDKRGTQEYLESTSGRLSWREALEDSHLIKVAHGNPSARHLKRG

SEQ ID NO: 955492 - protein, 81 aa, Homo sapiens
TGVGRHRTAQRKAAGKYSSWRPRASTNVQVLAHGAKRRQVHVHGEITEHAQPRQIPGKTKRIFHRCLVDTAIKLFADCRPL

SEQ ID NO: 955493 - protein, 34 aa, Homo sapiens
DGYRVLVVATRNIPKALERQTVHYQRRTQHLRYQ

SEQ ID NO: 955494 - protein, 54 aa, Homo sapiens
GRYLSGRSSCQGWANVTKRGVCIRRLARPVFFFFFSCWPPEESDLSLFQQGPRV

SEQ ID NO: 955495 - protein, 35 aa, Homo sapiens
SLPSKRRDEMYKRRDEMYKRRDEMYKRRDEMTAPT

SEQ ID NO: 955496 - protein, 112 aa, Homo sapiens
GAEIGKGGGRVVGSMRIHRGVTAFDLGEVQDAQIAHDQRAALEDHLRQRIQATFADRAGAVADPLAAFQVLGQHRVVLEALEFIERRQEGVAVGQVDDQPDHHLVVFQVMRP

SEQ ID NO: 955497 - protein, 64 aa, Homo sapiens
ARNTYLTEATSCSRRALLVTQVLADPIYWLIHYWLTHYWLTHYWLTHYWLTHYWLTHYWLTHYW

SEQ ID NO: 955498 - protein, 48 aa, Homo sapiens
GTAYNYDVDIYSCAVGYCMACLEKRLFKGLPFFLETESYSVAQAGVRG

SEQ ID NO: 955499 - protein, 99 aa, Homo sapiens
AVLDDQINASTMFAVDIQLDLVERFVAHPHRLGAAVAAQVVEGGFRQFLATVDAVQDVDLGRLAAAVADPAPEPAHIGVGFLDETQAHERKTVDEASVA

SEQ ID NO: 955500 - protein, 53 aa, Homo sapiens
QSCSIAQSNVQRTVPASNPPSTAISSVPHPATPIQVNITQFHSFVSNITHTHT

SEQ ID NO: 955501 - protein, 55 aa, Homo sapiens
MAYTNSQGMWRVSVVPSTVGRLVQRENGLNLGGRVLQGAKIVPLHPSVGDTVRLV

SEQ ID NO: 955502 - protein, 137 aa, Homo sapiens
RTLENSRPHRWCVQRGIPVIQVFHVEDQGHFSMQSGNVRTLSELLIKPQLVIHKRYHSALAGTPLAARLVEMGVTTLIISGIRTEQCCETTTRQAADSGFKVDFVSEATLTFPMTHVRSGRVYTPAEIRERTEASVA

SEQ ID NO: 955503 - protein, 200 aa, Homo sapiens
HALSSADQAFAVEYSHWVTVYSRREGLADATDVAQQNTGTLAEAVGQAGFELHVFYAVQFLQAVLAAAVVQEQRAIVECHRFVEDAVPFEEDFIVVFTAGDDLGTGTQAETVVALDTHPRKSIAVHRTVACPTVGAQQDGRCAVVVGGGGLFVADPGKAAADGVEVTDDDGAVAFDVIVERRLGDTLDRVDEHASRCVRN

SEQ ID NO: 955504 - protein, 178 aa, Homo sapiens
DQIARGSGVRWRRAFCAGRFVVAHRAVAGRLVLPCPRWVRRCSKPCEALNAKLLQVARQTYPVFKDAEAVRFEEGQLHAGDVSVSLAQLVKDSGEEVLQAQVDSEPDKKRQGYACATHTAVFVEVRVDEDLGTIKVSRVVSAIAAGRVVNPKMARSQILGGGGVGHWHGPAVKASVAG

SEQ ID NO: 955505 - protein, 57 aa, Homo sapiens
MLCQQFQWQQCVHHVCSLRPALSVVQVCYHSSACRQSRPGMSAVQGGHPFQQSAPAR

SEQ ID NO: 955506 - protein, 155 aa, Homo sapiens
ERTRDAGRRRRHSSVRPSVSMIMQAMAAVNPRNRLMAEINTRREENKAHTKYRQAIRRTGPATIQVIQGDKGRQRAVANRSQAQAGAETVRYARTPPRTAAARHVHRHRRFIADQHQSQRRQHRQGKTEAGVAVISHHHHAKWRTNRNRAEGVRS

SEQ ID NO: 955507 - protein, 33 aa, Homo sapiens
TYAFDQEVLTVLQFKHKAQQGTRMEPHAVWTLT

SEQ ID NO: 955508 - protein, 226 aa, Homo sapiens
TARTLYDSKATPRHAEARYDKGIGDRRTIRQASDMGLGSDKLVAAHYRRPCQAADTLARPVQDHERDHVLRSLREQFEEAKDQGRPDKQRRTEPNQTLARVQLRRTREAGGLRVQIRSRCDKQRRDHDLPGDTYGRQRQASDDNPHYIDTSTHAKQDTQLMLLSPPIDSKPTEPKVCSDSDSRTSSAIATKRIKSKLPSHSNCNSGCRRRRSMNTTVTSNEIGATS

SEQ ID NO: 955509 - protein, 61 aa, Homo sapiens
RPFPGLPGGSREKEALIQNRGSLNPQICIPSWALNQRRERLQKNVKGETQATDDSIKGWCS

SEQ ID NO: 955510 - protein, 82 aa, Homo sapiens
LMADVAQRVFHVLLDLSDQYGGNELFSVQRGRCRPPGNVVLTYGRPLRQSFGLVALQPLERCAILLAGTHSLSRVSGFMFAG

SEQ ID NO: 955511 - protein, 69 aa, Homo sapiens
SRYRCQKNNGILRDVFNEIELIHVTNEGNETPEEHQVTRNFRTHLIRGEKALTFAKLGVRAILSQKLFG

SEQ ID NO: 955512 - protein, 125 aa, Homo sapiens
RHHVIKGSDALHPRDRLRQDGSAESSKIDRGSGRAHYAEYINLPVGVGRVGYIQTNSCQSVSFVLCPRSTGPQSQTNCLQREGARCDKHKSPAGLSSLQGQQALQNPRKKACPCAVKDDIRLQSP

SEQ ID NO: 955513 - protein, 110 aa, Homo sapiens
MDMHDLPVFANFLQEGSFCSKYLHVLALYFGFGLCFRPNHRQIPVDSLALLQYRTCRCLGKSHIFRQMMSGITLSVNAQHNRTHEIVMSGASSSVAFALSPDAKAEDSGG

SEQ ID NO: 955514 - protein, 135 aa, Homo sapiens
SADDRSGDDITSAPMLDIEERREFMRFQEPLLNTRRIISEIFAHGCNSRQEASLYAVSRLNNPFGPAPLLIMRSTTMSITSAAAGAALAMAADSLFAGVDTQVPAADATVHCYGVNSCKGMNDCKNKDHAWQGPT

SEQ ID NO: 955515 - protein, 206 aa, Homo sapiens
MRTVGVYLVGDFGLVIALGTSFQKPSTWAPHVAFCFRLVGRHAFQFARDGAVSGFGGGDVDVRVAVRHGERGLELGVGPGLVALVVDEFLGFAFMDPCASTDHIFLQRLDLGQRRLDHGHAAIGLVLGTGNLAQGHLDTVFVLGDLPILSLGSGRKQQRKTHSTATRFSEPIVVFLMVEVPIVKPIKPPSSAPTSRSTQVVWGISR

SEQ ID NO: 955516 - protein, 104 aa, Homo sapiens
MPGCHQCANDWKDPANARKSSSFQQPRAILQPNARQPVHPAIALIQRSITEQIRSHPLTKFNQPVHFDSTTTKNCGEASMPPIVLVLNGPNLNLLGTREQGPHS

SEQ ID NO: 955517 - protein, 194 aa, Homo sapiens
DARRDPVDCWAAASAWLSNTAFNGHWRLLQDWVENLRELRALIGSLGQAAPRQSTSELRSALDALLEDWRPLVQAGDDDEDIRKAAPEQFIEELQDVRWGLFSLNLSRWLLARTWTAERNVRGNRQGAAQITNWLPRLLADDAVALQLQRYQQQPEDLAEQLPRIERIQAWLHHARHVVDIPELDRLYGELNKL

SEQ ID NO: 955518 - protein, 113 aa, Homo sapiens
TKWDRRANTGMVPPKDELSGASDLTTALDLVPSTHFSMGHPVHERQSQSVLEGNNRAFQIRGICLVHFRRQCNPLVMFNTQASSCRNIRQHGFKDLAHKVDKFTRQWQGTHSG

SEQ ID NO: 955519 - protein, 114 aa, Homo sapiens
WRAGASVANIRRYYDILAWVTQPQLEGNQVVEGNLHVPGVDKTKPPQDTPQLCSRQPAHCKSLWEPGLARDSGLTVKVIAACRTAIEGKRGSHHVIIVAYIGRRADEVPHAVNS

SEQ ID NO: 955520 - protein, 126 aa, Homo sapiens
MGRHGLHVGHPVARAYRDVRLVSIGGGADEIMLGIICKLMGTLPGEKAMNTLLLEAHNGVLHITLNRPECRNAMSLEMVNELRAVLAQLDSQVRAVVISGAGGHFCAGADVKDLVGAGDQLQALNR

SEQ ID NO: 955521 - protein, 133 aa, Homo sapiens
DQDQRLTQLEQPANCSMHAKIFSQASGDEEETDNTMFTRTAQNEIYSQFKRLPNPDLVMYVFPHLAGSDPAPIPGYTTVFPLYQRVQYAMPGERTEAYRWVFLNDSKRNGRQSVWNLAVTPGSPLSDDVQGPT

SEQ ID NO: 955522 - protein, 34 aa, Homo sapiens
LTTCPGVVAVAATAKTQSLGGGCTGQQLVVAGLA

SEQ ID NO: 955523 - protein, 78 aa, Homo sapiens
MLLHARVLIDSIGYGSLSGEYLVDEDRYLRQDYWTAVACVTDITLMAASVDTDGIINLRLEPEYNATPVYFYGLLWKV

SEQ ID NO: 955524 - protein, 98 aa, Homo sapiens
TLTCCTSGEKCPLRGDIDRHTISIIIFLLHIILNFRCIAYYFRTIVRDCNMGEQGPVFAVDEVHQAIHPYIDKDIYIREQWVICKLRFRNSGCYQLIC

SEQ ID NO: 955525 - protein, 85 aa, Homo sapiens
SRLYGYQRWARRSSGQNLFGDAVCLGIEHRFEHSAGCIWSLAGCGMIRKKSLVSTLLYMSFVSVAALGGYANLDPQFTFWVQGPT

SEQ ID NO: 955526 - protein, 159 aa, Homo sapiens
MTVLSDDAEAQAEQGIGHAVTSTQMEGWPLEGRRITIWHEANQGSVTEIEHRALDHRGLCEHQFNGFRLIEIGLAFVYELAKGGSPHGPKPPAKLCSYAPLGQVFAVDTGRLVVMELIAHPVLIEPGARLIHGVAGFDAKRCKVLLDATQGIAPAGTHS

SEQ ID NO: 955527 - protein, 116 aa, Homo sapiens
MIITVVVLPVLWPQQHAFMPDNFLSLHVTAPPGRRVSQQRVYRSDPIPDQHGNVVARQRNQQPPLDIGQVSLSRQHPHETTVRSDTKHEPQADPRAQTTFVADNPVLGQRQLRIAI

SEQ ID NO: 955528 - protein, 44 aa, Homo sapiens
MAYHCAAPGRCQGWRPQAEGVVVVPVELARPLHHGAELRTVDGV

SEQ ID NO: 955529 - protein, 45 aa, Homo sapiens
RTFLIISCGAVAVSGACPEALGWPGSSSSSSGSDSLMAPGASSAS

SEQ ID NO: 955530 - protein, 203 aa, Homo sapiens
MSGSMPRLHTLLLNETSLVEWPSSVFRVPRPEDFILDMRQNPIAWIPEFAPGSDKALIVAKTFLTRETLTPELLAQFKRYIEAAGRDPDRQLPKRGARDSEQWKTGYSAQEWPSRQVLWDMLEGSFGSEGFFNVLRAVRNSGDSTLGGVWLPELTAKVWRILEAMGEDAELREQLFLMARDPAACVDAGRQMSMRCGTTRGSL

SEQ ID NO: 955531 - protein, 44 aa, Homo sapiens
APNVLVNFESSTVISECETLSRKMMRVPYRVKALSSSYLEESPL

SEQ ID NO: 955532 - protein, 33 aa, Homo sapiens
DEPALMDFFQKEYLQLGEICTVSIINKLWLLLD

SEQ ID NO: 955533 - protein, 157 aa, Homo sapiens
MLEQLDDSDINAMRALNINAPICLTKLLLPLLKQADSAMVVNVGSTYGSIGYAGYASYCATKFALRGFSEALRRELADTRVSVLYVAPRATRTSMNSVRRKPLNDALKANVDDPQTVASAVIHAIAGDRRDLYLGWPERFFVRLNNLLPQLVDRGLR

SEQ ID NO: 955534 - protein, 204 aa, Homo sapiens
TASALDVPTQSTVVSVYATSKVTSAPFDNKLVLAARDDAAAFIATDGQWRGARLESALDYLRRTQPKLHASDLELAQAILVQKSSLYFYLCHWSHPMRSPLIVAALGLLFLADVAQAQTLKATSNIVVRASARTIDFTSDTTTSIRDSKIVREAHDDAASFVATNGEIRGAQLEAVFDTLRTRVPEARDASDQTLAEAIRRDPL

SEQ ID NO: 955535 - protein, 183 aa, Homo sapiens
TARPLRWRLSAAGWFAGTAADGLDDAADHLGLGIQRLDAFTGLLHVLGQVAHHVHGLGDHSGTALGAVVGLQRGAVGNIGGLGHRLLAVDLVGNDRGELDHFVQPLIGVQHRVVGGLQPHQAAVVVHAFEARGDELTGVQALPALLVFGTVVFLWFTDHTVMFAFDLRQTVTHAGPPRGHPLE

SEQ ID NO: 955536 - protein, 76 aa, Homo sapiens
WVRSGIFHERHLDIRVKMLFPTDHAYSLLIGCIPHLLTVKIPSALSKAGQSFSAVGGLDADIESRCVGTVKDANLC

SEQ ID NO: 955537 - protein, 199 aa, Homo sapiens
MDIEGIGSVVTSLTSSVTVPAASQVEPRKQISTECYVPTTNTKVMLWGDSHAQQYYYGLSKTLPPSVSILQVASSGCEANLPGTATGGLKYCDRSNEFAFEVMAKEKPQVLVIAQLEQHDTKNNLIDLTARAKALGVKNVIVVGPVPRYDQFLNQLVVRKFWNNTPRRTKENLLPASFDTDRALASQVRWWCWWVRYLS

SEQ ID NO: 955538 - protein, 162 aa, Homo sapiens
RRTPVRRRMRRLAETGSAVAFCPTSNFFLGSGLFNLPMAEKHNLNVGLGTDVGGGTSFSLLQTLNEAYKVMQLQGARLSPFKSLYLATLGGARALRLEDKIGTLQPGTDADFLVLDYNATPLLSYRLKQANNIAETLFVLMTLGDDRTVLQTYAAGQLVHQR

SEQ ID NO: 955539 - protein, 80 aa, Homo sapiens
MARLSTIVLRIGAFEFPDVMYLRNARVTECLAQPTRYAVQYVAVQALAVKGVQHLVAHGISNNRFKRLDLGAPLTVAPAQ

SEQ ID NO: 955540 - protein, 218 aa, Homo sapiens
MLVHKTYLKFLKSARRPVKTRLERGWYERPEMAPLHWVTEAGYVDPIDNRNKSRTSWVKTSPDSTTVTTLTIALARTAPHLYTSVSAPWRATSADSLYGRGLRWQLDEKSANNAHGAYNGSYAHHARRDEEEHPMSSTAQTAEGENILNQLMTIRGLSSLMERITTPRAIVPAPVPNTEQMDRLKGREVSTWSYRTDVARRRRHTDCSACACEHQIPT

SEQ ID NO: 955541 - protein, 195 aa, Homo sapiens
MGAEIWFKHGGSSSCSRKNCRCHIQDGYKLSTENPQDGDSVQSHGLSSERRKFTYVPTTIRARWNMDEEQMAFFESWFARTLVDGTLWFEATLKTPVGFKDEICKIKGMYDGPELVQVNRYEMSGTFLLRDRPLIEPGWENFPELWFGKNIIDLAINRDVARSMSPLDVCYASPGSEVLIPAFELFERFLENDHR

SEQ ID NO: 955542 - protein, 75 aa, Homo sapiens
WWVVLRFGVITPDLSSGRAKLLVSALSYARYTQVAGAVTLVSVILPAVGCGQFVFLFQGAAPHGFTCLGSENDPP

SEQ ID NO: 955543 - protein, 56 aa, Homo sapiens
GGLLGFSAIAFNHGEVCTAGSRCWSSVRSKTPSCRRVIEALKGWKPWQSTGPERPT

SEQ ID NO: 955544 - protein, 216 aa, Homo sapiens
RADCYAQAENARNAIAKGSSQQVLNSRGALPYRNKVWYAVQDVDNCGAVHCDCRHRTVHSGAAASQQAKSIGPVKSTTRFDPVARLVCGAYSKAIPEKKADHLKLVAEVMSPVGSNRAAAYAGCKYNREAVLQSASFFKTPRDMTDSSPSASPSSLTIYFRLLSYVKPYMGLFALSILGFLIFASTQPMLGYILKYFVTVSPIRSCAIPTVPFWRL

SEQ ID NO: 955545 - protein, 49 aa, Homo sapiens
QQQLLIDPYAKQLVGETSIVVLQRCLATSSATRSDDPLVIDEARLVRPF

SEQ ID NO: 955546 - protein, 76 aa, Homo sapiens
QGSMPSVFTAWHYVDQPENAVHDCAMVDGRSEYQYAKLGHMFDFVHIEGVQAAMVISSEQQNACPPSFRLSELYRV

SEQ ID NO: 955547 - protein, 195 aa, Homo sapiens
GVADTTADSVIAQASRQLYRFLPWPMANFTGPTIDGLVQIVAIALHRVGELITEQLADVDTVDDHVTQFPLTVDLRQGVGHRVHGAIAAGDFHSDFGTVARLVLGRINDNALVVVFQQSVTVELEQPLLEVFLERLHLRRRRFARIFDRHAAFGDAFSIDHRANDRVERVIELGRSCLYCTLLALRSASILLVVS

SEQ ID NO: 955548 - protein, 92 aa, Homo sapiens
YRSVYDQVDVNYAVEEQASGSITASVGIAQSAGLILGGSITQNNFLGYLVTDVSIGLTRSEYQSRYNFGYTDPYWTADGVSLGYYAFYRTTE

SEQ ID NO: 955549 - protein, 112 aa, Homo sapiens
MATHHRDQDLKDQGTSLVVKVGTKVKNIRLCDGDHDIDCKIDGIGPMKLKSEFVRKVMNLLHSIPRPPRDGVSHSALIERNTHTEKPRNCQYTLAILRIRIILIETHQGERP

SEQ ID NO: 955550 - protein, 50 aa, Homo sapiens
FSLLLVADAHIDDQVTDNRQSWQRTNDQLVAFDHGGQRRDARQRRILPLM

SEQ ID NO: 955551 - protein, 63 aa, Homo sapiens
WVSHDCRPFLVGIRCLRDRLCVADPAGVYRRPASGVSLIKIGIPLLAGLSAVHGLVPPHQNDP

SEQ ID NO: 955552 - protein, 206 aa, Homo sapiens
TGALDNSPGGRIVSDGSQTVTAANVDNRAGVIGSQQALNLTTANLDNTAGLINSQADLTLTGQTVDSSLDGEISAKGDLKLIVQQLIQRQGRLIGERAVSLDLQGGNLENSAGLISAKGPLTFARLANLTNREQGEISSQTAFTIAAKRIDNGDRGVILSADQLRLEADTVVNANKGLISGWNGLTVVGNGLDNSAEGTLSSKRRP

SEQ ID NO: 955553 - protein, 62 aa, Homo sapiens
DSAEDARRYRVHKVRMLEYRVGRLVNQGKFTLWTLSSFGQAQKYATSDTSASSTSWANAQAR

SEQ ID NO: 955554 - protein, 99 aa, Homo sapiens
TGQLGRPNTGKHDPLHYTPEQRAQHGISEGLVRLSVGLEDSCRLAGRYPSGPGQVQRCQPAAHCDSGVCDEIASNPMGYAVPGRRSEGSDCRSACLMFF

SEQ ID NO: 955555 - protein, 66 aa, Homo sapiens
LKAVWPRFQHDTSTRPGSRNRSGRPGCLARCHVYGTKPELRQDQRRQARIADIDRQARGDQDGLAR

SEQ ID NO: 955556 - protein, 150 aa, Homo sapiens
AAPRTLAHVLLGWLDEFKLEHPTIRLQLLLNDSNADLFRETVNIALRFGVPRDSSLVALPVYPITIAIACASPDYLARHGTPHTPEDLAHHSTLRYMRRGQANSTWYFRQGALLQEVEVSGDYLSDDGEIVRRWTLAGHGIAYKANRVRS

SEQ ID NO: 955557 - protein, 91 aa, Homo sapiens
ILIRSTHKTSLCSWTNRIDAPIHKLLPKGYLLVLFLDRLVLPYGCIRHSDQKGDAIMAKRTSSRQFVTVFVSLLLSFGVNAADLTVGPRRV

SEQ ID NO: 955558 - protein, 94 aa, Homo sapiens
AQRVIAITTMHLLRTQAILRCDRPGTEEPVAFPVVARHADIAGFIHKLRLLLVYRLSGRLTQQSRRRGQQRQCARDMEQIATIHIVSPHSIRSN

SEQ ID NO: 955559 - protein, 47 aa, Homo sapiens
LSRGRTDYRCRCRYTDGDKHDENDDHAHGITVDHPLSAYLMVFTVTG

SEQ ID NO: 955560 - protein, 97 aa, Homo sapiens
RSNHQTVMYEQYQQNLQKQAQKQALRPGRSNARNLSNPKCQFWLQQDQNAPNEKTRANVLQFCDLMSNTAMNKHAVLQLILEKLTVDLDIVQRAAQS

SEQ ID NO: 955561 - protein, 82 aa, Homo sapiens
EQQHLEHLMLTSESALEQRRFWALACTPRTSLSLALTIPHSNLAVKKPGLRALVLFIPIAVHQLAKCRVPIIVLFARACCQQ

SEQ ID NO: 955562 - protein, 79 aa, Homo sapiens
MPNQALARADPRSKQSSAQAAGVRTKAPRELPPPQTPAIDAVLGSQEPSDRAFSTRRGERLVIRYRPYRRGPSYPPRKV

SEQ ID NO: 955563 - protein, 94 aa, Homo sapiens
MIVFSIAEVISHISRLAARSTISAARFLGRACDGYKPFGDLGSRIEGVLQSKKPLLSKAGYDIAAHWYELALVRSGHQQIEGLLAHRCTDAAQS

SEQ ID NO: 955564 - protein, 91 aa, Homo sapiens
LNIEAISRRKPALNCHCDDHSLLILQINRYSRHRTVIIGIRCCLPNNHRRTGTRIGYSRIDGSKSSAAGLQIRSIAEIIRFLPAKLNAAQS

SEQ ID NO: 955565 - protein, 122 aa, Homo sapiens
TSPVTGPQGRYAKVTPPLISGKSSPQFHNPTCANYTHHRSEHRCAGWRLRLGTLAPLFVLPASWTDLPRQYGLPMKQRSEHSMKLTYLGDRATPESLSSAIALSADPIKVSSSGKRQLGAAQ

SEQ ID NO: 955566 - protein, 72 aa, Homo sapiens
MNIEALDRMKRDSRITVYVLTPYVIKLAINIGAVDRPNGSKVHNKVMPRLGGLAIIYRCRRRLFSRRGPSRV

SEQ ID NO: 955567 - protein, 101 aa, Homo sapiens
PIANYSYEHHTVIGLVAVMAGKTPRIGESPFVAQDVDNDAITPFDMQAIDRLRENPGVLDPGMRCVYVHVRPLPPPSADFQRLSPIYVIIPIGYRISSRAE

SEQ ID NO: 955568 - protein, 50 aa, Homo sapiens
MAERRTGEYISRNITSQWGITNTERIANTAYDLWMQQEIFREPCAIEMAD

SEQ ID NO: 955569 - protein, 55 aa, Homo sapiens
AFLMRSDVPLSTSAGQQERQQLDDGVRITAQYVLSRVTLIEIGNHVARPVMAENR

SEQ ID NO: 955570 - protein, 172 aa, Homo sapiens
APVSLQAAYGNEVEALALPMHWASREVTRWIIGWNVRAWDYLLLAGWIDGALKPGPDPAAACQQDDGAVAILTLVVIAALASLGSIVAELSVAKDFTGAARMAHIALAGGTILSSWAFTQVMFALHYAHDFNSARRQWQPGGLQFPDTPEPDYLEFLYFAAVIGTSGQTADV

SEQ ID NO: 955571 - protein, 186 aa, Homo sapiens
MLRVSLVGAGQCGAHRNYQSGSCAASFCRIFIVLPRKCCARRMPSDVNLLLCGAPSPPHAHQSRGCLVSGGLTLRSSTCCHKRPALTATSGKQETTSHRQQDICRIFTDDPARTLHVKTMRLHWDGTNPGKMRAFAPDGLIMPATARFPLLPYLFALILGVLALGGYWYGLATGGAADVAAPAQAA

SEQ ID NO: 955572 - protein, 219 aa, Homo sapiens
RRELRSTCTSALTPRNETRTSQHSQQMTDRCRACHRRYQSGSRTANHDSRARLSPLVPSSASLWTYSSNSSRNASGIQTWPVTPNFVCTGGAAPGPTARREKPFSGRVGGGALQRLNLEITDAAEPHPGKKSKGQHEVELGRGVLCGEIQNCIAIGLRDWQQPIFKCLAWALTVRDAEVGGGSADRSLEPHPVEVLTTQGFPATAGRVEKEAPMPYPRI

SEQ ID NO: 955573 - protein, 86 aa, Homo sapiens
RRGRCGNPGCRLERMVEHASIGRKPDHADAYPVSKIMLVVRNCSQSCWHHAAATQTYNCTRLVLIIDEPALSGHVLRMDAPRRSQP

SEQ ID NO: 955574 - protein, 44 aa, Homo sapiens
PVLAPTRLTDSRTVARPSAPGRDVPLCLAHVDLTVCVGDSSTTS

SEQ ID NO: 955575 - protein, 47 aa, Homo sapiens
NGPALVLAYIVFGWLPSLLTRPWPDVPHDGGTWRPHGVCEGTPSTTS

SEQ ID NO: 955576 - protein, 206 aa, Homo sapiens
CGRQIRACCPFHTSLTLPTEADPSGMPTYRHANVLTKLRQEGFEPFMVCQTRVRNEDRREFTKHMIRMRHASQINGSEANEIILLNSHDGTSSYQMLAGMFRFVCHNGLVCGETTADIRVPHKGDVAGEVIEGAYEVLQGFEQVQASRDAMRVITLETGEEEILARSALALKYDDPTRPAPVSETQVLAARRFDDRRAELWSVYTA

SEQ ID NO: 955577 - protein, 59 aa, Homo sapiens
MDQAGGQRLLRVENAWRGDQVLFGLQFFDSIGGALGHDACVQLQVVIEAHRIFGHARVV

SEQ ID NO: 955578 - protein, 85 aa, Homo sapiens
ARQQRQQLAVVVAQLSLSLGVACAGALLGGFTAEAGNDGVNTVRGAFQLTFLTVGLMAMLAAAIFLQLSPKDGKRVVSREHDIEH

SEQ ID NO: 955579 - protein, 98 aa, Homo sapiens
TSSSRAVEHDVLWPADDRRRPFLTTLVKLTTVGTVVVSQQVAVGVQALDHRRKKALRSSSVNRTSGACLPSLPMGMRQDRGAHAVLATAQVDQDQVRP

SEQ ID NO: 955580 - protein, 83 aa, Homo sapiens
MPMALDMDREDRVYSARMPVSRYPEAFISIATKHSERIVDHHEFDRQLQLRQCKCKSHIKMVTPPYPRHRDHLSSRERRLSAD

SEQ ID NO: 955581 - protein, 104 aa, Homo sapiens
EPDWRSMGCSIDVSYPRTCATQRSSTWSQPEAIKRHGMPLAFARSMGCSYTAECQRAGLTHRGLRTQGLSTGKSGRRSRSISRVDVALQGPTRVGTLTYQTIPS

SEQ ID NO: 955582 - protein, 162 aa, Homo sapiens
MSYGSNNRGHCCSPSLKGWLRTERRHRYLSKRTKGLENYRLATGAANARPNISATWSTSPAVITSGGRKRTITAMAPAQFQDQPALEAFALHQRRQLAMHRWVALTIRRAKSGLTSSTPQHQPTPKDIPQVREVALQDAQVFAQALGHGRRNGLPGRDPQGP

SEQ ID NO: 955583 - protein, 67 aa, Homo sapiens
LTPDITGHSTYKLKHTEYRKTKFSIYPLLTKQNVLVDIGLNRMVYLIYCDNLTLLSHIAVAARWQLN

SEQ ID NO: 955584 - protein, 64 aa, Homo sapiens
INMSWLVNLVNGWLRICSVLERFINALAGSPADVHSVDSLARRLLTRRRTFRRIGRVVPRGDSS

SEQ ID NO: 955585 - protein, 119 aa, Homo sapiens
EVASAAVQDALVRLQPPIFLRYPSHVVNPIPVNGAAVEIPWYAWRQPTDKIMLIMRYEVPGSHDLIIYDDSFTVGQVPEGVPIRRLIPYDGLLKFNGTTPDLYYVYESANILASSRDPL

SEQ ID NO: 955586 - protein, 102 aa, Homo sapiens
MNWRCASACCRSTRPGTADVDVVHRQAEVAQFAVVTNGFLEPVLVVGQVGNRRAHMEVQQADALVQADARKRSTTDSNWADDSPEFGFLAYGVRPLARCLGR

SEQ ID NO: 955587 - protein, 36 aa, Homo sapiens
RTHSELYPCGAMPGCILFLLFLAHLFNFFDLHLFPA

SEQ ID NO: 955588 - protein, 168 aa, Homo sapiens
NAGGIGGVAFILADGDEQIKTSTQKPAKIPRTDFQKLQTSLSSLPYMDSNRELTVRLERLLSARSHALRGNASRDAPRHHCARLEPCIVSWTQSVRGGIPTRSVGTIINMEVQANPASTNNASNPIKSGTLATCSPTCTAASSSGHNGTSTELSWLSSLYERGIPTQV

SEQ ID NO: 955589 - protein, 221 aa, Homo sapiens
ECCWARLCPGTAAEQRQEAKAENKCRGATAHAGSFCVMPTFKCVCDCELRSGFLICMEDPNSNGSHADKIHMLKTLAVANYRSINKLVVPLDRLNLVTGPNGSGKSNLYRALRLLAETAQGGVINALAREGGLDSTFWAGPENISRRMRNGEVPVEAVVAQGVKRLRLGFAGEDFSYAISLGMPIPVPGSEFKLDPEIKKECIWAGPLYRPASLLVQRSGT

SEQ ID NO: 955590 - protein, 56 aa, Homo sapiens
IKDVITLLLYTPVIPGTIALTHTFGLNCPVTLTSTYGCDLYSTAKVPSRVQRLLRL

SEQ ID NO: 955591 - protein, 134 aa, Homo sapiens
RRTALEHVEGLGVLQVLVQVVLLATGFQAGRFQQAAQQGFQGGVLAGFGISVAMTLKAVDIVDSGHGLTGWADDWLFSTPIKAAKTAGCFNQMIDNERKCMLRFDDLQLFVRAADLGSLSPAPRVSWPCICGAQ

SEQ ID NO: 955592 - protein, 91 aa, Homo sapiens
LTTIAVTGAYAARVGSGLVISLAAAAKARYDSIVATHSARSSQSAQQHFRQQMQPHKCKSKRCRRSGCSVGDCAADLVLNIAAARAFQAKE

SEQ ID NO: 955593 - protein, 79 aa, Homo sapiens
ALRTIYQSMAHAPEILFQNAVSAQQTAKHPGPGGQPTSDVMQIYSVDTTAGAAATEKVAQGGVSDNLTSLLTVLKSFQP

SEQ ID NO: 955594 - protein, 85 aa, Homo sapiens
VDSTAYIQTRARSDGTRTHFTSEAHLSLVDCLPATKAFRLLALPHVNAINNNLFIVRSGPVNPAHRRSPRRLGGQRPFRYSSYYD

SEQ ID NO: 955595 - protein, 188 aa, Homo sapiens
MPMRIGTGGTARADAQQNRSMSDRPLLSQIDPFLASEAEIRRTISDFRFSPWGLTNRLLVSCCSCLPKVSYMVLDVVGIGLLFQPYPGMVLPVVETHRSGDVLQLKLQCSVADQPGCLHIHCAGSSELMPGQRPDFADRKLVGQRRRHQPSQFEIFRRNAQLLTVEQLVEPLKHMAELGIDGRIVRLI

SEQ ID NO: 955596 - protein, 158 aa, Homo sapiens
HECIDWTVGMDCTGMEWNAWNGINPSEVEWNRKEWNRMEWFQPEWNGKEWNQPEWNGMEWNGMEWVQHRIEWKGNGINPQWNGMLIAMAMAHAMEWHGMECNGMHSTRMEWQGSGLNPEWKWHEMELDMELTGMERYGIEWEWNDMEWNVHPVLTGTE

SEQ ID NO: 955597 - protein, 133 aa, Homo sapiens
MTHDHKRRYVDCQVKSRSSEQPMSGHTPATTLCGADFIWHDIGPRKPYCRQYATVRNNDLVRLRFMSIEPAHGVPITQIEGDDRHKPGRPGQVPVWWMSQRSRDVGGRRPLRAPEGNRGVLWLGNEPDERQCG

SEQ ID NO: 955598 - protein, 35 aa, Homo sapiens
LECTNAHVLPERVGATLQDMFRPIMSEVLVVVIGR

SEQ ID NO: 955599 - protein, 143 aa, Homo sapiens
MPYLRQARTYRRNCCMTAMSLEATALGEMIRDNSELDATNTTMRPVTTWNSNVPRSAVHSVMLGSRPVISGINTNAAKCYEEHLCARQDLAPKAGVEFILHVHASFCLVPEDLVTGIAQARDDVAVFIFQALIDGCGVNLYLR

SEQ ID NO: 955600 - protein, 52 aa, Homo sapiens
YVGYLRSELTCGQKYRGGFHDFTIMVRLAFTCSLRLVAGLRICGGYNLSQRM

SEQ ID NO: 955601 - protein, 115 aa, Homo sapiens
EEYRRMARLHPELDDQDLARLLALDEAQVAQLRQHLHSSEKAVEQAKVLLHEREQRLAEHQALHNGNLEAEQLDATLFSLEQQLLEGEKHCAELLRNAKAKTSAARMPNPGPWPE

SEQ ID NO: 955602 - protein, 111 aa, Homo sapiens
SSTLSWRRAYRARRKVSRICSSYPILFIKKDWIYLYTSFSNFCRDCKKRLLSEWDSSQRAFKCLGRQQVNEIIAPFISEDLGDISETIESRLSQFALRHSVNKVPASDSWG

SEQ ID NO: 955603 - protein, 53 aa, Homo sapiens
YTAHHHAAGCACRTQTGFLTFLDDEIFLIQQPIQPRAEQGIDTYCHTLHGGVR

SEQ ID NO: 955604 - protein, 41 aa, Homo sapiens
SGAILDNGGTLHPAMPRCVKKASGCKALLSGKKSHLLILGA

SEQ ID NO: 955605 - protein, 53 aa, Homo sapiens
EYLHTIMPQVRLPNLQTGYLTFLDDEIFLIQQPIQPRAERGSTPRQSLTGGVV

SEQ ID NO: 955606 - protein, 166 aa, Homo sapiens
YHARPLAIDQYALATLGIDEPELTKLEHFIGPPLLQAFMQFYAFDEAKAWEAVNFYRERFKVTGLYENRVFDGVMPLLEELNIQGRQLYVATSKPWEFAREIARHFDFAKYFKVIYGSELDGTRTNKVELIAHLMREERLDPATTLMIGDRKHDLIGARSNGLDSG

SEQ ID NO: 955607 - protein, 115 aa, Homo sapiens
MLAYRLADASTGEVKVGAFKFRLPETTGGAVENIHASVRQWLEKLTQRLRGLHQARGVVLLLPLGETQDDRKVRFSTAARVAWISSMAKRERLARLPPYTSVRWLLPSQKNWSTT

SEQ ID NO: 955608 - protein, 124 aa, Homo sapiens
MSLTALGNFVAHARIARGLYWLTARLADKHIALDLAVGVVPPRAGRRQGLGFGHAFIFLVLGEQGQAVFRVGAPGEAGGDELALVIDVVDIVLRIIRQAGQAVEKLALLVQRGRPGRWPGSGVR

SEQ ID NO: 955609 - protein, 132 aa, Homo sapiens
VNDSDESTLRWRNVRDASPNDTTTLISAAAGAVVKGGLYERFRSTRRCRWLQQNLPGVDLSWFKGLQKPQGDIGFESYSPNFYYQNSRVTAVYTADIDKLRALMPPKLLAAVQPLQVLGRVAGLIAYTAYTL

SEQ ID NO: 955610 - protein, 87 aa, Homo sapiens
MGEASAPCLQVSIEIHVPIPVRPVAVSVVPAQGPRRRKYYRRQSWPKAWNLEHAISRGVHFALRLLNLFLKLPKKGFVAFQQNSGKD

SEQ ID NO: 955611 - protein, 39 aa, Homo sapiens
RSFRQLRRMQGTGTGASPDRDTSGLLMIAKKRRCCATCT

SEQ ID NO: 955612 - protein, 56 aa, Homo sapiens
RESTWVAERRDASPRNNHIDIALQQVPSVKGGLYERFRFKPAVSVFAEELTGVDLK

SEQ ID NO: 955613 - protein, 118 aa, Homo sapiens
GEAEIQPRKTNDLRQQVPSVKVGCTTLSVKTAVSVGLSRITGLIEAWFTGVAKHKVDIGFESYSPNFYYQNSRVTAVYTADIDKLRALMPPQGTGRRAALAKSGRVAGLIAFTAYTYE

SEQ ID NO: 955614 - protein, 143 aa, Homo sapiens
PVTDSESQLAVGGTPRCQPNDTTTRYRGSRCRCPGWLVRTVSVQPALSVVAAELTGVDLSWFKGLPKHKVDIGFEFYSANFKLTEQAGNSSLITGGIDKASGVDATAWYLAAVKPLASLPGRGLIRVYLGTPIRIEIFGIHSG

SEQ ID NO: 955615 - protein, 90 aa, Homo sapiens
MGRDWGGVRAASASGIEITRYQGVPVAVSVSSSKPAPLLYRRQSLTRLRFEHANSRGYIRLRSNLFPNSKKALGFKTPEDSQSLGVYLGL

SEQ ID NO: 955616 - protein, 75 aa, Homo sapiens
RCETVRHRGVCEQYRVISVKVQASQNRLIYRPFYTDSGTAVIQRIDELGVMHEVWRVNLAVGGRADRLWYTIDDL

SEQ ID NO: 955617 - protein, 185 aa, Homo sapiens
NDSESPVQRLKHPQRNAPMKKSSIALLLLSLSPLAGFAATAPLDLVGPVSDYQIYVTEEIAELVTPDQAFTDAINKGDLGTAKKLYAPTRVHYESIEPIAELFKRPRRVHRLTASTITEKGVKAEDFTGIHRIEYSLFSEKNTQGLAVLAQKQLNKDVQDLKNRVDELTFPPEKDRRRRPTADER

SEQ ID NO: 955618 - protein, 77 aa, Homo sapiens
MVHGAVLRAVTPSYRCRCITAVTDCLVVKISERIQTDVALCFCPLQLKSPGNSAAATDNARLERKRSYKPPLTTGTC

SEQ ID NO: 955619 - protein, 111 aa, Homo sapiens
RRCQSTTHHIDSRQQCRRQGGCTTLSLNRVSVVEQNTRVDLAGSQGAKHKVDIGFESYSADFYYQNSLGNSSLYSGIDKARALMPPQVLSAVNTSKSGRVRGLIATAYTYE

SEQ ID NO: 955620 - protein, 92 aa, Homo sapiens
SRGSRDIPESRALTDEDVTMINAYYCRLSSRTLGTRFIAEALRVVAYILRQHAAICVAFQVRIDGGLRDQQHKQQVDRGPSIASKSIGSVPG

SEQ ID NO: 955621 - protein, 75 aa, Homo sapiens
MSPCGLTQRYYYRLNGRRSDSVQCCARCCMGGGGHHVMQLFFNFDDQHCFEYLLLKQGGAGLDVFFVISGLVIIL

SEQ ID NO: 955622 - protein, 90 aa, Homo sapiens
YQRVNFVAERRDASPTTHPHDIAAAVPSSGACTTLSSTACRGCSRIPGVDLSCSKGAKHKVDIGFESTAQFYYQNSRVTAVYTADIDKLR

SEQ ID NO: 955623 - protein, 45 aa, Homo sapiens
RIRDIQRVLALDGFDASTAPVDCCCAAVRKRTIALDCYGDRSMLT

SEQ ID NO: 955624 - protein, 85 aa, Homo sapiens
EVAHDLFGELCVGLVDYKMNHSPSVTAKPRQVLHQRMVGAAIAGNEGVTSMKLHALPLMRGGRILVCAPGNTPRCRALRGWSCRT

SEQ ID NO: 955625 - protein, 77 aa, Homo sapiens
MIGIFGRDLLRAHARGSLAVHNGSVTTLAFQRFYVLVKHRLLSLALGKLIGAGDREEKQERPEEYHTYMISEDAEPR

SEQ ID NO: 955626 - protein, 63 aa, Homo sapiens
IQVIRLKYDLAAPKEDQVMVDHANNGEHYDQLIAADNEKGNQIVRDSDCALCVQARPVLDRGL

SEQ ID NO: 955627 - protein, 110 aa, Homo sapiens
APYGYALVGCEALIRDFKHQDNGLLGIRVEGGRRYRVRESGVQKDQLLVADVQWLQELPDQPLGEEDADLLALLEALAKHPMAASLNMGGQAEGHQALSKYSGQYLLTLN

SEQ ID NO: 955628 - protein, 103 aa, Homo sapiens
GTVTSGDWQYTYRPISSVLLRLLRLIERRYVLQGHKSFAAIIAGIHHNLRVVRIKDLKAHSLVESDFGWCAPKLDMRIPCNHFFHHRSANTKPTVLMMNNHIR

SEQ ID NO: 955629 - protein, 145 aa, Homo sapiens
MRFAIAGAGELCAEFAASTTLGGLVDKLHVPSVGPGAAQKLADKFGSLESVIKAELGLIFARRCPEKQAKAVRDFFDNSENASHALAIEQQLKDYGMALAEREKRSLKACPKAGAHLGTHGLPGADEPRCGQGQARKPGGQGGRF

SEQ ID NO: 955630 - protein, 200 aa, Homo sapiens
RVCPAWPPHSREASMSIIDFYYYNEGKRVREIAGDEHVKLGESRSGFCWIALSEPTPEELLAIQRTYNLHPLAIDNAMHPLCPPKLEVYNDELYVVAQTAELVADRISYGKMAIFTGHNHLITVRHGNAGALGKLREQTRGNRPTQFGKGVDYVLHAILHRLVDQYLPIFEMIEDDVLAMERRALHDFLGPEEVARIFEL

SEQ ID NO: 955631 - protein, 174 aa, Homo sapiens
DIQVIVHLETPGRFAGARHAGKHHLGVPGNIHIDIAQIMFTGATYPDKTGLPGGGGGMLRCEVMGNLVLRLHPAHALGQGIGTVGFAQQVDIGAEQMMEDRMSRVWPEVNSTGTGGFCARAQVARSVLLTRPGITTSVKIRSGDTPGLKHLHRAVAILGGQYGKPDCFSNSNTV

SEQ ID NO: 955632 - protein, 195 aa, Homo sapiens
YRVLSANASSSLSISVDPLMADSSRKGGSLTAFRGVMLLAREPSRFYNCRGQPPARPGGFVMLKLYGFAVSNYYNMVKLALLEKGLPFEEVPFYAGQTPEALAISPRGKVPVLGVEQGFINETAVILPYIDDTQPGVKLLPADPFQRARVLALAKEIELYIELPARASFAEGFFGMPVPEAIKEKTRGELLLGLA

SEQ ID NO: 955633 - protein, 65 aa, Homo sapiens
IARSAHQMKYSFRIYSQRRALCFFSVACQTMELIYSLAEVLWQSVHVIVVIPYILLFPRTVHSIY

SEQ ID NO: 955634 - protein, 88 aa, Homo sapiens
CNPDFSDQASLTLDIAAFCSSMKYSLSHFFTGRAPCFLARLPNYELIYSSMRYSEQSDQVIVIIPYITAVSSLTVHSIYRVIAVPEYR

SEQ ID NO: 955635 - protein, 39 aa, Homo sapiens
MVRAPLKKCEKLYFIDESKNCDSRDQYLDRANRGCISTT

SEQ ID NO: 955636 - protein, 84 aa, Homo sapiens
ILTCNPVSRISILTLRYRSVLFLRMKYSFSHFFKGPRPMLLSVLAKLSAHLVSADGTLAIPYHVTVVIPVSYCVFPRYRPLHAT

SEQ ID NO: 955637 - protein, 90 aa, Homo sapiens
QARISRIKHTDPGISQRFAPQMKYASVISSRGAPYAAERRLSNYELIYSLMRYSGSSVHVTVDNTRITLLFPRTVHSIYRVIAVFLNIDR

SEQ ID NO: 955638 - protein, 33 aa, Homo sapiens
MANNIMHSRTGHLRTVCFTMVRGGKQYRVCIPC

SEQ ID NO: 955639 - protein, 215 aa, Homo sapiens
YSAQWPEQEHGNVSVPAAVTVTTSQRRYNEAVSRRSITDMEHGEQISHSRTVHRLTVASPCAAAVHQTVLHPGNKEFTTGEHIQRPQGGGEGEGPGKAGYSGEGMDEFCIPDHSGYEFLEFLFEDLELTNLVKRNLTGTDNFKTVRAGISHEGFPSRINIIRTLRSAHSRRIALSGSSRATLKQSKEELERLKREDPDNFGGYPGNRGGNRTNQS

SEQ ID NO: 955640 - protein, 210 aa, Homo sapiens
ELGKPSVVTCGRNRDHYKKAVEEAVSRRIHHRYGAWSNKSSFPDGTSTNRCFTIAAVANRPWCIPVYNGNSPPANISSAHKAVAAVKVPGKAGYSGEGMDKFVFQITQEEFLEFMFEDLELPNLVQTQPDRHRYLLDRYAQGIINEGNPSRINIIRTLRSAHARRIALSGSSRAKFYQAKEELARLKREDPDHFGDIQDIEAEIRKLSAR

SEQ ID NO: 955641 - protein, 225 aa, Homo sapiens
TPKWNQGTLLGYANHLHDNDRWPMGDSGAGVALPPRFDAALELVPCSLPLTLSQQQDKAMALGMMHDLQPRAPFKRRVRRWLQQLLAGRSPSPYGENEFFRKAVRRHELLWVLKQDETLLKAGLQGLPPLFFAGLRARSQIAAWRVMKPRFKVLQLQPDYNVKTHDFADLGEQIVKALPAERFEVTSGFLSGRPLPGQPLSVAEHSHYFELPEKSLKGIRIGAMW

SEQ ID NO: 955642 - protein, 168 aa, Homo sapiens
MAIAAGENGLPAEVEALGSVCIHFKEVAGQLANLVIAQAHLIKRWQVEYSDRHLREASFFDHQTCQPRHFADVGRDAQRVMTQVQVLKVLQVAQGAALVVVKRIWLFARLSDLSLGRLNTAPGMSFKVYAVDQQAFQVGKVLEKSLGNRRSFLCSQFQLRNVLEIDIQ

SEQ ID NO: 955643 - protein, 170 aa, Homo sapiens
ASNTWICLVIFRGMNHGHVQYEASSSRNFRHDGFKDLADKVDKFTRRGVAIRSRNSQGEWGGRQDEFNRLIEPGQCVWRRSRQGQSEVGAEPKQGDAGRGRVQALFSLFGKLPYPSGTFDPLKHSKCFERLLLPADRPPSCGVQIAGGADRAPSVHHVRNLGNRPANTPF

SEQ ID NO: 955644 - protein, 180 aa, Homo sapiens
MSSPIPRGWHALDSACLQDCFVEPVGSTLVPVRLTRSRGGVYAFRALYSSRALRSTAEIVRYTMLGSTVGIPLSNISTVSEEEKAFREAELVASRRQQKTIKRVGCCLTSQFKRGENVGCVLKGPKFQVMGVSRLNALHMPYSGDTMSCRRSLLREVAGSSWRNRIPGRGVRTKNIRIDS

SEQ ID NO: 955645 - protein, 207 aa, Homo sapiens
ERQPGIHGGGYDQVIAGARSHDLALHDFGAVESIHMQLDAGLLLELPGRLRFKKPEPVNRYTEDSAAAAGVLVAAPRSEAKKIARKCARLIMTIPVHTTRLHGYRKLGVNIPSINEVVNTYKYLALACKALTLKGENMSLDLHSLAWHRSVGKLIMQLNRPEFWSSLIRVLNEYVQIDNWVVLVLGDHAVRVISLPEVADGFHWGGD

SEQ ID NO: 955646 - protein, 142 aa, Homo sapiens
NRAGRQTSAHVHCVAFEPQVVGQVGEDIAVVFNAIEFHGQCLRYAVTAVWLAQLKAKRGSGIEVKRPADKGFQLFVKPNKFFTIASQSNYSVRTKIAPHGYKERRHGLFQNSANALLLLITGAWLVVFLLTRSVLLITHLSE

SEQ ID NO: 955647 - protein, 145 aa, Homo sapiens
RRTRQQPLERLTVPIAGSFATNNSEALRDAALNHLGIALLPDFSAQAALAAGKVVQVLKDWTLKGAFADEIYLIRPYSPHVPKSVTVLVGYLKEKLQAGFNLVAADEGSCRSELAREKTENPALNLIARVIVGDLREQARSYRGQ

SEQ ID NO: 955648 - protein, 121 aa, Homo sapiens
IRRTKNMQNQNNKYDTNRDSADTLRTYHGRLSKYKESHSYARSSDANYRFARAVQALKRSHLMSSTRIIIVALGEMEVGLIVDAANDCPRSSYKKHGADYLKVIEAVKAEYIFTVYRKIGN

SEQ ID NO: 955649 - protein, 33 aa, Homo sapiens
MPYYNSIVAIRDNQFWRLVSLCEENLFSILEFL

SEQ ID NO: 955650 - protein, 43 aa, Homo sapiens
YRPQCLVDVCRPLAHARTAGTGVSQFDAAVNAIKQADRQLLFK

SEQ ID NO: 955651 - protein, 142 aa, Homo sapiens
PYSIKPGSRSANPGHLNSGKRSGGFCRSRRSGGGHVVCPQTLPWAKNGDSIMSLVANAKNVEGLEFVLVTSDHGFQDYDIKGHSVLRRACIPHDIKKGENFNLYHGESSKSGVKWTGDLADSLHKWFSSENTQQPERCELRK

SEQ ID NO: 955652 - protein, 69 aa, Homo sapiens
AWDWNVTLAELMNPSLSVAGFTPRRKRPSIWLLLPVLLLVGLSLLPLAYVGLKAWQAGWTEAVHLLWRP

SEQ ID NO: 955653 - protein, 144 aa, Homo sapiens
QSAQKHLRQQMQPHRQVEALSPIRLQRLATAQRTLAETAAARAFQANALAQIQAVQAQLLADRTLEQQRLRAQITDVGRQQSLARLAEIRLAEAAVTNQQTSAQSAHNQSLSAEVIAQSRVNCRKRGIGSLREQLTRLQSQHKV

SEQ ID NO: 955654 - protein, 74 aa, Homo sapiens
MGPPRRDVRPALFAIAFAQLDDTFDDFVEHLPGHRHGHQHAKRWHRHGHQVETEQANAHVMRGAQWARGLIDIC

SEQ ID NO: 955655 - protein, 62 aa, Homo sapiens
QREGGFGVQVELLRPSRRTRSTVLDMEYTTLKVVCEHQLSASMPHDADMAEIWTKVVPDHAA

SEQ ID NO: 955656 - protein, 50 aa, Homo sapiens
MSIGIGYSYRFNTRLGRCYLLRTFCEVADCIGGVGKNRADSDFSTKSWWL

SEQ ID NO: 955657 - protein, 151 aa, Homo sapiens
RGTGLPGNRMLEQAISPTGVQRCASINPFASKSSAISGELTFEYYIRRHEHRTMPAAGRSVRWAKAQRYPGVADQGRMWQAIPNGVHLNVIQASRTCRGWKPGPTFKAIDDVCLELLTARQLVISGLPGSAGAGGVMLELDADIVLAHEGV

SEQ ID NO: 955658 - protein, 114 aa, Homo sapiens
QRTAMGQRLYARYLQANTRRQGIYGKGMNRTSAEERQESRKSIDNNLSRNSQANSTSVENHTLRSSTYGIIVIPEETIEDIRRAVDLVDVISDSVQLTKTTTKLLWTMSVPWGA

SEQ ID NO: 955659 - protein, 142 aa, Homo sapiens
STSRGLSVDSTSYRMASMLVTRQIPSFTARERHIERKSWGSDFMPGTYKDTSVGKALYGTGMNTYNRRRTTGVSTQSFDKNFVETRRKIRPRSRIIHYGVVHLGYRIPEETIEEIRRAVDLVDVNSDYVQLTKQDAIILDYV

SEQ ID NO: 955660 - protein, 121 aa, Homo sapiens
MITERASSSGGCCRDGAEQLDDVEGGNHLIAIRLKVVPAIGCERIGRHRREAETNEKSEGGAGEQMLHADFDAGAIDNAYEAVFEGAGSIWSGRIMQKARRYSTGLSPDSLWRHCESIARR

SEQ ID NO: 955661 - protein, 57 aa, Homo sapiens
ETRGSRWCIDCPGRFGCVVGIRRHAPHAALAREVIERGGLLAGLGGDHPGLSGKRGG

SEQ ID NO: 955662 - protein, 60 aa, Homo sapiens
AHGGGGRTHRLVDGVVDRGGSAVACNFQFFEVAAGSVSDLTVCVLLSINTSSVGAGTVTV

SEQ ID NO: 955663 - protein, 126 aa, Homo sapiens
MPRLLWEDSLLNNRYAELIYAAYANASLFAVRSASHKLLNYAQNAREYLDFRYQGLTVAFDALELNITRLEEDMAMMQTRQRVVSDEVKHEVEQALNATADFMGAQKTALHQAIGHVFSARNILDL

SEQ ID NO: 955664 - protein, 52 aa, Homo sapiens
KTVVGYAGYAMIPRASRSFQVFQKQTSRISLQERLETYQFGEAIAAIATHGH

SEQ ID NO: 955665 - protein, 97 aa, Homo sapiens
SRCHNLTGLHIGDRTPGSIFIARLGPWWPWPAGMGGKQSGYKEVWRMTIPVLVGSYQQRDFLLAYSQADITDPTHSKCTSQSDASAVLRPYGALHLQ

SEQ ID NO: 955666 - protein, 72 aa, Homo sapiens
PALSDVPMLGGMRTFEQQVSEITPYRTDFSSTTSDVSTHHIDAVMPQLVADLLSRTPIRLAMVARRTDRHGT

SEQ ID NO: 955667 - protein, 58 aa, Homo sapiens
MTCNDVIDDSNYYYDMGRFTSESTHSTCQASQDSQCRLRFYGITGGQYVGSCKTSPAV

SEQ ID NO: 955668 - protein, 49 aa, Homo sapiens
MAQMDSGDGLTHTVPIYEGYALHPCHPAIWTLAGPGPDLTTSLKILTAA

SEQ ID NO: 955669 - protein, 68 aa, Homo sapiens
RHSRSVTGSLFWLAGHAEEARVGLDHPGAVPILEVVLHRGCMHAGLHGHVLYFVVLGWILVDHLVLLH

SEQ ID NO: 955670 - protein, 45 aa, Homo sapiens
SPLETLSYPRSGTISFSPALRFAPDEDPIRGSQRLPPPSRGPPGV

SEQ ID NO: 955671 - protein, 66 aa, Homo sapiens
ELGPAVVRIAADTVLRYELMDRIRPWSLFHSAIERKLEQRAFEEGRPNPVRFIPTGFQQSPRLLCD

SEQ ID NO: 955672 - protein, 34 aa, Homo sapiens
MLFYRKTIGYKVPRNPELPNAAQAQKEEQLKIDE

SEQ ID NO: 955673 - protein, 36 aa, Homo sapiens
TRCKIKNPLPSIETIEQEKQARRIVYEACAAYMHCT

SEQ ID NO: 955674 - protein, 70 aa, Homo sapiens
RQDVQVEETRCWWQAIEDSLMVVSTIKSSSAMVLKWLMDLPSSPQESAAFPLCAIFVSSPRPFPYGFLVL

SEQ ID NO: 955675 - protein, 109 aa, Homo sapiens
FTQAKALTTREETRCEATLTRHPQYGQQECLKHRARSTPWELPGASPSFLAVDSVPHSLAPRYLHWECPVDPLSSSGHFLQELRVRVSTLSRTALVSEGWCARVPIRIS

SEQ ID NO: 955676 - protein, 38 aa, Homo sapiens
QVLQVETETLQAERNSRSKSIGAAKARGEDIEPLRREV

SEQ ID NO: 955677 - protein, 78 aa, Homo sapiens
LRQRKPRGTLARYHIFTRVKATYSGGTLGMSSAIQHHADELRPMGPSPPQDMPHNRFLVDTTVAVLMPCPPAARLFSC

SEQ ID NO: 955678 - protein, 162 aa, Homo sapiens
SHIPIAGLSQDNKKRHRGPHPMSSQCYDQSQIQEYEVSAFNMTSPEPVMASLTSEDLHDMLASLGKNPTDEYLEGMMIEAPGPINFTMSLTMSVGEAERHGPRGCASQRLRLLTTRKPQVTSMRTTSVELLTTMGDRFTDAEVDEMYREAPLDTQGNFNSVG

SEQ ID NO: 955679 - protein, 126 aa, Homo sapiens
MKDDRRDRYSAGKRGGFNTFRDRENYDRGYSSLLKRDFGAKTQNGVYSAANYTNGSFGSNFVSAGIQTSFRTGNPTGTYQNGYDSTQQYGSNVPNMHNGMNQQAYAYPATAAAPMIGYPMPTGYSQ

SEQ ID NO: 955680 - protein, 46 aa, Homo sapiens
SRGIPEEEKMYKEKRRDAGGRALRTASGCINYKELVRIVLKWTEDL

SEQ ID NO: 955681 - protein, 83 aa, Homo sapiens
VSPSGMRWYLVVDCSGYAISGPTTMTVFEDESTSSRVSSTKSELRHPKPKNAKGHLSPETDTFSLGSGDRADHLERPLAVDAS

SEQ ID NO: 955682 - protein, 69 aa, Homo sapiens
RCCMIIFCLDRQYNVVLFSSRFLTTQLLWAKYPRPLAYSMWDKSVGCKVVIMVQVARWLKGQTPIYLRA

SEQ ID NO: 955683 - protein, 51 aa, Homo sapiens
WECSVLSGRLDIYEKDASGKGSAVDRRDKGSISEGSAYLYPSLHINWNDLK

SEQ ID NO: 955684 - protein, 42 aa, Homo sapiens
GSPVERRDVTTCLRTLHIALADQYTLSVDEWILAQPSAWRPG

SEQ ID NO: 955685 - protein, 30 aa, Homo sapiens
MAYSSDQPHSPRSNSHAHPNPLRLHRCSHA

SEQ ID NO: 955686 - protein, 45 aa, Homo sapiens
MWSCLPLSRSLSILLSAGDLGATEQEECEQLARQLLRTPTTHGDF

SEQ ID NO: 955687 - protein, 122 aa, Homo sapiens
HRRDRCCMLFMRGNVISGAPIIRGTSQLPLPPIVMGITMNDRLLQMHGLWRLPLLESVRLHLKGRLCWSHLALFSCRDGQENRELRCLLYSRTDDDLLMDWIEGLWGRQNCINTLDFALDRW

SEQ ID NO: 955688 - protein, 54 aa, Homo sapiens
PVREETRCTREETDAYVVYAGKRSYRGHRLLGELVSCPLPPQCDWVLLLNEDYY

SEQ ID NO: 955689 - protein, 42 aa, Homo sapiens
IPAEKRRDGPARHLLGDHIYTLSSQPMHLYNLLHCITLHNLE

SEQ ID NO: 955690 - protein, 109 aa, Homo sapiens
AVGVPVYCVLSPLVSLGLRTSVFSSHWVYPGWVAWEILLYVCSAVGMYVCVVAVSLLVLYWVALVATAERPNIQSFPRTELTRAPLPSHPQEFQAHESPSIHIQCGLEL

SEQ ID NO: 955691 - protein, 55 aa, Homo sapiens
RSLLSKNNGMILPGHPFSNSRTSFTVDNKGSTYDRWIDLVCLCILSVHYESRPSD

SEQ ID NO: 955692 - protein, 90 aa, Homo sapiens
LPVIENKVCNRYEFLKEESNPPNSVLGIWPEALTVARVTVEGLWFASRRTNTFYKESLLGVLAVHAPISLVSMFVFQGLFTWIDGVMKND

SEQ ID NO: 955693 - protein, 95 aa, Homo sapiens
AVCCRSSLQDTPPSIAENLPVDWGGVLQRPTGRLSWRWCALVYSCCLWIVFFLQVALPPHHDWGLEQHGGRKSSRILGHFTPVFLLDGLFGRTGF

SEQ ID NO: 955694 - protein, 92 aa, Homo sapiens
QASPAAQGLNKELSHCLHAGNREKPQHHWLPPTLAEKPEAGQGQSNAGSMSTRSARLRMVRYLSESIPTLHTLGLSLSALQDLCQELHAKAV

SEQ ID NO: 955695 - protein, 32 aa, Homo sapiens
MVEQIESETAFQEALDAAGDKLLVVDFSAIEV

SEQ ID NO: 955696 - protein, 76 aa, Homo sapiens
AEVFFDGVRVPSENVLGRLGVASRMPCTSSTMEGSGMDAALSGTMRGIIAKAREYTCPSPQETQTEFLLSYMPCVH

SEQ ID NO: 955697 - protein, 79 aa, Homo sapiens
IDILPGPKDTHTLSFPWAMALGATHRRDEEAQTAPRPQSFQVGELGMEHENDMLVKYITGCDHKAEGASLLWRGFSFIL

SEQ ID NO: 955698 - protein, 40 aa, Homo sapiens
MDTSHKLHCEPGHSAPIPPVCGSLKGPPPNRTAKFSAIEV

SEQ ID NO: 955699 - protein, 54 aa, Homo sapiens
ARALTPPAPQRDRVDLNFPSSAGGPGKERTEVCQGPWVPRWGQALGWFPGRSGP

SEQ ID NO: 955700 - protein, 94 aa, Homo sapiens
KAKVRLQFHDVAGDIFHQQCKRNELVIRVHPIEALYTKMMTKKPGMFFNPEESELDLTYCYRFNIVNLPDAYKRLILDFFCGSQMHLLLRYELP

SEQ ID NO: 955701 - protein, 78 aa, Homo sapiens
SSTDPPHFDRGEISKTHYRQCYSHESVFVEDLKHPGQVEEGGFIGKEMVLLTGVTSGHYGQLSCNGSTPLSPMVHLHT

SEQ ID NO: 955702 - protein, 55 aa, Homo sapiens
SSQKGKMCRCLNSELKNCERTTWMSLEAQAEKYSQNVDKYEEEIMVLSDKLKDAE

SEQ ID NO: 955703 - protein, 120 aa, Homo sapiens
MVYFMAIVKNNDLMSKYWLKAYSRASRFLSNIMCNKVESQLLSKDRRLNHYVHFEDATIYTHPNYYIHIQDLKTTSPAQNAYSLAPKPYSHLTITLQGDTSNVPTTKFLCTGFYPEKSKM

SEQ ID NO: 955704 - protein, 179 aa, Homo sapiens
NSHQQTLIELLMCARPGTKEEHTEVLNKVLALEELLDDLRKKKYGGQKHLSNPGFSPISVVSGNGKAKKGDLMNKGPRHTCTGYTCTKHVQSPRNYRTRVQTQGAYVSHVGGIQVQSPYVHKPCDYGTRTPISQVRLEKKGKNPKGPLKPLQRLKAGNLATLGAREKKFLPKKTGERER

SEQ ID NO: 955705 - protein, 66 aa, Homo sapiens
PSKVGGIVGNEDTVSRLEVFAREGNVPNIIIAGPPGTGKTTSILCLARPLLGPALKDAHVGTQCFI

SEQ ID NO: 955706 - protein, 70 aa, Homo sapiens
KLRLAGDQRNASYPHCLQFNLQPPSENISLIEFENLAIDRDKLLKSLEKIAVSYVKGTEHYQTKWDSELP

SEQ ID NO: 955707 - protein, 69 aa, Homo sapiens
RGAAFRLVSSDECPPRICSAKKACPPCRDVRVAPIQMGTRPSFSEPWEPPHRMVFAAQTNRVVRAYPRV

SEQ ID NO: 955708 - protein, 149 aa, Homo sapiens
GTLGKQKVEEPDQVSFIPGMQGWFNICKSINVIHHINKTNDKNHMIISTDAEEAFDKIQHRVMLKTLNKLGIEGTYLKIIRAIYDKPIANIILNGQKLEAFPLKTSTRQGYPLLPLLFNIKSGQGNQARERNKGYSNRKTGSQIVSVCR

SEQ ID NO: 955709 - protein, 89 aa, Homo sapiens
RTALLTGQTPGTHYQLDVQLYHWELLGPASPPAHVIVGPSAPSALRQLYALRRLRLRDTADMEAPGGSAWANIQVRGWMCTWLRVQETH

SEQ ID NO: 955710 - protein, 78 aa, Homo sapiens
ISNNKRDAVDKPRGFARGLDPERIIGATDSSGELMFLMKWKDLDEAHSVLAKEANMKCPQTVIAFSEERQTWPSCSRG

SEQ ID NO: 955711 - protein, 102 aa, Homo sapiens
VYFDRGEFVSPTCEGGILSEEPQAGDFGAECPGSQCSLWIVSILQVSSSSTSDWVFEKDGGWKSSRILGNFTPVSPVSSGLFGSAVVFFSCDRSCATLRFAE

SEQ ID NO: 955712 - protein, 42 aa, Homo sapiens
VRRLRFKDVISCKGADCCEQTGDNAYAIVLEFGLVGYFPLRD

SEQ ID NO: 955713 - protein, 38 aa, Homo sapiens
AKFPKARVTTYEIVWATARNAPIRRSLSLMLTLIRHME

SEQ ID NO: 955714 - protein, 42 aa, Homo sapiens
DSSTDPHTSIAEKSKSILEHLGKIESWEELVIALTFSYNICS

SEQ ID NO: 955715 - protein, 30 aa, Homo sapiens
MMLESFLIAIRLARGELRLCFSTAVRGLLS

SEQ ID NO: 955716 - protein, 35 aa, Homo sapiens
HHSIAEKSNEGETTGNPGDGDEGEGDGMFDLLLFF

SEQ ID NO: 955717 - protein, 62 aa, Homo sapiens
RIPYTSIAENHASGFRNRFLFTMEGPGFTHTLAVLYPAFCLYMLVEDHGRGIRCPTNPTTCT

SEQ ID NO: 955718 - protein, 69 aa, Homo sapiens
IGMVWIQSRKWREGHGKPFPYRRPPCTHSDRLGAKRKWTMQRQVDVSRIQQGDLSSDCLERVGLMPLQS

SEQ ID NO: 955719 - protein, 45 aa, Homo sapiens
DPPGLHVEDDLDTVVVPDHKLRHRTLRSIGNVAAIECHLETSPSG

SEQ ID NO: 955720 - protein, 42 aa, Homo sapiens
DGEVSDGEDQTQDTELVETRPAGDRTVQKWAAVVVPSGEEQR

SEQ ID NO: 955721 - protein, 87 aa, Homo sapiens
DHIKTALSSKDGLLPTKYRLFRRTAPRTDRPRDLNLAPVPVRFRLDTNLVKKPAGCITGAPNVTTAPTLFAFFPDSVCRSVASVSTL

SEQ ID NO: 955722 - protein, 99 aa, Homo sapiens
MVDTEEAMEDIEEVTEEIEEVMEDIEEAMEETEIRGGYGGDRVGGSGSGGHLKWRLWDETGMVSALERNRGGDFGGKRSGYGGQMGLRAHYRNDGQHSA

SEQ ID NO: 955723 - protein, 170 aa, Homo sapiens
MIHEDTTIITPSLALSIDHRRTDKQELHSREAAVLQLSDPTGCMNDVQRCKDIMDLKQELHNSVAIPEKENTKLQKQREDELIQKIHKLVQKRDFLVDDAEVKRITEQDEDKEMADFLRIKLKPLDKVTKSSASFLAENKAEPPPSKPTEANTGLALINDCCWATHCNIM

SEQ ID NO: 955724 - protein, 72 aa, Homo sapiens
ADSMYGCHVDGTLALRPQPRNWHSSAVRMPPNYRLLDELAEGLNCVSYGPAARVYKHYDLTLSDGPDDSLAT

SEQ ID NO: 955725 - protein, 104 aa, Homo sapiens
WHAHRHVRQPGPGEQGPAGEHQACCEGHPGLGRVVPRSVPAHHTVYLPRPAPHRGDAQLTVTSRLGPGVAAGGFIQRDGWKLAAPTRLPPCLGPRWPYLCAYGH

SEQ ID NO: 955726 - protein, 100 aa, Homo sapiens
MKPELTRTPDLITPTLALGGHRRDCGRSDPAACALERRIPRAEEFGTRFDTNPSPVTLLVKSPNQCYRDLDLSGYRGWSVGHLKPTLNRVYHLRFAFRGP

SEQ ID NO: 955727 - protein, 232 aa, Homo sapiens
APLKPRDETLERSDHYYAKLGTRPRSMKLNLVIYHKRLRCRIRGVSLFEKGCGKLETYIKLDKLGEGSYATDYKGECKLTDSLVDSDEIRLEHEEGAPCTDIREVSLLKDLKHANIITLHDIMHTEKSVTLVYEYLDKDLKQYLDDCGNIINMHNVKLILFQLIHGLAYCHRQKVLHRELKPQNLLIIQRGELKLAYLGLTRAKLIPTKDLLEMRVEPLVVPAPMTSLLGSN

SEQ ID NO: 955728 - protein, 185 aa, Homo sapiens
STSLYRCHLVGQLGIRPPSTELKHRSPWERRQLENAWIRAAGGIRCEDWRPTLELDKLGKGAYAKVYKGYSELTDNLVGLREIRLEHEEGAPCIDIREVCLHKDLELANREALMTFMHTEKVLTLVCEYLDKDLKQYLDDCGNIINMHNVKLFLFQLLRGLDYWYLQKVLHPDLRLKKLLMNHRG

SEQ ID NO: 955729 - protein, 108 aa, Homo sapiens
MIATWTRSTPSLKLSLNEGNKKLELHRKGLACAITTGILRSVRILHEVIKFNYKTNFSYTLNGHLFKIMNLWLHIYCRGIWNLYKTVGGTSFVKSCLNLHNSRTSDPF

SEQ ID NO: 955730 - protein, 115 aa, Homo sapiens
MVNVGIPSDIRIRYELLASLSLSYINLTECAYKWPYCSQSMYYGGMPTVDNVTILNGMGVTRRIVYKPELQPYLPHKRDNIEVAFDYFEVLWPWSGYLCIFIDVTKKAASWEGIV

SEQ ID NO: 955731 - protein, 96 aa, Homo sapiens
LRLRKTFGPRKRTLDNEGIPRSAGIGHEQNKTTQLRTMLPQLKIEIPHISSFKFIYLMATYESIHYNITHIYVFTVCTIIYMRTVLDLTKTTLTTD

SEQ ID NO: 955732 - protein, 245 aa, Homo sapiens
TDSLHDHVDTQLGTRATAQIIDAALAAKHTCYRENGFIMTEKDYLNLSPEYNKEYITKAPYATNCKDLSDHKYNDCSHDESTPKDSNETDCGRDQTLNRLNAFNRSNITTSHDIMNTRSCFSIISDSLSGYTYHSACRLSEQFQNSHRYSFTVSSGSPSGFLRTHDSTYALTLQIQNLLIHMKAEQNADHICLAQDNAHWETTLESDEGSPDGPRFLTYGKSKMIYFAPVKVAFPSLPKAMRTSN

SEQ ID NO: 955733 - protein, 209 aa, Homo sapiens
MKPGKPARRLTILRQPWHEGIDNATGSDFGYTTNAVHVVYTTGCRNYAHTDCPGHADYVKNMITGTAPLDGCMLVVAANDGPMPQTREHLLLARQIGVEHVVVYVNNGDAVHDSDMVELVELEIQELLTKLGYKGEETLFIVGSALCALEGLDPEESLNSVHNLLGAVDTYIPELAPNLEKPFLMPVEAAYSVLGRDNRVTRKLDLGIL

SEQ ID NO: 955734 - protein, 63 aa, Homo sapiens
LSPLASPLSLHSLNLLCHMLGEREEGNRKEKKRTVDQSIILRRIEDVGVPDLEIPTLLGSYAT

SEQ ID NO: 955735 - protein, 74 aa, Homo sapiens
MWLGDSGWGLCALCICALSRSLLCVFYIAGPCLRGQHFYSVESMAYCEGCYLATLEKCATCSQPILYRILRAMG

SEQ ID NO: 955736 - protein, 48 aa, Homo sapiens
AANRHSRQMVDIEDLEGPQRQSATLQDDQTYLCMLYGETEEDIGGPHP

SEQ ID NO: 955737 - protein, 51 aa, Homo sapiens
YNRIPKLKMQMTTFKEEPICPRHLQNEKLSCLADILPQERAFSGSAPVGWR

SEQ ID NO: 955738 - protein, 90 aa, Homo sapiens
MKCTKPGKSSRSDTMVMFLLLFTSKKSFQSVSFSRMSLLHLVLQVLGQVWASPAGGCGQKVQPVDGAELPLQLPTCLEQIPGGSGLTFGE

SEQ ID NO: 955739 - protein, 113 aa, Homo sapiens
SQTTGSVVLAVKQENEHLLEDYEKLASDLHGVDPAQHPHGLEDRVPQKTIQEMQQKLEDFRDERDVMHKHAQGAGADAQLKIKLQQAEDKAAPSASRTAYMPSERKMVSDINN

SEQ ID NO: 955740 - protein, 30 aa, Homo sapiens
MNLYNSKDNKIILVILDAISKIYQDEEKNK

SEQ ID NO: 955741 - protein, 45 aa, Homo sapiens
FASQQDDMKTSLKKVVKETSYEMMMQCVSRMLGPPPCMSPHMRCM

SEQ ID NO: 955742 - protein, 66 aa, Homo sapiens
PDSAAVSVPGRRGGVTGGLLRTAPVTRPLCWCHLWSAEENERLDDTDTTGVSATTGIPKTQNFDTL

SEQ ID NO: 955743 - protein, 77 aa, Homo sapiens
TSELAVHKVHDPTDWNLNGHVLRFRLPLSVKVSRLLGLIPNLMRIPVRNAEASEMKWSPFKDFQLSGLLQYESMSQA

SEQ ID NO: 955744 - protein, 60 aa, Homo sapiens
VASQQDGLNSLDLMILPALASQSAGITGMSHRAWPTQTILNFENVQFILSPVGWILLAGD

SEQ ID NO: 955745 - protein, 105 aa, Homo sapiens
MFTQTIGGLPKLIRATCQAPWVFSPTFSFQVLALVTAWNYSRLGYRGHVMVVSGFSGYWSFQRWLNDLPWDQHEALHNPISRTLGLSVRDQGWVSRSMLDLRPLA

SEQ ID NO: 955746 - protein, 121 aa, Homo sapiens
TSCGPHIDVISMGMLTQAAPALDFSLKLLAKEVAPVPKIHYSKPEEDDTCHGLTRLLMTLWVTRLYGQWPMGHIWHQLEPNSGSATCCSCDLSGLTAPLLISDLLICKMCLIKDQPHGALA

SEQ ID NO: 955747 - protein, 71 aa, Homo sapiens
ARGFPYSYILSSYEYSPLETTASNTYPFKILNSELSYGPITVQEFMEVKNALVSSEAMEQHLMKVSYHLTD

SEQ ID NO: 955748 - protein, 63 aa, Homo sapiens
SVPFDIRWQLLACPAYGELAVHGIKLIPDHRIFLSSAFSVVIWLVVDFQTCISLPNMASTSRL

SEQ ID NO: 955749 - protein, 40 aa, Homo sapiens
WSHPDHNTSQEAKQMMNRRLIAMAMTRPMIIQYQETVYIF

SEQ ID NO: 955750 - protein, 40 aa, Homo sapiens
VVENECEAYYTSSRLDLNSTAASTIDPAMGASDMGFSGVI

SEQ ID NO: 955751 - protein, 114 aa, Homo sapiens
ARGPALVQAVTIGKWSSGTRPWLLDEDCCPGGVAVTEISTPGPEDDYDHACVNDAAEVPEPDTGERTEANGAHSGPNQSRTLASSTGCGRDLSWQDLTYERVMGLNCAMGLMKD

SEQ ID NO: 955752 - protein, 98 aa, Homo sapiens
RRVTMARVGLDRVLMGYQTYPLALSLVFDNVQGHDLMEQVSPLTTLGRCQVARLEPAEGRSLQWQVFVPSAESIENLISLLARPWEALCGRELPVGLT

SEQ ID NO: 955753 - protein, 39 aa, Homo sapiens
MAVSFGEHGDSSVPVWSGMNVAGVSLKTLHPDLGTDKDK

SEQ ID NO: 955754 - protein, 82 aa, Homo sapiens
LQDMEDPIIAASSMTIDKLLLEEEDSDSYALNHTLSVEGYFMRSSHLSPVPWNWDYKMTLELRPQVHACLEESFYDYTFYAQ

SEQ ID NO: 955755 - protein, 129 aa, Homo sapiens
PEVCVLCRPCQLHTKPALPEVLARPGNHQHLPWFQCLAGARVPTLEMLHLDVEAFGHHVQRVTFLDLVLHRFFRRDFTRVLHHQGLADLEGLAVELVPALQVMHIDLVGLGDQREVVATAYLVAAGTPC

SEQ ID NO: 955756 - protein, 110 aa, Homo sapiens
AAEVDKRLAVRELASATLTHVQGCSAEDGMGLQHGLERLYEMILKRKKAARGGMKDCDRSPHYLSSHLDKGMHTWTAGWDQSVTSQSDWGAGPVHLNEGERSMECPVLET

SEQ ID NO: 955757 - protein, 116 aa, Homo sapiens
QASTYLQKMSMYNLKCPAEENCLASTPYRANVIDYDHKVLLTFPQRVKNQGTSHFLPILPRYSWEWHSGHQHYHTLDDYSHYDLLDANTQMRVAEGHKASFCVEDTSCDYGYHRRF

SEQ ID NO: 955758 - protein, 71 aa, Homo sapiens
FPLLDTNDPIHKFAFNTLSLDEKHSSPGLTSKESLIVQINTAHGFILIHVDNTKVTMKEIILKAVTRKKGS

SEQ ID NO: 955759 - protein, 125 aa, Homo sapiens
VTGVLGCCATFKERRNLLRLVRRAQGHGVGVVQMGPKRLSLPALNLCLAVLTWGGVTVLSHLPTTVGPYVPAGPGKGRHHLHKKASGWADALHPPPGLHANQGEDPVIRCILDPDLVLEQGFPLS

SEQ ID NO: 955760 - protein, 118 aa, Homo sapiens
GTSQGRGSLLLAVAGATSMVTLLLAVPITVLTVLALVPQDQGRLVTDTAGPGAHAHQGLGFKNLPEEEPETYLSLGLPTAHLISAPLKGLGLGWETTKEHAFLTSGTQFQDAQGLALP

SEQ ID NO: 955761 - protein, 71 aa, Homo sapiens
ERKTEPATGFIDGDLIESFLDISRPKMQEVVANLQYDDGSGMKREATADDLIKVVEELNSDPLAKGRGPLC

SEQ ID NO: 955762 - protein, 66 aa, Homo sapiens
ELGTQCMLHLALIAPVELAMAAAIQPASPLPVRADYESLKVAAEWYARLQNADASAQQRLAWQHWL

SEQ ID NO: 955763 - protein, 88 aa, Homo sapiens
VVFSEFFFVVEEHGRMVDGPFASYGSATGELTRRNERNLGSPIRSGCNDEPRTSDSNTREHPTKPAQTLDRDPPLKPGGVSKNRTLQT

SEQ ID NO: 955764 - protein, 97 aa, Homo sapiens
AAESDVLHSQFEQQGDVVLPKMNLLRQHNLFCDVSIYINDTEFHGHKAILAACSTFIRDQFLLTQSKHVTITILQSAQVGRKLLLSCYTGALEVKRK

SEQ ID NO: 955765 - protein, 69 aa, Homo sapiens
NYYTSNLRKVLAWDQWQGPRNLKVLDKDDLLLLSEIFNASSLEEGEFYKYGPICYGDCQYKDPLLTLVL

SEQ ID NO: 955766 - protein, 96 aa, Homo sapiens
GTAAMNAFLLSGLSLLGAWATWAGGATAHDGNSSFSLESAKKLRDLQEPHEPRVGKLRNFAPIPGEPAVAILCRTRTFQNNSSLFARTPMPKRYFI

SEQ ID NO: 955767 - protein, 91 aa, Homo sapiens
FEEFPMTPTTYKGSVDNQTDSGMVLASEEFDQKKAGIDKKAALVSEADREKAPYFSIFFSALIRKIKDFKTFDICSTGIYYKLQKRNQDGQ

SEQ ID NO: 955768 - protein, 90 aa, Homo sapiens
GDYVGEKGPGPRHSPARLEAMPRKIEEIRDFLLTPRRKDAKSVMINTNKDNVKFKVQCIIYLYTLFITDKEKAEKLKQSLPPGLAQKELK

SEQ ID NO: 955769 - protein, 91 aa, Homo sapiens
SKWKQAFNATVVVRHMRKLQLGTSQEGQGQTASHGELMTPVVGAGPVVGCCCRDCCVEPGTELTPPLSYQLKGPEPRVMILRVGGLCGSLL

SEQ ID NO: 955770 - protein, 112 aa, Homo sapiens
EFQIPWFHDRFWQQYNKGFGGMDGTQQHIFKMLPEVLGGINSVKALVLTPYYHNVHYECMLDKRKKPLRGGSHNITVGATTKNCLGIQNWNWLDQGCHQGLKGLLWNLWIQT

SEQ ID NO: 955771 - protein, 77 aa, Homo sapiens
IVRELHVYGSDVPVSSRDPTKFQHHGFGMLLMEEAEGIAREEHGSGKITVISGVGTMNYYRKIGYRLQGPYMVKMLK

SEQ ID NO: 955772 - protein, 102 aa, Homo sapiens
LFLDNQEVPQWSQCGIPSWRGWPGQDTDQQVLGLKTPPSSSYGAHEPVPATGGCPQAFGLTVSSPDAARGQVSAHHVRPGPQLAIHRTLLGPGPGGLFCPIP

SEQ ID NO: 955773 - protein, 89 aa, Homo sapiens
ALGGGRGAVAAGCPLPATGEQRPRWRRPALRPSPQPAPWEAGSRSTPTEGLIKREKPLQRVIPVSPICGRQDIRSNMCINVGSHHLPCV

SEQ ID NO: 955774 - protein, 107 aa, Homo sapiens
FYRQLLLTADDRVNPCMGGVILFHETLYQKADDGRPFPQVIKFKGGVGGIKVDKGAVPMSGQMARLPPKGEDGLSERCAQYKKDGADLPKWRCVLNIGEHTPSAVDI

SEQ ID NO: 955775 - protein, 116 aa, Homo sapiens
SSFSSMSLPGAPTASPGAAAYPSLTNRGSNFAPETGQTARQFQTRTGKGGGVCPSGRASSLIIVQVLVSNMFNNRQHNNLARLRAFKKIRPFLENQTTSSTIEKFPDLTMFPPFSE

SEQ ID NO: 955776 - protein, 78 aa, Homo sapiens
MALSAADKTNVKAVCGKGCAHAGEYGADALKRMFLCFLTTKTYLPDYTLSHGIIQVKGHGSMVTDALTNAVAHVDDMP

SEQ ID NO: 955777 - protein, 125 aa, Homo sapiens
QTFKMELGTGERSVSPHQGEEGIGGEGGGHEHNEEDSLWQGSRCACGNTTWTGRLHAFKPYPLLFRLCLCPLSCPLCKCPLRATSSSCCSCEDLWAVRILNLLSNTVPGKADEHSSDLCLVPTCK

SEQ ID NO: 955778 - protein, 98 aa, Homo sapiens
RQPPWLNQPTGFYACSSVQDFSRPPPHLVSTSNRAYMRNPYSSVPPAIDDYTKTYTTGVVATSAYTTDAITLQLHMKALICVPGQTVGSAYPPTAVTF

SEQ ID NO: 955779 - protein, 68 aa, Homo sapiens
PPQQSVDLPRCPVGACVFTALATALDVGLSNWSFLYVTYRCEYWPCPAASLQAEAVCLSIEADCTPGC

SEQ ID NO: 955780 - protein, 53 aa, Homo sapiens
ETKMAGGGQAYHNGIDLPLGPVRPGSAATGIWWRGGSLVHIDMLTNYLSLITL

SEQ ID NO: 955781 - protein, 142 aa, Homo sapiens
AGGFDGMYTYFAYNGLSFGSSHQNWKAVKNFCDANILMFIPSVGPGYIDTSIQPWNNHNTRNRVNGKYYETGLQADLTVRPEIGSITSFNEWHEGTQIEKAIPKKTPTRLYLDYLAHQSNLCLELTPPLGGAFYKEKEQWLM

SEQ ID NO: 955782 - protein, 90 aa, Homo sapiens
CPSLPCLRRSSPTPAPWTKFVQCPHGELQKRKEVVHTASLHKIGDISSCAHGLLALFSCDTGEIKEKSVSISMPRWLTGCEEGTAETIPG

SEQ ID NO: 955783 - protein, 198 aa, Homo sapiens
ESIRQKLALGSYFDDGPGIYTSCSKSGKPSLSSRLQSGMNLQICFVNDSGSDKDSDADDSETETSLDTPLSPMSKQSVFLVLIETLLKRSLNPWMTWTVLQGKRNCKLKPKWPLPWPNQWPKCKLKWRNRTGKSIPSLKLEAAKAENAGSVWEPEMVDTVPILSPIMPTCGSLPPLRPPPCHSLHIKFVYFYLPTVGL

SEQ ID NO: 955784 - protein, 82 aa, Homo sapiens
DSSLPQNQPFVFSLGTGLVIKGWDHGLLGMCEGETRKLLIPYTLWCRERGSPPETPGGAALMLNELLFIMECLTVLSPYWVM

SEQ ID NO: 955785 - protein, 79 aa, Homo sapiens
HPGDFGADAQGAMNKALELFRKDMASNYKELGFQGEAPAAPTPTHLGPGFKRERGLISCSHIEFASECLLCLVEVGRRS

SEQ ID NO: 955786 - protein, 179 aa, Homo sapiens
ASSGKHRILLNPSDRTAFNLVLYGRRSTRPGRDSPKFKPGHSTDLGMLTFARRSFLVSFDSLLSFHGIFIPELYSRIALNSPPLDVHARNKVSDLMSIVSSREGHLKLEIYQKTLWSTNGSGPLYKTDSTVLNRGITNFLIEEEILFIILAVPLEDYRSRKLNTPLPVILLKIKSSSRK

SEQ ID NO: 955787 - protein, 76 aa, Homo sapiens
HEAEKLQQYIAPGMKVYIDPFTYEDPNEAVWEFAKEIDVYCVKIEEVIGAGEFGEVCLGQLKQPGRQEVLVAFKTL

SEQ ID NO: 955788 - protein, 55 aa, Homo sapiens
MFNLLKKLSSHITNRPITRSRRRGINRSNYRKSNTNVSYSIRKAPFRVTTHAITG

SEQ ID NO: 955789 - protein, 79 aa, Homo sapiens
GTSFDSTEAPRAKSVRAKKPIKYLEESDEEDLFKNVRRLFKVIILPSPRLVLKLPEALNCLPSEFSLGKGFIVQDIKVK

SEQ ID NO: 955790 - protein, 72 aa, Homo sapiens
SGGGPSRSSFPGTSTFKRSRIRRARGGPATRELTGSGGPRWDLAENIASTWVDLLKGMGPPPSFILQASAIS

SEQ ID NO: 955791 - protein, 74 aa, Homo sapiens
DDDCAFTGKLLFGSEGLDLTRSIAPAWHAIQKPFRAGTGVVGAWGVSYSLLSVSPHSSELLLLIKPCFKLTNID

SEQ ID NO: 955792 - protein, 151 aa, Homo sapiens
EADGAGVGPKAESVVGAAMASAIAPPPGVTEALGAAKAPAMAGAPKVAEAPREAETSRAAVPPGTVVPTEAGAPTEGTEGSWGSNTLPRKLKLPGWHRLPRQLRLLCPQHLLGLQNLLGADEISWELLSSPKSGEGTWKHILPNKCNPVGA

SEQ ID NO: 955793 - protein, 68 aa, Homo sapiens
KIPPREMFLSEPDECFKVDENVIMVLSTHDMEGNELTQGQAMNLNKLFPAQEKLYKEYLQMAQNGSFH

SEQ ID NO: 955794 - protein, 78 aa, Homo sapiens
VASSVTGVVDLARRGRRWSVELKRSVSHAGDVGLEKLKELVDHFLAMTEEELGEDDTLNPKPLSPAPFPFPVVQIRKV

SEQ ID NO: 955795 - protein, 123 aa, Homo sapiens
RGINKKTRTSTEGGRSPGWLHGFPVPPSLLHSHIIVLSYHGRPGALCHSCSTGEPGEGGLGAWGRKAGKSPSWEVLAQLVGPLSTPTLFISVDFFAVSPNISQGAGGTCPNQPPVSDKPLLCI

SEQ ID NO: 955796 - protein, 95 aa, Homo sapiens
EKPGWLLVNVNAPAKARRLLRSQTLHRPLGPKARRNLLVLPPKRRLKSTPRPKISVCVLGDQHHCDEAKAADIPHMDIEALKKLNKNKKLCQKLA

SEQ ID NO: 955797 - protein, 115 aa, Homo sapiens
KPPSLNLHPAPDLLASMQLHKLNSQYQGMAAATPGQPGEAGPLQNWDFGAHAGGAESLSPSAGAQSPAIIDSDPVDEEQLLSLAEELGLDRANELTELRLWQNEFAFTADFPSSC

SEQ ID NO: 955798 - protein, 72 aa, Homo sapiens
LPRGRQRPDGQRGYMSGMPEPEAARFWSGGHSGHSYIGNQKENEYCETHNLGVDWEKAALGKAHSGPTLPMA

SEQ ID NO: 955799 - protein, 95 aa, Homo sapiens
NVGFTKDVGNIKFLVCADCEIGPIGWHCLDDKNSFYVALERVSHEELRGGVLISIFKDLPSSHKNWPFWWFILFRGLFVCAFLISVSQLFSFVHA

SEQ ID NO: 955800 - protein, 90 aa, Homo sapiens
MVDSGPIYDKTYGGGALRLFGFSQEMASFSDLNYQCTDPYIIKLSIERLIINQCWYCTFWNSVLEKTPRITDYSASFFYELELLGTPITC

SEQ ID NO: 955801 - protein, 83 aa, Homo sapiens
YVIRLEPLLQKVVEKGAIDKDNVNQARLEQVIAGANHSGAIRRQLWLTGAGEGPAPNLFQLLVQIREEEAKEEEEEAVVTLFQ

SEQ ID NO: 955802 - protein, 115 aa, Homo sapiens
ENHRSLFHKGPLIKVNRRQRYASNAVSEALILQVANKVKVPLQDLMVRNDTPCGTTIGPILASRLGLLVLYLCNPQLAMHSIREIACTSGVLHTLTLFKGFFVLFPFLNHNLLVD

SEQ ID NO: 955803 - protein, 84 aa, Homo sapiens
SCRIRHEMVCPEFVPSDVQMCPQFLPSGGFVVLLTSGVKPQTFAVSATALKGGASGVVYSSWWVHGLAGFRSEAADLHSECYSS

SEQ ID NO: 955804 - protein, 95 aa, Homo sapiens
RPNPSPECLRPCALPLRVPRTGYPPLLFFETGAWCIPMREYSALSIADCTLELLGLKKPHRLIQQRLLGYRRERTCPYFLLEGPPLTEVRGSEYT

SEQ ID NO: 955805 - protein, 40 aa, Homo sapiens
MAQAVSGRDVAVTFAPNTRNSLYGGRRSCLICPLVESGYH

SEQ ID NO: 955806 - protein, 71 aa, Homo sapiens
RVGKRLPTTAPSLALHYLLSPYTTLYYLRTSRTTRTVPYIHRTLEPPLGDPESPVSKPEEDELELEDTSDY

SEQ ID NO: 955807 - protein, 182 aa, Homo sapiens
RSTGRLGENMADEGAVMIKERYGDQEPLWISRAPLKACNEPREYGLISDLIIGKDIVPNRLDEREKKSFGAKGYADQRISTGSIGGRRVSHGPHGCTYSGIRTCIDVKGERHCTCTKVTAEIREESFHVQTRKRLWQHPFRRPGDYIRTASKPKLTSIKKFKAYTYLVGAELKVKKADGIRG

SEQ ID NO: 955808 - protein, 127 aa, Homo sapiens
LHLVSLAPYNQTMAPSFISQITQQVSQSLGIQWRLHIPCWPQTSGKVERANGILKAQLTKLTLEVQKPWTSLLPIALESIRASPKAPSFLSPFELIYGRPFLLQNRPPSNSQLGEYLPTVSLMSYLL

SEQ ID NO: 955809 - protein, 104 aa, Homo sapiens
SYPNLANQLVKPPTNEYLLLKMSSHYQCDVALVKDSADKTGRNAVITKGNEEIKSLGVSKKHLESMVKYLVGLSVVQVLTSVVPLLINLTLLRTPPTVVRRLRL

SEQ ID NO: 955810 - protein, 90 aa, Homo sapiens
MVQEDWQRVWKLGSGLVCHWLLDLGILAGRLSCLCYKQIDPQAWKSDCWLRKVVLPAHSPGPTGDLSITGWTWALMGHRVEIRLLTWDVK

SEQ ID NO: 955811 - protein, 191 aa, Homo sapiens
CRSSEDVCNGIRVGHPYWFRIGNALETVGEPDALANMNLYKPNMGHNSRTATYAEEALKRLINARNDPLTEAAKRNVINSNLKGNETNDWPTPKWAWALTSENEYFATESLRILPIINLNDLLSGKTNRNRPLLMTCLRISLEAFKYVVLTRRPTLDLALRVLWDDLREGNGAVMLYPKNCGSRTMQRGEL

SEQ ID NO: 955812 - protein, 68 aa, Homo sapiens
MSGWWIGNALDWIRLGYSGRSEWRNTFVDSTTALSKKYDATPGTDRPGKHKVYTDRYEVGHNLRGMRA

SEQ ID NO: 955813 - protein, 109 aa, Homo sapiens
NLSCFHPADMFGTSDPGGLASWTHNYSGCSCTSRVPDENANLDASCFLNGGLEGSREGRLSGTSPPPSMDAGRSSSGDLSWTSSDCFESLHALPDYSLGPHYTSQEGSC

SEQ ID NO: 955814 - protein, 99 aa, Homo sapiens
SRRESIPKQPSKKTPRYPFHVTGLFAPCLATATNRAYMTFRYFSPGRSKEASRTLTFIRQLRSMIPEMLKPPPTQYKFPRAVAPNFEQREPHNYLRASH

SEQ ID NO: 955815 - protein, 48 aa, Homo sapiens
MRTNRIISPKMMKRSDITLQSTSPKLLPRKQSYGTPQRAHKPYRSPRS

SEQ ID NO: 955816 - protein, 103 aa, Homo sapiens
VPEVSRKCYYDSSWNTPTYLEPDNGLDMSTSGCKFYCCSHDATDTEVTDQSSQARKNVKNLFILSSTRLKKVFGSYRNLIKIKIIEDYFHLKCWNISDLIKPF

SEQ ID NO: 955817 - protein, 181 aa, Homo sapiens
MDGALDSYTYVEDISSFPHSGEKDDAIHVTKFIRRLGSDTTFLRSVSYCTEIEPTGKPDEGKSFIDLYSTSSSVTEIAVYDHDATATDSVFNSGTGMTNAARVVDASTAFMFVEPPDHILVSKPPDTSCDSSKNADSKGPEFDACTPSIKHSNSNVSLAFADGGINLGRSGEYGLKKSRMR

SEQ ID NO: 955818 - protein, 133 aa, Homo sapiens
WHEDFSSLLINVLCGILLFFHNRALLSALRTCFGRYAFSSMIFLMASGNSFAASWSSGAASSVILTFLKPNFFLILSSHPLLALNSLDLDPSPSFCFKLSYNDRLFSNHIRAYRYVFLVAILHPHKSCIFNTR

SEQ ID NO: 955819 - protein, 146 aa, Homo sapiens
MQQELSFLPSKRLNPRTPPPTVPETCDQALPTNAKVNFWRPPPFRQSPQSRRTPGHIRERSSTAATGSTPYILFSETCERSVTFESNGYHSLSSRVSRTIPKKSSPLAFVIALRPTHLSPSAIVALKKLSNGRSRPLLSLSPLYLS

SEQ ID NO: 955820 - protein, 100 aa, Homo sapiens
DVPPVPTPSGDCWEKDLDEALEAGSCDLETLRNIIQGRPLSADLRAKDWKIAVTVAGQGDSYGIMGWEIKTLPEQTTIHIDCLQYIDQLGEPAEKAPESL

SEQ ID NO: 955821 - protein, 30 aa, Homo sapiens
MAKLSAKEKLREDIADLVYKVPPKPVPMTI

SEQ ID NO: 955822 - protein, 157 aa, Homo sapiens
RHREVRLTCFIETHHCNQVLGTRLRKYRDECTFLYGCNYHELSIREPRRRYNKPTLRRTPEVIHMRGLRMAILPRKRMWPLGNGRKYRSHVPGAEQPHHSPERVAPMWIRKTYHHPRGCDTLRLTDPIRPPRGLSMRNDTNASDCLLAAEDTPRLIL

SEQ ID NO: 955823 - protein, 99 aa, Homo sapiens
SCRIRYERDERQWKIWDLLKIVLSLFMIMKFFDPEDLLDERQIKGVIELRKSLLSDLRTYEPYGSLVQQILILLLGPYGVGKVSCVNLLRFIVQGHATH

SEQ ID NO: 955824 - protein, 115 aa, Homo sapiens
MTVPIKRCFARREKADANNRLRRLTYAPETPKHRQNKRPPLNKQCEKTRYVVPPTIENGPPTTKPENPSTKPNLNPVRQPLGNRPKHGSSFPPRTNYTMNDATVTKHGHFCYPPR

SEQ ID NO: 955825 - protein, 211 aa, Homo sapiens
KITLSRATAKNALLKHPLRKASSVTISLPGMLKKSYLDIEVTKIPEEVKAPAEADPMKKPLKRPLPKLEKGGDIAAEHAHLRPFLRRNSRDRRGYPSIDRPLRKKVENRAEAIKLAEIKAVDSELEISNGSEESPKENKEDGNNNVEEPPRIYNISLRTSRYENIFIKITKSFSKVNESCHGEGLTPLNPPPRSSDKGEEAEKGEAHVRTK

SEQ ID NO: 955826 - protein, 129 aa, Homo sapiens
SNTLHLVNRDNTEPETKSPNSRKRLSGKATNQLLPRQRRNLEDTLSMDLIDPRQKNGEKYDRKRSTHLKIPDKAPRPRRKPPRYDKSRGHPVISAHNDRRNSLKSSEEYEGSYDYTTRTICRIEPELRS

SEQ ID NO: 955827 - protein, 220 aa, Homo sapiens
YSRRNYVRTREGRIEKTETALEATGDVTDDVPEGDEEEEEIEDSASSASDETGTDTNEEANILTLQSLPIHLIHGLTELTPLQSPDTYNRLNYNGFHYSPNPSEIEIDIVRCETRPHPIRPHLLTIPSASPFIRKTSNLTRLTYSRPSRRTSYSAVAVAFVVKNKAAEVEVIGVEDSGGTDSDFLSKAGQFQKNAKFPSPSHYNTIEVDYPLNPKVNAVN

SEQ ID NO: 955828 - protein, 106 aa, Homo sapiens
PKPPHNILNKHARTGENAPNITKKKKTLKPKTYTPKYTTIKDNGNDRPVLAVNLQTHPNSRYNTPKKRHLKTSTQKNAPQQNTLTESLHDPLHLETPRLSFHPLLH

SEQ ID NO: 955829 - protein, 149 aa, Homo sapiens
MANLITFDDPSVKTVKKTIDETSAGFLVIIMAEIYAVETPHIARTLRKASTPPVRVMTLMIIKPTVVTTYLVFREKVDTEFPLKGARTSELDRYAPRSLVRLNVRMRYQGSYYFSMILRLTISLRNIRPRDIPYNRWQRPYGCYALKFT

SEQ ID NO: 955830 - protein, 82 aa, Homo sapiens
DIHILKVLDKARISTGDQPICLAARRYLSTHFQESHITVAGWNVLADVRSPGLKNDTLLSGVVKSGGLAVAVRSIMRTMASD

SEQ ID NO: 955831 - protein, 178 aa, Homo sapiens
PKPATPEGLTSPLSSLSPHTFRKPARARALSPVQLRLQSPFARNRHLSITLYNDMSWKYKAQSSGRSTSESIYTNRAVSIVCPLAGKFAALVVPTNWLMCGERWPVHRVSPCPSVYRSVVSGCLVVVSGTSLSKGGNIATYRTMGQCRKEYASKRLVKGYELQKGCAVGAPLQVLFFR

SEQ ID NO: 955832 - protein, 93 aa, Homo sapiens
ACTVQSLGNLLDMMYREPSRWSYTFQTFSFLSRLKVQLEPFPEKLYRPVKPVQIFERSGYCDRYIFVKNLFENGALNDIHRHIFQDWHSFSLA

SEQ ID NO: 955833 - protein, 84 aa, Homo sapiens
QDTEDPAQEEDLWRRRLSLSPSTPEGCESKDEASGGASDPGPGPHCASSLGVSGPWAPQMASSGDCPAATLLEGACKGRISPIL

SEQ ID NO: 955834 - protein, 97 aa, Homo sapiens
MAQADISLFGLSVMGQNLILNMNDHGFAELATKVMISWPMNAKGTKVVGAHSLKEMASKLKKPRRIILLKNAGQAVDDFIEKLRRCRDLTATGILFV

SEQ ID NO: 955835 - protein, 102 aa, Homo sapiens
QELEVLTANIQDLKEEYSRKKETISTANKANAERLKRLQKYADLHKDRLGLEILKIYGEKLQLIITNIDPKNPESPFMYSLHLNEARDYEVSDSAPHLEGLA

SEQ ID NO: 955836 - protein, 111 aa, Homo sapiens
MAGSPPPASLLPCSLISDCCASNQRDSVGVGPSEPGVGYSLVVRRFLSPSEKRSIRVGVTRFSRCSVTPFFDSERELPDPLRFPSEANASPCFGSRTVRASTDLRPLSGTP

SEQ ID NO: 955837 - protein, 102 aa, Homo sapiens
DGVGDKKRIQEVGEPSKQEKAVVKYLRFNCTTKSTNMMGHRVMIIILLQKQWTVYSDSQRVNANIGEEALFTTSEYVLVYSHIISNEITLSLQLLNVTDTEI

SEQ ID NO: 955838 - protein, 96 aa, Homo sapiens
EPDPCFGGAVAALDQLSQSERRLRKGATPEREGEALKPFLRRMEETMKLAPMEDTAEFCLFLIPDELWDSHKLYESLLKFIERIFTLFAPMLVPYI

SEQ ID NO: 955839 - protein, 114 aa, Homo sapiens
LFASYKWNVSRPSLLADSKDVMDSTTTQKYWIDIHLRWGDYDSHDIERYARAKFLDYTTDNMSIYPSPTGVLIAIDLAYNSHSAYGNWFPGSKPIIQQAMAKIMKANPALYVLP

SEQ ID NO: 955840 - protein, 95 aa, Homo sapiens
DDDCKAKAYRAAGDARSLDLSLIARALSLKHSPAYPGSGKHQLIDDNLIKQQKICPKLHDCSFSFSPEPLSMPLISSFCPRVSHPRLPRPDAFIN

SEQ ID NO: 955841 - protein, 131 aa, Homo sapiens
VDLGRVWAALGGWHGFTHPFKREDPLVLAILDDRAELRVIRSGSLSSSANALAFVLTMPSLWDRFSSSSTSCAPWSLPRTPTPDRPPRSAWGSATREEGLDLSTSLESSDCESLERSNNGFWAGGRHGLPG

SEQ ID NO: 955842 - protein, 82 aa, Homo sapiens
AIVWYRTWGIPPWSTVKNLMMVPASLMVLLLKPTRKFAYLERLSNKVVCKYQTLTSTLMENMKDKAKIHYSNKKHLMRFQKQ

SEQ ID NO: 955843 - protein, 90 aa, Homo sapiens
MTASQERPYFMSPELRDILLKGSAEGFGVSSYGNVSMNHTNMNTRMIEFLKKNRSPKNGQVNIEKEKVHKHMIKERIRTEKQKQSYLNSY

SEQ ID NO: 955844 - protein, 133 aa, Homo sapiens
IDEDEITASCRRYGPLIVDRPHKAESKSYFPPKGYAFLLVQEESSVQALIDACIEEDGKLYLCVSSPTIKDKPVQIRPWNLSDSDFVMDGSQPLDPRKTYICWWRSPTITKLWGLAMIMDRLYGGVCYVGDGY

SEQ ID NO: 955845 - protein, 62 aa, Homo sapiens
MRPYTTYTVVSDSIHLWRCVQGSYMLEPMSELHFFLWVKNRLWGATHGGSLLCSHHCEAEAG

SEQ ID NO: 955846 - protein, 45 aa, Homo sapiens
MNGYITNEDKANRPPYGQDDGVSGLLPEVLPNRGRRALTPAWLHL

SEQ ID NO: 955847 - protein, 78 aa, Homo sapiens
ESQSGKGDMVEMATRFGSTLQLDLEKGKESLLEKRLVAEEEEDEEEVEEDGPIICSEDYYSELEIDITEHLTKKEIHI

SEQ ID NO: 955848 - protein, 136 aa, Homo sapiens
DIFGRTVSKRSSLDEKHKPEEEEKKAEFERQRKIRPLEIEEKLICEETAEEYNNWYQKGWRKNWGKGRMKLNDEVLRMVAEAKRIMEKHMLEELERQRQAELVAQKAREEEERAERDELGANLQENDRAIGESQAK

SEQ ID NO: 955849 - protein, 77 aa, Homo sapiens
FYHPLGKMRQLKGKPKKETSKDKKERKQAMQEARQQITTVVLPTLAVVVLLIVVLVNVATLPTNHRVYPAVCRVPHL

SEQ ID NO: 955850 - protein, 85 aa, Homo sapiens
MGFGKSNRDPYATSVGHLIEKATFAGVQTEDWGPFMHICDIINTTQDGPKDAAKALKKRMAKNYNHTEKQLTLPLIDMCVQNWGT

SEQ ID NO: 955851 - protein, 112 aa, Homo sapiens
TYCCRGEEESMMMRIAQKCNINLLPLPDPIPSGLMEECVDWDEEAKADVHTYGIASVPYQPLKKHIQTIERSLQFQKAHGDHMDSSRNNPVSGLSVKSKNNSTQYACVKSHS

SEQ ID NO: 955852 - protein, 95 aa, Homo sapiens
EATSTVMMCGCLSSICTPGSRYPLCTRAGEGTRCDLCMGTLLDYGVLYGIKQMPKRDCYESFTNTWTDIMAVSYATCTPVAPQYTISVSCYTCGE

SEQ ID NO: 955853 - protein, 116 aa, Homo sapiens
MYEVTWWVGWTKGRCASLDEILSQRDAASARTLQLRSEEPSTPALPNSGQLSWIQDLITRKLDETQDLLAEVHGLGDGKLKAKDPPRSPSDSESNHLLFETERLLGEASFNCNQSK

SEQ ID NO: 955854 - protein, 118 aa, Homo sapiens
MPHAPIGLYFDTVADKIHSVSRKHGATLVHCAAGVSRSATLCIAYLMKFHNVCLLEAYNWVKARRPVIRPNVGFWRQLIDYERQLFGKSTVKMVQTPYGIVPDVYEKESRHLMPYWGI

SEQ ID NO: 955855 - protein, 53 aa, Homo sapiens
MCFPKVLSDDMNKLKARMHQAIERFYDKMHNAESGRGQVMSSLTDLEDDFQEG

SEQ ID NO: 955856 - protein, 78 aa, Homo sapiens
VHVEAYSCGELLSTCAVEEHVPARVPQDGELNMMNTTWGTGRLKYLMFTYNCCLWLGGLDAMAEDIWTLALMSDYISL

SEQ ID NO: 955857 - protein, 79 aa, Homo sapiens
NIWTPLWEELAALMPDPGHNPEGMLAHHWADGPAREVGLRQVPGLRANFSGIELLVTGGAQLGPLQAIQTPRGPPDIPS

SEQ ID NO: 955858 - protein, 105 aa, Homo sapiens
KLMLRKASLGPLPRASERPGVPVFLEMGPSAAGCEALRSITGRAWRWWPPGTTLSCLFTFHYQVFSGHYDLFPYNSDLCILLWPAVSAGGSQRGTGEGVPCITVN

SEQ ID NO: 955859 - protein, 137 aa, Homo sapiens
DNEALYDICLRTLKLTTPTYGDLNHLVSATMSGVTTCLRFPGQLKADLRKLAVNMVPFPRLHFFMPGFAPLTSRGSQQYRALTVPELTQQMFDSKNMMAVCYPRHGRYLTVAAIFPGRMSMKEVDEQKLNRLTRNST

SEQ ID NO: 955860 - protein, 95 aa, Homo sapiens
ARAEGRKGYGPVGPYGGFAGRDAFRGLGTCWLEKDALRDEYDDLLDLSAVHMESVREWERLLKEKCGYVGRLLNQEKNHENLHDEEDTMDHSEQD

SEQ ID NO: 955861 - protein, 102 aa, Homo sapiens
VSKATLPPRVKTDILDKLSYLVLQQNKGKKVTEGSLKLKDLPKQNGMAELLLLQILYDHLTLQAYHEGYAQKVTKDLLDPMVRQVTIVLHRVFGIKVYTVEI

SEQ ID NO: 955862 - protein, 95 aa, Homo sapiens
GRARSFSRGRRKKKCKICKLRSFFRKLNTRLMSQRICWWGGRQLFLKDHPHCCLSLAFLKESSEDIYFYMALLGVESLFRAHSADMKTFFCTICK

SEQ ID NO: 955863 - protein, 173 aa, Homo sapiens
NYDPHLRPAERDSHVVNVSLKLTLTNLISLNEREEALTTNVWIEMQWCDYRLRWDPKDYEGLWILRVPSTMVWRPDIVLENNVDGVFEVALYCNVLVSPDGCIYWLPPAIFRSSCSISDTYFPFDWHNWSPIFQSQTYSTREINLQLSQEDGQAIEWIFIDPEAFTEKGEWAL

SEQ ID NO: 955864 - protein, 180 aa, Homo sapiens
MLSFGGMFCISFWKPTFLPLSWGCCPGFHFGSLSIQSLQEPALGTTKEVEEVSITNIINSSISSFKRKISFASIEISSDNGDYRDLAMKTTDKVKVVFPEKRGRNGGLFHNLKTPARGVTYSKKRGPLDFYGPPRIFNGANNKYFLGAGEKFLGGPRAFPRHTKKGVKWVFLGAGGPPPP

SEQ ID NO: 955865 - protein, 94 aa, Homo sapiens
LVFLDLELVLVFLASGQYLEPWLPLKHPNMEQQCLGSLEGSGLLVEEASHAVWWEPDPPPPLPKPKLLSKPPNLAYWEPLGSEDLQSEGLEFHV

SEQ ID NO: 955866 - protein, 217 aa, Homo sapiens
FCTGGLLRPGTCKFAGAASQAPHAPAFLRARGEPQDPLSHPRVPAVSANCRMWKHLPVHSSPTPRLTPLWKLQARWLLPQLVYLQGWGSYSLLRPRNPLSHPRVPAVSANCRMWKHLPVHSSPTPRLTPLWKLQARWLLPQLVYLQGWGSYSLLRPAALISMVLLAREFLYPAMSVFRSVLLLAQFFSFEYNIKTNLFFYPSGDICSPNGKIGFNQP

SEQ ID NO: 955867 - protein, 103 aa, Homo sapiens
QVSAAVENNPADWLNPCQPLCKAFIATDEDIRKQEERVQHVRKKLEEALMAYILQGAGDTEEMDIEMEQVVMTPYEFDQGNFQPTFPKRKFSRNGTKMFPLAF

SEQ ID NO: 955868 - protein, 76 aa, Homo sapiens
SCRIRHEASEGMIADPSRCYVSSLTFTATVYLRGLPTLDTRELFAKDSDQPFAECAGVKLSQVTEDAFRAHTGCNH

SEQ ID NO: 955869 - protein, 130 aa, Homo sapiens
MQLGYRLQQIAAAVENKVTDLEEPRSHGLLLLQPGLGSPGSSEERPPSEVPVVTDKQSYVEGDSQSPGGSGLGPAGSTSYTRGLKAHGVVPSLLPESSDPVTPVCKELGTKGFQRVAGRDSKPLGRLYCS

SEQ ID NO: 955870 - protein, 156 aa, Homo sapiens
RSVLLCKAVGARGVGKSAFLQAFFGRGLGHQDTREQPPGYAIDTVQVNGQEKPLILCEVGTNGLLANRWTPPVTLLCLMFDGKDPKSFAHCASVYKHHYMDGQTPCLYVCSKADLPKSVAVFGPSPDEFFRKHRLYPFRADSLCWAIRAQHQPFFN

SEQ ID NO: 955871 - protein, 104 aa, Homo sapiens
MTEGASPKKMMFLFALRNITCLHTSSNIGKEQTQTQHGVGPWEVQPPWSGWPYFLQRPPKTITNRMKVKRKYGPPKSWTTVIQKRSLFPFKKLALLKGGFLFFF

SEQ ID NO: 955872 - protein, 83 aa, Homo sapiens
IRPGTVVHTSDPRALGGCCGRIVCAQEYLTRLGNMAELCLFQEYKKLAGRGGSCRWPQLLGRLTWEDPLGLGGKGCSDLRLCL

SEQ ID NO: 955873 - protein, 62 aa, Homo sapiens
MGQDLSSLISRWRKWRRGTSLHSREEHGKEANSWILLAQEAWCIPFPRAWDRPGFFKAKGPQ

SEQ ID NO: 955874 - protein, 118 aa, Homo sapiens
EKEEDDGLRKSLDRFYEMFGHPQPGSANSLSASVCKCLSQKITQLRGQESQKYALRSFQMARVIFNRDGCSVLQRHSRDTHFYPLEEGSTSLDDEKPNPGLSKDITHFLLQHNVMKDL

SEQ ID NO: 955875 - protein, 218 aa, Homo sapiens
PRQCPGEGLPSALITRHTAAPLDRLGGPMYETGTGSMTQVMNMHGNLAMDTVPEKVPFFNSTFYDKLRTKGHDGVKRSTRNGYILCKELLLIPIHLEVHWSLISVDVRRRTITYFDSQRTLNRRCPKHIAKYLQAEAVKKDRLQSLLWTLTRASYHVLCPTVLGDNLGPEGERNLAPPDASILISNVCSFRDHVAQDLLRAQNWAWHKKQKALGESRP

SEQ ID NO: 955876 - protein, 55 aa, Homo sapiens
MVLSAPETLKPGPFQNSELVKKSECKFTVFFKKMQKPFAPIGCRNEKESPGPANL

SEQ ID NO: 955877 - protein, 101 aa, Homo sapiens
LIPDSGKLEEGTYSCLATNELGSAESSVDVALATPCEGGEDTLGRTFHGKACEGKGCYAVDNYVQASRPEDNGDIIYLHPSGNPEAAVAEWVPGQVSPGLL

SEQ ID NO: 955878 - protein, 114 aa, Homo sapiens
MPETLPARRSPERPLRPSAPTCPVLHSQAADPERKSASDELDDSQGRPMLLDLERDYNAFKRFCMPEPGALDLAQNGNPEAKAPGPLCATHAVGMHTTHCLQMTAWRQDLVIEL

SEQ ID NO: 955879 - protein, 104 aa, Homo sapiens
PYLSTQNHGCLLHLMAAQRLLRCRNKPNHEGQLQASPPAAVEGLLVKPKPEPQLQGGPSPAHIGNLREQGLDGHLRGGPAIVEDQIPPSNLETVPVENNHRFHE

SEQ ID NO: 955880 - protein, 49 aa, Homo sapiens
MEGRQLRKRALRLGILHAGGCQHHFQDPWGMEGMETRELKGPDGHAFRL

SEQ ID NO: 955881 - protein, 93 aa, Homo sapiens
GTANKHTVQWWLKKFCKEESLEDEERDYGPWEVDNDQLRAIIELHEKLAEELSVDYSTVIRVVQHLKQIGKVKKLGKWVPYELSGNQNYRFEV

SEQ ID NO: 955882 - protein, 211 aa, Homo sapiens
ARACKRLTLETMKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELTENQKNSRFEVSSSLILRNHNEPFLDRIVTCDEKGILYDNRGRTAQGLEQEKASKHFPRPILDPKKSRALLEGRLRV

SEQ ID NO: 955883 - protein, 128 aa, Homo sapiens
EPLVTLNCCLLFCGDCWLHTPPSPYCCTLGDLHLITEDILGRIALLRGHPVRRRRCTCIHDRNPSECSEERKHLGWMEFTIKHSPLAVQSVRRCIKMKQAPEILSSAIGKTPSCEENRECAAFLSKAH

SEQ ID NO: 955884 - protein, 162 aa, Homo sapiens
EALNIREENPGIFAGLKEKCGQIHKALQGISGEKGGGESLSPAFHLQLEESTGSREQDVRLLQEIVEQCMNRKMALTQARYLEKEEKGLPPPSIRVGGTGEQTEEELERAASTIKEVAQAGGFRQRPGTKGSLANKKAGGLKNPGGQGVGRKERKNMGELWK

SEQ ID NO: 955885 - protein, 80 aa, Homo sapiens
EDEAVEDSESGVYMRFMRSHKGYDIVPTSSKLVGFDTTLQVKKAFFALVANGVRAAPLWESKKQSFVGMLTITKFKKNTT

SEQ ID NO: 955886 - protein, 152 aa, Homo sapiens
WGLLVLDFQLSPCPLPEHHRHRLPNRAAGFRSHCSTSPKSSWKGWRMEGNQASLEAAWEGDCVVSPTREARAMEQATSSNWAAWNSGQAPRLGELLGVFCPPPQTSVEEQGLPARQKDLNRTAKLSSPSLPTLGWKRNNPGPPRPLGWGNKA

SEQ ID NO: 955887 - protein, 79 aa, Homo sapiens
HEKLGIEGTYFHITKAIYDKPTANIILNGEKLNALLPRTGTKQICSLSPLLFNTVLEVLTKAIRQEKEIKVFRIRKEEV

SEQ ID NO: 955888 - protein, 145 aa, Homo sapiens
AKAKDWRTGKPDRVVRNVKGGKNSKYAPAEGNRYEGIYKVEKNWPEKGKPGFLEWSSYLRRDDDEPGPWTKEGKDRNKKLGLTMQNPKSYLETLTNRERKKENNKREEEEQQEGGLESPKTGKGKWKPKPTGGGPKQGTRYPNTG

SEQ ID NO: 955889 - protein, 86 aa, Homo sapiens
IVPDTAPPLNDYWVPILTEIVGYYLIAHGYFSVYGMMCGHAVALLEEDLDRNDSSATRPYFMYNTLKKLLIKTNTEGIGVLKAQCS

SEQ ID NO: 955890 - protein, 161 aa, Homo sapiens
TGPQDGGEIKIANEVSGTIVIDNILSGDSVFEINRSDQNLLGGNFLFLISLGVLWETGVYFTSAISTKRDRYAPRGPVQRPTPRCAFSFSGTFHAEKKNSAIFLPFAFERREIWLCSARLTGSQSLKLSLLFSEQLLLSYSFFKVPTFHIAPTHMLDNLCS

SEQ ID NO: 955891 - protein, 112 aa, Homo sapiens
WAKDMNRHFSKEDIYAAKKHMKKCSPSLAIREMQIKTTMRYHLTPVRMAIIKKSGNNRYWRGCGEIGMLLHCWWEGKLVQPLWKTVVCTQRIINHSTIKIHTHVCLLQHCSQ

SEQ ID NO: 955892 - protein, 123 aa, Homo sapiens
KRAHTLLPFIPNQTYEVQNPSTKKFTPSQSQNQGVQQFKGSQNQNKSARAGVLWVIRPRFHSHGVGQDPKTSLTKSSRVKTTSKSANTGAPRGIRPRFHSRGVGQVPKTSCTKSSQAKTRTER

SEQ ID NO: 955893 - protein, 82 aa, Homo sapiens
DPGRLGSRSPGTRISWMAAAANRRAGWTEPGIYYTGIVAREKPSMRKGDCLYLQLSFFSSLLSSTSSSCKFFYDPLMVLFLE

SEQ ID NO: 955894 - protein, 121 aa, Homo sapiens
SGVRGSTHYSTGGNSTTALPCSLPVPSQGGEQGRERNQAFGQTSRSKKPIELVQRQEAGALLVPPLTGERLRTDRGTPKGGTRNLSSLIFPLSQKYLCKLAFPIPPYFCGWFFWWPPLTPF

SEQ ID NO: 955895 - protein, 150 aa, Homo sapiens
QRRPRSETGCRKGSWVSAGLGKALAPALRPTHCPPLLEEMLPKLAIMSAGSGGWALGSSLLSWQMGITEPVPGTMRSRCLTKVASAEGKSQAQKAAYYHFVHWCKFLRQGLDQSRRLEYKSAIWAQLSLTSWAEVILTSICDYMLPPAGA

SEQ ID NO: 955896 - protein, 33 aa, Homo sapiens
MTRHKQISFKTYVRPALMSKRLYENTMRPIETT

SEQ ID NO: 955897 - protein, 111 aa, Homo sapiens
VNLLLILTFVAAAVAAPFDDDDNIAGGLLCEENSVPYQVYLNSGYQFCGGSLISNSAWRQQVTDSVPHTCETGRAQHLSPGVGMQPFINAANIITHPKYNSRTLDNDILLV

SEQ ID NO: 955898 - protein, 146 aa, Homo sapiens
APDLEWSARLGLLGYWDCRRSLGHSVLSVAQAGMQWRDLGSLQPPPSSRLPWPPKVLGLQPMPGRPVWEARSTSAWPPGLGSEEPLCPAATLSGRRGAPLPCRHPVWEVRSAFVRPHPRLGGEERHLSARHPVWDMRDSSARAESH

SEQ ID NO: 955899 - protein, 78 aa, Homo sapiens
MLDRTEGEEFMAKAVAIENQYMMIPRTMVNVTAIIKIMETKLVRKFLNRSLHVTFTYVVSLILHSFFRDSPEGPWAIL

SEQ ID NO: 955900 - protein, 91 aa, Homo sapiens
SCRFIHALSVIESIIVLAMAFERYVAICHPLCHAEVLNSTVTAHIGIVAGVRGSLFFSPLALLIKTLGLCHSYVLSHSYSLHQDVANLSYA

SEQ ID NO: 955901 - protein, 114 aa, Homo sapiens
GEPCPKKCRICHMDEVTQIFFGFEDEPDARFVHLEDCNHIFEVQALYRYMNEQKDDEFAIILKVCPICQVPIRKNLRYGTSIKQRLDEIEFILGMIPGLSREIASYPERIKGPV

SEQ ID NO: 955902 - protein, 83 aa, Homo sapiens
KRLAHCPNCWFSTLVLAPGVCKMKIEDVKSTTKTQRIACHSHVKGLGLDNSSLAKQAASGLVGHENAREVWSLYQGVGGCKHG

SEQ ID NO: 955903 - protein, 169 aa, Homo sapiens
ALLKLIFPDGAFESENRALINVQMLNNSGFARGIIEEFQNNNDLELQQKCINVLSTYAMIQGQIDANKEIGQFFIQTLTQLNVRPEILIEMTNSLFQIYGDASYDYNEPIFVRGGFLSILKDQVVPNLRQQFKMVDKNKNPELKERCHDCFTTLDSFIHYKMNENSTNQ

SEQ ID NO: 955904 - protein, 126 aa, Homo sapiens
TGWASPSASREYPSTLPSKPFQKPLFSVLLPVTLSDSDAGSVPGGSAAVPPGGICMGHLSNGCEVLSATHPTLPSEQTKKTTTGPVTAVSVYPMKVYKDPPVQEHWGETTNLSAVPELPSLEGYNE

SEQ ID NO: 955905 - protein, 159 aa, Homo sapiens
YTNDIQAESQIKNAILFTIATKRIKYLGIQLTREMKDLYNKNYKTLLKEIRDDTNGKTFHDLWIGRINIVKMAILPKAIYRFNAIPIKLPITFFTESEKKSIKIYLKPKKSPKSQSNPKQKEQSWRHRITQLQTILQGYSNQNCMILVQKHGAGTKADT

SEQ ID NO: 955906 - protein, 84 aa, Homo sapiens
PPASIPGVKSPPVGHVTTEPALCASIGQTTPRPLGSGHLRPLVGTISEVRTVEIRGCSLDIAYVLDSEHIPHNTERSVTVDKSA

SEQ ID NO: 955907 - protein, 83 aa, Homo sapiens
QLCALTFLAPFWVCSHILCVHRCPSTGSPLHVTRGAASPPRDYITGTFDRAWEKVDKRMLLSAFLFHFPATPHYPRREVVGWE

SEQ ID NO: 955908 - protein, 129 aa, Homo sapiens
MESALLPRLECSGVISAHCKLHLPGPRHFPASASQVAGTTGARHRTWLISCIFSRDGVSPWSRFPDLVIRPPWPSKMLRWVDRLIPYCWCTCSFNIDESLFCSPFQVFSCAVVIFILWSQFLIVFYAGW

SEQ ID NO: 955909 - protein, 66 aa, Homo sapiens
EPPPPPPAASNVAYPHQPQTKHKKLIKSELKYPYNLQRSCSPTDVSPSQHLQQTPPQSLVTKQLTQ

SEQ ID NO: 955910 - protein, 68 aa, Homo sapiens
EPPPPPPPPPFNKNSHPPTKKEASRQSPKQEGGGNETLRHEYSYSPANRYAELAGRQAPRIEAGVSRP

SEQ ID NO: 955911 - protein, 62 aa, Homo sapiens
MRRPPGPHHGGLGVVARSFRQRTQRRRERRVLAPDVEASQRKGRNIVLDFFVLLIETRGTRE

SEQ ID NO: 955912 - protein, 136 aa, Homo sapiens
MHPRIYSQYKYHLSILDVSYPRRKPKTLASSGYNSNNTESGQEAELVSASLLLLRNPSLEIAILLASQVLTLLGRGSPNNHLVLLGFLVGLPYELYPYFLLRPPQMSENPVNMLPFVEPDLGRRAFSPGHFGGVPR

SEQ ID NO: 955913 - protein, 135 aa, Homo sapiens
QTVLEICEDFCMSFTPDVREVVEFAIHIPSFRDLPQHDQITLLKAGTFEVLMALLASLLNVKDHTVMFLSRTTYSLQELGAMGMGDLLIAMFDSSEMLNSLSLTEEELGLFTAEVLVFAHRSCMENSASVEQLHD

SEQ ID NO: 955914 - protein, 224 aa, Homo sapiens
EPPPPPPPAYEVPHPQTHAPYFQKKNFRTPFFARPCSVLLRLTTLVEAASITKLNRWDGSRPPRYPLRLPSRMLNSGSTILYPPSSFAQAYNNPFSLAATNDPKPVNAITSYYYSEKLDDDPGVWFNKYSVPVRSPGTADISESYSLGYLRVLPRSALNLRVWGTYQPQSGCYCRGVLTGFTASCTMCVYRLLPHNAAIGKISVPFNPTFPDYTFSLLVGPTIK

SEQ ID NO: 955915 - protein, 109 aa, Homo sapiens
MRAASREVKEPINVLSQNTSQEKEGHRVRFYVSKGKEFRIRSFHLSKFEFRLLRVVYGRLRLYEDRALYSNIGYNAGEIIPFLPGSSVLAVSSGLLKRSPFLTLASDYE

SEQ ID NO: 955916 - protein, 88 aa, Homo sapiens
GEVDHSFFDSDFEEGKKCETNSVFDKQNDDPKERIDKDSRNVNSYTGDANNVDNLLTGTGNERNVKFPPEHPVENDVTQTVSSFSLPA

SEQ ID NO: 955917 - protein, 144 aa, Homo sapiens
KGGPSLASTTLGFLLTSSPSLQVQYEVGPPWKALTGLLVWRWLHYMGPGRLESGMKENSASSLLSKPTGRLLLKRSRMDEEDRHSLADINRLQKIWFNFFTTDPPTKELANPTNQPGEHRPGLSFDHRVELTGPAPALRVPYLG

SEQ ID NO: 955918 - protein, 86 aa, Homo sapiens
HQATWASPLSSAFCWQRSSWTGAFGTAAGVSCARLPHGPMQPQGLPPCPWSRARNPGHYARFGPRSPYPEPMQAGNMLPSFHPMCL

SEQ ID NO: 955919 - protein, 83 aa, Homo sapiens
LPASWAVNDIFSMSTDHTLAYDTDSFLEASAGPLRCCRCLTACLRNPALFKIDVMEHTHTHTLTHSQMQTHNILSTAGERIQA

SEQ ID NO: 955920 - protein, 105 aa, Homo sapiens
HREPTMELSADDKTNGKADWGKVGAHAGEYGAEALQRMCLSLPTTKTYLPHFDLSHWFSQIKGHGKKVVDSLTNAVGHVDDMPNALSSLSDLHAHKLLVDPANLK

SEQ ID NO: 955921 - protein, 83 aa, Homo sapiens
DIGIGIARENGLPGPPGPQGTARYGKMGATGPMGHQGIPGIPGPPGPMGQPGKVGHCNPSDCFGAMPMVQQYPPMKTMNGPFG

SEQ ID NO: 955922 - protein, 105 aa, Homo sapiens
RQGLTVLPKLKFRGSVMAHCSLNLLSSSDPPTSAFQVVGSTSVCHNAWLIFVFFVETRFHHVAQAVLELLSSSNLPTSASQSVGITGVSHCAQPRVFYSTFFFFF

SEQ ID NO: 955923 - protein, 105 aa, Homo sapiens
MAGVAGTQDTKSLGCTHMSGAALTWPGDIFPMVLGINIRLLATYANFCSWLEFLPRKWVFLFYCIVRLQISKLLCFASLIYKGMPLKAPKSPVEQFCWLKNFFPA

SEQ ID NO: 955924 - protein, 95 aa, Homo sapiens
DLDVAILVGSMPRREGMVRKDLLRANVKIFTFHGASLYKYAKKSVLVIVVGYTANTNCLTAFKSAPSIPRENFSRLTRLDHNRAEAKIAFTLGVT

SEQ ID NO: 955925 - protein, 66 aa, Homo sapiens
MVLWADRMALGLPTCCLQWLCLLLQQYGPCPESSRGLAKRTDWWSKHHLHRCMGQAGDPPTVNEGG

SEQ ID NO: 955926 - protein, 68 aa, Homo sapiens
MEAFLGSRPALWAGGPAPRQLYRIPSTPDSFMDPACALYRGPITRTQNPMVTGTSGLGVKFQGGVAIA

SEQ ID NO: 955927 - protein, 133 aa, Homo sapiens
PLLADGKGEAGIPWQEEGSKREGRRYQAFSNKQVSWELTRRELTHDPRTAPRCSRGICTQDPNTFHEAPSPTLGITFQREIGRGQKSQLYHPMPRWGTVLMKRGGGLVRNRPSLSERQGSCLKAYHCWQAEAR

SEQ ID NO: 955928 - protein, 94 aa, Homo sapiens
CCVSFTEDLDYVPTANLNHSVGKGGSCGLPLMNSYNLNDMASGLGSETRLDRRIGDAQSDTVLLHSSATLMTNDDNEESECTHVPADYLHADEE

SEQ ID NO: 955929 - protein, 107 aa, Homo sapiens
HTCGWKVVYSGDTMPCKALGRMGKDATLLIHEATLKDGSEEEAVEKTHSTSSQAISMGMRMNTEFIMLNHFIHRYAKAHLFSLNFSEKAGVAFDHMKVCSGDFPSLP

SEQ ID NO: 955930 - protein, 72 aa, Homo sapiens
YTGTSGGQTGPSGLPTPYTYASYNYLPEPYNYSPATYPGTRRPAQGVQVGHTGAMMAEDTGGDGRYPQRSHS

SEQ ID NO: 955931 - protein, 73 aa, Homo sapiens
KKRETFIYNQGRPTGVHKTHNGHTPKRNLLGKYHAGSGPGATPKGPIRTTITGTWSAEPRWTALRASRLQAVS

SEQ ID NO: 955932 - protein, 134 aa, Homo sapiens
MGFHHVVQAGLKVLDLKRSTHLRLHYEELPAQEEPPEPPLQIGICLRYMELMVKLKQNEAFPGPKGGPPAPWVGGDGNLFPILRGWGFPPWVRFTREDSLKEISPPWVIFYFATLGGMTRKIFFFLLGKHIFPA

SEQ ID NO: 955933 - protein, 80 aa, Homo sapiens
VASWCCPRWFAGDEMAFVKSGCLLVQSTIWKRWKKNWFDLRSDGHLIYYDDQTQENIQDKVHMPMDCINIRTGQECRDTQ

SEQ ID NO: 955934 - protein, 36 aa, Homo sapiens
MNPFGCSIAWGACSTATALFILAWRDSGNSTMSNSS

SEQ ID NO: 955935 - protein, 73 aa, Homo sapiens
TQETFGVLFFGHVNPEVHMGPLGVYNKAAWEESPNPLHITLLENGATDQSDSTLHRGLLNRNIDHDIHCTNNA

SEQ ID NO: 955936 - protein, 72 aa, Homo sapiens
TQHFISKERAGALMMPLVDQLENRLGGEEKFQERVTKHLIPCIAQFSVAMADDSLWKPLDFQILVKTRDILA

SEQ ID NO: 955937 - protein, 94 aa, Homo sapiens
TSEIATVSSGGDGEDEGWRVREEAVVAENTGMGGSTSFCRLQGHIAGSYHLEGNSLSLQYPYFVLSYISGLSGAGFSNIRVGLSLFYSLCWTCL

SEQ ID NO: 955938 - protein, 122 aa, Homo sapiens
YKEVPWNYTCRELAPTEWGWRTESHGDLIRCTGLTYQCEPGFQLLGSYILTCQWDLSCSAWPTGCQKIMTCADPVEIDNGHRTASDAGFPCRLPRPDPLPDMVHAKWGKHAHLLQPGHMHTQ

SEQ ID NO: 955939 - protein, 95 aa, Homo sapiens
MTQGKLSVANKAPGTEGQQQVHGDEEGGSSRAQAPPSYEEATSGEEMKAGAFLPATTAWPSPPSWSYVDPRSSISCDNGYSTGDHELFTTLSCDD

SEQ ID NO: 955940 - protein, 85 aa, Homo sapiens
NVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 955941 - protein, 132 aa, Homo sapiens
QGVAYYMWELLVCDMRAGQLLKSNVGQHKEGATSPKGGKRGKRGLGNGLTEETGSSWKFGDGDVKQVASGRHRCPAWWPQSNLYEQPRFQTNTHSRRIQEDLRTQNKRVGLIQACKTRQSPINNCFEPAFLQ

SEQ ID NO: 955942 - protein, 96 aa, Homo sapiens
TSHLGVLKTPHDPMMCPIQSLCAESYKGLTASSLSESALMPLEASCLVILAVKSKVPAQDLLCILCQVFQANDTRVHHSLSGQSDIRWGLYSYPPH

SEQ ID NO: 955943 - protein, 99 aa, Homo sapiens
CSVTDSVNLAEPMEQNPPQQQRLALHNPLPKAKPGTHFPQGPSSRTHPEPLAGRHFNLAPQADEEFSPNGPPLGVAFKERPTAMLVSFRNPFLPTLVIS

SEQ ID NO: 955944 - protein, 78 aa, Homo sapiens
NKLSSHAGPFATPIVVPGLDPGTQTILQEFLVPNYLIGCVNGRQGSKISEILHISWAHIKIWNLLRSLVIWYITIIVS

SEQ ID NO: 955945 - protein, 89 aa, Homo sapiens
KCFTCWLVTQGVCILTGLGFNGFEQKGKAKGDACANIKVWVFKINRGCTGTIAEFDINTNAWVGRYILKRLMFLGNKELSHALWWLFLA

SEQ ID NO: 955946 - protein, 119 aa, Homo sapiens
LDETRNLSAHKISGNFLMEFQVKNVPSERIATQKILSVLGECLDHFGPGCVGVQKILNARCPLVRVSPQAFGFQWDLTSNHWIGLTRSQLLYYIWCPKLKSESLGVQGPGLGSSTFTNR

SEQ ID NO: 955947 - protein, 69 aa, Homo sapiens
MARGLGAPHWVAVGLLTCATLGLLVAALGGHDYLNDHLNSGLSMAQATGTHMKISTMVNEHAHGHGHTD

SEQ ID NO: 955948 - protein, 104 aa, Homo sapiens
MAVGGRAEGGESPNVVLAPLICVGTQKAVSVYRTSNQAYGSRAPTVHKMPKVFYPNSNNFFQQQQRVECIRDNTLNVYLERSIYTGHEYCITCCDRINFHPSYN

SEQ ID NO: 955949 - protein, 85 aa, Homo sapiens
KINFDDNAKFRQKDIFAMDDKSENEPIENEAAKYDLKYIGLDGNIACFVNGAGLAMATCDIIFLNGGKPANFLDLGGGVKEAQIY

SEQ ID NO: 955950 - protein, 101 aa, Homo sapiens
LPPETVLLLPQSCQLTDDVHPPSQPPPPLRNNNNNCEENEHSLPPPAGLNSSWVELPMNSIGGTDNGNGKNGGLEHVPSLCFNPNGSPVENALELPNMIQD

SEQ ID NO: 955951 - protein, 77 aa, Homo sapiens
GSVVPGSSGVGTPRQFTRQRITRVNLRDLILCLEKERETSHSLLLYKAFLKGHRRTPGDYKYISRLRLLGTSKWDIV

SEQ ID NO: 955952 - protein, 122 aa, Homo sapiens
PSSAPSTPLSTDAPEFLSVPKDRPRKKSAPETLTLPDPEKKATLNLPGMHSSDKPCRPKSEYTLYKYLMGLYITIRRCCMLQKSSDPENDCCGTQTCPFDLFMVHVTAELSIEYDTLGMLHC

SEQ ID NO: 955953 - protein, 78 aa, Homo sapiens
HKKVDMMETNTTDDEKSTAKSLLVKAEKRKSPPKEYIDEEGVRYVPMRSKPPHTLLPQYLNPCEACYHHFQRYSDLTG

SEQ ID NO: 955954 - protein, 98 aa, Homo sapiens
QDPAYPDADSGSALGPRDLRCYRISSDRNECSWHHEGPTVGVSHFLRCCLNSRRWWYFPAGSTTTLKNLPPGWGVCAVTVTLWVEYCAKNQTEKSPEG

SEQ ID NO: 955955 - protein, 88 aa, Homo sapiens
STKPNRHTPPKSGYAIVQATSPPIRTYDFLSILEIYPEGNNFSVFHLLFYYSSGIIEALSLTYIIKLEDLPPPRTGKLALLNMPESGN

SEQ ID NO: 955956 - protein, 96 aa, Homo sapiens
ESVLRVDTGGKLAQENGCGVMVSHRLRETDDTFIADLLVELCTGQASEAILVSEEKLSVGLVFLAHPPSLSFQVFEVCRGASGEPRFTFRRERTAT

SEQ ID NO: 955957 - protein, 116 aa, Homo sapiens
RAEFGPRAKPLPRGAGVNPSSFTKGGGERNLAGPSIQPRPTTRKTDCAPASIEEEAVLTTGQDLVFNITKKTGLEPLLPYAHSELLGCSFWLSGELMEPLAEDAPPPSRNKNEVPD

SEQ ID NO: 955958 - protein, 66 aa, Homo sapiens
MIIYRDLINHDEMFSDLYKIREIAYGLCLGVQGKMVMWTEGDIDDYLIGGNAYDGGPYGRRYRKHM

SEQ ID NO: 955959 - protein, 119 aa, Homo sapiens
SGKYQFGNAAFQINAMIIHIVEFVVGVPEVSPFYNFMHTPGNIINMSIQQYWDGWGVDRRLTNRTVHETLSEDAPPIKARSWLEEHRYENFDLASVLNGKKKMPLWRMEVLPYRLEILS

SEQ ID NO: 955960 - protein, 106 aa, Homo sapiens
KSWMLWNFVERWLIALASWTWALCRISLLPLIETFHLNGGIILLLLIFISIAGILYKFQDVLLYFPELAIPLQRHLLFPIGPPRHFTHWKTIFTIKIRISIGNYRP

SEQ ID NO: 955961 - protein, 130 aa, Homo sapiens
RPAEDDLPMKAKGETIEGLAQFLKQYKEAIHDMNFSNEDMIREFDNMARVEDKRRKSKQKLGAFLWMLRNLQDPFYSRGPREFGGCRAPRYTIYIFFVSCGSQAYVKPCVLYLIVLIGFILILSIPYCVV

SEQ ID NO: 955962 - protein, 99 aa, Homo sapiens
AGNWGGMAEFGLQRRPFVFLSRVSPRVRSLRKRGGLGVDSLEEGALNVAGPGLPPCWDSNPKWKWGDLASSPPPAVSLNQVAVGESFALFGSLQHERSH

SEQ ID NO: 955963 - protein, 79 aa, Homo sapiens
NGNIGFLLSSAQLCYPGRMRITWAEPAELRLRGLGPSKVRSTRASAPQTHSCAVLNVPAVKTVTYAPKKTLPRIHTGPG

SEQ ID NO: 955964 - protein, 99 aa, Homo sapiens
PENPPFKKGVFGKPKKKKNSPGGGPGGAPPKTPPRGGRFGGPRGPPPPPKKAGGGGGGPPPPPGGGGGGEPPLGGGPPPRGGPPPPPRPGGEGPGPPPP

SEQ ID NO: 955965 - protein, 152 aa, Homo sapiens
MRRNKADVERYIASVQGSTPSPRQVSGSRRDRRPRPGRAAASRCSGVMAPDGRCSLARSVEAPAGWRSPVGGVALCKRMKSPGGTAVGGRPLAPALPLSPGLFPTLVPDGARSWGRPGPGFLADRAPRSNPRGLFFGSLGTRVLYWRVFSIL

SEQ ID NO: 955966 - protein, 31 aa, Homo sapiens
MDDNVWTAEDEQETYALGLFSLKIAFEFDKL

SEQ ID NO: 955967 - protein, 69 aa, Homo sapiens
QLAPSPGGFLLLQEAQEFSTYSLSHMLRKEAGPQLGLTIVDEVMKRSPKGEICLPLCSHGGTHICRFRP

SEQ ID NO: 955968 - protein, 79 aa, Homo sapiens
RKKVNPLYGGLQLWTNLGSGFSRLNIIFCYLGESGQVLPAQGSHKHDELQVDGGVVASRNQLNVGKTLSSDGGDDLPRG

SEQ ID NO: 955969 - protein, 110 aa, Homo sapiens
DTGSCFFTQAVMHRHDHSSLQPQPLGSSDPLTSVSQVVGTTGVRRHAQLIFIRFFERHLTGLAQVCLKLLGSSDPPTLVPQSAGIIGVSSPPGPKFSHKFSRRSKVPSLP

SEQ ID NO: 955970 - protein, 54 aa, Homo sapiens
MSTNINDNDHVFSYIKIKNYAFTHTQTHSHTHTIQEYDYSGMVAHACIPIYLRS

SEQ ID NO: 955971 - protein, 180 aa, Homo sapiens
MPHLPVACRANLHGSPGALAGRSMAQGIGRLQNCWTYPGLQSIVGPWVESRSVLAARWMLLARGHCEGKIPAPSLACGVCFLPETTGFSSSILNGATKGKHLERTFAISGESRSLDPCGVSYSLSKTTDFTVGNNMSSGVTITSTLLRFKRAQPAYLLPCYVTFTTTSDNNFASLTRRRR

SEQ ID NO: 955972 - protein, 101 aa, Homo sapiens
MRNNNKKNYFWFKKDWFPPGRAIAQMSTESGPGIKEGKVLKDKRGGGKPKYQGPKFSTAQGYCILENTTHPVGIGGLKKVHAREGSPLGQGRRRTQGPLVA

SEQ ID NO: 955973 - protein, 63 aa, Homo sapiens
NGGISGPVTVKLARAMIAGNGTGAYLGGGLKQTRNGRGGWQVPPNAYSILKFSVSEWLLLYLL

SEQ ID NO: 955974 - protein, 122 aa, Homo sapiens
MSPKGPQIHRLLFEEFIPCRVLAYVGHWITRTTRALNNCPKKPSNPLSFADSLDHPLLLGERPQIGSVFTPQGHCTPSPRILWPEGPNLLIWRPDKIRKFRHTLCPSVEKEYLPPQFPHTNS

SEQ ID NO: 955975 - protein, 151 aa, Homo sapiens
NKAGGITLPDFKLYYKATATKTAWYWYQNRDIDQWNRSEPSEIMPHIYNYLIFDKPEKNKQWGKDSLFNKWCWENWLAICRKLKLDPFLTPYSKINLRWIKDLNVRPKTIKTLEENLGFTIQDIGVGKDFMSNTPKAGATKAKLGNGDLLN

SEQ ID NO: 955976 - protein, 90 aa, Homo sapiens
IRGRVDGVLLITMNVLLGSVEIFGTFATLCNASCYSIPNEGVSGDFNQDVFTPVGYDKDYCPIIFTRGDCKCIMAEKKDPKKTFPGGEWI

SEQ ID NO: 955977 - protein, 36 aa, Homo sapiens
MMSGLRDRRRMGDRCLYLGGAKPEETMAEVHNGPDM

SEQ ID NO: 955978 - protein, 138 aa, Homo sapiens
RRSLALSPRLECSSVISAHCSLHLLGSSNSPVSASSIAGTIGMHHRGRLTFIFLVERGFRHVGQAGLELLTSSDLPALTSQSAGITGVSHRAQPSFIFTTRHFSKCLHFHNCPMEQVNYVDAAANLVVVVNPGIPDRD

SEQ ID NO: 955979 - protein, 101 aa, Homo sapiens
MSLQAKSKATITPSGSVIYKFNSTTSCATPQALDSSSAEVFIFVSTAVVVLEILTMTVLGLVKLCFHESPSSQPRKESMGPPGLESDPEPADLGSSSAHCT

SEQ ID NO: 955980 - protein, 52 aa, Homo sapiens
SRPRRLSAVDRNYYLNRSVSFDFSAVNLEFQNIERDITLRVCQFRPVGQIMR

SEQ ID NO: 955981 - protein, 47 aa, Homo sapiens
IRGRVDYNSFIITNKHETLYGGYDRIYRTRMLKTTKCYTKEVKEDLN

SEQ ID NO: 955982 - protein, 49 aa, Homo sapiens
SRPRRRITYDSKAHLFVMGVEEVAAYHLGRIQREDGLPPLREAFTETNH

SEQ ID NO: 955983 - protein, 74 aa, Homo sapiens
MCVQGTINVGFSYKALDGEQNGPDIIQGCPLLLHDVQAYVTLGVHFRVIARREELHCGRIARVATGELYRELIP

SEQ ID NO: 955984 - protein, 52 aa, Homo sapiens
FAAASTLADPFASVAVAPVAAATTAAPAAAAASANVEAKKALTFISKWEGVI

SEQ ID NO: 955985 - protein, 138 aa, Homo sapiens
MQPFPDCELNILRQSVEGVLFMLAHEQLKQQLSVTRNNCRNRQLNQCFHDPLLEDSRADVKRNNVTRMVSVPQTTAGAILDRVNIGCGYGLVEGHPRRQFETTSDSEDVWYILQFDYSRLPKQRIGHFHEGDAYVDKW

SEQ ID NO: 955986 - protein, 155 aa, Homo sapiens
KKTWALIYFWGGDHECVRVCKGNSCFQGLRAGPLSLFFAHPCSQCRPPPWGAGPAPGHPSWGGSVFGTMGTLWCAGGKVGGGATQLLSFLQPQKENGLGPPQLWAGLAGGSIARFNHPFIGIRLFPGTLPLFQGDVIYGNFPQVARALNPFKKFL

SEQ ID NO: 955987 - protein, 114 aa, Homo sapiens
MCSRQDRIQKDIDAVIHKSKAEDCLFAGEFLLFQNLGPSAPFLVFQPKRVWLGQLLTLKAKPEWPQRGSRPRGKARYFQPRVEPEACKHPSWVPQAAAKRGWLDPPGLRNGLIG

SEQ ID NO: 955988 - protein, 30 aa, Homo sapiens
MLLCKRRSLITRRETHLQWNNLALRHNNLS

SEQ ID NO: 955989 - protein, 73 aa, Homo sapiens
MGPSGNMKIAIKQQRNCETLNIPYRTKAGQGNTVTSPENEKDLRCQVVRKAPIRQGLEWQAREPPPRPEPILS

SEQ ID NO: 955990 - protein, 127 aa, Homo sapiens
SRPRRRILTLSPRPECGDTISAHCNLHLLGSSSSPASVSQVAGITGACHHAWLIFVFSVEMGFHHAGQAGLKLTSSDLPASASQVAGTTGVCHHAWLIAHLANLLKKNCRDRVSPCWPGWSRTPDLK

SEQ ID NO: 955991 - protein, 68 aa, Homo sapiens
IRGRVDISEASDYYFVKMSDIFYHAVNLRLAGVCATDTWRMCLSSESLASPKSFVALNDVSELTPETD

SEQ ID NO: 955992 - protein, 61 aa, Homo sapiens
IRGRVDEDVYHCRVEHWGLDEPFLKHWEFDAPSPLPKTTENVVCALGLTGVLVGIIIGTIY

SEQ ID NO: 955993 - protein, 67 aa, Homo sapiens
RAEAIFIVKTERTKLSQHIKETKQVVAAELVGSLAVPIFIPFFGPVHFLLTGPFYITIDCAILLNAH

SEQ ID NO: 955994 - protein, 59 aa, Homo sapiens
MVPERPPTSFQGPTGGSGPWRPAGLSLAHPGGHSFQWLQLLGVDEATLLDQIVEVLVAG

SEQ ID NO: 955995 - protein, 77 aa, Homo sapiens
MWVSCSPSPFLHPTNTLGAVLERDTLGIREGRVFNALGRWSEAQCQRQQLQVTPKNRRKGLGKALGLIRFPLMTIEE

SEQ ID NO: 955996 - protein, 96 aa, Homo sapiens
PPIGEPRGTGARSQAKGWKNKTNDNKKKKKGHSFLCARGWPVPLCVVSTRKVECAVVVIWPLPVPFGRGGVVWSGSPLSPVCSNSLCTPLNAAKTM

SEQ ID NO: 955997 - protein, 90 aa, Homo sapiens
TTQQTNPLNQNHPVTKIPPSPGIAVNKPICRINPSQRKSDLTAVYCSISSLSRGLREWAPRGPGCQCLSRDIYLELQTWGLPILKKADLF

SEQ ID NO: 955998 - protein, 102 aa, Homo sapiens
VCERESCQSSLSSKKATVGSVRTSVWCLSMLCTFKPTAGIKLKVLSLEVASTCSVASPRVLSPRGVRSPPNGGSAPALSRTWGLRGGSSKEAMNCQVVPGPP

SEQ ID NO: 955999 - protein, 117 aa, Homo sapiens
MGLHTCSSSLLLCSNSSFWGKVLASSHEMTSGHLFSTFFLYASLILPLSPLSSTGLFMLKGEDSRAFWVAPSLACTLSSRLLLVPLLDQGRKFLPCQAGLFGWWGRNFRGWRGFYSR

SEQ ID NO: 956000 - protein, 113 aa, Homo sapiens
MVRPHFYLKIQKLGGYGGTCLESQLLGRLRREGRLNPGGTDCSEPRSDHCTPSWTTEQDSFKKKKKKKSTRVANLVVESRTRKFRTRYPAGVPLLSNESHDRVLAFIWVLAVS

SEQ ID NO: 956001 - protein, 72 aa, Homo sapiens
SRPRRHQIWGSMAPGLDKHEKRIAVPVVVSSMLLSYTGMGLAYFLGLPLILKFFGGATPAGVEMKTAITKSG

SEQ ID NO: 956002 - protein, 108 aa, Homo sapiens
SRARRPAATPRAPRTLAKGSLTDSFPDLLSLAAEDCCCLIALEAPWTITDAELWITLTVEDAQLYEDTLAGRSVLIKNLTPQTLQPRWTGPYLGIYRTPTAGRLEDPP

SEQ ID NO: 956003 - protein, 35 aa, Homo sapiens
IRGRVDNWCNTRYWRAKQSPAVPDTPPEATPAGCF

SEQ ID NO: 956004 - protein, 30 aa, Homo sapiens
MPPAYGRRGREFKEKEEGPRNWERDLQAVP

SEQ ID NO: 956005 - protein, 139 aa, Homo sapiens
QGAALGFRKRSSSSLAGGSTWAISFFSLFFSLDFARSLRRRARDLDRERGPSRTMARSHSRSDRGRSPPVHLPFPYCPLDPHCPCLLPLYCPGELGRLDPGGGAPPPATTTTTPTGGTASSTHHKNTHRTGGNPSHTTL

SEQ ID NO: 956006 - protein, 92 aa, Homo sapiens
KKIQLLFLKYWEGKGGKRAPDEEGPFRKKLRIITKGPLAIGEALGTWGGGSRRSFIAIKPELGSFGWHTIEAGLPQRGAELNLPRAINALVD

SEQ ID NO: 956007 - protein, 124 aa, Homo sapiens
GRLGRSSAFQHHADELFIVDTTFVVFMPCHQHLYFFLWHLFTQCDKNMPDFSTHDGAFSFFVKHPKSFALILIGGPGPCSWPLFAAWAEKAQNPPPFHLFYIFFGVPQDLNPLGVGRVFAQGPL

SEQ ID NO: 956008 - protein, 65 aa, Homo sapiens
RQSLTLLPRLECSGMVSAHCNSASQAQAVLLPKPPEELTPPSVPPPLANFRISSGAPPFTMVDRL

SEQ ID NO: 956009 - protein, 43 aa, Homo sapiens
FAAVSTFHSMRGSDGVGEHHVLAHAKQAHLAGRVLQGRLLLYH

SEQ ID NO: 956010 - protein, 112 aa, Homo sapiens
SRPRRLFFLEMGFHHVAQASLKFQASSDPPTLASRVAGTTGACQHSWVIFVFFVEIQVSLLPRLVSNCWPWEILLYWAPNVLRLQASCSPLKYARYVARLSCRAGFMSHPFA

SEQ ID NO: 956011 - protein, 124 aa, Homo sapiens
ELSYLVLETMWIAMFPVSFSARRRVGPNTIPKLCVDMRFLEALATILVRCPKRTFMVSRFGGRSFCTKRFYSFNSCVGGLLFDRFHKQLKKTVKEEGLMQAPGKTSLVLRGTTRMSFPWAGRPN

SEQ ID NO: 956012 - protein, 109 aa, Homo sapiens
FAAASTNGAISAHCNLRLPSSSNTACSALLSSWDYMHMPPCLANCVFVVEMGFLHIGQAGLELLTSCDPSASGSQSAGITGVSHHPGRELRQRGRELSSSGSDSRRPGN

SEQ ID NO: 956013 - protein, 67 aa, Homo sapiens
SRPRRPIPIMGIDAGLAVLGVLAVLGAVVTGVMCWRKSSGGKGGSCCHAACSDSAQGSDESLIACRG

SEQ ID NO: 956014 - protein, 166 aa, Homo sapiens
LDKIPQYCFNSEKNTPPSKRSFNTAVSLEFKVFSCHGESPGEPFPLGFAGDLFHWHPEPLAPGNADPGVQVVELGRAQGHLVVLLLGRGLHTQLRQLLLQLFQEPPFFLQDTPGLAIPLGFGLSPRPPKFCPGLSHLLLFCLDLCLEILHRLFERTGGCSLMVAEN

SEQ ID NO: 956015 - protein, 108 aa, Homo sapiens
MLCSWRGLFQDDLGLQKPLSGGSSLAYRGCENLNSVTCRGHDHVTSRPGGSTVRQRRILKGPTTGRISACGEASPDPKEASVSDHMAHRSKCQARSSLGESEKGMRWT

SEQ ID NO: 956016 - protein, 55 aa, Homo sapiens
MEWNEHALDSTRLQWNGVEWNGMEWNGIYFNRMEWRGMVRNGTVRNVLEGLVMEW

SEQ ID NO: 956017 - protein, 153 aa, Homo sapiens
SLRPPPPCALWSRSPVTGDGLLPPRTPGAYLWLLGSAARDQAGSPEKRFVKGLRQYGKNFFRIRKELLPNKETGELITFITIGRRPRAASSEPIVSTEQAGSEINAPVTPVHTLNPAGILGPINPGDDFDSEDSEQELKGTPAATASPPPPKI

SEQ ID NO: 956018 - protein, 53 aa, Homo sapiens
MAENDTQMQTLPMPPGGDSLTKQERAPGLRGANGSDIPPKGKLNILFSMHPPR

SEQ ID NO: 956019 - protein, 103 aa, Homo sapiens
NCLFHCSTLAADSCRAGVSRALLSRRVCSSISHFFTLAALCVKAIFSLAFSDFRGVLGVTRVRSPFIGRSVGTGIPGKITWGLQFFPRFGLGILGGFFTPRDI

SEQ ID NO: 956020 - protein, 125 aa, Homo sapiens
APVFENKLGNWMGSRGKGEVFQGELFLHPWPGLLFKTAGVQAKPGSFAQLGPPPYPYSKERAAPGFLANCLFAHVATLLGGGSLTGFPALKCNFFCHPPGGPGGIHVKSPALDHHCWTPENRRKN

SEQ ID NO: 956021 - protein, 130 aa, Homo sapiens
MNKVDLTDLSQGCPTKLWGPCLNGLPEPTDLSLRPDAGILRLECRTGPGEIHGVNSLSEDEKPDCLMHDDESTVHCTNILPGLNDQREKDILCDMTLIGGRKDSRSNGCACPKHEKFWPATVARLNGWVA

SEQ ID NO: 956022 - protein, 116 aa, Homo sapiens
RFLSRVVFFIGDIRVMELFQRTEGGFPVIFPPHTDEDIKGPRRSDEDYKLEQIWVQRGSAGAVGTRERPPGGRGTEEMRVQPRRAEYTCPCSLSRQAPTANTVCAVPWRWGQEPFE

SEQ ID NO: 956023 - protein, 34 aa, Homo sapiens
MLLPEEKHFICREFYVKEFGVMGVNYLTDHLLFL

SEQ ID NO: 956024 - protein, 76 aa, Homo sapiens
SRPRRLPKQRRTGLFSATQTQEVENLVRAGLRNPVRVSVKEKGVAASSAQKTPSRLENYYMDAGDENNSWSIFFES

SEQ ID NO: 956025 - protein, 65 aa, Homo sapiens
KLAAANFTVQLDDYLNGRAVQNREVQGFESATFLGYFKAGLKYKKGGVGLRIKHVVPNEVGVQRL

SEQ ID NO: 956026 - protein, 80 aa, Homo sapiens
TETCPIARLECGGTNSPLGFKQYSRLSPPSSWDYKRAPPCPANFLHSSRDRVSPRRPGWSRSPDLLICLPRPPKESKIKA

SEQ ID NO: 956027 - protein, 104 aa, Homo sapiens
KNSFAGHGLLGWQYFSFNTLKMSSPSLLACKVSAEKSTVSLMGVPLWVIRRLSFALFSIFAFALTLSGLIITCWGEDDFALYLFGDLWASCIWMSRFVVIFGKI

SEQ ID NO: 956028 - protein, 115 aa, Homo sapiens
APTISLFLPLGFLPPLRAPHHQGKACWPNPISFFFSLITQNPFCPQAFINLFVHIKPNGFGEGADKKNGKGLVQPGDFQNSSTGKAIPGPVVAQGVLVLFRVEVLGLNIQQDLQK

SEQ ID NO: 956029 - protein, 81 aa, Homo sapiens
ALRPLIPALSSPCPVRRVLSYLTCGERHRSSGSVRLAGEGATVSVCYLERTAAQETERVLGLPGSKEGPPRGSHAVFQADV

SEQ ID NO: 956030 - protein, 103 aa, Homo sapiens
PGKTACLFQRLEVGMQNAGVPKGGGACTPGADRDNAPNPNTVHPEDTAEPPTFQRLTQTSSVLCWGGGSTTMARPDGGGGVAGFSCISFRPSGGTYFKGDRCY

SEQ ID NO: 956031 - protein, 125 aa, Homo sapiens
SRQTESCSVAQAGVRWQDLGSLQAPPPGFTPSSCLSLPSSWDYRCPPPRPANFFFFVFLVETGFHCVSQDGLDLLTSGSARLGLPKCWDYRREPPHPAWGAIHSYFWLEMEPGAQELGRAHVDAA

SEQ ID NO: 956032 - protein, 51 aa, Homo sapiens
FAAASTDTSHKLDWEGGHSAPMPPACGPLKGPPPNRTAIVSGLARGVASRT

SEQ ID NO: 956033 - protein, 68 aa, Homo sapiens
RLFLGFNLSWGCNNSRSSCGGSSHRGSSHKGRWISQEGLDLFSKWEGVIRLHRQGQDSFVPADDRMGH

SEQ ID NO: 956034 - protein, 99 aa, Homo sapiens
PTQAFFKDQKVQVQGKKKGHGQKATPPKGSLTVLGGQHGAHKGKEFVQKGMPRGGEIGRGVASQGHQQAGAQDLEVDGIHPHLVGMQVAQSKQGTGQVI

SEQ ID NO: 956035 - protein, 43 aa, Homo sapiens
GEFFLLKWAGAGSFEVGWFNFLEFPLNWVLSGLVQLHKEALDV

SEQ ID NO: 956036 - protein, 28 aa, Homo sapiens
SRPRRHKIKTLPSPSLNVPSQLKGIPIT

SEQ ID NO: 956037 - protein, 154 aa, Homo sapiens
VVVVVLDGVSLLSPNKDQKRQRRGIYYGKGFNATRRAKINIYATNTGASRFIKRVLRDLQRHLDSHTIIVGGFNTPLSILDRSMRQKINKNIQDLSSALDQVHLIDIYRTLHHKSTEYTFFSAPYSTYSKIDHVIGSKIFLSKCKRMESCLRGR

SEQ ID NO: 956038 - protein, 50 aa, Homo sapiens
IRGRVDWKNSFCSHIMTINTKDFCDQMCGVFFHQQASNQFLLAPGGENPN

SEQ ID NO: 956039 - protein, 114 aa, Homo sapiens
MNLQLVPYPRLTLSIVLESIEVVITVLFLRLGHLTGGEKACFVVITGKNILRVVTLITLRPAKGHRKQWLGMFRGDSWLSHVIHHSNELSRESSDRNRETMSVRQRAGGREGDP

SEQ ID NO: 956040 - protein, 93 aa, Homo sapiens
SIAQICDKGAVITVTVNFMELTPRLHSLTWTTKSTGRNLAGTRRLAMTQIARISDKGNERRLQAERLVGTQALQEAQALRFNVFSGEFNAKLK

SEQ ID NO: 956041 - protein, 108 aa, Homo sapiens
MQVIINTGQAALLWKNGILRARSICTTRVGESSPSINQPDWNSVCISTLWAENTYHISAKVVMSKIDEVGPIQIMKRPMFFASHLRGLARYSLSILSQGRASGELVEG

SEQ ID NO: 956042 - protein, 140 aa, Homo sapiens
GPHSTACAQVPHRWGVVCFLRKQQGFSRLMIPIWVSSQRCCYVRDVVGAVSAVLSSAASKGAGNIFPLASARRSIPAHAFALKKYLGGIEPVSSTCDNEHTTASLGQAEILGVQDPPRDCSFGSIHTTSVLPFLPWLVEG

SEQ ID NO: 956043 - protein, 52 aa, Homo sapiens
VLPVSVRTSTDMWSHASGFSLTYDLNCDKLCTDFQEDIEFHFSLGWTMLVEG

SEQ ID NO: 956044 - protein, 126 aa, Homo sapiens
MKSSGGRMVRWLNGYACNEPLPTSTTTYMCGQQLNVCVSKQPAIMPGQSYGLADGSCSYQDFSESRNNRFSTPEQADKNRIQNPSNVLHLLQRPAGGDRGRTSLRSAIELGVKRPSSVKVFYRLQV

SEQ ID NO: 956045 - protein, 68 aa, Homo sapiens
HRSSLHLTGSQAMIDTMGMGKTNRLKRVTNIFRQNNYKHAWHRTGALSLKLKGCKNNSYTKDSNWYEI

SEQ ID NO: 956046 - protein, 86 aa, Homo sapiens
TCTRMFIAALFTIAKTWNQPKCPTMIDWIKKMWHTYTMEYYAAIKNDEFMSFVGTWMKLEIIILSKLSQEQKTKHHIFSLIGRIEQ

SEQ ID NO: 956047 - protein, 109 aa, Homo sapiens
AIYSHISGVDLVRDGEVTYYVLEDNLRTPSGVSYMLEDRKMMMRLFPEVFAKQRIAPVDHYPNLLLKTLKSAQPPHNPNVVVLTPGRFNSAFFEHAFLAREMGVELVEG

SEQ ID NO: 956048 - protein, 39 aa, Homo sapiens
MHMVFSLGGMHAIACETLVEGSLTKPSAHQTCPSELVEG

SEQ ID NO: 956049 - protein, 34 aa, Homo sapiens
TRTPNAWWLMQCHRHLTDEMKPEPKRPEWPELAT

SEQ ID NO: 956050 - protein, 30 aa, Homo sapiens
RYLYSPDTKFIQEEIDTSLSNMAKSHLYKT

SEQ ID NO: 956051 - protein, 82 aa, Homo sapiens
MVHPCVAGGTLRVVNHRQRHAIFNGAAGVLVLQLQKQRAGTGIKLVQLDQRCPANQFGDGVVDRHDVFLSGCHDGMIGRRNF

SEQ ID NO: 956052 - protein, 51 aa, Homo sapiens
MHLPTSEIPHGDEILVSWRHLGPCVLAKCLSKVTMLEVSLKNNVVSVSVRR

SEQ ID NO: 956053 - protein, 140 aa, Homo sapiens
KRGTKVMDRNPSPPPPGRDKEEEEEVAGGDCIGSTVYSKHWLCGVLSGLIQIVSPENTKSSSDDEEQQKELEEEMEKKFAEYWDKSMDEDVALFLQEFNAPEKFMGVLAKSKCPRLRENCVGILGKKACFPGEMCCSNSS

SEQ ID NO: 956054 - protein, 114 aa, Homo sapiens
IDRVSLCCPSWSQTPGLKGSSHLSLPKCWAYRREPPTPAHLLVLCTTARDLSVYVTLLSTKKDSRSWEKVLWAPGLWRCSLSPIVLISHSGEKRFQYRNLPTAEARPQLKAYTM

SEQ ID NO: 956055 - protein, 68 aa, Homo sapiens
SNQNGLDLNVRPQTMKLLKDNIGETLQDIGLGKDLLSNTPQVQATNAKVDKLHYIEFKSFCSAKETPK

SEQ ID NO: 956056 - protein, 67 aa, Homo sapiens
AAIVAVVAVHVVLALFVYVDWNEGSRQWREGKQDESEHHLFIALNSFFKMINAGGGQSDLNKVERTC

SEQ ID NO: 956057 - protein, 108 aa, Homo sapiens
ETGSCSVTQAGVQWRNHGSLQPPPFGLKQFSLLSFPNSWDYGYGTLHSASFLYFFFFGGKQGLAMLPRLVLTELLGLFTTLWLPKGWKFKVLPPCPTKNNPFAGIHGV

SEQ ID NO: 956058 - protein, 115 aa, Homo sapiens
LKCKHSNRPSTKKRFSFVIGTPDEHLMSGSRGYPLMSVDDDILASRLEPDDSKGKRKPWVTGSGRRPGLHQLCNKSGGLVFRFERLHLFFLLIFGSGCYFTWIDFALYPTTQRTL

SEQ ID NO: 956059 - protein, 104 aa, Homo sapiens
GQSKTFNNFFWNPRGTEFKWEKGEGGFKQRDPQGPSQLGLNNGGGQTFFSTAWGVKSGKAWKFIPHPKIPQPIKSPDLGFYKHLLNKQNPSKFVPVGNFSHTMD

SEQ ID NO: 956060 - protein, 119 aa, Homo sapiens
CSWWHSVESHLGVLAPKNVYQKDAQIERTYVDEVNSELVNIYTFNHTVTRNRTEGVRGFVNALNKQKGAPQLFVARPKEAEVSLQVPLILGGMINPISSTTKGNKPFFRPPPRMRSRCN

SEQ ID NO: 956061 - protein, 50 aa, Homo sapiens
MQTLAPLTPGCLGSRDGLESLLLQGQSHKERPPGPTAASWAPPESGVLKG

SEQ ID NO: 956062 - protein, 119 aa, Homo sapiens
GPETGQAEADVTLSKLQGDKAATGCPGRKNHHFPGSPCSLRPQPWVQENDLWPLPALRMANYQLHPLNSSHITSLVAALSRTTYLDDINPGAAKIKPDPPNEDLKMRGSFGNFWTTGMK

SEQ ID NO: 956063 - protein, 179 aa, Homo sapiens
TGTCAPANDFNLTQIQSAAESMKGLGTDEDTIILISSRTRAMSSWKKIRQTFKSHFGRDLMTDLKSEISGDPDKADSGAHDANGPLQCQAVEEGHGGSRHRMTKALIEILALEPMLKSGPSMRPYKEDYHKSLEDSSEAQTHLATSGGSSFLWPRGIVHGGKETTGPVHGKMPRWLLSS

SEQ ID NO: 956064 - protein, 87 aa, Homo sapiens
VCKHPPYGGRRQIEFGFNPACHDSATCCFSDSEALNREFRLSLVYVRLRNVLRGDLSRCLSNLMACSSEPKTGHRGLAMDGGFTTLA

SEQ ID NO: 956065 - protein, 65 aa, Homo sapiens
YLFSPDTLIAHHDEGDQHPNRQEMIATRDELQVPEKDSADQRDDDELFDQLVAEVFHGTINQLAA

SEQ ID NO: 956066 - protein, 41 aa, Homo sapiens
SYSTLLLQYHIALRQVIVRDRNEKLFRCSSPGNRVFSARTF

SEQ ID NO: 956067 - protein, 148 aa, Homo sapiens
MKTLTAENTVATPAKKLPSEIQSSPVPAPLAPAQPSPFELPQHSSSSTDEFDELLALLGNINEPSEDTKNKAVSAAHTAPPKLDEIQPSQTSNQGGAPLAIIEEVTPMPSNNTEIGQGFVEWLKKGIASRTIIINDTKALVHTVAGTH

SEQ ID NO: 956068 - protein, 78 aa, Homo sapiens
DRLVGPASPPRQIIDYRDHRVEVRTGKSGEAHDQHVQATSPVCQQHMAENALDAYVYRYAQTRDTIDSKNQATVHTQN

SEQ ID NO: 956069 - protein, 32 aa, Homo sapiens
MVFARCPWIECMHNWDTRIVGQPGGDNGYLSS

SEQ ID NO: 956070 - protein, 55 aa, Homo sapiens
MAPPACRIVISCFMSQRRPLKGLSVAMSGSAHPFLTIFEGSVKTGGGTAVYEGGW

SEQ ID NO: 956071 - protein, 172 aa, Homo sapiens
WVPALRSEILSLPKRKGGILLLDETQDTELWQRWKVLTAQQPVGRTDEASLLAAAMDLAEGMALPLSVVWAAIKFWVDQGLVKVMAVDDEIQRRGPMALSDLFDGALKTLAAQQQAAPAPVATDGFLYSGNRHESVPRALFLDRRLTPLERNAWQVFRLLLNDDAGTHSGYR

SEQ ID NO: 956072 - protein, 32 aa, Homo sapiens
WNVPSREGSQPFWMRKAGSQVKSAHSARCPTL

SEQ ID NO: 956073 - protein, 171 aa, Homo sapiens
SSSNHVSRLRRRRSVLQQGVEAYSASSQALQFGDAIRQACSSRTWTLSPTTSRVKFGACLPVSRTNRRVLKRNTGYPHCCSRAEIILALNIHLKHRLTAVHFLPSGPAPVGVGSFSTSPENVTMIQKINPLARGYYGFEIRRVAVVSYEIAIRKRSFRCTRLSASYQNDPP

SEQ ID NO: 956074 - protein, 44 aa, Homo sapiens
GGSFCGRKSIAHYHKLGIEPMSKTLVSPDSLTLPKALEIFRALR

SEQ ID NO: 956075 - protein, 53 aa, Homo sapiens
FDMHGVESLGSTVPSFGQCEASVKPASGQHVSAGSNAGGRLTSPKAERISRSN

SEQ ID NO: 956076 - protein, 125 aa, Homo sapiens
HGKPRCNPHKPTLYAIFTPHPALALVPLHRSCGQCPHTRQSPQDGEISMSVLDGVSLLWAVALFIYLLVALLRADRNQERAMHSYDYWLIIAFFAVVLVPAPFLGRFYYKVMEGQRTWLTQNDPP

SEQ ID NO: 956077 - protein, 188 aa, Homo sapiens
RHLGDDKRVSSGTRHPGRCAPLYLAACQVLGRGAVVVLPESHEQVAITVEGQARAEVVASRQLGLLAQYHLEVFQAAQVGRQTPAPYGCTGLAALASAFGVRQVNQAVLLEVWRQHHIQQPTLPLGPYLRHALQGRRQLAVRGTQNAGSQAVRSPGNLAGPAKTPVPTDGQGPGQPAWRRCCLARWGT

SEQ ID NO: 956078 - protein, 77 aa, Homo sapiens
DPCGAYCLGAYDEDQIIAPPERKYSVWIGGSILASLSNFQQMWITKQDVRQKPAHSISPPANSFYDTLQPPVAGYRR

SEQ ID NO: 956079 - protein, 67 aa, Homo sapiens
RGDLEDPVRTDAVPRAVVESVHVNEEYGVHESRRDRAVAQALEADGVTFHSYLDQLFFQPGSVRVRS

SEQ ID NO: 956080 - protein, 79 aa, Homo sapiens
GVTLRILAYGRYAHALFRKPGSADASEYTYLHLPKRCPMFNTRLKQELTALREELSSLLQVKESLESEMLCLTLDRVRS

SEQ ID NO: 956081 - protein, 76 aa, Homo sapiens
DLEVPGVRTHQAVGWPGKQLMADQQARTEQDFVMFSHPNLFVSDVAEYAQNIGAQADGKKVLAFFPKLDPRRASVA

SEQ ID NO: 956082 - protein, 122 aa, Homo sapiens
MAEVELEWVPLVGEELSEQWRLGNVHVVKQVGNADICHMTVPAPARTLSACVVLAIQVAVATDTPFLHACKPCTERRRVSGCECQAGCQGAFFQPRDILALLAHRVAADQSMHAAIPGGVRS

SEQ ID NO: 956083 - protein, 41 aa, Homo sapiens
MSVVCMTCRQPDLTAPIRAAAEKIDVSKFPLADAFTRCAKV

SEQ ID NO: 956084 - protein, 125 aa, Homo sapiens
MTSGGIVLRVNALRCNVRKVGEVGEETWRSPGSGVTLQRQTGRVIEVCIEYRPFAVNGVAKVQCASDCVVSIDRRFMTPAAEQFLCPYPAVQFRFGDRGRGQRGIGVERGLQEGRAPGHQIGFES

SEQ ID NO: 956085 - protein, 65 aa, Homo sapiens
CVRTHTFDIQDGKYLKISFLGALQTLSISRISSDDLFAVNPVNVRGGNIDRIVFHLRFAKRGVRS

SEQ ID NO: 956086 - protein, 137 aa, Homo sapiens
MTLSVASNSLWRASLLAAGPGSGPIKNTAFIQSEHLGRFQGRFAAQREQSLATRSGGVFDQTMPQRVIHPPGLLLPVQAPATWQAERGRRGLALSVDPGIRCQPLASFQQCADGRQQVLVERWVEEHYVVFSRCLRP

SEQ ID NO: 956087 - protein, 152 aa, Homo sapiens
VSALDYALRLAWWIATRLVDAELTALCAMAVCARVNGGSLQVVVGPMADSIADEIRLAMPGFVAAVPVAVAPVDKPVVVNVQEAEQWLNALGGRGNVRHLEAVAMTRLRVELGDDSRLSEAQLTALGCQVVSQLESGVWHLLMGDKASVAGY

SEQ ID NO: 956088 - protein, 113 aa, Homo sapiens
VQRGSRRYGRSPPARVDTEQRDQHHLEVFPFAEGLANRAPQALPSSFIFKKAGDSCRLMRIQVEMPSSTMENKNGMRQPHTSNCSPGVRSGRPLRTLSEFAPSMPHAVGSDGY

SEQ ID NO: 956089 - protein, 120 aa, Homo sapiens
GQRVPNFDLHGFQGHTGPSLENQIKIRPVRIHVSFIDRVGITQEVLALLGGRNLNLDAVEMVPPNVYIDAPTLSAEVLEELRDASVQRARRASGKGRRHPSGPASPLATRRPAGGHGVRS

SEQ ID NO: 956090 - protein, 215 aa, Homo sapiens
IALGSVIIHSLTYSSVNDLMLQTILGADAMGVFLGVTPDIEDDVMNIRFRINFLHCNRRLCPAAIRQRFGPMGWKGPHSSAKFFWRDYYIMRPRPGLDTTEATTGAMRPSPMERAMPPEMAVPMQATHSVAIARARAAAISMAMTRATHASEMGKLHRAGHSMETAPGQNGQGFTHPGTATAADGQTYSGQTSITKDGVTRSGTCTTLADRGVLL

SEQ ID NO: 956091 - protein, 215 aa, Homo sapiens
RRSLVTKGPANCLLDDFSDRYQRQKATHPLRPLPLSVADLPASDDNRRALPHSRKENAVKKLLLLTPLLALLLQGCGVTMTQYEPNFDNVQVLKRAAPLQPVSNAQVTAAPGEGSLSVRANPIRSPSGSIPAHIQAAITQELQLAGLLNPQAERHLQVLVVKNSLSAGMGSGNGTLAARFTLLKGNDVVYDATKDVTHTWSSSFFGFIAIRTPPR

SEQ ID NO: 956092 - protein, 202 aa, Homo sapiens
IPSQTPNAKKREIVKLPQELVSQLGVRSDQDLSTEFGFTLHYLKKERKARGISSVNVPKYPEEMLSLLGKVADRDLVARLGYSSTTLSILRKKLGIKRHHKVWTAERIALLGKIKDSEVAALLGGAFTKGSVGQCRRSLGIPICRGPRNGAPTALFLSLSRGLTSGKMEALPSAQPGETGQLTQFPLSLVQKPIRFKPKPKD

SEQ ID NO: 956093 - protein, 214 aa, Homo sapiens
AKSSGRRLAVIAVEERDQAIEDAGLKPGQDRNADDVPDLQVPFDHADEVHQGQAYSKGIQPHQRFELVMRLSLELAADQIQCIAVLTPQGMGDKTKNDSFRPELAPVVVRHRQHLASGDKQHQAFRQALQLGLRTSQQLFIRLGVLHVRAYRCDHLDGLAGIDELVQLLHQQVVLHLIHLNPVDNRLRPGIRVQGNGSLAQADILGQAELIASA

SEQ ID NO: 956094 - protein, 152 aa, Homo sapiens
MPGDRMALLETLLRWVRSSEVPAVEEPLSRAYSQLDALADPLKTPLQRGIAALRNTLGQDAADALLQPAPMRADEAACFHFPLPIDYTGQERRLRMGFPSKFPRGLLRLNVEPSPWLVRPHATTSGLSLHGFQGTPHIWALRRPWNRTALLG

SEQ ID NO: 956095 - protein, 238 aa, Homo sapiens
ASRPDGIAGIYGMNFKHMPELDIGYGYFVVLGVIAISCVFLFVRFKKAKWLWILPIVFFAVIWRLQRALYGSLSNPTQDEGASMTEQLTDALQAVQSFIAKGYDREYRVKDSNLVDLEPGSTIGPCGICVDAAFRLGSGDDGDNASTLYAITDPATEHKGLLIDAFDEICYRDPVQESGPQCRRSRLTSIRVIRSSKLETFMKAMGYKVPGPIAADARWSESIASAVLRIESVEGGAG

SEQ ID NO: 956096 - protein, 83 aa, Homo sapiens
LRGHEELLAGREDHRQVVEEAGLEGIATKPVLGDALVETKIQLFAGDDGVQGFWMFCHIVTLSSCLRDGGTVQIAQGSKQDEG

SEQ ID NO: 956097 - protein, 42 aa, Homo sapiens
CQREGSVKQVELVSGRGSDKFLVAKLKGLDDREEARLLAGYE

SEQ ID NO: 956098 - protein, 110 aa, Homo sapiens
IWLSGHHDAHQQRQQENMRHVECPHPTQDFQAGEEIALALQNLAVGQHGCVAGQEHEDFRGVTEPEVLHGDVGEGVVRHVIPENEDQRQAPKKVDARVASVQHGSGLLNK

SEQ ID NO: 956099 - protein, 67 aa, Homo sapiens
HSQVPAVGTFCAARTARFRSSRERGTPTRPYRFDRPGPGAKAAHQEQAVDRRRRVAVARFIGERTGQ

SEQ ID NO: 956100 - protein, 34 aa, Homo sapiens
SVSADTLKPAQSQAVRCRGIYNKAQYLEQRTTMM

SEQ ID NO: 956101 - protein, 108 aa, Homo sapiens
MRNSLVGCLFAAVLLGGLSSTVLAEENGSDHSTTVPVTATDKPATANDSKLDHGAMDHSQMSHESMDHDQKTKKEIEIMTSKFLRPTLMALAVSTGPAFFFMAQAAEE

SEQ ID NO: 956102 - protein, 74 aa, Homo sapiens
MTMASLAFSKLFQIDTGFSTLKLSFQVTAQCRLGLIKGIPKDLLGHYFLITLLVFVTEQNLPYDEYQKRYQEIM

SEQ ID NO: 956103 - protein, 55 aa, Homo sapiens
MTKARREKRYSCRNFDTRHDPAFNKGFQTERRSAAGSIGKRRGASQTFRYANSRR

SEQ ID NO: 956104 - protein, 45 aa, Homo sapiens
MSRLEPSQQSCALLIRFDFAVARKRLTQQGDDALGFEAGEDILAQ

SEQ ID NO: 956105 - protein, 104 aa, Homo sapiens
MCFYPALSLYEKPAQVGIGVYRRVLMTPSQASQLPEETELSDYCGSWLACDEALKLNRVACTEMQKAPPFTGRGFCFSACHSDLRVAHMQDLHAIGATGGVVAV

SEQ ID NO: 956106 - protein, 55 aa, Homo sapiens
RAQRAAGEAMLSWLIPAKSHLAAPGVGHPGGIVGVLHVVGALQLGQLVGREDTRL

SEQ ID NO: 956107 - protein, 48 aa, Homo sapiens
VAPGRGDQKSLATDQHMRWRFVGTGQRVESDRQRRGERSDMGGGRAAQ

SEQ ID NO: 956108 - protein, 89 aa, Homo sapiens
ETCGEFDERQHRLENDIKTLIIEALGLGDISPDDYGSDQTLFGEGLGLDSVDALELGLAIQKKYGIKIDADAKDTRNHFTNVASLAAFV

SEQ ID NO: 956109 - protein, 159 aa, Homo sapiens
ESCVATSMLRYCDVGYEKLCAAGQPVFDLGLLDRQLLAQHIEHGLVALAERVEVIPQPQCLALVIQYAGIGQAAGAEHFQQTVGGDVVQAGQLRVGAAAAQQFQAFDRTVVGDKEVVAVIAPVHLSRMFDGVVDFLAAELQRHRRQATQFGLGVLIDDL

SEQ ID NO: 956110 - protein, 144 aa, Homo sapiens
MINKPPLTDAIVVALARLIDDSQLSEKREPTHYDLDLLFAQVSITAGDQPGPGGRPVGKAKRIRGALNWALTNHPKGGEAFIPALISTVQGYGGFRQQSINYCGAEAIANLISAIAAQGWELSMDGNLTPNVLEAMKGRQLTHA

SEQ ID NO: 956111 - protein, 145 aa, Homo sapiens
PFTALLSQMALEAVTWYEGIALSMDPYLIITIPIVWLLYEVKLNKVLDTELTIGKLLLRIRHDFGRRQHYVLAEPHAALHSQILSMYMSLVIDNLYALGSDVVCFMAFEHFHTVKNQLVYDLMASTIVRYRSRSHVADISRDAPL

SEQ ID NO: 956112 - protein, 88 aa, Homo sapiens
MSVCQRLHAHQGEGWIRPWLKILFLKHCLTVMRLEGVVLNPCRRCFVNVNRFPSGATLDQVKKDAKKLARTQNIPLNQAQDAAALKHG

SEQ ID NO: 956113 - protein, 188 aa, Homo sapiens
RQIRISPEQEKGRMQRVHHTKIEPGNMVRRRSVPSRHGSRDGITDMPASTEHIDNKRRDQRRVRRSRRLRTGERELAVHRSTIPWHSGEAKISEKMPDDHAKTVRYPERISLIIYRRWIWNRVRSSNRRIRIVMHMRDKVDRIRQAAPGVSAAARCTAGPSNNVDNGQSTSVQPQQRRESFEDPLEAT

SEQ ID NO: 956114 - protein, 166 aa, Homo sapiens
ELPTDTQHAAALARQHEPRMNGKASMKAYAKKPLRHAVEIRNYTFAVPEYIQLLDKHGVALVVADTAGKWPYVEDVTANFMYLRLHGDKQLYASGYSAEALQRWGDRIERWAQGKQTADAHLIDPHHTPRRRKQRDVFCFFDNDIKVRAPFDARQLLQRFGLDQHL

SEQ ID NO: 956115 - protein, 227 aa, Homo sapiens
ATRLRKQQTQGRTGQRFEPHKKLNHVGADAGHNSGGIEHLAPERTQAKTAIELRQTVHAQFETQLANHIEDDGKRQYNTTVRVTGTVPQTGRSRLHWLPHYAASLAGSSAPVAAVSDLASQRLNALLNAGVANSPQTSMPMMRLPAANARRAWSTWVRRMPPWSQLVAASSLASTSLSMVIQIASVGRLAIIWSRKAPNPGRQVGQCSGFLLLVAGRPHRPRLDGMR

SEQ ID NO: 956116 - protein, 118 aa, Homo sapiens
RTPRRLLTPTSVTEVRPKANDGIPRSSNVDVIAVIMDCPPRLEHQLVRRLVADHPDHCQTALLNKNVLYPTAVADVVSLAQDHHSINVRRPMPPFDSRSVADRMPTDEEYCPAEQTIS

SEQ ID NO: 956117 - protein, 94 aa, Homo sapiens
GVGFLEHLLRAQCSIRRDDGYAPADYRLPAGRFAYRNCRVDVRKNRRVEDSDGQPERVLTRDEMLDDISLYWLTNAGASSSRFYGENNNNNFSA

SEQ ID NO: 956118 - protein, 61 aa, Homo sapiens
YRRWAEIIELSINLKLAGDLIERMLRKVQQQKTSQRRQFSEVGLEELSGLHSQLIANLRLG

SEQ ID NO: 956119 - protein, 186 aa, Homo sapiens
VASSLVVYCCVQRFRTIAGRYHQHAETVFVVIIGERQQRFTDGGHPGAQASPASMTWVEMLSISSTAALAYQQLVTGGVLEHYRQATTDKVARQFIDLAVGKRHLALGVSFRELHHRLVHQVYHAALVKAVEPGQGQHGVIALAKGIDVMLEDDLVLGAAQRFETLTRRTRLMACESTEHLLQVIN

SEQ ID NO: 956120 - protein, 118 aa, Homo sapiens
MVGSGLFEEEAEFSDIAADANLMDDMIVQIPEALTALYLLCNAPDEKTGDPQATSPLSRLPVEPMGNRPLLLRYALLAIGWLSVALGVIGIFLPVLPTTPFLLLAAACFARSSPRFYH

SEQ ID NO: 956121 - protein, 132 aa, Homo sapiens
RPKLCAGVRSFGLACRPDLEPVVVFSRVVVRQPFMGNHKIGIRRVNVEKILLAAEKVFANKGYGSTAMADIAEEAQLPRSNLHYYFTTKSELYSAVLFDLLELWKQDALSFETFDDPRVVLSSYIRAKMAAR

SEQ ID NO: 956122 - protein, 216 aa, Homo sapiens
CGACFEHGALSRWVSNGCGFCRSNSAPTGIRTLRLGTVGVVSTSRGSVSSGISCKVTCDTESWLSELVTETEASPSASWTITTDVSGTMPSACAWLPNISSRAIRPNAVLEHVIVMTGSRLGEMSGSEVTQVQNDGAVEGHFLIQGQVLRKVDGGVHLKLDPQLADEVGLTVARRSKCHIGSWIAIGLGRPAFAAVGGRQDLHGLGVPTGLGTTTH

SEQ ID NO: 956123 - protein, 116 aa, Homo sapiens
IGRSTSCMSGEALIRRMVEDLKLTPDDRLLEIGFGMGISASILQEFGPASHTIVEPHPQVLLQAERWKGVRKNIQLHPGYWQQLDTSSQRYSAIFFDPFADEMAAVDNENLRFLKF

SEQ ID NO: 956124 - protein, 70 aa, Homo sapiens
AAVLPKVYRRRLGRTAPDRCRCASHLMNHFPTHQRTEILRCGDATISIFNIETTRSIIGDTQVARGLLHV

SEQ ID NO: 956125 - protein, 166 aa, Homo sapiens
LRGELVRDVRITQIYEGTNGIQALDLMGRKIVGSGGAFYTMFADEIRQFIAASGPELAEFTKPLGVAVGNLDELTAWVLDRAKSNPNEIGAASVEYLHAFGYMAYAYMWARMAKAALGKEGEEDFYASKLGTARFYFARLLPRIHSLSASVKAGSESLFLMDEALF

SEQ ID NO: 956126 - protein, 138 aa, Homo sapiens
LSTNVMDGAWRRPPKSLADYGHTEPKRGAELVGQEPFGYFGLGRHSGFSKVTRRQGGTLSGRYRSNGYVHNPTVLTARQPSRASPLVWIARRQVDGVGFQAVIAGKPTEGLRRAREIGIGCQAVFAGKPAPTVGSRRT

SEQ ID NO: 956127 - protein, 94 aa, Homo sapiens
GSLSTNVMIVSYLNGCADAAATQRASEIAELLRITGWRYAHCNARFAYLRMAPMMGKKSQVLIPAIIRLMARYEPVGVWESSDSYRVEVYLRSN

SEQ ID NO: 956128 - protein, 33 aa, Homo sapiens
MVLDPSRLYDASYVYAARRTNLCNLATVSGAVG

SEQ ID NO: 956129 - protein, 108 aa, Homo sapiens
QVDERWAPMAAPSSTRSSGINSTLDLIGDGVWVTIPSPPVGREVRLHWYGPSNRVEMLKYIETPGDVRIKTPAHYVLEDLKRLVKVYWQVSLNGTAHRYSKVVTLRNC

SEQ ID NO: 956130 - protein, 83 aa, Homo sapiens
LARMQANERVRLEHELCRAIEREELSLYYQPKRRLVTQRLNGAEALIPLAPPDLGRGPARALLFALGEENGMILANRRTGYWN

SEQ ID NO: 956131 - protein, 117 aa, Homo sapiens
PNVDHRGHAGKPIYQMSKWWARRRSSVFRSMLIAAATKAPEDKSHAARLVWDNYYANHQKKGTFKHLKGGGHLHGWRDHTSWKALASVCRLVGNDLNTGSVVRGQARTGLTYDPPEM

SEQ ID NO: 956132 - protein, 87 aa, Homo sapiens
GDSKDPFSTNVHCLRDMWCKRHRMQLGPLACNLMGASQAIGPLLSKYAWSLQVWWHRRSTRSSCARLFKPRPGLITGVHLLGNGVAY

SEQ ID NO: 956133 - protein, 105 aa, Homo sapiens
METSCEHPRAAGTLKTKDVQWPQGASSCLVNGNKQALSEPAILAALREHKPALIELIKAGEYTATKAGEVLVPFNGIPDNAERINPQYADPVNLKQDEIERIEIR

SEQ ID NO: 956134 - protein, 74 aa, Homo sapiens
MGSQVDEPHMGGGSSPGAVQSVLAWLGRRCQIVQTGVGWHSWFSFPTDLVELAEGLVQGRTHHRRVEVDIDDLD

SEQ ID NO: 956135 - protein, 131 aa, Homo sapiens
TVCHRSDPFTQAVQGVGEQQRMTVIQRFALGLSGVDLVAQQAPAFQWRGFGGALQPGAGIFQQRRELIEKLWRTVLNVAYTASSKASITWQQVNHAPAQFLGVAYRLRACAFVGQLAIIKFKGVEGHSGLK

SEQ ID NO: 956136 - protein, 58 aa, Homo sapiens
MYLSALVEQLHVGMDFNISREARRHVVNGPPLLRYSRKKPRPTFSTRPGRGTESFPGE

SEQ ID NO: 956137 - protein, 47 aa, Homo sapiens
MGFTVELRMLKRQVEKALAAKPVASLIGRHALKTERNHRSLHADHVQ

SEQ ID NO: 956138 - protein, 91 aa, Homo sapiens
SVLKQAAKFVRLRVSAQQACLFIDKRGITVVLADNPRRWQDLRSSIMRELIRMISSAWYWYFYTTDKNKRTTPDKLAKNFVLTRAIAQHVI

SEQ ID NO: 956139 - protein, 139 aa, Homo sapiens
SAVQQPMRKTLRFPGKRFVMAANLFSSLFWCARMEIKVNFLDNLRLEAKFDDFTVIADQPIRYKGDGSAPGPFDYFLASSALCAAYFVKLYCQTRNIPTENIRLSQNNIVDPENRYNQIFKIQVELPADISDKDRQGIL

SEQ ID NO: 956140 - protein, 86 aa, Homo sapiens
HRVVLTSWKSQALVIEVNGFAGLGTDRDLLGFAAQYVSAYLIGPRHFRGRLADRSPIAYRAEVQGQTVTLEATEYPQILPGLVPNL

SEQ ID NO: 956141 - protein, 54 aa, Homo sapiens
GHSEDYEQHGTLMTIFVFTSEPEFQVKAIGIYQANWLLNRSSGNTKNSSPLLQN

SEQ ID NO: 956142 - protein, 44 aa, Homo sapiens
HIHAPYPKLPTCISGRIDGLGRRRVRLDMGEPVKIVEEADKMIN

SEQ ID NO: 956143 - protein, 63 aa, Homo sapiens
MADFMAKMAKHGPVWLAHLYTDFFAVGVVGFLDVQGDQPLGVSGGGRVAFQVDNDEVEGQDRL

SEQ ID NO: 956144 - protein, 63 aa, Homo sapiens
EHNVFSLANRRMIQISALPAFTDNYIWLLQDPTTQRCAVVDPARCHAKCWPWLRAECRCGRLS

SEQ ID NO: 956145 - protein, 98 aa, Homo sapiens
CSTNVVDSVSAQTFQPFPGQSHGYLPHRPYPDTRTHPQIGLLVIHIFAPVRLCRHPFCVHGVNHSPPESQTNGWGSVKPQKQTGFHFTQRAHVMGQIP

SEQ ID NO: 956146 - protein, 42 aa, Homo sapiens
ARMWYGSVDEGRYTSEPNPVLTTLTGCVIQTYMPWCADKKIT

SEQ ID NO: 956147 - protein, 101 aa, Homo sapiens
PRNAIEFPDYRYISKINPVQCADRSVWELAAGMPDLRSFSQVAVMLSQASQLPHLIEHIHTFEAILRLMNLPFFARRLLRPLLDPYRRFRHAKLIHAARVS

SEQ ID NO: 956148 - protein, 37 aa, Homo sapiens
LLRYSEDPLARIIAPVLRFLVRRGTLYIGDLRVDALA

SEQ ID NO: 956149 - protein, 39 aa, Homo sapiens
QSLEPMYISQRYTSARNEEVFMNIQLKEAVVIGVDAYRG

SEQ ID NO: 956150 - protein, 212 aa, Homo sapiens
ISTNVEIDKMLRGTAYMAFLIHRDEITQLLEIHKVLLIEKAGKSKWPLAPEAPSLAPIRRAYRAGSDNEQQFLVDSVYIGKAKNLKALLAGGIDQGQVAKRRVKCELVPSLARRVLDDLVVHAPRADVSSQCLIAHCGAPAPGVCTGGRVPGFRTPDDRAYLGFPVKAAGPNSLGHSPQAVREAICQQIHTGINPGLGLHNRAQLDLVDRLC

SEQ ID NO: 956151 - protein, 158 aa, Homo sapiens
PKDSSTNVIVYGDDVVKRHRDAVGPLACQLDGRFTGFGTAVEQIGLVAAGVVAQTIDKIQLRAVVQTQARLDHGCHLFGAMASLYGLGTVTQAVGPAALTEIQISAGRPASRKSQGTLPPVQTPGGGRATGGHSGTGLETFCTRGMHNQVIQTRRAGT

SEQ ID NO: 956152 - protein, 185 aa, Homo sapiens
ATLEDPLSTNYLDLPLTKPPRLVPEYAGWCAGLLEFTDCASLLTSSNGPCVVNCTSSFCALPDRFERVQGQGGLVPPARKRVAEQLGNQRGGNHRLAFRHSVAIIAPGLGHQAQFAVEVGDIDADFALAFLSFSVTVDALQGDDGYAGVRAFAGYGQRRVDNKKQTVQEPLAGFNQLAVDVEWGD

SEQ ID NO: 956153 - protein, 58 aa, Homo sapiens
QRMCPARTFAEGIEKVGLGEVIFDVPQANARIRHSIFSDRPAPDSVKTTQVGHPVVEP

SEQ ID NO: 956154 - protein, 60 aa, Homo sapiens
VSARRLTDTNTGRHGKRRTDHFRAAAMPKVRLRDRAEDKTHETGSRQTPTPGPRAEVTQA

SEQ ID NO: 956155 - protein, 123 aa, Homo sapiens
HECGTSGTCAQSASNTCPCWRLIMSDSKTLRPIIEAAPLKPQPTQNVHGWERIGSVAGGVMMVGKGLRRGGIFGLIQVAIGGVALARGFTGHSSLKDKLGTGAARESEQRCATKDSETGIGLT

SEQ ID NO: 956156 - protein, 93 aa, Homo sapiens
VRYGSRICTGLFRGGPSLGFLDVQGDHAPFGGGPRWWARCFQVDTDEVEGQAQPSSRSTLLGTTCRPRLISCATNAAAMRGEVFLKPLTPAFG

SEQ ID NO: 956157 - protein, 89 aa, Homo sapiens
VSSSDELTRRGLTNELAFDFTVLRDALTIGNLRLTDVGFDAGVTVASWSTRMSKLQLCPLPADASFDQSHSYSLDRGKTGSILRHSLPK

SEQ ID NO: 956158 - protein, 91 aa, Homo sapiens
MGLGGDVFVSGYWPKRSQIVGVGLDTQLINLSGLSVRSAAKNRHGDISQFDKFQVRPIRPKSRRKTLIERRWLTWRLNVGPTYRCSKGYRS

SEQ ID NO: 956159 - protein, 29 aa, Homo sapiens
MASGDMRTSQWGRLNLPADQIASGSLQLL

SEQ ID NO: 956160 - protein, 48 aa, Homo sapiens
MCTLRSGGRLNLSRRYNSFWFMYSSSLLVFWSLTSMSYFSSSDSIDTW

SEQ ID NO: 956161 - protein, 39 aa, Homo sapiens
MTTMEEEIMEVKITMILEIMTRRTSNYESMKSEHFGGSR

SEQ ID NO: 956162 - protein, 100 aa, Homo sapiens
VVKRNPATEHLSSWRKDINENSLVVASDAEPGQCRTSDLAERFWKDRPERVTAPYAKVKLSDLSRGGTTVVILSEHGGDHPSKALNTRMQPIVNWYRGVG

SEQ ID NO: 956163 - protein, 34 aa, Homo sapiens
SRIYSTTDYYSFFPAALLSEPNTTLFGGTTITCA

SEQ ID NO: 956164 - protein, 106 aa, Homo sapiens
MPVTSHRLREALRLNNAVPQGLSSCIFTTDVREAEQFMSAVGSDCGIANVNIGPSGAEIGGAFGGEKETGGGRESGSDAWRGYMRRQTNNVNYSLELPLAQGITFD

SEQ ID NO: 956165 - protein, 59 aa, Homo sapiens
ERLRTSESSVAVPADVSDELLSSHIVLEHMTGSSGEVGIPVWQALGNVRLGAVLSVHLQ

SEQ ID NO: 956166 - protein, 75 aa, Homo sapiens
NLRLVAGVLQTFDDVHCITAELSALQRMLAAIEHFSACCVLCCVRRKGERNDWDNFFRMGCPGWRDCSGKRRMTA

SEQ ID NO: 956167 - protein, 43 aa, Homo sapiens
MISLIHGNGLVVPGYSSFKPICDRRRLAMNLRKSSIIAGGYWH

SEQ ID NO: 956168 - protein, 205 aa, Homo sapiens
MPITSYCIYVIAVGILKTDVAPGWISLSLQQSGMFFLISLVLLVEGEYILNMASLSNEGPLYHVAQEFHPVREMTRCEKLNVEEWASESADKEIPTSDRACCRGLTKAKYATMRKSSGGGFYGAAIGIYLARQRGFKRILLIERESALLMRASYNNQARVHNGYHEPAQFYHLLSQSSKLAEIVRDWRRHKADSPSSCYAGQSKY

SEQ ID NO: 956169 - protein, 187 aa, Homo sapiens
MPITSSHKRKTKCMSSALATGITYLHGKKTSDDSFVIDTSSQFVVAMQVQRSEASDSFTEATREEMRDLQDSLVNANGEIFERPGDYGLTVCEEVPSWALSEDPTPSMIHQTRRLAGFFMGRNPPYTSMCSIPSYQAFATSGPTFRRVTMQHAIKKATSQPEMLDGFDQTKLPIDRDSIRGGYMAGY

SEQ ID NO: 956170 - protein, 70 aa, Homo sapiens
ALMAGHEDSNGCINYEASVKHHHVSLEWSSHRTSIVRKTGWQLIIITPMTNSPGLFTIIQDHKAIWTAHD

SEQ ID NO: 956171 - protein, 155 aa, Homo sapiens
AEEARLVVPGEIAVVDIHIVEITRTEQLRQARQLVAAFRESASGIRNPGRFGKQGIGSEHTLVGVGAVGEEAVEQQALVGQLVEVRGDIARTSQCAHRMTSEAFHQDHHDVLDRQGFLGRWREVTAHGSGVGVYQLLLREHQHVTHGLGGQRLFQ

SEQ ID NO: 956172 - protein, 40 aa, Homo sapiens
VNDSESHTSSRYTNMITSASCSIAPDSRKVGVHLDACLGR

SEQ ID NO: 956173 - protein, 99 aa, Homo sapiens
MSYPESLFTAYTGTCCDGFYTKYGDIIKASLHCLRQRLLDMGCADDYMMTLNSGVMGLTQQDAHILDHSIELMDELFPHAQGAYTLEGVLACHRRHNVT

SEQ ID NO: 956174 - protein, 52 aa, Homo sapiens
MIQQQSHMSCTDGQYPLYGTYRIIVVLAVCRRVRLSHGTIADCSSFRSADYR

SEQ ID NO: 956175 - protein, 35 aa, Homo sapiens
LEVHESTHRRRFIKRSVVCVDNTSCCTLAIIFNGF

SEQ ID NO: 956176 - protein, 96 aa, Homo sapiens
DDPETVILLSAREIDQERLMEFALCMLPKVRIGILQRYSRQKYEGRERCINVSNFNAEHLKPTVDDTGVVPPSFSAQILRKGQFKENDSEVEDDEL

SEQ ID NO: 956177 - protein, 113 aa, Homo sapiens
QDVELIALEWGDVDWVGGSIRIVRAKTRAGMRIDPEDASVRRTVKLLKPALDALTQQKAITFLAGGRIYMNPHSGQPCEESGRIRKILWLPAMKKSRSALPAAQYQKSQNLRL

SEQ ID NO: 956178 - protein, 178 aa, Homo sapiens
MLVLQVEARCRRSDRNSAILRTLEHSASVRRCAGPGSGQLRGDNVILAFAVQVKIIFGIDVFELRRNKAIAPVHWVLDSGSLRSSVFRLHGSGRLRGVQASFTYSAIRIERPAVFVNHITVSKVSVRSYGFSLVGEVEPPRMVRQLTIEGDLRQTVIRSDLQKSSPVDMTAGPDPICG

SEQ ID NO: 956179 - protein, 36 aa, Homo sapiens
HFIVDLLAGNGIRIFHKFPALYQWQSIAPCGSGFHG

SEQ ID NO: 956180 - protein, 77 aa, Homo sapiens
RIREMIQRVHDVMNLRRKYASIATIIGIIVVIASVLEGYVLSHGKICALIQPFRSADYRRCRGTGPFFEGETHGYMY

SEQ ID NO: 956181 - protein, 69 aa, Homo sapiens
YLRIVISESTLWVGDSSTGECESVGLQACRAGSCAVGAYQLDGAVGVGARFVVWDSNITILNHQGPSSN

SEQ ID NO: 956182 - protein, 146 aa, Homo sapiens
MNTSYHTDESPAPHHGAGRQISKARLPASACTDARSWKALASRVTVFRLGSTVKIWSDGESPAWRDSAGDEIEPVSKLSLIIIKLHMEEAPSDFSGLQSRSLNWQRIEKVVVRVPTDNLNGLSESTEALAQTTSQASQLPHGIDVR

SEQ ID NO: 956183 - protein, 58 aa, Homo sapiens
MAAIHIGISGWRYTPWRVDFYPEVLTQKREWQFASRAVNSIEINGSFYALEDPQALRR

SEQ ID NO: 956184 - protein, 226 aa, Homo sapiens
SYPQMDHPSARLSGSKPKNTCSNAGHLASTTLCFKPARNTLQRQGRQVTVIRYLAQLRRGLGHRQVGFQLGRRTEAVQTIFVQPLVIALPSPVSRIENGARKAPVYQSLGKTQRFTTFDETRCGGLIIFKLVKSNRLRSAKLRRDHVLQAAEDTFRYRPGVLRTQSHQHLLDHLALQVTLGAAQVERDDREMLKSEYAWMSTRGISHRADHSCAIMEATGGWPEQR

SEQ ID NO: 956185 - protein, 34 aa, Homo sapiens
MRTSRHSIELMDELFPQPGAYTLEEFCLYIAAYR

SEQ ID NO: 956186 - protein, 189 aa, Homo sapiens
MRRRSDEGQGDSGADGAVGCWRPEQTHVDYNNALFSEVKQALEGYLAGREGLPVKSLSELIAFINRTQKPGVPDQKLLEMINGVQTNQEDRDALWKAILPIFQNTIDDPMKEHKLDAMVSNFQSHNYFFSAAAGYPGISVPSGMDEDGMPTALYVYGSANSEATLLSVAYGYEQASQAIHKPAFLPGAP

SEQ ID NO: 956187 - protein, 67 aa, Homo sapiens
MSCHVAVVLYSVAGVLAILAHHHVKGVDGVARRRDLQLDQQVFHGNLRVETTDLLQHFARNQHGRRR

SEQ ID NO: 956188 - protein, 56 aa, Homo sapiens
PNGIPKWNPYELIVEGFSADYVWGGMEPGFVLLGKALLSVSDSGVIAVRVLSFLIF

SEQ ID NO: 956189 - protein, 77 aa, Homo sapiens
MEFALAAPKGAYWILHAFSRQKYEGRERCINVSNFNAEHLPTVDDTGVAPSSFSAQIERKGQFNMRMTVKWMDDVLE

SEQ ID NO: 956190 - protein, 77 aa, Homo sapiens
MIQRVPIFMNRRAVPSLWLNNRHIVVIASVLGGYVLFHVYIAALDQPFEVLIIGGGVRRIFEAKPGYMTMHVVKESP

SEQ ID NO: 956191 - protein, 126 aa, Homo sapiens
SIAFSGYTPESLSRVSPLEPENMLNIGAWIKRMAKSLDLGVFSATPPATNREAVYKINALLQRCYKARNGFWIIFIITIDGNDALITLIERKGVGATKLCTKFSCCCLDQEPPHAKRLQLVQLQGT

SEQ ID NO: 956192 - protein, 72 aa, Homo sapiens
ITSYSDHTEPGGERQVFLARLHAPQARFRGGSGWVVEAATVGIGTLVGMLREKALAQVAVGKVQFDPFKSRH

SEQ ID NO: 956193 - protein, 161 aa, Homo sapiens
PPNGSTADSHQTSLPARPEWTGYDVTCNPLKAFLSTHGIVMKARLPEATLTASHRIHHSGALGFNLSIKSASEPFSRETSQWKWSGITTQANDVAEPFILGDPELLYDQAAESEVAEDGPAFKGVGGEQVNAVGLVIAADAAGVLKQVNQAFRGLSSDGVL

SEQ ID NO: 956194 - protein, 97 aa, Homo sapiens
LITAVVFDHTEPGGERQVFRPDFTHRSQGFEEEAAAVVEAATVGIGTLVGMLREKALCQVAVGKSAGFCSIQSRHRERWGPAIDRKFFVCTAGAMVF

SEQ ID NO: 956195 - protein, 42 aa, Homo sapiens
QRNYRRFSYNTFPASPSNTIPSTKITASLSFPMTSNTLDLTR

SEQ ID NO: 956196 - protein, 42 aa, Homo sapiens
LTLDGSPSFNWEHTMMEQPNYNDDVHWCAHMVVPDALNSVNP

SEQ ID NO: 956197 - protein, 38 aa, Homo sapiens
IPTKRAVSKLSASITLVLLRPLLITNKRLTLTHEHMWI

SEQ ID NO: 956198 - protein, 39 aa, Homo sapiens
PRFMFLRAKGLIGAVARLRGITGAVATGLHQHHMQVRDP

SEQ ID NO: 956199 - protein, 55 aa, Homo sapiens
MSAIIPDEKAPIVTDTNTAPFDTSALGSTLIDGGCRFGLWAPRAERVELALVADD

SEQ ID NO: 956200 - protein, 110 aa, Homo sapiens
ATYKVREGIYVKDQWNGSILPTRYEHLVQSFKKITNVLSSLGLLITFQIFYQCVHIKTIMTALALCICNMRTVPDVSRPLSPFTEAITWAGTVTHLLICLFRDGVSLHHP

SEQ ID NO: 956201 - protein, 108 aa, Homo sapiens
AWSGHGGSHLEYQLPGRLMQEDLPEPRSSKPKCRRIQAGRAGNAPALQPGNRVRPCLSLKKGGPISQLLRRLRQENGVNPEGGACSELEITPLHSSLGDRDSNSKKKG

SEQ ID NO: 956202 - protein, 100 aa, Homo sapiens
GPPMENPKVFSMAVLWNADFYFQKDRHKSELLFGLAPKPCTQIKPLGSSKNVRNVCSSLQSIDLLRKAPCRQSNAVHGLLGLRGKPPYWSPVIDVNRSVL

SEQ ID NO: 956203 - protein, 164 aa, Homo sapiens
VCLYIHSITSYKCTMETYSLKNLYESIDNKALYHTFTAFGKHPFSVSVVRDENGFQMATGFVHFETHETAERAIEKMNGMLLNDRKVFVGRFKSRKEREAELGARAKEFTNVYIKNLGEDMDDERLKDLFGKFGPALSVKVMTDESGKSKGFGFVSFERHEDAQ

SEQ ID NO: 956204 - protein, 38 aa, Homo sapiens
AVYVYEAKGLIGAVSQAKGITGAVATGLHQHHSKCGIR

SEQ ID NO: 956205 - protein, 104 aa, Homo sapiens
MTTTRGDRETGLTENLYDQKARIKTLPQICHKTTLSGSIIGHRSIQFKFYSYLNIMILMKQQKIDHFVWFEVNCDFNEYCRVQSRLSLNGRVYIQNIKALGIRV

SEQ ID NO: 956206 - protein, 219 aa, Homo sapiens
SDDIDEFSHCEHAPQLMAHTPCLGSGVKDLCDTLSSAKSWGELIEDEDSGKALVAQQPIGNLLMSGHRELICPQYLSVHLHVHSGHHLHKVLEHHGGLGRSDIGVVHGVHNAWIVLPKGQVLDVVGHVDVVKAKALQSHETCTWDCWKLFPGGKVEVSGTLLTSKKPYTWQPFILLLLHLLAEALSPALLNSIWVLEGPASTAICLPHIFKGVTALDIF

SEQ ID NO: 956207 - protein, 84 aa, Homo sapiens
PIYKTKPFAWTTLYHNLCTIDCLKLRKILPETFIIHTIIRIFHIKINSQVSGDPILFHLFKFALKFRLPFQLFLSSTNINFVFH

SEQ ID NO: 956208 - protein, 44 aa, Homo sapiens
MRLIRALQKCCLNAEVNNSNSCSVIVESSSNEISTFCSSQNHIK

SEQ ID NO: 956209 - protein, 57 aa, Homo sapiens
RYDRARYRLCDFEREESRNLIDEDSTITEQLIAVINLALRQYFSEQKSIHSLNLILM

SEQ ID NO: 956210 - protein, 43 aa, Homo sapiens
VSRADFLTRFYNSLQLAALSATLATLIAVPAGLAITRYRFPGQ

SEQ ID NO: 956211 - protein, 34 aa, Homo sapiens
MHQACLHVGVMRIGVSPAVTRSVAIPAHQAGGSP

SEQ ID NO: 956212 - protein, 116 aa, Homo sapiens
GKAITGISYHPEASFHEEHDLTQNYIFKEELALLAIYRYEPLNLMSKKKVLIDSYEHRLNAYFVVVVYVYAFSESYLGPYIYPPIFETKFCFLTSPFSVNLQVAIILKIVENYFHP

SEQ ID NO: 956213 - protein, 75 aa, Homo sapiens
MGVQRIPAYSVPHTPGKGVDRNGRFPHISDRRWVNGGTPLGATNEAAWRDEVPGSWCEHFWPQVSCGQVLGDAGR

SEQ ID NO: 956214 - protein, 68 aa, Homo sapiens
GAGEIESSMPLCKTYDQLAIRNRRCTYQPIIYGSMHVKAELLSALMSQRADRQTPKANHHPPMVSEVS

SEQ ID NO: 956215 - protein, 103 aa, Homo sapiens
QTHELLSASVRVLKKTVLSKSESGWTLIRHKMCLHLDLETCQPSATVRKKCVLFKPPKSMVTCYSTPLRDPKIFKTLIITCYLQSGTLHSSGWVYQVTRQVSL

SEQ ID NO: 956216 - protein, 35 aa, Homo sapiens
STMYDDELAGVIYSSILTPLLPFLASTPVDLEQSP

SEQ ID NO: 956217 - protein, 144 aa, Homo sapiens
VKRNYKKYTFCVEMESRSVTRLECSGVIWAQMNPPPPRFKRFSCLSLLSSGDYRHVPPHPSNYGIFSRDGVWPCGSGWSQTPELKRSAGLGLPKCGDYRHEPPRTALSPLALKQEEIPSTLEEISSNYWVTHLAVLKKSGDGDH

SEQ ID NO: 956218 - protein, 62 aa, Homo sapiens
RIPSHKQIGSREIIHASQTTRRWISYQVITDSSAQMFLTRVGTAESDRDKHPVPAGQMLRTA

SEQ ID NO: 956219 - protein, 80 aa, Homo sapiens
VPIIVEVWYGGVSIHYRQDQQKCPMFQYATGEPLSVAMIRAVYVLFFTCSKSSLSSSARMEMAPVSGLISSQLAVSLQLI

SEQ ID NO: 956220 - protein, 59 aa, Homo sapiens
RAQLEKRCNVEEARHPSEDLRSCLRIDWNHELAGGTNFSDTVQADPQTVTRLLYGFLIK

SEQ ID NO: 956221 - protein, 109 aa, Homo sapiens
RAVAGHGICDVTTTYTTLIVTATCMRNHLPQSNLHHNRRLRQLTHDAPVSNRCPRSMAVSHVIDTITVPGDPYIEVDTVNSYCKVLGILARRFYTGTIGLGHSYSVKIW

SEQ ID NO: 956222 - protein, 31 aa, Homo sapiens
VSFIIMHMLHHFNRSASHSGHGIHTRGIQQS

SEQ ID NO: 956223 - protein, 67 aa, Homo sapiens
IFDTSLMLWDTRSCKAPLYDLAAHEDKVLSCRLDVVRHTSELEEQTINCIPTDIHLPLPMLGHESEQ

SEQ ID NO: 956224 - protein, 97 aa, Homo sapiens
VNTCRLAQYTIERYFTLVTSIADYETVKLHYLGLYSQSFGRMFCISFGKPTMPSTFLVELSWVSFWISLDSIPARTCIEDNKGNVEEVSITNIINSS

SEQ ID NO: 956225 - protein, 151 aa, Homo sapiens
LYGTIEVTVMWRALSVFQEKADGLRPSLQTWVSTLSARADYAVFHNRALAPAQHPTLRKRILHTHYCIHTEFTEVYYQVSFMNKQVQSPIWMAAIKYLGISAILYYKYKCPRGQGNQPEELGTGSILCGNFSLGMLFPVQMYTVKKAYRAV

SEQ ID NO: 956226 - protein, 32 aa, Homo sapiens
MIASGVWQRYGKCPDPVLHYFTPPSILPSLFL

SEQ ID NO: 956227 - protein, 42 aa, Homo sapiens
MDNQILQRLKYYGAKCISTVCSVAIQYSNLEQPMIRGSREGH

SEQ ID NO: 956228 - protein, 41 aa, Homo sapiens
MARASEPVQILQSPSPAYTVHASTFWAHPTLPPNALESCNA

SEQ ID NO: 956229 - protein, 78 aa, Homo sapiens
GIVWCYGPGTHRPPLGALSAPPGSIVSLCTTSVFGEFENLRLSRWFSNLLESCRSLENLQFKKNIGLIWPFVESKNPI

SEQ ID NO: 956230 - protein, 101 aa, Homo sapiens
MQTINGDKTKLTLTNGKYSKLYATFCSDSASTANWYALITLSKLKSKLKTMLRICGYCKSLMIEDLLFQKVCNSGPLFLWNGRKDLISHAKVPPHDSCLIF

SEQ ID NO: 956231 - protein, 69 aa, Homo sapiens
ESRGSQVRQEDDEDREDEEEVPNAASGKGSRPCFEAYQEHIEEQNLERQVVTGHNCRATGWPRHYSPQR

SEQ ID NO: 956232 - protein, 46 aa, Homo sapiens
TVALSAVSDKADTVVCRARYDGAGLLAYMQKQVVAEVQTRVQPVWV

SEQ ID NO: 956233 - protein, 35 aa, Homo sapiens
VYILNVSACFYQCPCTPTLTWRCRFLAMNVDDHLS

SEQ ID NO: 956234 - protein, 37 aa, Homo sapiens
DPSNQQTACKAGQQAKPAGPTPLPVFTAMLIPSIQHA

SEQ ID NO: 956235 - protein, 134 aa, Homo sapiens
PLRYIFAPRHELRYDYYFVIREIFQTLSPFLGAFCLQTTSILLFNCVFFSFSLFDLTVLFFQFINLVAAPVILITAYGRTASFHCSSLAVESHSAVVSRALLSRRVCSSISHFFTLAALCVKAIFSLSFSDFRC

SEQ ID NO: 956236 - protein, 37 aa, Homo sapiens
SNGHISTRQLSAYMIHVVVPQESLSPRSPSPVSVYKV

SEQ ID NO: 956237 - protein, 67 aa, Homo sapiens
SERAQTHYHVRVVILDKSSCSAYNDWYMTTYNKSEYLLSGSDKEGSIETKPVNTLQLLKDYLDYLLI

SEQ ID NO: 956238 - protein, 42 aa, Homo sapiens
YSPHSTPVATPDEGNVPATASTLNHLQTATACEEGAICRSAM

SEQ ID NO: 956239 - protein, 68 aa, Homo sapiens
RYAQPTALSPQQLAVGGDLDVSASFTLMSFLVLTQLPCHSLLVPAAGRLPAPPDVAEERDMGYLSSNF

SEQ ID NO: 956240 - protein, 120 aa, Homo sapiens
RTRMQVHNALPVAHHLRKHSEAQPMCAMCATVLSAWAAGLSHQCTHAEPTANPSFAASGTTRPSKSSRWSSTYAGTSLIKPTQTRVWAKIPSPPRCTCMMCSWRIPALLLLPLVTLDLSG

SEQ ID NO: 956241 - protein, 109 aa, Homo sapiens
TFTLPSKDVFQPCHKIIEVIAISFSDITPCPPCRFYRMGSFGWVMEGDVISHDISMLAVTPERSGRHCKSQPALAGVRGFSGRSHVSHIMCQPPPSRHFQGTDCGYVAV

SEQ ID NO: 956242 - protein, 46 aa, Homo sapiens
MSMASFTLMSSWYSTQLPVPYPACPCRSGGLPSSSVLVLELLTVGI

SEQ ID NO: 956243 - protein, 67 aa, Homo sapiens
LYAQPLIEWDVHYQEACSHYVRRARTKRPSKSLLPAVEVGELPPQGTLASKTRGGGDVAPMLAGAVT

SEQ ID NO: 956244 - protein, 52 aa, Homo sapiens
LPAAHHLRKHSEAKPMCECVPRAYAWLMPAHHASPHDGTFLRSDKGTSPCTF

SEQ ID NO: 956245 - protein, 101 aa, Homo sapiens
TTSCEEFEGFQYCLGTSQREIVHASLIDRPSELIFAGDSFGRPNTQFSIRLQNVPIGSNNMPHFRHLETANFLFVDGHVKAFNDGQRDKCEMWNRDASVCP

SEQ ID NO: 956246 - protein, 66 aa, Homo sapiens
ADVGRYTAAPLTNQFVCAPVHGHVQHSTANKSVHCEVHKHVALCVLLLDESQSSSRKISNLCPLLH

SEQ ID NO: 956247 - protein, 190 aa, Homo sapiens
PPIPVPQQAGGAQEGRTSKTTIKHSIALRRMPSHGAHHNSGTNSPGSGFHSSQMLTLGSRNSTLQTLTNLPKVISHGLKNMALPPETVDLLHHSFLKQKQSSLCFLKGQHKGCFGCVETASRISQSPLASDVIVDAGWGGGQRRVLFLLFGLIWPSQAQHPAYLPHCGYASSYAGPFLWLLSLPVQLCTI

SEQ ID NO: 956248 - protein, 94 aa, Homo sapiens
PGKLCGHSQSQHQISFSQFKEQVISTPHQIFSPFHVCQKWSSNAAHVQSYVSPVKHSFNSPVFISSCRQSNIWHSTPSSNIAIIIIIIIAIAII

SEQ ID NO: 956249 - protein, 60 aa, Homo sapiens
MVSTERYRSVSHNDEKKLQLKTHTHITKEKKNIGKTEPQHKEDLCVYIVPGEWDIKSSQE

SEQ ID NO: 956250 - protein, 45 aa, Homo sapiens
RLSVQVVSTHPPNLCSSCWKALSACAFTVSSSSWMASSRVHADEP

SEQ ID NO: 956251 - protein, 105 aa, Homo sapiens
KHGFLVDYHGLVHVTLDGDIRRNFGPVVTLPFCRHSFIPIVIYYMPELPLASCTQIPMDFLTLSLACPIRGFPQLRVIGCVFILDFSPSPLSPWGVAGTTPFSLS

SEQ ID NO: 956252 - protein, 37 aa, Homo sapiens
SVRDMWMGARGGLRRHQLPPVLIDRLVLYCGSLAGQI

SEQ ID NO: 956253 - protein, 36 aa, Homo sapiens
NHVVTGTPLPVHQGQTALPPPEAPPYKSNQGEFHYV

SEQ ID NO: 956254 - protein, 34 aa, Homo sapiens
VDRGHEEGCEAISFLLSLIDSAGPLLREPGWANT

SEQ ID NO: 956255 - protein, 75 aa, Homo sapiens
LEDTGALALPDGLLHNEGTRAVDRSDPFPRASGSPGADRTVLPCSPAPRATMSASRVPAGAPGISRPMAAGIARA

SEQ ID NO: 956256 - protein, 105 aa, Homo sapiens
MDLNTAAIQGNRDENLTDSKNEGQHGSTPYHDKMVKMRITHHLTKHQIPHGITQHQSPLIRVIITNIRNLESALNMDSLSRISLGRYTKNTDQRNLVTPVSSDSW

SEQ ID NO: 956257 - protein, 112 aa, Homo sapiens
VCVSIFKIALDIQGCLRFSFFSFLRQSFAVVAQTGEQWHDLGSLQPPPSGFKQFSHLWPSFSQHSKACHFIQFRINILLWLMMNVGEKETFVLHTGLLVIKWLYNFDCWKLC

SEQ ID NO: 956258 - protein, 77 aa, Homo sapiens
VFILLVQSKLATISDSKGKRFMQPDETQGSGGESLTLILSIMSLPTGLMFKTFQNHHMDGYGQDCAALLHNELSSPC

SEQ ID NO: 956259 - protein, 59 aa, Homo sapiens
RSRSRVHTYGELNTASVPVYYETRSSKVLEDSDLKKSDIDYIVLVGALDSNFIDSTPGF

SEQ ID NO: 956260 - protein, 56 aa, Homo sapiens
MSYGTVCICQGNFYSQLTHSANATHLLSPYRSICCWTIGWGPSSSYSCLLIHICWK

SEQ ID NO: 956261 - protein, 61 aa, Homo sapiens
GLMQLRSVVLNAQEFSNRAGAFLHSDTSDTHIRIKGRLDNRDGTLASNASHIVVEGQFDNR

SEQ ID NO: 956262 - protein, 119 aa, Homo sapiens
IHNHLYSGVGRLLVCACAISILVGVSGVMNLLLWMYREKAEKSNDGSAAWELISSRHLGLWHSHDNSSRTAKSKISARVSSLESVGIQGAESAQSGAENCYCLQIHDSSDRLEHDLYCI

SEQ ID NO: 956263 - protein, 54 aa, Homo sapiens
LATSLQPSYKMVVFFFIPPRGERRFRKRHITSLWPFKFVFSTRWNEEKDHPFMY

SEQ ID NO: 956264 - protein, 31 aa, Homo sapiens
MEKNALSEIRCMLKMAWLQVDVQSQAIDVEN

SEQ ID NO: 956265 - protein, 36 aa, Homo sapiens
KLNTHYLKTSPNIITLATPTHPIGPIYHPIRTGYER

SEQ ID NO: 956266 - protein, 71 aa, Homo sapiens
RRLKDPIGAGALYDSGHRSSTSYWFDTLLCLSVYLVIDIARGEYGYVIKITVRTTGNNKETNSSSIIAFMG

SEQ ID NO: 956267 - protein, 40 aa, Homo sapiens
STLRIRERSKPVHELNYGKPVTDYRLCERYAMVYGYNAAY

SEQ ID NO: 956268 - protein, 80 aa, Homo sapiens
TLEDLDDVLMLHGVGHAHPLQTVLGAVAPNAWRTINCLASDRWMRWEYLALTCIYTKKRGETPYFTYAIILRIGASVHHV

SEQ ID NO: 956269 - protein, 56 aa, Homo sapiens
ASHDLTAIIFVVASSSYHMVIREDNQTNRLQDALNPFNTIWNNRWLRTISVILKIL

SEQ ID NO: 956270 - protein, 85 aa, Homo sapiens
TQGSALISFDLRDIVDVNQDELMSIVGNDLRRRCAGLKLASRIVGIATANRVQLDDAGVLQSMSDFMRRLSVLRQVALTTLQIDK

SEQ ID NO: 956271 - protein, 64 aa, Homo sapiens
IYRILMFADRLTILYKPQRTLGTLYLLFVCISCEFLVHSSKPPYRAELGQPGNLLGNDHIYNRY

SEQ ID NO: 956272 - protein, 166 aa, Homo sapiens
VPVTLEDQHQHGAERLQIRLRRLTCVAPIFQVMSSNSPSTMGMTPVTHSTVTIQASQDTVRSTTLTVCDVREGHPQHFDRQADHSQRSQHRDNQPKHRQGQHAQEHAPGGQRQQQGQHGKQHPVHDMPAKPDGMRVTLLPTPQAQHQPGQCQTAQQNAGFGQSRAL

SEQ ID NO: 956273 - protein, 72 aa, Homo sapiens
NLEDRFFEHEAELNNVGLPETSSTFGVFYAFVKLKEQECRNIVVDSLRCIAQSPPSPTIDRLHPVSSRRPEP

SEQ ID NO: 956274 - protein, 144 aa, Homo sapiens
KDGRLKRIPCAPPGSVDSHTGNPMKGLSCSSCCSILAVFCHSGHSLVPVFENPNPTADCKTAVNCSSDFDACLITKAGLQVYNKCWKFEHCNFNDVTTRLRENELTYYCCKKDLCNFNEQLENGGTSLSEKTVLLLVTPFLAAA

SEQ ID NO: 956275 - protein, 109 aa, Homo sapiens
ISSPVSLEDSSNFFVTCGSIGRFHYGEDGDKGWLLWEVDTSSAVCTLQRTPARRTVDIVFDGKPDLDTLRDAVARQDVAGAFVRVRWTVADEDRHEVNRQAIQEALGIL

SEQ ID NO: 956276 - protein, 131 aa, Homo sapiens
ALISFDCGVTALDGATGRTVWQGKADVDLTSGPGSDGTLTAVAGEKGTVVAFDEKGAQKWKSTVNGEVLTAPLVGQGLVIVRTTDGRILGLDGSNGDRKWIYQRSPSALNLRSSLPMIFAGDNVILGFAGG

SEQ ID NO: 956277 - protein, 155 aa, Homo sapiens
MHRVRGRLELSHRHLDPPTPHWTLSLRTWLSYTPAVIGMTSPSHVNALLVFWGVHYRKSPVAHGSLPQIVASSLYLRLFPQERNTPLTCSNDSPCPSLFPVLNGPQGEQACSSTTSQLRALLQFFTGERKEGAPAQPGQENKTLSHGCGRLLPAC

SEQ ID NO: 956278 - protein, 47 aa, Homo sapiens
ARYQLGADSLTIEGDWRTLPKQSVDGKAPLATGEEDDDEVPDLVENF

SEQ ID NO: 956279 - protein, 39 aa, Homo sapiens
SARSISIEIETGAIDIVRKGKMKNYNQALYSKDYPYTKL

SEQ ID NO: 956280 - protein, 31 aa, Homo sapiens
TSSSVRLVHFVHVWKIICKRAVLQRLHSSQE

SEQ ID NO: 956281 - protein, 41 aa, Homo sapiens
IAASLSEYGSQGCDELTLAMTDLEIRSKPEEDVGYLKKNHE

SEQ ID NO: 956282 - protein, 180 aa, Homo sapiens
GWCAARRGTSLADKDMMAKDSKFKMPKFKMPSFGVSAPGKSMEASVDVTAPKVEADVSLPSMQGDLKATDLSVQPPSADLGVQAGQVDVKLPEGPVPEGASLKGHLPKVQMPSFKMPKVDLKGPQIDVKGPKLDLKGPKAEVTAPDVKMSLSSMEVDVQAPRAKLDGVQLEGDLSPADKD

SEQ ID NO: 956283 - protein, 44 aa, Homo sapiens
LMLKATLEVSPPGCFHAELGLQLYLQACSPSSVMKASLEGKLAE

SEQ ID NO: 956284 - protein, 36 aa, Homo sapiens
SSSMRIPSPDRSHFPAYVWYLICIRIPPIVSQDHAS

SEQ ID NO: 956285 - protein, 71 aa, Homo sapiens
HAAWLCSTQDQVEFSIFHLFVVTLINHQICASHPAELVPIRVSSVFIEGHPHMLASDFIFCFPEDDLLSEA

SEQ ID NO: 956286 - protein, 68 aa, Homo sapiens
LDVNEARHLSASCKESGSVRGLWQWDRKSHPDNAQRARHIYGTDNHIIGFGATLPTGLDALIRYTGCQ

SEQ ID NO: 956287 - protein, 38 aa, Homo sapiens
VYHMMSKKDIIPTTFSADEQLERLYAVTKISMVLRKMR

SEQ ID NO: 956288 - protein, 40 aa, Homo sapiens
MVGQDHVLGKGSFLFCDQRILRTPTALLCSPIFFPLCFED

SEQ ID NO: 956289 - protein, 92 aa, Homo sapiens
TLEDPPVCALQPRLGMVQASTHSHRAAIGSGAGMRQSLETGVAPPLVGFRVTVQAGSSSCGPVSLLQETAHFQLTPRVNHRISRKVRYSQGC

SEQ ID NO: 956290 - protein, 93 aa, Homo sapiens
SFPAWASLSSNGLIHALGTLSKRSRPQNLKGENISPSSDFFFGWGEELVLLGSRPHSAPWGQLVVRLPFLAEILFLCAPVSPRTGTNTHLKAV

SEQ ID NO: 956291 - protein, 75 aa, Homo sapiens
TTLICDIITIITHLLVAFAENEALDKFLSNSEVCGGNSKMSSGHKGYKVSQLPQQSLTKLLNLRVTGIGYVKTGW

SEQ ID NO: 956292 - protein, 93 aa, Homo sapiens
MEVSSLDNEKITMQNLTDRLDSYLDKVRALEEANAALEVTLHEWYQKQNQNSPEMRLQTILSRTLKSSEEKIMDNKQRQIQSHPGRSHNARMD

SEQ ID NO: 956293 - protein, 104 aa, Homo sapiens
MSAEINVIYTSSQSGRQKHHQHTLKSGMGYTSNTRAVYYYGIPSLAFPVFTLANPILYFRVRKFQKRSRPYQTTSLGIPASLCCSYGRTCTYSIALPINLYIQS

SEQ ID NO: 956294 - protein, 38 aa, Homo sapiens
PLPLSGKSLDQHSHKLSPQIVLPCQGPTTTFEWMIDWS

SEQ ID NO: 956295 - protein, 92 aa, Homo sapiens
PLHYLRLLHSLLPMWPQTFLSNAYYGHMSLLRTHQLSMCCATAKFLLALVPLAAVLLFRGRTQKVVVVQGRHKSESGYTYGSKAESKAAIVH

SEQ ID NO: 956296 - protein, 82 aa, Homo sapiens
GSPKSPPYPPNLTKKMNKIVYAVIKYKDSSGRQLSEVFIQTALDERSCPSYYESHPKDPMDFKEDNRSDFRNTQRTDSTQAT

SEQ ID NO: 956297 - protein, 150 aa, Homo sapiens
TISALHAPKTHITHHLLSLIHDSHPRGAGALSLLPCGRLTLTWQRAGCGPDPGHGARGRPGLQGMEPSSKWAAVVVPSGQEQRYTCHVQHEGLPKPLNLRWEPSSQSTIPIEGIIAGLVPFGAVITGAVVAAVIVEGGRGTNKKGGSYTQ

SEQ ID NO: 956298 - protein, 37 aa, Homo sapiens
HISDLLSNTRAGGDNTPTKSAAVSTLDRRMHGLLITS

SEQ ID NO: 956299 - protein, 133 aa, Homo sapiens
LSSPHYISVLLFNITRLNLYFKDTDSWNKFKKQIQLYSAYETFALLIKTLYRLKVKGYKNIFHAPKNQTQAEIAILISDKTDFTSTVVKKRKSLCNNTATNAPRKYHNPKYIWTHHCSTQIHKTSIAKPKRKI

SEQ ID NO: 956300 - protein, 57 aa, Homo sapiens
DTPLPPVVVHGHSNTNSKETYECKECGEAFNSPNLFHTPSKNSHWKGGPINVGKIVR

SEQ ID NO: 956301 - protein, 35 aa, Homo sapiens
MIGVESCLVVECRARAFLILRAKAYNHCAHHKGIG

SEQ ID NO: 956302 - protein, 33 aa, Homo sapiens
YRRSAGAAAAGAVSARACRSRSASPARRDRAMS

SEQ ID NO: 956303 - protein, 35 aa, Homo sapiens
LELGTMLLSSFYMNSRFQRILKAIQISTCRIHKKS

SEQ ID NO: 956304 - protein, 126 aa, Homo sapiens
SVASIPLLLHIDSSNKYCACSPLAVPWFRCSPLLYQCSLVLQLYIGDIFSCPALRLGSAPMSSRPRFLMHVRYFMICVIVSPINKLQLHRVFSSCCVMPASSRAGQFHWLKVKRQLNPRGAIHTGP

SEQ ID NO: 956305 - protein, 88 aa, Homo sapiens
MQADFVLFIHQRHLCYRLQVNSVLMQSCVCKHLVPDRRVLSWRYGSVVKYSVVCPYAQCRNPRLLGRSSSICFSLTYTTSSHKTVTSR

SEQ ID NO: 956306 - protein, 53 aa, Homo sapiens
LILNPRETQCTSIGPHQRTGSTDPIQVILALGDYMVSHLFMPVIECEQDVSEM

SEQ ID NO: 956307 - protein, 41 aa, Homo sapiens
VVKLRMAWERSHISTTKNSISAGKAGASCFCLLLQNGCFLL

SEQ ID NO: 956308 - protein, 55 aa, Homo sapiens
RSTDAAVDSKYPHVRIKDLTALDKYQVYTHMNLLKEIVTRTLPFTLYINNYLHTA

SEQ ID NO: 956309 - protein, 56 aa, Homo sapiens
MRGRSRKRQRQKQEAFYSRRCQKSYHRVLGEEQKQEANIESYFMQTFIYFSLKVKV

SEQ ID NO: 956310 - protein, 83 aa, Homo sapiens
MHYYKPEFIQDVFKGSVMKKCSSKNLFDGGHSPFPVVKIDTYNAAIAYTILSQDPELPDKNMFTINRNTGVISVVTTGLDRES

SEQ ID NO: 956311 - protein, 37 aa, Homo sapiens
RYLITTPVTHCKIKKPFTFERDVGVFIGMVAQQIKQT

SEQ ID NO: 956312 - protein, 51 aa, Homo sapiens
PDPYKTCTQAEAGSSRSRKQAEAGSASCFCRFLLLPLLCCFLLLPQWSCVR

SEQ ID NO: 956313 - protein, 35 aa, Homo sapiens
MHITYRDQTRSGRSQGGMAVDGRGRKASMLLPLTK

SEQ ID NO: 956314 - protein, 131 aa, Homo sapiens
MRAGWTRQQQVSHNAPHGAKTCVHYSLHFFAYSLLCGINILLKTSKRPKDTPVNISDKKKRKLLCLSIAQKVKLLEKLDSGVSVKHLTEEYGVGMTTIYDLKKQKDKLLKFYAESDEQILMKNRKTLHKAK

SEQ ID NO: 956315 - protein, 44 aa, Homo sapiens
SQDLTASSEDLVVCYVWPSSMYLSLVAATVIDSGQTLTPRGMSY

SEQ ID NO: 956316 - protein, 37 aa, Homo sapiens
SYCYFQGLGERVYSAGFQQKFNNFNMTLCSSYMECCS

SEQ ID NO: 956317 - protein, 104 aa, Homo sapiens
AARVMTDGSQPRSTRVKEELVPFLLKLFQSIEKEGILPNSFYEASIILIPKPGRDTTKKENFRPISLMNIDAKILSKILANRIQQHIKKLIHHDQVGFVPGMQG

SEQ ID NO: 956318 - protein, 39 aa, Homo sapiens
GRTVYLLNPRIFFLVSLQRHKLINKASRSFIFSIALNLE

SEQ ID NO: 956319 - protein, 71 aa, Homo sapiens
SASRVFGVYILPLLEEVDAAMNAKLTQCGWKSCATRKGELSPDKILKDHVPTDCEKDILLVALKKTLKNIT

SEQ ID NO: 956320 - protein, 167 aa, Homo sapiens
MTRGELHPVASSSSKSISSTRFDSNDVIACCFSSEMYRFVIEGKVYAAIPASVLAEARVNATTVIPTFLAIRALSSTCSVSPLRETVNEHLIAGGVAEKNVPAVPRPGDKCRFAQHLQFLGQVLGKQIGKPGTVEKKALFLAQQVGKLLAFVLGDPLKSLLIVGDEL

SEQ ID NO: 956321 - protein, 211 aa, Homo sapiens
PGSARDEGLRRQQQHHAGELLCAIAASLSLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNAR

SEQ ID NO: 956322 - protein, 39 aa, Homo sapiens
EYSTHRRPDSSLQLRYAFKLNTHYLKNPKHITELLSTTW

SEQ ID NO: 956323 - protein, 35 aa, Homo sapiens
DQHNLIFFNGFICFQHNLGTTSAQPQHNPSTNWGD

SEQ ID NO: 956324 - protein, 52 aa, Homo sapiens
SKQEHQQAAYIGVSKEGPYKADHYRYKPYLPADIPRRRRYHRGLLHETARLL

SEQ ID NO: 956325 - protein, 30 aa, Homo sapiens
MRRLILFSIVVVCCRLSVERPVRVDSNHVI

SEQ ID NO: 956326 - protein, 120 aa, Homo sapiens
SRSIAYWSNKGPADVRLKLELLSSPETSTQLAVVTMSRRCELRGELPRTGKTRRIRSSTPYVSRSCPMAGGDAPLNRRVFGLHKPRDGASSRRANSSCSASGLDAEPETSSPGASMDLTT

SEQ ID NO: 956327 - protein, 57 aa, Homo sapiens
RNYYLRGITICAVPKPLMVIFELSSAQAPDTAADITNKAIKGFNFMLSPRKFLHFIP

SEQ ID NO: 956328 - protein, 36 aa, Homo sapiens
SIRSVDDHTSNASSLVISTGTLFWMLRKTGPSVLMA

SEQ ID NO: 956329 - protein, 54 aa, Homo sapiens
MGQASESCCRMTCVTSSTRWTDLQVPPTYRYAESSMKNSFGLKYLHKFFNIPFL

SEQ ID NO: 956330 - protein, 120 aa, Homo sapiens
DEAVVQDSAQYLSCRSSRPSDAKVIIGLDTGIARLLGVVKFWVDPSALCNLSCRSAGVFHTPLYSGFCITGGTQSPSISSSQTSGYLSIRVRDMLGLVPVLRLGVCGIIDLGPLIPVFRF

SEQ ID NO: 956331 - protein, 218 aa, Homo sapiens
QETLSCGEDLREKETEEAEHGLGEPMDGLGTKQEGVLCVPGRGAKLQRGVCTTYTHRARGSSRDEVLEQTLCSVVPSVPGTGSSETGARRADVQRALWYAGRDRCATDVWCTDLAPCPTVYSCMEVTRAAVKHHSHVVGPFRRDHLRWHHCSTQVEPYLQWVLHSPHAEELIPSLKLIRTDIGQARIQPNVLFILREAPKSNSELELLRHWWVTFSTL

SEQ ID NO: 956332 - protein, 35 aa, Homo sapiens
GSGDSSDSVTRLFQVSDYLASTAIWTISKAPYNSR

SEQ ID NO: 956333 - protein, 33 aa, Homo sapiens
LRSRAGVCEPVLALAVRLDLCVSGWGSLPLGPT

SEQ ID NO: 956334 - protein, 34 aa, Homo sapiens
ITECDNVKYSPVHGHTLQPDMQNSKNKTLAHWDQ

SEQ ID NO: 956335 - protein, 42 aa, Homo sapiens
CCTHARLVLGCLLTLLISTAESILQKEQFPQPFCYWWTLVFQ

SEQ ID NO: 956336 - protein, 69 aa, Homo sapiens
MVRNVTDLTGDNNRIVITETTCKNKSVGILVSLVLRSVLSRLSNTFPKVGLSSGEKLKSKNLSPPGFRV

SEQ ID NO: 956337 - protein, 36 aa, Homo sapiens
GTSPVPDGSVWERRYHMSGVLVRQHNLWTAQAGDRH

SEQ ID NO: 956338 - protein, 80 aa, Homo sapiens
SSIIPSRRCVEVCACQKGHLRSRGGSRRRRHSHSGLICVLPTTKPIGPVIDVSDSRVGMKVKVWVYFTGYITREMIWDTA

SEQ ID NO: 956339 - protein, 66 aa, Homo sapiens
VRSDDENLPHTFYNELRVAPEEHPWLLTRPPETQEATGEDDQIMFENFTTQTLYVAIQAVLILVRL

SEQ ID NO: 956340 - protein, 39 aa, Homo sapiens
MDSSAADSLNPFGINAASVGSVLFNSPEMQALLQQISEN

SEQ ID NO: 956341 - protein, 44 aa, Homo sapiens
TSVENESMTRCGFHLAELSALGTPGTVPPAGVAVVHVVRAEPYR

SEQ ID NO: 956342 - protein, 33 aa, Homo sapiens
MVCSAYSVCQRYCLPALGPGSWCRGSRSSQFVT

SEQ ID NO: 956343 - protein, 44 aa, Homo sapiens
MNEEENRFERCFIFGAVWALKMRSLFTGFAARGVRTSYHRVLVT

SEQ ID NO: 956344 - protein, 37 aa, Homo sapiens
YSSLSRVCSDDVDYGLARSSTLWSDRLPTRMSRVEVL

SEQ ID NO: 956345 - protein, 87 aa, Homo sapiens
MDPGRSDMTSRASELSPGRSVTAGIGPTHDDVTFEAVAQAFGDELKPHPKLEAATKALGGEGWEKLSLVPSSARLHYGTDPCTGPSG

SEQ ID NO: 956346 - protein, 35 aa, Homo sapiens
GTILNQPDFSSNDISTMCGGVIMLGPLHLQSWSER

SEQ ID NO: 956347 - protein, 35 aa, Homo sapiens
DLSEAENRFERCFIFGAVWALKMRSCFLVCSGTGL

SEQ ID NO: 956348 - protein, 53 aa, Homo sapiens
GDTCFCPSQDLFNYSTLLYSLLAKSTFDPSSFSTGYRSFLGAEAVKRGSIQNV

SEQ ID NO: 956349 - protein, 32 aa, Homo sapiens
MRSRSSCLSSRRNGRVARRISLIFIRRNKRRM

SEQ ID NO: 956350 - protein, 39 aa, Homo sapiens
LLLLSAIAATDGTVPLQWRSSWSPPGHTDCFLLLPLTKY

SEQ ID NO: 956351 - protein, 73 aa, Homo sapiens
AEVTLDDPGPLGRGSEEHHVFKIGDRNCRRMSYYCSGSSDAPKFTCSPKCKQAKSISHEGALPLQNGLVQHRE

SEQ ID NO: 956352 - protein, 42 aa, Homo sapiens
ERSCFLLLPSCFCCFLLLPDCPLTGCVLSTVPKSNSQWSCVS

SEQ ID NO: 956353 - protein, 105 aa, Homo sapiens
MSLPVWYACAFMILSMLPDHPYVAGHQSTRRFCQALRHHSLFNLVLKGFIFHPIQQRLKFFLNCFTTLLSFLTFIELHSFLGNIRGTSSHQIREGPEYSIHPQVL

SEQ ID NO: 956354 - protein, 87 aa, Homo sapiens
ESSIDTINVRIESDNCILKMDYISSHLEDPHTVGSLFPFIVASQSTIYVSILLPFFREAQGPLCYKDILGHVKLLVVQPHTVHFQGL

SEQ ID NO: 956355 - protein, 66 aa, Homo sapiens
DLDISCKHPATHCTSGTIILKRLFLFQQHHRYHAVSVNSAEFLSNGNSNLCPCLFPVLFPKLLTWQ

SEQ ID NO: 956356 - protein, 34 aa, Homo sapiens
PEEGVLGQSCAAENLEMLKRVSGCHIRSYTLDQY

SEQ ID NO: 956357 - protein, 124 aa, Homo sapiens
LFLLVRRARAVACVVLCTSEPVVVVCVLLRLKLGSSAVWRLTSVSSVDFLQTCSVWPVTPERSRFMKSHDLRRPCEETVLLLGRLTLVARNEQPNQILREPPVILCTISLLPASCFCLRMLLLR

SEQ ID NO: 956358 - protein, 35 aa, Homo sapiens
GHQTAVKWIERTQGSAEHVRSSSQVCITGWRIGRS

SEQ ID NO: 956359 - protein, 34 aa, Homo sapiens
TLVCEHPALSTAFLLTINKEDDEFRGVYWVADMS

SEQ ID NO: 956360 - protein, 49 aa, Homo sapiens
DLEDPGRSDHGNPELTQDYLRIQKDPVPYICALSPSLRIFSSGTMSSER

SEQ ID NO: 956361 - protein, 67 aa, Homo sapiens
PRVPGRSDDRDGEKFAAWVTSINWSQLIADVKEFFQELDKGVQALGGWKVVLMALLGLKIISMVVRA

SEQ ID NO: 956362 - protein, 36 aa, Homo sapiens
RGYPMPVSPLSFFTQTQHTPAGVTLRLLMLPYAPLT

SEQ ID NO: 956363 - protein, 50 aa, Homo sapiens
RCIIQEQAPYTRTQTLRELGSRLAALAPAWLWANQPGTKSDFPDIAMRDF

SEQ ID NO: 956364 - protein, 47 aa, Homo sapiens
RIPLRGDSLISQCRVCASKASGCKAILSGKKWLWLIPGVDDGTGRIR

SEQ ID NO: 956365 - protein, 39 aa, Homo sapiens
MDNFEELLKVLGVNCDAEEDCCGCSVKPSSGDQQEGDTF

SEQ ID NO: 956366 - protein, 63 aa, Homo sapiens
PDYLHATAYRNTALGRPIEGPTANITVYTSEGFSGFYYHTFYRGQEYCLLLLELLPMRRNERF

SEQ ID NO: 956367 - protein, 90 aa, Homo sapiens
WVTLDYPKSLIAGDVIAECCPGVVMPRSLLLEMALRQIRVRDSRVWGEDFRSRSNWKWFQEKPLSFSHTRPYRKPTQVGEMSILRRNERL

SEQ ID NO: 956368 - protein, 45 aa, Homo sapiens
MTTRTCGSFSGICAIARLLYDYVFDWNMLKFGASRAADYADAGGT

SEQ ID NO: 956369 - protein, 118 aa, Homo sapiens
LPDEAGAAPPKLTDLRLLYIGFYGLLAPACLDNLIRRRPIATVVCIASFYIYRALFLAGYNLVKGEDYLYAVRDREMLAHMKLHPENFPEEDKKTYGEIFEKFHPITLKSSKCLLQFH

SEQ ID NO: 956370 - protein, 43 aa, Homo sapiens
MAPFSPSGLPQFSVCTSICSLNPPKHLHLRRCQPLHTGPAART

SEQ ID NO: 956371 - protein, 36 aa, Homo sapiens
GKSAVGGRRNENLVITGNNQPIVFQQGTTKLSVEIE

SEQ ID NO: 956372 - protein, 57 aa, Homo sapiens
LTTYSMLVGNTALLVMLIEFQGEAEVDRVGLELPSTTREVLVLTLFVLVWVYGVPTL

SEQ ID NO: 956373 - protein, 65 aa, Homo sapiens
MIATALGVCCTLCGARLPQHPPGQEIWDAWMLEYMCSQRVTPQTPPGSHIMSPSSARKTAKMENI

SEQ ID NO: 956374 - protein, 33 aa, Homo sapiens
LSVGHTHLHHHTHTHTHTHTQTDPAASLEHPEV

SEQ ID NO: 956375 - protein, 44 aa, Homo sapiens
MTVMLMVSMLMLVMMVLLMLVMMVVVKVVMDSDDGEVMMVMSGD

SEQ ID NO: 956376 - protein, 42 aa, Homo sapiens
GGRQRTDGPWAGGRHSTLGTTYSCVGVFKNGRVEIITTSHAT

SEQ ID NO: 956377 - protein, 72 aa, Homo sapiens
SISTLGKEVYIKNGDKKGSCERDAQYAPGYDKVKDIQKVVTPSVPLVLRGVESLMLDPILAEVIGGPLDSSQ

SEQ ID NO: 956378 - protein, 45 aa, Homo sapiens
MGKFRKQQNRTAVGHRNPLVCHHLLHLGAANIQETLNQVIVIGFD

SEQ ID NO: 956379 - protein, 84 aa, Homo sapiens
GSWQRRVALQCGIVVCSWGGPMEGRMVWLVACGKENMTAALQADLKNPPMSHAKSQPEAPTEEVDSTSRRWHSPEAVDRWTAQR

SEQ ID NO: 956380 - protein, 105 aa, Homo sapiens
VGSYGSVTVTLLLLLIHGDTPRPRPPPRATRRASPRATRRALNEPTMRHAKSHTTRHTTSRLFAWHLEWLFARLFVPVFSLEMEFTTRNVPHQEPRHEPPNEPGT

SEQ ID NO: 956381 - protein, 66 aa, Homo sapiens
AVVVYLYKGFDDHVCPINFRGSRRAYHGDQIGQTIRKARRLPSKGDRADVEMETLTQQDHYSEEID

SEQ ID NO: 956382 - protein, 43 aa, Homo sapiens
YQTREAAVSLERSGVAFRMAGTSLVNARTSLRLELLFKSSLRL

SEQ ID NO: 956383 - protein, 45 aa, Homo sapiens
LEDSRAWGTDCQRPVSKYSQAVPAVYRGAHSQSSHTTSRTKSLTM

SEQ ID NO: 956384 - protein, 56 aa, Homo sapiens
TSRRSRLIGWLLVWLIGGLVVWLIVWHLAGLLVLVAIFPIFLLDDILQVVVNLCPH

SEQ ID NO: 956385 - protein, 49 aa, Homo sapiens
TIEHTVTDMTCEQQHPGWHGAGVYLMGTDGHPFGGASNGFPGPQAPYYC

SEQ ID NO: 956386 - protein, 51 aa, Homo sapiens
SYDLYVGPLRTSTGATQMSHPKSHPKSHPKSLADVPPQEPHDEPPKEPPKE

SEQ ID NO: 956387 - protein, 49 aa, Homo sapiens
LKEMKPVEPEFELERPGILKLVPGSPSCLRLVAPQFPCPRPPPFLHLRL

SEQ ID NO: 956388 - protein, 47 aa, Homo sapiens
GLVGGSVAAGCIACHQAHPTLAAQPPSQSVCHVLCTACCCPQQSLHF

SEQ ID NO: 956389 - protein, 104 aa, Homo sapiens
PQRGEDECCWCMRVFFAAAYMSTSLGERSTCCAFRDRFISSRPLRLSERPMRISERETVTLQQVLRKASGRESPCPRFWGMILLVALKELNDVPHIDWFDFHRG

SEQ ID NO: 956390 - protein, 152 aa, Homo sapiens
RIPREERTWLTGASEFPAQQHPCQHHCESGARSLPFKTVSSLTGPRGFQSGATRIYERELSLCSRCSGKLLVKSRSVPGSGASYCWLISKQLNDAPHIAWFDFHTGQGDMKCALRRAYWLPNVFEDRVAIFVLYAFQTQRGAASMIMTFLVN

SEQ ID NO: 956391 - protein, 40 aa, Homo sapiens
GSLCGLVVALREALCVALSVAPGGARDEPPLSSHTKRPPT

SEQ ID NO: 956392 - protein, 71 aa, Homo sapiens
TKNGMHHHAHTRSHTTGHTKSHPKSPAMSTLGARNEAQRATLRALPMSRTTSHAEEPHKEPRKGPPHEPHY

SEQ ID NO: 956393 - protein, 53 aa, Homo sapiens
MLFSSIFVIRAAVLNEDAVRSTPGAASISTLISPPTRRHTTSHTKSHTKSPTM

SEQ ID NO: 956394 - protein, 98 aa, Homo sapiens
HCVTLVWLHSGGLREALRVAHRLARGCGLLAWHVERPMVWHVRGAPSGRMGWHVGRLFVWLLGWLMVGLFGWRMVGPIVWLLGCSLVSCESAVFGVCT

SEQ ID NO: 956395 - protein, 90 aa, Homo sapiens
DSRGSPAVVALGVAHGVCSVVWLIGGLSGGAYRVDLRVAPGRGSLRDSRGWLFATLGGALCVALGVALCVAHWVAHWVGSLGGIFVCRIC

SEQ ID NO: 956396 - protein, 56 aa, Homo sapiens
GDSTNSALSVLVEMRHEIRKVSEHERDARSGKFHHVTSCDKSQSTRHTTVYAATLR

SEQ ID NO: 956397 - protein, 40 aa, Homo sapiens
MAHCGDSVELEHQVYTVLSPAPPSSVLSTSSVLSTSSVLS

SEQ ID NO: 956398 - protein, 35 aa, Homo sapiens
EYRNRRSPWAVSTQVTGRWTLVCHMLPSSVPSSVL

SEQ ID NO: 956399 - protein, 84 aa, Homo sapiens
WTAQRVDSTEELDSTEEVDITEEVDSTEEVDRTEEVDRTEEVDSQEGWVGYSEAKQGRSGCSSPWLLPSFRDSQSWAQPWIWQC

SEQ ID NO: 956400 - protein, 39 aa, Homo sapiens
TEEAVVGLVGMLARELAYRRAALQLGGAPVRSETSASVL

SEQ ID NO: 956401 - protein, 53 aa, Homo sapiens
VTARELNGGFLNPDLASYVLSTSSVLSTSSVLSTPRAVHPSVLSTSSVLSSCP

SEQ ID NO: 956402 - protein, 47 aa, Homo sapiens
MALLQGDDVWSSQKMLRVWLVVVVSQGNVLQALSVLSSPLCCPPPLC

SEQ ID NO: 956403 - protein, 43 aa, Homo sapiens
MAAESSKAETEVAGGTVSVAEGGVIPLQLLLPGCVLGVALLPL

SEQ ID NO: 956404 - protein, 35 aa, Homo sapiens
RYSHTELWLQGLPPLCCPPPLCLLCASSVLSTSSV

SEQ ID NO: 956405 - protein, 35 aa, Homo sapiens
PPVLSLLSAVHLLCAASAVLSTFSVLSTPLALLCA

SEQ ID NO: 956406 - protein, 43 aa, Homo sapiens
TEEDRGVHNAVVHWLTEEGGGMYHKRGGGFAEVTGWVGVLLCA

SEQ ID NO: 956407 - protein, 43 aa, Homo sapiens
CEPGVDTSPGTCETLSTSSVLSTSSVLSTSSVLSSCPPPLCCP

SEQ ID NO: 956408 - protein, 74 aa, Homo sapiens
DRGGASSWVDVLSVCSDYYVPVSQLPRSSWPPRLSTSSVLSTSSVLSTSSVLSTSSVLSTSSASSVLSTSSVLY

SEQ ID NO: 956409 - protein, 36 aa, Homo sapiens
SSEAEKLESYLEGECVEWLRRYLENGKDKLERADPP

SEQ ID NO: 956410 - protein, 33 aa, Homo sapiens
PNQTAVYFCATSEQGEGPYTGELFFGEGSRLTV

SEQ ID NO: 956411 - protein, 30 aa, Homo sapiens
LPPKHLCYFCASSDSTTGELFFGEGSRLTV

SEQ ID NO: 956412 - protein, 33 aa, Homo sapiens
MSTLLCAVHLSTSSVLSTSSVLSILLCAVPSVG

SEQ ID NO: 956413 - protein, 38 aa, Homo sapiens
QNYYVCPPSVQYHSSVLSNCPASVLSTSSVLSTSSVLS

SEQ ID NO: 956414 - protein, 37 aa, Homo sapiens
LRRSTLAAHSTLRKVALCLTRQEAAAVLHGNVKRSPQ

SEQ ID NO: 956415 - protein, 33 aa, Homo sapiens
IGSPHRNPNEGLVDGWDDPRLPTVRGVLRRGFD

SEQ ID NO: 956416 - protein, 35 aa, Homo sapiens
LGPCGEGDVRRGDVEKVSSQNKLVSFSLDQQGLLD

SEQ ID NO: 956417 - protein, 42 aa, Homo sapiens
TEDPLIKPYRTFVGRSSKPYCVNNPTLGEFCFTIGFDDQGLM

SEQ ID NO: 956418 - protein, 60 aa, Homo sapiens
MQWSYPTPGGDSRGQVERGDWRFTDLQSTNKRSTHYSRMRALPLNDKDHLPYKPTTDHDF

SEQ ID NO: 956419 - protein, 35 aa, Homo sapiens
SSNPVIKPCHRNPIQGGHYSQFTRVFGGPSYIASL

SEQ ID NO: 956420 - protein, 45 aa, Homo sapiens
WDPRAIKPFIEAIEEGPPNTPLMAVVVYLEGFDEGLMTGFDEGFD

SEQ ID NO: 956421 - protein, 34 aa, Homo sapiens
DSLGSPHRNPKSLIASSETLTFHFGLQSSRLGFD

SEQ ID NO: 956422 - protein, 39 aa, Homo sapiens
GSPNQPVIKPFINPKSLIVLSNPSSNPETRIQVDHYSQG

SEQ ID NO: 956423 - protein, 57 aa, Homo sapiens
IPKPNYQALDCSPTNRVSMCHRNPLGAFWGILVQKGQIFERFPHTTSKNNHFTIGFD

SEQ ID NO: 956424 - protein, 67 aa, Homo sapiens
MYCPSFYRLEVLGAHRVRILQQGLELVVLGDGDDLQNCAELGENLVQHIQGHRLEDDLHDDTPLCVW

SEQ ID NO: 956425 - protein, 47 aa, Homo sapiens
VQDIDFTEDGGHVDPYLEFGSSMWDDERDFACNCCYCTVNWLYCTTV

SEQ ID NO: 956426 - protein, 86 aa, Homo sapiens
NPASRTGQDDSAYSLEQAMILVNGLKPHCGGAETPWETESSHPTHHPPGKYPGLVGSSHEGNEGRDSLDSQSGRRKTQSPVSQNTL

SEQ ID NO: 956427 - protein, 63 aa, Homo sapiens
EYVALCEINQLNLVDRAVLNLALSPSGKHLLISISEMQCVKVKCASSRGNLLNDMSPLCVWGT

SEQ ID NO: 956428 - protein, 127 aa, Homo sapiens
CAYSAGLNPNIDALQMALVYAQGMFENAQGIDIRSSYLNELLQKLRQLAYTADDVLDELVYFRIQDALEGTYHATAFMIQAAIDGLVVHVPHIAKDVASTLKLPSCSCAASSGDLDERENGGTQGCL

SEQ ID NO: 956429 - protein, 104 aa, Homo sapiens
EDYKRREEHSPLYLQDCWFFLLTPVVLLHGTLQTPWRCQVDHLLGPSRSRECAKRLPRLPWPSPPPRSPESSCCANERDHIILSAFANAERDHNLIVTTTLHLN

SEQ ID NO: 956430 - protein, 62 aa, Homo sapiens
MVRSWLEVDALLASESLIKQISESSAQSLHKSRKVPFPASHTTENMCGQTEDECDSPLFSDR

SEQ ID NO: 956431 - protein, 121 aa, Homo sapiens
TAGSEEVALLSLGDVDRQKGTAALHMPGTHQGQLLYTFCKKEEDLECTIMNGFACRKGGEVKKKMEVEMTDSIRKLSCTEKHIKALGGRYQIQILSPGHIGISSGGCGPSSESKTIISSLA

SEQ ID NO: 956432 - protein, 47 aa, Homo sapiens
MFTGAVAYSQTQRGEATERSSSSNDHEVILNSYLRHAELKTCSFPDS

SEQ ID NO: 956433 - protein, 36 aa, Homo sapiens
RYQCTTKRTEKCRTSALHREHGCLWVPQLTTPPFST

SEQ ID NO: 956434 - protein, 119 aa, Homo sapiens
MCEEMNGTVISARGDPAAAPMEEINELNLQIHEAELAEVENAKCQNSKLEAAVAQSEQQGEAVPSVMPAVRLAELECAPCRKAKQDMACLDQEYQEVMNSKLGLDIEIATYRRLLGLQG

SEQ ID NO: 956435 - protein, 31 aa, Homo sapiens
ASTNQTSMYLCASSPGPGVRVHLRFGDQVNR

SEQ ID NO: 956436 - protein, 101 aa, Homo sapiens
LDFKADIWSCGITAIELSMCEPQTLDSTPCAVCSVIPMNRPTTLQGSNSNAFKEFVEGCLNKDPPFRATGKGAPEAQVHHTLNQEDLLPHGRLIDCLDYKG

SEQ ID NO: 956437 - protein, 33 aa, Homo sapiens
ASTNQTSMYLCASSSRGRGRSEAFFGQGTRLTV

SEQ ID NO: 956438 - protein, 123 aa, Homo sapiens
TCAVVTLDYPSLLSKQSLLALIWPVLCTRSSSIGPPRCLRGDHVAADGRRHCATLGSAQYSMTCSQPRTSAMPITCSPMEAIVQRPRGAGGPGKAEGDRAVGAERIPSAGDGTYTFAECTFAP

SEQ ID NO: 956439 - protein, 32 aa, Homo sapiens
ASTNQTSMYLCASTDRGNIQPQHFGDGTRLSI

SEQ ID NO: 956440 - protein, 31 aa, Homo sapiens
ASTNQTSMYLCASSGGSRKEQYFGPGTRLTV

SEQ ID NO: 956441 - protein, 81 aa, Homo sapiens
PSRRVAINAYVFARCNSASTVVTVKRNIRRCVEVAKRIAERLTHPFEPFVNSNKQPKSKSTFVELPPSNDEKKPFFCGACS

SEQ ID NO: 956442 - protein, 35 aa, Homo sapiens
ASTNQTSMYLCATTAAGGPSGDNEQFFGPGTRLTV

SEQ ID NO: 956443 - protein, 84 aa, Homo sapiens
AAVSRGPGRSDNTTSSTRSDEETPFYTNTYSDFSVTREVYILYSTRLREEFFPLLVTYYFGKKRTIWIHRYGPSGTLNRRLLIS

SEQ ID NO: 956444 - protein, 33 aa, Homo sapiens
ASTNQTSMYLCASRNLQGLNEKLFFGSGTQLSV

SEQ ID NO: 956445 - protein, 32 aa, Homo sapiens
ASTNQTSMYLCASSLTSAAGELFFGEGSRLTV

SEQ ID NO: 956446 - protein, 40 aa, Homo sapiens
DEKSIRGEDMSDIYGSKAGFLAMKKTNRKQMITDLWMVRA

SEQ ID NO: 956447 - protein, 34 aa, Homo sapiens
ASTNQTSMYLCASSALAWREDGELFFGEGSRLTV

SEQ ID NO: 956448 - protein, 31 aa, Homo sapiens
ASTNQTSMYLCASCYVWGYEQFFGPGTRLTV

SEQ ID NO: 956449 - protein, 33 aa, Homo sapiens
PAPTRHLCTSVPAVTRTGRKDEQYFGPGTRLTV

SEQ ID NO: 956450 - protein, 57 aa, Homo sapiens
GSSVRSRNRDLWEQLDALKADVERLASINEVLLDENATLKARLGSMGKCPLTDAPLT

SEQ ID NO: 956451 - protein, 32 aa, Homo sapiens
PAPTRHLCTSVPAVLRSELGELFFGEGSRLTV

SEQ ID NO: 956452 - protein, 92 aa, Homo sapiens
PGRSDTEDTTSPDLHLAHLECLCEQTVPASARKSQTGLSVQTGALVNILLITSQAPSDYRYYPLTVLSRLQQHPQASSSQDNEGCPGSPGSY

SEQ ID NO: 956453 - protein, 53 aa, Homo sapiens
SPSSANPDEGYNSKRSTHVKTLVQREPSEVARNVLHFLPQKTTIALMKLKGRR

SEQ ID NO: 956454 - protein, 31 aa, Homo sapiens
DSSIYLCSVEVTRTTSNPYEQYFGPGTRLTV

SEQ ID NO: 956455 - protein, 30 aa, Homo sapiens
DSSIYLCSVEGAGTGSSREQYFGPGTRLTV

SEQ ID NO: 956456 - protein, 30 aa, Homo sapiens
DSSIYLCSVEDGTTPAQETQYFGPGTRLLV

SEQ ID NO: 956457 - protein, 30 aa, Homo sapiens
APRHLCTSTSGITPNQDQPQHFGDGTRLSI

SEQ ID NO: 956458 - protein, 31 aa, Homo sapiens
LAVYLCASSAGTGQAGGTEAFFGQGTRLTVV

SEQ ID NO: 956459 - protein, 70 aa, Homo sapiens
MLYSINYYSINYYSINYYSINYYSINYYSINYYSINYYSINYYSINYYSINYYSINYYSINYYSINYYSI

SEQ ID NO: 956460 - protein, 46 aa, Homo sapiens
MHAKMHAQKLSPAHTPTGNSSDKPLAINESLTNTILTPGIGQISCH

SEQ ID NO: 956461 - protein, 30 aa, Homo sapiens
MGLHVWKLLQRGYGATSGLISIKEKYVKDM

SEQ ID NO: 956462 - protein, 59 aa, Homo sapiens
SINYYCIDYNSIHYYMHKLLHAYTIPPSILNYNITPPNNVQPCNYYYSNAHYHTNAPVG

SEQ ID NO: 956463 - protein, 41 aa, Homo sapiens
LREQQYQLNINESHYAILTPGLVNFVPATAVTRLTQVNSLC

SEQ ID NO: 956464 - protein, 33 aa, Homo sapiens
GPYKHKLLHAYNYSHAINYYMHKLLTCVLLCVS

SEQ ID NO: 956465 - protein, 105 aa, Homo sapiens
EPHDLRILLNSLCSSIQYTRLRRARESQNQVRKHSLIYFQIRQKFHLKCGDRAPTQFFQMVYFRIQKELPVEFDQWTNCRTPGEQALSVFTYKVRSVMGQSVTCR

SEQ ID NO: 956466 - protein, 31 aa, Homo sapiens
MAVGLGAVGESYDGVVVVVPFNSVGSCLVSA

SEQ ID NO: 956467 - protein, 34 aa, Homo sapiens
IQYSMFTLTPPLSYSFTHSTNPTSIANPTKTLTK

SEQ ID NO: 956468 - protein, 64 aa, Homo sapiens
SIVQPFSSKPPVSFTGAVILIIAQGAYFLIDYSAQQTQSYERTHSRSIFLSHGLQTRLPVIVHA

SEQ ID NO: 956469 - protein, 121 aa, Homo sapiens
LELMSDEEHLFVFQRSLLDDEQDFRNGLAELDANIARLQKSIRTGLLEQHESSKQNIIRCFVFHKHSQLGSYCNVYFSPQCKCMFSCSFMCAQSIIMVTKSHHNVIVAASYCTRGILLEIE

SEQ ID NO: 956470 - protein, 61 aa, Homo sapiens
IADCIQHYYYSINYYSINYYSINYYSINYYSINYYSINYYSINYGSPEGFHSLCCNSLCCN

SEQ ID NO: 956471 - protein, 112 aa, Homo sapiens
YNGDVMLNRLFGPYVLRDIVTSFSLHPAGSRAEMYTTPLLTDVALIFCYCSNSKIVFQYHLAHNHVHVHHHSSNYETFFLSVRSHHLFWESKATPRTLISKILTIMLWGISH

SEQ ID NO: 956472 - protein, 106 aa, Homo sapiens
EAVTPKTTGSCHRRFAVINYHHPFPTSSLCPPCKHIPQQASIQANIKSFSQLLLAQFLKHNQTKHSTCTQAQHVSFTASSMHSIASLVFNISFMLVEASSQQSAPA

SEQ ID NO: 956473 - protein, 108 aa, Homo sapiens
SSQPLLAFTWTDPDAIRLSKLPGLYCRKASQTAPLLQSSPNFILICYLSQHNSHKNTRALPADRVRLIPQTSIPYKTTTPFLPRHGSCGQNSYTRGRTAPCSLSVQTT

SEQ ID NO: 956474 - protein, 33 aa, Homo sapiens
IELDLFTSPFEYKNKHYLMRIHVWGGIEWYGGI

SEQ ID NO: 956475 - protein, 42 aa, Homo sapiens
PYHSIPPYTTYTTLYHPIPHVIAAWLLWFTGAGGVALVYPVD

SEQ ID NO: 956476 - protein, 46 aa, Homo sapiens
SSRPELYTITTIITHCTPKTRENNLTCFHLSFLNVYIAHTYFNGGI

SEQ ID NO: 956477 - protein, 58 aa, Homo sapiens
PLSPFAAEYLSRRSSFMPPLPVKRPEPSVFDNCSNLGLICLISFTERRQDDKVAHLLY

SEQ ID NO: 956478 - protein, 35 aa, Homo sapiens
APPAGASRSVSGVPRCAGADTSYPWSLTNLNNKLY

SEQ ID NO: 956479 - protein, 36 aa, Homo sapiens
RTLLKYSAIYLRNFGIRRPFVGASRREGHRPGGGIR

SEQ ID NO: 956480 - protein, 55 aa, Homo sapiens
YRICYTPLPKCNGGSKVRCVRSDIVLKCNGISVLNCETDKTSRYESKDIVIRWYQ

SEQ ID NO: 956481 - protein, 38 aa, Homo sapiens
NSDYYHYRNMQSVHIWGNRRSQHIRSAMDRALALVVSG

SEQ ID NO: 956482 - protein, 36 aa, Homo sapiens
LCAWVVGAWVVGAWVVGAWVVGALPHWTPRGAHLRH

SEQ ID NO: 956483 - protein, 61 aa, Homo sapiens
PTRLLVVVVIPDKRSLFGFVTYSNVEEADAALLLPHAVDGNTVELKRAVSREDSALLGLLK

SEQ ID NO: 956484 - protein, 37 aa, Homo sapiens
SDSGFYLCAWSVLRDTLSRVGGYTFLTMATPSVRGPG

SEQ ID NO: 956485 - protein, 31 aa, Homo sapiens
RGHSTVFLCQQGSGLLYVGELFFGEGSRLTV

SEQ ID NO: 956486 - protein, 33 aa, Homo sapiens
ASTNQTSMYLCASRLDRASSYEQYFGPGTRLTV

SEQ ID NO: 956487 - protein, 30 aa, Homo sapiens
ASTNQTSMYLCASRTPGLNEQFFGPGTRLT

SEQ ID NO: 956488 - protein, 36 aa, Homo sapiens
IAEVSSLGFSVIYSRHEVWAVPLFLEGGRNWLLLGS

SEQ ID NO: 956489 - protein, 41 aa, Homo sapiens
LYHPALFEVPSLKLLACLCIVGHQHMIPENALEEITTNMDT

SEQ ID NO: 956490 - protein, 71 aa, Homo sapiens
VDLQDPLDRQHHPDTKTWQRHNKKGNFRPITLININKILANQIQQHINKLIHQDQVGFIPGMQGDSAYANQ

SEQ ID NO: 956491 - protein, 99 aa, Homo sapiens
MQCRNPLGQPNINALKRSLLTPCVTSSVIADARRWAPSGLVAAPPLLVCSGTAFAPRLPIMVLALECLQFFYGNWCKLSVDLPFWGLEDEGLYLTDPLG

SEQ ID NO: 956492 - protein, 30 aa, Homo sapiens
DSSFYICSARHPSPGVGETQYFGPGTRLLV

SEQ ID NO: 956493 - protein, 49 aa, Homo sapiens
ACLLMQAGLSQWGAGLAFSVSARAHLFVGLHVVGSVSINIVLKEQGMNT

SEQ ID NO: 956494 - protein, 38 aa, Homo sapiens
QFKVIWSSAMSNIFHVGGMVQLLQATNTGFWPTSKPTL

SEQ ID NO: 956495 - protein, 30 aa, Homo sapiens
RPSHTSEYLCASRLGGETQYFGPGTRLLVL

SEQ ID NO: 956496 - protein, 94 aa, Homo sapiens
MPVEYTLSTKLYLSVKELSSWTTVNLQGDVEGTVANLKSQLDSILDNQLSPGSVGLSPLPINLPTIELHRRVCSFSFFLGSSSGIGGLSFGPYR

SEQ ID NO: 956497 - protein, 31 aa, Homo sapiens
ASTNQTSMYLCASTSGQAYGYTFGSGTRLTV

SEQ ID NO: 956498 - protein, 375 aa, Homo sapiens
MDDDTAVLVIDNGSGMCKAGFAGDDAPQAVFPSIVGRPRHQGMMEGMHQKESYVGKEAQSKRGMLTLKYPMEHGIITNWDDMEKIWHHTFYNELRVAPEEHPILLTEAPLNPKANREKMTQIMFETFNTPAMYVAIQAVLSLYTSGRTTGIVMDSGDGFTHTVPIYEGNALPHATLRLDLAGRELTDYLMKILTERGYRFTTTAEQEIVRDIKEKLCYVALDSEQEMAMAASSSSVEKSYELPDGQVITIGNERFRCPEALFQPCFLGMESCGIHKTTFNSIVKSDVDIRKDLYTNTVLSGGTTMYPGIAHRMQKEITALAPSIMKIKIIAPPKRKYSVWVGGSILASLSTFQQMWISKQEYDESGPSIVHRKCF

SEQ ID NO: 956499 - protein, 30 aa, Homo sapiens
TAVYYCARDYYDSTGYYYVGAYLGPRNPGH

SEQ ID NO: 956500 - protein, 114 aa, Homo sapiens [sequence omitted]

SEQ ID NO: 956501 - protein, 227 aa, Homo sapiens; identical to SEQ ID NO: 804621

SEQ ID NO: 956502 - protein, 204 aa, Homo sapiens [sequence omitted]

SEQ ID NO: 956503 - protein, 330 aa, Homo sapiens
MASAELDYTIEIPDQPCWSQKNSPSPGGKEAETRQPVVILLGWGGCKDKNLAKYSAIYHKRGCIVIRYTAPWHMVFFSESLGIPSLRQPVVILLGWGGCKDKNLAKYSAIYHKRGCIVIRYTAPWHMVFFSESLGIPSLRVLAQKLLELLFDYEIEKEPLLFHVFSNGGVMLYRYVLELLQTRRFCRLRVVGTIFDSAPGDSNLVGALRALAAILERRAAMLRLLLLVAFALVVVLFHVLLAPITALFHTHFYDRLQDAGSRWPELYLYSRADEVVLARDIERMVEARLARRVLARSVDFVSSAHVSHLRDYPTYYTSLCVDFMRNCVRC

SEQ ID NO: 956504 - protein, 35 aa, Homo sapiens
MPLTPTVQGFQWILRGPDVETSPLGAPRAASHGVG

SEQ ID NO: 956505 - protein, 558 aa, Homo sapiens
MALKGQEDYIYLFKDSTHPVDFLDAFRTFYLDGLFTDITLQCPSGIIFHCHRAVLAACSNYFKAMFTADMKEKFKNKIKLSGIHHDILEGLVNYAYTSQIEITKRNVQSLLEAADLLQFLSVKKACERFLVRHLDIDNCIGMHSFAEFHVCPELEKESRRILCSKFKEVWQQEEFLEISLEKFLFILSRKNLSVWKEEAIIEPVIKWTAHDVENRIECLYNLLSYINIDIDPVYLKTALGLQRSCLLTENKIRSLIYNALNPMHKEISQRSTATMYIIGGYYWHPLSEVHIWDPLTNVWIQGAEIPDYTRESYGVTCLGPNIYVTGGYRTDNIEALDTVWIYNSESDEWTEGLPMLNARYYHCAVTLGGCVYALGGYRKGAPAEEAEFYDPLKEKWIPIANMIKGVGNATACVLHDVIYVIGGHCGYRGSCTYDKVQSYNSDINEWSLITSSPHPEYGLCSVPFENKLYLVGGQTTITECYDPEQNEWREIAPMMERRMECGAVIMNGCIYVTGGYSYSKGTYLQSIEKYDPDLNKWEIVGNLPSAMRSHGCVCVYNV

SEQ ID NO: 956506 - protein, 95 aa, Homo sapiens
MSHSYKKAISDEALRPFQMDYFGGLPPGQYATRMTGQVHGSGCHLRSAPCDLGASQRKLSSNFSEIDAGLFSQGKSAAYTDIGATKPVEQRETAS

SEQ ID NO: 956507 - protein, 66 aa, Homo sapiens
HYTYTLRKQFYYNRYNVQSYVICQKVILIIRLGCASKLEGWQVDGHEFRLHFSVSPLYLFWESVTL

SEQ ID NO: 956508 - protein, 47 aa, Homo sapiens
EIWVALTGALEGWSGKMLLRSVHDSPLCWGKTEAVVRASPGGLLVTL

SEQ ID NO: 956509 - protein, 103 aa, Homo sapiens
LSFSQHLSPVCVSMSAWNETPLHGLHCHGMYICIHVCVCVACSAFCSASGAVPHCYQTIAVTVVPDVLAMATDNLPSPGNAGAALQRAGSPSSQGLLCRIELE

SEQ ID NO: 956510 - protein, 77 aa, Homo sapiens
VILSIPVSATPSRCCKEKYIWKVLRGTGRHGYDKRNRESGPLNICIHFTVRALLRAITRTSIVFCNHSTFACNIRQV

SEQ ID NO: 956511 - protein, 40 aa, Homo sapiens
SRGSRSIVYTIQHWTDIRTENQQRNIRLNLHYRDTISVCD

SEQ ID NO: 956512 - protein, 53 aa, Homo sapiens
MTVLGDDGLNDADNLNVPTKIIADCGTQGVLTFWDYNSNSQPYSELYLGSLNA

SEQ ID NO: 956513 - protein, 56 aa, Homo sapiens
MPRNGVMHVDECVDFHRLWSAMQFVYCIPVGHTSSQSSSALVMGYTGLAVMIIALR

SEQ ID NO: 956514 - protein, 45 aa, Homo sapiens
ILTGSTHGVNVSMQTKPKNSKAIAPRLPLPSVLAMRPSLSSEEDS

SEQ ID NO: 956515 - protein, 182 aa, Homo sapiens
RCTVDIAAVRDDIDDSVFDLVPSPFMAFRSDLWICDQGKKSIEWPHSSLQLYSGHCTRFPHLIGHLRCLREELASSIIFFPQTASRRVFLYSPEVSYLIMLQRDFSYLVRKISRMSSMSNSLRETMMRIRGVVPSPQALHSLEEPFSTIFRGCSGLTSWAACPQSGPRVICEECQGGGRRRS

SEQ ID NO: 956516 - protein, 38 aa, Homo sapiens
FHYDRSCHSHRNTSMTPPKFQNHFDLLAWIEALAISCL

SEQ ID NO: 956517 - protein, 99 aa, Homo sapiens
CDRDNIRTTAHQEEIAAAQETHNTMLVRKLKDLKITGECPFSLLAPGQVPNESSEEAAGSSESCKATVPICQDIPEKNIHYKSSSKKNQSEPSLSSTLG

SEQ ID NO: 956518 - protein, 104 aa, Homo sapiens
MHRHLKLVALPIFNFHQIISHWVECYCFKSQYVKMKLSSPDYILFENPPFLSVVPSFLQFPTLEISYFTLVRTVISITTTYYYELEAATLLCATHGAGWFSYFA

SEQ ID NO: 956519 - protein, 81 aa, Homo sapiens
LYRIVHVRVTLFVLEEQACPDIRRRSCTSPTPLCRCSPGHTWPQPTVQQEQQLFLQEVHLHSLHLPDLAQVRETPGAQEQL

SEQ ID NO: 956520 - protein, 37 aa, Homo sapiens
TDIDSAKMQNNEHIPITPLTISSKPLINSYADNSHML

SEQ ID NO: 956521 - protein, 101 aa, Homo sapiens
ADPLNAGRSISQSLGRVSSVLSESTTEGVTDSSKGSSPRLNTQGNTALSSSLEPSYAEGSQMSISIPLTSSPTTPDVEFIGGSTFWTKEVTTVMTSDISKS

SEQ ID NO: 956522 - protein, 58 aa, Homo sapiens
MPQCRISVGHVVGFRKFSCSDAAWQAVDLLVANIFSLLRGDENNRPWRAIVFLVCLFR

SEQ ID NO: 956523 - protein, 64 aa, Homo sapiens
LEDPLINVFISFLMYCIKLEILHWLNSRCFCQCAGNSFKCLSKLLNSILFKSRTCLSLKRISGY

SEQ ID NO: 956524 - protein, 74 aa, Homo sapiens
MRISLIRLSRCFRRRLPLLIGVIGVKFWRRAQGTCGPHVPLYVRMNTVFGLPGHLTCQQGAPTSGPRQAQSTPS

SEQ ID NO: 956525 - protein, 78 aa, Homo sapiens
AITYHGSNYPLPCYRMCRAPCKNLEEKTGRDGFCLNEPIIPFSATENYIFIIGFKKSCNSLLFFGALLSKVPSLDNVI

SEQ ID NO: 956526 - protein, 80 aa, Homo sapiens
LYRISLIRLRRYKIFHMLQSCCVGRHLTPLMTAIKKYPGTSQFCRSISIVMARSRFAPGRKRVGHDVIIRDNTDWPNLVL

SEQ ID NO: 956527 - protein, 75 aa, Homo sapiens
LDDPGYHISSVFSIQLVIPYEASLFKISKVLESTWNPNSICASNSADGYLRTPKSNYIQKLNAAVLHLRHYVRTS

SEQ ID NO: 956528 - protein, 105 aa, Homo sapiens
MSETGIIDVFLLLGPPSLMFSQQYASLTGTQALRPLFSLGYHQSRLNYRDEADVLEVDRGFDDHNLACDVIWLDIEQLDGKRYFTWDPSRFPQPRTMLKGIRGDR

SEQ ID NO: 956529 - protein, 84 aa, Homo sapiens
DIALHNICRQVRGQAELVTTSPVELLSQAVAQASGTPAAVPHEPGLGQHRGLLQIHAPKSDGHQHRPASVRAAGSHLLTGGHEA

SEQ ID NO: 956530 - protein, 132 aa, Homo sapiens
SSRDPLIVSTRGFWVPPTSRGDRHLCYWRAVWQAVCWLLTLSLGRKPVHACVYAWLCFVLVISGFLGKFLVKAPSFAWLIQGKKRLSRSWVGKPECSEAVTKVYRAGAKALLGSFISYCSWSNFLSPYPSCL

SEQ ID NO: 956531 - protein, 51 aa, Homo sapiens
MSVSQVKAGLYCHLHANERISEPLLEPQPIVTPFPFTAFAKGEPAHKFKTW

SEQ ID NO: 956532 - protein, 77 aa, Homo sapiens
EADLEDPAIHYRQGPVGSLKSVAAILEEALDTHKLVTAAQRDGRYWDSSTSTETRDFVNIESPLTERGLFISGECDK

SEQ ID NO: 956533 - protein, 92 aa, Homo sapiens
EYAVVVLVTCIHSHVLVLCSTFPGQVGATTPLCRRRLPTFRQPMGRRAPSVPREHPTSVCDVAFSPSALRVRFAIEKDNLYFFLLYFDKHLS

SEQ ID NO: 956534 - protein, 119 aa, Homo sapiens
MMRDKHSEQSSSVLESSELKDKHSDPSISVLTPYVRDKHSEPSHCVLKSYLKDKQFGAVVELDPWNPYSVGQTHQKSYSSVLESFVTGQTNRAQQPCIGIPSGGQTLRTQKQCSGILCD

SEQ ID NO: 956535 - protein, 34 aa, Homo sapiens
RYSDGLTDYGLTRLTRLTRRIRRLGRRDDTTRTM

SEQ ID NO: 956536 - protein, 42 aa, Homo sapiens
MTSCLLLHDLVSSAGFSTIISLSVPGGLTTYGPPDVHVAFPL

SEQ ID NO: 956537 - protein, 85 aa, Homo sapiens
HVCIWVSRLSGGASEWSRTLCIDHGSPTSWEVNAGDLVISGGASCVVLSPVDSILGNPRPLGSSIPGVPVLPGSSILGGFPSSLS

SEQ ID NO: 956538 - protein, 85 aa, Homo sapiens
MQIKNSSMNPQNGMNVDPASTGCVFLQTPADASQSHTLISKGGHLDFILVIHELDIDFVVTHLSGHHLASKVIYVLGLRRCTEMV

SEQ ID NO: 956539 - protein, 70 aa, Homo sapiens
IPGNSYTSYFYLSISYYFYRYDLSYMNFSTYFLYHSQLESRRTFLTNLDESARTQPWLAYIFLHDIIETK

SEQ ID NO: 956540 - protein, 78 aa, Homo sapiens
CVTQLTAIGAVLRISLQSMLSFVLCQDACSFRGRVLGAHYENLHKERKIQMKIHHFNGWINMKQNFTNRIMAIQLYRF

SEQ ID NO: 956541 - protein, 118 aa, Homo sapiens
YRVNVLNKKRAEDISDYILANRHDYVLPSLYRKLDTAMAFEPMDGGKQLGTLHIPMSAMMLINDGQHRRFAIELALKSDPSLQNETAPVQIHFDQGLRRSQQIFADINSKAVKPSSAL

SEQ ID NO: 956542 - protein, 36 aa, Homo sapiens
MPATTSKRKYPRTQDVEVYLWGYPGLGLPGGYGPRI

SEQ ID NO: 956543 - protein, 35 aa, Homo sapiens
TYQGTPILAHVFDVNSSFVAQNGIGFSNRIACTEV

SEQ ID NO: 956544 - protein, 37 aa, Homo sapiens
CVETDEDTRDSDSSARDFVSAVQAVSLNALIECIFSH

SEQ ID NO: 956545 - protein, 121 aa, Homo sapiens
QSECDKTLGEASPEDVEVGVPIQRGKSGPKGLLSILMSKRSEPNSLLPENLNDNKIINQLIDLHARDKDLRVVLVTKDINMRLKARACGIAAEDYSTDQLVDDVSMLSRGYHMMTGSFWDR

SEQ ID NO: 956546 - protein, 124 aa, Homo sapiens
VQSECINLMGVVKGCKAFLPLLEKSQGRIINIASMAALMQGPAMSNYNVAKAGVVALSESLLVELKQQEVGVHVVCPSFFQTNLLDSFRGPTPAMKAQVGKLLESSPISAADIADYIYQRVAEG

SEQ ID NO: 956547 - protein, 33 aa, Homo sapiens
EGFAYLWSGARASYGVRRGRVCFEMKINEEISV

SEQ ID NO: 956548 - protein, 41 aa, Homo sapiens
MAERKLFNKGIAIYKKDFFLVQKLVSWALFQGKWGPGAACV

SEQ ID NO: 956549 - protein, 55 aa, Homo sapiens
YNYRCEDTMRMLLDTLTLMPKRGSNGQIPVVTPNDLLVSGLISWYALVSRPLGVG

SEQ ID NO: 956550 - protein, 36 aa, Homo sapiens
EDPGYHIILSEITQEQKTTYPVFSLISENYSIVYTR

SEQ ID NO: 956551 - protein, 60 aa, Homo sapiens
AECALTCDYSLQTTKTLGNTIPIISAHYSGVLGTASYSLLIRVELGQPGDLLGNDHIYNV

SEQ ID NO: 956552 - protein, 42 aa, Homo sapiens
TCVMSVCLKNVVVPHKKVAVATPDKKAAVTPGKKAAATPAKK

SEQ ID NO: 956553 - protein, 35 aa, Homo sapiens
MSDFWFSRVSESTQDTAVRQRHSDVAFDLDVGSSI

SEQ ID NO: 956554 - protein, 46 aa, Homo sapiens
MTSDNLISALNKHGLGTALMARLEINYDILKSFQTPDTQRRRGVGG

SEQ ID NO: 956555 - protein, 94 aa, Homo sapiens
LSHYHLWQKNFWGPVLRINVRNGDEIQQIESTSEFNNLKLHFWKSPFSFNRPVDCLVPSVNLQAFKFFLRILGLEDGGTIEDLQALLDNEDNVI

SEQ ID NO: 956556 - protein, 119 aa, Homo sapiens
TSYPRIIKGYTYYIFIFILFLLIFIFFFLLLLLIFWVSCFFFEPVWAVRGLLSCVHFCPCARYAPISFSYFSSYLSCFLCIWLCIFGLSVHTTFHPISLQFPPGYATVCTFDLWAMCTA

SEQ ID NO: 956557 - protein, 131 aa, Homo sapiens
AEGGIKLASSYTSKKMEKNFAPIWILPRASPTPDLDTTSMIRFGTSELIKCCSCFFQDGVSFCHLGSASRVEQSSYLHLLSSWDYSHVPPHLANFFFFFFLEMGSGSVTRAGVLGCSLGPLNPLPLGSNQV

SEQ ID NO: 956558 - protein, 43 aa, Homo sapiens
MEHLELFWSKVNIPKVLRAAEQAHLWAELVFMYDTYEEYDNVI

SEQ ID NO: 956559 - protein, 115 aa, Homo sapiens
SRLSHYQQTGVSPVPLHDGTHDCTRTLGALPGPPISDPCTAASPSLAYAGNGIICGEDTDLDGWPNENLVCVANATYHCKKDNCPNLPNSGQEDYDKDGIGDACDDDDDSDADDG

SEQ ID NO: 956560 - protein, 71 aa, Homo sapiens
PLPHDQVNLRDELLQLYSDSDEEDEDEEEEEEKEAEEEQEEEEAEEDLQCAHPCDAPEAVSSCLCTCKSFL

SEQ ID NO: 956561 - protein, 102 aa, Homo sapiens
LEYTGYHIISICMKAADSVSSEQPILQRQDTRTHRPAFRPEHSMPRGTSGAPQQKLKFRRCSQSGTLTGLGDERVSCRGEGPGHDPASKLGGGTCTPTDTCS

SEQ ID NO: 956562 - protein, 59 aa, Homo sapiens
MSVLGSDDESGRYRRQLGMVSVNAPDFAYGTALRTDERQEVSSEGTVMPSASRRRAAVR

SEQ ID NO: 956563 - protein, 97 aa, Homo sapiens
MAGLRSVCLVFDQMKAVPRFVVNASNRRMAVNADALFHRPATLGEDRALEPLLEQYHFMHKCHHANEHLLITGRREHPQIVPVCACFGWVENPWEQD

SEQ ID NO: 956564 - protein, 60 aa, Homo sapiens
ADRRGGLAQAVAMRAVSGVGLDVFENEPDIHPGLLGQPNVVLLPHLGSATLEARQDMGDR

SEQ ID NO: 956565 - protein, 125 aa, Homo sapiens
RGSPSYPRGRVWAAREPQGALAFAETMAEEEGPPVELRQRKKPKSSENKESAKEEKISDIPIPERAPKHVLFQRFAKIFIGCLAAVTSGMMYALYLSAYHERKFWFSNRQELEREITFQADSAIY

SEQ ID NO: 956566 - protein, 50 aa, Homo sapiens
DFIPTVRASNQYLREYGAGVWALSCKWLPSGKRFKRRGEGWFTRFFKSSG

SEQ ID NO: 956567 - protein, 103 aa, Homo sapiens
MQLSHLLPRLESNWCDSRLTAKFASEVQAIPRVLKLPSSCDHKHAPPQPANPALLVETGPLHVAQADLELPTSGDPPTFASQCDGTTGASHHAQHRMIYLSQM

SEQ ID NO: 956568 - protein, 45 aa, Homo sapiens
LSHYLPEYFNSGLAQIQLMAPQGGGGALQSTASLFVGSLSLLHLY

SEQ ID NO: 956569 - protein, 71 aa, Homo sapiens
LGTLQQQVAGFIKNETLKGCGILQHYGHEERRSQDRRFLFVWNADNIRAFGVRQSKASIHGGRTDREADWL

SEQ ID NO: 956570 - protein, 105 aa, Homo sapiens
LIDHKSICDHHETTRVTCTCNADTPEEMHHMRYTLLKRVQRGHQREEGQEFIVRGWLHTEVKNSPKMSSLTLKKRWFVLTHNSLDYYKSSEKNALKLGTLVLNSL

SEQ ID NO: 956571 - protein, 50 aa, Homo sapiens
YRISVRKSAKCWMMAGVLQGDHPSSNLNTPLMTENYEPTPSEALVSAQKH

SEQ ID NO: 956572 - protein, 77 aa, Homo sapiens
MICPYCLTALPDEFSPAVSQAHREAIEKHARFRQMCNSFFVDLVSTICFKDNAPPEKEVIESLLSLLFVQKGRLRDA

SEQ ID NO: 956573 - protein, 52 aa, Homo sapiens
VVHANTSKELKQSARRNLFKKLGNDKNIHFSKEDIQMINKYMKKYLTSLIIR

SEQ ID NO: 956574 - protein, 117 aa, Homo sapiens
QRLNGCVCVCVCVCVCVCVFLKSSLVCILLFMSFLLLQRGVRNIERSWCRCGRKRQMTCGKKLSTQYSPFGYALYRLQPALFIRVTVDSWDSYPYVRGEGERVFSLHSVLLDLIQSP

SEQ ID NO: 956575 - protein, 93 aa, Homo sapiens
AQCELIYNMESVHNLVYAHAAVHPIHRRAVDINRALGAQLAEASRVVDQLAHPKSVFNGTQSRSTRSASSSLAIYQTTPDCRRSFIGLIVYGT

SEQ ID NO: 956576 - protein, 136 aa, Homo sapiens
IAHRTPDNLEGSIREGLVRDGIDTFERTVPNPDMRAAISEVAHQCSSAPAWFELQPPRVKDGYSSSVGDRQYFIDYNPAVSRSKCNSQLTFLHLLSERNSRFQNIIINGRLTEPSRSACTRFSLPKAYPMTSSSVA

SEQ ID NO: 956577 - protein, 42 aa, Homo sapiens
MDSVHNLVYAQLHVHRTTQLRGYINRALTPTTRHEAWCVDHG

SEQ ID NO: 956578 - protein, 123 aa, Homo sapiens
SDTVHGSRNLLAPDESYKDFMQAVVRPARDILHEHGLKGFHELRAAYACERYEQLIGFLAPVNGGRVHQEDRALDQRARKQISHELGHNRIDVVSAYIGGGDDGRFRHSVVPAPRTQRVRCRY

SEQ ID NO: 956579 - protein, 96 aa, Homo sapiens
SDTVPPALVNNPSTQQLTRLEDASQKREYGRYDPKNIPKKERTNQNSLWTFVFLCFLILFCFIFFFFFLKDIEAKGNSYPNFQDTNMTYPSRITHL

SEQ ID NO: 956580 - protein, 108 aa, Homo sapiens
MGLVLVAQVSGVRQLKALIFVNEYPVRAETFPRWSINPANPGMNSAPQCLAPMLDKLPIGVISHAGNTTTAHSTPQGCLFQLQRFGVVPAHRSDRPEVQRLDTLIVQR

SEQ ID NO: 956581 - protein, 59 aa, Homo sapiens
IGERTVENVISVRNGLGQQARGTEGEWGHTIPSTYHTTDSTWDEIKEDFPLKEVDIVMV

SEQ ID NO: 956582 - protein, 42 aa, Homo sapiens
ERCAPASGRNPSNPPVTGSLSSTRSEESMPDVLLMLIMIIAG

SEQ ID NO: 956583 - protein, 113 aa, Homo sapiens
PAIGIHGLILLYMVSGFQYDSYVSFGSSTPLAHSIHLSAFLGYSPYSFIIDSCPFFRHVPFTVRFIAPDCTSGKIQAIHYPHAFQSPNHSFQIVHRTLISLLPHGRCTICIVV

SEQ ID NO: 956584 - protein, 115 aa, Homo sapiens
MNVSRMAVFVSGAATKLSKLFQSRQMGYFDVEKAPESPTNSTSFAAKGDAMLFPVLDGLKLHKVLVRTIKEFVDDEMPTYASALAYQMLFSLFPFLLFLIALIGFLHLPDFFSWL

SEQ ID NO: 956585 - protein, 32 aa, Homo sapiens
MSNESYQTAPRDPHSAHSLAGERTRARGSSNS

SEQ ID NO: 956586 - protein, 144 aa, Homo sapiens
TFSDRSGGGECPEQCANEAMTTTTNTQVEGDDEAGFLERLVGEERRQKRLQGALERQMEYDPTITDASLSLPSRRMQNDTAENETTEKEEKSESRQERYEIEETETVTKSYQKNDWRDAEENKKEDKEKEEEEEEKPKRGSDQR

SEQ ID NO: 956587 - protein, 43 aa, Homo sapiens
SWTFSVASFLSLFSDRSSLIAISLICSFSDLLFSDLLPPPPLT

SEQ ID NO: 956588 - protein, 72 aa, Homo sapiens
VFFKRATFEAIAPQVGNDAVIPEYLLNELYYDGTEYANSSVAGPILASRRLEVRATEARNSVDQWSLACSIQ

SEQ ID NO: 956589 - protein, 58 aa, Homo sapiens
CSSEEPEVITLEMIMEDQEELFVVPETVECWDVVLLNFLAVTTMTIHLSLPCAGSGAV

SEQ ID NO: 956590 - protein, 40 aa, Homo sapiens
MFSRNALDLLSAGRSRDEGSITSCSLETARIPMECIGSQE

SEQ ID NO: 956591 - protein, 77 aa, Homo sapiens
LQVIRIFPSSTRLDFLTASSSDEAPIISNSERVVSSTKTDFNESSRQVKVGVTTEVDCLSRDSFLSMSSYLLFSTKD

SEQ ID NO: 956592 - protein, 31 aa, Homo sapiens
MSISSCATLSVSTQHKGLFGKPGPSVNLRNR

SEQ ID NO: 956593 - protein, 76 aa, Homo sapiens
VLYKNSQVHYQAVILHVKYSIQGSSRSQERNERNNQQPCSQGGLKTSLLYLGKTPLPPTPIPNCIYNFVTEDHLFV

SEQ ID NO: 956594 - protein, 33 aa, Homo sapiens
MNHPHLVHQCPLWALCMSTYWTLSVSPFYTCET

SEQ ID NO: 956595 - protein, 79 aa, Homo sapiens
PTLTQGFFLVSKVLFLFGLTVKLYKVDLEGSVGKFNSGTKILSMDNLAITTARLGYVDLYSINSSHLFWLHYDGVCVIL

SEQ ID NO: 956596 - protein, 53 aa, Homo sapiens
TLSQDSWYTPYSWQQFLFALYLWYARAAFKIGFGTFPGTSSQHTNHSSVVSSV

SEQ ID NO: 956597 - protein, 78 aa, Homo sapiens
MELTDTIKQTKIPKKRVLLQPQHYIADRSGNVLAAFHSPSEENGGSTQATVVWLLYTQLPIMCWVMDGSTLQGNHKTH

SEQ ID NO: 956598 - protein, 36 aa, Homo sapiens
GSPSCSSRIVLSDDEIYLRLPFGVSPIMTVVWFVWG

SEQ ID NO: 956599 - protein, 39 aa, Homo sapiens
EEIQHVPSSQYEAYVDSKVDMVTSTAGFIEQLIKIYLLV

SEQ ID NO: 956600 - protein, 182 aa, Homo sapiens
VTTEHLIEQDASFATSLTAGPYSYFHEMDLVELYSLACHINVPVVTWKTIPSLHIPKSASLQGPSWSQQDIVQFPISIDDSFIMEEHESRNDFCSIEASSCFIKTDETSECGDIKVTPIHKLHHKKQTIGGLKAAKQLSEEGVIAGQRQDPFLGHGAFHIIILQNHVLLQHLHSIEVSCFFY

SEQ ID NO: 956601 - protein, 38 aa, Homo sapiens
RVGRDSPSMKTKTLNYILLAIYLYRTKLAIQLHVTLFF

SEQ ID NO: 956602 - protein, 92 aa, Homo sapiens
TKTESYQNRALDIQDKVKPKPKIKQSKSSQKQKPKCRYRHAIGDQATLPLKWSGQVPKTSLTKFQMSRLQVPVPSRCSATALILRGGCHTLV

SEQ ID NO: 956603 - protein, 82 aa, Homo sapiens
VYFRATAPNDVERNYETALSRPRGQVLQQINQIKKNHRLFPFPPVRFNQSAFATVVDFLDTSCRPQSTGEEAPILRKFILKN

SEQ ID NO: 956604 - protein, 153 aa, Homo sapiens
DDTANEYMTVKRGASRSFMTFERLKQEVSETVTIGISIIVSCKRTERRSPFDRSISVRSYSIVNAEYIQAVECAPLIRERDAVGDERALRHSVIYPYVLIVVGGPWVNSCSVREEPQVQTFGVCAWLRSQWGEATICGIMTERLYSQNPGQVG

SEQ ID NO: 956605 - protein, 69 aa, Homo sapiens
NLLPYVAHELGHNLGMNHSWRDRTCGSKELHHRIQEHRVPEHFSSSSAEDFEKLTLDKGGNCLLNNSKA

SEQ ID NO: 956606 - protein, 94 aa, Homo sapiens
FPKVINHRDRGLYERLQLIMLLCAADNTEITPVFHSNFSEKTDHPQHGALSVLHNIHEYRTHIHEDGYCPGKKQKITSVVRDVEKLEPLSYSVY

SEQ ID NO: 956607 - protein, 54 aa, Homo sapiens
VGRFHPSVAMDGSNKNYTYVFLIANLFPHQTKDISQSFKGLVPGEDNFDMGPFL

SEQ ID NO: 956608 - protein, 63 aa, Homo sapiens
TRICSSLHGSSIKDILISHFLYSFFSLSIQILESLPEIFQLRLRLLLSCHQLNFVFSVTNGEE

SEQ ID NO: 956609 - protein, 52 aa, Homo sapiens
RSDLNVVVMQCCRTAGNGPPGPVCGSRVEICWQDVPPGELQMVLSSFSYVVE

SEQ ID NO: 956610 - protein, 56 aa, Homo sapiens
GSAHLHYAATSDTFMAGSEYLLRNDANPGSVISSGYNAVHYSAAYGHRLCLQLIAS

SEQ ID NO: 956611 - protein, 52 aa, Homo sapiens
MRATQVLWMWIEMKETIIAFDWATKWTVSLLCCTERLRRISVSFYHVKNNGK

SEQ ID NO: 956612 - protein, 47 aa, Homo sapiens
RGTFDVNLSVVLGDLPPSPGRMFFSIAQIIPGRAVQNTEGTVAEYTH

SEQ ID NO: 956613 - protein, 85 aa, Homo sapiens
FPVGPDLPTPQMQVSHSHKAKGVAELDRLIWINKQTPMLRLGAPREFVSIGQELSQEDMGHPSALGKHILNLNVNFCFGLTSENL

SEQ ID NO: 956614 - protein, 41 aa, Homo sapiens
HKVPVYLTMSTGVELIKIIRRRLQLSANPAFSLFGDRTQHW

SEQ ID NO: 956615 - protein, 46 aa, Homo sapiens
FVCIAIITDSPYFSYLSQSYAADITILLTDRKLNTTLLRPRREDES

SEQ ID NO: 956616 - protein, 38 aa, Homo sapiens
MTDRVDDTLSFEIEDNVSGFNSFGNWMSIEGFRARGGT

SEQ ID NO: 956617 - protein, 36 aa, Homo sapiens
SHHRRAISQTPRFLRSPLNSCRHILKAMIYSKWINE

SEQ ID NO: 956618 - protein, 36 aa, Homo sapiens
SVGYNQPAEISLHEEEEQEEHEKLASAFWHWCKPCF

SEQ ID NO: 956619 - protein, 127 aa, Homo sapiens
AATSCHTYLSHRLFAMESRVSCPELKCKGTSSAQCNLRHLGFKQFCCISLPSTWDYRHVPPRPANFVFLVETGFCHVGQAGLELLTSDDPSALASHSAGITGVSHHARPLSHLYTCLLILTSVFTFG

SEQ ID NO: 956620 - protein, 132 aa, Homo sapiens
LPIFRTCHLMCTPYLSHLFFEMESRSLAQAGVQGHVLSSLQPPPLGFKQFCCISLPSTWDYRHVPPRPANLVFLVETGFGHVGQAGLELLTSDDPSALASHSAGITGVSHHARPLSHLYTCLLILTSVFTLG

SEQ ID NO: 956621 - protein, 56 aa, Homo sapiens
AQCSNEDEQLQSVSSSIWITQQQLAAAVYICLSTHRIIVEKPKKLPPNNQRKSEPT

SEQ ID NO: 956622 - protein, 54 aa, Homo sapiens
WRRHKWLRRLLDELTLGRADLEMQIENLKDELAYLNEEPRGGEMNRLCAGLGGV

SEQ ID NO: 956623 - protein, 41 aa, Homo sapiens
TEWVAMAGEPTTLRMKKLNWQKLPSNVAREHNFYVGVLSRD

SEQ ID NO: 956624 - protein, 220 aa, Homo sapiens
AGGAILLAASTLLQVAPSKVDGTSHVTGKGVTVETVCSVDELAASVLTGKTDHMASFQLSTQLCWWWVCQVTAWPVWVFLFRTKKKHPAVIYMANLALADLLSVIWFRCKIAYHIHGNNWIYGEALCNVLIGFFYGNMYCSILFMTCLSVQRYWVIVNPMGHSRKKANIAIGISLAIWLLILLVTIPLYVVKQTIFIPALNITTCHDVWPEQLLVGDMFN

SEQ ID NO: 956625 - protein, 38 aa, Homo sapiens
MLSSCLLSVVDDLARYNWLQCSASTSLVCPAPAAVDPL

SEQ ID NO: 956626 - protein, 34 aa, Homo sapiens
DEGKKHLTAPILRPVYTYIWNDKHLDHTHSHLRI

SEQ ID NO: 956627 - protein, 104 aa, Homo sapiens
NGHLSTPSNRCLVLPPSPRTCPLRWEEDLQGSQQKAGTKSALRHKLCRHPEKGHMDKLCCLQYPHGYIWARDPPSHLPQGLRQCGETNRLRRQVTCLHITTKVS

SEQ ID NO: 956628 - protein, 102 aa, Homo sapiens
PYGRTVNGRTLYHTCPALELQAPHELLQHQAIQVVLQVGIFDPSIQVGVVVDLDHHNPVARLFEVHAIKPIADQVGGFHRQLHHRLGCLMDCQGAAFASVRS

SEQ ID NO: 956629 - protein, 63 aa, Homo sapiens
PEDFLSNALMTPTQMYGLISRTAKRTTGESSEKLSTHMGLPGTIINNGSITRLQKYRAIYQLL

SEQ ID NO: 956630 - protein, 51 aa, Homo sapiens
MNGSMRVQLSLTYKPDEIDLPDEEAGMTQQDEKTLWSFNLFNANSPAPGIL

SEQ ID NO: 956631 - protein, 36 aa, Homo sapiens
TLYCWSLYCILLLSPTVFFYYLLLFGHPSESDLSLF

SEQ ID NO: 956632 - protein, 74 aa, Homo sapiens
ETVITRRQDHREPASLRGTLRRGRDGDTSGHAQHRCRSATRADVSSSNEQCDSFPECIDGSDELMCEVTKPTAD

SEQ ID NO: 956633 - protein, 36 aa, Homo sapiens
MYILYLPRPSLNKYIVTNACTFRSCNPHYGNYPRDN

SEQ ID NO: 956634 - protein, 71 aa, Homo sapiens
TDQPLVRRSGCAVIDETGTLCTIFVSAAEEDWKLNCQRRCWLNITPQAKFAPIWGADIHSLKSMRIKWVTD

SEQ ID NO: 956635 - protein, 56 aa, Homo sapiens
MPSVCSPDTPPSATRQPCKICPGDQRNFPITYLAGLSLAESYAGSYANILGPSQAP

SEQ ID NO: 956636 - protein, 61 aa, Homo sapiens
TLCSLSSLYWELGMRVDVSAQARCVDLLIRVLLTDRSLVFQRTDAFHRDRFDPMVSSTQSA

SEQ ID NO: 956637 - protein, 39 aa, Homo sapiens
VCYLGVTRSIVKPLLDGQCFQLAAVAIHITKHVTHHQRT

SEQ ID NO: 956638 - protein, 52 aa, Homo sapiens
SRVPFYYVALFEPRIACARISGPLSAAFDTSQLSIWATRELNREWLCRFHYP

SEQ ID NO: 956639 - protein, 47 aa, Homo sapiens
MGLRHAAVRKTLAFLPAALAPTLLPFAFGAIETGSWAGKTTCEKLYA

SEQ ID NO: 956640 - protein, 76 aa, Homo sapiens
LPDPQARLMLARMVGHITYLSDDSMGEKYGRGLKSEKLNYDFHSVYIPRWKSYPALPGATEFSRAYSTPNNLTLLD

SEQ ID NO: 956641 - protein, 113 aa, Homo sapiens
GCYPAHLKLDEAPSAPSGGGSHTTLSLAWDLIRSAATRDLQNSPVERARGSLPSATTKDSQLAKALEKILRRGAPQYLNDGRLTLDVLKRIAVQPTGENEVLDNAIQVVSEIL

SEQ ID NO: 956642 - protein, 59 aa, Homo sapiens
RIPDGRFVGRQRIDSDGCVRVLLVVGNMLYVYGNGGKLEPLTIKYRFDYAWGNPQVNRP

SEQ ID NO: 956643 - protein, 56 aa, Homo sapiens
RILMRCLTHTFCVESGPGSELEGYVVAEVEHIHRWRSCCGRTPNKCGGFCRVPGNK

SEQ ID NO: 956644 - protein, 71 aa, Homo sapiens
LLTGLLLHVHTLAVCYLNNAGHCRTTGYYPRRPACRGIGRRLSLMEPVPTNIFYGRSDVMFVSLARGPERC

SEQ ID NO: 956645 - protein, 139 aa, Homo sapiens
LYFRQKLRCFQEAFIKAYYSLETLQNEYAFSSWITRIVSRLCHDPAFQKKRKEEVIARDNILTGKPLTQGFDGTFVGCGFISKRAMQKLSPEQPGKLIGITGDIPGAFNLLTENLPEILTDTRLDRVTRPVGGNPSSEI

SEQ ID NO: 956646 - protein, 50 aa, Homo sapiens
LDHIGFEHDSSISILTRLILAPGRPQFPNYSELSASSAKQDKVYGQVSAE

SEQ ID NO: 956647 - protein, 77 aa, Homo sapiens
EDPEAVPQRAVARYSPREGSPSWIAAHCGVPEDYSYGIRKRKNIDKNDRCQRSKVTIGHFRTIGVVNDHGQGTLLLR

SEQ ID NO: 956648 - protein, 56 aa, Homo sapiens
TVSLSITQVISFKNMHYQIYARKANGYRLQIYYLSPKQFVLSQVGDPSRSQTLQGM

SEQ ID NO: 956649 - protein, 36 aa, Homo sapiens
LTHALPRRLHRLRHPSQRDKLQPLVDSIQLAGGEAH

SEQ ID NO: 956650 - protein, 109 aa, Homo sapiens
YSKIGTDRECLKQLHCHKRYDSVMRHRIEERGVRTITCSGTREISVQASRRVRCTTAFTSSQTLRVSRWCSGPRTTEEHASELRRAGGGFRYNSHSKNPCIPGRGVPSS

SEQ ID NO: 956651 - protein, 34 aa, Homo sapiens
AINWSREVVEKEFLEKVKHLENQIAQSPAIDPYH

SEQ ID NO: 956652 - protein, 66 aa, Homo sapiens
VSNKSDGITSILPTPIWHLFVATGAAVHYYAIGKYLDRSPTDFMRAFYDLVCTITTPNQYNFIYGT

SEQ ID NO: 956653 - protein, 33 aa, Homo sapiens
EDPDVSLENKTSQRKKNYLYTSLAHFWLRQVVG

SEQ ID NO: 956654 - protein, 64 aa, Homo sapiens
LDTSIKYPSPRFMCLTKCGIYTIEYHSAIKRPKVLRLQYYHMLHTRNPHVKAAPPVTTISTTIV

SEQ ID NO: 956655 - protein, 53 aa, Homo sapiens
ALEDAECLKSPPIEADPPVTHDLRVSLEEIYLWLYRLKMKISHKRLKPLRGQG

SEQ ID NO: 956656 - protein, 77 aa, Homo sapiens
LEYGRSWSPHFRLVTELYESLVEMSVTFLMETKVHCLTLDELCHVRIVTPVVVISAHQRKTLSKAKAINAEMKSHER

SEQ ID NO: 956657 - protein, 45 aa, Homo sapiens
VFYNEAVRRKETPDSSGCFMQSGGIIYLVVYSDGQFYSPPEIRSR

SEQ ID NO: 956658 - protein, 83 aa, Homo sapiens
MLTHTRQLCTVSALLYQLLLLTVLDQAVCTCPCTSPNSVLQDVILFVITLISTTALSDLNSFMGKSGIASVFYNNCSFSRYTY

SEQ ID NO: 956659 - protein, 40 aa, Homo sapiens
SLGTATIIDYEEPSQVLKNEQDIYTHLVQSLLESDSINQL

SEQ ID NO: 956660 - protein, 83 aa, Homo sapiens
SDIKSIDEVYSTETFFTYCVNTLGSLSLKRGSIMTLPYQRQAGNLNVHRYGTTSVAGLQYLNLYLAGSSKASRGRHHCNSYRS

SEQ ID NO: 956661 - protein, 33 aa, Homo sapiens
PRSVVQDLFHLVVNVFQRIPLYNSCEMFSKLHV

SEQ ID NO: 956662 - protein, 140 aa, Homo sapiens
MAAGLRPCDVASTLTFLRLMSTECSQNITYHCMNSVAYMGSADWQTYKTGPCSLQGSNEIEIRAEGNSRFTYSVTVDGCTSHTGAWGKTVIEYKNTKDLPGCPVNDGGPPRDVGAPDQEYGFDVWPCMLPVNYLHPNPRS

SEQ ID NO: 956663 - protein, 46 aa, Homo sapiens
DSDNVVTLIVEQTNFNSGCTLGDVPDPPSRSYNPIVDMDSRIGLRC

SEQ ID NO: 956664 - protein, 39 aa, Homo sapiens
PETIDLAVQCLHELTTTCTASTSLDVIDLPFATPETRVC

SEQ ID NO: 956665 - protein, 46 aa, Homo sapiens
DGDLQPPRLKTNPAHSSPFNASFSISTAHTQQTFSQSSCDSPFQHS

SEQ ID NO: 956666 - protein, 38 aa, Homo sapiens
GLAVTNDAGRDYGWLVLASRRFLTWSYTEPTFSTDWLA

SEQ ID NO: 956667 - protein, 43 aa, Homo sapiens
MQCAKATGKLVVGKNPELGNMLFFWNLLMLTFYLFSNIMGEYR

SEQ ID NO: 956668 - protein, 37 aa, Homo sapiens
YSERKSEFEDDQIPSYIDINDSDGMRRVISIVPAVGS

SEQ ID NO: 956669 - protein, 37 aa, Homo sapiens
TPGTAGEKQPPPPRLHTSSKTLEDPLKFQALGKNYRP

SEQ ID NO: 956670 - protein, 33 aa, Homo sapiens
MRIPCLLSLQNGLGHGRSRHVIDQGTEDQGTED

SEQ ID NO: 956671 - protein, 59 aa, Homo sapiens
RLIYRTLIFRPHTGLAVKPNGSKKTFPSEDKSNKLRADIKITSQKEVATSRLCIECTDG

SEQ ID NO: 956672 - protein, 65 aa, Homo sapiens
MGKETDPLRYQSKKSKGIGLCWPTMQRISLHEKSGLVILELGGALHFMSLSRREKKGGTKTQNKT

SEQ ID NO: 956673 - protein, 50 aa, Homo sapiens
AGLAKAVIGVGPCLTGSRREALNLDLVLYQQGKVHLPAISCVKTSLRPRV

SEQ ID NO: 956674 - protein, 35 aa, Homo sapiens
LHFYVSLCVTIDSAAVWPLVQVGEKRFGPFISPLQ

SEQ ID NO: 956675 - protein, 61 aa, Homo sapiens
MSCSRALVLTAMVNLTCVTSELETGVHSRQLVVHCNGQTLRHQHVFAAKVGDELVDVEVTR

SEQ ID NO: 956676 - protein, 152 aa, Homo sapiens
GSDYTICWRHRSVRMLERCQLGCNGSMRFSVRCLALETSVPAASFLLGCPGASSLHLSASWDKDSTLRERSCSLCISWYTPTSTSLTGETLARGPRANFTIFSPFCSRTVTLSSFCSWSNTKKKVLSSGQELAQRVLSSDRATTGCEEEGAF

SEQ ID NO: 956677 - protein, 58 aa, Homo sapiens
IREGLGAEVSKKAVAVWGWQDVEDCSSALTWGLGPDTAWFTPQPEKTGPPVPVDSYRW

SEQ ID NO: 956678 - protein, 131 aa, Homo sapiens
MRNTNEVLVPRGSCPSVSERACDMHVADMLVKVNALIKDREGYAPGTEFHRCNEMSEYWRTLGRNFTCFQDTLPHDVTFPMIHAKWKPLDHRRVRVWKVSKFNVDISFGSEEANMTRDAPACSVQKRAVRS

SEQ ID NO: 956679 - protein, 59 aa, Homo sapiens
MCSQKVGEGLVDVEQLERTQILAKSQSYFASERKIGFSSPGDLVELDGNGDNLVLAKVL

SEQ ID NO: 956680 - protein, 46 aa, Homo sapiens
KTGFRVREWEGSQLRKEIWRVFGVGTPQRGPCWPWLPEESLKKHQE

SEQ ID NO: 956681 - protein, 54 aa, Homo sapiens
MKRSFQRSGKHKQDHEEDVTTPQRKPENSRELNNECWPGAVAHACNPSTLENME

SEQ ID NO: 956682 - protein, 42 aa, Homo sapiens
SVPDVSSVCLAGGWWRWRAHRPMFSSTSPVPMLCCHRKAGID

SEQ ID NO: 956683 - protein, 49 aa, Homo sapiens
MVICTLSVLLYSSLRTHCKPNGETKVLVSTQHVQRKTVDIMMRLVQIFI

SEQ ID NO: 956684 - protein, 117 aa, Homo sapiens
TNPGADRDLPRWATEADKAELEPEQKSLKQTDRLSTWQILLYSGSVVSFIRGLFFHECREQTIEDGASSGQQVVVIEDGLAQPSQYTLDANSLGGLNATDIQVMHQSSDAAEAWLDQ

SEQ ID NO: 956685 - protein, 153 aa, Homo sapiens
IVVGRKLSLTQKPIGCIRLLMSAQTEAGPDEIDMITCLWEGMKKPVLRPVKFSKLQEVTQEPSENLTLFQARLVEAMRKYVNLDPESPEGQSILAVHFVSQAYPDIRQKLQKLEQGPQTPFPILLNTAFEVFNNQEKTSKIKKAELEEEECHH

SEQ ID NO: 956686 - protein, 154 aa, Homo sapiens
YHIGWTKAVPDTETIGCIRLLMSAQTEAGPDEIDMITCLWEGMKKPVLRPVKFSKLQEVTQEPSENLTLFQARLVEAMRKYVNLDPESPEGQSILAVHFVSQAYPDIRQKLQKLEQGPQTPFPILLNTAFEVFNNQEKTSKIKKAELEEEECHH

SEQ ID NO: 956687 - protein, 76 aa, Homo sapiens
GLGTLPDTAITSRRYRCHDTASPAVDDVTGRRARNARETRDFIQFHINPLMTLKIEVKAVLGLTMTSRAVIQSSLC

SEQ ID NO: 956688 - protein, 110 aa, Homo sapiens
MGSNHAETRSEENSLCCYKITKETPNIVFLLLFDILLLAGSTLWYAYLLRYGLRYYSLCCFKITKRKFYTLPLLYHFYPIHGCLLIILFFCSLSFVLYLPYRVVVSQLLY

SEQ ID NO: 956689 - protein, 62 aa, Homo sapiens
SPEADPEDGKPVMDKVKEKAKEEDREKLGASTHESISSMLIDPDDVSDQNEWKPVLLSQSKA

SEQ ID NO: 956690 - protein, 36 aa, Homo sapiens
MAQSAVCSYILSTCLFFSSVTYSEFPIAHYLSLLDL

SEQ ID NO: 956691 - protein, 47 aa, Homo sapiens
FDGSSARLVCVLYILTSWSFFSSVTYSEFSSAHIVGFWSTSPVPSVI

SEQ ID NO: 956692 - protein, 88 aa, Homo sapiens
MPPPGGYGPIDNKRNLPRRGLSALQLARPYEIWKPLVYGTCHPPSRCYRPIAKQLNFPRTSLSRYRMFALGIGSLISEPLDLYDVYPS

SEQ ID NO: 956693 - protein, 39 aa, Homo sapiens
FDGSSFSITERMTGVLSTTSLNGERDFVCSHDVVCLQPL

SEQ ID NO: 956694 - protein, 33 aa, Homo sapiens
NHIKPQTVIETLCEVTKGDAFVTSDVGQSPDVR

SEQ ID NO: 956695 - protein, 35 aa, Homo sapiens
RRKHSHIASPAEINVCFITYKYNIYSSDRWIKNVV

SEQ ID NO: 956696 - protein, 130 aa, Homo sapiens
RPNKVGRWSVIRFIAGSRLGFRGMGGDELQQQRVSVVYLKGINRSPQSLDLRAFAETFQARAHLLQYRIAQFTVLKASQQSLHVGEEFGLQHGRLRYFVIDDECLTGLSSLAADCSKRRSWVICGRASSR

SEQ ID NO: 956697 - protein, 68 aa, Homo sapiens
FDRSKKNRVRQRRCKDGSIGQREVKMLGILVLKMEEEVMSSLLKAEEARNGFSYGCFQKEPALLTARF

SEQ ID NO: 956698 - protein, 67 aa, Homo sapiens
SPVFTLDQQHRLLAATHSVGVRFICACLPTRPGLSARTIYATQLACSGALLPRIRYRARRIACPAQP

SEQ ID NO: 956699 - protein, 37 aa, Homo sapiens
EQNRVPEVLAALAIELNRRGFKEIPMTGNISEFVLLQ

SEQ ID NO: 956700 - protein, 40 aa, Homo sapiens
PFYCPGAQYRRIMTAWRGAALGSAISAMLSLRGNFRRGTS

SEQ ID NO: 956701 - protein, 48 aa, Homo sapiens
SSGRSLQDPHPALVDSDTSGRSRRPPIPATTQCPPSGTRARFPLSLFL

SEQ ID NO: 956702 - protein, 48 aa, Homo sapiens
RRRGMEEQPTVLGPNCPLSIWQELRTPPDCKGSAKCVHQSGGHIAIYW

SEQ ID NO: 956703 - protein, 30 aa, Homo sapiens
MADSCSLPPSEYSSFRALFLRRSPRCRLEN

SEQ ID NO: 956704 - protein, 35 aa, Homo sapiens
LAGSPDFNTSNDVSSCEGNVYGCQQPAVNSSSVIS

SEQ ID NO: 956705 - protein, 35 aa, Homo sapiens
SYTDPPLLILEPGPHRTPPVRRQQPIRTSAPINFR

SEQ ID NO: 956706 - protein, 57 aa, Homo sapiens
LLEIVVSINFYELTVTEFRCSEESEDPHNLLELVVTIILILRLALVTLAFSQYPFST

SEQ ID NO: 956707 - protein, 48 aa, Homo sapiens
ESGRDMVDITQEPGFGYHVRREHAVRIKNHVSCLNTYCSLHWELIHTS

SEQ ID NO: 956708 - protein, 95 aa, Homo sapiens
ENGTIEIIKKYTPTWQMYQRAQAIAGERSKRTTTYARITPICDRASLQPVHITIWYYLRVNRNITAMPNWLLEVRMAAVEHRHSSGLPYWPYLTA

SEQ ID NO: 956709 - protein, 84 aa, Homo sapiens
HGYPYNVVVVGRIIIADCPPKSISDCGRVRYRVHHSYTIEPFGLDCCTMPPVGSMHQPERAILKPQYTSCLLYSSKVPQSPLIY

SEQ ID NO: 956710 - protein, 44 aa, Homo sapiens
THLYASNQNGHTAESIMMPHTGIHHLAIMPGEASISLEVSAHGL

SEQ ID NO: 956711 - protein, 105 aa, Homo sapiens
MTKPMESRKTARKQTMFHRAHELRRRAEDYHKCQIPPSAKEALMQTGSECRQRIIVILQDCPTGSYLTAETLKNRMGHQPPPPTQQHSITDNSLSLKTPPECLLT

SEQ ID NO: 956712 - protein, 105 aa, Homo sapiens
MSTVLDKINGKRKTAKAHLRQTKNDRHVSTRAKERQVSEAEENGTLDMTDIHTYMEMINVRKRSGGGQRTTTDAKSPLLQESLFSNRCTYNLVLPGSEKNYYSHA

SEQ ID NO: 956713 - protein, 36 aa, Homo sapiens
GIRVELLQPFASLSFSVISPAGKELSSVIFTITTRH

SEQ ID NO: 956714 - protein, 58 aa, Homo sapiens
QDPRYDVWKPTTHWSNASTFKGLIMRVMNLTYSQQMNMASTATTTAHGNKRRHKQLEK

SEQ ID NO: 956715 - protein, 45 aa, Homo sapiens
QNATLGDWTTSEYFEVYMKARGLLSFCHPKIASTLSLRQMVIDHM

SEQ ID NO: 956716 - protein, 47 aa, Homo sapiens
VTVDAELENSRPQDCRLKFSGTLDCIGLCLDQVKSRIFNRTGTSSVY

SEQ ID NO: 956717 - protein, 80 aa, Homo sapiens
MAGPAHVLGPGKMVNYAWARYAEGKLWWRSVAVRDVQIGRPTWSIGAKDLSIHLVAGSLRSFPHDSWCSRIPYAPPPTHF

SEQ ID NO: 956718 - protein, 42 aa, Homo sapiens
PVLCRKLHRFTLGLHMDYTGATQDYTGLHRTMQEHTGAIQEL

SEQ ID NO: 956719 - protein, 34 aa, Homo sapiens
DLEDPVSYRISSSCPRSFLRMLACGDPTHPATQF

SEQ ID NO: 956720 - protein, 35 aa, Homo sapiens
GFPAEGPVCPGPLGSESDFVPSCAKAYSLRASTVP

SEQ ID NO: 956721 - protein, 73 aa, Homo sapiens
IHRQHRRSEYEQQEEYLIVTAGPGSDISSPDLTDLYILKQTPQGTFLVGQPSPQTSGKQLTTGSVVQGTLGVS

SEQ ID NO: 956722 - protein, 43 aa, Homo sapiens
RFCRIPPGTVDVQFYEGLEKAQPVRVRFSGDYVAELSSLNGSK

SEQ ID NO: 956723 - protein, 49 aa, Homo sapiens
PEQIDNSGEGGGGGDDNSCGCGSNDGGGSDNGDGDYSSDGDADAVVMVM

SEQ ID NO: 956724 - protein, 52 aa, Homo sapiens
YFTSPTLPAPHLYPMLLLLIYTHYGALAYGMRNLQGFQERYISKYQCWPLRK

SEQ ID NO: 956725 - protein, 60 aa, Homo sapiens
MQLDLPPKPHEYQSNSFSLRWAFSYSLTRMPARGYPCASEYWSLTTMYEGSTYSPADRTA

SEQ ID NO: 956726 - protein, 54 aa, Homo sapiens
LADSHCCRALPFAIGFDHQTGRTRYVQHALCGYDQIQQAVQNGHGTLMPISNRP

SEQ ID NO: 956727 - protein, 48 aa, Homo sapiens
MPENQAASLGRTRPRAFGFSSRRRLMSAAGNAGLRITYPADLAPLWHG

SEQ ID NO: 956728 - protein, 50 aa, Homo sapiens
CRGPGAAASSGSRDSRSSSTSFSLPPRPTCGFFCCSITDGVGRGGGSGGP

SEQ ID NO: 956729 - protein, 45 aa, Homo sapiens
MSISSSIPSAMVGWLSARHATCYRFTGARPPPEPSDVRQSFFQGE

SEQ ID NO: 956730 - protein, 123 aa, Homo sapiens
MLTAAQKSVGQNSHQGWAGLPSLLFRSPSLLIPSSLLNNLTWLCTGVNPQETAAPLGHSGHTLYYVGPPSCTSSLHRSSQTGSLTTPAVSIKPVASMPLTETMLPVRRVGCHLCCLQALDQST

SEQ ID NO: 956731 - protein, 141 aa, Homo sapiens
SRFFALRNDFDGCSQQFTAFFQTVTYRAAATWGGRCITVLGVLTIRGRRLSIMHEKKVIPLVEGVEPAAAANAILAWHVRDHAIVQIRPLPITATARTSTRKPGIASCEMADSGPGWITFREVFVLYLSKGVHFALQIGMK

SEQ ID NO: 956732 - protein, 117 aa, Homo sapiens
YVFAMQNFARCCLGRQCCRLYPLVDGPPFEQALTVPMGSVIASVSPWSCPRSIARAALAATCNRRFRRCVGSAWNARNSLSMPHRPISSSSATTRRASTPIEPVRGSIPCSNWGICR

SEQ ID NO: 956733 - protein, 115 aa, Homo sapiens
RFFAVVGDVLGRPRVRHQAQEGKQDSHIGRVGALAAILELESIGHALAEPDMPLVLGVLADVPVLLGHTGLSGVHAGLTSLHVAEDFDGIQVAALVGVNPVLSTLPVRVAHLEVT

SEQ ID NO: 956734 - protein, 33 aa, Homo sapiens
MSLIRSTMIRSLLLTHVAGDTLELARQALVFVG

SEQ ID NO: 956735 - protein, 73 aa, Homo sapiens
DSLPMVNTSISPERPPMSICASCAKLQFPTKCYCCKRQDCSIWLTDEESPMRINPPLVALSVGAFGIGVTEFA

SEQ ID NO: 956736 - protein, 46 aa, Homo sapiens
TASADIRAVVYDFSPSRSGEHARNFLQDWKGKLVCDDFGGYKASFA

SEQ ID NO: 956737 - protein, 101 aa, Homo sapiens
SILPSDENVGDAGLGLFMPVADGVSVRTITSRAGGVTWMPSVMLSHTLLTAIAHSDDVIPIAVQELDAEIRLITHIAPANNLTLTDEVPIDGHATVQVNYL

SEQ ID NO: 956738 - protein, 125 aa, Homo sapiens
MSGSGESMSDGFQFEYGGQGSDPADVVIQLTLLRLMCTEASQNISYHCKNSVVYMDQQTGNLKKALLPPELNEIEIRAEGNSRVHLQQSLSMAARVTPEPGAKPGFEYKNHQVCDGVPEARNSEI

SEQ ID NO: 956739 - protein, 63 aa, Homo sapiens
HATGELEQYDSAYVLAKRLVAFAPAIEFCGDFELERDDLGIWWKKFLSGKVFKKKQRIKVWKM

SEQ ID NO: 956740 - protein, 43 aa, Homo sapiens
DPNTGMLIRKGYKKKKELGKSYPAVYKNITSSITVLEAPLPSD

SEQ ID NO: 956741 - protein, 79 aa, Homo sapiens
SSSYGACQRYAVSSELRDRNSREQRQVAVLISVRYDVKRAHDLLSFWFSRSVEKYTGYWLVRQAVIRRPFDPSCRSSYM

SEQ ID NO: 956742 - protein, 42 aa, Homo sapiens
LEDPMLIPPWIKRFLVTSNFKVSASPLLYTLIEKTMHNVQAS

SEQ ID NO: 956743 - protein, 38 aa, Homo sapiens
GSLHRQGEDISRVYQCDLCLGDHHIHVMRESLRQLKRC

SEQ ID NO: 956744 - protein, 114 aa, Homo sapiens
VSLGDLEDPKLQQDKVRGNIKRRLSSHTIENSLGINNLRKKENEKAPAKDYWVGTKGLAKTKKVTEEKVVREKGHGKEKLSSSSLQIDLCHPQQPSAITPRFAKKKILGGEKNA

SEQ ID NO: 956745 - protein, 63 aa, Homo sapiens
ARGDRSNDKEHPELFSGLVWSGEQDIAAGLIDGLGSASSVARDIVGEKELDGFYGEESPFDRF

SEQ ID NO: 956746 - protein, 50 aa, Homo sapiens
ISPCMNIMSSKENGRHLVLLTFIFLSLILSLGMGVLRRVSRKEEVIILNS

SEQ ID NO: 956747 - protein, 37 aa, Homo sapiens
DLEDPVLISVIWARGDGSFGGDWEKTINIQGVIVILL

SEQ ID NO: 956748 - protein, 32 aa, Homo sapiens
YYDEVITVMIIIEILLQFTMSCLFAFLPFYQL

SEQ ID NO: 956749 - protein, 46 aa, Homo sapiens
PGIKAHRITTGRCEVDYQEGLEGSRIVIKNLMPPRHCGMRVFVLDL

SEQ ID NO: 956750 - protein, 60 aa, Homo sapiens
VINSELMDPNATDDNQAPDHQNTDYRLNPMLEKPVKADIPKILVTGTLDQRGTRGSEIPL

SEQ ID NO: 956751 - protein, 38 aa, Homo sapiens
SRLRGILPSTVRVERLWSFWQLSNGLQAWLSPSLAVPS

SEQ ID NO: 956752 - protein, 74 aa, Homo sapiens
MDEELWLGFTTVLLRTAPCLLCHIPTRISLPREVRGSLYGAMQNWCRETKTDGRDGVIFTAGVERAELRTQSTE

SEQ ID NO: 956753 - protein, 120 aa, Homo sapiens
DDRRTISAPSKTSKSLCGEREAKVINRLAVDQQHRHGWASKLWPNLLGEIGIYRVSSPGLTDHKIAVYSFSRGTLMSRLAVFLLTALLGANAMAADVIDPNRTKEFGDITVRYNTFTSSF

SEQ ID NO: 956754 - protein, 73 aa, Homo sapiens
MALGFMAWATLPIFSIMKRFILMSFSCQSKVMRSSGRPWHRGKPGLDPGSCSGRTDGHRGNPLRLDGCPIKRR

SEQ ID NO: 956755 - protein, 91 aa, Homo sapiens
TLEYPHTNAFGTGRAGNSLPMALRRSVGGDVTLRVVPGLYYERLSLEAKSSFFAEPWTVGSEADRIGYRFKGGSALSFQPREQPFGAGSDP

SEQ ID NO: 956756 - protein, 37 aa, Homo sapiens
CAVDCDTIICIIHQQSMVQNTALSSITLYRVPPKHVG

SEQ ID NO: 956757 - protein, 81 aa, Homo sapiens
LLYDEQPRFLLWRDTKISHKLCVEVPSLGPIGNVLGTQRRRRVNFSNSDGYVSLSLYWAGFIAEKPLIQSHLSLGAQVIVK

SEQ ID NO: 956758 - protein, 64 aa, Homo sapiens
RNAFRGHATPTRVGVALPLALESRPRARVQPPPPQMLMLVADVQTRTLTFEAEKAIPVRTEIEL

SEQ ID NO: 956759 - protein, 39 aa, Homo sapiens
RLSRAPYSHNGNYSQRGSRGSTPSTTSSSVPIKRMPSRS

SEQ ID NO: 956760 - protein, 107 aa, Homo sapiens
LHDTAPTAVLITLENEKQHKSPLLGESQIGGYHRMKHYSLLDLSSSQATKRTCGQLNAYCKAKLYILYASNYMIFRKRDLAIAKLLESAAKARNPEEVKYRQLSSRA

SEQ ID NO: 956761 - protein, 93 aa, Homo sapiens
LRRKLLIFIAIHERIDKGIVRRIIASSYRRMFCKFIRKNSAFLKPISRSNSAAIIVKRCHMKHMLAFHFMESRRLSHSFSRVFDERRIERGTE

SEQ ID NO: 956762 - protein, 98 aa, Homo sapiens
KIPACNEGHRVVQISTCRSCKKSVSNVNFERKVQLGDLNANITKKILRLLLFSQLKLSRFQRIPHRGPNMHLQILQTVCFYNCYIARNAQLCEEFTDN

SEQ ID NO: 956763 - protein, 103 aa, Homo sapiens
MAQQGWQPGQPLELKPTIITAGRRNTYWGGEGGGYVGSGDGWGLQEGPRRGEGDRSRFKQFDFPSTTADFIGEQKYNQSLIDAEYSARSATLTTETEGVTGYR

SEQ ID NO: 956764 - protein, 90 aa, Homo sapiens
RNAFPQRIPELLASNPSYVFFSARPDSNEGPRGSLNVPLTAGYSVAVDRKVIPLGSLLWLSTTKPDGTPLSRPVAAQDTGGAITGEVRST

SEQ ID NO: 956765 - protein, 72 aa, Homo sapiens
LILIVSGKLSEEVVVHQINKAFMNSGHAMPIRSLTFPRDSQLLVTASDDRLHQRSMTVQHTQFWLGTRDKRP

SEQ ID NO: 956766 - protein, 193 aa, Homo sapiens
AKRRMPDKAHLWKLRQGRWARWHPELFGPGMQHRFGGRGTTEQGTWIEADALDTAIAQQAVEHALSITLGEELFMTHLHGQRPINAIEKSSQLRQAWRRKALRELQPQRRNALTQRAHQADKTFCRRQLFTQIASMADIAGEFGGEAKIIRHDFGPALHSGGRGASIKSGIALNGVEDLGIEPEVIAGTCLNG

SEQ ID NO: 956767 - protein, 61 aa, Homo sapiens
LSTVGQAGACLTYRGYDVRELAAELQFEEVAYLLLYGELPTQAELAAYSNKLSKLRVGTEL

SEQ ID NO: 956768 - protein, 179 aa, Homo sapiens
TYRLRVPPTSVLESQVLERLIVENLQLQIGERSGIRISDEELNQAVGTIAQRNNMSIDQFRAALAHDGLSYEDARDQIKREMIISRVRQRRVAERVQVSEQEVKNFLASDLGKMQLSEELHLANILIPTPDGANSEQLNAAAAKTQAIYERLKAGADFAQMAIAQSCSDNALEAEICRR

SEQ ID NO: 956769 - protein, 138 aa, Homo sapiens
HLDVNLRTVHFDQIDVLPYPVVCIGCHGFVQHSRFKGADRQPHLADAQFKLTSALPRSCRKGSEAQPDDLRLDQGQIVMRCVLFHKTPESNNYPPEGNFTNRKYCSFPCLKTLVRCLCRRLLIGCRKIHPMIGRKRKA

SEQ ID NO: 956770 - protein, 32 aa, Homo sapiens
LADRVSVSAVYDNETPERLTQAVCSQWAECSY

SEQ ID NO: 956771 - protein, 58 aa, Homo sapiens
NEKHVYINQHLNWGPMSVENRGAYKTRRWDSYPQTPDTALPKVDHKALEYHARLHASE

SEQ ID NO: 956772 - protein, 31 aa, Homo sapiens
MGLGTRHGCINARKMTFALLKGVLQMSEGST

SEQ ID NO: 956773 - protein, 57 aa, Homo sapiens
MAPTQRTGSTDPKGNSGSGDYMGATCHACIGGTNVRNEMQTLQAEDTTYSSRYTRVK

SEQ ID NO: 956774 - protein, 36 aa, Homo sapiens
GVVSVRCQWVHGRGSQEREGYPHAGNRSREILFLAP

SEQ ID NO: 956775 - protein, 60 aa, Homo sapiens
VLAHRFHGNPLIRALRIKEDTSAIATVSGSVPRDGDLQVLAFLHLDTSDDGRLKRGNSIH

SEQ ID NO: 956776 - protein, 65 aa, Homo sapiens
KPWKSGVGLVSTGPGLLRTTALLVMRGVHWCSGMTLVRPCSLAATGMIFLSVIKLIAEATLQVVG

SEQ ID NO: 956777 - protein, 38 aa, Homo sapiens
YLVTSDDMMLVLSLVAPSVLLHHSGWLASVPENLCSSG

SEQ ID NO: 956778 - protein, 62 aa, Homo sapiens
RRGESGVPQPGRVRLAGGAIKVSQRASCSSLNSHRIGASRFRQLSAAPRNDNSLNASGSPPQ

SEQ ID NO: 956779 - protein, 55 aa, Homo sapiens
MGVGDELGSLVISVVRLQCYTFSMLTATPCERDEEGESLYHMRAEPSSPWAPLTM

SEQ ID NO: 956780 - protein, 36 aa, Homo sapiens
IIIALQPGSRTVRLDVIPRSVLVLVVCACPLLWIVA

SEQ ID NO: 956781 - protein, 115 aa, Homo sapiens
MLVFLPGPNQQLIWIPLRHLKPYYELDAQEEILGGSRGPRSCSHVEIDTEEDPNCHEQYPSNIATYLGTDQEAVTDGWNKNLRKAGQPVTMSNLMVPMIAVITIAVSIPSTTAAI

SEQ ID NO: 956782 - protein, 104 aa, Homo sapiens
GRLYTDPLCVGRRAWLWLDGPYCTDTLYGHMFTCNVCCRRLYIAKLRPFIFCNAQDSDTLCVVGFIRGLDSPDLPQWTISKDMRKAIGIQQSNSLLQPGECERN

SEQ ID NO: 956783 - protein, 60 aa, Homo sapiens
LYSVVDSLHGSPTTVRLFVVIALLIGSRCSMVIAPAVDSINTLFWRSDERRPPLRSVSQF

SEQ ID NO: 956784 - protein, 83 aa, Homo sapiens
GSTQHGEICLDKGIGAYSDQSNNFSNRIHRLSLPYHHNRSRAIECTHCHAAKTSHDYQIVQPVCVEARHVNKYWFLRQQDHDD

SEQ ID NO: 956785 - protein, 35 aa, Homo sapiens
SMRLPHDLLTPPAENPKGQKDRGSLMCRSLMCRSL

SEQ ID NO: 956786 - protein, 55 aa, Homo sapiens
MFQRVLQQFVSLQQLLSLIGEQHEYLQANAPVDATAVRYEVPGKGFFGVIANESV

SEQ ID NO: 956787 - protein, 88 aa, Homo sapiens
ARSSTIPHISSSVAAPGAPSPGPLHCCDYDLSVHSHPGQALPASSSRPVNLFDQNFSTFGILSSDALWQLQGSIPCLHSLDAKSIPLM

SEQ ID NO: 956788 - protein, 164 aa, Homo sapiens
AQQPAMTPRLLKIDTPESYDLSCHLNDLTDAWKLYAGATWTLLDARLKDITVKNEGVSWRITLAARLPQAWPAHINVNDHERVQLTLWAYAVVYFCTMLTKAHVGTCVPAWHSTMSPTNNTDRSPRIPTGDRTIFSLGLGYQVMDNMTIPGYSYLKEEDVKDLR

SEQ ID NO: 956789 - protein, 104 aa, Homo sapiens
TLAVIDNLSLRSVRTQDLTDAWNSIAVHLDTLERLKELRQETKAVSGANGGALAPGLVSTIKEDQNWHDTWAYAVCTSYQLTKQVVLRTGLTFEPSATNKTGSL

SEQ ID NO: 956790 - protein, 62 aa, Homo sapiens
PDLSGRTELVVTNVTLRLQEITVKASNVLSEGRAARVGGWLMFLGRSSKYPSHITFDPFIFR

SEQ ID NO: 956791 - protein, 127 aa, Homo sapiens
MQRGWYEILRELANTFGGIDLVPHIESKPLSMSIEELCARSPMPFQKAEHKIKVEFAKLLKQIESVKLTLGSCGQFNVIMTTNYDFTIEEAYAGTLHSPGSLARESRYSLYRRHTAGKKGFWHVHGD

SEQ ID NO: 956792 - protein, 94 aa, Homo sapiens
LTAVTSMKAEDLIKNDQRPERLFTPIRHPVLHVYPCKNIAKEISETSYTYLLCRAGRKFAELEILGRPGANISLVRIEIEEVMLEADVIKVKTV

SEQ ID NO: 956793 - protein, 34 aa, Homo sapiens
HYRLLHVRPLHIGVSRVNEGFMLLMWMGEGAIME

SEQ ID NO: 956794 - protein, 78 aa, Homo sapiens
YSDLNGCYLQVQTGNDYANASEAPVEDSILADKICIHCGFKVVVDNPLRYAAKERQGRGLCASEHPSPGSPRGIGPTT

SEQ ID NO: 956795 - protein, 199 aa, Homo sapiens
RSVPPGGCCPGARPGIRAPATRRAGEDVIGEVIGGAVARKFFGGDKGSHFLRARLALEVRSQAIDVSHVTAQQRRLHRVHLTRGVIEQGQHLPSKTARVVDHRTPQRACFPPAVVGAAVAKTDQHHQCRAEQGQGHQRQIDLGGEKQHEIHRHCHIPQQQPEQRPAHIAHGLDDQAVFLQKGSFQTRTSRWGGGHNPLL

SEQ ID NO: 956796 - protein, 45 aa, Homo sapiens
MYIYCPHQSKAVQQNFQIPVVWGACIPFPSPVTLVCAVCDETLIQ

SEQ ID NO: 956797 - protein, 116 aa, Homo sapiens
MLLPSDKRFAQFIHVNKLLEQMSLNVIGKSALWVQLQGTLMPKTTLFDLDGKIAFVSGASRGIGEAIAKLLAQQGAHVIFSMPQCWMGCQHVADAIIAEGGKATAIACHIGEMEQI

SEQ ID NO: 956798 - protein, 66 aa, Homo sapiens
YTRKSAHDDSDNDYNSELLALLAMYRYVAQRRDDHVGDYVIEQLHVDHSAPARQRNRCSLVRASAS

SEQ ID NO: 956799 - protein, 66 aa, Homo sapiens
MPLSETLSAGNVYANNGTTPWPAAGAMTNCNGNMRGCDDYLPTPSLPASWLDKPFADYSQELASLK

SEQ ID NO: 956800 - protein, 74 aa, Homo sapiens
SRTVTNGNLRQAHFKTAVEQVEEFWIDTARGNRGLRPGEEFHGAPRRFVGQANVADLAGLYLFIQGFERFLQYA

SEQ ID NO: 956801 - protein, 61 aa, Homo sapiens
DRAGRSVQLRISVQDTGIGMIQPGCERHMFQAFSQADNSLSAPALAVPGLGLVISKRLIEQ

SEQ ID NO: 956802 - protein, 115 aa, Homo sapiens
SAWSSEVGPTTVITARLARPHEHRRRQRIHAGHQQAMYKVQAAAADLLAHAGIGLIVRQGVSGAGLNLAFAQLHGFPRRQVGAEHQPGGRTEQRQHRAQLRHHGDGAHCRLNLHQ

SEQ ID NO: 956803 - protein, 61 aa, Homo sapiens
ADKHASTTSRVTTGNSPQAVIGVTAQKGMSKSNKARRIADTRGPVCTTASSIRSYQESAHK

SEQ ID NO: 956804 - protein, 71 aa, Homo sapiens
ASTDETGLADSSAQSMENARPLAWALPGELMAQGIELAAQAEHLRMGHQAAACNSVKVRMPLTMRIMSRAE

SEQ ID NO: 956805 - protein, 61 aa, Homo sapiens
AWRTTTLNARITGPGYTDCQYLLYSDKGVLRRLHAHHLLSEGHANVRVYRPALRRGPRVTL

SEQ ID NO: 956806 - protein, 113 aa, Homo sapiens
TQYAYGSQDEDVLTMRIEALPLLAQTIAQIRSQTGIGSKQGIALAALKHRPEPLPDSATPAEAIRGNRRRCSSSRMTLELPSSKPDHFNRNIADRNVNADSTLLWIFSTPPAG

SEQ ID NO: 956807 - protein, 101 aa, Homo sapiens
EVTLRILKVCYLLRCVILSSLYWDLGMPVDVSMHRRAVLIYLIRVLHKRAKLVYFNVLMRFTEIGSIHGLVSQVRKLALQRLYHLCIGYGHETDPGLKTLG

SEQ ID NO: 956808 - protein, 53 aa, Homo sapiens
LLRLLQPDLSGRTELGVTKVTLRLQEITAKASKVLSEGEQRALGDGYMFLCRA

SEQ ID NO: 956809 - protein, 67 aa, Homo sapiens
MNICLAKHPSDATAVRYEVPGKGFFWCGSANDERTRFLLQLVRGLRLSSTGWVAWVAVCPSIAIMSV

SEQ ID NO: 956810 - protein, 125 aa, Homo sapiens
ADSSLTSYLEATGITISISPLILCLRVLWVCVYITFSFKNTFRAAMRGHKNSSPSSIPRLTSYWFRLLRYRQNHHLVFYATQHASVENALPLLQQIPSSSLPGPLSTQETWCVRRRMASALLGKR

SEQ ID NO: 956811 - protein, 41 aa, Homo sapiens
MRRHAASYTPRSAWKAALCSELDGFVCSRGRAFFTEALFVV

SEQ ID NO: 956812 - protein, 69 aa, Homo sapiens
LLPDPPARYDAGADCRHITYLYDDSMGEKFCAVAIKSEKLNYDFHSVEFQCGKLPAVTMGEEFSGRIDA

SEQ ID NO: 956813 - protein, 61 aa, Homo sapiens
LYRILTRSVTTLLHPGMYRFRNEFLPCAALDGNYRAPVEVAHATDVTWHQYDMISWHKQIF

SEQ ID NO: 956814 - protein, 36 aa, Homo sapiens
MTAMWSICEYPAVPPVFKLPQETSCNSYCLIHMLYD

SEQ ID NO: 956815 - protein, 34 aa, Homo sapiens
ADRYLNGDVVALDSQHRVNDEMARSLYVSVRRDN

SEQ ID NO: 956816 - protein, 74 aa, Homo sapiens
TYPPAQLGLSVPRSPCILVNSSNLLISLPHGLQLLSSPQTLCPRLSLAPHVSASPSPGDYEHSSAYGFSVPYSP

SEQ ID NO: 956817 - protein, 30 aa, Homo sapiens
MLRSFLGASGVEIACCNNAGHFGGEQLMSS

SEQ ID NO: 956818 - protein, 37 aa, Homo sapiens
MLVVATLRGCLGRLQSGARHQRPRPAYPLCAAGSRVN

SEQ ID NO: 956819 - protein, 70 aa, Homo sapiens
LLLNSTDDTNEVYCALNTRLGYQTLHGSRYLLDDSLNKYHFQPYFMADIYSFGLIIWEHGSSLVSHEGSW

SEQ ID NO: 956820 - protein, 158 aa, Homo sapiens
GDSTGSLTVCYPPAHPADVAGALAGNGWRQKRSSRPPATQRFTVAPVLHLWLRGALEVEKQRRQYPGIDRRLQLQQQGDDTGQAHHHKFGAADPEQRTNAAVVHQAPADQQDTRRHARDRNMRINAAPNNANNATHSSENNPGNGEQAREQTVGVPEL

SEQ ID NO: 956821 - protein, 75 aa, Homo sapiens
YLPRRLNVFSCACLPRVMLFGEVSIHVFCLLFTWAVCFLTIRFESSLYILDTNLLSDTRFANIFSQSVTCLLGTD

SEQ ID NO: 956822 - protein, 87 aa, Homo sapiens
MSRFSLGDTPPESQSAHALVKLGATGVLHRPDEVTQLGITVPTIDADTVLHRHRNRHRIAQCAFTQSATRAGCAMKDLRRIIVVPAP

SEQ ID NO: 956823 - protein, 76 aa, Homo sapiens
AIEDIIGGFHLLEDRYSHWARPGCPCALSVLQASARTTGLNAVLGPEECPATSFSQLLILPPLFLRTGPTRIGGLY

SEQ ID NO: 956824 - protein, 56 aa, Homo sapiens
LCGTARGRDVQDAVGLMSKVTSIWGTPLGARRDAAQLASAPHRLLSFAHGPRRPRY

SEQ ID NO: 956825 - protein, 37 aa, Homo sapiens
KYEDHGEQNRKDAEAWFTSRTEELNREVAGHTEQFHL

SEQ ID NO: 956826 - protein, 98 aa, Homo sapiens
LVCTRGSRLSGTAPAKWNCSASHRPSSDFSHSCAGQVPVNSSQPNPSGTEASHFSAVFCPRDFSKKKALGSSPHPHTIMVEKYGRLYMPGGQPRSSST

SEQ ID NO: 956827 - protein, 71 aa, Homo sapiens
MQDPAYGFDRHHAIAGQPAPTQALFVISYAFEIRRWRRAHVVELPLAVPIHNIHHAKLIRLGDTSWLDMPQ

SEQ ID NO: 956828 - protein, 65 aa, Homo sapiens
LILRIPPNVELLRRVSGGWVGDFIFQDAFPLLWGLAASNACAAPPALLGPVGYSSTCDVPVLPRR

SEQ ID NO: 956829 - protein, 168 aa, Homo sapiens
MNLSGLLRPVYDETLCSWATRCALSPNIKLISESNIDEWSSPDNRQYFNPDWLLGREFELYESQAVELARQLKLDIDEIAHFFRPRSEFLLAPASRVAYCHLCIQSDVAFKRYPSWRKSWCYSTNAYCFQHRCLLRFLGDALVADKQWKAFWKGDAGDYLPGKRGSHI

SEQ ID NO: 956830 - protein, 32 aa, Homo sapiens
MIVSLEMMNNMGGDRVCRFTSRVDGMLVPLKA

SEQ ID NO: 956831 - protein, 57 aa, Homo sapiens
PKVELHEIFSVRRLIQNIVYDITRLKTALDHRDIAFCVKETKNVLPIYEIQAKFFIN

SEQ ID NO: 956832 - protein, 66 aa, Homo sapiens
EVEHERTLLGPVKIGDLLSWRRATARAKLCAARSVAAPARANPVVRTWCLGGDNALPRNPSTYSAL

SEQ ID NO: 956833 - protein, 47 aa, Homo sapiens
WTCRVAATSRFNSSVRLVHQASASFRFCSRMPSYWLRMSLRILARSV

SEQ ID NO: 956834 - protein, 86 aa, Homo sapiens
MWNCSEYSDLFHEDLGVYGEGEFSMQARLRGSQKAHCFILKVMKTTKAPHLEEPGSAPASHVDKGQQKEQGGGLRQGIVKRSSYPI

SEQ ID NO: 956835 - protein, 102 aa, Homo sapiens
TPHCRTTTEACSSSTNGGTHPPKVPLYNSILANVVVVISQTFFEHLNTGEVRLSIFMRGYLYYRALFNRHWPQNIFGMPGVKQQSSCQLLFKMASLLILPDV

SEQ ID NO: 956836 - protein, 65 aa, Homo sapiens
GVTFPCRRRESGSGRSDRAPPDSAIILPSIVAQREDDADKAEYSAETVLERLDDLVHGHTRGQAE

SEQ ID NO: 956837 - protein, 58 aa, Homo sapiens
VKTGTHGLYTHTLYSLYAEYGAKTIYFGGWEYASTILKTLKKNTQAVLHACRVYYACV

SEQ ID NO: 956838 - protein, 84 aa, Homo sapiens
VVKYVHQINQRNGVVTVTAQNFGDTNIDDKSITLTPYVAGTGGNTALDVSAANKDQGKAIAEWRCGPEATNGIAAKYLPGSCKG

SEQ ID NO: 956839 - protein, 46 aa, Homo sapiens
KTPHRLFSLYTEYGAKTIDFRRLGVCQFNSQALKKNTKRFARGARF

SEQ ID NO: 956840 - protein, 40 aa, Homo sapiens
EDIFFTSNTGSAVGFQAIMRIALRSSRSLVSEMSGITIVI

SEQ ID NO: 956841 - protein, 92 aa, Homo sapiens
SKLTGVVDQSVVLVLIQQQTYSWASGITVTGAALVKGSGGDDILKLGVGARRYRQVVIVIGVRVEVVQWLGHLSGRYLAETTPENSSPWYAG

SEQ ID NO: 956842 - protein, 42 aa, Homo sapiens
SPAPHQVDFTLSSDKRLRTPQFSRCPLKDAKTLWPPFNSLRG

SEQ ID NO: 956843 - protein, 51 aa, Homo sapiens
TDTYGFKDSTLGPRGTQSRGFDRSGNQGTVAESDNDPLAFGGNVLIPGWCR

SEQ ID NO: 956844 - protein, 61 aa, Homo sapiens
QPGPYSKTYEFGVVNFVDWYSERMLNNLGAAPAPYLKGVAAHEERLCGSGLARDGIVSVKA

SEQ ID NO: 956845 - protein, 46 aa, Homo sapiens
IPTYVAYLIENNANQYNSSTALLQLLLGVSILPYLQAYRSNIEIYH

SEQ ID NO: 956846 - protein, 126 aa, Homo sapiens
AQHCPDHGNTICWLRRVEESPQKHRKCYAAGSSSHQTRPGFFLIGRGVAGIMGSGRGKRRRMATDRCPRARSIFSGDLESRFEFADALCCCMSWKRPAISSGSRLGPMQDERRKLSPGDPASNLVN

SEQ ID NO: 956847 - protein, 98 aa, Homo sapiens
LETAIAASLARPGTTGTARPTIFSSAEQLLGCQTERTEAKCRGAQQTDRSKYAAQKRRVRAAQAEVEAVLIISNNSGPGIRITNQAQRPLNKQPGTPG

SEQ ID NO: 956848 - protein, 34 aa, Homo sapiens
MRATARRYCSTNELTRVLSEKFGIDRYINPTKEI

SEQ ID NO: 956849 - protein, 56 aa, Homo sapiens
MVTVRHSAGRNFMVHFMEEDRRRDKEPGVKALTTGGGVSMLVLEERKDFPPGSFRL

SEQ ID NO: 956850 - protein, 76 aa, Homo sapiens
LVPSLPELGGLLTTACGIRCVCEFRFNLLRRIARFGALHFHGQQVLRGPVFIGAQFKGETPVCIGCFGFLDLDVLD

SEQ ID NO: 956851 - protein, 71 aa, Homo sapiens
THRQDPGTSVLMKLGLSDAKLSKQQFVVNIGKESRSQCDLVKEARKNEGALTIWWIKLGKRIPGWSECYKC

SEQ ID NO: 956852 - protein, 52 aa, Homo sapiens
TLKGLTVHPSQACSLGKVKKVKRNSATVLPRLFTDYITSCITSIRGTVLPVS

SEQ ID NO: 956853 - protein, 71 aa, Homo sapiens
QQHTGFQEPVFDEARTELSKLASSIFVAEYRKRVQEPLRFGEGSQEERRSANYLVVKLGYRILGWSECNKC

SEQ ID NO: 956854 - protein, 81 aa, Homo sapiens
PSHFLQTAPSQDPGTQCSDEAYGLSDLTRASSSFVAEYRRRVQDASCDLVKDARKNEGALTICVVKLGIHGFQDGASATSV

SEQ ID NO: 956855 - protein, 56 aa, Homo sapiens
MDAHESHEEAEGRRRQLGRRVHGILRLVKLSPFFVFLDYMLSLLPLYVLFIPFLAV

SEQ ID NO: 956856 - protein, 36 aa, Homo sapiens
KKCLSDITRFPQLGTINSCAPDFSHSLIALSFRAEI

SEQ ID NO: 956857 - protein, 71 aa, Homo sapiens
VVTRLISHNDLTYQDVVCFAPETTRIGSFDSCFHVVGHVMPPGLVMLVDRTEHVKDSSRSSAEEPQCASFC

SEQ ID NO: 956858 - protein, 42 aa, Homo sapiens
MVSPIHLLPVKKISITSTTTTITIITITTTTITTITSLALSG

SEQ ID NO: 956859 - protein, 63 aa, Homo sapiens
LETQSSACLIQFEPGIATCRGQALRSSSTATPCPIGTSCGAEWHNKLMAESQAVTSSGHTISV

SEQ ID NO: 956860 - protein, 70 aa, Homo sapiens
VSTRSPPETQSSNTWPLLDQARTRSQIALAASVGFFAAIQAPLGDPFMPITRMSGLRCEFLAVRSESVSS

SEQ ID NO: 956861 - protein, 40 aa, Homo sapiens
VVSSTDPPLETQSPTSLFGLTYAILIFACFVSNLQCDREL

SEQ ID NO: 956862 - protein, 46 aa, Homo sapiens
DSTRIPPSKPSTDFVQPSGLAPLSPLIALRVVSNSVIGKPPGSPYC

SEQ ID NO: 956863 - protein, 54 aa, Homo sapiens
CTLVGRPYTIPPRNPVLPQPALAQHCGLEPPPHPHTQTQSRWLPPLDVVKIPCL

SEQ ID NO: 956864 - protein, 36 aa, Homo sapiens
SLHDPPLKPSNDLSGYARIKDSSERASACCSRILYA

SEQ ID NO: 956865 - protein, 53 aa, Homo sapiens
LAGSPPKPVVDAILGVLINIQITYNMPLVSTLIQCGYETIGTGRYYILYLLSV

SEQ ID NO: 956866 - protein, 100 aa, Homo sapiens
LLDIAHLLLCGSSAAMAQELGTPALGASNSEPSHTSLHSGQGQQPLSSQGMCVSWHFVTINSKWSLSHCEVTYRKSPASHFALAGSSELPPGKPNLCPNP

SEQ ID NO: 956867 - protein, 68 aa, Homo sapiens
LIGLSLLLLQNLEQVENRLQELEETNRTCQNVWNSRSSGRECIQVRVECKQNRMNVENLLELDCTALH

SEQ ID NO: 956868 - protein, 45 aa, Homo sapiens
HDFPFVTSDVAVLHDLAPSLAACFIFISLSHSGKVGAPLDDRPCT

SEQ ID NO: 956869 - protein, 175 aa, Homo sapiens
PDSWCCPSRHILIKTHVLSLLIVSDYISQTPTSSTKQQLLSFRGMVGYFRLWIPGFAILTKPLYTLTKGNLADPIDPKSFPHSSFRSLKTALKTAPTLAFPDSSQPFSLHTAEVQGCAVGILTQGPGSRPVAFLSKQLDLTVLGWPSCLHAAAAASLILLEALKITNYAQHTRKV

SEQ ID NO: 956870 - protein, 81 aa, Homo sapiens
MVAIQGMLQLWSLIKNTGSLIVTNICRLYSEARASQHVLSSGEGCSRCIKDMGGGTSGKVSVSMPREITPEVSPGLYKQPR

SEQ ID NO: 956871 - protein, 53 aa, Homo sapiens
MRPDFLVCMVFLQIPQLSKEHIHNKERPLVYPKYPKFLNSDKGRMTTNTPMEG

SEQ ID NO: 956872 - protein, 39 aa, Homo sapiens
AQREVTLSSQCHRLLMGELNSKPGCLPEQRDLHTERGSS

SEQ ID NO: 956873 - protein, 43 aa, Homo sapiens
MDLALNVRRQAMHFKCMQLTDFILKITAQCPTEVCPDKPGRRQ

SEQ ID NO: 956874 - protein, 59 aa, Homo sapiens
VGLVVMSIDCMLASVNISGFAGCKVLQLLSFAVVIVSLEPSTVSYVRYECAQLGASTIL

SEQ ID NO: 956875 - protein, 45 aa, Homo sapiens
IACRTYFWMGTVRKLEDEISEQQHLKGMAMSPSLECKVHRPKPCT

SEQ ID NO: 956876 - protein, 59 aa, Homo sapiens
MRIAWCTCVAHERLRSMALPSVRRQAMPFTCLPLTDFILKFPHSAHQKSVRHAWQKAAL

SEQ ID NO: 956877 - protein, 126 aa, Homo sapiens
MRNCPGDDMGEAHRLGAVPDGQSVDVTGLTALMLPSLLQQLDKLRMIIESVVTSSYTLLSMSSVSPAKFLYRELFTCQVDGACPFPMACEQERVQAHTSQPKSLWRGLFVIRVLCVFMARYTSSST

SEQ ID NO: 956878 - protein, 66 aa, Homo sapiens
GYNTTRVYDSKDRKLVNLGRRITKYTRVTKNPVREYKILKKRHRLASRKRRLEKDRRKKNLSDRVG

SEQ ID NO: 956879 - protein, 48 aa, Homo sapiens
PRKVVSSILPITERNVVLRELRDRDDVVGVSHSSSRQLIGHLEVQDAV

SEQ ID NO: 956880 - protein, 59 aa, Homo sapiens
EAERDVVQGHCQESCRVIEPLGHLSLWVHQLGPQVELRWCHPRVAGYRMVKLHDGQCRE

SEQ ID NO: 956881 - protein, 36 aa, Homo sapiens
RGLTRVGVDMAARAVPRVGVVSRPVFNGGRAFNTAG

SEQ ID NO: 956882 - protein, 38 aa, Homo sapiens
RTDHLRIDKPSFAIDRYLQNERTVDFALSFARIVERSD

SEQ ID NO: 956883 - protein, 33 aa, Homo sapiens
FGQLSNALLRDCRYLSAIGMHTQGMTQEQSRKM

SEQ ID NO: 956884 - protein, 75 aa, Homo sapiens
GSARIARRHRVSEALDIDAALAQADLVVTCRGSGVPALSAEAARRAVDARRGRDLMVLDLAISGDVEEPVPAGVE

SEQ ID NO: 956885 - protein, 106 aa, Homo sapiens
MSQEKEFHEDNVYQFKAGTGHFRYFGGVMSSVKARTGHLDVYVQVTGRYDGFSLGSDGLTFLSSYITKRNTLTIGVKCLGHAKIFGGGMAEIMADVSQGCFEPVVR

SEQ ID NO: 956886 - protein, 52 aa, Homo sapiens
DLYEDPHDCTSGMHTLEREEWVAMVCSWMELSPGEVALELGALGFLSPGDIY

SEQ ID NO: 956887 - protein, 151 aa, Homo sapiens
MSDLLRIPHAATEGQTPSLSRRKLSRGSGKLCVAGVSADRLFMTWPRPEPGSGASSVAEYMGLYTPQTLENLSTDADSHIAQLSSVGSQVGLPLSPDAVHLPGAEFRRAQILDYDGVMIGQLTYLDARNGPVALCITAAKKGAVRMATRTG

SEQ ID NO: 956888 - protein, 40 aa, Homo sapiens
LFLCILVLQHVNNCARLGACGCEDGRTCTVTIDWLHTPEA

SEQ ID NO: 956889 - protein, 67 aa, Homo sapiens
SEKRADIADLATELVYDILNSLSALPLCVQRYGRRVGVRADKRHRGADSVAGAIRQPGNVAAFHRAE

SEQ ID NO: 956890 - protein, 70 aa, Homo sapiens
MPVTRPSISALCKCLGLVLASSCDPKATGGLMADSRTPGPEDVDNADGTNPALLSKGMLGGDDGMTMASL

SEQ ID NO: 956891 - protein, 115 aa, Homo sapiens
TYYGIAVPRVYWYSGRPVSMVAVSSDCWVHLQTNNRQNRHTGINMRFIIVVLPMVLTQVTGLRFARPSATPAIASVPGTKFKWAFDASKICSFNLEMSKVRLSSLPCRWRLTMSQ

SEQ ID NO: 956892 - protein, 128 aa, Homo sapiens
HLLGAKIYSPCLTGTPAYTKSKENLPCNRHRFPYNHNSNPQSLPKSQLFPQTTALCTVIPVSYWQIHMCHRVSFIVTQHKNNKLGNSIPSTIPNNGVPYHLFPHSFLSPFQLNHSSILFNLLTHSAFV

SEQ ID NO: 956893 - protein, 71 aa, Homo sapiens
KTNATEPEPSVNPHIYGQPIFNKGPKNIQWAKDSLFNKWCWENRITIRRRMKLDLYLSLYTKKSNQDGLQT

SEQ ID NO: 956894 - protein, 132 aa, Homo sapiens
SDLLQSLHSGAWQSSRSTFLVRLTVGFSGGWRCLSIEDKDLVGLLAASRDEMWWVDDGLCSFQSQMAGQSQDILGVLDSQVWSDNTGSYPFSELISEASSGTNPVRRGCSCESPCAARLGEVKDLGWGTQEA

SEQ ID NO: 956895 - protein, 61 aa, Homo sapiens
KIMPLHSSLGKRARIVSKYTERTHAGQAPVAHTCNPEHFAGRARQIAGAQEFENRLGNTVK

SEQ ID NO: 956896 - protein, 106 aa, Homo sapiens
WRQRLQRVDFVPLYSILGDRVTTLTKKTQFDILDGFTTSWDVNQYRWGLCRLASRCPHSWFLREALREKFSSLSPALRGCHILGARPLPSIFQGNQQPVKSSSMNP

SEQ ID NO: 956897 - protein, 115 aa, Homo sapiens
DHLYQEMEAAVQSWHADGPLSTAVKATMQSYTGSQQLHPLRDHHGPFTHRQCGAEEAIPLYTQEEAIPLYTHKAPKSSVSNISASPRAPLCAFARDNPAEVGSTHQPPGTRSLSF

SEQ ID NO: 956898 - protein, 132 aa, Homo sapiens
PVEVQCSGTILIMKSPPPRFKRFSCLSLWSSWVYRHVPSFPPNFFFGIFGKRLGFTSVGLDWSQIPVPRRDLAHRPPKCAGITRCAVFWFGLFGLVFGFFFFFFWKQILALYPGLRSRVAISAQWHPSAFQS

SEQ ID NO: 956899 - protein, 47 aa, Homo sapiens
MHTTIHQSTSIFSNTFSHRITQQFIVRLQQHNTSIRIRRRHLQHSAS

SEQ ID NO: 956900 - protein, 51 aa, Homo sapiens
MRVESAYEVEYGIRNELGNPKSRPERLYEVRNYDGRIGEDARRSRQLDGGY

SEQ ID NO: 956901 - protein, 49 aa, Homo sapiens
MVHLPHVVVPEWAYYNRLKKSTIELNAMIRITDTAQEHFAKLLANQEEG

SEQ ID NO: 956902 - protein, 31 aa, Homo sapiens
LIELGPGEAAVQLSQDRGHMISLDNKSETPS

SEQ ID NO: 956903 - protein, 100 aa, Homo sapiens
MSGPGDGDCRGKPGSLKTGSPAKIGAPAPPQAQLQGRVEFWPSTIPKLVSCSRTKFPPFVAAHVSPTTAHIRATLQFIRVAPLRKAGGRGQVTLARASLP

SEQ ID NO: 956904 - protein, 31 aa, Homo sapiens
MVPASRRGQRDRALLAAANVEVNRPAVEAGL

SEQ ID NO: 956905 - protein, 50 aa, Homo sapiens
GAVNRQAACRYAVSPRQPHAGVVGGVAAVHVDRHRFAAAAEFPLRVARRF

SEQ ID NO: 956906 - protein, 53 aa, Homo sapiens
MTYRQDISIPKQEEYIYIYIFFSTLYTLSPRLECNGTISAHCSLCLLDSSDSP

SEQ ID NO: 956907 - protein, 48 aa, Homo sapiens
MWRWSVSMLVRLVSELRDLSVIHPTSGLPRVLGITWRRATCTRQPSQG

SEQ ID NO: 956908 - protein, 178 aa, Homo sapiens
WPETQREKKKEKIQSLLIKMKKALLIKSATRLKVGKHKVSSALAGKSYARGTCTGAARPNYGPRFSKQCSRSIFSSTPAIFICSFWKPSGSSITHFILFYFILFFETESTLSPGLECSGTISAHCNLRFPGSNVSPASASRVAGTTGDRHHARTIFFSFSFLEMGFAMLPGCLNSGLS

SEQ ID NO: 956909 - protein, 156 aa, Homo sapiens
MMISVSDSQYTFIRSDGLQTMTEGSKLTNVLDWIRTTACTNIVTTSTGSRDLLKAKQTEKEKSQEVSSKSGSMKDRISGSSKRSNEETDDYGKAQVAKSSSKESRSSKLHKEKTRKERELKSGHKDRSTSHRKRETPKSYKQWTANTEIRSPTGSV

SEQ ID NO: 956910 - protein, 42 aa, Homo sapiens
PGTGVGDVSDRLQFNRYIFGSHTENLDLSNLVSFDNFGLQGY

SEQ ID NO: 956911 - protein, 197 aa, Homo sapiens
KTDMMAGVVVGTRNRYLLKRLRQENCLNPGGGNRSEPTSSTLHSMPETLTHRGTVTVLRLTVDWPLYPRAERFNLFGGGGGGRDVDGKMRHEVKHMEHNRRDWLTLAQTQHSRPGERVGAGSSRPPSDPPCRLGRAQTSKWSLPNLFRGQEAGRGRGERSSPQRTSAEGGQSIMTEAEMQVWWPTERSFPTSPFAGL

SEQ ID NO: 956912 - protein, 33 aa, Homo sapiens
GSGKGESEQTKIGPRASLVPPRTRPLIAADVCG

SEQ ID NO: 956913 - protein, 35 aa, Homo sapiens
GAGSIRFHTCLEASFVDTLLHTSPSDLVVHLPVLV

SEQ ID NO: 956914 - protein, 67 aa, Homo sapiens
PPSSYHVFSLYKWELNDREHMYTYEQNRHWLPIDRVAGWRGSSTQNNYRVLAWVMKYFIQQTTDDTS

SEQ ID NO: 956915 - protein, 47 aa, Homo sapiens
MAAQSRSLCQSANSSCSGKRSWLQMDLTLLLLRWRKATSCQTKATGE

SEQ ID NO: 956916 - protein, 80 aa, Homo sapiens
VHCSRAQIDGLDKWSELSNPARSGQDFFHARLRCMALAARIRRLQVHTVWPCLLHCSRVYLYWRWPPAHVEDFDFDGRHR

SEQ ID NO: 956917 - protein, 103 aa, Homo sapiens
YSYCSVVALLPMLRYCPTVICIERCIGLLRTSLLDASADDGGRGGVIAWLASLPVSSCRLNAPLLCRSVEQVQQLRARRDVAIDQCAQFSAADTVVTIAVQAG

SEQ ID NO: 956918 - protein, 131 aa, Homo sapiens
MHHHTWLIFVFLVETGFHRVGQAGLELLGSSDPPALASQGAGIAGVSHCARSISTLSVSLCLCVSLCLCLYLYFCFSISLHICLCLFLCLCLCLSLSLSVFLSLCLFISLSLSLPLSLSLYLYLSVSVSLS

SEQ ID NO: 956919 - protein, 160 aa, Homo sapiens
YARKNSSGPLEMTQHLTDCLGQLYRYGLGVSYVEREHGGEIPYTIYVMEDARSMGAQLRVFRGAVWFYLVQRRCGFAGIAAFILQWSLRTLRRVINELTKVQRGEIQRMSEQHPRETGADDRKINAFIESERDNLERQQHYRCAILRIASRRPIAVLRTH

SEQ ID NO: 956920 - protein, 175 aa, Homo sapiens
SVPISTWCSTCDRSPSRFTPIQDRCGLCTREHPIQLRWRQPPQTAEHPAEQAAVIVEHWVIAILQQLRLFDRQLFASDATAAQATSQHPVRGAVPVIGALAAVLAEGAAEFGDDDHHGVVPGRAQRIGIGSQPFAEIAQVCWPGHLPRYTWLACVSQADIDESPGDERSRINVAM

SEQ ID NO: 956921 - protein, 62 aa, Homo sapiens
IYLRHSSNSISGMKKMYSLMMIMEGNDVLSEMNIRYAEMPKTDLRMMSYGMMNKGIWIWEFQ

SEQ ID NO: 956922 - protein, 38 aa, Homo sapiens
QYYSPFYEEEKQAMYPSPTVPMCPEVEVLVGESSPFFS

SEQ ID NO: 956923 - protein, 203 aa, Homo sapiens
LDGVLVVLTVLWLFSSVKADSKAITTSLTTKWFSTPLLLEASEFLAEDSQEKFWNFVEASQNIGSSDHDGTDYSYYHAILEAAFQFLSPLQQNLFKFCLSLRSYSATIQAFQQIAADEPPPEGCNSFFSVHGKKTCESDTLEALLLTASERPKPLLFKGDHRYPSSNPESPVVIFYSEIGSEEFPIFTGSLYQKHAANQYVSN

SEQ ID NO: 956924 - protein, 35 aa, Homo sapiens
MSVGQRVRRSRKRSREKKDSVPAPNWPPILFSVHA

SEQ ID NO: 956925 - protein, 97 aa, Homo sapiens
EPRTGMCCKQQKYRDQLLRGRPSMRTKNAKPRERDISFYPSLFFLTKILMQCSEIQQPSSDHEDKNLKLGRKEDTGSWMKSLSSCISFGLSPLAYST

SEQ ID NO: 956926 - protein, 76 aa, Homo sapiens
GPDVLEASVYLFRFHGASGARRSPSCSALLGFKALLLFGVLAARAARRRPEHLDTPDTLPRPTTVSCSPCLRDLVA

SEQ ID NO: 956927 - protein, 157 aa, Homo sapiens
MAGIWQEHQTLEVLDRDYSSVGKLLVVPRAALEIYTEWAPSGCDSSELRPPQVGRYLLDVRHYTKLTPVTARVQRKVCEGEESKGPWVGRRLTEGAWGEHQGRASGQCLGQCRPKRSLAAALLLLLMDELGDGAGDAAYQGPVLIEADAPIMIGIQV

SEQ ID NO: 956928 - protein, 45 aa, Homo sapiens
MVSEIILDTGYWPPRCTLQKFVDYLFETIFSKAHRGSALPLAYST

SEQ ID NO: 956929 - protein, 114 aa, Homo sapiens
YPIRHKTNSAMKRMPTERDNSAAMSVVFFSSCKFCVQTKSSNTARERLKPVVETFARMFEMTSSCDCWASIPVLEIHRERIMFESLVDSNQASLQAWRSSSLADWAFVSLAYST

SEQ ID NO: 956930 - protein, 44 aa, Homo sapiens
KTEYRQESHGCGSLILKVFSLLCGSGNCLILTCELWVVVGVDIG

SEQ ID NO: 956931 - protein, 84 aa, Homo sapiens
VRKYMRQEEGKIMTSFTTDWQKGVAIPNVFGTRTRFVEKNFSTDGVGNQKVSGENCSTSDHHALDKARNVHPLYVQFTIEFALI

SEQ ID NO: 956932 - protein, 69 aa, Homo sapiens
HVCRQRALLSAEVAEHQCDAPVGMGTMLREDLVLSKPSRYHAQHTFTQKQTWQRFRSLVISYRNSFITN

SEQ ID NO: 956933 - protein, 39 aa, Homo sapiens
MAAVLVGFIIIGVALPVLPLHVKNDLGFGTFIVGLVAGA

SEQ ID NO: 956934 - protein, 56 aa, Homo sapiens
MTPKPAPRAVNEPGLCAASSRTILKRAIAPLADALPPAQQERVAQALSLVYGTEVF

SEQ ID NO: 956935 - protein, 35 aa, Homo sapiens
MSLIEGHVLEASATLYDYYNPERRCSVFYGAPSKS

SEQ ID NO: 956936 - protein, 142 aa, Homo sapiens
CISNSVSRLVILMQRSFTSLVSCIPRYFIVFVATVNGFAFLIWLLVWLFLVYRNACDFCTLILYPETLLKLYNISRNFWRETMGFSRYRIMSSTNRDSLTSSLPIWIPFISFSCPTALARTSNTPLNRNSEKGHPCLVLVFK

SEQ ID NO: 956937 - protein, 44 aa, Homo sapiens
RCAVTVLTYVIGLAPRHVDLRPYVLCGKDIRTVPGGLCRVALTE

SEQ ID NO: 956938 - protein, 154 aa, Homo sapiens
LLDFTLSAAARGSAEATEGMATIDMNTTFLSPGTGDLVIEARCLRRGGSIAFCEGDIRRADGELVARATATFKITAAARAATERRRAPRQTGREQAYFLKSRDGGTVGRGSSGMELAHELMPEYIASCMARIAAASQVPLPHITMRVSVVLGPA

SEQ ID NO: 956939 - protein, 121 aa, Homo sapiens
MPSVSKNAPQRQLMSHGSHSKFLCTKEIRALKSYTPILKHCSISSGSKPKQFFSSRSHQHAPVFQTRLCTTTSKIKTCKFPDTAVHTIHFTHIFQHSIHTLVSGFCSFIQFEHHHQTIKAT

SEQ ID NO: 956940 - protein, 44 aa, Homo sapiens
SRAQLLIGSFLYFVTCSIFVSSTPEGISCTMSAASHNSLPLSIC

SEQ ID NO: 956941 - protein, 36 aa, Homo sapiens
CIRKAEVVEGSGHVEMKKLPIVCAPYLRLAHMLRVS

SEQ ID NO: 956942 - protein, 33 aa, Homo sapiens
IRKVQGGCGGETTLRNKKATCELCPYSGLAHMQ

SEQ ID NO: 956943 - protein, 33 aa, Homo sapiens
SAVTDDPKCAKLTPVIKLINHIIHRRSPVQHLR

SEQ ID NO: 956944 - protein, 42 aa, Homo sapiens
QWQEKSECCGRSRTMCAYSQSPAIKKQLDRHLPSPPTLAYST

SEQ ID NO: 956945 - protein, 77 aa, Homo sapiens
PTPSHGGQVDVRIELARFTDGDCGPYWSVVDIRQRHRKLIRFLQGLFEQVLHCPIESEEAIVECDLCQSVRIASADV

SEQ ID NO: 956946 - protein, 35 aa, Homo sapiens
PLAVCLILERYDRPMRVSSVGCSMKPTFQPHASPF

SEQ ID NO: 956947 - protein, 104 aa, Homo sapiens
MHWKIQSTGRRVQGEVRWELHSLDHQLVLDRIPMNLFERKEEVKEVLIYGFPSRCGATSIPTRHRSARAYTDTRGSPIPLIMHVNWGRHSETPVLERNLLHFRM

SEQ ID NO: 956948 - protein, 68 aa, Homo sapiens
IARSKRDTCSLAGPTAWRHASLSSQGLMLYDARLAHASSMPHSGAPPRHTSVPCPYATGTRARTSLNL

SEQ ID NO: 956949 - protein, 33 aa, Homo sapiens
MSSRGASSRLFNSRGISDKCPLPLHYSLASPYA

SEQ ID NO: 956950 - protein, 42 aa, Homo sapiens
LIVSYSYSPSSPSSLLFLFLLLYLPLTPYSHLLYTYQWTLHH

SEQ ID NO: 956951 - protein, 35 aa, Homo sapiens
WSDHYWLTHVHGQYWLHYGLLTAASLIYAIGARIT

SEQ ID NO: 956952 - protein, 66 aa, Homo sapiens
SDLEDPGVTLVKAVVGQVQLDAHAVVGGRGDFQCFFVVVLLEVLLEARVAYQVRYRLAAVLRGLEA

SEQ ID NO: 956953 - protein, 39 aa, Homo sapiens
ETTRAETPYSSEAIAICMPVTYLKLITFRTKFFFLKPVV

SEQ ID NO: 956954 - protein, 45 aa, Homo sapiens
CASLGVPDNANAHAGSAWKLLAASMTFYLHTISKQTRMNVSAIRD

SEQ ID NO: 956955 - protein, 64 aa, Homo sapiens
ELGSRRGGQRRPQPPTVCKRPPLRSEGEHPAFGSGTLPGFGEASPASCAPLPVRMDLPPGSAAA

SEQ ID NO: 956956 - protein, 93 aa, Homo sapiens
LLRKLSDTAVADTRRLNSKPQDLTDAYGPPSNFLEIDIFNPQTVGVGRARFTTYEVRMRTNLPIFKLKESCVRWRYSDFVRLKNELVRDSKIV

SEQ ID NO: 956957 - protein, 81 aa, Homo sapiens
MFCHGTEEQIGELKEAFFLFDKDGDGITTKELGNCMRSLGENPTEAEQDMINEVDAGGDGTIYFRECVTMMGGRMKDTGCV

SEQ ID NO: 956958 - protein, 172 aa, Homo sapiens
EDVAVCFTQNEWASLHPTQRALYREVMLENYANVTSLSAFPFPKPFLIFQLEHGEAAWGPDPWTLAGGEALRGMCTGGKTKTENEEKTAQLNISKESESHRLIVEGLLMDVPQHPDFKDRLEKSQLHDTGNKTKIGDCTDLTVQDHESSTTEREEIARKLEESSVSTHLITK

SEQ ID NO: 956959 - protein, 99 aa, Homo sapiens
WGMGNRYCWAEGGRRWKHNWQFLQKQLKYLAFSVAVNTNLPRRYHFRPHRFWRPASCCPQNNEASRLDRSGLTITAYTEKAWWFLCLKSALKPQKFAIG

SEQ ID NO: 956960 - protein, 91 aa, Homo sapiens
GGGRRLGRDGGPVLGGVGQPGDPLAPGPPSPRSFPPSQFFLLRNLHPSSGCGTLGRRPGTAALSGGPEAVNGPVSKVVKPVPSVGALGQGS

SEQ ID NO: 956961 - protein, 119 aa, Homo sapiens
AAAGAAGILLWFLQEQNRAYSSQDVFGFLQREHGLGLAVVAKTLEQLAQQGIKEKMFGTQKIYFADQDQFDMVSDALEVLDGNIAALTAQVQSLQQSCRSMEAELKELSCALSTPAMQK

SEQ ID NO: 956962 - protein, 71 aa, Homo sapiens
MGSVLARCLEPLPSSGPGFGGGEEAFVVVEPGAEQEILDNKDVVAQHVHFGLGRSDALIICEIGDVFKAQN

SEQ ID NO: 956963 - protein, 155 aa, Homo sapiens
NFICTHICSSGLFDRIGSKKSDYIKLYVRRVFITDDFHDMPNFLNFVKGVVVSDDLPLFVSRETLQLHKLLKVIRKKLFVKRIDMIKKIAVDQYNDPFWKEFGSNIKLGVIEDHSYEHVLLNFLGFPASHYATDISSLDQVESVKAHDLFYLMAW

SEQ ID NO: 956964 - protein, 98 aa, Homo sapiens
NLEPPDMGLEDEQKMLTESGDPEEEEEEEELVAPLTTVFFACEQLEICVKARERLELAERVSRSHSEEDWTEELFLPARDHCVAHKLSNNLKLMWGLN

SEQ ID NO: 956965 - protein, 149 aa, Homo sapiens
LALFVQQFDLRNHGLEIVRLQAHGLLQGVLRIRQQGTVDVQARQLNPVFGGFGLGLDFLHELIEHLLQRPEVQPQGVRGQAEQGIGSGKPYALFRVIQPQTSNRVLLTGRHQAGDAVDRGFAHQRQVAGQVFVGKLQGLGAGVVRQFGM

SEQ ID NO: 956966 - protein, 128 aa, Homo sapiens
LNLFLFQGFRLVPFLVELRAVMDWVWTDTMSFPVQLAVCGGRDANIFIIKCSRETEKVHEDLPFSSKSSIAVALKFRSLIHFEKYPQPIGLEKKKIVKYGVGGLIILFLIAIIWLPLLFMSLVRSVVG

SEQ ID NO: 956967 - protein, 160 aa, Homo sapiens
PNKVPAGMILPTMNGESVDPVGQSALKTEERKAKPAPSKTQARPVFVKIPTCKIFVGETLTSPEELYGVFTTQELVQAFTHAPATLEADRGGKFHMVDGNVGEFTDLVPKHIVMKWRFKWSEGHFVTMTLSFYCKNGETELCMEGRGILVSEEERSRQGW

SEQ ID NO: 956968 - protein, 46 aa, Homo sapiens
RREDEEEGSQIPELQGFTTNLQMRDMLWSSDQVEHGYKSPANTTQL

SEQ ID NO: 956969 - protein, 48 aa, Homo sapiens
SKRGFQTQSTGDAVVSRGNEQGSGGRSGTDSIPRVCGASPRPTFHLAR

SEQ ID NO: 956970 - protein, 40 aa, Homo sapiens
VGPKKTPLDLRAVLLPPHWAALRVNLFSFTKPVTVMDLIR

SEQ ID NO: 956971 - protein, 78 aa, Homo sapiens
HNRFHVFLERTELNPNLFDRPQTNADPRQAAIEYRLVARIELRCFAVHSRSFKTYVASPMTFSTYGQQLQSPLHYSLL

SEQ ID NO: 956972 - protein, 66 aa, Homo sapiens
HQARLNIVAEWQQRRYRRAEGESLASFGFSEPLDRSAARPFQDWLHTLERILEVRLALRTHHRNRS

SEQ ID NO: 956973 - protein, 38 aa, Homo sapiens
SRNILLPLTSPMTVPVLVNLACPHCVSQCACLWHARHC

SEQ ID NO: 956974 - protein, 125 aa, Homo sapiens
MCSHRQQTASSGNSGASPYADDARPPPLDIHFVSILCHSHSESAARVSTGSFPTPPEPQSASGPREAGQAVTGNGVSARGTSPGQGEGREGRERGCCPTDSTVSSGCGFSSHNNRAFSKMGNFSF

SEQ ID NO: 956975 - protein, 51 aa, Homo sapiens
EPNVGQAHQGSYTGDKKDEYIVQGKGLEIAQHLRVTLDKLDFINYTSCLAP

SEQ ID NO: 956976 - protein, 64 aa, Homo sapiens
ALRGLLSGSAYYLKHQFYPSVVYLDQVPAPALEVLYIQAFVLVFLLGKADRQGVLGSTEGSRDG

SEQ ID NO: 956977 - protein, 33 aa, Homo sapiens
FNLFSLKLEEKKSAPTSNTWNTEARTVLHLRTY

SEQ ID NO: 956978 - protein, 194 aa, Homo sapiens
HIVRSVVRECLTGECSRMLRQIDLGSRRWFPRFRCEAKFRTAVMIAVSLALTGAVCGYAYYLKQQFYSSVVFLIQYSVPSHGSPCYPCLSVYVFLLSKVMGKVFFGQLRAAEMEHLLERSWYAVTETSLAFTVFRDDFSPRFVALFTLLLFLKCFHWLAEDRVDFMERRPNISWLFHCRIVSLMFLLGILDFLF

SEQ ID NO: 956979 - protein, 31 aa, Homo sapiens
MLQRLDIGNPEPEALNPIVKFCKRTQHLRFG

SEQ ID NO: 956980 - protein, 108 aa, Homo sapiens
RHDTIELGTVRSSARHRMGWFPGRLPEWRSPQRVGNGSSVPTQAILRRGELTAVYVETANGWRLRQVRLGDRVDQEHVQVLAGLAAGDRVALDPVKAGLIAAQAARGD

SEQ ID NO: 956981 - protein, 49 aa, Homo sapiens
MIHIYPGEGKGIGADTLHSCVYHKCLEYEKQQRIFTFTDDPCVPMWSPT

SEQ ID NO: 956982 - protein, 34 aa, Homo sapiens
ARYLSKRRSANVLMFVTRSPIVKFCKWTQHFRFG

SEQ ID NO: 956983 - protein, 45 aa, Homo sapiens
MPAPFKRRSGLEMRVVCNNQKMLAGHVLPPEALEENPCLASFGFW

SEQ ID NO: 956984 - protein, 39 aa, Homo sapiens
LLSKRRSAEGETLTRVMEVVVSQDCAIDPSLGNKSETPS

SEQ ID NO: 956985 - protein, 32 aa, Homo sapiens
CFLPLVVGSLMLSAHDNWAKLQRVSWAVLVYL

SEQ ID NO: 956986 - protein, 32 aa, Homo sapiens
MCESSQRDSGVRNRVRMYGETKVLSLMAIGFD

SEQ ID NO: 956987 - protein, 37 aa, Homo sapiens
MTTQDQYQSGEHSEIPSPSRGLQRDEVPPPLSWDWAI

SEQ ID NO: 956988 - protein, 43 aa, Homo sapiens
RTLIAVSICADTVKNNPGYGTSRTKEGLKTWGRVRWLMPVIPA

SEQ ID NO: 956989 - protein, 73 aa, Homo sapiens
RTIWVSIGIGMGDAVMAGNGENGECTEAEANGLKHPDLIHLETENAILSVVAPRSRFEKGETVLCPPHTVQGH

SEQ ID NO: 956990 - protein, 44 aa, Homo sapiens
MPPRLHARQYARRTDAHRGLSRSRHAAAPHRTAVPKSRDRCRKR

SEQ ID NO: 956991 - protein, 33 aa, Homo sapiens
LDKLAAAVQQKGYACVCLFWYWSKHLVKCEIAL

SEQ ID NO: 956992 - protein, 92 aa, Homo sapiens
RVPVRCLRDNDMDAPALSPGASSSSTAGAITDHIYFGCDLIYTYYVQRPAGVPLTSAPVRAPERSYGGSSYVLALVSVVFIRLHWIAHRQFN

SEQ ID NO: 956993 - protein, 73 aa, Homo sapiens
MHLMPVVESRVIPIQSAVAIQQSRIQSALQAHLTQNNPFASYTLHTWGFFWQLFLGRNTSPEFCFWEPGPWHT

SEQ ID NO: 956994 - protein, 33 aa, Homo sapiens
AVSIVKSKNPTVISQISTQYCMHTILGPHPSED

SEQ ID NO: 956995 - protein, 85 aa, Homo sapiens
CCESISEANDPTQSQIKDYTDGPYAAWTPHGADAAFPAGYLDVERCIPAATHYILQCLAPRCWRMRPGSRAGVIHVIVLNQATGH

SEQ ID NO: 956996 - protein, 34 aa, Homo sapiens
PSIAGAICLLRDWHYFFILIGRVMVTAAQTLCQM

SEQ ID NO: 956997 - protein, 101 aa, Homo sapiens
TLKCLKVNLEYPHSIARAIVPSRKQYVFNNGSNVQRIVFPFDQMCYYFKIALSLAHDIFRVQYMCTEITFVYFNQCLDYMPFCCMFAFSVMILADVQDRAS

SEQ ID NO: 956998 - protein, 36 aa, Homo sapiens
MNDNEDTNWHGEEVTRSLSLRALPALSLHNWLTADS

SEQ ID NO: 956999 - protein, 44 aa, Homo sapiens
RTAHRQWSPAAPARRGVFKSQSKYILQCMAPRCFEDEARAARAG

SEQ ID NO: 957000 - protein, 46 aa, Homo sapiens
PSRNHKVTSCMQTLPGESRLPFEALKLRNYFSPLALKILHRSPHFQ

SEQ ID NO: 957001 - protein, 40 aa, Homo sapiens
QLICLWGHIDVDPVRNANLRHTSGPVPGAHRSPTIRASIV

SEQ ID NO: 957002 - protein, 45 aa, Homo sapiens
ILRRYRTPPLRPGPAGYQCLSAVGAPGGLGPHHSLALALGLHWLH

SEQ ID NO: 957003 - protein, 75 aa, Homo sapiens
STRLARSSTERAHVLSRLSALQLLVHICPEQSSSRCLAAPSSLLLVHITFSMRGHQLRKASCGCLYPVNPTANTS

SEQ ID NO: 957004 - protein, 64 aa, Homo sapiens
STCWDFCPAHSSSSCLATPSRLILVPITFSSGDNSSVRLPVDVCPQCLPLKTLPKSVLNEQMTD

SEQ ID NO: 957005 - protein, 106 aa, Homo sapiens
YAVHQSKVSYDDPLLTLFVARSKLAVTIRRTTLTRECLFHAIGHFQAAFWLVSGLCVTALFRIGYALHRNTTCRMRARCINSLLETASLAWVIRPGIHIYTLLTAL

SEQ ID NO: 957006 - protein, 88 aa, Homo sapiens
AQDLMAGCTFAIKSITCVSCTFIMTAILRDLELEIPFDPAIPLLGIYPNDYKSCCYKDTCTRMFIAALFTIAKTWNQPKCPTMIDWIK

SEQ ID NO: 957007 - protein, 44 aa, Homo sapiens
AFGGQADGSLKASMVKAIPTKNIKISRAWRCMPVVPVTWVLRFG

SEQ ID NO: 957008 - protein, 34 aa, Homo sapiens
PKLIPKRYRTLSQWNVRAQSESAQSNDAELELGV

SEQ ID NO: 957009 - protein, 31 aa, Homo sapiens
MVKAIPTKNIKISRAWRCMPVVPVTWVLRFG

SEQ ID NO: 957010 - protein, 62 aa, Homo sapiens
VGPCDGLILGCSADEGSETMSETQGQGPAKRWYVVHAYSGMEKAVERNLRERIERRISPFAC

SEQ ID NO: 957011 - protein, 31 aa, Homo sapiens
MPSSASVGIFGTRGIPDFAKGCTAGDQSVRM

SEQ ID NO: 957012 - protein, 86 aa, Homo sapiens
LRDEHACFHFQFALFVSSCDRSAGDGPSYPIHSRFAKMSSFSRVYMTFLDHPVENCNSRAQWLMPVIPALWKAEVGGSPEISPFAC

SEQ ID NO: 957013 - protein, 39 aa, Homo sapiens
ILRIPHVERTDRCLSRSETRRIVFASRIFTTPIDQIRTH

SEQ ID NO: 957014 - protein, 63 aa, Homo sapiens
VPTVHLDGFIILQHPYPVIIYCHSHNQTVIIYCQQPNRPVIIYIAHSQAPIDHLMHTSQTPSD

SEQ ID NO: 957015 - protein, 41 aa, Homo sapiens
MANGLIPTPFQDKLRTLSCSLTIYRTTTMGHCRTHDQSVRI

SEQ ID NO: 957016 - protein, 33 aa, Homo sapiens
MPNHVERTDPIFVTNIRGAKLSVKSVLDQSVRT

SEQ ID NO: 957017 - protein, 70 aa, Homo sapiens
MIVEGDRDYGMIVESDPDYGMMWRVISDYEMMLESDRDYEMMRQVIAITDDAAGDRDYEMMRRVIAITDD

SEQ ID NO: 957018 - protein, 71 aa, Homo sapiens
LVGGSAWSTRLSGDSGPCPRAHGFNQHPGRLWTVLGAAVLNCCPRELVLGPRAPGVDQRSAATPVQVKHGY

SEQ ID NO: 957019 - protein, 204 aa, Homo sapiens
CSFVCCLCRRLAQPVQPVRRQNVCPTDSPVPSSNISDARACAAGTRDANRNEGILALILAGHAQDAGEEGSTPCDRGWIGLWLSGERGLDALIQIISTHQLAERALRIAQWEITDHADVMAAAYWATGQRQLWLLDHPDTFNVAGQIKGAVEVEPVICAAYRDIATVATDQWVRWLELQETVAAIACRKQDASIRSKRLLCSPL

SEQ ID NO: 957020 - protein, 146 aa, Homo sapiens
VATKDTSRTHGVRICGMQMYDAQHDKLVFQDKYYGRNVKPHEFTSVLESFFHNGYQVLVHHIPPLVEKLHCLARHACKLVGYRFYASSWLLIYDGDIRRQNTLWQGFEADVWQGARRPSAQSDANTEHSESFPQMTPGSEASTGYR

SEQ ID NO: 957021 - protein, 36 aa, Homo sapiens
MCNCSQVNTEILVNHENLGRDLDVFLQGHQSYWIRG

SEQ ID NO: 957022 - protein, 59 aa, Homo sapiens
CVIWLDLSQDIRGDRRRAEPTFFVKSSPCLYPSKAYGGQKGREEERKGCMPPEYWPSFH

SEQ ID NO: 957023 - protein, 67 aa, Homo sapiens
EYSRQVTGAVVMPVSQHPGSAEVGRSLRSGVQDQPGQDGETPSPLKTQKLSVAWCVGTLQSHATCGG

SEQ ID NO: 957024 - protein, 69 aa, Homo sapiens
HPAKLHAQGNHMHGRLHVSIGLFNCPVPVFSICTPGFMRTGSTCIPCSLHHSQIQFYLIRDGGHCSYAI

SEQ ID NO: 957025 - protein, 51 aa, Homo sapiens
MLYLSCVCELHHSSWQCQILNPLSKARDQICILMDTGWVLSPLSHNGTVNL

SEQ ID NO: 957026 - protein, 78 aa, Homo sapiens
TPLPGLSTGCLGYPSGTSDRDNGGSSSFSCSSAHSCIHSMHAVIAYGQSLCSCVPSAPAAAHHCCTAGISSFSTGIHG

SEQ ID NO: 957027 - protein, 55 aa, Homo sapiens
PDVISSNNGKKSDVKYDARFDKYLDPSFLQHRIHWSPIFTSFMMRASSMVGFSCN

SEQ ID NO: 957028 - protein, 49 aa, Homo sapiens
PSRTHSPVSVMHHVHLCLGCKLGSSSGSSLSGHASYLTFPNSRLNGRRR

SEQ ID NO: 957029 - protein, 68 aa, Homo sapiens
PYSRHVTGWLIMASEMAIYSSWHSAAWGGNRRGQNTLFPFTSHLLTTPFEEFPKVNDKDKKKAVNLSG

SEQ ID NO: 957030 - protein, 42 aa, Homo sapiens
MGLFRDSTSSWFSLQRGYVSRNLSISSRFSSYLPRDVGVFLM

SEQ ID NO: 957031 - protein, 63 aa, Homo sapiens
VPLKGCAVGGVARFFGVLLLKPLKGVCSGEAPVGVCYPVLFYLPISSLRTLATPVGVATPTAS

SEQ ID NO: 957032 - protein, 36 aa, Homo sapiens
GLVDNDRDRHNTELIFVYGMCQLYLKIKESQTHLHV

SEQ ID NO: 957033 - protein, 37 aa, Homo sapiens
CIRTAERTSCVDLRQIISLTEPHSPCQSNADSSCNSN

SEQ ID NO: 957034 - protein, 175 aa, Homo sapiens
ARGLPASSLIALCPDSKCGQETGLTHRNCRSLGRVGQHSSGYNRNKTTTPQIPTQPHPQPKPNKYALPVTKTDRLTLHHHVGVVYDRVTMSICGMNKGKPTVPKRNDTSIHSNACGSMAVIYIQNYNGKAISYPITSALDRQRIIRYLWKLQAANEAMCHLSRSVTDTTRVTYPD

SEQ ID NO: 957035 - protein, 102 aa, Homo sapiens
RSLIGCWSCNGVISAHCTLRLPGSSDSPASASQVAGITGLHHHAGLIFVFLVETGFHHVDQAGLELTSNDPPTSASQSAGVTGMSHCENRRELPPGLQLQQP

SEQ ID NO: 957036 - protein, 48 aa, Homo sapiens
GPTSTHQATLGQWYEALPLKEEQSFCPTVNLKTVDLVSEQTRVNASVE

SEQ ID NO: 957037 - protein, 46 aa, Homo sapiens
MRYRGRCMLISAIPDTSYPKHLLPNTSFTNTSFPNTSFPNTCNSNS

SEQ ID NO: 957038 - protein, 157 aa, Homo sapiens
MKLTKLASTVNTGRICDKLGNVVHAIQATEQSIHATDLVPRYCLTLANLNRVIYFICDTILWVRSVGLTSGINKEKWRTRAAHHYYYSLLLSLVRDLYEISLQMKRVTCDRAKKETSASQDPLWFSVAEEETEWHPSLLLLLFRSLKQHPPLLLDTV

SEQ ID NO: 957039 - protein, 104 aa, Homo sapiens
MAQFTSFRIQHRPRLVYLEWPVKGHLLHDGLTGPLTSRPYFSFTGLFLTNDNSVAKITPTAPIVAKVKTLREAVSGLSVVPECVRRILLYFFSLLVLLAVYQFC

SEQ ID NO: 957040 - protein, 32 aa, Homo sapiens
VINPEAKKDDEVAQLKKKCRYPCGTSQKDLKD

SEQ ID NO: 957041 - protein, 75 aa, Homo sapiens
SGQCVCVCASACACSCDVCLVCMFTRVRVSLHVGVCVQVCHVCVCMCAVCASFSSHVFFITMATPITRAPLIVAL

SEQ ID NO: 957042 - protein, 102 aa, Homo sapiens
MPLLGIYPNDYKSCCYKDTCTRMFIEALFTIAKTWNQPKCPTMIDWIKKMWHIYTMEYYAAIRNDEFMSFVGTWMKLETIILSKLSQEQKTKHRIFSLIGGN

SEQ ID NO: 957043 - protein, 45 aa, Homo sapiens
PVVYYYCSDADKTTDGEFHTLGTDVGWMEARSITTNHAGLINCLI

SEQ ID NO: 957044 - protein, 109 aa, Homo sapiens
FLRWSLTLLTRLECSGMISGYWNLCLPGSSDSPALAFRVAGTMSAHHHAWLIFVFLVEMRFHHVGQAGLEHLTSSDPPASASQSAGITGMSHRNWLAATLTGSVSEARC

SEQ ID NO: 957045 - protein, 36 aa, Homo sapiens
DRRESSSSYTPGTSCASWAGEGRPALISFLLNALAS

SEQ ID NO: 957046 - protein, 34 aa, Homo sapiens
TSMSWCYFIILILNDEETEAQCRLSNLPKVTWPL

SEQ ID NO: 957047 - protein, 118 aa, Homo sapiens
PVTILRSRTKIPFDPAIPLLGIYPNDYKSCCYKDTCTRMFIAALFTIAKTWNQPKCPTMIDWIKKMWHTYTMEYYAAIKNDEFISFVGTWMKLETIILSKLSQEQKTKHRIFSLIGGN

SEQ ID NO: 957048 - protein, 114 aa, Homo sapiens
ARIQALALSQDDATVATASAFDVVMLSPNEEGYWQIAAEFEVPKLVQYLEIVPETRRYPVAVAAAGDLMYLLKAEDSARTLLYAHGPPVTCLDVSASQSAGITGVSHCTQPKSS

SEQ ID NO: 957049 - protein, 35 aa, Homo sapiens
LVSPCNTHRASSHPTLSSHEKHCFSSARGVWADNT

SEQ ID NO: 957050 - protein, 176 aa, Homo sapiens
TSAVWSPLLECVIAGHESGELNQYSAKSGEVLVIVKEHSRQINDIQLYRDMTMFVAASKDNTAKLFDSTTLEHQKTFRTERPVNSAALSPNYDHVVLGGGQEAMDVTTTSTRIGKFEARFFHLAFEEEFGRVKGHFGPINSVAFHPDGKSYSSGGEDGYVRIHYFDPQYFEFEFEA

SEQ ID NO: 957051 - protein, 42 aa, Homo sapiens
GSDRDCIFNTTKLMNRRWSPSLVNEERQSDSLIPIRNGVGIN

SEQ ID NO: 957052 - protein, 151 aa, Homo sapiens
MAIIKKSGNNRCWRECGEIGTLLHCWWDCKLVQPLWKSVWRFLRDLELEIPFDPAIPLLGIYPKDYKSCCYKDTCTRMFIAALFTIAKTWNQPKCPTMIDWITTMWHIYTMEYYAAIKNDEFMSFVGTWMKFGIIILSKLLQEQKTNTTIL

SEQ ID NO: 957053 - protein, 91 aa, Homo sapiens
PVPNVSSNTILTKKNKAGGIMLSHFKLHYKVTITKAAWYWYQNRYIDNWNRTEASEITPHIYNHLIFDKPDKNKQWGKDSFFINGVGDNIT

SEQ ID NO: 957054 - protein, 54 aa, Homo sapiens
GYFNRRTGRSFNSTYMRFTALDFCAFFLSLFEAIKIFLDNGGCLSTLVSGNLVS

SEQ ID NO: 957055 - protein, 96 aa, Homo sapiens
FISVQYAGDKVLMFSGQGLKVNRGASLREKKNDAFCFVSLRQSVFGGLRQPFGDDLQPKTASNVNLKRYQGTWYELARLPMYFQRNCAQCRRGREF

SEQ ID NO: 957056 - protein, 114 aa, Homo sapiens
QGFDHVDFKLRELIIYSNLGNRGPFDFHWSFWVQEALDRDEQVITRSSILFFMFNLPDGAFEFADSAYCGFQLFRIPMNGVPTHTFCFKDGNKAHIALNNLELLTRAVDAAANL

SEQ ID NO: 957057 - protein, 117 aa, Homo sapiens
YGKNADQPLFRRRDTLMVYFRFSYFRVKAKRISAKLGNECTMPRRLLCALSVWSYESGDLSAYLPLVVKLPSSRDGCSTALITGFAFDYRSSRFHTFAILSSENTVAFMLAACPNVD

SEQ ID NO: 957058 - protein, 107 aa, Homo sapiens
RSRRLFCSRPWGFTPKELFSNRLRFRTMLVAWSSAFCIMLFMYQILQMFPQLSPRNLVFWFITSLALFGVERMVMLRLFRNLMANGKYLQRTVILGFTDTAVRRRGR

SEQ ID NO: 957059 - protein, 33 aa, Homo sapiens
AEKSNSVVLLISETPCCMCWADSGHPTSSLHLQ

SEQ ID NO: 957060 - protein, 33 aa, Homo sapiens
SVLDGSLFIEATEPRIRKHMATHDLKQKSRKSH

SEQ ID NO: 957061 - protein, 77 aa, Homo sapiens
VGNSGSETDPSVCMVSWDEACDVHGVSPLVSTGQPCRASAEARHKSSVGYTSSQGPGESHSISRYSRPASEDRTRKE

SEQ ID NO: 957062 - protein, 73 aa, Homo sapiens
VFNCGVGHIDLPRAKKGGRQEDVRDLRSDAIAAEECQWRYNTPDMESALSTTLAMAALLTRIERQAEDRLRIC

SEQ ID NO: 957063 - protein, 168 aa, Homo sapiens
VESETSVIKLGDGGSSGDGYPFEGKDGSWLMLFAPEQWGWGDSHLDDDELWILGMKAKWSGERMATPYGEYWRGSPFLFKGEEYNSLRWVTAVSDGFLWCSTTINFEEGWQVRLSVPDEGPGPPWGGNAEEESLEVVHSSFQRTSYDRCTTEGTEGWLPNGAVLAEDY

SEQ ID NO: 957064 - protein, 50 aa, Homo sapiens
TQSAAQFSTLPAHIGSGMGSRFNIGQASPQPEHRHTHSLLSHTVSSTFFT

SEQ ID NO: 957065 - protein, 56 aa, Homo sapiens
RIGKLNTEKQITCTVHHILYKAEVNFSCRMLSTFEETNRYPPRPPEGTEPQLKDCW

SEQ ID NO: 957066 - protein, 97 aa, Homo sapiens
SYRFNGMEWNGMEWNGMYWNGMEGEWNRMESIRVEWNGMEWNRLEWNGMEWNGMEWNGMEWDGLQWSGVECYGEELDCSGMELNGPEWNSVESSSVE

SEQ ID NO: 957067 - protein, 100 aa, Homo sapiens
YIIHWLQIHGTKYSAFDPSMVSAEELEVQKGSLRISQEEQCVSLAVNDELTRCVLVYVSGISTRQPAFSFRYVRLTGSHCVWEVGPMVIFMTGGISTKPV

SEQ ID NO: 957068 - protein, 80 aa, Homo sapiens
DLLIAYYDVDYDKKLEGPTYWRDRIMMVAKKFLDAVHQLYYAVASRITFSHELSDCGLESTAGEIPVVAIRTAKGVVPVL

SEQ ID NO: 957069 - protein, 37 aa, Homo sapiens
ICGSRADPLWRVTKMKMQSTIVIRRDYLHYNLQLKDA

SEQ ID NO: 957070 - protein, 54 aa, Homo sapiens
VLRLSTAVGISDLEGYSHLQKRKSMALSFTGLGFNTLCPLLCISLQQVAHSCVD

SEQ ID NO: 957071 - protein, 72 aa, Homo sapiens
TGWRHSKIMVIRLPFNVVIIQAQAQNTFKKTFGAGQQWLTPVIPVLGEAEAGRSGGQEFQTSLANMVKPSLY

SEQ ID NO: 957072 - protein, 69 aa, Homo sapiens
CDVSPTPENRMKALFTCNSFYPVYHVYLSTENYNSILKMAENAVCKMTEQCITNQEYSQWQRVYGQITG

SEQ ID NO: 957073 - protein, 74 aa, Homo sapiens
NRISSSYKSSNRHESQETNSFTDAREAYTKLYSCARIRCLAPVFPLLGEAEEGGSPEVQEFETSLANVVKHCLY

SEQ ID NO: 957074 - protein, 61 aa, Homo sapiens
MLSPTPDNRMKALSTAIPFTQCIMSTINRKLQSILKRQKMQFEETEQALEPESVVAGVLGD

SEQ ID NO: 957075 - protein, 32 aa, Homo sapiens
MLTRLCGGTPNDTRVLTPPNVLAGADDSGGLW

SEQ ID NO: 957076 - protein, 45 aa, Homo sapiens
MGLVRSVPDDLIILGPSTVRTPSDDRNEVTGERVYISLGSGIPCG

SEQ ID NO: 957077 - protein, 52 aa, Homo sapiens
VPHLLDDQPYKEKGELLAHVQQRGIVGSHFVSSLDQLHITQDYNGAPKDCLS

SEQ ID NO: 957078 - protein, 108 aa, Homo sapiens
SLTVRNPIELSYLGLALLCMSLSQRKGSFCAATAFFIVVAGRSNVAIVSALAMILIHISHGRSVARTTRLALLVVLPCILIFFAAFLPDIYLEPGSVDAAANLVVVGA

SEQ ID NO: 957079 - protein, 80 aa, Homo sapiens
IEAVSQWRSIEAVSQSVEVYVKQSASQWRSIEAVSQPISGGLLKQSASQWRSIEAVSQPVEVYVKRSASQWRSIEAVSQS

SEQ ID NO: 957080 - protein, 50 aa, Homo sapiens
MRSNPPRQRGIADVSGSRKVSPASGVFSKSFHTSYSRTIPMPDNSEASRR

SEQ ID NO: 957081 - protein, 130 aa, Homo sapiens
SLRGTGASMNALATFLTHRGQINPQTLHLKKEQRSARRCTREDVVMLCKAFVAGIRTNGKFCDFIAGGLWPAQFFNQTGQVSLSKLFPRANTVVNIHTALARPSVNDQHFAAIAHQSLKCKVTTTKEPVD

SEQ ID NO: 957082 - protein, 136 aa, Homo sapiens
IAKSSNHTLYRDANKDATEFVEQKLRDNPWIYPDKNTVATLVPLEPLPLKLERIRTRVWTKVKSGTEPAWHSSLLAEGYMAICKETKADSHQLVTLIKMVEAYEAQRTHGLASLGNDERLLNRIKALLHKHDGGVA

SEQ ID NO: 957083 - protein, 108 aa, Homo sapiens
ASTIATLPASPSCRVEVVAEASALDSRRDSAGDDRSTTSTQGNITCGRPRKNIARRVGDGQGGPRAGAHALDCCCTCALSAAEPIGVSIRKRASRKTGDVDAAADLVV

SEQ ID NO: 957084 - protein, 78 aa, Homo sapiens
MLDSDLQCDISSILHYKKNQNGKGCVRTNPHFCQLMDVQHFGLPGSHLTTEIVLSHVYVNCSKSNVFRGKVIYFLGRR

SEQ ID NO: 957085 - protein, 72 aa, Homo sapiens
MFCGNLAILIHGFDPNRAFMDDSNNKPPTFWQMLHSVMAAAFGVQSGRNRARDFTHGKPSHFVILVDAAANL

SEQ ID NO: 957086 - protein, 107 aa, Homo sapiens
TTTKFAAALNGSGSPALRAQTSGLVGHLVEVTITFFRIDHHPLTVFLQEISVDLSYLQRAVDRRHIQQTHQTVSAVSRVFISTWVPRTPRGREGTGVRVHGLSTAVD

SEQ ID NO: 957087 - protein, 100 aa, Homo sapiens
VDLHRCGVGMVVHFHKVKERSLPPLPAEWVHGETRSGTPSPLIRPPCFRSEWLYSVNGVSIPTTRLKQPVSSDQGRIVEKLKRLQSGIEGLDARRRGREF

SEQ ID NO: 957088 - protein, 40 aa, Homo sapiens
LSRGSRDVSPNNWRIKEMESAYSVIQGDYEGGYELCYVTV

SEQ ID NO: 957089 - protein, 69 aa, Homo sapiens
LLSESRLRVSHSSSFLLNRTASLIPLQYDVCPHKLIHIILAGRGIDLINENHEMASDFTLFASSAEFDS

SEQ ID NO: 957090 - protein, 92 aa, Homo sapiens
MTGKETNIAWVLTTGIAATKQTSLGKKVDPVFTKNLKISQVWRCAPVVPTTQEAEVGGITWVQEVEAAVSCVCCHCNPDLSDRAKLYVKKRH

SEQ ID NO: 957091 - protein, 116 aa, Homo sapiens
YTKPLMKTLMSKGYELNAEKIEHSKAEMQRLIEVLNQKLIANHGRYFVGDRLGLADIAVCSMLAPVLEIKGTPWEKDHEESLSEAFSAYKTYLTNLPLGQYVLRRGREFSSSSRRP

SEQ ID NO: 957092 - protein, 102 aa, Homo sapiens
KLDRPRARLIKKQRAKNHIDTIKNDKGDITTDPTETQTTIRASYYHLYANELATLADMDKFLHTYTLPRLNQEEVESLNRPVPGAALVAIIERYQPKRVRTR

SEQ ID NO: 957093 - protein, 125 aa, Homo sapiens
VIDSNGMDPKNVLDRNGLEWNLFEKNGIEWNDIVWNGIKWNGIEWNLIKWNGMECNGMERMECNGMEQSRIEWNGISSNGMELNGMDWNRMELNGMDKSIMESNRTEWNGMECRRGREFSSSRRP

SEQ ID NO: 957094 - protein, 61 aa, Homo sapiens
QYQRHSAQKEEKNPKIYTGTTIRPRIAKRNPEQTAHQQLEAITIHLTSTFISQQCISQTQT

SEQ ID NO: 957095 - protein, 42 aa, Homo sapiens
RPFFSTETHVTVTTFPRPPDGRGRTTDDLGVVPRYAVDATLL

SEQ ID NO: 957096 - protein, 39 aa, Homo sapiens
LTFGHRCRRCRCRILNGHWSGTSYLRDTAARCVAYSLGD

SEQ ID NO: 957097 - protein, 36 aa, Homo sapiens
KLVVGYRAPSAQLYKVSSRFLGRMKTIAYYPLPDEV

SEQ ID NO: 957098 - protein, 64 aa, Homo sapiens
QKHRAIKSTISNMLIVEVVLDYSTIVRELMDYGVYIVMKNFYDQDSGEEEFTQRCVADRGILYS

SEQ ID NO: 957099 - protein, 39 aa, Homo sapiens
RSARTSHIDCGNYITFPQCYSQEIPNKFLKQSYDSLRSE

SEQ ID NO: 957100 - protein, 40 aa, Homo sapiens
MASEWTRRRTRGSRALIFYLYSIPESGSKSKAEGRCCCCM

SEQ ID NO: 957101 - protein, 43 aa, Homo sapiens
NAPVRSEALAEIGQQVVTSVQVYAMAGTRAAPFSIQLPLNCLT

SEQ ID NO: 957102 - protein, 35 aa, Homo sapiens
AQNRHEGRELISARAALSLPVLKAMVGYSCCVRGH

SEQ ID NO: 957103 - protein, 52 aa, Homo sapiens
STSERFASRFSRLIALEGTGEVMEEPGEDGEVASYPVYAFCRVRARFHGVEL

SEQ ID NO: 957104 - protein, 78 aa, Homo sapiens
MIVRTAGRGRPVSVRRIAWTGVALGLIVAAVVVGPVVLLRHEITGVYSNDPAVRALAASLLLWAALWQFFDATQVCAI

SEQ ID NO: 957105 - protein, 51 aa, Homo sapiens
PVRVTVTLLQATYSCTILEAATLAISTINLPSTLIVFTILILLTILEMVAN

SEQ ID NO: 957106 - protein, 38 aa, Homo sapiens
LRDDNLPENEDSPGSQAWVMPVVSATGEAGVRGLPQPG

SEQ ID NO: 957107 - protein, 35 aa, Homo sapiens
QGEAGGGSLDVGQDPLSVLGGTSSLKKNQPSQPPI

SEQ ID NO: 957108 - protein, 43 aa, Homo sapiens
LVTVWDKEFPPVMGGFPQSAQTGGRQQTCVTAVLATGLLHSQP

SEQ ID NO: 957109 - protein, 105 aa, Homo sapiens
CLAVPALRVLCVPLAAALAVSLAVSARHHSACFLGQSSGAGARGVIAQLRQHSGTVRSHRVAVLGSGTGPSIAPCRSGMSRGTPAGHPSGHACVRGSPQPRHIRH

SEQ ID NO: 957110 - protein, 74 aa, Homo sapiens
GDLEDPTSYHHEVSLRLNVTFDIASPTGYTQCLCCGQHLREKSTSITITNDEGRSSKEYIDRMFQEADRYRVQD

SEQ ID NO: 957111 - protein, 107 aa, Homo sapiens
MEYIERMAQAADIYTAEDEKQQGHGVIQKFTSFLFLQHVKQPDVNDEIHLQGTITDEDKHKILDKCNEYYQAGLISNLNAEKEESEHQQRDLDKVGNPIITNLYQSA

SEQ ID NO: 957112 - protein, 103 aa, Homo sapiens
MTSQRDTVSSMNSLESYAFNMKATVEDENLQGKITDEDKQKILDKCNEIINWLDENQTADKEEFEHQQKELEKFANPIITKLYQSVQEACQEDCPWVGGVYRA

SEQ ID NO: 957113 - protein, 36 aa, Homo sapiens
VLRSMTTFYMGPTKKKEKMVSAAFMKRYIHVAKIIK

SEQ ID NO: 957114 - protein, 109 aa, Homo sapiens
MHDRAQILVETGVVGVPVRIQHDGVTDRRVEDRRAGSSYKRKRKTVIWAWRQDGNCKAGRRRSGWTYSSVMIQEKFEAPSSAVMAILDTRLVGQEDPRLDLQEWQTREQ

SEQ ID NO: 957115 - protein, 69 aa, Homo sapiens
RPYIIRTASLTVYQNRKNGNRVVRTCCLTLNKQEMYDDERDNVVLLVQKHLISKIWDYVSLRSWSSFFT

SEQ ID NO: 957116 - protein, 58 aa, Homo sapiens
LYEDLPLAYQDKIGGGWAGFFCKWAYAAKAGQWTWLTSRSTPSPLLPVLVRADARSGV

SEQ ID NO: 957117 - protein, 122 aa, Homo sapiens
DSLGSPRTTRSMSVSAERAEAGASADWPAQRKKLGLYLQLITSGPTLPPHSWRQRPQAELALPLLLGIDTGWEGAAEDSSLYNMEQKDLYLVGPMSTLPDPRPLREGRAQAHLRLKCTSHGN

SEQ ID NO: 957118 - protein, 55 aa, Homo sapiens
MIHTSKLLGMKRIALRIQRNVHTSSRQYMSSKLPISHICKNPTTAKAPGDINSKT

SEQ ID NO: 957119 - protein, 47 aa, Homo sapiens
AFGERAVALSALMRDVRVSCRWSVCRLVVSLRESQSLVTTVECCVWS

SEQ ID NO: 957120 - protein, 43 aa, Homo sapiens
MTWSAWTAPDKTTPCSSSHTGDRNSTTRWWTTVVFMVTRSYTV

SEQ ID NO: 957121 - protein, 129 aa, Homo sapiens
MVKMTILPKVIYRFNAIPISYQVTFFTELEKTTLKFIWNQKRAHIAKSILSQKNKVGGTTLPDFKLYYKATVTKRAWYWYQNRNIDQWNRTEPSVIMPHIYNYLIFDKPDKNNNGEMIPYLINGAGKTG

SEQ ID NO: 957122 - protein, 58 aa, Homo sapiens
MSQNPNVSYMIFTKDTTISTISKIHMHTWIGQSLPYHTPEDWESPAMPHQIETSNHKA

SEQ ID NO: 957123 - protein, 128 aa, Homo sapiens
ILWADEARFMCQVPCWSLIHSFIHSFCGLVKLTLCARCHVGPSFIHSFILWAGEAHFMCQVPCWSLIHSFIHSFCGLVKLTLCVRCHVGPSFIHSFILWADEAHFMCEVPCWSHIRRRGREFSSSRRP

SEQ ID NO: 957124 - protein, 84 aa, Homo sapiens
KQEQIVTDHSHRTSGSNPTSKTQRAANAQSNLWASRSDSKRVSTSPSRTGPYTLRTDGSDRVVHDFHAHLRCTVPENRSCPEPW

SEQ ID NO: 957125 - protein, 56 aa, Homo sapiens
MNYPTMASNCSGERKRLTSLTLNQKAEMIKLSEEDMLKAETGQKRGLFLRRRGREF

SEQ ID NO: 957126 - protein, 40 aa, Homo sapiens
SRVSPDVESSGQHPQSPNSIFGCIFYTLTAIVRLPAATLG

SEQ ID NO: 957127 - protein, 48 aa, Homo sapiens
MNPPLYQMKTASRSSSRRKSLGGAQRARCPIDVCPGDVEGGTVPACTS

SEQ ID NO: 957128 - protein, 98 aa, Homo sapiens
MIFSNQIIFNGIGSNSYTLGNYSSTSLTSSNTLYGNNLTQNVTFTDYNRDGHMDLLGEDSVYADGSRAGHSMARRRTVPGRVGGQVDAAANLVVVGGR

SEQ ID NO: 957129 - protein, 38 aa, Homo sapiens
MISTRGMPDPLTLRWKLSSQPTIPIVGIVAGLAVLAVL

SEQ ID NO: 957130 - protein, 73 aa, Homo sapiens
LEDKIRDKFEAQNPNVKIHIVGFAKKVGDLIDGLVMVVMFFGIAFVITRCCCCGLPTASQYRRGVEHHAGGRR

SEQ ID NO: 957131 - protein, 55 aa, Homo sapiens
MSPAFSLNGNYFLKQMINGNTIYHNLEHTSKNIREILAVSTYIRKRRKTPNKHLT

SEQ ID NO: 957132 - protein, 50 aa, Homo sapiens
STQKLPMPTIFQVVMAAYWEKFSISNNLPRINLIGYGRRGREFSSSSRRP

SEQ ID NO: 957133 - protein, 32 aa, Homo sapiens
MEAVRLAVIKPGHRTWSLAVRGADSEEDARSF

SEQ ID NO: 957134 - protein, 59 aa, Homo sapiens
IVRVSRHGSSELCWGSSLLLSSELLSMLCLTCVGARPGCGTSSIVSGCFPVMFRYPRRA

SEQ ID NO: 957135 - protein, 133 aa, Homo sapiens
RRLRNGCKCLTIVVQGKEEQVTSYMDGSRQSKSLCRVFLKLQNLVRPIHYHEKSMGKTYPHDSIMSFRVPDTTLGNYENYEMRFGWGHRAKLYLSMPGHSQISYLHISKPSCLPHSTPNSRRRGREFSSSRRP

SEQ ID NO: 957136 - protein, 61 aa, Homo sapiens
MLKENAPVVNRACEGSRLRCPYENLIPIDLSLSPISSGGTIQLQENKLNNAHCFYIMLLGR

SEQ ID NO: 957137 - protein, 49 aa, Homo sapiens
MSAGLHIIVQANHTDCVVRTRSEAFEALRCLSSPIRCRGIRSLDSILQG

SEQ ID NO: 957138 - protein, 41 aa, Homo sapiens
HYLRWSLLPNLVFLCCCLVSSYCSCSRVSFVKFSIDRSRIG

SEQ ID NO: 957139 - protein, 67 aa, Homo sapiens
GLDVQELGVFIDVSADQPRTGDTVDLRMFPRNPFHGTTSQGEFQDEAYDGAGRYDLDHTAFELEQRN

SEQ ID NO: 957140 - protein, 36 aa, Homo sapiens
MPRHRTCSLSVSDGAEMVSRPLHPPDRFNFPLGLKK

SEQ ID NO: 957141 - protein, 53 aa, Homo sapiens
HQFRADKRKRAAAMALVTKQLENAGGADNGQENVDQRKAEDRTWDSKARFTVW

SEQ ID NO: 957142 - protein, 49 aa, Homo sapiens
MRISSYFGKPKLWGDCLSQCEGAMSRDHATKLQPPRSSPGNSRTSCLKK

SEQ ID NO: 957143 - protein, 201 aa, Homo sapiens
TDLTSEIAVLHHFTDSIGSRTRPRRDLAVTLILQRRSTMALKQNLNLSIFVGGETFASKIAGNFSEAISDPTSLGALVASALALFVITFVVDATARLIAAKGVKRRAPPPLTTSPTMADNTPGQLDLSRPSGKRTIKSGCASAFMIVATVLAVIPLAWLVNAAVRRSIGSLFHASCRTTRWILLRLGEQGASTYRRNLEMA

SEQ ID NO: 957144 - protein, 146 aa, Homo sapiens
MSVPVFGPLEAPATSFGPTANPANGLIKVNGRPLEMIEPAPRYQYQLLEPSFAFRQGAICWCRPSVSRVKGGGHRWPQIYAIPPVPFPKPWWPISQKYVDEASQKEIQDILIPYDRTLLVADPRRCESQKFGGLLVPALATQKSYR

SEQ ID NO: 957145 - protein, 177 aa, Homo sapiens
ERKNWASAWESIVETQAVSRPVPGRQLEYGLTRYLDGDLSWRRRCAWEEIAEAVNMEKQPQNSRRGLAPREVPPAVGLLLIMALMNTLLYLCLDHFFIAPRQSTVDPTHCPYGHFRIGQMKNCSPWLSCEELRTEVRQLKRVGERSCKESLPVCSDTSTKSHSQQLTSLEMTDDFLH

SEQ ID NO: 957146 - protein, 88 aa, Homo sapiens
ADLASKRAGIYTALMPSHPARVYMVHNIISQEHHVNADAYHINKLTVIVTHQPVDVYFPRVHFADHRWDVDNGAINGMSRVSSSVVRS

SEQ ID NO: 957147 - protein, 136 aa, Homo sapiens
IHVSTGESFQIKCSLSLKKLAQVLPPSCSFSHLLLLTSISPYCLFFFFWRWSLVLSPTLECNGTISAHCNLRLLGSSNSPPSGSRVAGITGARHRTQLIFAFLVETGFHHVGQAGLELLTSGDPPTSDSKVLGLQA

SEQ ID NO: 957148 - protein, 34 aa, Homo sapiens
SRGFLSLHQLAYPEEDAQSITRKSLKSTLKTSYY

SEQ ID NO: 957149 - protein, 105 aa, Homo sapiens
SLGRACCQAGVQWRDLSSPQPLPPGFKQFSCLSLPSSWDYRYAPPYPANFVFLVETRFHHVGQAGLELPTSGDPPASASQSTEITGVSYRTWPLLHLLSHNKHSN

SEQ ID NO: 957150 - protein, 67 aa, Homo sapiens
RERVKAKNVLKSEVLKMKSVWEDEGLKGKISEAKKKVLDKCKEVILWLDVNILVEKDEFEYKRKELE

SEQ ID NO: 957151 - protein, 66 aa, Homo sapiens
HSLVYVRLLFVFLVSSGVHLRWAGMVSLRALVIPPPLPRRVLGLQACVQWPRPAYLFSLSRTHLVA

SEQ ID NO: 957152 - protein, 48 aa, Homo sapiens
MHDDGDDGDGGADVDGDDTYDGDNDCDDVDGGDGVMTVVMVMVMMVMG

SEQ ID NO: 957153 - protein, 35 aa, Homo sapiens
RHAPLVPGSVAALAGVCGSVRARAARSAAPSFVSY

SEQ ID NO: 957154 - protein, 75 aa, Homo sapiens
LLSHKNVIGGIRHLTSSCSTRHYSEQYTAWYWYQNRDIDQWNRTEPSEIIPHIYNHLIFDKPNKNKKLGKGFPFN

SEQ ID NO: 957155 - protein, 116 aa, Homo sapiens
IRGFRLHCLPRFYFSSSCSPPSTSLYLMHLQPPDANTICIIISMSLSFLALSALHFSISTHFHKMDNLLKNVLVRGRARWLTPVIPALCLKKEVREQVLKSERVSVSHLRGTKKWS

SEQ ID NO: 957156 - protein, 33 aa, Homo sapiens
MFGQERSVCSYIFSDLLRSRARKEMRFCMTAAG

SEQ ID NO: 957157 - protein, 59 aa, Homo sapiens
GDSEDPPHHHIIIITSSHRHHHHISSVINIDPPLSSTFTYAYILLHLIISITIIIIITI

SEQ ID NO: 957158 - protein, 48 aa, Homo sapiens
AANFVFLVRDGICMLPRRSRTPSSVILRLASSLHTGVILTLPPRTSLR

SEQ ID NO: 957159 - protein, 57 aa, Homo sapiens
ETIKIPADFGSEYSHLPEQAFYMVEPIEEAVAKADKLAEEQFIVRGLCPLYCLSPSD

SEQ ID NO: 957160 - protein, 55 aa, Homo sapiens
TDPPPAPWVQCQVGSLTGCWYTFTLVTALCLMCELSVGHETYPLDAVEHIHLLHA

SEQ ID NO: 957161 - protein, 43 aa, Homo sapiens
MLLPVSSPLSLRCPVLLSQGAVSVWSKLCAELEWQLRPVLGPL

SEQ ID NO: 957162 - protein, 75 aa, Homo sapiens
TPVADDREHAICDHQQRTWSLPLTQRKGTENLDTVSVSGQSNNGIWSEKAEGTGDLELILMTGGRRDCERALPIL

SEQ ID NO: 957163 - protein, 76 aa, Homo sapiens
CFKAGGWGGSVRCTFKLQMCRVGKASDMARSAGRAFQAAGTVQHAWLFPRLADSSVPRLGSQGSVAMFCGVAAGQQ

SEQ ID NO: 957164 - protein, 67 aa, Homo sapiens
MHAGGCMLMLVEQLELELVVAELVELALVVTMVEQLEQNPGAAGGAAAVLVVMMVMVMMVAVLVVMA

SEQ ID NO: 957165 - protein, 36 aa, Homo sapiens
QEEVYWYRMMSLTSSKAKELNGPGTWDFPDVISVSG

SEQ ID NO: 957166 - protein, 40 aa, Homo sapiens
SCMCAIDVITYRLYDCDDVMVVWCDDSGMGWDDGMVGYEL

SEQ ID NO: 957167 - protein, 55 aa, Homo sapiens
VLLSICCLSWPLGRRVKSGSRSESEVKSKCPGTRAPVVGYKNRSLVAWELVEQSM

SEQ ID NO: 957168 - protein, 155 aa, Homo sapiens
AIYCTHDNLVPLSVIGPAILAPDPPKRLILLMSQAPLVLVDGSSYLYRAFHALPPLTTSKGLPTGAVKGVLNMLKSLRKQYPNSPFAVVFDAKGGTFRDELYAEYKANRASMPDDMRVQIEPLHQSVIALGFPLLCVEGVEADDVIGTLARSSAA

SEQ ID NO: 957169 - protein, 42 aa, Homo sapiens
CITTITATIITITIITTITIITTIITIIITIITSIATTIATT

SEQ ID NO: 957170 - protein, 53 aa, Homo sapiens
DDSDDGDDGDDNDGHDCLVMVMVTVMMVMMLKVVMMLMVSDGHGDGGDDPDDG

SEQ ID NO: 957171 - protein, 43 aa, Homo sapiens
YIIAIIITITIITITLLNLYFYATLNLLHLIMTITIITIITIR

SEQ ID NO: 957172 - protein, 41 aa, Homo sapiens
IAIIITITIITITLLKFYFYLTPNLLHLIIMITIITIITIR

SEQ ID NO: 957173 - protein, 67 aa, Homo sapiens
LLLRGYIYYARNSSSSSHHNLLESGVCTHLTSVCQPLCAHGKTRTPPARVGASPPPHLLGREGPSLS

SEQ ID NO: 957174 - protein, 32 aa, Homo sapiens
PPKVVAALLAVCLPAFLILPLPGLLTYAPDQS

SEQ ID NO: 957175 - protein, 84 aa, Homo sapiens
AWLRILLCDEAVSERHLTLKYPIEHGIISNMGRHGVNLATDLLQCSCVMAPEEPPVMLTEARAEPDEAKRKTMSQVSGPARHFW

SEQ ID NO: 957176 - protein, 61 aa, Homo sapiens
VLSLAYIHGQISYQSTPEFLPKPRDEVVLLARAICKSYYYPVRAMPRTSGISIMIRVTDQR

SEQ ID NO: 957177 - protein, 41 aa, Homo sapiens
MVLAMTIKRCHEAVCAMIAAMSPPPYLQPGLGSSSRVAAEA

SEQ ID NO: 957178 - protein, 60 aa, Homo sapiens
EDPGIVDDSDDNSDDGGDDVMVVIDGDGDYGGSDDGDGNGSGNGGDDGDDNGDDGGDDDV

SEQ ID NO: 957179 - protein, 82 aa, Homo sapiens
YVVMTVMIMVMMVVMMYGGDDGDGDGGGSDGEVIGMVVAIGGDDGDDNGDYCCDDDVVVVTYGDGDDGGDDGGDESFYISED

SEQ ID NO: 957180 - protein, 54 aa, Homo sapiens
SDEVMIGRIDDNDGMIVVVMVMVTVMMVMMLKVVMMLMVSDGHGDDVVMTHDDG

SEQ ID NO: 957181 - protein, 43 aa, Homo sapiens
MNSSYLPVSKRITYQPSRKSIHNVVDSYREISYREARGMIVYP

SEQ ID NO: 957182 - protein, 156 aa, Homo sapiens
ASAHASGFFNFYFYFEIIVDLHAVEIIQRFHVPFTQFPPVVTSCKTIAQYHNWDTDIDSCDIEHFHHHKDPSCFSQPRPILSHPHPLLNTATTNLFSISIIMSLQERYINGIFWYKTFLNWPFSFSIILWNYKLLPVPIVCSFLLLSSTHGMNVLW

SEQ ID NO: 957183 - protein, 103 aa, Homo sapiens
MGIPDWSLRLSSQRPHRQGQATPPGPGHTARAGHTAGARPHRRGQATPPRQATPPGPGHTATAGHTAGACLIAPQSGMLCTASEGESLSITKENRKRSLTAQG

SEQ ID NO: 957184 - protein, 104 aa, Homo sapiens
THGPELLDLSLLHFVLFSFPCRERGCGLRRHHGGQQGGPQAPPALLGSAYAADRSGDYRHASPHLANFCIFSRDGVSPIGQAGLELLTSNEPPPRPPKVLGLQA

SEQ ID NO: 957185 - protein, 127 aa, Homo sapiens
TRPAVQTPQLYTTFLPPPEGVPPPELACLPTPESTPELPVKHLRAAGDPWEWNQNRNNAKEGPGRSRGGHAAGGPAPRVLVRPPPPGCPGQAVEVTTLEELLRYLHGPQPPRKGAEPPAPLTSRALP

SEQ ID NO: 957186 - protein, 81 aa, Homo sapiens
FRQPLGTYALKKVDKTQIRSIQEVPAPVLSSLSVPRGVRDSRHPSLDHARHVERLQLLVSCPCHISMLILFNKKARSELEA

SEQ ID NO: 957187 - protein, 113 aa, Homo sapiens
SFVPHWEVTGLSVHRNDRSAGSKSRPSMFPANRKLRTLQNHKSSKSRLSREDRTQGCAIPPPGTAFLRLTLRPVNDVQRILRLLSQKHPDSFHTPAYVFKYLILLGEMRTDNT

SEQ ID NO: 957188 - protein, 47 aa, Homo sapiens
LLGIDIVILIISRRPLARSCIRFFIFISILFLTITFFFLLLFLPTFF

SEQ ID NO: 957189 - protein, 102 aa, Homo sapiens
VVNRRAIDRCLCLRCAAKSNNANASTGITGILFIGHHSRGLLGVYAARLKLRIGGATTILVTHHKVRISLTFFEHDFPLVLVLFVVFNRMHRLTTRREQDTP

SEQ ID NO: 957190 - protein, 52 aa, Homo sapiens
MSCGMWIRPGQWQRRACDHWREPHHSPRTPLHSLQPYARYTERSHPIHCTDM

SEQ ID NO: 957191 - protein, 68 aa, Homo sapiens
NRLCRCSKGTCGLDGYGYYDSRATSNIAITSRKFDSAVRPEESSSEGILQVFKSTPQLGTYTEDCNMS

SEQ ID NO: 957192 - protein, 73 aa, Homo sapiens
TKASAPATPSLYSHEYFTSYYFVPVLQETSPLPNLTNDSVLSVYIRYLTEARQNNSLPFLMVKYCNTICLQCR

SEQ ID NO: 957193 - protein, 70 aa, Homo sapiens
LIFDSPLTEIEVALASCRLYPTQAMLMPLSRFLCCVSPAGHTVPHSPSKALACPLPPSPPWLAAYLSSPT

SEQ ID NO: 957194 - protein, 36 aa, Homo sapiens
YTPSITSTSCANHFSMQHSQHMHSQHHPAASPLSHK

SEQ ID NO: 957195 - protein, 76 aa, Homo sapiens
NPKMCAITANQDRPGQCKALDHQVLLDHLSQVRNPSSACASHITFIVPPFRLRRLHPSATLRESRVNGFFCSRQSS

SEQ ID NO: 957196 - protein, 31 aa, Homo sapiens
MSFLVPGESRMSAGLHNSPENGLDNPGGNHA

SEQ ID NO: 957197 - protein, 105 aa, Homo sapiens
TAEWSNYYCIRLPFADTINSVCLVNATRMKITSHNRFYGPNELIDESAKISSPSFLGTGLAWALSCALSASCNHPVRLSKSLRRRIILSSTKYLHYRICMHLLAI

SEQ ID NO: 957198 - protein, 38 aa, Homo sapiens
RIYKISSQWVRDPYNKIYALQQRTNGAITPVIDKRRYL

SEQ ID NO: 957199 - protein, 105 aa, Homo sapiens
MLASLVIHLTHSCCAFTGMLSEYTGAKDIAIRQDRHSPQFVKEADNKSANESDNCRQCSSDLKNLEVHGECRVICRCWSVPLSVVKEGTGRRQRYAPNSSLNSQR

SEQ ID NO: 957200 - protein, 105 aa, Homo sapiens
MIRDRAEGWESQGDQSLGPFKTSSSSGRDSHPYPSTQIIPGSSGGVCWGCVQECSESTGPEVAGGMMWTPGCLAFLLLTATSFLWEIVPPQFLVVHGTRLLSLAD

SEQ ID NO: 957201 - protein, 45 aa, Homo sapiens
MCASDYSVIIRPKYQEDQCCVNPTLDVARYFTYLCFVSFSVVPNN

SEQ ID NO: 957202 - protein, 59 aa, Homo sapiens
CIIFHDIIFPFCVTVSFSSLRLDILQTQRIRSGIPCVICCRLINNTSPLSVDMNVESPR

SEQ ID NO: 957203 - protein, 34 aa, Homo sapiens
MADGNGTAVVVVLTDVDLDLSLEHTEFPQARLPV

SEQ ID NO: 957204 - protein, 42 aa, Homo sapiens
YCHHCSESLFGKKYILREREPLLRVCASETLFANTCAVVWER

SEQ ID NO: 957205 - protein, 107 aa, Homo sapiens
MYRTAEWFKRILHYTALSLHVVDILNLSVYRYRMKITESIMYFRAQVTDRLSAKNLFTIFPGHWSCLGAILYLGEPVVITQDIVDDFESEIIFPQNTFIINFIHFWP

SEQ ID NO: 957206 - protein, 112 aa, Homo sapiens
VFTSEQEMSLQKIAFTSLGACPGFQLELNRMRNFDLDRRALCHPQDAPLPGCCQGLKEGVEVMDHRCFIRAIIRHSDLITKEASFDYLQNVRERLLLAAMRELGGMRRRLPL

SEQ ID NO: 957207 - protein, 66 aa, Homo sapiens
YCSNFLTLHYAQNRGRFKLLTLTSQINEWAKKHLYGSMEGMRETRHSRVLEECTEYRVPGIPMSQG

SEQ ID NO: 957208 - protein, 45 aa, Homo sapiens
MTLIRSCLVSVLQLRYSPALTLTVDQSRPHSSVSDVAPDPRSIKT

SEQ ID NO: 957209 - protein, 72 aa, Homo sapiens
TNLRFTRKRSNQRLILESTLRNIQNKVVIGYRWWWNISVVNYCETTLDDETNSKRLPYHYFEYTTNTTTIAY

SEQ ID NO: 957210 - protein, 83 aa, Homo sapiens
CRISNKLLVIDVFIVKAPYKLRIKQVVPCGSMDQSAFAAAASNAPLVMYRIIIVYRDVMTGYAIADAVRSVIFFKQINDQQFI

SEQ ID NO: 957211 - protein, 50 aa, Homo sapiens
CVITHDIYYAIHSDILSIYPPIHLSIYPSIHPCINPSIYLLIHLPIYLLI

SEQ ID NO: 957212 - protein, 37 aa, Homo sapiens
MQRIGRKRKTYSTYKSIQVTTHLRNDRTATDGQHDSI

SEQ ID NO: 957213 - protein, 53 aa, Homo sapiens
LVTYSKQGDVQWGPSLPSFLGGVDPSQVGELRVHLRRPALHSPACGKSSARLL

SEQ ID NO: 957214 - protein, 40 aa, Homo sapiens
ARIPYFDPGVGSVQSLEVEAKWGAGRREREVTGNRESLLV

SEQ ID NO: 957215 - protein, 40 aa, Homo sapiens
DHVSQQEAVQWWPKPPSFRGVLIQARCSELMSPPMTPSIF

SEQ ID NO: 957216 - protein, 44 aa, Homo sapiens
SIFSSISSISFSFAASCSNGLCNFQHRHSPGIQPTSATRMHVAG

SEQ ID NO: 957217 - protein, 38 aa, Homo sapiens
KTPMLKNVAHIGIAVTPLGPSHELYRKLHGAAHSTVAA

SEQ ID NO: 957218 - protein, 51 aa, Homo sapiens
VIGVVKDRTCSFMSMGTMRITWFMPLISVSTAIGLGGLEQAGILDLYLNVV

SEQ ID NO: 957219 - protein, 119 aa, Homo sapiens
HGRHFRCGESGCRVMAQQADHVRLHAGAEDHLQILGHLVVGLAGFQAADQLKTALEQGRRQVIALQLLAQQHAHRAPCTGNRNHAGSTDLWGCQAGDHCAFTVPEHKHLAKARVAFEFL

SEQ ID NO: 957220 - protein, 60 aa, Homo sapiens
ALKRIQTEALLLQSSSHPYPKTRSLASWSLQQKKLITLRGAPPAKEAQLHRKPGQRASRW

SEQ ID NO: 957221 - protein, 59 aa, Homo sapiens
MSLAWPGPFLFRPCYVFFCLTTTLPLDGTGTFLVTLSGSGFVLAATWTAVRGFVWGAPL

SEQ ID NO: 957222 - protein, 62 aa, Homo sapiens
GVKRRGNIQAAEVAVSLHYAAAFYFSIGNSRGGEFRTSAYSLSSDNPYSLISMHHTIYWRYR

SEQ ID NO: 957223 - protein, 56 aa, Homo sapiens
GLFLFRRAQFSFACSSTPHGWPCLPFLCIFLGQGLCSLLHLAAVSGLLVGASSQRR

SEQ ID NO: 957224 - protein, 60 aa, Homo sapiens
WLPPAAMGSRVHESCSFWAGGSWHSDAPFTPILLTPMLSYQCSTTLVCSALQQCLARMVP

SEQ ID NO: 957225 - protein, 103 aa, Homo sapiens
SLDADSSQVKSPNIEENMLSQNALEGVARRGDEHQETECAVEAMQSIEMDEENSASQTVCACYSFFSVVRMLRSLPSGGSSLGCETPSTTLSPVVRTRPVLDS

SEQ ID NO: 957226 - protein, 116 aa, Homo sapiens
SFGLLVAELEACLPDSSISAYNIIYFVGNVVNAYEVFVDKSLAMALSLYVGFQQLYLGIAQHKKTGAYPFAGHRLYFIMVFAEKLPEEFIGLPEMLHGNADVFYFFEHGCFLKVQK

SEQ ID NO: 957227 - protein, 76 aa, Homo sapiens
LYRLTSNTSIHELHSTHRFIKHVIKVRRKQSRLPKIKRTLGSEIQQALKLRNAYRQPPKRKKVQHRSIDIGITPHN

SEQ ID NO: 957228 - protein, 33 aa, Homo sapiens
HVQGGACEVVTLTSRQSPSRNQLLAWATYCLVA

SEQ ID NO: 957229 - protein, 113 aa, Homo sapiens
MTRTPEMTATSLNGRMNGSEKVKQRWYSPYRTNCPLSDRGIEMYVVVEGCTSRKRGGLGVQIGDGITETKPAKRGRKRNKVGDTIFRYGLTLNPRDNPFLTSYHRQYQNNMKK

SEQ ID NO: 957230 - protein, 118 aa, Homo sapiens
EAALEDPLLATESEYCAGSRRGRMIDQERLQRKRKAPGQCRREWDAEKTDGMFTDGPVPAHEPSHRYDDQAWARAPEAPQLFGEFLSQHKAEASSRRRRKSSRPQAKAAPRGLQVTIE

SEQ ID NO: 957231 - protein, 98 aa, Homo sapiens
MSDLIWDLETQLLGDSKRTVLDWTNGSGHQKEIQGHPQNGRNLGFPEVESREETFNKTSIYCTRLRMCQARVLDPRSQKKKTKKQVQQAANHKILTGE

SEQ ID NO: 957232 - protein, 78 aa, Homo sapiens
CDAVFLCRLVALLWARLQDTTKVINSVHIKQSRTYRLATGSDDNCAEFFEGPPFKFKFTVGDHSPLCQTVCDSLLMGT

SEQ ID NO: 957233 - protein, 95 aa, Homo sapiens
HSCLDIRRISSDLFIEINIWLTTDRLSTIFFGIHYISLSSKEIFPTELLNVYDRNISLSRYRVLRIRHFVALILTRVIAISSSRILRRMLIDFNL

SEQ ID NO: 957234 - protein, 73 aa, Homo sapiens
DLVDAVEVVRVALFRIGDEVVGRIVVHHQAVLRGQRAGVRQQHLRLRGGTAGGDAHDVDVAVVEAERVEVADH

SEQ ID NO: 957235 - protein, 47 aa, Homo sapiens
MILVVASSKDLWASDRDEFVQRSIRTTRRSHSVLSDMRLALTIYNHS

SEQ ID NO: 957236 - protein, 86 aa, Homo sapiens
AEANIGVPVRPFPRWMRCVKCGLLSPFDTGLFEIKEHRFRPERTRFVHKSCRGSKGDQPAKDPDAVPARFLLACRNGHLDDFPWHY

SEQ ID NO: 957237 - protein, 71 aa, Homo sapiens
MLDLGYGFDLKYVPAFVFFESIPYVIVPRYVSCFVYFGIYVRAWEEMDRNYFRIDVIVPTCLGIVEHNTTQ

SEQ ID NO: 957238 - protein, 46 aa, Homo sapiens
HRIVTIPKSVCSPMPVSRRRARPRCPREGRSLFMRSWSIEWSVNAS

SEQ ID NO: 957239 - protein, 94 aa, Homo sapiens
PLVDSLLSASPFLHPVGPHVPVALSPRAENLAEEIDGEGVVTHVGGDLVPPEGRTERARADKVFENSVASPPDGLGPTAPPPAFLTAEAIDVAA

SEQ ID NO: 957240 - protein, 77 aa, Homo sapiens
CEGRWDPGIRSGIHLSSQRPCRPVALPVRPPGGTQISTHVRDHPPPHQSLSEILAEWERATGPWGPKEGEKGLADEQ

SEQ ID NO: 957241 - protein, 59 aa, Homo sapiens
VWCYDSITLTSTDSNQNHKLICRVKELFLIGAQLNVGVMAYTDGYSLIPSVLLTNTDGI

SEQ ID NO: 957242 - protein, 49 aa, Homo sapiens
LASTCYFNFHLHVCLRCSVGASISAVCTCQAMPSLATWPVCISPHVCSL

SEQ ID NO: 957243 - protein, 114 aa, Homo sapiens
SLIHSHMTPQYPRSGRRSIEALQARSSGHHQSHLYTPPCTGYPHSPPPSLHGKGEEASDIRGPIPVDNAIHIPTEYRTCDPSWSQPNIRSYSGACTPGMKSHLWGKVPTRTIPT

SEQ ID NO: 957244 - protein, 62 aa, Homo sapiens
CAPSTPSHNPATPRKFWGYSPDGPILATLHPPIHRSPNQTTVTTPPTSIPPGRYTPQSILAR

SEQ ID NO: 957245 - protein, 53 aa, Homo sapiens
CRCAALYSGQRWARGGCGSLVVWTLRRRSGSPGDLLRPVPATFRRPCASGGRG

SEQ ID NO: 957246 - protein, 88 aa, Homo sapiens
MILKGTLDVRLLYRRMNECEAKFTGFVDADFVGDLDTRRSLTGYVFTLFGCAVKLESSTTSCSQVHCHNKRRKGISLVEGIDQCTITP

SEQ ID NO: 957247 - protein, 78 aa, Homo sapiens
MSMHEQLGKFTIAFCNPHLKYGYVRPKLCLDDRVCLKTEFGTYGGDDKAHHIAFFLGFIATTFDNAVVKIVLPITPHN

SEQ ID NO: 957248 - protein, 63 aa, Homo sapiens
KSRHTTEILGYSPEVPSWPRYLPPFTCSPKPSHDLPLPQNSIPHVTDTPSSLYSAREYHLDET

SEQ ID NO: 957249 - protein, 64 aa, Homo sapiens
HRCGLERAALRILGWGYHWLGLSLRYAGLGKRLAAAWREGFGFLVLVGLSWSLSVGVYGVSSSP

SEQ ID NO: 957250 - protein, 38 aa, Homo sapiens
NLVTHGCHDRRCSYWTTGTGGDGDAYRSTSPLYGTCLG

SEQ ID NO: 957251 - protein, 37 aa, Homo sapiens
MCPPRSFTYPHTTEIRGYSPEVTSGHARSPHYTDPRN

SEQ ID NO: 957252 - protein, 89 aa, Homo sapiens
MQKSKQQEQAASSKSKQQTATSNKKRKDKDCFPCLLNTTSFFSPMSQGSNFNSSSLHYLNKYISSRLIAAHKYMHFSAWGSLSSEFCNP

SEQ ID NO: 957253 - protein, 33 aa, Homo sapiens
MLARRVRVGILLGEAPVVCCFSDRAVVWAWRGV

SEQ ID NO: 957254 - protein, 31 aa, Homo sapiens
MVALPTLLASRTLLTPVPIHSSHHFIFTWRL

SEQ ID NO: 957255 - protein, 41 aa, Homo sapiens
PGAHIMAAGSGGGQGQHTSQPPVGLSRASRQGALFRVSLHG

SEQ ID NO: 957256 - protein, 66 aa, Homo sapiens
MQAELTLGDTALCSPFSPLVPRPWSLPSAENLAEGLVGRGVITHVGGDLGAPVEAWTEKGHGRDNG

SEQ ID NO: 957257 - protein, 53 aa, Homo sapiens
YCEKGVSGRCYMERVGGGGEPTISPPVGMSRERGEVALFRVSLMGGGMAERGV

SEQ ID NO: 957258 - protein, 49 aa, Homo sapiens
LRDVENRAVGILSTTYLSVYPGHWLSSSGCFRTCFFQSAMADSLRIRMS

SEQ ID NO: 957259 - protein, 69 aa, Homo sapiens
SFTRIRHTTEIGDTPLEFSILATLPPPHSPDPANQAMIYHSPKLHPSWADTPSSLYYARVLHLRENPPP

SEQ ID NO: 957260 - protein, 48 aa, Homo sapiens
IYHLTHEGHPERGTLHTLPRLSNMGTGRRLRSPPYPLHDIQRLVTPFS

SEQ ID NO: 957261 - protein, 41 aa, Homo sapiens
LISGGTGFEADYGIAWGSPTAQYPPRTGVNVDSRRKGELDS

SEQ ID NO: 957262 - protein, 105 aa, Homo sapiens
MSTLAMKLALRNRVRRLLSVINLNCYWVNLVVAVVNFPNKQIGPIQSECLVTGFHDSDAGVVLCVPDTDVPDRYQATIIEKEKPKLSLGFSLEQSDPTIATIDET

SEQ ID NO: 957263 - protein, 79 aa, Homo sapiens
QAEPDPRWTPALCHAPILIPWFPTVLVGLSRSARISLRDWWGGGGHCTRVEILVPPEGRTGRARADKVFENSDGIPLLM

SEQ ID NO: 957264 - protein, 152 aa, Homo sapiens
HGARIRSDSIQSNVLVPLGEYIPLSGLLKWVLTAMQNDPSISGFSRGEQQQQPLSIHQQHLGASICYEVAYPNLTRLNARQSDFLVTVSNDAWSPGTAGPLEDLQMVQMRAKENGRWFIRATNTGVTAFIDHQGPIVERAPQDVATVLRWRT

SEQ ID NO: 957265 - protein, 33 aa, Homo sapiens
GETDVVGECMGRDERTGEAARWASYHLSSIDVA

SEQ ID NO: 957266 - protein, 77 aa, Homo sapiens
VPDGRSLSQPDQQSETPSHKKKEKEKRCDHGVTTTTKILIGNGPIIYKDFYYSCHFPFKIPFPFGGQVKKNQYSDRP

SEQ ID NO: 957267 - protein, 50 aa, Homo sapiens
AAVIHSYHSNMTYSSILRVLDGDRYEGPFKPPHLDTTNPTCHTLRSHEVV

SEQ ID NO: 957268 - protein, 46 aa, Homo sapiens
LIEIKRDIERDSPKCPTVTKCAEPRIILQKLTLILKTRSDTNGVWL

SEQ ID NO: 957269 - protein, 45 aa, Homo sapiens
YDIRPLMYCQNNYTSVMMWPCDFHDFPSVPSDSLHTSVYTRFLTA

SEQ ID NO: 957270 - protein, 52 aa, Homo sapiens
LFLQSHIDSERGWDTWAEEIPWLILNLRLKSMYHQSNHLSAPDPSSTLYDCG

SEQ ID NO: 957271 - protein, 39 aa, Homo sapiens
MLRRPCLRPPRSLFHVYPPAVYSVSWSSLFPSVTDGPCY

SEQ ID NO: 957272 - protein, 91 aa, Homo sapiens
LVASTVLQSGDEPDSVLTKRKKDLNVRPETINYKKKHRENSSEHRLRQIIYEMKYHDNTGNHKQTVDNMEITFKLNNLLRLQTEICTRDRT

SEQ ID NO: 957273 - protein, 69 aa, Homo sapiens
PVTWCYISSLSGRLRRGGGTMAIMERDATEFSKTLSCPGPSCPGLLVGHQYLHPDAVSTTLPTNPSARF

SEQ ID NO: 957274 - protein, 124 aa, Homo sapiens
DHCTHCSFYLLGSCDPPTSAPVIARTTGMCHHAWLIFKLFVEMGSPCGCSVLVSELSRLNVILSASASLKGLQSRSRCTWAYLEGHFLKNYILFQSFGLLIGSTPDHFASKNNSLGYRSSEIRN

SEQ ID NO: 957275 - protein, 50 aa, Homo sapiens
SEGVYTTPRLVPFGEYIPVSGLLKWVLPAMQNDPSIRGYFTVVNNSNNRF

SEQ ID NO: 957276 - protein, 47 aa, Homo sapiens
FPFSSVTFTRNVAGTWADVRSQAIPNLRLKIQYHQSNHLSAPIPVRP

SEQ ID NO: 957277 - protein, 38 aa, Homo sapiens
MPDRKGQGGQGLGELGGIRLLMAVVPTALPQAFLTAER

SEQ ID NO: 957278 - protein, 49 aa, Homo sapiens
GSSWDRGKVVTLVVLDLMAEIRDRLGISSAHYPPVTGVIVTLEEGGIDV

SEQ ID NO: 957279 - protein, 53 aa, Homo sapiens
LVGAVDQRIRSGMHRVLKTFRPWPFLSGLQGHRSPPSVYHPFLNKSLSEILAE

SEQ ID NO: 957280 - protein, 55 aa, Homo sapiens
LLSVTGWLSGLVCDSSAIMELGCHLSSTKTLYLPCALSCTWPSSGGTMILHAMCC

SEQ ID NO: 957281 - protein, 50 aa, Homo sapiens
LSRKAEGWGGGTQAIRSVVHRVLKDLVCLAFLSGLQVAPDLHPVRDHPSP

SEQ ID NO: 957282 - protein, 82 aa, Homo sapiens
SFTQDPPHHGNSVDTPQRFPSGHAPPPIHRSANRTHVTTPSCSNPLEDDTPSVYTRTRLHLVKIPRPESTLPRPTPSMLGSV

SEQ ID NO: 957283 - protein, 46 aa, Homo sapiens
GAVWTQAIHGAGMPRCSQMTLFVAMALPVLASMWGTMISTQCCDYP

SEQ ID NO: 957284 - protein, 43 aa, Homo sapiens
TTGDLSSLDICKCRCIDLIPHNRTVDTVWMAVDESCDKPAENP

SEQ ID NO: 957285 - protein, 47 aa, Homo sapiens
TRSASTTHYGHPEHGTSYISRDIPTWVDWTVGYPYPPPTLYHDITAP

SEQ ID NO: 957286 - protein, 33 aa, Homo sapiens
AQLYSSAGQIIVVEFWDGSGSEGGTVVHATIYL

SEQ ID NO: 957287 - protein, 39 aa, Homo sapiens
MAWGVGGVPMAIMELGCHAMSSNDLVLPWPFLSWPPVWH

SEQ ID NO: 957288 - protein, 33 aa, Homo sapiens
ECGGYWAEEIPGDRTPLKSSTTRVTTLLPLIPA

SEQ ID NO: 957289 - protein, 38 aa, Homo sapiens
CLVVCPPSTPFIQESATPRKFGEYSPEVPSPATLPPPI

SEQ ID NO: 957290 - protein, 46 aa, Homo sapiens
LSVCPPSTPSTNPPHHGGFGDTPQRVHPATLPPPITPDPRNQPTVY

SEQ ID NO: 957291 - protein, 103 aa, Homo sapiens
RSLSIKDDTQIVSIQSPVVVAKINFFLFFFFFFFFLFFFFFFFFFVVVVVVVVVIVETIREYVLCNMVKIEIHSLCMGNCCFRVNDIARNEFDEIHGNLSLAS

SEQ ID NO: 957292 - protein, 42 aa, Homo sapiens
AVAASYHEQRRYNEVMVECLGRGERIRECRHGGPRYHLSSID

SEQ ID NO: 957293 - protein, 34 aa, Homo sapiens
WKIDCSVAHVLASRICSPRSKHSTHHFIFTCAGC

SEQ ID NO: 957294 - protein, 94 aa, Homo sapiens
KSIHSYHSNIDLPQYPSIPGRRSDPEAPSSPLTVDTTNPTCHTPLAPGLHPLPLPRSTERGRSLGNKEAHPMGTTPSTSRPISDLRPSLDPNPH

SEQ ID NO: 957295 - protein, 35 aa, Homo sapiens
MACGPRVLGKVSRGATVEECGVGKLSCRMSKIDVA

SEQ ID NO: 957296 - protein, 53 aa, Homo sapiens
AADHVSPSTPSYKSATPRKFGDTPQRSIRPRSSPHSPDPLNQPTVYLLPTTSY

SEQ ID NO: 957297 - protein, 34 aa, Homo sapiens
ILENRWYACHVPASRYRHPCPKHSTHHFIFTGGC

SEQ ID NO: 957298 - protein, 43 aa, Homo sapiens
PRVYDSGTWLGTGLRRSPGDFEPPPQIQCHQSNHPTAPIPALT

SEQ ID NO: 957299 - protein, 41 aa, Homo sapiens
AGPRSIDGECAGVVGTVADRLCQGVDAVRCGDEDSAHACRP

SEQ ID NO: 957300 - protein, 34 aa, Homo sapiens
RETGSHSYARETIPTGGLDVGSLPPLSLLHDIQR

SEQ ID NO: 957301 - protein, 36 aa, Homo sapiens
RAYSERAGQMNCGSSVWDGLSGCGSAARVAHATIYL

SEQ ID NO: 957302 - protein, 43 aa, Homo sapiens
ITPERGGYWAEEIPRRSRTYRLKYQYHQSEPPYCPDPRLDTYM

SEQ ID NO: 957303 - protein, 38 aa, Homo sapiens
MYDNLAVSKRHLVHSSKAVDTPATNLNKRPEYTAKVGL

SEQ ID NO: 957304 - protein, 35 aa, Homo sapiens
QWKIDGRVATVRPPHPLTVSKHSTHHLHLHRAAAH

SEQ ID NO: 957305 - protein, 75 aa, Homo sapiens
IQSSRATMPGIDDAFFSSPSETDAFNVMSQLPFLPFSKPTIDEATISAVGDVLRSGWITSGAKVQAFEAQLSEYF

SEQ ID NO: 957306 - protein, 57 aa, Homo sapiens
HTLQLISDEGCEVIAKSDLVGMAAFLTINNIYYSAVPAKSSMCGIVELRLLRRGTAL

SEQ ID NO: 957307 - protein, 54 aa, Homo sapiens
LSGSPPQHTQSSPAEERPSSPYSWPQLSCCYGLLPKIERSASAPSLHRTQADEL

SEQ ID NO: 957308 - protein, 46 aa, Homo sapiens
RSWNKAGADRLRPQKHRPLRQEHTGSIEAGGGKAAHPEACLSDETA

SEQ ID NO: 957309 - protein, 43 aa, Homo sapiens
ARNAFFLLMRNIIRVAVLDKGTDFLFLTVKYSFILWETRRIKL

SEQ ID NO: 957310 - protein, 50 aa, Homo sapiens
KIARYRQHRRLTHTFSTPGPVPAACGGCATVYAQLTGGNFSISFLFKISP

SEQ ID NO: 957311 - protein, 107 aa, Homo sapiens
NLEYPALHGYSSSIEEAFSPEKASTFLPPNAQLTAFYIFYYSADSFWFISVSLTLLLLLLEMAGPVNEKHPNFHSNVHMFHIPQSFYFGLKSYCFIQHDSPGFEIIS

SEQ ID NO: 957312 - protein, 53 aa, Homo sapiens
EPVRLRGWSSSRSRVVSAFVVDLAAATSRHPVDEVEHVLPAAGRELLVVLAVV

SEQ ID NO: 957313 - protein, 37 aa, Homo sapiens
TETHHHKKKNLAAKRTEEKLTKKNKPGKKDPYKFFPP

SEQ ID NO: 957314 - protein, 63 aa, Homo sapiens
FAERSGSVFQSHIIAGRNKAEREVGVGGLEVLVEQAVDGCLHVGGIILTNLGAHGLVGEKELT

SEQ ID NO: 957315 - protein, 32 aa, Homo sapiens
MAVAGGAQGLLLRYELDQQVRFTPVSEDDYRQ

SEQ ID NO: 957316 - protein, 71 aa, Homo sapiens
SWYGLIFWHTLGVELPGQMATVQLPEELLDCFPKQLHHFTFPPAVYKGSDFSRSSEDTIFINIIAILMGVK

SEQ ID NO: 957317 - protein, 69 aa, Homo sapiens
IVTRNPAGDTPLGTYGLIAALAGLHYGSEKLLPLGSFVLALYLPCALHIVRGVRQPARRARTQSAEASS

SEQ ID NO: 957318 - protein, 37 aa, Homo sapiens
VTSSVNRILSSLFPGVNAARASCNSLSSLFPVYNDGP

SEQ ID NO: 957319 - protein, 49 aa, Homo sapiens
SLTGPILPIEYTIARHLRVVSPGWARWLMPVIPAFWDAEAGRSQAQEDK

SEQ ID NO: 957320 - protein, 47 aa, Homo sapiens
LQADTRVSPRQLTGLNPSSLSPVPQDPCLLGKGLLGYESIRLEDTKY

SEQ ID NO: 957321 - protein, 35 aa, Homo sapiens
EPLVPMPLDLYIPPDALEVFLEAFQGPLDLLLYLI

SEQ ID NO: 957322 - protein, 45 aa, Homo sapiens
MYAVLFKPKQAWFILMASNGNGGFTHVQTIDFQVTNGCIELLNPS

SEQ ID NO: 957323 - protein, 72 aa, Homo sapiens
LQQSTGACKLAKGSNMCTTQASFRRFSFNVKTFRHVVSNGSSTSGSGPKCCHANVQGPCSRWVLAKASEGIL

SEQ ID NO: 957324 - protein, 102 aa, Homo sapiens
VTGDQPQIFEVCSFRVQIIARAMERGAVAVVRKASTSSTEKSFETTAKPGSATASTSTPTGCGLVAQTIHFPSCDKLNLGPSQFASSGFPKAFFDTSDCTGT

SEQ ID NO: 957325 - protein, 73 aa, Homo sapiens
SILSLRSILLTFRRRLPSTTPHGPRTSGSCTDQENEFLLIQLTHAAKCMLTDDTELTASVPKADPRINSARTA

SEQ ID NO: 957326 - protein, 55 aa, Homo sapiens
MKGGSLLRGELEKKSKAIIEGNISILHDVKGRQSSAVEELGSPSLLFIFLRLPAV

SEQ ID NO: 957327 - protein, 54 aa, Homo sapiens
LVVPIEMGFLDFVTERRQAEGPDALLFSELRFDEKHLYSRAASRFFCGPETGAG

SEQ ID NO: 957328 - protein, 45 aa, Homo sapiens
RSSVKHTTAIIVAYNPLSRTSNSTPTNSFLMTSSQASQASPFIPP

SEQ ID NO: 957329 - protein, 39 aa, Homo sapiens
TGFFDDVFCCTDITIASCQRLGMPHGFLLHSLFHLFEPI

SEQ ID NO: 957330 - protein, 33 aa, Homo sapiens
MSYGNSSLPIFKWSCLGFLVLSCRSYFSLRRKV

SEQ ID NO: 957331 - protein, 45 aa, Homo sapiens
PHLLIKRVFGFRINPSLTFSHHSLEASFRYLPSAFFLALNILWLY

SEQ ID NO: 957332 - protein, 38 aa, Homo sapiens
TRGLSYALAQCGVLQITLQQLKLEVTAKAHIQSLVLEL

SEQ ID NO: 957333 - protein, 35 aa, Homo sapiens
GNISEYKHLWMANTAPIDEDIVEVSYNVLRVVEYD

SEQ ID NO: 957334 - protein, 57 aa, Homo sapiens
RYKYITLCIIIFIITGSSASLSLSLLSVAMLPCVPQKPPFEEVVAVRCLVVRVLFVV

SEQ ID NO: 957335 - protein, 51 aa, Homo sapiens
VSPGILVITRTISIREVGPWSAHNRDSGRLTAFYTVFFFIAGLELKREFVE

SEQ ID NO: 957336 - protein, 48 aa, Homo sapiens
LDTICNIPKGRQFQPAASGGWHAWSLCMLPSVMLRKGLYSKPPDNIRL

SEQ ID NO: 957337 - protein, 45 aa, Homo sapiens
MGSSSSPQVRNWARCRDTIRYGRYRRAPRSIRRHIATPSKTKTCG

SEQ ID NO: 957338 - protein, 48 aa, Homo sapiens
VPSLAVTRDILVTCIHPHDATMGIWLPNANTSEDLNWLPDEANKPIID

SEQ ID NO: 957339 - protein, 56 aa, Homo sapiens
RPKIIGSRTISQQSLAGADMKCTITASGKDADSHRHIGLFRRKYSPHLITHQDTSN

SEQ ID NO: 957340 - protein, 49 aa, Homo sapiens
SSVTLRIPQECPVPDRVPAESDVSGPAAGVITAALRRAIRSQTGAARAY

SEQ ID NO: 957341 - protein, 45 aa, Homo sapiens
MAKGHKQPAGMATVHCIHANCIAPKHARGISHARMAVQAGNGNCM

SEQ ID NO: 957342 - protein, 101 aa, Homo sapiens
CGITARCSRGGPGPRAPSTSWARHVGVLAAGSGMVPRGMGLDPLSSALRSLTCIPLLGQAEGWTCLSESGMAIRVGKCNVGTSGMAIRVGQRKVNAMCRVT

SEQ ID NO: 957343 - protein, 69 aa, Homo sapiens
PPAYCDGGRNCTPEHIAGVPKEEEEGLRTITGPCFANFSLYWPLKDCRCSKQGIYIKQLQVLSRESQRW

SEQ ID NO: 957344 - protein, 61 aa, Homo sapiens
GLNMLTFARLGVKLELLLPAYARATAVPDLRCVFDQHHSSWQRWILNPLSKVRNGAKVNDV

SEQ ID NO: 957345 - protein, 61 aa, Homo sapiens
LLLMSPLSCVHGYSLSFLMAAACSCALLLQWSLAFATSAWPLLHHSASPASTIHTPAVLFF

SEQ ID NO: 957346 - protein, 104 aa, Homo sapiens
MIRKSVMNTNDLVGVQAAHGERSIGIWYARHLIEKSLRDIVSLLAASEAEVQQLLSERAPLTGHSCYPDALLHFRTHYFNCALPHVRLCFETFVLAGQTLLRAV

SEQ ID NO: 957347 - protein, 45 aa, Homo sapiens
MCQCDGSCAIDCAKEVIECAWKVCVHYNRHVVCQCDAVACHDDGE

SEQ ID NO: 957348 - protein, 109 aa, Homo sapiens
MCPGMVCFACSWLKKICQCGAEHANRAFRNVVHFLCRFRAPPISPLQTRATLSRSPARHSSGLHCPLPEEKVDLIVVPREAVQTLRYIGRAYIVRFVDPEGHVLCLHGV

SEQ ID NO: 957349 - protein, 41 aa, Homo sapiens
VLLTEGTVTDKDSKGGESLCVDLLKEAHVCRAQWLTPVIPA

SEQ ID NO: 957350 - protein, 111 aa, Homo sapiens
MRHCMSSIFLIISTAYVYVTIRLVYIITRRLSYQTYSEILSIIDIKEAEGNRAIQMQIFYILIEIEFYFNLNKIVTNYTQLKKVVNWHVCKIAVYDFVLVFIFPSKKGPIY

SEQ ID NO: 957351 - protein, 157 aa, Homo sapiens
HPKCGRIKTNFASALLSYLSISLGLTSVAQAEVQTGFHTCKPGWSRSPDHHDPPASVTPKCWDYRCEPPHPRPVFNLLSYRLMIHLGLISSYRVRTWSSSLTWDYRYRDYPPPLVEKTILKIVGSYMSGLISWSRICNIRVPCLSLGPVSYCLNYYS

SEQ ID NO: 957352 - protein, 98 aa, Homo sapiens
YRDKRRRRIHVQQLTSKQAKQRDPQSRHITVELLKATDKGIFYIFFFKDRSHHNMAQVGLKRLASLDSPTSTSQRAETMACAPLAGGNTTQEKNPLPS

SEQ ID NO: 957353 - protein, 132 aa, Homo sapiens
YRKSAMPGNSSEQESRITMKQLSLGNIDDLAPVLPVIGMIHETDHPRAHHNLSTRNTLVINLSLFETGSHSDAQSGAQWRKLRLLKTLPPGFKQFSCLSLPGSWDYRHSPPHPANFRIVSRDRVSPYRSGWS

SEQ ID NO: 957354 - protein, 46 aa, Homo sapiens
SFGRWTLHSVRRQAMPFKCMQRTDFILKFPAQCPPGSMSDKPGRRQ

SEQ ID NO: 957355 - protein, 30 aa, Homo sapiens
MPCSACSSLIHPQFRTVPPEVVRQAWQKAD

SEQ ID NO: 957356 - protein, 47 aa, Homo sapiens
MDLALSEETAMPFKCMQRTDFILYIRERAHLEVCPTSLAEGRHQYSC

SEQ ID NO: 957357 - protein, 37 aa, Homo sapiens
ILPVYQPSSLTFSILLAGALEQALDNEIHVNFLILQN

SEQ ID NO: 957358 - protein, 40 aa, Homo sapiens
MPKQVHAASTDIILQVSCTVPTKSNVTDKPEQKVQTYNTT

SEQ ID NO: 957359 - protein, 51 aa, Homo sapiens
MPFKCMQLTDFHPPSFRYCAHLEVCPTTPGSKAVLQELHVLLRGYRVSYTS

SEQ ID NO: 957360 - protein, 67 aa, Homo sapiens
LVYMNLTIMLDMADREGVVDIYNCSGAAVTEGEHGAIQRSRYVFIHECDPRKPVFVRDTVWCAASQC

SEQ ID NO: 957361 - protein, 47 aa, Homo sapiens
GPELKARSNSEGSLISDHLPSGPFIYTKPPVTGIEKFGSLAPERVEN

SEQ ID NO: 957362 - protein, 35 aa, Homo sapiens
RRPLPFKCMQLTDFILKFPLRAHQKYVRQAWPKAD

SEQ ID NO: 957363 - protein, 43 aa, Homo sapiens
LRCRTYFWWHCAETEDKSVSCMHLQAWPVSSLQCMSIDQSPVL

SEQ ID NO: 957364 - protein, 65 aa, Homo sapiens
SAQGMRRHCLQCGAQALPFKCMQLTDFILKLPHSAHPKYVRQAWPQADIHTHVQPGATRARTSYI

SEQ ID NO: 957365 - protein, 40 aa, Homo sapiens
LQLGDRPCLSRCMQLTDYHPQDFRTAAHHKYVRQAWQKAD

SEQ ID NO: 957366 - protein, 50 aa, Homo sapiens
MSAYAGLSDILLVGTVRKLEDEISESACILKRHGLSPHFSAMSTRPKPYS

SEQ ID NO: 957367 - protein, 40 aa, Homo sapiens
MVRRQAMPFKCMQLTDFILYFPLLVPTMKYVLTSLVRRQT

SEQ ID NO: 957368 - protein, 49 aa, Homo sapiens
MRVLALHTVGIQCPHYTSGLGQLFALFAHVQNTDKKAPSWKAKHSRPIR

SEQ ID NO: 957369 - protein, 41 aa, Homo sapiens
VYRSVICVPTSYNRTASLTRVCLLDINSPIMERAVGRTGSS

SEQ ID NO: 957370 - protein, 47 aa, Homo sapiens
CCHDIDHTFYRDDAKQQTGYKNPEIKIDETGSTPGYEGEGEGDKNIS

SEQ ID NO: 957371 - protein, 70 aa, Homo sapiens
ASASGQDLIGLICWQIYKEGREPKLNDNVSAYCLHIAERCWGRWTPDFPPAGFQVSPFIFGFRYFVPWLK

SEQ ID NO: 957372 - protein, 42 aa, Homo sapiens
RSVQSSGSGVVQGVGRQQGGAPAQHQVVVAVWFNTTSVSRAC

SEQ ID NO: 957373 - protein, 39 aa, Homo sapiens
QCSSSVIQAGVVVQRGPAGTTVAGTSINIRLLLHLVQTT

SEQ ID NO: 957374 - protein, 45 aa, Homo sapiens
AAHIHSAVGGCVASTHSCVSGHVHVQMVSPSSMGRARIQLFSHMA

SEQ ID NO: 957375 - protein, 51 aa, Homo sapiens
TGYGRQVRYVLTDGGVVTRGSDGQQVGDTTLHTTVVVDFGIHNTLRTTGLT

SEQ ID NO: 957376 - protein, 53 aa, Homo sapiens
CGYKRINCFHVTTPIRVWPQDGRGIRFQPSEPARMQRCMACASFIYRKLRSAL

SEQ ID NO: 957377 - protein, 86 aa, Homo sapiens
EEICTSAACPVKPYVTILVGWSFTVILHSHQCEQTIKLRTASVLSKMSNMWDSYTHILGSRQCHTYLAHAQVVCSILDCRPCSALQ

SEQ ID NO: 957378 - protein, 44 aa, Homo sapiens
MPIIAQMTTQTPISAIAVSRTILLWCKIPLGTTKLRRDLSAGYR

SEQ ID NO: 957379 - protein, 34 aa, Homo sapiens
MSSTPCKKTCRCRSDMGRILTVTSNTNASQISTS

SEQ ID NO: 957380 - protein, 44 aa, Homo sapiens
PSKKLDIISPTVAEHYTGEKAASFSLMPSIMKELIPDKVNVLFV

SEQ ID NO: 957381 - protein, 83 aa, Homo sapiens
SRLAGLFPRLCRTAAWPVHSCMRRPRHLHSLLPFPPDVPRAALSLVSSIWRPPPGSRPGLGLPYYVRCEGRTPGDSSTTSTLQ

SEQ ID NO: 957382 - protein, 44 aa, Homo sapiens
ASSGHIEILSECCCSRLETKWEPAKPRVLNMLNISPFSFGLVIQ

SEQ ID NO: 957383 - protein, 35 aa, Homo sapiens
VALYRSVACWAPFVSSLAQLPSLRISMVPLYACLL

SEQ ID NO: 957384 - protein, 33 aa, Homo sapiens
LSSISPEEETPFYTNTYADFSVTLKIALKIDWL

SEQ ID NO: 957385 - protein, 84 aa, Homo sapiens
VCGAQCALMFFSRIGCTSDGLSEMPLERGAADVKRQRHVSGADHVCYQGVHDSLIYARRLSGQIHRILSLGKAFDPCHLIVSSS

SEQ ID NO: 957386 - protein, 47 aa, Homo sapiens
MYSDRISSSYATLIPTLAIITRGGNQPERLNAGTYFLFYTLPEDCWW

SEQ ID NO: 957387 - protein, 70 aa, Homo sapiens
MHPNVSKLSVEPYNSILSSHTTLEHSDGAFLVDNEAIYDICRRNLDIERPNYTNLNRLISQIVSSITASL

SEQ ID NO: 957388 - protein, 61 aa, Homo sapiens
MALVLCNGRLCGGRLLAGRVIPSIVATSQTSGVDGGKGQQDSYVGDEAQSKRGILTLKMLV

SEQ ID NO: 957389 - protein, 42 aa, Homo sapiens
MRILYYSICFLEILCIGLMFKSRESHSIAPLKIVGGPEDCWW

SEQ ID NO: 957390 - protein, 49 aa, Homo sapiens
EPVGDAVVGHALLEDLGAMYPWVPTAGMGLLLGEVTGQAQVRDPHGAMR

SEQ ID NO: 957391 - protein, 54 aa, Homo sapiens
MLDSPKRKRPKSLAQVEEPAIENVKPPGSPVAKLAKFTFKQKSKLIHSPEYGWL

SEQ ID NO: 957392 - protein, 55 aa, Homo sapiens
MEILSDVQLIKTGDKGGASEATRLNMLNISPFSLGRVIQQVFDKGSIYNPEDGWG

SEQ ID NO: 957393 - protein, 46 aa, Homo sapiens
ALGCHRCTYIFCVSFRLAGCFNAFVPLPSPTGSLSVCVLSPEDCCW

SEQ ID NO: 957394 - protein, 84 aa, Homo sapiens
CYRRSIMLHGLTAYTVGFHFFTLHGYTAFKHAAWNPLHSIEIHWATLHGIHCIQSGIHLTPLHGIHCINRDAFYHAAWNPLHSM

SEQ ID NO: 957395 - protein, 69 aa, Homo sapiens
VPAGLGPDKDVRSTAIQPIRSGFRADAGSTRCPRRHGPPCRGAVRSTCCLADSDPCPSSRGVDYAIPAD

SEQ ID NO: 957396 - protein, 55 aa, Homo sapiens
MLVWTLIECICSLYINGLRTVDFEGSDSASGSLPLALVKRVRAVPPSLSGASFGF

SEQ ID NO: 957397 - protein, 63 aa, Homo sapiens
MFLPVRYCVEFMLTAIGCPHTRLYSCVSQNVTAQLVVPDAGLATPLCRKYFQHQGELTEIKEH

SEQ ID NO: 957398 - protein, 36 aa, Homo sapiens
MGDKPAYVISCTRGSWAMAILLTRRFMQQAPHGAPP

SEQ ID NO: 957399 - protein, 39 aa, Homo sapiens
MSYVYSDSLTTAHDGNSAAASYIQLPGPGNFHVSVPRSN

SEQ ID NO: 957400 - protein, 85 aa, Homo sapiens
MSYAPGSLRYQIRCCRAAVVWVADAARDPELLWLWQYAGGYSLPLNLNSNTTNVNNCCFQICLPTQCQPGAQSQVLTQGSVGHNR

SEQ ID NO: 957401 - protein, 93 aa, Homo sapiens
MSYGVLRLNLIYRLLSLPSSIRKEPHLFLVDLSVGHIDRESPWSALSTLLPCELQEVHESAGDHPRLALVPEAHNSRWYRRSNFDKSLAHSLF

SEQ ID NO: 957402 - protein, 44 aa, Homo sapiens
GLLSYVLYRNSVNHCATTGTPQLHLEIQLSCVLVNFHVSVARTH

SEQ ID NO: 957403 - protein, 52 aa, Homo sapiens
MSYGSYEYAIGPRFYICWLFGTEAIITQGRPRVHSYLRRLSLNILETGRTDW

SEQ ID NO: 957404 - protein, 77 aa, Homo sapiens
MTLTTEGECAPAAEMPGTVSDSWPLDCVSRAFPDSIQPPANLWHPDHCWPPRMGSWVLLFIDGLYLRRVTTYRVWVP

SEQ ID NO: 957405 - protein, 50 aa, Homo sapiens
LPWKTPCRGDCTYSPALNQRCFAYTGQERALMQRVGKIPQPPTRHPLLRA

SEQ ID NO: 957406 - protein, 48 aa, Homo sapiens
AYPRTHHALPTDTPAIPTDNHAIPGTTRYYPGHHALPTDTSYYPRKPA

SEQ ID NO: 957407 - protein, 36 aa, Homo sapiens
AAQSPCLLDEGGFTRDFTKADGPVTTVYDASVNYRE

SEQ ID NO: 957408 - protein, 75 aa, Homo sapiens
SFKSFNTRQMTYFMQVNVAHSILGVIAIACKSSAAKVDSIFETSLSQVIGKKQLLICLSFIMRSQQFSHIFRLHF

SEQ ID NO: 957409 - protein, 70 aa, Homo sapiens
MGPSNGLSLRSDDDLSIIIAQKSSTVEQKRREPNTNKDVAGFHRDLMWVMTRMSGSHSVVNMRMSITPHN

SEQ ID NO: 957410 - protein, 54 aa, Homo sapiens
TKDGSRAWKSKARQTKGVPNPMQTAQCLPVQSYQELSVSPPSGRLYVRHLSEVL

SEQ ID NO: 957411 - protein, 35 aa, Homo sapiens
HSAPESSKIEGQQVANKHDQRSSSRDQTMRPDIGS

SEQ ID NO: 957412 - protein, 201 aa, Homo sapiens
MEEHPELQQFRGPDGRRLISQTQAPSMTGGSGCVKRDLLLTPKCWYYYRTRNSQTGPRRGPGERRLNRKIEIERILFVLVSARQDDLVILHEQEYDSVLESVCKTEFLSLLAKRNEEKTQKQLPLKYSNTLELKLKKDNWGPWSAGGSGKVQFHQGFGDLAVLKPSNKVLQVSIGPGRAKNSRPTRKDNSQNKGNPVGLKC

SEQ ID NO: 957413 - protein, 129 aa, Homo sapiens
LTRPHVNDSRVHPEVKDNIAMFTEPSENKDTTYQHSVERPYKDSSCSSRIVIGACNAYRVNRGGSATTLELAGLQTGPWTSLSNEYLDSPPRGLVTSSVPLSILGPTCCISFFFLPCLVVPGEFVPGGY

SEQ ID NO: 957414 - protein, 53 aa, Homo sapiens
ISLQQVSGELGAVGLQVQTLTSLSVRSKGVMDSRRAPRDAPVALALRHRQLLP

SEQ ID NO: 957415 - protein, 159 aa, Homo sapiens
MHRCRRLHPGNLFCPINTDSQGGWLYHEETSYPVYPGSLGGQYIPENTVSSVYTGCLGARYIRKSSARTDTPMAEGQRESHTSHSFSTVLSWYRITLQVMEAKVMVHKKASYSSQMFMRLNGKYDSGDPPASASQSVGITGVSQHAQLRSRYIKYSPLL

SEQ ID NO: 957416 - protein, 43 aa, Homo sapiens
DSAQRIPDYSINQRQIGEAFKLRRKSNHSSATIVALYLYIRQT

SEQ ID NO: 957417 - protein, 76 aa, Homo sapiens
MVADPAFGSYPRRMYQHDRVDAIGFHGELVMASRGGDVILSYCSLIFSSSKMQKYTNFLTDTRMEYRCSHSSSIIG

SEQ ID NO: 957418 - protein, 36 aa, Homo sapiens
MTIVPNTQEAEAGGSPEPRSSKVAMNVPVHSSLGSR

SEQ ID NO: 957419 - protein, 69 aa, Homo sapiens
VTSTVKCKQPGSPSHSQGLAMRDCAIRPRYYAFPTVSAICRSGDSLVAYTTRTLNYKDSTGWMSGQTPS

SEQ ID NO: 957420 - protein, 33 aa, Homo sapiens
MCTEYGGNYGGPYTSILNHLNAQLQYYSMAHHN

SEQ ID NO: 957421 - protein, 73 aa, Homo sapiens
QKGSERACSTSNTSSENGSTGTVAGASERQEAQQHQHCHGILKALMQAHMDILFSLWLGEQVEGSGGREAVAR

SEQ ID NO: 957422 - protein, 58 aa, Homo sapiens
VVWLSAAHSASFVGHVAFVLFSTHSLLHPAPPHSVPQAASSVCPKPSVLRGSLHSLQG

SEQ ID NO: 957423 - protein, 59 aa, Homo sapiens
RWALHDARSGAMFMDICSNRLASTSTFVGHPSCFKYRAISVSQPHTKPRNQNYPKSHAC

SEQ ID NO: 957424 - protein, 68 aa, Homo sapiens
LHGIICSNSRFKHVGSRMQASKQTARHWVHHSKQASKQAFKSNKSPSASTASSVQPTHHTAPIVGTQH

SEQ ID NO: 957425 - protein, 50 aa, Homo sapiens
MDPMLSQDVSYTSIDGFMTYESDLLHRPCDITNGVVFPDTAKNLEMALAG

SEQ ID NO: 957426 - protein, 30 aa, Homo sapiens
MMNINSILQNNCSSLQFLTSCLNSSSVCYV

SEQ ID NO: 957427 - protein, 89 aa, Homo sapiens
DAGTRFAAPPYLDYAGYHQYIEEMLPPESPALYGLHPNAEIEFLTVTSNTLFRTLLEMQPRNALSGDELGQSTEEKVEGLSFLFFFIEV

SEQ ID NO: 957428 - protein, 101 aa, Homo sapiens
EFDGFSVRETSIRPILTKKKKKGPREKPAVSKLKDQKKDSQQNKNFWIILACPGKIAMKRDRLFPLPREHGSYPDGEQRSVHQPQPEKQSSNLSIPVGFGG

SEQ ID NO: 957429 - protein, 57 aa, Homo sapiens
MPQKGSGSKFPGDGKDTRARALQVEGPHNLGNLAGSLFLQPLPNIVPSRGLHSSFIF

SEQ ID NO: 957430 - protein, 35 aa, Homo sapiens
KVGQGYKRRLSEQDFWKLTTGASWDNWLVAAKQFI

SEQ ID NO: 957431 - protein, 99 aa, Homo sapiens
MGHSDQDLLRPQWVPPGPELGGARAGPGLALESLTDWQPDRGWAWSGSQGGFLGEAVAPGALEGEANHTGCGACGQGTSQDQGLEAAGVCLLGYLLGWP

SEQ ID NO: 957432 - protein, 32 aa, Homo sapiens
GLPVSGIYVLNIFVATGFHGLHVIMAQLSSTG

SEQ ID NO: 957433 - protein, 114 aa, Homo sapiens
ACCRSIWDPPVLFPSINKNNKNMCRGSSQTTFFLYSHTTTTIINTEHICDQKCGGFSPLHQAVDTSSVFSNSGWGLSLQDCLHTPGHQLHVWGPGSHDPLSSCWCSHDPLFGFG

SEQ ID NO: 957434 - protein, 82 aa, Homo sapiens
MKVACFDLSKYLDMGVIHPLNKSTVGGRRFATLVITGNNQPIVSQQGTTQLSVENNKTSITSDIGMQLTDPRTQHIFIQHST

SEQ ID NO: 957435 - protein, 83 aa, Homo sapiens
MRRQLVWCLYLVLIRSSELSFVYPGSTGRSLHADSQGSHLSLSDSRKQGCTPVDWKDGDSVMVLPTIPDEEAKKGLGRKEFSP

SEQ ID NO: 957436 - protein, 142 aa, Homo sapiens
MMTEEDVKLLSISGNRLPLEVEQGSTEKSKLAADEDDDDDDEEDDDEDDDDDDFDDEEAADPAPVKKSIRDTPAILCTKVKSDWTRLKTIINTKIKKDHESFKKQEKTPKTATGPSSVEAHYSHNASKYRNKVVLFPKWKAQ

SEQ ID NO: 957437 - protein, 36 aa, Homo sapiens
HFSITLKSKLSSQYHLNQARCKDSHLYPSVLRGKDP

SEQ ID NO: 957438 - protein, 72 aa, Homo sapiens
RSRYGGRDGESKEDKARQDITTNTYTSQELKSALAKCKEGAEMESTKEDKARQAEVKRLFRPIEELKKDFDQ

SEQ ID NO: 957439 - protein, 74 aa, Homo sapiens
LLLRSLYRSPSLTVSFFRFPGASLTRLFLLLFFLLLIIFIIIIFILFVVVVLLVLIILYFIFILSPVLGFPPGT

SEQ ID NO: 957440 - protein, 40 aa, Homo sapiens
GECSIFTNDKTVPVLLLHRMLSVERQINEMAPAQPGPQEV

SEQ ID NO: 957441 - protein, 51 aa, Homo sapiens
MKAVILERLLQTVELEGTVRTHSDAVRRQVPDKIRQVIDGVAAALGAQAEL

SEQ ID NO: 957442 - protein, 40 aa, Homo sapiens
SDVHVPHVYDWREVEILMFLSAIVMMKNRRSMFLMTCGTW

SEQ ID NO: 957443 - protein, 38 aa, Homo sapiens
ERRDRKYRRAKDRKYRRAKDRKYPAFVPLFVLHRVVAL

SEQ ID NO: 957444 - protein, 57 aa, Homo sapiens
APISGSTSVPILAKGNHTLITSQKWTTIETRNIREAIEHFGIKIYQFPDCDSDGTKM

SEQ ID NO: 957445 - protein, 41 aa, Homo sapiens
RFFFSFLIIKIIIIIIFIIILFIIIASSSQQQFTFFWALLP

SEQ ID NO: 957446 - protein, 42 aa, Homo sapiens
IPHFHHVLTHDEAERDVSRVALSGKLQSIEPLGHLSQEIPGT

SEQ ID NO: 957447 - protein, 74 aa, Homo sapiens
DGYLSGVYERYRTYYPYPADDKGAVDKTSMTRNMSWSDEAAGEQYAPISICPQLVVPPSSYLVTFLLIALYLFP

SEQ ID NO: 957448 - protein, 35 aa, Homo sapiens
ICVHLNSVIVYTSLTAVLITNKRSMYRNPADWTKT

SEQ ID NO: 957449 - protein, 47 aa, Homo sapiens
ARFSFVHFLVHFGHVAAHSVIQGSSSKPMWAVAHQYPFPSSPAGSKQ

SEQ ID NO: 957450 - protein, 66 aa, Homo sapiens
IDYNKQHLPSTDRRKTAHGILFNAAAYALVVAVILIRTALKLHRRIHSHRSPTGFLLITILPSKLK

SEQ ID NO: 957451 - protein, 50 aa, Homo sapiens
GAAIQLYITGLSLTLNHAIPLTWPSFTQTAIHALACRLQITSYTMLLAGV

SEQ ID NO: 957452 - protein, 115 aa, Homo sapiens
QAIDREYFLVILTLLAGLCCHSQTGRPELTYLQQQYLCQVAEATWEQEAIPDSAARELNPSVAVQFTFLQLIPNPVQHVVTKQSILLLLCSNLSGWASRNRQSYTGSPLTIMGVL

SEQ ID NO: 957453 - protein, 55 aa, Homo sapiens
SAAKYVNTPETPVYKKSHVLYGLDPGPGPTWSKKSQAVIVEGYTDVMAVHLSGID

SEQ ID NO: 957454 - protein, 34 aa, Homo sapiens
SRYRVAMNTMKLYLDYRIYGYRYDQPIAMIKSNK

SEQ ID NO: 957455 - protein, 40 aa, Homo sapiens
PAIHALASFNTNSYTMHGRRLTLTAYNHALAVVEHKQLYP

SEQ ID NO: 957456 - protein, 99 aa, Homo sapiens
EVKWHAPRLLSLPVCYPNCNKAPTQREKAQTEPTPAPAWPRSFDSYSNPTSEISMPGSLNRPTNNMQYANAAREIYRREMLASTHARHKAPWYNVTMWR

SEQ ID NO: 957457 - protein, 111 aa, Homo sapiens
MRIPCTGRSLSTNRLKPCTGRRLPLTSLYPCISPALYTNSYPPALGRRYPQGALTMHWLSVYSYPQWPTAIGDPFIQITINQSESDLSVIYTITQFLEIRNCCSCLHYNLT

SEQ ID NO: 957458 - protein, 69 aa, Homo sapiens
HAHLSSILGLIYPSVLTSQTLAITCYSHCTGIPFLDRLILDIICWFPIMFHEDFALTCSMHMSMVFVVT

SEQ ID NO: 957459 - protein, 50 aa, Homo sapiens
PHTPTYYQPSSSNAPEDPPVTIILIIAHGLTLLITILPSKLKLRFDLVRV

SEQ ID NO: 957460 - protein, 102 aa, Homo sapiens
MGLVRSCDYPKTLFFLNGISLYLAQARVQWRDLGSLQPPSPRFKRFSCLSLPSSWDYRHAPSCLANFVFLVETGFLHVGQAGLELPTSGDPPVLASHRAYLT

SEQ ID NO: 957461 - protein, 36 aa, Homo sapiens
MTEVASGKLRKGLGAFERSILTQIDHILMRQREITS

SEQ ID NO: 957462 - protein, 52 aa, Homo sapiens
MPASSTHCPETHAQSDGPRSTRTPGRLGPLSMGPRCQTICPGPHALGTDSTW

SEQ ID NO: 957463 - protein, 45 aa, Homo sapiens
TYTATSPISLQVSLCITKYFLITMAWVWTEKVTLDDGWMWPGCGL

SEQ ID NO: 957464 - protein, 51 aa, Homo sapiens
VLKRTVTGLKQCSSTYCMQKACEELNNAMAATFWHLILDHEECDEMIINWT

SEQ ID NO: 957465 - protein, 71 aa, Homo sapiens
MASSKRKKVEIYDVLMSTHMHTLRLIGFLGHMVCESLSGLRIQESLKKENSLGQWLTPVIPALWEAKAGGS

SEQ ID NO: 957466 - protein, 33 aa, Homo sapiens
KSSELYDYIYAGGGDLISTLYAAHATVKVQSRD

SEQ ID NO: 957467 - protein, 34 aa, Homo sapiens
MLGKQVSSRACRRQQEVCSEDMRVTTGRGTRGGM

SEQ ID NO: 957468 - protein, 51 aa, Homo sapiens
TLEDPPILKTDTLEFILEDKGNLWDSQYFIYSTNMNLKLSPLKAPYYEVDI

SEQ ID NO: 957469 - protein, 143 aa, Homo sapiens
TFGKCQVRMIARTVDSQFKFAGKGRKRRGQAHRLRRADWSSSRIGGRTSAPALSYKVPYCGGSIARQSQLAGYLARRRGAYRLVHGGDALDLLVPVVLKPGAFVAHGGGSIQAVDPRALGVQLLFVGQFGFQAGNFTGESRAI

SEQ ID NO: 957470 - protein, 66 aa, Homo sapiens
MQVIAWFQACTLPGAYCLHSVSNEGTSSISTAWLFSDFIAMKEYIIQVKQRTQHGYILQAVRFFNL

SEQ ID NO: 957471 - protein, 68 aa, Homo sapiens
QPQALGRLFLDQQVAAGAGYHGRDSHVGAKPLCTSHETSSQNSRTGMAQALCKLPRTPAPARKFHASS

SEQ ID NO: 957472 - protein, 35 aa, Homo sapiens
GVWICRENVEGEGLANRHHTRGIKRPLDGDELLPN

SEQ ID NO: 957473 - protein, 35 aa, Homo sapiens
DNTIGIAHYRPELLGSSYPPTSASRAVPIRRQGHR

SEQ ID NO: 957474 - protein, 108 aa, Homo sapiens
WTVTRQVGVVLPTCGTRIGSHALKRGSHAVISASCVRVYLRHHGTVDRIMNELNGRALDAVAGSNQERPAKTDPAAEGQVKQAPEPHKDLLAGEEGAAPVLPGLHSQF

SEQ ID NO: 957475 - protein, 37 aa, Homo sapiens
LAARSARIRRLRAVPSDSRLMRRIIVYSVPMSLWFVE

SEQ ID NO: 957476 - protein, 63 aa, Homo sapiens
DCLVHEEKHQPLHTWNKPTLPDQAEKAFCHGNLARVTLLLSNGSQEHEMVHYDYLSMCQVWRS

SEQ ID NO: 957477 - protein, 45 aa, Homo sapiens
SADLGLAQLILAPTQRSRGQGVVESAGKEDPVELDSSPKSAKKRR

SEQ ID NO: 957478 - protein, 72 aa, Homo sapiens
DEYRGAEYVQTWNIADGIDLSMIVFKRFKRRADSSDHGSTLMESSSDSRPCGGKGAVFFFIRQKWTFPKRCT

SEQ ID NO: 957479 - protein, 38 aa, Homo sapiens
IYIQVAVLDVKWTECWYFVVHARNKPVGLSLVWFKTRS

SEQ ID NO: 957480 - protein, 53 aa, Homo sapiens
SSVISSCHIVNRRDLAIFAASGRRPRELSRSFHDIGKKVRPGGIRIKPQIGHA

SEQ ID NO: 957481 - protein, 30 aa, Homo sapiens
MKSRVCRRNWRIDFLLSLFPFLLFLLTLLA

SEQ ID NO: 957482 - protein, 94 aa, Homo sapiens
MLPAGAVVDDAGVNATSVHKPVTECDFFVKIVNGLEKPHKHGLFTPFGLALWHLPHAPAVVHKTCTRTKRYRFTPFCEESVDPFEAQMGHFGAG

SEQ ID NO: 957483 - protein, 56 aa, Homo sapiens
VTPSQCANEGCGRDDTVRGVPRCFYPNTIDVPPEEECEFKTLLQGSASILTRCSPR

SEQ ID NO: 957484 - protein, 58 aa, Homo sapiens
LFATGTVLGGGVEGADQVPSPELSLPGSEGNGLCLVGGGGAGLCGTARERAHLSHFIG

SEQ ID NO: 957485 - protein, 93 aa, Homo sapiens
VSRLGTVRYRATSITQHEGVGGSVENDSTEHEKDYSPKGDQQQVLKEEVVSCGWGKTRPVSYIGLCLVIQGQSDLFSACRPSPKSEKTVPSGE

SEQ ID NO: 957486 - protein, 75 aa, Homo sapiens
MTSRQPIEKRSIDTKSAGHSPVWGFFAEQAGGNDLLETGIMVIDLVVPFAKGGESRAVRVVPGVGEIVNMMDLIR

SEQ ID NO: 957487 - protein, 105 aa, Homo sapiens
VTYERCQCPCLERIFKSGCVFACAPTTSIGCTKSFHARYCSILVRRRVRAAGIIKWASLGLQPKLIAVLKIRIDVLFVLQFSLRVHRKAVLSYSQINGHIDVLVA

SEQ ID NO: 957488 - protein, 38 aa, Homo sapiens
MTLYVRNDTLRTVIVSASAWIRHLSSVPQRGLAISVNE

SEQ ID NO: 957489 - protein, 39 aa, Homo sapiens
QVCGNSICLALNLLDYNGRSSFMAVSDRRRRDAYVQPSR

SEQ ID NO: 957490 - protein, 196 aa, Homo sapiens
MPNGRLPESFRPHDTFRLRLPRVRCDLLKPCRCFCEVLVAFVVHEPRRTLAGLILHVDVQHVGAAGVSDEPARTTRIQFADELATLCLAHTLHRDIRRCAIGMLTRAAWLRSLYAMRRGAIARIDCEIATHRLRRLGKDRGELRIDLILTGMHEVQLAAGADWRVFRLADEAGQPLTVRVRDLCTLPFIALEKIEV

SEQ ID NO: 957491 - protein, 100 aa, Homo sapiens
AGRQVCAQLFLRQTIRAPSQAALDITWIDDNRARDIKRCRFVHPAKDIARFQANSFQLMTAARQGKRPCTREVAAKRPSNRNHLSSVLPPFLSNSKRRQR

SEQ ID NO: 957492 - protein, 83 aa, Homo sapiens
MDAETKKRSVELTVGGKLRSFDIDDPVLPDWVEENKLSAGDFPYDKKMKRGEYDAALEALQVELVKVQFWLQATGKRVMAVFE

SEQ ID NO: 957493 - protein, 43 aa, Homo sapiens
MHDPIVQALGPDKLVLGYCRYFPNESQWVLVFAFGVSRSVRCH

SEQ ID NO: 957494 - protein, 70 aa, Homo sapiens
RILMSEDTLQLGTPCALGTTRRTPALAKTILAEKKKEGAAKVTDAQAPKKNTRTLIGLLVSDKRAKTVTV

SEQ ID NO: 957495 - protein, 37 aa, Homo sapiens
IAICQRQTGEYRVGTYLLVRNNTGKPVLIPDKPLRGK

SEQ ID NO: 957496 - protein, 120 aa, Homo sapiens
IRLAKCRSAKTTCIYYHTDDQDFSYYLNGSLANEALEPSDAVLSPNATRQCVDIYGGPFVENNPELLISVPDRKITSTKSGQHRALRDNPSLPERHRKDGAQEMLVHAITPPNEDNYGEG

SEQ ID NO: 957497 - protein, 48 aa, Homo sapiens
PKPDLPCNDLACRLQTSNGALSMLIHKLADKINHFSAKFDSAPSVRAT

SEQ ID NO: 957498 - protein, 114 aa, Homo sapiens
VRTGIPILFPLRIYASQTCGSNAIAFFHVSFAYTSNNEPTSRKKPESIKSCANNWSLTTTKSGISFPEDKASRKFRFKSTIYIRNVPNCLNLNSQLFISPSSSDIICNRFPVLK

SEQ ID NO: 957499 - protein, 37 aa, Homo sapiens
MCMCSVCMCVSVYVCVSVYVCVCIVCMCVGSVCNIFA

SEQ ID NO: 957500 - protein, 36 aa, Homo sapiens
GVDVGVAGVLYGKYWALFQRFLGELILVTMGTKPWF

SEQ ID NO: 957501 - protein, 57 aa, Homo sapiens
LGNRDYSLHNHKDIGSPYLIILRLRLSVLGTASCLLIRADLGQPGDLLGNDHIYNVI

SEQ ID NO: 957502 - protein, 31 aa, Homo sapiens
MSLGTALCFLIRADLGQPGNLLGNDHIYNVI

SEQ ID NO: 957503 - protein, 51 aa, Homo sapiens
DYLYKPQRHWITIPIILRMSCVLGTALCLLIRPDLGQPGDLLGNDHIYNVI

SEQ ID NO: 957504 - protein, 39 aa, Homo sapiens
MTYYSALELEVLGTALYLLIRADLGQPGDLLGNDHIYNV

SEQ ID NO: 957505 - protein, 56 aa, Homo sapiens
GNQEYSLVTTTTLRSPYLIILALETVMSYGTALSLLIRADLGQPGDLLGNDHIYNV

SEQ ID NO: 957506 - protein, 119 aa, Homo sapiens
MDGRRQRIRFEQSYPPISGELSSHPVASVHLTIFSLSPERVSSSILVGIDFITTIINYKTPLPYTQYQTPHLSSDPFLITAAYFSLSLPVLAVCFVIVLTDRNLNTTFFDPAGGGDPIL

SEQ ID NO: 957507 - protein, 55 aa, Homo sapiens
QLVDILYKPQRHWIAIPIILALELWVLGTALSLLIRADLGQPGDLLGNDHIYNVI

SEQ ID NO: 957508 - protein, 51 aa, Homo sapiens
DVLYKPQRHCITIPIILRLAVFLGTALYFLIRADLGQPGNLLGNDHIYNVI

SEQ ID NO: 957509 - protein, 135 aa, Homo sapiens
EWSGSGMECNRKKWNRTECSGVERIAKEWEGMELNGLGWNGVKWNAMEWSGVQWNAMEWNGMDSNGMDSEGMDWNGMDSNGIYYNGRIRMEWNGMDWNGIDSNGMDQNGMDSERNELEWNGLQWNGIEWNGLARN

SEQ ID NO: 957510 - protein, 159 aa, Homo sapiens
MNGIGGIELNGVEWSEWNGMVIGRMELNGVSERRIEGSGRSAMRIGWTAVQWSEVQCNAMQWRAVECNGMECNGFEWNGFETNGLQWNGLKWNLLERNEFCMEWNGMDWNGIDSNGMDQNGMDKKRTNSNGTDSNGMELNGMDLQGMDSKGIDSNGMKS

SEQ ID NO: 957511 - protein, 65 aa, Homo sapiens
GRSAAACRRLTLRGIPQVDSFSDSELDEYKERDTKVFLLTSNPVSSQKQPAFKATSGKGKPAKIV

SEQ ID NO: 957512 - protein, 88 aa, Homo sapiens
HLTGLKCSAMQYGGIQLNGSAVQCNEMQCNSEQMEFNGSAVQCNGLPRNGKELAIEWHCGGNAVKWNAMQLRCVQCNAMPWNGMDSNG

SEQ ID NO: 957513 - protein, 64 aa, Homo sapiens
MPGSDHEAPVLGGDYGLGRNIAGIFVIAHCLSRDFSRMRRAAACLTRAATGFNVWKYTSCPTHK

SEQ ID NO: 957514 - protein, 138 aa, Homo sapiens
DLGPHLINNMICTSFWFKTFPPYVAFCTNNKCRKNHVDVMNRTTNKTEKPTNNSGTDLIKVGITRKRLSITLKTEDESETIKMPIGDNAIKLSNNTMREAKTNHDTLVREDTLFRFIRTNDGKNVFFKTLRNFNTLIN

SEQ ID NO: 957515 - protein, 50 aa, Homo sapiens
MTALATISLEFRHSSFPFSYFSRMRRAAACLTRAATGFNVWKYTSCPTHK

SEQ ID NO: 957516 - protein, 94 aa, Homo sapiens
CCVPGELRASTGTSRIHVHHDASSDPNRDSDAGYRYQIAPVPRWRLRPWRNIAGISSQLIACLCFSRMRRAAACLTRAATGFNVRKYTSCPTHK

SEQ ID NO: 957517 - protein, 54 aa, Homo sapiens
MVLRTVIGGVVNLLICVLEGLRRIGKKPMNYSMISTITQGKEENPSAFLRAATR

SEQ ID NO: 957518 - protein, 54 aa, Homo sapiens
MIDGTDFQLSGIQEVYVSLLMDSREVREDLRLPEGDLDMEIEQTYDCGDEILIT

SEQ ID NO: 957519 - protein, 39 aa, Homo sapiens
EHHQYTEHHQYRERHQYTERHQYNEHHQYREHHQCTVHD

SEQ ID NO: 957520 - protein, 38 aa, Homo sapiens
SGVGARVTVPRDPSPKHASTFSQGKALEQVPKEPLLIL

SEQ ID NO: 957521 - protein, 33 aa, Homo sapiens
MTSFGHTIFSTQLNKSRGALLAWDDIAIIQKQV

SEQ ID NO: 957522 - protein, 98 aa, Homo sapiens
MVALSLHCSRHGCRRFFVAYRGCDSAQATCSGKFNNLVRFRGFPYVPDSRDRDLTTPRFNPQTRQTRVFLFEDEHDDTTADVSNLLVQVASSNSNKQL

SEQ ID NO: 957523 - protein, 53 aa, Homo sapiens
EDFRLVQAYWMVASSMWRARIASGRFNTQVVTADKRYFIGLAVRLLTGVVAGI

SEQ ID NO: 957524 - protein, 140 aa, Homo sapiens
RWLLHLCGGRGLRLARFNTQVGTADKHYFIGLASPAAAGVVAGIVWAFSDYGIQGSKMSFLVALMVAAAGMLMVSNIKYNSFKELDLKGRVPFVAILAVVLVFAVVFSDPPRILLLAFLVYAASGPVQYLLHLRQRKTLP

SEQ ID NO: 957525 - protein, 103 aa, Homo sapiens
TILRIMATLWAAPVHNGLLLSFSMLLKKCRVLSHGEDGRMIAGQVSDINLAAAPKVNRGKAGVNRSAAEMYGSSFDLGTMTFNGDYYDRDVQLPRHVYLLSPP

SEQ ID NO: 957526 - protein, 53 aa, Homo sapiens
SVYWEMVIFTCKICWNPLLVSFSEYQLTHMTCEALSNLEMAETMKCCIFLCTV

SEQ ID NO: 957527 - protein, 118 aa, Homo sapiens
MSQVKYNRARSKSEVGDIGTNPDPQSEEQKQRREDQGSECIGHHGGGPLLRLAEQVLNFLFWSETVLGQDSRGSFLLRELDDHISHIPEDRVLPSGISNDEVESVGAEAESIQSYFRG

SEQ ID NO: 957528 - protein, 156 aa, Homo sapiens
VTKAVWWTWPKCQMTADVYFLRTSEATEIYMSPEVILCRGHSTKADIYSLGATRHPPCMTGNPTLGLKRYHSLISIPPYLYINPQCKHLPLEGHCSMTAVHVDETSLIEASLERNPNQRPRAADLQKHEALNPPREAQTTADTESGLCPLGAQEDC

SEQ ID NO: 957529 - protein, 65 aa, Homo sapiens
MLLFLQQTLLKKKMKLFPSMEIISEVASHLGTQNSVISNCGTTSGNLWMMGPVGFMEYTVFTAIT

SEQ ID NO: 957530 - protein, 56 aa, Homo sapiens
RGAGVGLPVQCVGLPVQVWAYPVQVWNYPVQVWDLPVPVGELPVQVWAYPVAGVEP

SEQ ID NO: 957531 - protein, 79 aa, Homo sapiens
MHGRAGIDIRAITWRVKGGPGVVSPSSAADCFPGAGSHTCTGTETGWAGRWRHSPPRLSGPDSLPRSRSAGAGPNTDRT

SEQ ID NO: 957532 - protein, 37 aa, Homo sapiens
VHTCTGSPHLHGSTTPAPESHTVHLVLHLDLPSKWIL

SEQ ID NO: 957533 - protein, 52 aa, Homo sapiens
LEDPSHTVTDTGFHKVDGLHEAWWAASTLAESQRVLWEYLAPSAVYGVGCRV

SEQ ID NO: 957534 - protein, 47 aa, Homo sapiens
TPPVCSPHTVRPSLVAQLKGGPPHLSFDLVEGTAHPLEIAGRWCETT

SEQ ID NO: 957535 - protein, 64 aa, Homo sapiens
VEVEHRELQVSGGGAQDYRSMEVEHRDYTSVEVESQGLQVNGGGAQGLQVNGDGAQELQAGAGV

SEQ ID NO: 957536 - protein, 39 aa, Homo sapiens
VVPHLHLVVPHLHLGVPHLVPHLHLAQPLEPILIPEVTD

SEQ ID NO: 957537 - protein, 69 aa, Homo sapiens
RLTGAVHPSLGNWWSLRSRGEQLMPNLVRTPDRRSALQPRTPGLKRSSHLSLPSSWDYRLPKEREKLGV

SEQ ID NO: 957538 - protein, 34 aa, Homo sapiens
QSRYLGPDGTGPNILTDITNGLQIPQARINGQLC

SEQ ID NO: 957539 - protein, 93 aa, Homo sapiens
CPSGKLWRDGRGTRPEHHPVPLLALPWTVGRVISEAERGSSLGMAIRVSPLANVVQLVHLIWPSSENLRIYDDIKKVVKQASEGPHKGILGYT

SEQ ID NO: 957540 - protein, 53 aa, Homo sapiens
LWFLKPLAEERDALNLKFGKNPPKKAASELAAFFVPPESERPIGMDPVGGQPR

SEQ ID NO: 957541 - protein, 39 aa, Homo sapiens
MFENRLIIVSAPRTSNHSLSGGIKLLGGGASSSDDSTSL

SEQ ID NO: 957542 - protein, 35 aa, Homo sapiens
PCQPYLDAPEIRNDYYLNLVDWSSGNVLALWYWTT

SEQ ID NO: 957543 - protein, 84 aa, Homo sapiens
CDTEHGYGIIVYHDCNSRQSSCGEIELVVVLDSMIKGVHISHTNPLSVARLRKPAYNPQRPRDVLWSQLVTHSRPWPFPEHAAR

SEQ ID NO: 957544 - protein, 54 aa, Homo sapiens
TSSQGLPAAPHPAAGTPSSQPTIPIVGLVAGLAVLAVLAVLGAMVAVGVTAARH

SEQ ID NO: 957545 - protein, 39 aa, Homo sapiens
CDKYDFRKQHTFILLLVILLQQYSLRENEDITTYYEGAC

SEQ ID NO: 957546 - protein, 83 aa, Homo sapiens
TYYLRTTTTVRRFFRDYVVHWTNVAVGLPLTGDGVTDVTVRYVLTDGGVRYAGLGRTTRLGDNVYTLRLDCMTYELHTHTTYD

SEQ ID NO: 957547 - protein, 49 aa, Homo sapiens
MARPQFISPFYWTRVDGQSFPLVGVILYLAATDHSCAMSLGKHLSAGEN

SEQ ID NO: 957548 - protein, 43 aa, Homo sapiens
RHSILLQAGIGSARHSWHASCFALQSITLLGLGVPQLAIRQSM

SEQ ID NO: 957549 - protein, 41 aa, Homo sapiens
DVYNKGYGFGMVKIDLNTKSLVEWNFLLLVMLYTDTGKAVR

SEQ ID NO: 957550 - protein, 38 aa, Homo sapiens
EGGEMDSEKQCGLALVSFIDPVLEHSSCNTTSSYRVET

SEQ ID NO: 957551 - protein, 93 aa, Homo sapiens
RIPEGAEQKEATVGNEIRGLGKRCKRREDLEIRFILIQNRAGKTRLDQSGTCMFDDDEQTDSWIEESAMPVSPSDDANTHHTLCEFRILYDSF

SEQ ID NO: 957552 - protein, 93 aa, Homo sapiens
VLCRLAHLYRSWYEVHTSALPLGREKGGKLTPEEEEISTSTHMTSKIIHKKYDHRKHIARFSSLLKQQFHQGRAPCVHRLQGRDSVAEHIGIC

SEQ ID NO: 957553 - protein, 82 aa, Homo sapiens
RPHTGPELYPVQALLTSAPFEQDVNTLTRFVTGRRAREGPRHGRVDPSAQLALHSMSKPSLLAVRKVGIAPLYCIAGSTSVT

SEQ ID NO: 957554 - protein, 78 aa, Homo sapiens
FCILHWDCHLAAVRLARRPGRVGECRPVQLPSTKLQRAPSGLGTSCSLNQLLATCVARHNTYLQECTGQREPIVSRSI

SEQ ID NO: 957555 - protein, 59 aa, Homo sapiens
MRICLDYEKSYRIKDGVFLYFEDAAGVIREQLKAIMKGSAITGPVAKDCADFWPRIASN

SEQ ID NO: 957556 - protein, 81 aa, Homo sapiens
TILTRGAVSCSQPNMTIKKDIEKDSPKCEREDMVHPYSHLPSGLGSFNWLGPDTRFDHIAMVENEGLEAQKLLPYPPTYPR

SEQ ID NO: 957557 - protein, 43 aa, Homo sapiens
AGQLISLGRTGLLAKSVLLKYHTMLPHSLTYLVIPVSRTFILS

SEQ ID NO: 957558 - protein, 46 aa, Homo sapiens
YTSRGKNVKKKALTDFKKLRAYFVEEDGAFPAGKLTRRRSSSEVLA

SEQ ID NO: 957559 - protein, 72 aa, Homo sapiens
SVYLSLLSVWWGVELIHSTDLFRALQDPHPSLAVELVYPGAPFISRKSPPRSLPPPAVLSPYPTIEPPYRSA

SEQ ID NO: 957560 - protein, 53 aa, Homo sapiens
MRIFLYPQLPSSRLILSGAKSPVSGTVFPIPLPAIRPLVHRPPCPCARGDPAT

SEQ ID NO: 957561 - protein, 59 aa, Homo sapiens
CVVAGRFLFTFTCFWLRRLALARAEPATSYVRTTIHMIARATLSSLRHIIRSTKYRTDL

SEQ ID NO: 957562 - protein, 48 aa, Homo sapiens
MVCKHLCYQHGHNAVRSGECDEAVACQTARQPGSSPAAIRRAVIHAYM

SEQ ID NO: 957563 - protein, 82 aa, Homo sapiens
SRTFSSIYTPTSLLPPGSAVQAALLMWAHVRERAGPAAAGRGSPFRWGLATAGWRDDCPDQCATPPSPPSSTHILGYPNASK

SEQ ID NO: 957564 - protein, 141 aa, Homo sapiens
MRSSSPDERLLPRQRAALLLRVEYADLTLQLGDDGACARAVPQHEIRQITIEVVPEVEHAGATPFLKRKKSNRFPCREILPFSKRVIRSHCSEPFSSSFLKGLRRSVKKLGLSAWTMTTSKSCANRDHHVPIPCYEAKDVV

SEQ ID NO: 957565 - protein, 57 aa, Homo sapiens
NPGTSFISNSFMGAFRQSFTSVCNVDLEQSVTTQYSGLNEHQSPIVPIYVNLCTTLT

SEQ ID NO: 957566 - protein, 59 aa, Homo sapiens
MLLCAAAAGTLPCSLHTYYYRAHDHSRTLKTLQLTSDLVYGASPPARPTHATPEKTSFN

SEQ ID NO: 957567 - protein, 37 aa, Homo sapiens
VYSASVTSDNLSRHDMRAPGSMRSLQLNLTKIEQLCS

SEQ ID NO: 957568 - protein, 32 aa, Homo sapiens
DCMASLDIESSEAVFASAFSIVFPEWSSSTSL

SEQ ID NO: 957569 - protein, 46 aa, Homo sapiens
RYVAMTQCGSLGPPLFKGSTLQLCGGEIPCGGGLSVAGTPQTVQGL

SEQ ID NO: 957570 - protein, 51 aa, Homo sapiens
TDLRHTGKKSQGSAEQDVDIEKIKPSWGLENQSGSHARVSHVVCFIGPSGT

SEQ ID NO: 957571 - protein, 75 aa, Homo sapiens
MAMEYYTLSKFLELITAQFCPTPTSSGWNYVKGELPTLNREQPDQLTQPQISWKEETSVAGKGIVSYYLAIHSTI

SEQ ID NO: 957572 - protein, 36 aa, Homo sapiens
LPCPSAGPCHPQHSSDSSFFASTYLLLELAQQAREG

SEQ ID NO: 957573 - protein, 70 aa, Homo sapiens
ELSGRSHECDFVSFPPAAICLGSISAVFSSGAPLDQQCEVLGAAEDRDCGQGGLTSVGAIGIEGDRTERQ

SEQ ID NO: 957574 - protein, 57 aa, Homo sapiens
MAHGQEPTRRAFPPPEACTRGADTKGISIEGNIAVGQSTYVKLLRKINPDWHVATEP

SEQ ID NO: 957575 - protein, 41 aa, Homo sapiens
VGVCFCLSAVQVWALYQLFTGLLKGQWCPRMLGFHLMVDNL

SEQ ID NO: 957576 - protein, 73 aa, Homo sapiens
RFVCLQPGVGQGRGPATQVGQRDAWAGRWVMADHFFPFLSARIGHSRSSESVPKVYLRAERERPCRYPKGTEL

SEQ ID NO: 957577 - protein, 59 aa, Homo sapiens
MPSDAMERWLHLSKISLSQRISCTVFNQYPGEKLLLLQSFDKLTYICPNQVSLAKRVPS

SEQ ID NO: 957578 - protein, 38 aa, Homo sapiens
MHLQMAHETVVCSTDLQSIDRSIPPDRVDGESGLGLRR

SEQ ID NO: 957579 - protein, 42 aa, Homo sapiens
MYRALYAGAGTDAMSSRISTSMMYNQSVSLDDRPSRPSSATW

SEQ ID NO: 957580 - protein, 44 aa, Homo sapiens
YSLYYTYNLSKRTNLYALGSYATNYRFIDGVKSTVGMVGVRHRF

SEQ ID NO: 957581 - protein, 82 aa, Homo sapiens
VLGVEGQALLLGVVAERLRTLEAGDGLGLAQQQLLDLMVSRSTAMISARRTSRFWVMPFLVLERSAKAHPGPPVGNDVGIAQ

SEQ ID NO: 957582 - protein, 47 aa, Homo sapiens
VVVCELSLIQIPVIYLESVHTKLHHREGMRMSWQDEFRQWFPITRDK

SEQ ID NO: 957583 - protein, 66 aa, Homo sapiens
TRITLLMTSTDGRKNRFPAQFPGNAEQIPPPPDSTVPPTSGKLTRSLPRGALCVSLISRSAAANSP

SEQ ID NO: 957584 - protein, 54 aa, Homo sapiens
AIFDFLDYIVNEPPPKLPNGVFTTDFQEFVNNMPHQCTHADASDLEDAHKTTLF

SEQ ID NO: 957585 - protein, 37 aa, Homo sapiens
HVMMLLSVARRILVDGWSAHMAVAGFLLDGISCLMTQ

SEQ ID NO: 957586 - protein, 74 aa, Homo sapiens
MDNRRCSTRYPVAYRNFMNRCSGLKLAFPNPMTSIPQPRKSPRQQGSKQTVDTILQATDRVRAEHGYRGNKHQP

SEQ ID NO: 957587 - protein, 76 aa, Homo sapiens
KGVTGVEKGIANTVNINVGFLCLLLLVRVFVPGRLLNLLNGMLQNLGDYLTSLVSRSFDMYLYGKARQWQGAWTLF

SEQ ID NO: 957588 - protein, 51 aa, Homo sapiens
MRQIGESRSTPEGQDCGGQMEDVVLNAHVRIQLSKTDKTLVGSFEVSDGIG

SEQ ID NO: 957589 - protein, 34 aa, Homo sapiens
MTSTLTVVKNRFPAQFPCNAEQIPATTGFNRPAH

SEQ ID NO: 957590 - protein, 64 aa, Homo sapiens
WTYHTQTFALTLLRRGDQDVGTNWTIGYDPGQNPPYGEALKAAYKFINVGNYQLNVSCGALTQE

SEQ ID NO: 957591 - protein, 30 aa, Homo sapiens
MQSHNSFRGGESSSSSGLGSILTIPITTQH

SEQ ID NO: 957592 - protein, 38 aa, Homo sapiens
HRSYGSAYRIAYGFRYVPDDGVLDQPILFARAARNVVQ

SEQ ID NO: 957593 - protein, 98 aa, Homo sapiens
GASKSKSRLGSTGAFAIQINGQLVFSKLANGGFPYEKDLIEAIRIASNVEDPRGYRQQLCSLRHSCSREDSGFLLCSGVQTLVSLWSCWELPLPLSPT

SEQ ID NO: 957594 - protein, 55 aa, Homo sapiens
VRGAAGKPGSDRDWRRLREQTVNSRRFYLLPPFPGTEAVPTVCSPLYPPPCPPRM

SEQ ID NO: 957595 - protein, 36 aa, Homo sapiens
GAVADVTEVDDCGGRLPKGLSLKKNRFIENSGRPPN

SEQ ID NO: 957596 - protein, 41 aa, Homo sapiens
SPGAHEQAGERLRWRWPYDICHGRLAGGDRLRAHRDLARGS

SEQ ID NO: 957597 - protein, 41 aa, Homo sapiens
MARGLLLVSLYFIYRQMLAYDSVDFAVDTCVIPSGSLPLLH

SEQ ID NO: 957598 - protein, 42 aa, Homo sapiens
VALRRQAFQVRLVLVRLCSGRYSRMRTALPPLELLRCSAGPC

SEQ ID NO: 957599 - protein, 34 aa, Homo sapiens
DLEDPHAAGEIHDHEGGFPSARLIHCTPNATPDG

SEQ ID NO: 957600 - protein, 112 aa, Homo sapiens
PYTYILLQAPLMLTAARCIRSASSSFMTTRGRGFEPRACARPSTLTTSRDILEAMARGEGPSNAVVIVVCCGWGAGQLGKRAVRRNSWLTVRADAELVFQLPLEQALAGCRL

SEQ ID NO: 957601 - protein, 39 aa, Homo sapiens
SARYLLGGIQGGEVLVSIETSSEYSSMQSHNLYQHPPPY

SEQ ID NO: 957602 - protein, 49 aa, Homo sapiens
IPVAHHILGIPACMRTSAKTRPVILYQQAIFDRHQCVVLDERELYSVSH

SEQ ID NO: 957603 - protein, 74 aa, Homo sapiens
MKDEDIRIHTCILSIVIFTLPSGCVTDGKDTSEPNKHRSIHTRGKVGRPLKGLLRASTSSQMASPYDAQDDARK

SEQ ID NO: 957604 - protein, 77 aa, Homo sapiens
MKLSKLPTRPYDYFDLSGMCLRLTEVRDETTFYRPHDRSGLLVAYPEEKNLTAIINLLRFVKTTQRRQSAMNESSTD

SEQ ID NO: 957605 - protein, 46 aa, Homo sapiens
LVVGGGCDGNSNNYLTKEELLKKFATVTENATGVTVCHQQECSGFL

SEQ ID NO: 957606 - protein, 39 aa, Homo sapiens
MRIDVCLLRLWTYFWWALCRKLERGNHVSCMQLRKAWPV

SEQ ID NO: 957607 - protein, 71 aa, Homo sapiens
GRYIAYNSGLARYGAISERYHSGMELGRDRRLTRQRAILYKRLKVPPAINQFTQNGSPNDPQHVPPNASPN

SEQ ID NO: 957608 - protein, 46 aa, Homo sapiens
QTGCRTYFMMGTVRKLDDLKSVTLHALERNGLYPHLRARSIDHSPV

SEQ ID NO: 957609 - protein, 42 aa, Homo sapiens
SDILLVGTEQKLEDEISELLHLERLGLISSLECKVHRPKPCS

SEQ ID NO: 957610 - protein, 65 aa, Homo sapiens
CRHILLVGTDAENLRIEISELHALERHGLSTSLECKVHQTKRPCSRSHTHCTDQGVSYYEIAPST

SEQ ID NO: 957611 - protein, 48 aa, Homo sapiens
VSRMLITILGTVKPNANRIALDFQRGNDVAFHFNPRFNENNRRAKGGT

SEQ ID NO: 957612 - protein, 53 aa, Homo sapiens
VSPKIQNNNTPERHECRPAMILGYWDIRGLAHAIRLLLEYTDSSYEEKKYTMG

SEQ ID NO: 957613 - protein, 46 aa, Homo sapiens
WRRRVSRLLKSGLSGRSCCCTRRMPTPTGTCNNFVHSDLYGHSACA

SEQ ID NO: 957614 - protein, 58 aa, Homo sapiens
MDEVTTFVHSDFSDSRRMVTRRVQFGVFGVCMHTPRLHTTLNAPDLVWMLGSRCGRSC

SEQ ID NO: 957615 - protein, 78 aa, Homo sapiens
RHSDLIQEVYDVGVCSNNFVQSDLICGSVWTVGVCSNNFVHCDLECGPSACVHTRNDQTFLRSSGVDEVVANPKGRSC

SEQ ID NO: 957616 - protein, 34 aa, Homo sapiens
RWMIIVAQQLRPQDLIERSVWSFGVCMYGCSACA

SEQ ID NO: 957617 - protein, 55 aa, Homo sapiens
MDLGVHAHADGPIQLMMDEIVAAHAEEPHPLVHKSRWTKLCNNFVHWTCMDIRRV

SEQ ID NO: 957618 - protein, 130 aa, Homo sapiens
DRNLVGNAAHNSLFDVICTNKKKSRFQTADPPRLSKRSQRRQNISVPTNMPLMKKHHPRNRCVDSLAIVLTCLSLGQFPTVRGILSAHTAVPSTAVRPCFGIRKGVETSRMSLSYVDSGIILRTPAGMGS

SEQ ID NO: 957619 - protein, 31 aa, Homo sapiens
MYVSGLSRITHVVCGPSVCARRSTESDTHCA

SEQ ID NO: 957620 - protein, 81 aa, Homo sapiens
WLYMSIAVCLLTHSLQDILLVGTVRKLEDEISETACTYDRHGLSPHLKCTGPIDQSPVSDHYSLYRPGENLYEYELAQAIS

SEQ ID NO: 957621 - protein, 72 aa, Homo sapiens
CAHLLRARITMRVGHTDRNVQLLQITVDEVVAARTSSIQTCGGLDLRRVQTTSSTLICGGLLARRVQHADRP

SEQ ID NO: 957622 - protein, 124 aa, Homo sapiens
YQPIPKKELVEIASRKDIPVRIFTYSPIPLSYGCLVEIGSTDALPDDVPVSATRGQAHPLLQHDVLELSSTYRTLGQETEATQEGAIHLNHRPSPHTNILLIHHSNFRIPFSMNEMIVKPNDEV

SEQ ID NO: 957623 - protein, 43 aa, Homo sapiens
SEVAGGVVFRRVQGQVSMDEVVGAHAVCADQRRCGEVAVDEVV

SEQ ID NO: 957624 - protein, 31 aa, Homo sapiens
MKAKGCYFKKGTEIVQLHATPTPFLGSDVAL

SEQ ID NO: 957625 - protein, 47 aa, Homo sapiens
QNRLWSMALPQVRRQALAFQCMPLTDFILTFRTVHQKYVRQAWQTAD

SEQ ID NO: 957626 - protein, 47 aa, Homo sapiens
MVTRGVTPKKPILTRRDPVLHQGSEWTKLLCTRRGSILEEIVVDEVV

SEQ ID NO: 957627 - protein, 68 aa, Homo sapiens
RQYFVGLRRATIIVHSDLDRRCLESRRCAATSSSTLTSRSVWTLGVCSKNFVHCDLSTNSQCVVPRSV

SEQ ID NO: 957628 - protein, 63 aa, Homo sapiens
MGIRRVHAHAETPNKSRWTKLLQISVDEVVAAHAEGPDRRRSEWTKLLRNNFVHPDLRRYGPS

SEQ ID NO: 957629 - protein, 107 aa, Homo sapiens
ALEDSTTSSIAICSVWILGVCSNNFVHRDLISRSVWRLGVCMHTPKTQTAHAECPDYPQLGDPIVPRCLEDLILSRCFRYWISVVSGKSARSLESLVAAFPAASELT

SEQ ID NO: 957630 - protein, 54 aa, Homo sapiens
MDEVVAATTSSIETATTSSIVDLDQIRGEQVWALGVCSNNFVHTDLMYLVIRRV

SEQ ID NO: 957631 - protein, 76 aa, Homo sapiens
QSDWTKLLHTPSVIRRKSQWTKLLRNNFVHPDLIGRSVWFFGVCCTRRISTHHTPNLHTAHAESPDPLVHQVLMDE

SEQ ID NO: 957632 - protein, 75 aa, Homo sapiens
LYRILCTREYCIRRCTREHQTVCHQEVRMDEVVADRCGRSQQLRPYLICVVIRRVQHAEAPYVRESQHVIVDEVV

SEQ ID NO: 957633 - protein, 53 aa, Homo sapiens
LEDLRNNFVHTHLCQQGVWALGVCSNNFVHHDLQQLRPFRFDFKKCLVPRRVQ

SEQ ID NO: 957634 - protein, 53 aa, Homo sapiens
AGPCTRRAPYTSSIPVDEVCNNFVHNDLYGFSACAVTTSSTGTSRTRLDVRRV

SEQ ID NO: 957635 - protein, 62 aa, Homo sapiens
MAKLLLHTPRLQTPRVREITVDEVVGNNFVHSDLGLGPRRVQQQLRPQDLILRSVWRLGVCR

SEQ ID NO: 957636 - protein, 37 aa, Homo sapiens
MATSRHIIHHYALFSLVLRRVQSTVTFAPRYGLSACA

SEQ ID NO: 957637 - protein, 85 aa, Homo sapiens
LTRRANIHFLRSGHKWTKLLQIRVDDEWLLHTPKNQTSGDPPTSASRSAGITGVSHHTRSLFLFNRNNFVHQDLISRSVWTFGVC

SEQ ID NO: 957638 - protein, 121 aa, Homo sapiens
LGAFEVPWEPELHLKAKAGVASDFGKETAFFEARGLTKITFSPLPHAFRCLQAFLLQTGDGKHQDLKYISPETMAALLTGKFSNIEDKIVIVDCRYPYEYEGGHIKTAANLPLERNSKAQA

SEQ ID NO: 957639 - protein, 36 aa, Homo sapiens
LEDPGKLRPLRFLVWSFGVCSNNFSIAICMDLRRVQ

SEQ ID NO: 957640 - protein, 60 aa, Homo sapiens
VSLEDPSHAEPPDVREIRMDEVVAQQLRPFCFAAVWVFGVCSNNFVHPDLKKYGDSACAG

SEQ ID NO: 957641 - protein, 36 aa, Homo sapiens
AQIGKVDPVEHVLELHLNWYASKTVSMSHPSPRMVC

SEQ ID NO: 957642 - protein, 44 aa, Homo sapiens
FEATRDGQQLRPPRFAQVWSLGVAHAEYTTLYFSRTQIRVDEVV

SEQ ID NO: 957643 - protein, 33 aa, Homo sapiens
SGLQNGDAHELDEARFPLILPTTQHDALYAPQH

SEQ ID NO: 957644 - protein, 59 aa, Homo sapiens
DLAHAESPYPHVRRSKSQWSAVVAQQLSSIRICVDSRRVHAHAKHPYTSVKSSHMDEVV

SEQ ID NO: 957645 - protein, 55 aa, Homo sapiens
NNFVHPELVHPDLNKCMVPRRVHAHAEGPNYITVEVCVDEVVAGHYGVWIFGVCR

SEQ ID NO: 957646 - protein, 55 aa, Homo sapiens
MCGALEVPTPRHQTGPERTRTGDLTSSFSIPWVVGNNFVHSDLSDSRRYGDSACA

SEQ ID NO: 957647 - protein, 42 aa, Homo sapiens
LRIPFVHSDLSTHNAASLVPRRVQQQLRPEVICGVGTFGVCR

SEQ ID NO: 957648 - protein, 38 aa, Homo sapiens
RVAYCTREATLHTPRAQTKIADLHVHTPSAHTIIADLH

SEQ ID NO: 957649 - protein, 40 aa, Homo sapiens
VFAVPGGSMVATLKLSGFDARAPPGVYPADEFDLARSPSP

SEQ ID NO: 957650 - protein, 81 aa, Homo sapiens
LNNDTAYAEVTTLHTPRGQTAARRASIAKSPIFTCTRRKTTLHTPKVHTAHAEGPYCTRRDPTRTGHRPKSPIFTDLHESN

SEQ ID NO: 957651 - protein, 97 aa, Homo sapiens
DRDIGVGVSACAVKIGDFGLVKIGDFGLDVKIGDNALTSRSVWILGVCSMDFRRVHVKIGDFGFVKIGDYGLVTRRVQHAEDPYRSRSATLVWALGV

SEQ ID NO: 957652 - protein, 36 aa, Homo sapiens
LDRDDRRLWFGIRRVHVKIGDYGLDTRRVQYGLRRV

SEQ ID NO: 957653 - protein, 106 aa, Homo sapiens
MGGHRFGRSACAVWALGVCSVVFGVCSLDIRPRRTSTHFLKSNHNRRSSRGRNRRSSRVKIGDIGMDTRRVQFGCSACAVGGFGVCSMDTRRVQCVAFGVCNFGYS

SEQ ID NO: 957654 - protein, 37 aa, Homo sapiens
MLGLHRESHTAHAECPWDIADLHVHTPNTQTIIAEGI

SEQ ID NO: 957655 - protein, 111 aa, Homo sapiens
WSWTLVRVHVKIGDYGLLSVGIRRVHVKIGDFGMLSVDPRRVQFGHSALHTPNVHTEGVHNRRSSRHAEGPHCTRREPIVADLHVHTPNVQCVVADLHAKRPYGVLEQPII

SEQ ID NO: 957656 - protein, 48 aa, Homo sapiens
KDGDIALLSMVIRAHAEDQTDRSKRSRRIFTLKIGDFGLVLRRVQSGG

SEQ ID NO: 957657 - protein, 30 aa, Homo sapiens
MADLHEIGDLLWTLGVCMHTPKIHTDVADL

SEQ ID NO: 957658 - protein, 74 aa, Homo sapiens
LERYQAMKRRSSMRYSCEKMSKHTLIRRFPNGGKPAERSSYTEYNRDTEAERSELKHLSSCRNRTQTRGAPLEV

SEQ ID NO: 957659 - protein, 43 aa, Homo sapiens
TDYQHRHAHKERLKQKKELGKSYPDLYTKNITSSITQYYEAPL

SEQ ID NO: 957660 - protein, 55 aa, Homo sapiens
GKGYPLNPEVVDQEERGYLRGKEALKGTRCRLSAKGMPSVLGPVSTTGRNSERSE

SEQ ID NO: 957661 - protein, 97 aa, Homo sapiens
LLRTTALALVTHCAKRSPSGCHIVSAHPECRCTLGSTGPARSTAAGTQGASQGTWLELPTNHYYDRTRIPQTHISRRQYKLREQSDYKGHNVIPPNM

SEQ ID NO: 957662 - protein, 71 aa, Homo sapiens
SIPGGFVRSWPGKFDPPDLTLCCRSPYSPISFRLLSRDEISRKGLRVVTLNFSDNTQTPGPLGMLGSAYPV

SEQ ID NO: 957663 - protein, 44 aa, Homo sapiens
MVSLVLAPALASCGCNVPNDQRTVVWGTQRVHLVISWMSIPVIQ

SEQ ID NO: 957664 - protein, 50 aa, Homo sapiens
MAAQCGDSGAVKIGDYGLVKIGDYGMVFGVCSEDRRSSRVKIGGRTFGVC

SEQ ID NO: 957665 - protein, 45 aa, Homo sapiens
MGYAGLKKCMDSRRVQCGDSACAVWTFGVGDNVSDLSLSMGTRRV

SEQ ID NO: 957666 - protein, 64 aa, Homo sapiens
TPKVTLHTRASTLHTPNTHTAHAECPYTSEKAKSPIFTDRRFGLLSVGFRRVHVKIGDFGLVAR

SEQ ID NO: 957667 - protein, 60 aa, Homo sapiens
GRRFGLAQVWAFGVCSMDSRRVHTPSPQTIVADLHESEIAIFTIGDFGLVPRRVHVDIRR

SEQ ID NO: 957668 - protein, 33 aa, Homo sapiens
AHARAPTPHAEGPQLHTRKTKTPRNRYRRSSRG

SEQ ID NO: 957669 - protein, 62 aa, Homo sapiens
VKDGDFALQNYALVRSATTLCSVWILGVCNAEAPYRNRRSSRVKIGDYGLDLRRVQCGLSAC

SEQ ID NO: 957670 - protein, 49 aa, Homo sapiens
IWLDLGVCSVDIRRVHVKIGDFGLGSRRVQHAEAPYCTRRVTKPLSPIF

SEQ ID NO: 957671 - protein, 38 aa, Homo sapiens
TKLNGQERIIADLHACSSALSACSVWFFGVCSVGTRRV

SEQ ID NO: 957672 - protein, 54 aa, Homo sapiens
MAHLSSRICYHPPTNISLNIQTSRVASEAGVMIHGIVVDYGLTYFCIVSSVLSE

SEQ ID NO: 957673 - protein, 133 aa, Homo sapiens
FRNHHVICLIHARNEDHLSYFTFIGRVAASGRHFIRSSIDGFFIRPYYTMMLGKQITLNDMESVDREYYNSLKWILENDPTELDLMFCIDEENFGQTYQVDLKPNGSEIMVTNENKREYIDLVIQWRFVNRVQ

SEQ ID NO: 957674 - protein, 59 aa, Homo sapiens
ISVVMLLIMRYTLDWVIYNRTVGRVTVPHGWAGLAEATIIAEGEAYTFFFTWQADQVVV

SEQ ID NO: 957675 - protein, 70 aa, Homo sapiens
MPIGIGATGGHVDAPYRYGRGTVMTQPGTGSEKPDNLGDSSSRGESSPAQDGGTNLPSGAELQPEDSQHD

SEQ ID NO: 957676 - protein, 44 aa, Homo sapiens
IRGSPISAYSAQMFPTANTPMPLRKQSKRRSNLFTYSEQGATLV

SEQ ID NO: 957677 - protein, 40 aa, Homo sapiens
TFVYWGYRQFCSMDIRKDRQLLIVGITLALESSGACLSPE

SEQ ID NO: 957678 - protein, 35 aa, Homo sapiens
DFGFRQCDVKIGDIGLAQYGLSAVCNLHEPIIADL

SEQ ID NO: 957679 - protein, 51 aa, Homo sapiens
YPVLSCVERLSGYSDNEASRSLIIETLSGSYSSSTLQDTGGVLGDWPVRFY

SEQ ID NO: 957680 - protein, 36 aa, Homo sapiens
NADPQTAHAEAPGRIADLHVHTPKNQSVSPIFTGDP

SEQ ID NO: 957681 - protein, 64 aa, Homo sapiens
MRFGRHEVRIEAGVQSVQITPSRRVTGVKTRPDVENELQVDTTYRSTQEWHCNTIVNLSTNELT

SEQ ID NO: 957682 - protein, 49 aa, Homo sapiens
CFVKIGDIGLDARRVQYGSSACACTRRVSILHTPKIHTRTGQSVIADLH

SEQ ID NO: 957683 - protein, 63 aa, Homo sapiens
MSLTCLEPVHPGVEVTTAWGPGPCTGDLEMLSLMEGSTARDGVQLLMQHDMDGNRAKKDKVAL

SEQ ID NO: 957684 - protein, 33 aa, Homo sapiens
VYLLKSATEVNSPGCVAFEFDHLIEHSQATCFV

SEQ ID NO: 957685 - protein, 36 aa, Homo sapiens
MIESSSVPQRHLSVKYVYSLENNDNDQATEELSWSS

SEQ ID NO: 957686 - protein, 46 aa, Homo sapiens
RGGTRSRTEQDYHGDNSIISEVKSNLSHDGLLTAHVPVLVGEQSNA

SEQ ID NO: 957687 - protein, 55 aa, Homo sapiens
SVDTLGVYELVYGIAGYAVRIHKNRKVRSRVLVTKYVVYEFSVESASYVVPIVDC

SEQ ID NO: 957688 - protein, 58 aa, Homo sapiens
VIGSFPDKSLHQLQNAPVHQAPSLYKSGRILYDIRPVCNSACPRARRSLQALLTCGNM

SEQ ID NO: 957689 - protein, 157 aa, Homo sapiens
PQRVLIFDSVCHINARLQRSSHVHHTIFIYRWCGHPGKFRLQITFLKRERHFAIFNTLSHIQQDLTSLRPFVAVFNCTFEMPSITKRKPPSGTGSDGFSIEYFKRTHRITIDIAETETVVLQEVIGCDVARLFFQNTANFELATNIRKSRIVSIVNG

SEQ ID NO: 957690 - protein, 54 aa, Homo sapiens
MGPTCLPAHWSTGWPHRLGVLSGAGYCCLASDDEGFVEVSMAIAAAALQTLTVA

SEQ ID NO: 957691 - protein, 32 aa, Homo sapiens
NIRVSEIEEEAALRNASNQLINHIETVFGHQC

SEQ ID NO: 957692 - protein, 39 aa, Homo sapiens
WVVLNPTLTVGERLGYGPDAPSADPFSRTRLIRHSELLS

SEQ ID NO: 957693 - protein, 47 aa, Homo sapiens
KAEHEVVRLIGVHRITEQAPLQGYEGTRSDALAPVCKRGSSNISTMS

SEQ ID NO: 957694 - protein, 38 aa, Homo sapiens
TARIEQRAINRVEVLSDGPSTWVMFPVIDEPEVYRGIL

SEQ ID NO: 957695 - protein, 33 aa, Homo sapiens
ARMLGLRGGPGYEEEDEDEEEYDEDAQVVEDEE

SEQ ID NO: 957696 - protein, 119 aa, Homo sapiens
REHYKHLYANKPENLEEMDKFLDTNTLPKLNQEEVESLNRSITSSKIKSLIKNTPTRKEKKKKGPGPVVFTVDSYQMYKRKLDPFLLNPFKKIRGRGFLLNSFYETGFILIPKFGKDTP

SEQ ID NO: 957697 - protein, 63 aa, Homo sapiens
IHNDSQIEADFRLNDSHKHKGEHKDREHRHKEHMKEKGRYKSKHSNSEHKDSEKKHKEKEKTK

SEQ ID NO: 957698 - protein, 136 aa, Homo sapiens
MHYELVLVNLHLDSVEDELVNEIVSAQPRSVNSGRASIKVYDSQPFYKRKNTGSPDRKPSKKSKTDSSSLSSPLNPKLWCHVHLKKSLSGSPLKVKNSKNSKSPEEHLEEMMKMMSPNKLHTNFHIPKKGPPAKKP

SEQ ID NO: 957699 - protein, 114 aa, Homo sapiens
RSAPLCEPRHPLRQGRPRWTSVRRARPGVTVGTGDGGIPDLDKLPAPFRTVVESAYGHGVGDVFLFAAPAALIAFLITIFIKEVALKTNAANDAPAEAEVPAAVLAEVPSGAAA

SEQ ID NO: 957700 - protein, 182 aa, Homo sapiens
MENNNVWLGWGYARGGGDIGMYRHALPPGLVSTKNKKKEEKEDEISLEDLMERERPALGPIVPKLTLESFLAGKKREKTRKDGVTLTMIWKRGKADFKSGESTSESGVVKCVEFRAERVKDDDEEADDTGYTQGTGGDEVDDSVSVNDIDVSGYIPGDVDETGIRVASVERSAIIFREDEEI

SEQ ID NO: 957701 - protein, 80 aa, Homo sapiens
AGRVSQQALSEALWPHQRGQYTLRDSILLCASNYAQTTDSCSQRSPCLSLLSSYDCRHMPPDLTDDYGAMRRDQSTAVTT

SEQ ID NO: 957702 - protein, 45 aa, Homo sapiens
PYNLPYPQAYLLSPRGVPQIVVTFDIDANEYPQMSLLCDNEYAEK

SEQ ID NO: 957703 - protein, 33 aa, Homo sapiens
LQRILYGHGTGVVKHDVTSAGVCLVSNWVMRRR

SEQ ID NO: 957704 - protein, 39 aa, Homo sapiens
EWYVAVRTSLLTQLVTVTRVRFRRGSLIKRLPHLNGGYL

SEQ ID NO: 957705 - protein, 54 aa, Homo sapiens
MERARNGVILEDLVRCNRGPLRVVETVLFVIEVERVDRLAHPLVKLVFQRAIGQ

SEQ ID NO: 957706 - protein, 75 aa, Homo sapiens
HIESLLTLHANGLLMLLLWTTVRETRTKLLSLNDKGLLGARNTLNVWSRKLRMYNAEDQKQQGHGVIQEIHRQFL

SEQ ID NO: 957707 - protein, 45 aa, Homo sapiens
MRRPRGSRDAACWIAACTLQSADTPRASDHAVGARRLRFEAIVFG

SEQ ID NO: 957708 - protein, 70 aa, Homo sapiens
TVDLMPNGILNVAAVDDSYGTREQNYYHEGQGRWSKEYIERLAQEAEMNKAEDHKHRDTGVIHEIHLQFL

SEQ ID NO: 957709 - protein, 64 aa, Homo sapiens
SLLPLCATGLDTGCCRGRQYGDTENKITITNDKGRWNKEYIERMVQEAEMNKAEDDKQRDTGVI

SEQ ID NO: 957710 - protein, 99 aa, Homo sapiens
MIAIRNFQSEVNFSEIAFSSNFCTRFGNDPGDFIFSPKIRKSSTLCMIGIENDKPSILTIKNSILSRHQRSTPPSKDGDSFHPAKAALCDGEPPKELTS

SEQ ID NO: 957711 - protein, 157 aa, Homo sapiens
NSYEREMFDKARLKLGLDKAVLQSMSGRENATNGVQQLSKKEIEDLLRKGAYGALMDEEDEGSKFCEEDIDQILLRRTHTITIESEGKGSTFAKASFVASGNRTDISLDDPNFWQKWAKKAELDIDALNGRNNLVIVTPRVRKQTRLYSAVKEDELM

SEQ ID NO: 957712 - protein, 67 aa, Homo sapiens
SSARLTSESLSSGNLFVTIASPPPSVNRITTTGVLCPVNGIAVCASNTTRYPLTCVSSNNNVKGFIS

SEQ ID NO: 957713 - protein, 166 aa, Homo sapiens
AGSESGKINNVNIKSKFMNFAQKMAPQRKAQVYCNHLKAMVPQVKGVKICDYSQDSKSPGKRNGASPAYSDYSYRVHKESDAENQVPCNTNNIGNLGEEEPKFHAHEENRGHSEVNFDSSTVVKEPGLKDNMNAERKSKVGNTYILKASLEPENIKSTPGVANNGS

SEQ ID NO: 957714 - protein, 61 aa, Homo sapiens
MLAGQRFDTQEAQDVLRIGRAVHNHFTLVHHLTVMHQHLLVFGNQELVFFTVHIGDFQTLL

SEQ ID NO: 957715 - protein, 90 aa, Homo sapiens
YALNPAEQRGEFHGRFSLPSIMASNAPFTPSIEMMVMSLPGLSPASSMAWMAPIAMSSLCAYSTLIFLPSAFRKASITSLPLARVKSPVC

SEQ ID NO: 957716 - protein, 42 aa, Homo sapiens
RSYRACSGIEHEVCTHGVAHAPADDAASEYVDDEATYSQPCQ

SEQ ID NO: 957717 - protein, 50 aa, Homo sapiens
MRRCCRYRRYTLPGIGERQPSSFASEQVFADTLFQLTNLGRDRRLRGMQL

SEQ ID NO: 957718 - protein, 154 aa, Homo sapiens
TVCEDNNQLSSTANYTYAVQGVSDDLNFLKDTHMVSSQEISWHWAIPCAEGCFGQVVIAYSLVIDDRPAHVGGYLAVKILKDDATEKDLSDLVSQMEIMKMIGKHKNIINLLGACTQDGPLYVIVEYASKSLREYLRARRPPEMEYSYDINRVP

SEQ ID NO: 957719 - protein, 50 aa, Homo sapiens
MLNWIKNSCSDFGRKTKRECLELSDYQSRSCKARCRPRNCMEAQYHGFSH

SEQ ID NO: 957720 - protein, 111 aa, Homo sapiens
IPSEEVEQLELELHRNGYYFLTQYDVELYPAHRTLNWEETTRSIQTQDDEVMMLTERVAEAHRLARMDVQGRMEKRRNARERMLEIMMTQTGAIGVRNKVAGGKMKKWTGR

SEQ ID NO: 957721 - protein, 91 aa, Homo sapiens
FPQWHHIARVVSRRKKFLIERKGNRTTVVNKIADILPPKLHLASKRFSSFAIQITSQTHHEFIKLTISSQRLRPSTSALRLKIIRSFRHRN

SEQ ID NO: 957722 - protein, 108 aa, Homo sapiens
MTRDLAVKVPYCALMCRRVEVRVCSVQLSVVCQKESQAQELVYTVSSRAGDLSRYIEIALKRPGCVDDEKYSRKEDVLVNASSCEIKYFTYSPFVWPGKLYGDADYLE

SEQ ID NO: 957723 - protein, 45 aa, Homo sapiens
SQVGLVHQGPVVHDVEGDFRVVAGAQLLPDQFLDVLVAGVLGKAQ

SEQ ID NO: 957724 - protein, 97 aa, Homo sapiens
NTRLNWYLARSKCVVIMYHWRATQNKYLMSKPVTSTERRVEVFDVRCFFRPGHGLEGTSAEENQVSEHLVIALHCTGYNRRNLALGFGIRGLPLKST

SEQ ID NO: 957725 - protein, 162 aa, Homo sapiens
ARYRRCALNPTGKCAVVCCYSCVIRQKVDPAVVKSAAIRQAVTGVIDNRLPFCSTRIDDSDGTARYSARLSKRVLRTPFTSTIIQRGFSRRRLRIKIVAGGVKLRVIRVSRADDFCHDPRYRAQDNSNGKQNTITNLHRIPHEIPGLIIPHAKPGDGRCSHH

SEQ ID NO: 957726 - protein, 54 aa, Homo sapiens
MNYYSINYYSINYYSINYYSINYYSINYYSINYYSINYSPEQSQLQYIHQQTMF

SEQ ID NO: 957727 - protein, 56 aa, Homo sapiens
MANILFLTGCSGAHLSSQKLWETEAVESLEVMSLETTLINMVTSMSLLKNAKLARH

SEQ ID NO: 957728 - protein, 71 aa, Homo sapiens
EEKYDPGYEASYCGAYGEHPCYSEPCGFSSNGSNCTSVELKMENQLFSGIPNGQWMTQSFTDQIPSFTNHC

SEQ ID NO: 957729 - protein, 41 aa, Homo sapiens
MVCDRNCALIAGAVIGAVLAVEARMLMPVGDLLIQKTIKKQ

SEQ ID NO: 957730 - protein, 62 aa, Homo sapiens
SKKRPGMSHSMIGVTSKFSTVQLVSTSTSDVKAVVGLLDLNAQLSQFVLESGKAVCFVAANM

SEQ ID NO: 957731 - protein, 149 aa, Homo sapiens
MQFLNHQGYGIGDDEYSCAYYVSPECDLGTMPEVSLNTPMLDRRRYSRILLDLNEKQMIFFLNGNQLPPEKQVISSTVSGFFAAASFMSYQQCEFNFGARPFKYPPSKFSTFNDYAFLTAEEKNHFAKAQASCSVEASQYPRKLLFPLL

SEQ ID NO: 957732 - protein, 165 aa, Homo sapiens
MCPSSAIMVSVAGSHLIGRTCNSEAGGILSLRLIHVTLGCPHGCFLGCLLHIWLLPCPCVLFLLNIAETPPTSPVKFMNHAEGEKEKTAITVNMTVGISITTAEPMFVPKKVMVAIQPQTPQPGMPTAVDDADDQLSHEGKEECHETEGAVSPAAEEVAPVTWAE

SEQ ID NO: 957733 - protein, 49 aa, Homo sapiens
MPPKSAEVVYEVEACLLALFENLFQLEGNEKHLEPGECSEGLAGDIPSL

SEQ ID NO: 957734 - protein, 44 aa, Homo sapiens
SAFLYGCPRRTQTITCDSNLIHYRQLHIHGAMARPPSTTNVPCS

SEQ ID NO: 957735 - protein, 44 aa, Homo sapiens
PDHYWVTVLTAFNLGGPAKLLGYQGLIVFIVRHSTPVENCFPKT

SEQ ID NO: 957736 - protein, 53 aa, Homo sapiens
MVAIVATRYPKVQKRFAVDFSVATRYHDFHPGDSRASRKTFDQAACGLYGYGG

SEQ ID NO: 957737 - protein, 40 aa, Homo sapiens
MQWCQEVVEGKLGMFHRLVSTVSIIMLVVTLCVENVELIV

SEQ ID NO: 957738 - protein, 83 aa, Homo sapiens
AYPLVNVHNMFAQSLRYVSMLIAHISSLIQFVYLNLHSAHITPLLPLLNLHNTQITPLLPLLNFHSAHYRKTFISCISICWFW

SEQ ID NO: 957739 - protein, 38 aa, Homo sapiens
MIRIEPGTRRVLSFAIHIIKLDKVILAQKYCQTHHHSV

SEQ ID NO: 957740 - protein, 42 aa, Homo sapiens
MRSVSSSSELKECSSTFAKGGPECPWKSKGSESLPGKLPECL

SEQ ID NO: 957741 - protein, 81 aa, Homo sapiens
LNKSQDRPSASRRARSPMLDSVPGPSHASSVVRAAVRACFCPWPKAREPSWQITGVSLKVQKLKNLESDVQGQEASSTGER

SEQ ID NO: 957742 - protein, 124 aa, Homo sapiens
SSSSESECGGILDQLTELDLYVVSHEERFAPGVEQCIIQPPPLKSHAHERHSGNFPGRDSVPFDFQGAFGASFCELQRSILSTMELETDRMVTIDEGRDLDMISGGEIDQSSDFQSIDSSQPDF

SEQ ID NO: 957743 - protein, 131 aa, Homo sapiens
MHGTSAQLTKAQVFSLIDTEPPDLPLLTETAITLSPTLVDINWIVEDSGSSDIAACICILKCSYQHSLWRPVRNKEGIKTGYASETRCKSLKIFRRPRKLFMQTVSSDDSESHMSEEKKEEDLLNNLCNQC

SEQ ID NO: 957744 - protein, 33 aa, Homo sapiens
MLKEAEKELHEKFDRLKKLHQDEKKKLEDKKKS

SEQ ID NO: 957745 - protein, 36 aa, Homo sapiens
SVTKTPIVAVNCCCIVSSSQITELWVVCRVSHWPDC

SEQ ID NO: 957746 - protein, 108 aa, Homo sapiens
YLPCFRIVIANRHRWTIVCDIWLYYTHTDLSIEAFKCLLCIMHLNLEGLGGLEGREAFVLCPGDGSHLLCRRTDSSFSFHGFLLYLHGSVGHQDPPGRGRPRLGRLLL

SEQ ID NO: 957747 - protein, 158 aa, Homo sapiens
RSTSLHSKRIKYLGIQFTREVKDLFKENYKPLLNEIKEDTNKWKNIPCSWVGRINIMKMAILPKVIYRFNAIPIKILRTFFTELEKTTLKFIWNQNRARIAKSILSQKNKAGGITLPDFKQYYKATVTKTAWYWYQNRDIDQWNRTEPSEYRKVGTGR

SEQ ID NO: 957748 - protein, 85 aa, Homo sapiens
LRLARWLILLHNDRNEPEHRTIIKRLPYYTLCPPRSLVIPFCNFSVPHMLKTQKVRRIVRPRFHGLYSYLKIKIKRAFALLLHGR

SEQ ID NO: 957749 - protein, 84 aa, Homo sapiens
RYTSLLVTCSSKHCSLNFSLTSRIGVISLCPNGRLFHQINSDGRVHVLHTSSVDNSPIASLGPITYRTSRILSDDQSTALRIES

SEQ ID NO: 957750 - protein, 41 aa, Homo sapiens
IQRDKHQDLMPKQSLRCRMQACDAVSKACDAGVTTSRCSTL

SEQ ID NO: 957751 - protein, 65 aa, Homo sapiens
MTDTNRARTSVCSLFSFYETGPLTRAGLHCRWREVLGFESPPASASKRLGLQGRARAWPILTSYF

SEQ ID NO: 957752 - protein, 51 aa, Homo sapiens
MYSSFNEKVLFHYTHTGVPVHYICSLQEAIHYHTVRGLAPSLTDTSVDIPC

SEQ ID NO: 957753 - protein, 43 aa, Homo sapiens
MSFPRSDLFVNYYYCPQILVFSSYSRPYHLRSRCHYTAMVPDY

SEQ ID NO: 957754 - protein, 45 aa, Homo sapiens
MAYPQLTIVDALLVLDLRGIKETRLLVFDELPSFLIELVVVAEER

SEQ ID NO: 957755 - protein, 44 aa, Homo sapiens
FRLDLVRLYSVSMKTYIVVGEVGVGALLLVEDDLLHLVVGLEHQ

SEQ ID NO: 957756 - protein, 43 aa, Homo sapiens
MLNATGWGTVLSTSSDICPYDKNICPRENIRGFTWSCEVRAST

SEQ ID NO: 957757 - protein, 67 aa, Homo sapiens
LGLAGPKGFPGSRSRSRSCARSLIFVDPLEVDFLVLNQGMNYEWKVSYTHPVTRINLSLSTYFLDAH

SEQ ID NO: 957758 - protein, 39 aa, Homo sapiens
MILTRVSTYKYMTTLLNSALSLRQINNTEMTINSPISTI

SEQ ID NO: 957759 - protein, 52 aa, Homo sapiens
RGRYLEATQHHYHTLKDLPQLLLGQRGVVWARCLLRRGFACHVPACARGKWT

SEQ ID NO: 957760 - protein, 106 aa, Homo sapiens
KQNGHHGISSNGVIIIWNRVEALNGLKRNHRRMELNGNIKGTRMESSSNGIKWNHRMDTNQIIVEWNRMESSNGLEGNHYRMELNEIIIEWIRMESSSKGVEWKHH

SEQ ID NO: 957761 - protein, 135 aa, Homo sapiens
MITIESRYQLSESPLEVYSRGEPGTREENGRNIEPVRMSLLSVCHSVFLLMYHAPLENSLAEVILNGDLSEMYAKTEQDIQRSSAKPSIRCFIKPTETLERSLEMNKHKGKRRVQKRPNYKNVGEEEDEEKGPTE

SEQ ID NO: 957762 - protein, 37 aa, Homo sapiens
MIRIEPVTTVIAGLVVIFMMLGGTFLYWRGRRIHEDE

SEQ ID NO: 957763 - protein, 131 aa, Homo sapiens
YELSSVPSHLLSRGRCDIIIISGRKEECEAARVDLWDGSWFRVITLNVEVTFDLHTLVIGQKGSGIRKMMDEFEVNIHVPAPELQSDIIAITGLAANLDRAKAGLLERVKEPQAEQEDRALRSFKLSVTVD

SEQ ID NO: 957764 - protein, 125 aa, Homo sapiens
MIRLEFGTVSSSDSIPLSPFHSIPFHLSPFHSSPLHSSPFCYSLLHTSPFHSIISIPFHSIPFHSIPFKAIPFDSIPIESLPFDSIPLVSIAFHSTPIHSTPFHSSPLHSIPFYYTPLHYPSQHS

SEQ ID NO: 957765 - protein, 41 aa, Homo sapiens
ILRCADDHQVHTLIIFSYLCFQHLGNYSSTQSVVVCPDIIQ

SEQ ID NO: 957766 - protein, 64 aa, Homo sapiens
CELRPRIGVAPFSRTLENFPPALASLQVAPSLLSCPLQHIVTISLVNLPFFTYYYLGKWLYHLQ

SEQ ID NO: 957767 - protein, 109 aa, Homo sapiens
DSMVTDGSRNVSSATLAVLFSKPEEMYNVYQTDFSKAFARNGIWSCKMNEGRGPRWLLKRVKPNGLPILTCIKSHLGPPNPGRSLVAGPPLALRDLGLLKVLVPGKEDR

SEQ ID NO: 957768 - protein, 99 aa, Homo sapiens
VVRKRISSFNGFQLWLMTSPLTEKGRLVGNWVLLGRPLGSPPGRKALGNEHLKNSDWGPWLSRTAQKEFTHSESEESIPPDVMEEIVWGGDNWACSCCP

SEQ ID NO: 957769 - protein, 94 aa, Homo sapiens
SLIDALFHAVWPARYPTAARSLMKVRVTLYVTTIKVIWGMLDSLTECFFISVYDLDSSRYPIGMNPRPLWLVAKKLDMIFSGTSCVNFSMNLKL

SEQ ID NO: 957770 - protein, 33 aa, Homo sapiens
LSGLFISMHLGVVSAGSCIHGKNECVGWILYHV

SEQ ID NO: 957771 - protein, 91 aa, Homo sapiens
GKCAREILAVWDMKHRGNGVHRAHDLCTASTCNLYSLLIVVYTTDIWLLKYLLGQWCVIVPRSILATALQEFLKTIQCPLTVVINDRSVCT

SEQ ID NO: 957772 - protein, 118 aa, Homo sapiens
HIYLSSVPQACELVARMTMWLEPSVAMAPALYTWLGCCWFTPHWCTCSWGWRNTESEADSWRPGLPPYGWRFWARLLHIWILPCPLCNFFSQIAETPPTSPVKFMNHAEGDEGKDGHH

SEQ ID NO: 957773 - protein, 39 aa, Homo sapiens
ARVCISRVSLVPLCEIVLRKYIISDIFFEITLIPTLVLI

SEQ ID NO: 957774 - protein, 93 aa, Homo sapiens
AQLYPFLLAQYVPFGLAYICDRVVRMSPYMCHIITTRGALGMNYSIFCANEVSSFEETFSTLFYKACFFPWTKFLSPGADAGGRDNGMLLCDT

SEQ ID NO: 957775 - protein, 108 aa, Homo sapiens
SLPYLSMQIARDYLIASSAVQTGLFNVNVDLFAGKSVVSDTLQCSIICFNIQTIFKGYVQSDFWLVEESVKLLEFFSCFDLIKLGLEDRLLVLLESYLPFHFFLLLEE

SEQ ID NO: 957776 - protein, 40 aa, Homo sapiens
IELNCQTLPANDLTHSLSSYLKEICPKWVKLRKNHSEKEI

SEQ ID NO: 957777 - protein, 42 aa, Homo sapiens
HQRRITAFSREFAILCPCPRCPVWCPDYSISFAVTSLHDTRV

SEQ ID NO: 957778 - protein, 34 aa, Homo sapiens
MQRVTDYHLPPSPRPCKPVPPHQDPANQYRCKPG

SEQ ID NO: 957779 - protein, 34 aa, Homo sapiens
YWFRGSPCYWLQRYWFAAVLVCSGTGLQRPHKTL

SEQ ID NO: 957780 - protein, 39 aa, Homo sapiens
FCRLLLLPASCFCLLLLLLPASAFSLTRSALPSSTYVRV

SEQ ID NO: 957781 - protein, 32 aa, Homo sapiens
MRGVGRSRKQQKQEAAEGFLLLLLPASAHTTL

SEQ ID NO: 957782 - protein, 166 aa, Homo sapiens
MRFIFCILSGLGSVFPFQPDMVLIAADFKSAQTGVFGYCIRVVQFRYSIHPLVALRRKHCLTLVYREIKDICQQQLIVGGLLYCVFQIVKMLLAGHAQVEKAGTLPQRPVQADAQRQVADTAKAARNALHMHWRQITERHAASGEPLQNHGSPRMLQAIFRNPAFS

SEQ ID NO: 957783 - protein, 97 aa, Homo sapiens
VRPPQPVPELLITLLPALLILLRRFRPDLTAVHRRTELPALFIITMQSICTIFVTDKIPVTGLTVIHPADGALASHQRQQQQERHQTTGALKQLPGS

SEQ ID NO: 957784 - protein, 155 aa, Homo sapiens
QESSKREIQKLETSEDLRGDRDEEKCQLKTDLQALSSEGELKKTPSAKGLWLCDNAEEAASEIELKQAMQQRSEDNARHKQSLEEAAKTIQDKNKEIERLKAEFQEEAKRRWEYEKELSKVRNNYDEENNYLKNQVETEINITKTTIHQLTMQKE

SEQ ID NO: 957785 - protein, 44 aa, Homo sapiens
MPVVLFEKQNCNDRHDSKNRADQTQYSSYRQQRGVSYCKNGNAS

SEQ ID NO: 957786 - protein, 39 aa, Homo sapiens
ATIEPARRTSVQLVCCLTTSVNVALLCRRGVSTVSPSDG

SEQ ID NO: 957787 - protein, 72 aa, Homo sapiens
LWTGKQCCAYWGTSAHKNRWALTSHAPRVPVYATHEWRQASDYDIQQQTEITEHKTGVSERCRLTGNGSNSS

SEQ ID NO: 957788 - protein, 35 aa, Homo sapiens
TGVLIPPVCSYPICVLIPHRVRIPTCVATYPTSSS

SEQ ID NO: 957789 - protein, 56 aa, Homo sapiens
SDDDGDCEPFTYDGGQSLLCNMHKIPVMMVSMRAVTYDVGPHCFLCMMLKIPVSTQ

SEQ ID NO: 957790 - protein, 68 aa, Homo sapiens
SVIIATARPLVASTDLSNIPGLFAIDQVLPEDSQKAESQNTFEATDLEFKKCFPSDETCETPVDETSE

SEQ ID NO: 957791 - protein, 135 aa, Homo sapiens
YLEDPRTLAWAPATPHPHRAIEPVPTQQLPGKSLQCQLKASQPLPLQWNCSCHPQTNEGAKALLHTSNKLQLTQGEKASYFPWVPHTPHGSPPDRFLLAWAHSTNPPSWADCTEVTADLHISEVEPPESSKLGYR

SEQ ID NO: 957792 - protein, 40 aa, Homo sapiens
LVVYGPARDLHRLVAWLFGRLSVCLPYEPRDEPPKEPHHE

SEQ ID NO: 957793 - protein, 46 aa, Homo sapiens
PHRLYKEVHLLYFPNIVIKGSELQSVWLETIHEKSIFMIHSPPMYK

SEQ ID NO: 957794 - protein, 54 aa, Homo sapiens
RGSPPDKSLHQLRTAMLTSYSTPKRHTMSPSNLITAMHHAPRASLMSHPKCHPK

SEQ ID NO: 957795 - protein, 67 aa, Homo sapiens
GRTDGRTGPPEVPPNEPRYEPHEAPRREPHNEPRNGPHEEPHRVAHGVAHRVARRVALRVALGVALR

SEQ ID NO: 957796 - protein, 67 aa, Homo sapiens
LIAWLFVWLVVGLLVWHVAWLMVWLLVWLFGGLLVGLIAWPFVVLFVWLVGWRIGWLLVGGALGGSR

SEQ ID NO: 957797 - protein, 47 aa, Homo sapiens
EGVNLAPGRTHIRPHEPARRVARGGGAWRLVERFVWLIPITQRATRR

SEQ ID NO: 957798 - protein, 80 aa, Homo sapiens
AHGAVRKVTTGITGSWRTHRGKRRASLGVFCFTAIERADIEGSKSDVAMNAWPPRASYPCGNFSDTSMRHPKCHAMCHPK

SEQ ID NO: 957799 - protein, 61 aa, Homo sapiens
LWVALCEGQGALEWVRPKSPTMSHAMSHPKRPPKSHPKSQPYSPKRHTKSRAKGHAMSHTM

SEQ ID NO: 957800 - protein, 64 aa, Homo sapiens
PFVWLMGWLFVWRVVGSACAYPTPAAADNLVEPHSRWPSGIAIIPHEPTTRHTKSHPMSHTKGR

SEQ ID NO: 957801 - protein, 59 aa, Homo sapiens
LVVGLIVARGVHGRSLLVERFVWLIPFVIGINQTNRSTKRHPKSHPTSHPMRHTMSLTT

SEQ ID NO: 957802 - protein, 61 aa, Homo sapiens
RFGGLLGWLFVWLVVWHLGWRLVERFVCLIPRRIVRLVAGRFGWLVGPPTYSTPLMSLHQE

SEQ ID NO: 957803 - protein, 70 aa, Homo sapiens
TLMKHKEPYQKPDINITSCFNNQTEIRSRGTRNVSNCKKQEVLKKYKWAYQNPDTKSNTTSKKKKKNQLN

SEQ ID NO: 957804 - protein, 69 aa, Homo sapiens
RLEDERYVEDRQPQKYHPKSHATSHAKSLTRSHARSHSTGHTKSRMVAKLKLKGIDRKDTTGHATSHPK

SEQ ID NO: 957805 - protein, 71 aa, Homo sapiens
PLEDPRLIAGRLVWPMAGRVVRRFGWLIARLMGWLVGGLFGWLIGWLFAWLIAWPFVSIPLSFSFGPLRNE

SEQ ID NO: 957806 - protein, 37 aa, Homo sapiens
TKSPRSNGTSIKHATMQLKTLSLATPPPSVLVHLHLC

SEQ ID NO: 957807 - protein, 37 aa, Homo sapiens
MVRLVFRSGQLALSQTRRTPALLCASPPPCPVHLLCA

SEQ ID NO: 957808 - protein, 55 aa, Homo sapiens
DSTEEVDSTGQHRGGGQLDLHKEERERGITIDISLWKFETTSVPPLCCTEEAAQR

SEQ ID NO: 957809 - protein, 40 aa, Homo sapiens
KLLHLCAVHLLCASHSTEEDRSSVTGIRVAAPPCDVHLLC

SEQ ID NO: 957810 - protein, 69 aa, Homo sapiens
QHPLYHPHHSIQPPDTCFYSEDSGLISRLHDASNNHSRLCSPHITLSCPTPLYSIMMLSILLMMLYTIL

SEQ ID NO: 957811 - protein, 33 aa, Homo sapiens
RQRRTKEKHIHTAHMTQLRSVPVRQSSETLLCA

SEQ ID NO: 957812 - protein, 32 aa, Homo sapiens
KKHPGGLMMKGQQSPERPPGTPPSVLSTSSCA

SEQ ID NO: 957813 - protein, 38 aa, Homo sapiens
QAVAVFTFGEIAGSAHRSAWISLALGKPPSDCLDLQGG

SEQ ID NO: 957814 - protein, 37 aa, Homo sapiens
WRVPGRVLEPYLNLTLLSDSSSPSSVLSNSSVLSMLS

SEQ ID NO: 957815 - protein, 36 aa, Homo sapiens
IHRNRTRGSSTGQVNSSSKSPSGSIMGKRIFIHQAL

SEQ ID NO: 957816 - protein, 60 aa, Homo sapiens
RGVQKCLFYIYLLKTSNPHGSCIRETLRSDSKKTKKKKKKHRKSSSARDDEEKKHEKLNA

SEQ ID NO: 957817 - protein, 35 aa, Homo sapiens
QDRKGPHSVHVKSTSVLSPSSVLSISSVLLLCAVQ

SEQ ID NO: 957818 - protein, 38 aa, Homo sapiens
PRYSSTIFRVLKSALRDLLLCAVHVLYTSSASSVLGAV

SEQ ID NO: 957819 - protein, 39 aa, Homo sapiens
TAGDSAYSSVLSTSSVRSTSSVLSNAVHLLCAVHLLCAV

SEQ ID NO: 957820 - protein, 55 aa, Homo sapiens
GSSLHGSGLSKPAAVDSPGLSASSSVLSTSSVLSTSSVLSNAVHLLCAVHLLCAV

SEQ ID NO: 957821 - protein, 54 aa, Homo sapiens
LGITYGELTGSCGTTRLTRDGYHAYVAQDWSAVALHRRDPTTDQHGSIDLIRYP

SEQ ID NO: 957822 - protein, 39 aa, Homo sapiens
YGRTTDLHCQDLYWTSSVLPAPLCSSSVCPASVLSSSVL

SEQ ID NO: 957823 - protein, 43 aa, Homo sapiens
MTVLSVAASVLSHSVCPPLCVSHSSVRVPAPLCLLCAVPSSVL

SEQ ID NO: 957824 - protein, 110 aa, Homo sapiens
MTMASRPGAGQRDGWCRWCQRNLGFRCFGNELLLVLKRKEHSLPLENRGLSAPLQTVPTVGTLVCARGSEAPVHLITSAFCEFRCSVLILLLPQEHVTLWGVDIEECTFW

SEQ ID NO: 957825 - protein, 73 aa, Homo sapiens
GIYGLSDLYIYMTVMVVELFESTPSTYHVPRALQRCVLTGPHRKRGCSCHIIDVEPKGPEIVCYSPNIELVDI

SEQ ID NO: 957826 - protein, 42 aa, Homo sapiens
KNKCEKIKRKNGTEEKAEEITKRLEEPEELKCYTRRTISRYT

SEQ ID NO: 957827 - protein, 55 aa, Homo sapiens
QQSKKISSAQIKENERHTEDKAREINKRLEEPEETKVLTPRRTLQQINCDCLDYK

SEQ ID NO: 957828 - protein, 59 aa, Homo sapiens
MEFTPGELAYGRGAKHSYALYDLVCAGGAQKLTPWGSIASNFVYGRYRRVPFGYELESK

SEQ ID NO: 957829 - protein, 51 aa, Homo sapiens
MGRDEQKSTVCIVVATMKLLALQVALQQTEIHNLIQKIGNFSIVRLLGLQG

SEQ ID NO: 957830 - protein, 40 aa, Homo sapiens
MPLNSSMGHKEDLSQKQTNQNNDDDGDDDDCLDYKEGTEL

SEQ ID NO: 957831 - protein, 33 aa, Homo sapiens
PEVMVVAHGGVYSAESRVTKAAAHAPVRAERGY

SEQ ID NO: 957832 - protein, 64 aa, Homo sapiens
RPVEMGGDVCSSLFAVIYAESRRIVAIFPLINIYVDNQTAKLLLCAWIVAFFPILSNTTAWITR

SEQ ID NO: 957833 - protein, 33 aa, Homo sapiens
FNHLWCNKWTISDHHTLTTYSSNYRECNTSSER

SEQ ID NO: 957834 - protein, 44 aa, Homo sapiens
TVSWSVTCIFAGKLRICGDMQSRVMRTRRFSTCPVYFIWWRINT

SEQ ID NO: 957835 - protein, 75 aa, Homo sapiens
RIQQSYVIQKIGDLLVQQFSGENGERLKEKYGVFCSGHNETGSHYKVVVQQNKKFQNLIKKIGNFSIVRLLGLQG

SEQ ID NO: 957836 - protein, 82 aa, Homo sapiens
VDPSWDQHLHHSENDLLISQLKESLKVRRIRVRKKDLVSFFSFIFKTCPWFPQEGSIDSRVRGRVSDCLNEYYRVFGPSGPV

SEQ ID NO: 957837 - protein, 68 aa, Homo sapiens
EAISKRSISKRSTGQKSQHNIPPAGVTAPFTDAYCPLTVIKPYSDVAFVTPSMSALPIICEAEFTKRW

SEQ ID NO: 957838 - protein, 39 aa, Homo sapiens
MVCCVGRRGGEEVAYDRISVTDAILTLTDARLLMLRVLK

SEQ ID NO: 957839 - protein, 45 aa, Homo sapiens
MADEEEDPTSEEENEEMEEVQKVDRYQERDFFLKELRCIDVGFGD

SEQ ID NO: 957840 - protein, 59 aa, Homo sapiens
RGFQISHCASRVAVLYRYNRSTHTLSLYTASSARPDEGYKVKRKYHVKTLGQGAAAMRD

SEQ ID NO: 957841 - protein, 72 aa, Homo sapiens
VPSKTTGPKLAKLALTFAVGCDLGAEPNLRAVHANDFTYVTANYYTQLIQNLINGTCYPRDNSAMRDLGTEL

SEQ ID NO: 957842 - protein, 39 aa, Homo sapiens
PALVWLVGGPSGALCEAHRGLLGKLRGNQLLEVRLVFRD

SEQ ID NO: 957843 - protein, 43 aa, Homo sapiens
LLAWLFVRLIGWPEERLFVRLFVRLIRVARGEVEHERTCEDPK

SEQ ID NO: 957844 - protein, 47 aa, Homo sapiens
SIGLLHCLVPVSSSCTPGLCGRQHMFPCSFILNHAVLLIGCISIGPR

SEQ ID NO: 957845 - protein, 75 aa, Homo sapiens
TPGLVYLHPYLNAVTASAITNAQSCSSHCTMPARNWLENVLVTDCGTVHSCITVLKLPDCAQMPYADAGPHRGNG

SEQ ID NO: 957846 - protein, 50 aa, Homo sapiens
VVIRSSLLQSAIALDTAGHAGAGLTINLDRWIVRAKTLSFVTDKLVYAMR

SEQ ID NO: 957847 - protein, 48 aa, Homo sapiens
MDARHGILHPDPIRWVTGTALLVRVDTLSSQCSGVSRTSRAYRLLLSS

SEQ ID NO: 957848 - protein, 73 aa, Homo sapiens
MTVTHNTLLTSGRTTFDTSYDDDGLTDSRPCDDAYRYVMTVCYGQNYVHLTDCNVPLGRLTDDTTPVARVTRW

SEQ ID NO: 957849 - protein, 45 aa, Homo sapiens
MAYTELLKLLHNTSQDLYTNLVYEAWLAASSMHTAVNPIITLSMQ

SEQ ID NO: 957850 - protein, 101 aa, Homo sapiens
MAYSTVVTWWCVNRRWPCRQRGQGGDLFGPGTYKLTTQTLPLLTNLKNWDKLFASPFKSDVYFFSTRQQLDLRWGTSQPITLRDKDFGAVRLRAFGNYADA

SEQ ID NO: 957851 - protein, 42 aa, Homo sapiens
MVELDVGAAVAEVGQVEVAAVRFDAGSERDTRESLTQNEACG

SEQ ID NO: 957852 - protein, 68 aa, Homo sapiens
RNAERKHESSSYYEYFLNNEYREVNEYEEHRYEKAFEDKEKNMINTEKLELKPPEKKKSDEETNLKLH

SEQ ID NO: 957853 - protein, 98 aa, Homo sapiens
YSSPSTLQQPRAAWSSAPGRTANWLSGGLLFSKARLVPSKAHSYIAAAQTIITTQFFLSSITRLIWKSHTHPLFPEPNSQRHQAWGPKGHQFSSFPRH

SEQ ID NO: 957854 - protein, 128 aa, Homo sapiens
VWVIRGFQTQRGSSYTFPVNRSSTLLRHLEFLAHVQLSDAPRAPIQQSFGEEFRQHDGMVTILMFNRRRASPKHRYNMTEVNIVEGGPHMAKEQSLKINLCVYGVPPTPVYKGVEEGRVGPLYVLSAF

SEQ ID NO: 957855 - protein, 111 aa, Homo sapiens
TQRGSDQVTTELHRSTRTRSTPEWYGNPVLKIILLDNGEPSSYEEAMAGPDSNKWLEAMQSEIGSMYENKVWTLTDFPDDLQAIGNKWIFKKKTDADGNVTIYKSRLVAKG

SEQ ID NO: 957856 - protein, 98 aa, Homo sapiens
KRREDGRQRLTHTERAHAVAIEAVLQTEPGVMDVNRAAEAQLEAECADAARIEALLQAEADVLDLNRAAEAQLDAERADCHSHGGPPARQELDVLSAV

SEQ ID NO: 957857 - protein, 35 aa, Homo sapiens
CWSKTTNTNISDAQEIETSELILPAIILVSSPSHP

SEQ ID NO: 957858 - protein, 70 aa, Homo sapiens
FNFYTMWSTIDSTSEPFEAVIIGIRNLYIIYSRPASNTSESKSIDLFIRQKSVTRIFYSYVFENPAIICV

SEQ ID NO: 957859 - protein, 53 aa, Homo sapiens
SPRVLASVVLLTVCVGRVGVLCVDGRVGVLCVSDVFGVRVGVLLCVRTCWVLC

SEQ ID NO: 957860 - protein, 38 aa, Homo sapiens
YTPYTTLYHTLNSLPTFTILQYKKSTTSMRIHVWGGIS

SEQ ID NO: 957861 - protein, 37 aa, Homo sapiens
FDLYRIFRLSTRGMRESFRSLSFKVWYHEWYGWYRGT

SEQ ID NO: 957862 - protein, 45 aa, Homo sapiens
MLYTLYPLYHHTTISTLYHHTTLPTFTILQYKKSTTSMRIRGWYS

SEQ ID NO: 957863 - protein, 34 aa, Homo sapiens
TESKTIINGWRQLQPSNARKPGFTLRRKRYLSSS

SEQ ID NO: 957864 - protein, 66 aa, Homo sapiens
LSYYGNHMSLSPDYTLCSFKNSQYITSCDSPLKFNFYRELKVTSKQLQRNNQQPCSAQVVISGSPQ

SEQ ID NO: 957865 - protein, 74 aa, Homo sapiens
MSFRRGCAYVSCKKGDLVVPEFNPFLVRFADTTLRDRHLGYFSTILYNPPDAPDYSASLLPDWLTCTFIKSGHH

SEQ ID NO: 957866 - protein, 37 aa, Homo sapiens
RGIVSYTTESFPDYSSDRYCRDWLTCALHQKVVDHVA

SEQ ID NO: 957867 - protein, 100 aa, Homo sapiens
TTMINCGIDHNPSLIILSCSTASSFAAILPAINPPTCTAALHNDLHHYDDVPPFTYPVLLRTARGRTLTSCLLIFNHQSLLVQVRSHQMRINRLYRNRTH

SEQ ID NO: 957868 - protein, 41 aa, Homo sapiens
MQSNVATHKLTVLSANPILFAIFWFGKKDCATRAPDYSASL

SEQ ID NO: 957869 - protein, 52 aa, Homo sapiens
TSSCNRRGQSLPAYVIYVALGRRPQLEGTTPPEPPISTRIVICLTGYLYRCI

SEQ ID NO: 957870 - protein, 54 aa, Homo sapiens
LSFLKCLECWDIRYTNYISTLPKLTWWCDDAAQEVGYRPDVLRLLAHRYVPDWL

SEQ ID NO: 957871 - protein, 102 aa, Homo sapiens
MRCAARTGAKLRLARTLARDAWHLKQRYQYTALVRHDCLTNENTFTDLKNTYTRLRQGIFKIRVPTHVNKINRMPAFGNRVRLKINHERAEHELNVMARHGR

SEQ ID NO: 957872 - protein, 70 aa, Homo sapiens
LEESPLIAEENRKNQGTVNWSVDDIVRGINSSNVEDQLQSYSSCQETTFHEKNSPPLDSYSKCRRRQNRR

SEQ ID NO: 957873 - protein, 33 aa, Homo sapiens
VKQNSTTVGLSPLNEGNVASVHVGVSTWRHVAS

SEQ ID NO: 957874 - protein, 73 aa, Homo sapiens
MLGGPCISCCWVEQWCCVQLEDESVSEVYTTSASLQLRTPASAVLVGTQDAISAANPRVIDDSRARKLSTDLK

SEQ ID NO: 957875 - protein, 81 aa, Homo sapiens
TDRLAELAVWALLRNKWIVRGDSVRLPSERGLFTSILKTFPAGTFVLSISKQAKGISSCCCFRIFFFRICSSERTHCSLLK

SEQ ID NO: 957876 - protein, 35 aa, Homo sapiens
ASSEGWVHPSGSGSSSTQKRSGCNSHVSRNACGAA

SEQ ID NO: 957877 - protein, 77 aa, Homo sapiens
GRPLEDSPVCGRVVVWVVGCGASFVVGSTARVRTRKLVTYAWAGRSQRKLWCTVRNGPDVQIGRPTWVVGAERIIEP

SEQ ID NO: 957878 - protein, 38 aa, Homo sapiens
MGWVGRAGALVTEFVTEASLGWRSLRKRSLRRRVRRRS

SEQ ID NO: 957879 - protein, 44 aa, Homo sapiens
YQRSIKSARNERSNTLRYRASVTSAYRALLTALRNERVVEVRSG

SEQ ID NO: 957880 - protein, 35 aa, Homo sapiens
PPRRPIPGKNFVRLYIRSNPDLYGPWGICATLALI

SEQ ID NO: 957881 - protein, 33 aa, Homo sapiens
IHPDEPTNQDSAPSVSILIMWDSQLYQAPLALI

SEQ ID NO: 957882 - protein, 46 aa, Homo sapiens
NRAIGHSQLAPVGLHSSPQAQQAAHSATHHFVIMPHAPGIGSTGSS

SEQ ID NO: 957883 - protein, 52 aa, Homo sapiens
YHIHSLHACVVALCNPCSSTQQELQVQHIWCHVACVEAANVGCKLTILCGIH

SEQ ID NO: 957884 - protein, 81 aa, Homo sapiens
IIMAATAASITDLNPLRLLPANQAQPVISQVFIFQLGLHPGHASITIMVKHSSSLIQAGAMWQSGPQVMQVNRHFYRPIQH

SEQ ID NO: 957885 - protein, 35 aa, Homo sapiens
QEYYYNSMMSISYIGEGVIYNTLYAGFILGPYPEG

SEQ ID NO: 957886 - protein, 54 aa, Homo sapiens
HSIFTTKHQAFTMCPKQAKHPTQQTKERTTLNAAHCMVSHPATVAQRPLHQTIN

SEQ ID NO: 957887 - protein, 73 aa, Homo sapiens
MYQSHITSVTHESTGRLMQTGPPLVLCCLEVHSTRYALNHHPRVQSFADLEGKVALQPCSLLQKNKTYLWPLS

SEQ ID NO: 957888 - protein, 47 aa, Homo sapiens
ELREGFLCAGHLHRHLSHLQPIGKYNHLRFTDEELEVYQSLSNLGLI

SEQ ID NO: 957889 - protein, 55 aa, Homo sapiens
AWFWFYYTMHNHLRVSLSVNLTKAYDSPSTCVINLNKVDLVCSTKGLHQLDIHRL

SEQ ID NO: 957890 - protein, 54 aa, Homo sapiens
GVMRARIFSSRQSTAGDGAMASLGAWGCPVVQPLPLLSRGLLEPQISLSYYTIS

SEQ ID NO: 957891 - protein, 46 aa, Homo sapiens
PFLPSSCWNSETFMPLAKKFPPLGAQVEPSGAFSKTRLALAWTPKN

SEQ ID NO: 957892 - protein, 102 aa, Homo sapiens
FLALSGTMDFKQKKALNTDMEELGLETDTAGCSRCGVFLSQMWPTMTYSSVRNHSSHSKPTSGRLETSHHRFSTKRQPQILYIPMTERKGSTVRTCKPGTCK

SEQ ID NO: 957893 - protein, 73 aa, Homo sapiens
YYSEDTLYRTPLMTPKAHVESPIAGSIVVAAVLLKSRRLWYKYAYTLYSHIPLNQTLHSLTHFLVTGLPSLEF

SEQ ID NO: 957894 - protein, 59 aa, Homo sapiens
MTSPLWVKSLILDNSWTIPFRYWHLSKHIKQSSKLGPIIFILGGINGPSRKKFTSSFLK

SEQ ID NO: 957895 - protein, 54 aa, Homo sapiens
PLGKIPGSSSIIHIGSTSSSPSFILTRSSVSSLILPPYCLGTFLYRYPVRLGQY

SEQ ID NO: 957896 - protein, 67 aa, Homo sapiens
FPLSDFDSTDTLEAHRCFQSAPAPTVLRCESGNVLLIMLRKVETPFCGEAAGPLTLQETKCAVKQES

SEQ ID NO: 957897 - protein, 44 aa, Homo sapiens
GYTLSRTDCDTGERLNAMECALHEKNVKSVHYWNCTNLALTKID

SEQ ID NO: 957898 - protein, 104 aa, Homo sapiens
EYLRRPGLGEVLNVGNVVLNPRSRSLIKVIRFLPISKDGELYHGHVREGGRSDTEFCQDADGARRLLNLNLSLLQVTILLFLHLLLDAAGAQSIRTHLSKPLDV

SEQ ID NO: 957899 - protein, 65 aa, Homo sapiens
MASQPEFYPTCNDDLTAILLKLFQTIEKEGLLPNSFYEARVILIPKPGRDTTKKENFRPISLMNI

SEQ ID NO: 957900 - protein, 48 aa, Homo sapiens
IPTEKYVFIGYAKVTVGYTFYHRSKARIIFGAVVREAYAKVIYQVPIT

SEQ ID NO: 957901 - protein, 69 aa, Homo sapiens
KIDRYRPVWSCYSRTVDLVIIMRVTIMTSLVLRSHSTPRYRASLNFHLTSEHWQKSHRSHRAGSRCLFN

SEQ ID NO: 957902 - protein, 80 aa, Homo sapiens
QASRVELHGGGYLEKWFYAQVIAAFILLLHTVHEQKDEEDGTEDAHDATHNQSCQDLRSLTDAAALTQCWTLDILLIRLR

SEQ ID NO: 957903 - protein, 33 aa, Homo sapiens
EELKSEVRRRSDTVVVPTISPRNPKTLVSRKLK

SEQ ID NO: 957904 - protein, 36 aa, Homo sapiens
MDVPRRRFSTSRTLRRLQILCDRAATSGATSVKRFA

SEQ ID NO: 957905 - protein, 64 aa, Homo sapiens
CRIAYTAVRRTVRLCAQYCTASCAGGHGCQKYCTQRRFEAGFLIGLVSTPAGLFPGWCRSRRMI

SEQ ID NO: 957906 - protein, 88 aa, Homo sapiens
MAQGATDEVSINSAVRLRLFNRVGLDRLAIGAGNLSLSLAVGFFLNEAEVVVELLGALCAALCKGSGRGQGHQAGQHQGREFHSGIPI

SEQ ID NO: 957907 - protein, 51 aa, Homo sapiens
PVSLFIYGRLFLCHGGEIGIRTLGTGEEYNGFRIRPIRPTLCISSNARAII

SEQ ID NO: 957908 - protein, 67 aa, Homo sapiens
RGSDRLMALYRDEIMKLSQSQFDIEMTRGNSYNTLKQALICLWIRYWSYKIKTETYDVLSTSNKVVS

SEQ ID NO: 957909 - protein, 36 aa, Homo sapiens
MSCEPNDEFLNWLSVGLLVVGWPFISSVTRHIAVDE

SEQ ID NO: 957910 - protein, 64 aa, Homo sapiens
SSAVIMVPRYDRAHIGCMTAKHVRFRDRIDGWAHALIVSPTSDLQGSALRTIRRRACADERDLI

SEQ ID NO: 957911 - protein, 42 aa, Homo sapiens
YPLLTERPLSSVGSQHVGSVLHGTVTTIFRYYARTSSRMTVT

SEQ ID NO: 957912 - protein, 48 aa, Homo sapiens
HDTIQLVPAISGGVPTGGRRNPRVGFANQHPAIQQPLATRLWRSVKRP

SEQ ID NO: 957913 - protein, 41 aa, Homo sapiens
MSLNNWTARAIAPTSSPRLSDGTETSRSPPARPFITSVMAA

SEQ ID NO: 957914 - protein, 35 aa, Homo sapiens
HTLVLSTSPAKDDRFHVELPVCPASAEPCGFFQMS

SEQ ID NO: 957915 - protein, 65 aa, Homo sapiens
YYQCTVPPEPYTFAYDNIVQDACPTRLDCVAKNNSNGIASAILLGLRNWKPDLIWKAQGRIRICD

SEQ ID NO: 957916 - protein, 38 aa, Homo sapiens
DNLRAAALLIGVQQGLPRRVGSERLALIQCEIFTGGVA

SEQ ID NO: 957917 - protein, 64 aa, Homo sapiens
LVAYLEPRHAIVVHPQFTEPEAALRAAGISVGRHILNVPDGFALDPDLVPDDADLVVVGNPTNP

SEQ ID NO: 957918 - protein, 43 aa, Homo sapiens
FVSAAKPEMRRARHRLETRRNKTHTVVPPSVALRPTTFRSRPV

SEQ ID NO: 957919 - protein, 67 aa, Homo sapiens
LKVTRKDTYNKLKTKDEPSGNAKRHPLMRGTAVVMAGARRNKFISRHLPQRRTYSKTFTVKSVHDAI

SEQ ID NO: 957920 - protein, 123 aa, Homo sapiens
MMPAGIINLTRILLPTISRWERPSPRRTGFVHIVSKLLSPVKILLIFCTAFSSRLRQNSPLSDKDDMLPTELFLQFAYQPDLDFLERFQLRNGNKDYDSFPTTTNFNFLSCRNIQLPELSLEV

SEQ ID NO: 957921 - protein, 46 aa, Homo sapiens
QQTIGSYELPPVMLASLHSQVPRTNATLLGPAKSMVRDARVGDKPR

SEQ ID NO: 957922 - protein, 33 aa, Homo sapiens
DPHGQYSYIRKSIVLLQQIMMFHVVLAENPVTY

SEQ ID NO: 957923 - protein, 123 aa, Homo sapiens
MAALREALVKVRKVVAGERSSVLVSLATNQQPLAVLFLPNLKVVDIGWCVHTAVHRQGMEVVAHQGGIAVEGDGLVLHLQGFECAGMGFQVGNELRLVLHLAAGVAVGELVGRQCMKLLEVQM

SEQ ID NO: 957924 - protein, 79 aa, Homo sapiens
PLGLWVSAWISSVGDRRGYSIHPFMRAQRNSMIEASELTFYESHYFFPVFKPRFIEFLHFDIQSTGQKSHRVNTRRGPS

SEQ ID NO: 957925 - protein, 50 aa, Homo sapiens
PPPPPPPPPPPPPPPPPPDMQAVHAVTFLQADLKQDSPPAYCRLAATDAL

SEQ ID NO: 957926 - protein, 54 aa, Homo sapiens
RLCQRVANTSNTDKWVHVLQLQPVELRLLSAPFGQYQYCCREFSNASVNIFNAP

SEQ ID NO: 957927 - protein, 56 aa, Homo sapiens
MEFLHAYERQILGYIQLRKGPNVVGPYGLLQPFADSSKGLSQILLSIALLVPPKTS

SEQ ID NO: 957928 - protein, 96 aa, Homo sapiens
MGHIEYLGFSCEVPATEGPEQSQDRMNVSSVGIQPVQWFHVPLGGAKAGVKIIPKNYTDNELEEITKEFTMKLAQEGFIGPGIHVPAPDIRSGQRE

SEQ ID NO: 957929 - protein, 83 aa, Homo sapiens
MLPQFSVHMAIPSPFIWRSEREKEISDDKAREQRKVIQKRKLKMLTNSPRSKMCVQVRWMTAVRMMMKHPLKLNEQYFDQAAP

SEQ ID NO: 957930 - protein, 35 aa, Homo sapiens
DITETYLITIRYTSTKNEKQKRQEAPKIDYLYTNR

SEQ ID NO: 957931 - protein, 99 aa, Homo sapiens
RLLCRTGGSGPVFTIEVRRYDTRDEVIEALKQGGVDFLGSANGYEAADPQLLLSRSYANDQPTLVTRSGDSQVLNDDLAGKRVAMLYHYMQPDAVRAFY

SEQ ID NO: 957932 - protein, 48 aa, Homo sapiens
MFPLFKTAKSVRFDRRSNTVVVPTINDANLEIRQCYSHDSAGPASGET

SEQ ID NO: 957933 - protein, 63 aa, Homo sapiens
TSGVPCMARSRLDYRTLRILEYGPRLLFLSVFGTEALLQRAGRGRFSIAPLEVNILDRRKTDQ

SEQ ID NO: 957934 - protein, 37 aa, Homo sapiens
SSRYRSPRCDGISSISGPPTQRTAGKFSEEVSDLLHH

SEQ ID NO: 957935 - protein, 83 aa, Homo sapiens
ETQADCYLLLSPEKTSSLLKVITLKSNNPQTRIETDTHMQAHFYPQSRQYLPLFTSCVMILIIQCLYLVSVWSNDTIVAEYKG

SEQ ID NO: 957936 - protein, 32 aa, Homo sapiens
MQTSVGPNQGSAAIRRDVRDIPINMITACADM

SEQ ID NO: 957937 - protein, 86 aa, Homo sapiens
KPERLIITTGHMLYSSLWSRLISNRGILYNHTSRRSSLALSSTFNIVLELGKPLAAVLPKLECSGAVLGHRSLHLLGSVRPPSSPS

SEQ ID NO: 957938 - protein, 89 aa, Homo sapiens
MIPDYDVCMVLCWEEGCRIRNRGKFGNTKGEEEEEASVLGRLHQFLVKMMWLLRVAILHVKKPESQKEQTPELGKKKRGRGKAQVKATN

SEQ ID NO: 957939 - protein, 157 aa, Homo sapiens
RIRTFAHSSSRCEKPLPESRTSGLSESVRKTRRYFRFLTNGLEHERKSKPVNFDSSQDLVQQGLDIYTLRNSILYCSPTCYPENAMSSKNSKPATTNSKKVSSIKPKFLDTPRIPGMSPAFKGYDGGIAQWLLFGGLTVAVDKNWAAKPKDKIQVLV

SEQ ID NO: 957940 - protein, 57 aa, Homo sapiens
GPGGARGPLILEVVELLDSRRRHLLAALSSTFMLCLAVGSGAVPGPPVSVALGGVRR

SEQ ID NO: 957941 - protein, 53 aa, Homo sapiens
LTKPLHNNGPPREDPALGGTSAVENEYTSPGAVMVKGSSTRYVDLFLFFSVRS

SEQ ID NO: 957942 - protein, 94 aa, Homo sapiens
NGPDSCLRGKECRIKRFQQVERRWGYSGSSDRIRFSVHKRIFVVGFRGSYGSIHGPTDYQVNIQIIHTDSNTYLGQNDTGFSIDGSASNFRVRS

SEQ ID NO: 957943 - protein, 48 aa, Homo sapiens
YILQRMSLPQPTQQAPSVTGTSTSFEHEYLRISTASGSMGVRQRPGAS

SEQ ID NO: 957944 - protein, 60 aa, Homo sapiens
ANRYTVSRTDLTQGRPMAGRLRQRRWHIGLPLDNSTGVAVLLEDHAWCVNTTLSCSELAV

SEQ ID NO: 957945 - protein, 121 aa, Homo sapiens
TAIAVTTVSLASIFHQQTSLHYQSDSLSEPFLILLEHTVAGFAFLFPPKVAEASIYSLLKKEDSIFVNEECCFYLNQSALVYDNIKKLKDRAQNFTNQANNNVESTWTLIGHPGYYQLLGL

SEQ ID NO: 957946 - protein, 48 aa, Homo sapiens
VLRISNYHIFDFPYAGEVNMSELITPTVLFKSLADATRTKITLLIARE

SEQ ID NO: 957947 - protein, 37 aa, Homo sapiens
MPRWALRLLWSLERTLRPTEAIATVQPGDLALTLIEL

SEQ ID NO: 957948 - protein, 37 aa, Homo sapiens
RPDEYLHSSPEAVPTFKVKNEEYFIRCTNRAKGLIEL

SEQ ID NO: 957949 - protein, 143 aa, Homo sapiens
LDHTCTVTLLRRHLSRRIAINTRLSIPSTSSSTIKVARPSQAVGSANHSIYKFSVFKVFRTPGTAKCGHATGTRLVDGIRGASAGTATAVVLGKDDWEAPEGVHASPEMTKGLESYIRNTNFPQRKTITKPVNPPSEAQQLLW

SEQ ID NO: 957950 - protein, 77 aa, Homo sapiens
MALVVGDEAMKIFLDEYSEHEHAHLTVALCGVECARSPAKLCCPLMLVDGHLKRLHVSLFGGNWNLDLSLAGFQGEI

SEQ ID NO: 957951 - protein, 85 aa, Homo sapiens
MHDIKIQTEAVSQLMRMTACPAKIPDEEAQKPEGGLDDEPEYCTCIQRQRNLRLRLKAMDGEWEAPQHCEPIDVSQVFYVDVRQR

SEQ ID NO: 957952 - protein, 62 aa, Homo sapiens
MAPKWLYLNCCACEASGGLDENGCHYEGYVADEKKIPLSAIRARVVRKANGACNNNCFKGIV

SEQ ID NO: 957953 - protein, 104 aa, Homo sapiens
MHTNPKTTRYLDISSSGDQIGMHIEEVVPLNHRGMRRKRSGHLLHQSSRRPPSTLRIFKQDGKRPQKLKQEEDAAKDTMALIHKSRNIGQGGKSKMRETDRKLN

SEQ ID NO: 957954 - protein, 38 aa, Homo sapiens
KRSQGMGRAHAGTQACKAGQASDSSTGFVSFPADVLQH

SEQ ID NO: 957955 - protein, 56 aa, Homo sapiens
GVDVDGTDWTGEDDALTPATKTSLRHRRHADTLNVVERDVGTNLSDHDNSRTTDKR

SEQ ID NO: 957956 - protein, 35 aa, Homo sapiens
MGSGLTIGTDSYLVTRGLVLTYWRVDLRTYVTWVD

SEQ ID NO: 957957 - protein, 39 aa, Homo sapiens
MFPLCLSCHRGSSCSQRRGPFRHQAAATVYVGTGTVQHF

SEQ ID NO: 957958 - protein, 52 aa, Homo sapiens
PQITWPPMVLKLRVHRLRRTHSSTPTYFPHYTSEPGELRLLDVDNRVVLPIE

SEQ ID NO: 957959 - protein, 34 aa, Homo sapiens
MASLAFQTSRYKLHYYETPTGIQVVMTTDLGVGD

SEQ ID NO: 957960 - protein, 53 aa, Homo sapiens
AALPASPSLNSDPRLALILGINTQTCTSDHPSHCGNIFKTHKLQAPKGNCSSQ

SEQ ID NO: 957961 - protein, 70 aa, Homo sapiens
SCRDEVAKKYEEVICPSQRVEVLCPKSSDPTPPHWRPSSLAKSLLFGISPQPLSLDLIHTFSETLIFSVF

SEQ ID NO: 957962 - protein, 77 aa, Homo sapiens
AQGSMDYTRIHGQVAQAQQHKQHKVFNMPELHIAHARSSTIPSAYGCIQIMLHISPYTGCNDSHLSPLAQHIAQHAP

SEQ ID NO: 957963 - protein, 94 aa, Homo sapiens
LRYTFSFFQTSGWDAILSHIFPCPQACIPAGNQGHRHSMSATVQPHGFHVAQRGHGILSQAQPGSGSMAHSSSAQGVAQYDSSSSHTAAAAAYF

SEQ ID NO: 957964 - protein, 61 aa, Homo sapiens
MGGQEARGGSWGEHQAGYQASAGKCGTRGLSAELLCCSCSWMSYGDGAGDSRAIKVPYSYE

SEQ ID NO: 957965 - protein, 95 aa, Homo sapiens
MSNLPKSIDLQERVVEYRYSMSSVLKAEISQDIDHILETLSALGVDLGGTNLRVAIVSMKGEIVKKYTQFNPKTYEERINLILQMCVGSCSRSCK

SEQ ID NO: 957966 - protein, 109 aa, Homo sapiens
TRRKRCKLNQPIVDILSTGSTGLISMVYNMYCNLLEEMVVLLFNDPHELPSSMRRVQSKNKLTLSERIYATYLYTLRSSGVRATYSLSISPSIRFLITTGLGKNRAFNC

SEQ ID NO: 957967 - protein, 118 aa, Homo sapiens
SRGEDEEEEEEDEEEENQSAPPRTTKPQTDARKRKRPQGLKTKRARKRRRSNSSVTTETIAETTEVLNEPFDNAEEERPMPQPEPTCETEAEEDGRKPVPRKAFQQQPVKKRQTEEEQ

SEQ ID NO: 957968 - protein, 47 aa, Homo sapiens
MRHEEDNDKVRAATEDLGLEILRDRLDVDLDGGEDERLPSGELVPEK

SEQ ID NO: 957969 - protein, 30 aa, Homo sapiens
MLSPRSRRVIFDQENGATSTESSPSRLIAA

SEQ ID NO: 957970 - protein, 38 aa, Homo sapiens
MTFSVTRHEKVAQQPIGNLLMSGHRGLICPQHLSAQPI

SEQ ID NO: 957971 - protein, 59 aa, Homo sapiens
MTVDEVFHDTLIKDMLQPDENLHCLHNLEDTIVNGREETHRSVRHPEHTPGRYATPTSR

SEQ ID NO: 957972 - protein, 137 aa, Homo sapiens
MSARTDNAIKNHCNSTLCRKVEQEGYLQKSSKASQPAVATSLQKNSHLMEFAQAPPTAQLPATSQPTGNNDYSYYHISEAQNDCSHVPYTAALHVNIDNVPQSAAAAIQRHYNDEDPETDKRTQAFELLLMSNENEL

SEQ ID NO: 957973 - protein, 81 aa, Homo sapiens
SSVPESTPILGAYRASASETVIIIGRVAQGHGYVADTIYPVRGIIPTERSLGNVYVNPSRHITFNAPTISPLSVRNNTQHL

SEQ ID NO: 957974 - protein, 71 aa, Homo sapiens
MVRLVHLSGARTERLKRAKAARKRKNLEIFCGPTSKVDLRRVEDILKNDDQISTLINNAGYGVSSSELTSD

SEQ ID NO: 957975 - protein, 125 aa, Homo sapiens
EKAHPHTPDHVMVQMTTLESSNRGLLGSANAPKPKIHTRSLTDLTLMNTTPWHERSPTSTWAARVVSANGKYLLTLDKPFLEDLISQTDVGGKYLKLLDDKLSPTATSDEARVLPDAWKNHLKAR

SEQ ID NO: 957976 - protein, 53 aa, Homo sapiens
MLTELTVLDVSDRAEDRGIEINQRITMGETVREVRVRQRAFTQRDDICAIFDD

SEQ ID NO: 957977 - protein, 35 aa, Homo sapiens
MAVGSLFGVVDTLESLCQDIHAPHCGLDCRMVHHE

SEQ ID NO: 957978 - protein, 118 aa, Homo sapiens
TARCLWAMGFQGLCGWSFRLLQQLLNHLFLRLVATFSEVGETHLPFGVDQVVRGPVLVIEVAPDRVVVIDGYRVSDAELFHLIPDIADDAFKTVFRGVDADYHQVILLYFCAQSLTYG

SEQ ID NO: 957979 - protein, 97 aa, Homo sapiens
LFSENTCDNLSYLERYHAMALNGAKDALDGRIREAFVNSSDPELAIDWLMHSLQGTFFSVSVYSSLDALVLAHPDVVVVLDTHNQLLTQRNDRVEAR

SEQ ID NO: 957980 - protein, 70 aa, Homo sapiens
SSSVGIMIQFAKEACFIITVRNRTMTFGARPNKHLAFASLYGIVDTYLRASARTFMRTIVAEIAGWCNTK

SEQ ID NO: 957981 - protein, 72 aa, Homo sapiens
HKGYSPKKVHYVLIPPNNFALGILLARCLAIKSPRLIAVRHIVTASLLFRAQRPLLSVKDFQHDRRDRTHGP

SEQ ID NO: 957982 - protein, 100 aa, Homo sapiens
MSNSYTDYSHDHMFLGKSHEEDAKRTLWVVALTVVMMVAEITAGYLTGSMALLADGFHMATHAGALGIAAAAYGYAKRHASNARYSFGTGKVGDLVLSQG

SEQ ID NO: 957983 - protein, 77 aa, Homo sapiens
GSSRGYLSCCTASFYHKLEVLLQGPPVLASCPEGGSLRRQMENEPPVPGGHHMQAFRNSPFLPGPEIQPFLNTNLLL

SEQ ID NO: 957984 - protein, 155 aa, Homo sapiens
SAFRRAAICATPLTKSLNAAFHWCSCKASAERLNKVYAAPYHQRVGEFAGHELHRRRYVLAEQTRCVIPQGLGAFFELAAQHLEQHQCVFTEQVMQHIARHCRSGQADIGRAMLVVFQQVAVSGLMRIFQVHKHPVLQGAWPLYLIQEARFIRVF

SEQ ID NO: 957985 - protein, 80 aa, Homo sapiens
GRTTVAALLHFAFVEQGTDHHLTGLLDVRCKYVHRLLLGVDAGLEKLAIRDCMSICVTLSSAAVWHRYCAARNAKSKSEW

SEQ ID NO: 957986 - protein, 43 aa, Homo sapiens
MHQLNHRQQYIPPNSTSLTSLSGSEPLHQCHLTQSQHLVAPFS

SEQ ID NO: 957987 - protein, 127 aa, Homo sapiens
ILRISGLSHSCMTYSLPMRSEIAGVDRLCRQIVLALRVHEHSSSRQPRVGTAITPTGRRRYRTSFNSGLADEGLRRRYIRFQQQCLEPVLERNPGEDRDTQLFEVQRKALEHLQWQTGKYGICDFEQ

SEQ ID NO: 957988 - protein, 104 aa, Homo sapiens
LLELASQLPHSVLDACTGQRLLGIKMSIEGSVSQTRCLNDLRDACTGDTLAAEQSDASCRIFSWRSAVLLAGYLTKESPIVEHDALHDDRQYLRDSMTTIMLDD

SEQ ID NO: 957989 - protein, 120 aa, Homo sapiens
LIVCTATITYEKTGGCTKLIKNIEYPVDFELSKELAFSQRVYNKNFNATEPIGSLQWVYHHGDSATGGPYTTDVFQIGLNGWLRIDEQTGQGDQPGTRVGGNHLLNAQTNSCINRRVDLL

SEQ ID NO: 957990 - protein, 49 aa, Homo sapiens
MGLARTFLIAAPLGFISMYIRLKLEDSPEFLALQRAGQTSRAPLREVWQ

SEQ ID NO: 957991 - protein, 82 aa, Homo sapiens
LAPALIWEAGARPEPFAGTVTIETATTENDHDAPASQPAVINKSSPEGWEPLPQAADSIAVFAPPAAARAEPDVMEDMLDES

SEQ ID NO: 957992 - protein, 77 aa, Homo sapiens
SEAQCFGMPDPSMSFARRAAFGCILNSAVKRPGYLAQIQMTAYDTRHVFRERVHEEVIGGKWFGCSNAAGGLPVGQY

SEQ ID NO: 957993 - protein, 128 aa, Homo sapiens
LIHALRPVIEWSDNLFEFFLSQISVVHEYQGGLMKRNDLFTIEYQLHGEPKSFIVRAPRMDNAEAWHWASCDADVPVIPKFGQHTFKRVSKPMAEKYGITQVAGVARHRLNGRRASEDEQSDSCLHNY

SEQ ID NO: 957994 - protein, 96 aa, Homo sapiens
LKPAYFLDLRHKKRRPWTSLDDEVVEPGGFEPPSASTPLSVTTCLAVSIKLTLSDPKGRVLWASCVSFSRFVHNVLHGDSVLYDNHFGFTDIRLVI

SEQ ID NO: 957995 - protein, 109 aa, Homo sapiens
ESTPQLARRQAPLPRPANLLGQWTSGSAASTNGLPNNTHTALNSGLRNSIIAKTPKVPAAKCAARHALTARVGRAFSFGAAGAACVSWPACMDAGRKPMDRSSHIFSGG

SEQ ID NO: 957996 - protein, 109 aa, Homo sapiens
RLGKTTDAQYSRRRDDGQGGFQYLHYKPPIALVVSELYPQRTLMRRYRPVLVFFGAKQHEVFAEFQLLSHERQSLIVLPPWESSDIELHIARRVPESWPSGCNCASMAK

SEQ ID NO: 957997 - protein, 193 aa, Homo sapiens
TLWIPCLLSLGQLSWLARLMASVSQDSNHGAVTENSLAEGISETLRTLSEMRHYQRLPDYVEPICALNIRGKELCAAVLGQHQYRALSESMLTTREFLKEISYELITGKVSFLASHFKTTSLGDDLDKLLEKMQQRRGDSVVTPFDGDLNECVSPQEAAAMIPTQPGLDNETFHIYQPQLTVARKLLSQVCAI

SEQ ID NO: 957998 - protein, 137 aa, Homo sapiens
MSFPKPRRSTSTLPGSGPSAELHASYSQSNGHTAAATNTPMRQMGERISSSSADRGLYIKKDLNRIAIEHLRLAHIRTKQAARQTALPRLGPARVIDRRIHIRIKPILIRCNTLPGRFRLLTDQTDTHDGLHTLEAI

SEQ ID NO: 957999 - protein, 134 aa, Homo sapiens
HAWRVDSEESLVKAHLHPAIPRQSARHQRCNAAAAYTWAPVCGDRVTRPTFTGHSGPNCHTRSSWNGVSPGQVGVAVLKGGLISHHVFIGFIARLSLVTEVNDTREGCEFSCEFWRDTGNLSQLLRGNIGLMHR

SEQ ID NO: 958000 - protein, 116 aa, Homo sapiens
EFAAAAMAEALSNTSSGFKWEDFQRIANKPGVHYALAGFSADSTGDNGVGVVQAVIEALNNPQSTTSPCNECHGAGFCMSIVQEEMRCPCNAPIQLSKENAMNNLCSGYLSRETLT

SEQ ID NO: 958001 - protein, 81 aa, Homo sapiens
TPEDEVGSTILQSWYFDVNSTTMTPISKRKNKRYDKKYAEIGRARWRMPVILPLWEAERGGSPEVQEFETSLANMVEPHLY

SEQ ID NO: 958002 - protein, 67 aa, Homo sapiens
MRSAWAGRMQASSMHGGPGISSSTGCVIFRADVLQHRSVIQIQSLLCAVLQAHTGPSPGTSGTASIT

SEQ ID NO: 958003 - protein, 102 aa, Homo sapiens
CESTLGVITQKVREQFYELTRKALAQFLNDQINDRLKSAMSGVIQPSLASIPVTNSAKADAQERDEAEDKILTTLEELEGYHIVRAVVRSVVDAKRIVQRGC

SEQ ID NO: 958004 - protein, 53 aa, Homo sapiens
MSSFTRTLLIASAPSVPTTSHFQPHRDESQKENALTHIGVCVCMCVCVCVCVC

SEQ ID NO: 958005 - protein, 157 aa, Homo sapiens
RYPVKAHPHSMNSPADRRPQRIIFATASAISETGPPSEPASPAAVSRPCRRIANSMRYSSSSPSNNNAAVLAHQLGHVGERPHAILNGAEVTLWFTRNFQSSPPDLFGAVRNRHSLGTDSANGLAVADDRKNLLIQLNCPLRPGQCHVQQVQLLTQG

SEQ ID NO: 958006 - protein, 97 aa, Homo sapiens
MPRVCGRLELGNLGVHLNGPLSEDNTWSVGLTLPRRIYRHDNNSTKTDTIIAQTNNKERRILRPRHSGSMPCKFPCTLGRLIVGRTALSHQEFKDHA

SEQ ID NO: 958007 - protein, 104 aa, Homo sapiens
LVLNAFSHGSSNAGGTFLSHYAVHHTSSFRGDAERHRVHSHAELGTINDEHHLNRPHKKAAFIKGGFGFRYGYACGRMCGNRITSRIDGELGNNITKTVNADTF

SEQ ID NO: 958008 - protein, 115 aa, Homo sapiens
AEPPESTPTLQPLIERLRDSAKLGLRIKPFPVNVREHGRSGIGFVRTRAERYTLSLPILGCEFVIAARGADEKSVLAILQRSVQRLVMRTPSNMARHLETISLAGQPESCLQQSK

SEQ ID NO: 958009 - protein, 70 aa, Homo sapiens
ARYPVKHTLGGACVIFADRRALCAFLNYLPSSLSIGLSSAFFRDGRDCLQLFEIVCINGVSVQARSGCAS

SEQ ID NO: 958010 - protein, 35 aa, Homo sapiens
ALEILRVSNIIIPTIRYAINTAILTSTGLVTNEPF

SEQ ID NO: 958011 - protein, 32 aa, Homo sapiens
MLTYNHTSESLPFELCEHSYLHTDEGIRSAHW

SEQ ID NO: 958012 - protein, 123 aa, Homo sapiens
RLGKSACGYAPPSPIKLTGHFSCPSSADVIEKHLKLFQSNLVPADPEVKAACRVTQTLREQNGQPELGKPELTSKAASGQVVGGDPSQEEPINLLCRNEGLCCASRRASWRRQPLEGSHLLPK

SEQ ID NO: 958013 - protein, 59 aa, Homo sapiens
RYPRESTPISTVFGSSIGIVTCSTDSLTGTTLHPYKTYLERFGCIRTHPFFGDRFFKQA

SEQ ID NO: 958014 - protein, 112 aa, Homo sapiens
MVINVISATVGQVVCCDRSLASLTVELDCALSHADDMQDFSRRRIAVYLQTRQIHDLGHMLNRLCLPHSYLASTLPSAMVEIPIVIRRPRLAQHLGDLVQLITVVPCHPRVA

SEQ ID NO: 958015 - protein, 33 aa, Homo sapiens
MDNTCTGRTHRLQELPSKYMMKFLEITRFTYSL

SEQ ID NO: 958016 - protein, 57 aa, Homo sapiens
TKSCTEAEKGKQRRRRNPSSFVGFDVQNLLPFSLCAYEPVTTTATDILPCRCYTESQ

SEQ ID NO: 958017 - protein, 38 aa, Homo sapiens
MHAQPTTATSRRRNPRSFVASCQPSCLRLCALSQSHHA

SEQ ID NO: 958018 - protein, 48 aa, Homo sapiens
MALPYTTTHAQPDVLALCLLNGNYSPPLCGGMSVMAESSPSVPDSFSI

SEQ ID NO: 958019 - protein, 45 aa, Homo sapiens
NLPSAYHNYNHSLLVTIHVAQNHYTIILTMPLTSLLCGSDHIKCL

SEQ ID NO: 958020 - protein, 101 aa, Homo sapiens
GPFTEAHSLIEKTKQIIQALLYHTLLLGSLYNPTYKPQRYFESILHHFRRHLQLNILSSHRLPRNFTVIIELKLILTTLHSESTRRNPSRRQTLHGNAKPL

SEQ ID NO: 958021 - protein, 64 aa, Homo sapiens
GAFYGNRGTRNQAAEAEKGNEKKEEPKSFVASDVQHLIALRPVCLVASPTHAQRFLPVDAHRVP

SEQ ID NO: 958022 - protein, 71 aa, Homo sapiens
AATVLRKQIVRKVEHHDVQSVDSLWLQKMLSLEMPSEMVKGDSKVLLRLVERVTYETQIKFNKQCLNYLVT

SEQ ID NO: 958023 - protein, 35 aa, Homo sapiens
AATEKGKREERGTQVAMWLRVNHSCPIACVPWSQS

SEQ ID NO: 958024 - protein, 48 aa, Homo sapiens
HVSVFRTTELGQKGTGGLPPNLIPSEQRRPQMYLDTLGSEKRGRLLLD

SEQ ID NO: 958025 - protein, 70 aa, Homo sapiens
LILNVCPSYQKELSLSCTLRATCTKESDGVILHTLQKTAALASIEARLSLHAGTQGYCLELQAGTGSRGP

SEQ ID NO: 958026 - protein, 106 aa, Homo sapiens
MAILDKPAPIVLAFQGLELGQHPFRCLLTHQLLTHLALVVDDEGHRQGLTARNLEDPVRVLGQYRELDPQLVAGGLQFLTLHIVEVDAEHPDILAFQLFCQGIELD

SEQ ID NO: 958027 - protein, 65 aa, Homo sapiens
VRGDLVQRWFFSHDDDRLKLTVYFPRIAVDNKFANIKFRHYGFPFKVTALMKPDPRGANFHGGVL

SEQ ID NO: 958028 - protein, 84 aa, Homo sapiens
SSLTWTSVMKCLHGYPRLISASVGTRGNARNLPADVQCIQYLFNLIIPKMGFALLENGKCDGQLVQCISQYQFRHLKYAHGCAF

SEQ ID NO: 958029 - protein, 75 aa, Homo sapiens
MYPVGLVHLYRTYCCNVSCRDGSPRENILKYCILQQSAPLQNILEYCIQLVCLACIAHSAALEQWIMRFCNTPID

SEQ ID NO: 958030 - protein, 111 aa, Homo sapiens
KHTLGLCLSVSRTPLCLSLSVSVCLLVEHLSVFLCRSLSVSRTPLCLSLSVSVCLLEEHLSVFLSRSLSVSRTPLCLSLSVSVWLLVEHLSVFLCRSLSVSRTPLCLSLSV

SEQ ID NO: 958031 - protein, 134 aa, Homo sapiens
GPDVAVGQSLPVRVVAKLRARLQESYDNSASDFVKENVAAFVNMTPETFSGVYANAIKETHWLSYTNFGALVSGSNFSTDALANGDTDVFINIDLKTLETHAGLARVVIGSFLNAIYNRNGAMKSRTLFLLDEA

SEQ ID NO: 958032 - protein, 67 aa, Homo sapiens
LYLFSRQVIGWAMKSRMCSDLAIDAMLMAVWRRKPQQQVMIHSDQGSQFSSSDWQSFLKANNVIGSM

SEQ ID NO: 958033 - protein, 56 aa, Homo sapiens
NTSPEPLLMPSFIHNIERSLIDTWRWGIHYENLTSLLYAVTLSIPITSFDSCRRSW

SEQ ID NO: 958034 - protein, 135 aa, Homo sapiens
HTSPEPHLMPSPINNIERLLIDTWCFLIHHENRTSPSTQLHHQSPLQPLTAAAVAGSLGVWVQDTTFSTLSHLFTLHFQFCLAQGLLSLCGSSTYMCLPAKWTGTCTLVFLTPKIQFANETKQLPVLLMTRTLHY

SEQ ID NO: 958035 - protein, 37 aa, Homo sapiens
PIAGEAVWFFGGKKTLQLFELPEFLRCFFLSCVAFEV

SEQ ID NO: 958036 - protein, 74 aa, Homo sapiens
MRSSIQQAVRTPWMSPQHCFRMAQKLVNSYTLVFKLTCWPDLRPLDFCRSAFRLPVLFLQLTPKHSRHPTCYRS

SEQ ID NO: 958037 - protein, 91 aa, Homo sapiens
RHRLAQQEHGGGHNHCSASPERRRSVMRFMFSKSKADASHCVCSMSLTVVAELSHQCVVGIDRQQRTATPRLSTSDHTMALITRSLISHKT

SEQ ID NO: 958038 - protein, 118 aa, Homo sapiens
QSDISSKNRELRTKTHLTSIENAYIYRRKCKPVHNSKPVTDHGVLAKAISSDRKLGSYGLEFPTLTDPQDKTTGSCQTLEKSQNTQLCHVNTKGNSILKYKVKISNKFYNPVLTSDTS

SEQ ID NO: 958039 - protein, 56 aa, Homo sapiens
MQSCSYMCQITQSGIKERNFRAKTIELIEDKRAHLHEPGFGEGHKVNQNINQNTYL

SEQ ID NO: 958040 - protein, 79 aa, Homo sapiens
GTRRIMQQKQKKANEKEGGTQVAFVASMIQPIICHSPVMPGASPTTLAYPPVVHTGPSTDGIPFALSQQAGSHLVLPDE

SEQ ID NO: 958041 - protein, 69 aa, Homo sapiens
MIYLHSSREQREPPSTLADGESELVSGFKTEYAAGPFALFFIAEFTRLIDISTRLHEYVLPRNNLFRYA

SEQ ID NO: 958042 - protein, 105 aa, Homo sapiens
GRPSRIPVHCEYYLFRMHTNRHDDKLSSQTCTKKHVIFKSVLFLHNANLQYSIIIIWYLSQRRHLDSSSLKHLVPSLSSQAEERNSKSTYCFFCQFLCSKIHIRT

SEQ ID NO: 958043 - protein, 72 aa, Homo sapiens
MILCIKSYSQEYHTINGHNAELRTALSTPEMQDVPEFQDWNEERNFGFGQIHAVAVEISDQDQEVTLEEDLM

SEQ ID NO: 958044 - protein, 59 aa, Homo sapiens
IYAYISIKAIESAGKFPSSLGLSVLFLSSPSKFTVSFLRFFSDGICSLFGLVFQVLDHT

SEQ ID NO: 958045 - protein, 36 aa, Homo sapiens
DSSRIPTYFYVVLVKSGALYEGIGCNLRCKQSFSEE

SEQ ID NO: 958046 - protein, 70 aa, Homo sapiens
DITCQQGAASDGVLQRPRKQLGNPCNCRRNGRRTVPRSRCPVTDEEESSVWTDNSCVGELERSRQEDIPH

SEQ ID NO: 958047 - protein, 132 aa, Homo sapiens
ALICGRLRIPAYRATAHGRRNTDLLTKLTRDLRSLQRIGPKRPSYRGLGELHGPFSQVEDLERVEGITGKQMESFLKANILGLAAGQLLWRLLTVVSSLRLFKFLYKPVLCTYSFCSGSLRMSVLRIRSTEL

SEQ ID NO: 958048 - protein, 121 aa, Homo sapiens
SQSDRISDPLIRNTLIRTLKSPLSESSRVQNPLQLGQNFECTKTRNTLYRYKIYTYKNMLTSLRKTDWPMLPIQYRSKQNAVYTPFHTHTIATSSCGNYGTKATMQRQKCQIPSYTNTNTH

SEQ ID NO: 958049 - protein, 48 aa, Homo sapiens
TLARIPHDVSHSPAGFFDDVQSEENSHRDCTHQRSHAGLWDHVTVLRD

SEQ ID NO: 958050 - protein, 57 aa, Homo sapiens
SGSCSWIGLVLERTLASSSLELSTRINFEGCTPSSGEQADIILNVFAAAPLSSARRC

SEQ ID NO: 958051 - protein, 51 aa, Homo sapiens
MVVLIFHDYKRTSQIHAKSTVQELITFLNAFYATYVYTYDPQVFVPFRVPS

SEQ ID NO: 958052 - protein, 47 aa, Homo sapiens
MQAMAEKRPEIQMIASDVVIYDAMMPALKNAKKEGTHHAVVVLPKRV

SEQ ID NO: 958053 - protein, 112 aa, Homo sapiens
DTPACAAQASAPFTGADYSGRYECTGPGKHIGSYKGVVDMALDAKQSTGKYAAYTFTFTLYLEDKSRYDGMATGTSDALGVYFAHTDPVLKDFGVGVAQMTSTPEGKVSFVK

SEQ ID NO: 958054 - protein, 35 aa, Homo sapiens
RIPEEAQEDELRKKVYRRDEEGEGDDGYEQIFQLM

SEQ ID NO: 958055 - protein, 74 aa, Homo sapiens
GHDEPFTSQTYHLMAARDRKDMILQTHDATQDFQNNCRMKESLIGSPDPMLPSYKHGYGIVFVHEAASVHKFDE

SEQ ID NO: 958056 - protein, 120 aa, Homo sapiens
MTVYSRVNEGYMLLMWWVSEPHCVVGNGTTRLDKKRDLQMRDARRYYTLFDYYTTRSRGARNEQRQLVVHYADKAASVCIVISKQKKRDRRCLEQKFRKSFIGKTQNIDYEAQRNCKDQD

SEQ ID NO: 958057 - protein, 72 aa, Homo sapiens
PGRTTQACKMNNDKSEAGAEQQLRERTMSTNVTDGALSGGARMTPAERAARPYLALALHCTTLNDTGARLNP

SEQ ID NO: 958058 - protein, 89 aa, Homo sapiens
MERTNKQKWNEHGIQVIHDLFVYGRSGDKTIRIWDVRDYNIIATSEHYRERTYNNQLRVLTGQTICCKQQGMMWLTLYLTANDTPLPYS

SEQ ID NO: 958059 - protein, 57 aa, Homo sapiens
AVTGWCVDQLVTRVSVLGPASQQGSLCSEQSVNRVRRFSDQSVSRVSVLGPVSSAKG

SEQ ID NO: 958060 - protein, 35 aa, Homo sapiens
MRFVPHALYYSQQSMRNKSAYFAETSGSFEDALPR

SEQ ID NO: 958061 - protein, 128 aa, Homo sapiens
LQQLLSNKVTTRQLQAGLELLTSGDLPALASQSTGLTGVSTCSWPQPSLSTYTCVDGINMHCPIIIAQHMQIFHHHFRISSNHQAAATCGFHPSGHSTQPAISKSTFRAHCTSQYSIKTSVFRSIINQ

SEQ ID NO: 958062 - protein, 93 aa, Homo sapiens
CTRVHSVSLYDDSSLTPLQIPDARVEQLGESRTYEKVINSIRHGVIETRYALYPQHSGAVVIPAQTFSATLVESRPPQENTLQGTKPGKMIHV

SEQ ID NO: 958063 - protein, 69 aa, Homo sapiens
EGEGNEEKVRTSTVTLRSTVPEVLNAQRRERPVKWAYHERVYSHAQTQLGITAHTHPIFKVCVIKAPLA

SEQ ID NO: 958064 - protein, 63 aa, Homo sapiens
TRASGSAKDEDVFDLLLEPHPHISGNRPPGFGDGLTDSINLGHVTTTLYTDTDVYTSKSLLAE

SEQ ID NO: 958065 - protein, 34 aa, Homo sapiens
KPAMTRKQLLPGNSFDQETAIDQETAKSGIRFDQ

SEQ ID NO: 958066 - protein, 64 aa, Homo sapiens
RVSEHCVEVVTLKIQLECSGHVCLRHSLHWNGQPVFCFDVSTQCAVLHAFSRFLFQNQSLTEID

SEQ ID NO: 958067 - protein, 71 aa, Homo sapiens
CSISSRIPVYVWYATKSLEINPHILCPSDSLQTDAEGYQNMPLPNVLLWHRDYSELKATEKKQMYEKLRIP

SEQ ID NO: 958068 - protein, 38 aa, Homo sapiens
YRSMGHTCHGLSQSSGTRNVLQAMLLQMLEIVVIWRPA

SEQ ID NO: 958069 - protein, 71 aa, Homo sapiens
APPILFPFIPLDMTTRVYGKRKLKGKLNTDRDINKSGPLSLTAPERYAPFTIFTDRYIAACLFFHLLPFID

SEQ ID NO: 958070 - protein, 105 aa, Homo sapiens
MKGSHDQQTFLLVIGHVAQFLARLSSNASFTPAARAPVRKSPPEASAANPPIKACEPNLGNATFCKPVLGNIPDQVESISRKCVSQTTLQRVAKTGFAPERPIYQ

SEQ ID NO: 958071 - protein, 32 aa, Homo sapiens
QAVEQLAMVHRFRGAVHEIPEDVIALDVTITS

SEQ ID NO: 958072 - protein, 61 aa, Homo sapiens
YLADQTSRCSLLGLLLVTWLVLGTWYWWTTNLHWLDALRHVALNVTSVVTTTGFALGQRIV

SEQ ID NO: 958073 - protein, 105 aa, Homo sapiens
HGTALRRCFSFSHWRKPPPSRRQRRPLASPKENEKRPPFPSVAGNGKGRFGVRRKQREKIDDGRIDGQYRCSLGREGRTLAFSWRTARWKARFRRLFRMSRPSRR

SEQ ID NO: 958074 - protein, 97 aa, Homo sapiens
QQQGGSDMLVQLDNGSSITIKQGETMGTVTVPAPTDDVFIDKSTQTVKITGTTGGNFEGVTITPAGATTTINDTIDDVTVVLKATGSVSEGGQIVYT

SEQ ID NO: 958075 - protein, 122 aa, Homo sapiens
LQQDKGMTAMAPRVKANEVMQWAWKRLIDRQSTSMPARTKSCLERSCSGELYRNLLHRIPGFAQFIRILVQPVDGIEQALAQHFIAEFFHGAHQVEGRGFVIFRDGIQGLAQVSGKARLSKI

SEQ ID NO: 958076 - protein, 62 aa, Homo sapiens
MADVRGDQVDVLVPSCGFFSQHVPLLGGGHRDFHGGAHAVELHDQAFGGDFFPEHRFVAHHY

SEQ ID NO: 958077 - protein, 51 aa, Homo sapiens
DLTHLADTALTSILNPSRAQLRLQGYQKTSLTAPSLSVGRHQQARWWVRAR

SEQ ID NO: 958078 - protein, 51 aa, Homo sapiens
TRTLHTHLVMYIGTSYVCTMLMSRLRSLVSNVKKSLRAAYVKPCVLRDSGV

SEQ ID NO: 958079 - protein, 110 aa, Homo sapiens
MADSSSEMMIGTHEDMTHLDSPALMIRRRYFRLELRKEWSPCSSFSDPESEKRNTCVLREPIVAQYPELTRESEKIIANFKKKMKVKNWGTLFELHRTTFGKVTKNSSSD

SEQ ID NO: 958080 - protein, 51 aa, Homo sapiens
MRVLVCTLLQTALRMNERVLGAERRSSDPERCVDKTADGGMKSDLKEDELV

SEQ ID NO: 958081 - protein, 62 aa, Homo sapiens
DLEDPKLQQEYYNLPMQQMINTDLSRILKGPEIKEPLSTRKKIIQSPKEEPLKILENLCWEL

SEQ ID NO: 958082 - protein, 69 aa, Homo sapiens
LTLRISSSNKIAAARQRELCTYQVPGPAPGPNSPALPLWICTLTLDSAAQWEEQNLLLHATKFNKTVLL

SEQ ID NO: 958083 - protein, 42 aa, Homo sapiens
MASILPTLRVKNTADSTTPVNTPFCKVMGAEQFHFRPEQFHL

SEQ ID NO: 958084 - protein, 62 aa, Homo sapiens
VELTKVIIIMTMVLLSKTADCFWQEQRSATPAEALKDHSTHHLTPMTAAASRVGAQPSLAAN

SEQ ID NO: 958085 - protein, 57 aa, Homo sapiens
PDSSGCVRRREIQRRHLLNHRQTREYEPNQSSADIYGAICASRPGSAGSAANTRYTC

SEQ ID NO: 958086 - protein, 66 aa, Homo sapiens
GPKLQQEQILVSTYVVEIDAKTGLDAKREDLGLNLAKEVRKGLKVSDKWAGEQQGRLAVENPGCAI

SEQ ID NO: 958087 - protein, 53 aa, Homo sapiens
TQQDTRALHDNDPRLRRHSSSTLMKVSAEISSCSIGFFQGHADFERDHIRQAV

SEQ ID NO: 958088 - protein, 45 aa, Homo sapiens
MKHGARTIKNDDRTYNISRRYAMDMLRYIIDEHVTGLNASAGDPL

SEQ ID NO: 958089 - protein, 101 aa, Homo sapiens
DLEDPPTRAAYFIAGKLGRNRTTEGLAGTPSPGMTAKSQGLSGGSGRISILPPLVHPVCCGDQAHATQGQGRKQSFLFSSGLQAECPMLCSDSMQTFLLGA

SEQ ID NO: 958090 - protein, 89 aa, Homo sapiens
SSNKTSSCTPGPPTVVPHSIVSPPEEGQSKTAPKFSGLRYSDGMLLKLQEAATTLSLQIEKPSWDPNLQATLEGYGNHCNPRTAERWAS

SEQ ID NO: 958091 - protein, 46 aa, Homo sapiens
HNSSELRELYDNRAGFTIGNNTSYSRVTLTCTHDESNPRLKYPISE

SEQ ID NO: 958092 - protein, 52 aa, Homo sapiens
AHLRCIQQLNDLITERSSEMSSEDEATPWPPDTASADRMVLHHVPDDPKFIE

SEQ ID NO: 958093 - protein, 59 aa, Homo sapiens
CASGMARCSEKLDYTHGVFTVEQHIRGKWVCEDCETLIQAPVPAQVIDKGTPGGSSSRR

SEQ ID NO: 958094 - protein, 44 aa, Homo sapiens
RTRPNEVPGGEARAFCLLLRFSKVSRRQGGTLSGRYLNNGYVRG

SEQ ID NO: 958095 - protein, 69 aa, Homo sapiens
SSSKIPVLIAYTASGAFSAFGQSCMSRASHCKGEVTNESRAEEHMTTRSDIAVQDARREEEIREEARGG

SEQ ID NO: 958096 - protein, 52 aa, Homo sapiens
SVQRTVRNCDDQIGRLNLDLTGYRPSRFDPGIHAVHKNSRVEIFVIDGQGGE

SEQ ID NO: 958097 - protein, 75 aa, Homo sapiens
MMLDGANKSINRITIDGDTSHQTTADMLHRHRTRPILPSNHFHRQVHCSRALKHGSVCQCAWHVAQAIVRDGEGA

SEQ ID NO: 958098 - protein, 64 aa, Homo sapiens
KIQQTPMHETRIDETYKRLDRRIPLRRDYTLRDFGYGPGVASGTFRYGYSDNLTLESHAEASSE

SEQ ID NO: 958099 - protein, 78 aa, Homo sapiens
MSSSGVNILEKPPRAIDQLHCARREKMSALIGDLPRMYELKPCDPTAYRQQTRRSTLIVAALFLALAMLLSSLAVMLF

SEQ ID NO: 958100 - protein, 82 aa, Homo sapiens
APLERRHRIEHHRAARRAWGRRAALRTTRLDTDRHAPWKYMSEHKASGSQAYVVMRVIKRACAPTDMGTLTKAIIETHADEL

SEQ ID NO: 958101 - protein, 38 aa, Homo sapiens
ARTLVVIVQQPEELDRLILKPTLHTMFVLFSPVSLTES

SEQ ID NO: 958102 - protein, 48 aa, Homo sapiens
TLEDPKLQQRGDYSVWPLRKTEKKWRVPATQQALLRLLAEDFNKFGRS

SEQ ID NO: 958103 - protein, 134 aa, Homo sapiens
RGPRSVMVCGGDAVDICRHISSIVSQSPSVIQSLRPVLMSSIIPLNISLGSECDKLPASIRLSTVARFSVKTRSFLSAACPFLSDCLGGPPGKCLLDSLTFYSEDLYHNCFWEDYDQIIVFIFLFEGFNICNVF

SEQ ID NO: 958104 - protein, 50 aa, Homo sapiens
PQTYARATATRDPSHVCDLHHSSWQRRILNPLSKARELNPQPHGSQSDSL

SEQ ID NO: 958105 - protein, 85 aa, Homo sapiens
MLNPLVIVAGVSDVEDPTEAAVVVELEAIKLCTLPTWIGAGCKFKVVIEGERMFETRYCSDSALMIRFEPAQGDLEVSKTLNELE

SEQ ID NO: 958106 - protein, 93 aa, Homo sapiens
KRTRSDVLVRDPSVASQLLRGTVRHATEIEHQVCACLRCPGLHARYTDWLQRVPTLRRQARVTRGTPFVMGIGDCNYSPMNEEFPVSAGHKLA

SEQ ID NO: 958107 - protein, 110 aa, Homo sapiens
VSIRFTAIIQSTSRVLKEFATFDGAGTTSLEWGGYPILRFDELPQVDIQLLDYPDEPPMGAGESASVPSAAAVGNALFDALGVRMREVPFTPERVLKALESAAQVKEDKA

SEQ ID NO: 958108 - protein, 57 aa, Homo sapiens
ELEMEDLILPSGSCFGVGVGKTGNPLSSAQISYLSSLVGVSKDGSSNQKAGLCLKLN

SEQ ID NO: 958109 - protein, 52 aa, Homo sapiens
ENSKYYVTIIDARTRDFIKTLLQDISADVLSDCCCWYYGEFEAGISKNGQTR

SEQ ID NO: 958110 - protein, 68 aa, Homo sapiens
VAGASESHLTDLTLLSSFILASRLTLSDERINTLESLHSINHFTLYKSKSLGYLFFSLMHNTILTTTG

SEQ ID NO: 958111 - protein, 66 aa, Homo sapiens
DLSELSGSRHLGNVSRLNAVYSMQHGAMDAEWMQWIAYNVAQWYLIECRGSHAACLNAVDSMQSGA

SEQ ID NO: 958112 - protein, 34 aa, Homo sapiens
YYGYQSVLLSIFAGDTEALKPLIVPNWIIFLNHL

SEQ ID NO: 958113 - protein, 65 aa, Homo sapiens
NQLGTVLRETDERRAGGRIPGSRGGSVKVSTDYPEASYAPTVLRLWGQKKFLSALSAFHESHGVS

SEQ ID NO: 958114 - protein, 118 aa, Homo sapiens
MSTAGLKFNTNWRNRQINRHPDLLQRGTESSVLCHQKTYNHKTKEAMDIQLAAFINCENESSGNSPGKCKAKLAYCGQLIKKLERQEAEERANSRLKVRRGRVQTHKGLTKRPRVSKD

SEQ ID NO: 958115 - protein, 124 aa, Homo sapiens
GRRTVGHTQEALNNAADEVQKLLPAADTGSIKDRRPAHRDMAPVRITRICQLGITVLQWFETITIRDNHRLEICIPDTYSRRTINPCWTSHRCHQPESGHKTEKRIEERKRTRLRSGKLATLEG

SEQ ID NO: 958116 - protein, 86 aa, Homo sapiens
ILCVCLVAPLIRESCTVNWAGQDWAPSDDEVVSQSPSPHTSDFSDWSSFNAKQYPLDQEEGKTCCPLAGPAFYQAPGPSFPGRPSS

SEQ ID NO: 958117 - protein, 36 aa, Homo sapiens
HQPLSRSGLPLSEIVRSFGQNSIIAYDKTGAGCVGL

SEQ ID NO: 958118 - protein, 67 aa, Homo sapiens
LLERISLPTDTLPLILYRAFLLKMDRVHIKKIRVALDRRSSNEYLAAVSSLLNSTAHYEDGGGSQLP

SEQ ID NO: 958119 - protein, 60 aa, Homo sapiens
AVSKWISHGLQCTPCSVVTWFLIDCSESPCSVAQWISIECTVFHAACMNAVYSMQREEME

SEQ ID NO: 958120 - protein, 42 aa, Homo sapiens
MRLVLSDDLIPVPCHMVCTGYIEVIGRVEWSSRTGACDRPFE

SEQ ID NO: 958121 - protein, 87 aa, Homo sapiens
LCETLYTVLPSSRDRCCSWVHQSAYDVERTQEVKGLVAAAPKEAKGNLLEKKLGKVKGLWRQPPEKAFQGQSVTMLAAPSAEKSLKD

SEQ ID NO: 958122 - protein, 34 aa, Homo sapiens
LSDELIRTCHMYTRLHRSDRQTSNGRRARGVDRP

SEQ ID NO: 958123 - protein, 33 aa, Homo sapiens
TDTVYLELYIDGLTPAGGSFFIRSNHPSALSAR

SEQ ID NO: 958124 - protein, 85 aa, Homo sapiens
SPLNGSRPNGSRRRAHFGQKPPVEQKGGSFLDLDFQLRIQTVKAGPHDPSDLLGFKQEVSEKLPQGYLACGGQAFIATSLFDPSM

SEQ ID NO: 958125 - protein, 117 aa, Homo sapiens
MSLDTMTEFMLGAIEPPQSMILKVIESSTRRPRRLALHADDERRHPRKSLQVPDDCSRHTTRNLPRAFYPPPDSEADDAHGCHSSALKKRDEAAQLPGEPRVYRTRQSVHPVRRLTL

SEQ ID NO: 958126 - protein, 36 aa, Homo sapiens
SGALLVEVVYSWPGIGRLMYDALAQRDYGVLMGGFL

SEQ ID NO: 958127 - protein, 114 aa, Homo sapiens
SLPLSVRCLSVSELLRRSALNRKIMTRTDIKLMNELLRLGGLQKHLHNQMKDGMTTELSKQFSEVLVALKKAVIQLIYKLCQSGSDDQVNVIIPPKRRDGATSFMKLVAYISVR

SEQ ID NO: 958128 - protein, 96 aa, Homo sapiens
MSCLAFVPVQRDHSNELLLDYLHRCMTDGCSEFKMMAGRTQFVISPNTRVIAIDLNNIMGDDSNAGHLKTGIMFLFAGEVAGGHFVLPQYKDYLMK

SEQ ID NO: 958129 - protein, 43 aa, Homo sapiens
SHRFVRLTCKKELEKSCHSSGGFGLGIWDPKEKVDEPSCQVPV

SEQ ID NO: 958130 - protein, 53 aa, Homo sapiens
MPVLLLTWWGQEIVWMTGLGERILLYAFLRVSWSAAYPLLSNGISLNLYLIQL

SEQ ID NO: 958131 - protein, 110 aa, Homo sapiens
RGTPKGASTRSAYLTHAPTGRALAWKTLLAKPAPRRSWFDKAGIETEALLADQPVMALGKVQLTSRFHEWPVTADGISTKGCLASNVSANFCWFGEAEALDSHTGFGTSS

SEQ ID NO: 958132 - protein, 142 aa, Homo sapiens
MTYPGVSWDIDMEIILPVRVGTHKLAASKGSDFLQRVAMICFDELMALITITSEKRTMFEPKTYQEKLNLLNRQLVDNLLMQLPDQIRLNLKEVTDQLVRSEAIIRMEQVNNVVGPIEIPEDERADNRFMLDLLASNLGRTA

SEQ ID NO: 958133 - protein, 87 aa, Homo sapiens
VNSDIGRDDLRCDPVTAAKRHPTAEPSENRHDQATATREPDRVQATPFPDDKVTMPLRPQQHPTEQSPHQATANTNRQNRGHEIEAD

SEQ ID NO: 958134 - protein, 73 aa, Homo sapiens
RSLQDPPSLFANGFSAVPRVGVARLLRLEACIAACSMLVPFRLVVIYACELTGTGMLAFVILLIANRKARTKP

SEQ ID NO: 958135 - protein, 54 aa, Homo sapiens
RSALRELIASWLISKSMERLTSQLVRVLDHMGRKKFFIKSSGNAEDTYLDAIGQ

SEQ ID NO: 958136 - protein, 146 aa, Homo sapiens
TRIEFVVQELDRLARAQVLEVHITARQLDALDTQWERLGVGIGRGRFAGGDLEQPQQIEFAFLVKQDLGLGFIQFDIRQMQRAGPQAVQLQVQIEAFEAYLLFTWRTDIQPPERELQAVRIEFDTLDMGRGGGVVGELLIGHPQGN

SEQ ID NO: 958137 - protein, 60 aa, Homo sapiens
MSSRIPTCAYFVAYITVLLNDVGLQAEQDAVVTVDPRDLSTYRTGSSRVGMKHRLRSLMC

SEQ ID NO: 958138 - protein, 42 aa, Homo sapiens
YTCRLLHIGSLSFTLTPAVPCDGNTRRCLEIPNLSGLPRTPC

SEQ ID NO: 958139 - protein, 35 aa, Homo sapiens
YTLGSIVKQNSPSYTGGCRDWWRYTCQYGIRTIPR

SEQ ID NO: 958140 - protein, 120 aa, Homo sapiens
LLRTCETMVSVVTIVLNASTAWRFVTSVQIHECSVELSCDRLDRSSLAALRESFHQRHKALFSFSEPNSPVELVNLECSVIARLQRPPMPELATPLKATAAIPAGHRPMLFNAPDDWQDT

SEQ ID NO: 958141 - protein, 72 aa, Homo sapiens
TLTAGLIMGVLVTHSLTDTGKCHYFAVLTDHFLDKRKMVNLMTIADKCMRTLSARHNALTSWEPPLFNAESH

SEQ ID NO: 958142 - protein, 119 aa, Homo sapiens
VKARKTPYAPGTHEEPQDRCRFSSKLAVKTVLCQRITRTAVLAQHIEGDETGLFTQYLTGVVCRGSDFCIRNGCKTPRFASNAYSFASSCIVTSPPPSTSDETIMVLAGHIRHASLTEK

SEQ ID NO: 958143 - protein, 93 aa, Homo sapiens
MVFNVIARNQDDHTKNISFLLDTDGTWYLSPAYDMTWSYMPGNFWVDSHQMSINGKRDNFVLEDLLSIANQIKGLKAREIIREVHEAVVQWPG

SEQ ID NO: 958144 - protein, 76 aa, Homo sapiens
ILQLAGIQLHRDLLDLSCVSDDLLHHLQGLSMCHSGACWSLHPDALSLDYSASLLTFSNPVIVTRVLVLALADVCA

SEQ ID NO: 958145 - protein, 44 aa, Homo sapiens
MADIQTERAYHIAADHLSTQEERSCWEKLATEKLPRLLQVTSPL

SEQ ID NO: 958146 - protein, 63 aa, Homo sapiens
LSGPVWMLSDSLKLNTQSKALSTKELPLPRVQEGLAKAPPHSPLLHRGDTQHTVYWTHFLTLT

SEQ ID NO: 958147 - protein, 44 aa, Homo sapiens
GCSADVSADDNGPLHLHLGHHAQQRIRPRMDHLPVKGHFLSMFV

SEQ ID NO: 958148 - protein, 47 aa, Homo sapiens
NYALNNPQQRVVVDISTFGQGSDQNAYYDIDNLAGSDGDSAFMPALY

SEQ ID NO: 958149 - protein, 33 aa, Homo sapiens
MVLCIFILVTTPRGDPPSNGHLTSEGAFLVNVR

SEQ ID NO: 958150 - protein, 83 aa, Homo sapiens
MLVGAQRKCSLLVAWSLLFFEHHRQLLGKWRTFKYLYLALVPVPVKNHRSSSKPRLAEESQVVRKVLANVFGDCRRLQLTLRH

SEQ ID NO: 958151 - protein, 81 aa, Homo sapiens
AVILVVDLYAGSPQSMLARNSSPVNNLETSSYNQILPTYQAFRPEYSPSQHLDHSILRDTEPKAPSATHTRVQTYRNYEAI

SEQ ID NO: 958152 - protein, 99 aa, Homo sapiens
VGLSFCSSFRLSFSKRLQHHAATALTDAGVALAQLGAGGAQPAFVQQLVLQVGFDARELLGLFGLDVQAGFVLRVAFGDLDDVVQALDLQAHEAWARAV

SEQ ID NO: 958153 - protein, 82 aa, Homo sapiens
FVNSASQIADQTLGTNGGGFFGVTRRTLFEDPTAWANLFELSAIILIPVALVSPSVIYVKDLRQSRAILGCMLALFLIGGAT

SEQ ID NO: 958154 - protein, 115 aa, Homo sapiens
QSKVTRQCTPLDNVQQKEGPRGSCWQVQQVTDVMTMLDDKHPCNQPVEDKRSREQVRQNGTLSLADHPEVAFARHFVAHRRRVHRSVGLQVFVMLADQAEELLQTDKLLQKRVGV

SEQ ID NO: 958155 - protein, 97 aa, Homo sapiens
MPNAINSGACKLEKPAHPLRHVDQHVRRVTGNLVLRQRGLHHFETLVDQVQQCRRPNVIDDERAGRGLWRTLFFRRSRRLLGLGFGRLQPRVDFGSL

SEQ ID NO: 958156 - protein, 86 aa, Homo sapiens
SGGHRSAVLQVFAKGRDVAHRAFERNYGFAQFQQLVQLGYLAGDGVGAEVIDVFEFKLHIQVGVLIVAENRRNRHVQSNFGFSQYF

SEQ ID NO: 958157 - protein, 97 aa, Homo sapiens
MPYVRIELVESAEHALSIPLSKIEQSDRLWLDDFGQGIANFSSFTTWHYEYIKIARDLFILLRQSEEGSRLFFTLVTLMNRYSKGVIIEGVETAQEW

SEQ ID NO: 958158 - protein, 53 aa, Homo sapiens
RSCLHSLEICDEVEDSSYDNHLEGDDPNEWRWATHFYILCCTHYDRFHLVTRA

SEQ ID NO: 958159 - protein, 116 aa, Homo sapiens
YRRSELDGNVGGFGTTLPRVWDNVKKELELSGEVAVEDWLAMVLSWAIDLMRPVSSGLCCVIGGVAAKMQIRHNPSWAARNAAARADQTNSGIPAILLAPHPAGFQAAFGGKGTVG

SEQ ID NO: 958160 - protein, 64 aa, Homo sapiens
DLTTEVEESSYDESSRGLMTPMREVGHDFYFLCTIRQFHSYTAATIVFFHRSSRDCISMHLVGS

SEQ ID NO: 958161 - protein, 74 aa, Homo sapiens
SRGSLCVVAGHFRAVHSQASRTRNRPQPRYCGQVRMPTASACRVVMVVLDLNVGAGFCGSGLARSHTKPGSHRG

SEQ ID NO: 958162 - protein, 75 aa, Homo sapiens
RRRADRCTAAARTLLLAHAIKRLHVTAIAKQRGGFKRQVIALILAKAVLSRRLDIARLVRQLGAVSPCPLAKAMR

SEQ ID NO: 958163 - protein, 107 aa, Homo sapiens
MQDAFILSFPIVMASSLIILINFAILSTDGLISKHFTFGNNIPNLADAQQIFTPVMNGSVNIMAILITFLVARNIAISFQQDDLLCGLTAIGAFFVVYTPYTIIDGQ

SEQ ID NO: 958164 - protein, 33 aa, Homo sapiens
MILSDMLNAKYEVMVEQNRKDAESLVTSRTEEL

SEQ ID NO: 958165 - protein, 40 aa, Homo sapiens
LSGTARISRSEVTDLRRTLQVLEIELQSQLSMKAALEDTL

SEQ ID NO: 958166 - protein, 138 aa, Homo sapiens
RFVNWAEPLDRLPQLDRTFISNNTGKRVCLTMLGKLDLVAGMTLTPKDATAFAKRLKPWIAELYRGEDPEVGRCLPLDDFLAVGGKPIFARPRFVLKPDAIAELNMHEIADSRLQIIDWAYLYCGKQRVKGSTNTGLR

SEQ ID NO: 958167 - protein, 57 aa, Homo sapiens
RETGGITIVLSRSPVVAQWLTNPTRNHEVVGLVPGLAPVGEGSGIAMSCGVVRRRGS

SEQ ID NO: 958168 - protein, 80 aa, Homo sapiens
QLGTSSATRPPPLGSASVSDPKAIRQRPHTHRRKPRHAFQHAAHLADLAAGDGVAELEQLRKTAGRTQFGSALDQVWERA

SEQ ID NO: 958169 - protein, 81 aa, Homo sapiens
RLCRIFERSSPFRLASVFSEGQVGRVGPGLEGAPGILFLVVIEFLTLLASEVIGNLGLIVLVPVLPFFYKMSKTCSFNFTM

SEQ ID NO: 958170 - protein, 76 aa, Homo sapiens
MYNDLKFPRSDRAPRLLAVPVAGDRVRGIARELEQEGFRYLFCRVSTLKAGWCASIPSRSAVHPDCRRRRRGLYPF

SEQ ID NO: 958171 - protein, 78 aa, Homo sapiens
KLGYRFRETHICISQSPSHVFFLFFMAAPTAPRTYESQTQLRSNDAAAEATLDPLTHCSGGESSQHLRETHILITIAL

SEQ ID NO: 958172 - protein, 50 aa, Homo sapiens
MLRLLPGFTLAAVTLVANYRSLPEREVPILLSPTQKAVYQSMMPTEVLAH

SEQ ID NO: 958173 - protein, 38 aa, Homo sapiens
MQCRELVTQVTEEPISQTEDGEEQESTTTPRLKGQKKE

SEQ ID NO: 958174 - protein, 67 aa, Homo sapiens
SSSHRFVRSMFLYSVFCCFFSDQSCCPPHVKVLGKGLQSTVPRDPRQRVDDAVAVVKGVESGVSLLA

SEQ ID NO: 958175 - protein, 67 aa, Homo sapiens
SRTRILLRCGSAVTKPDRIHEDTGSISGLTAVGQGSGIAMSCGAGRRLSLDQVLLRLWHRLATVAPI

SEQ ID NO: 958176 - protein, 56 aa, Homo sapiens
TTSQQQQQQQQQQQCMRYQKGLEQSGRITQVTVKQYFSTEPKLTKDFSSEVNLEEI

SEQ ID NO: 958177 - protein, 52 aa, Homo sapiens
MSEPFSLIQHVPGTARDCSRQVVFMHRRNLLKASMAIAAYTGLSASGLLAAQ

SEQ ID NO: 958178 - protein, 115 aa, Homo sapiens
MAIDPHSGWNTVLPVLGRTLVHGLDRDRLNLRSTPALRSWSVRFWLSLNLRKPEQIRQFFARLNVRTAVDVAALDRSGRRPYRQWQNPAQVPLLKFTLSEPARLSVRVGFGSLTE

SEQ ID NO: 958179 - protein, 59 aa, Homo sapiens
GTALVNCQSSRAWDETSVPSGVQSPLLLGFPLGCSGLGIQRQRLRWLQRGGFDSGPRAV

SEQ ID NO: 958180 - protein, 64 aa, Homo sapiens
RSRETHHLEEDRTRAPFEHGEGSLVVCPATGDKRRATDLIIVGLTGYVHVQDADESEGKKQGLA

SEQ ID NO: 958181 - protein, 94 aa, Homo sapiens
SCETPHRLIFVTYQIFIRIIAAQLLPLSAEPSGLNALMYKDLKFPVLIVHRDIKADTVAGAVFKALAGLLKAQQLLLVEGLGVAQAAHNVGTES

SEQ ID NO: 958182 - protein, 70 aa, Homo sapiens
ARTALVNFRETRTPCSWQWQILNQLRKARDQIRILMDTSQVLNLLNHNKNSLVSVFVIRELNPLTFKVIP

SEQ ID NO: 958183 - protein, 73 aa, Homo sapiens
SVRLVQLLSLAFKFLLTVSVLPSISPSSLGCLEQFLGTPPICPVLDAPGGWHGSLPTISKALSPWGQTNPTLW

SEQ ID NO: 958184 - protein, 92 aa, Homo sapiens
MPGIFAQAFLFMSVTAQPASPAPDHHAQFIELLSASLAQNAFIKLVLAKYVGEEAELQRLIIKQVVVKEQACLSFVYRYKTRDITKNFPSLT

SEQ ID NO: 958185 - protein, 72 aa, Homo sapiens
GSSRFVNSLEKQTRTTPPYRELSRSARLMFHRFYTRAIRNDKVVITNTLVSTSPKLYEHFCRFWYRPITRKP

SEQ ID NO: 958186 - protein, 114 aa, Homo sapiens
VDGVRRRLPAGGAAMNKVQNNKAWWLVLPVFLLVAFSAVIPMMTVVNYSVQDIFDQSSRYFVGADWYKQVLLDPRLHDSLLRQFIYSACVLLIEIPPGIAIALTMPTKGRWSSL

SEQ ID NO: 958187 - protein, 93 aa, Homo sapiens
ARYRSRGDDDSDDHLITTNRRLWTHLVERDLTTYEFDRMFNQVSENVSWADVSLMAREFGVTAADVSQWILERHGELVPDGAGAQDDEGSRFG

SEQ ID NO: 958188 - protein, 63 aa, Homo sapiens
MNSLSELTSQKGLLLIRVLLEVEKTAGLEESNRHVVSWLRLKVLREAYRLKPAKGQGLHRLSN

SEQ ID NO: 958189 - protein, 63 aa, Homo sapiens
QLDLFDHEGYHNLPEEWIEELRFVFEEPHRTIVMHNVPFDIQVTFGEGFDFNANSFCTQILAH

SEQ ID NO: 958190 - protein, 51 aa, Homo sapiens
MGKNIIALPDEKIVVLPGYKKQRCKTESYARPRWQLAHGPQKYIEQNERVN

SEQ ID NO: 958191 - protein, 59 aa, Homo sapiens
DTAMSITHDAYLKLYQLSKPDLSERFNAILLDEGQDVNPVIADIVKIQRVRKVAVGDPH

SEQ ID NO: 958192 - protein, 33 aa, Homo sapiens
VSPILIVHGCQDSLTDGGGFVVQLEVVQHQGTE

SEQ ID NO: 958193 - protein, 35 aa, Homo sapiens
SPLEYPLFHEKRSELQEQQMQLALAMSREVAEQEE

SEQ ID NO: 958194 - protein, 36 aa, Homo sapiens
TEDPPQIPFTTITIETADHARLQLQLAYNWHFEGVP

SEQ ID NO: 958195 - protein, 38 aa, Homo sapiens
DPGWYMAQPVSSELVTVICLAHVSLAARDDDGYLLAEM

SEQ ID NO: 958196 - protein, 49 aa, Homo sapiens
HWSFCVNRHHSTQLRTAVGLSRPSQPSTVEGISFWPPNPGSRHHHQHPP

SEQ ID NO: 958197 - protein, 86 aa, Homo sapiens
SLSSMRKKEEEELVAMSALSGAGQRESSNNPFKTEKERERQAKLAEEKMRKEEEEAKKRAEDDAKKKKVLSNMGAHFGGYLVKAEQ

SEQ ID NO: 958198 - protein, 53 aa, Homo sapiens
EELQNLIMGSTKPARRQPAAEWQPSKRIFQPSRRGTTTPLASGASVNTPFINL

SEQ ID NO: 958199 - protein, 33 aa, Homo sapiens
QTIPYRLVLPGKRLGPDAEMGVGDELGSLVLSV

SEQ ID NO: 958200 - protein, 57 aa, Homo sapiens
EDPSRLVPDGLWVYVDCCPACRAPAGECPDILPKCLSEHECWGRRDHSGHTVTDGQM

SEQ ID NO: 958201 - protein, 42 aa, Homo sapiens
EFFTPETHEALLSACRFKWTRISVSILGSMFQLVKSKEARRA

SEQ ID NO: 958202 - protein, 54 aa, Homo sapiens
VQTDLAATLSGISDKGTDSFYKGATADAIIKASQDKGGILAKQDFEQYKVRELE

SEQ ID NO: 958203 - protein, 72 aa, Homo sapiens
LYAIADLRHIPQAQGGSILVADQKRFVVLGLFQLVVGLDLPVALTVFQRALGPAHVGIGDGVTHIVQGHAVL

SEQ ID NO: 958204 - protein, 44 aa, Homo sapiens
IPPNIGLDLYFNIADDDLRRQATMCTGTRRSDTPGGCEMDFDSR

SEQ ID NO: 958205 - protein, 95 aa, Homo sapiens
TVRRDIVDEGGISNFTGSAGFDLTRTPFAVSRKCQNYLIRSQSKGSSAQKLPVTVTDVEGSKVTIKSTLRILALELYGTLSRTLIELGLGDKIGG

SEQ ID NO: 958206 - protein, 67 aa, Homo sapiens
CFFALYRTEIDCVLYSPREGGQRTLSPSCATTPLILFNFEISCQEAKALKCDFVPVTLREGKPVLDC

SEQ ID NO: 958207 - protein, 66 aa, Homo sapiens
HLRLEDPTNTAPSMVAPYILILHQSRQCPRPSIFAMPLCRPRKLNINNKNSNNDQQGPQFLHLLVV

SEQ ID NO: 958208 - protein, 83 aa, Homo sapiens
EDPTYHPPLSYISILEKRKGRKVETETPSFEDTQGGKSLRMWPSLVGWSGHRDPFVPPHHETGSLMPEAKKLWPRKKTCICNT

SEQ ID NO: 958209 - protein, 53 aa, Homo sapiens
RVAILEYPTNTLLFPTSAILEQEVEEGSVARRAQFEDPSGGNDAVTDVVASFS

SEQ ID NO: 958210 - protein, 43 aa, Homo sapiens
VGADRGPSRSKQKSPTRNKELNGMYLNAILVLSHTLPWCSFTI

SEQ ID NO: 958211 - protein, 96 aa, Homo sapiens
RMTVLEYPVIQNVLLVYQVDAGILVMLLCCSVTLNTLVFYCINGYVIFFTIKYLGVNEHKKMIANQKHINSESGMMVMPNNQIVHMGGWESGTFAF

SEQ ID NO: 958212 - protein, 83 aa, Homo sapiens
CVHTGVQTYQDMLLLSIAARQTQDGSIECVLTVRELFIVKTTSISGVSLPAPKRGRASAQGAAKRKRGQNPTLKQADTEKNGS

SEQ ID NO: 958213 - protein, 37 aa, Homo sapiens
MTGVDHLHQQIVALSLLGGVAFGGDQAIDQVDTQLLA

SEQ ID NO: 958214 - protein, 48 aa, Homo sapiens
MGLHSEPLFSGAFHYLGKLELHIDLIARLLTQQQAQIRTCATDLATSI

SEQ ID NO: 958215 - protein, 30 aa, Homo sapiens
MATGNGRKVCRCLPGQMRIPEPVLRILPPV

SEQ ID NO: 958216 - protein, 101 aa, Homo sapiens
MSEANIQLIVAGRSCCQSLLSTNHAAREQATTPAKAALEKTRALILKARASFITKEGMAQIDQLETPLKNYENLLLQVLTLHQLSSLLQDTSDVTELAYPT

SEQ ID NO: 958217 - protein, 45 aa, Homo sapiens
VGHKLDSKALTSYSSYLVPLLGAVASWRQQRLMHELSLLRECKIE

SEQ ID NO: 958218 - protein, 78 aa, Homo sapiens
AVVDKQNLYFVQNPPTPPVAVYLARPSGTFPMTGDFPRMSPGHKDSQEDVVGGDRSKGWNVLTPKRKPQKGLSHTSQE

SEQ ID NO: 958219 - protein, 52 aa, Homo sapiens
PWSRSADQRIRTVRGLDALFNSNSLSGENVDFCLVSDSAIIDACHRYLSLSD

SEQ ID NO: 958220 - protein, 41 aa, Homo sapiens
MGPMTFAFVPGFKVAVERQTFPIYGTEICPEAVTAKVFIIG

SEQ ID NO: 958221 - protein, 61 aa, Homo sapiens
RRIAHVDLGKGSDRSEPLRAPMELQIRFDLGGFRNRLFARTWQRRVRHFDVIVNGHDHSFE

SEQ ID NO: 958222 - protein, 65 aa, Homo sapiens
VVGKPAASQPSCLRPRYISLALIDATPYSPFCTSRYPVLTLDTLRLISCPLPYSDKMTPTYDARE

SEQ ID NO: 958223 - protein, 77 aa, Homo sapiens
VVGSLEYVALGVISTQPLPDRFYGVLIPSNKSNLKKGARRLLFTLHASETPGSGSPFLMILPNCGDVNVIDRFTVHP

SEQ ID NO: 958224 - protein, 126 aa, Homo sapiens
SSVLGWFMERAESEDPELQRMVRMILDVSSPSNSFECRWQASRLLLAAYLLAQLFALGALLSLDLPYSSLGMLVCMAHAAWVLPRHLLLTHRSSIRGLRRDEDGWQLYSDERGWHSVQLRPDSVAL

SEQ ID NO: 958225 - protein, 62 aa, Homo sapiens
CLSDKPHPETDGLHIASGARRQTERRHVRPENSDNLAGRLLYCKRPVTEKADTRLHEPVNHH

SEQ ID NO: 958226 - protein, 36 aa, Homo sapiens
LADYLVEIEEPVCSSMSPLEQIDRYVPNPTEVVHTV

SEQ ID NO: 958227 - protein, 37 aa, Homo sapiens
MAELKLGSTSTGRVVLVRADRPNAPGVEALDTAPELR

SEQ ID NO: 958228 - protein, 88 aa, Homo sapiens
GELRDLMDAAHLLGASTWHSRARWLFCPTCANGGMIAVLLSFSFLIGDFVFANLLARGRYETLEVYWFNMRNGSGPLHQRIGYLLYRW

SEQ ID NO: 958229 - protein, 73 aa, Homo sapiens
SNPGYPRIPARDVIKGSLEHPKIGGLGVLPTDVTVWNVLGALSSVVHAVIKMTELLSELLNNCTTLDLKPFPT

SEQ ID NO: 958230 - protein, 62 aa, Homo sapiens
DRRKLHELVPLVVIPSFTTVAHQLDVDRRIANRLHAADGLYIELIAAKGLGATRQFQGRAAR

SEQ ID NO: 958231 - protein, 40 aa, Homo sapiens
MGSIGDRVYHVDLLTEVPLRSSTTCGLAAPRYRLGLSTLL

SEQ ID NO: 958232 - protein, 103 aa, Homo sapiens
AAAFSQTSNEQHSTLYLHENHVFTLAHMHENMQWYVFLGLWLTFIYHQCTPLSIHLATNDRLSLLWSWLTNIPLPYIYHIFFIPFICCMDTLLLVKPDIALNL

SEQ ID NO: 958233 - protein, 76 aa, Homo sapiens
LSDERVNLKPNLSWSHDVSGYGPTAFSRRRQAISVGVDADYRNTYTASLSYTTFFGGDYNTLTDRDFIALSFGVNF

SEQ ID NO: 958234 - protein, 49 aa, Homo sapiens
ELTLEYVLVNDDTTSVPSDDGVRTVVYVTLRTLPWEGGRGTLPAPEDAV

SEQ ID NO: 958235 - protein, 95 aa, Homo sapiens
MGYDDAVAAESSRSRFKIMLICAGWNGWAQIYRRREPDSIRRRYRRYNARSQTVNLYREALRLTNMMVDVEVVPSLLVSLHGGNVPGRNPNQRKE

SEQ ID NO: 958236 - protein, 68 aa, Homo sapiens
LVVDSPHLLQPTSVPCSAPWSWMRCSAQRDGINEKLLRTVTKPPHRGGIKITRIEIKDISPPADLMAA

SEQ ID NO: 958237 - protein, 140 aa, Homo sapiens
DRKPPVTTFWNKAIDVDADCSGQLTPDTVLSFSSSFGRSQPIVELMGSYPVVMIHQVLANVSLSLLSGQEPVTGIHSVFKLRNTRSIGALSQQLPRRLMLWRMRERHNRVVWSEGMFIGTQHFQQHDRYLENLIDARSRP

SEQ ID NO: 958238 - protein, 62 aa, Homo sapiens
MAKALQCDPDADLVVRRSPQPPDIPLSYALTNRWLQPPRLLRYASSASKPGDAGRRARDYRS

SEQ ID NO: 958239 - protein, 102 aa, Homo sapiens
QTPFRSYRRRASSILNLSSVHTSVILSKPISLITECYFISYKTLWYLCFPFPDYRISGILRKNTQAETGHETPVLTESRVIIPAGLLIPWVLVSLSLTFSSE

SEQ ID NO: 958240 - protein, 104 aa, Homo sapiens
MPQPPNVAEYRLVAPRLVILYFSRDRFLHVGQAGLELQISGDPLASGSQSAGIIGMSHHAQPACIVFLSWTLGDGLCPLLLTVNVQWDRSCDHQNLRLPRSSNS

SEQ ID NO: 958241 - protein, 51 aa, Homo sapiens
LIVTLEYPQVSSGLRELYTGALRPVPSVSSNEGLSTDPNIHLDYGIPKLEL

SEQ ID NO: 958242 - protein, 74 aa, Homo sapiens
SESRMDSVLKKAKTGCCGRASPPAVMTQANNRMAKGYLYEVTADMSVKYKLGVNWSVTGGPEGAKDPTEVQRFF

SEQ ID NO: 958243 - protein, 133 aa, Homo sapiens
HSRGSITEARHVMDYKPTGLFITSHGSKEKGKAPRTTLVIVAIEVNRAPPLTHNRNASGEKATHSVLDMSSFELSGIQEGGDLEDEMEGWAADANLEMSAMAMSGLNQEGQNEMEEDLQLSLEEFYPQLCKEE

SEQ ID NO: 958244 - protein, 81 aa, Homo sapiens
LDVYLYTRLSQFMRVEQRWSPSFSTTGGLFLVMHSPVPRSLRHSFISSSKRWQFRETVVWTLVCPEPVLAAWRCTQSSSSQ

SEQ ID NO: 958245 - protein, 121 aa, Homo sapiens
DSGSKTNVLPVPTTSHLNWEMQSPSAGLSFYLGHPSEFPPFHPPPFPPVVKFCPQDFSQDKHASSTCFHPQFQLFICLMSEYSCLHAMRMQALLCNFIKSSCIYDSVHSPGLAGSRDTQRI

SEQ ID NO: 958246 - protein, 77 aa, Homo sapiens
LEDPKSTEIAHTASLMSDPQWIAVLQEETRIVTTQAAKWPTQSLPFLGSYGAGSGFGILLLSLSEMCLCFISGGSGL

SEQ ID NO: 958247 - protein, 119 aa, Homo sapiens
HCSCLQTTGGCEPPCCCWDLNSGPSEEQISVLIPWAISPAGAHTFIRDTLLKLKAYNTPYTIIVGNFNAPLSAMDRSWKQKLDSDTLKLTEIMNQMDLKIFIEHFILKQKNIPSSELIM

SEQ ID NO: 958248 - protein, 60 aa, Homo sapiens
EKRRCGSDCTKQFNNPTSFPRNTLHFVAPIFTGGNLSREEMLRCNSLTFTLHCGLDRQSR

SEQ ID NO: 958249 - protein, 64 aa, Homo sapiens
YVPFHILKFLKWLYLASHLVTYIEVCRSITRKSISIILVIVINLNGKGGYHVQENVSEANVGGY

SEQ ID NO: 958250 - protein, 68 aa, Homo sapiens
SVCKQSSRRTRMSGECHSQGKAGSGVWMAFSSGSSIRLFHTETLEHLQEINIATRTTFLLPGEAAHLV

SEQ ID NO: 958251 - protein, 56 aa, Homo sapiens
MSLIRRVYHPEGIGETTQTMVRRPDPDPSTSEGNGSATALFQANDQKHTRVAKEVE

SEQ ID NO: 958252 - protein, 40 aa, Homo sapiens
VNLGGLERVCRVGARREGVGDRHRFFLGIGCPREFWSSER

SEQ ID NO: 958253 - protein, 35 aa, Homo sapiens
TWYTVSLIQLTGIYKSVQVFVERLYHALNSVQRYP

SEQ ID NO: 958254 - protein, 124 aa, Homo sapiens
LTGTMLMGSETGCRPDGVSLGIGAIDQQTSRGYRYSIGYATCPNHEERVKVVKILDTTRIRGTNCQRSSSFILASPPTPSSYITRRATISMPRETHTATADRFFAAILWDFDGTLVDTESREVE

SEQ ID NO: 958255 - protein, 50 aa, Homo sapiens
RPPFLVSSGFEDAMDGLPSLRPVIELCIPSSWVPTQAPPGCHVVSLFTQY

SEQ ID NO: 958256 - protein, 46 aa, Homo sapiens
PFPSGCLPVAIGKAPGATELGRRVFVKPIEAWARFCFWCRTPAVLC

SEQ ID NO: 958257 - protein, 70 aa, Homo sapiens
MEYGTYGRNPRQWPRRCLPLAVLLVMSMSRLAGAKITYNDDAGETGRVTIVREMSVLGARVDVSIYRRTR

SEQ ID NO: 958258 - protein, 74 aa, Homo sapiens
MWPLTSSAISGEQLIHALLLLVSEVDDLRRWEGFADSGKQVVPAVPGAVQLDLDPAPTQVERVTCEADDVDAVH

SEQ ID NO: 958259 - protein, 38 aa, Homo sapiens
GHTTLCYKKGFCLGFGRAIPHACVGPLQQRGRGRWSSR

SEQ ID NO: 958260 - protein, 58 aa, Homo sapiens
MVEEVVMVVEECGMVVEEVVIVGEEEVMVEEEEVVMVVKELVIVGEKVVMVEEEEVVM

SEQ ID NO: 958261 - protein, 108 aa, Homo sapiens
DGVSLLLLRLECNGRISAHCNLHLLDSSDSPASASRVAGITGVHQYAWLIFVFVGGFHHLGQAGQKILTSVDPPALASQSAGIAGMSHHTRPTYRIFLPLLSSSPPRI

SEQ ID NO: 958262 - protein, 153 aa, Homo sapiens
LQRAVRAAQQIPVRPYPANAGDRFARHGDRKIGRIAIRRCRGPGIATPVDSPPFDQIARPYNRASNPHRTKYRWNCSCITRRLQFQFLQARPSTARATSNYSAIELLAKHGPNSTADGPANRRAQRGQNQCTHFNLPLHASDRECASRETQAH

SEQ ID NO: 958263 - protein, 50 aa, Homo sapiens
YRSDVARYFRSLRFRRLTDIVPPMDGDIVLVSPAPSQLHLIIRAMVRLCC

SEQ ID NO: 958264 - protein, 100 aa, Homo sapiens
LSELTLPDIIRSPRFRRLTDIVPPMDGDIVLVSPAPSHLHLDDRSNGRLCACPYRVTPRSAWPCISRLANSRSLGVVVRGWSGDTGFDRVGHRRIGEPVG

SEQ ID NO: 958265 - protein, 118 aa, Homo sapiens
MDGGIVQVFACSIAIAPDDRSDGRLLCMPMRGYAASCMALHFPTGKFSIAGVVVGGWSGDTGFDRVGTAIGGPVGGAVGAMLGQQLDRAIVGNGAPPRRAALAGTGTANVELWHLHSS

SEQ ID NO: 958266 - protein, 168 aa, Homo sapiens
YRADVARYFRSPRFRRLTDIVPPMDGDNCSWFRLLHRNCPLWSQRLAALCMPMQGYAAVVHGPAFPDWADSRSLGVEWEVEVATLVMTGLGTAIGGPVGGCVGAMLGQQLDRAIVGNGPRRDGPRLLELELQTSSYGTAIPAIFGTMRVACTIIWASDLIERRTVTGV

SEQ ID NO: 958267 - protein, 144 aa, Homo sapiens
DYRADVARYIRSPGIRRLTEIVPPIDGDIVLVSPAPSQLHLMIAGMGGFVHAHAGLRRVVPGPAFPDWPMLDRWRVVGGWSGDTGFDRVGHGDWLGPSGGCCWGHAWPAARSRYSLDWPPPRRPAPAGTGTANVELWHCISSDI

SEQ ID NO: 958268 - protein, 122 aa, Homo sapiens
MRVSKAGGSHLMVPAPHRRRADEVSYRCHPGTVWSTHWRCSRRSRSPHRFCHDHHDLCRLFGSHARQGDRNEPVELPNPAQKVLLAQAGKCCSVVISTCVGTVGHQCLRTRRCRHSARLLRC

SEQ ID NO: 958269 - protein, 127 aa, Homo sapiens
ASTFNAPSEAGRKYPSSPYPANARDRFARHGDRKIGRITIRRCRGPGFATPVDSPPFDQIARPYNRASNPHRTKYRWNCSAIPRRQQFQYLQARAVAQGPISNYSAIELLAKHCPNSTADVPANRRA

SEQ ID NO: 958270 - protein, 124 aa, Homo sapiens
LDLQCAVRAGKKIPVRPYPANARDRYARHGDRKIGRIAIRRCREPGFGTPVDSPPFDQIARPYNRAGKHHRTKYRWNCSAITRRLQFQFLQARARRDGGHFQLSAIELLAKHGPNSTADGPANR

SEQ ID NO: 958271 - protein, 65 aa, Homo sapiens
REAKLTLILFRMPGDASNRMTDTRLFAVRRRIDGERWLRKYRLAAFHFADQLPGIFGKIKAIIRG

SEQ ID NO: 958272 - protein, 96 aa, Homo sapiens
QPQFGLDFDSDLTTTPQPNAWQRRWSEFFAEQRIGWQLQLAAEKGMTFGDIDDIVDRVYLRLQHHQPQPSLLHGNLWPGNCAMTANGPILFDPASY

SEQ ID NO: 958273 - protein, 106 aa, Homo sapiens
SEFFLPAAFTEPVYQDGGIAIKFNSHRASYTGDQGFIITLMNLPKNSGIGVFRDNLVGRGPVSKSADWSGWRLNHRESKLSSCARVGPRQGPRNQMSQFINLGSAS

SEQ ID NO: 958274 - protein, 123 aa, Homo sapiens
MPSYLDELARQECPEVPMDEDFKLGTLKRLGLPHSTQADVGKAWQAMLARVRDWHDLDPRFNTEMEKLIDFVTRDHVDELDNGEMDMSIDVDTVSDLIRDVSARVIDPRFRTLHDHQIHQKKP

SEQ ID NO: 958275 - protein, 73 aa, Homo sapiens
LIFSLKNSTVEAKAKSISTCASALTTAACCKVIAVNQPKDAVAPTKPTASDGFHAFAMRRSSSLCRQTIHKNI

SEQ ID NO: 958276 - protein, 35 aa, Homo sapiens
MGKAWAYLKNLRIEQGSMEHDEAVADLQNWWAGDA

SEQ ID NO: 958277 - protein, 100 aa, Homo sapiens
LAYPIPHSEQAPYEEVKCNFNVAEALRELRFNVKVDPRQGSVLGVKRSSRNFEHGFRMHRKELSPDPGQQGAHTVSVGKCSRVLLTSGGKGIEFLQPGES

SEQ ID NO: 958278 - protein, 42 aa, Homo sapiens
IPANKELRCGLNTAHLIILKKTYHDSLLCSDLADLQNTAPET

SEQ ID NO: 958279 - protein, 57 aa, Homo sapiens
RRVPSTLDLLGGCAEALATQADFTPFPGQQAPQQHPVRAREDASCLFQLLLAPIASL

SEQ ID NO: 958280 - protein, 38 aa, Homo sapiens
AVVPLTFSIGHFGVSSFSFHLNRIWLQAGVASGGVKNQ

SEQ ID NO: 958281 - protein, 42 aa, Homo sapiens
ARWYPPREASCSPVWPRSHDWKLLRPPQKQKPPWFLYSLEQD

SEQ ID NO: 958282 - protein, 67 aa, Homo sapiens
FLYQSNAYILLSNMNSSLWHRKDIQHPMLSSQRDPAMSQLCPCCSEIKPGDVLMPWEKGIHKNGSHS

SEQ ID NO: 958283 - protein, 51 aa, Homo sapiens
GFSLGKEETLERDSFKSRSQKCLLGSLYITRRVQDLRVTIEISLHHFQRYL

SEQ ID NO: 958284 - protein, 35 aa, Homo sapiens
GDATLTGKLSAVGSRCILSRAGNKLYSSGTGFWLV

SEQ ID NO: 958285 - protein, 43 aa, Homo sapiens
GVPVGDRRLNTEDSPGSGAELGFRLAVVEEVSSGEVQVVESWG

SEQ ID NO: 958286 - protein, 43 aa, Homo sapiens
MIRNEVEVKHQFATLVAFIDATFVSDVQCVILECEFLGPPAIF

SEQ ID NO: 958287 - protein, 78 aa, Homo sapiens
GTVLWPQRMLTAVSPARAIPAGEDVILHQASEIPQVSLNISQQVHAVNMEKYKFLGISIGGQSNERGDGGIYSWLHHE

SEQ ID NO: 958288 - protein, 61 aa, Homo sapiens
MSPSESFRTGTENVSSVGIQMWSAEEAGDSVTTGANAPMTVAGLLAWANELLWPCRRRYLV

SEQ ID NO: 958289 - protein, 62 aa, Homo sapiens
SRVIPSKSGYRSCPVSRSSSSSSSPRRTRRRSAEPAMVVVDAADMGYEGGGQMSPYIEALRT

SEQ ID NO: 958290 - protein, 109 aa, Homo sapiens
RREGARQNGGTSWEILFATGVQVVASVADETASATHRSRVRHRGGTRGHRPCAKYAASTHNTKAAPQATPCRDSCQRLFLAELLEGPRRWKMSVCRRFSLRLDGDFRNA

SEQ ID NO: 958291 - protein, 69 aa, Homo sapiens
TGREAVIRVDIEREQMRAKLEPEENRLKTLKEDLESITKIVKDLEASHQHSSPNEQLEETSNGVQRHRN

SEQ ID NO: 958292 - protein, 33 aa, Homo sapiens
SFSSYPTVWTDFPMLISSSFPRTPQSVPDASNN

SEQ ID NO: 958293 - protein, 52 aa, Homo sapiens
LGDDLHPGYRFTGRRFTPGKRFSPGFRFHWRWFNTGKTLSPGFPFPGASGFP

SEQ ID NO: 958294 - protein, 47 aa, Homo sapiens
LGNRLHPESGFTGRPFSTGKRFQLENDFPGRTLLGGKAFNLYKGATF

SEQ ID NO: 958295 - protein, 42 aa, Homo sapiens
MSSADICCRMSCPVVLEGVDGLRQPRVTLRDDNSDCVPELEL

SEQ ID NO: 958296 - protein, 46 aa, Homo sapiens
RETAFTLNTDSLAGGLQGETPFTPYTDFGAGLLKGETPFTPLTAFA

SEQ ID NO: 958297 - protein, 233 aa, Homo sapiens
MPLKTAKTGMPSLTTPIQHSVGNSGQAIRQEKEIKGIQLRKKEVKLSLFADDMIVYLENPIVSAQNLLKLISNFSKVSRYKINVQKSQAFLYTNNRQTESQIMSELPFTIASKRIKYLRIQLTRDVKDLFKENYKPLLKEIKEDTNKWKNIPCSWVGRINIVKMAILPKVIYRFNAIPIKLTKDFLHRIGKNYLKVHMEPKKSLHRQVNPKPKEQAGGSHYLIQLYTGSVPNS

SEQ ID NO: 958298 - protein, 43 aa, Homo sapiens
GGNRFYREYGFPGRRFTGRNPFYRGSGFPGRPLSTGSPPFRGA

SEQ ID NO: 958299 - protein, 32 aa, Homo sapiens
MLDRVQMFYDFGFLYDFEFHISWGGLTIMVED

SEQ ID NO: 958300 - protein, 137 aa, Homo sapiens
VIWLGCVTYAIDRIGQLMRPGIYPPLQRRPFGAMRQQKIHKRPHPMGHIAAVGIQQGKRPGAPAVRLQHLHQAAVGQLLLYDELVGLEEPRAVLGQGYATQHVVRAAVACFPSKLPLLAVFLALSPHVTVDVRISRG

SEQ ID NO: 958301 - protein, 45 aa, Homo sapiens
RDVSAIIAELDKQFPGVPELGEDIEQFMEVARAQHWINLPDLPPK

SEQ ID NO: 958302 - protein, 33 aa, Homo sapiens
PRARECAVCCLDFEAILVQPGSPPDKTQVPMVV

SEQ ID NO: 958303 - protein, 33 aa, Homo sapiens
RQLRADLSVSPMHLLRTQPGGFVSDDNIADLGQ

SEQ ID NO: 958304 - protein, 65 aa, Homo sapiens
MVDGTGWGVIGAQPVNYSGLSYSSWVQQQKGPKAVSVVLQLETPVQAAREDHAKDLHTGKCRSHR

SEQ ID NO: 958305 - protein, 101 aa, Homo sapiens
TLQVFVSGLPKLLERQSTMLTEVDTRPDGLYETGRGSVCTLAESGLPVLPRRPSTAFEGSYVLEAGTTQGSCAATKKVPPGGRPPGENDRVGPLEGKLRET

SEQ ID NO: 958306 - protein, 34 aa, Homo sapiens
AASVDMHHVCHDVLLEAHGLHIVASSTQSTGQSL

SEQ ID NO: 958307 - protein, 44 aa, Homo sapiens
TVFLIEGDCQMDNRQNCRYSRDEEGNALVIAGVQVRYSEATIGD

SEQ ID NO: 958308 - protein, 87 aa, Homo sapiens
VIAGRELTELPGVMSSRVMLAWTSATSTHPVAVAVVGLPSETGRAAGSDVDLEMACILDSAETTNLFQFNEMKKYIAYPESDNLDMS

SEQ ID NO: 958309 - protein, 42 aa, Homo sapiens
RLGIEQTYSLRLQMLLLTQCNSTCLNVKRPAAVRPAAGFDDF

SEQ ID NO: 958310 - protein, 52 aa, Homo sapiens
VYMSAGMESTIKIPEQFGEESLEQLMELLQKLKGIKPNIQKNWLKPVPFFHV

SEQ ID NO: 958311 - protein, 39 aa, Homo sapiens
MLAPANGAVRRIRQLIGIQISTVPVPLPTSKSALSRSKS

SEQ ID NO: 958312 - protein, 43 aa, Homo sapiens
MSSTVTLYIDAGFVQPCAKITLEPLERGFGHTLGNALRLILLS

SEQ ID NO: 958313 - protein, 31 aa, Homo sapiens
MRISNRPRNTVSGCWCERGYDELCPVDAHWV

SEQ ID NO: 958314 - protein, 49 aa, Homo sapiens
TSRRWESVLVYQRKAHVIVAILTKTNPRRYTHLRLKQQLLGKFQRPHRG

SEQ ID NO: 958315 - protein, 38 aa, Homo sapiens
ITVAAARADNAVVAGQGLVADQVQLADYHHQLDLIRNQ

SEQ ID NO: 958316 - protein, 92 aa, Homo sapiens
TFRYNARAMATVRQFPARRVILARDGVDADAIDTAIGQLMQTWDLSCRYSAAHSARCASRKSTNARTRWGTERPWGYSKVTGLRECHARRIA

SEQ ID NO: 958317 - protein, 76 aa, Homo sapiens
IRVRDLENGITNAVKLHADSARDDEVQKLSGIGSKQWIHGSAGDTRAIVGYCHLPVMCAERSSPYDYIRQATSRTA

SEQ ID NO: 958318 - protein, 88 aa, Homo sapiens
GTASTPGDTFLDKSSKSYRAVEFFTGKVTPRFGGQIEAVYQKDIRPGSQDQTWMSLGVRPAYAISEQFKLVTELGHDQVEATGGTRKL

SEQ ID NO: 958319 - protein, 173 aa, Homo sapiens
DQFDLEVDFDISNVDQAKIQELHERLEHVMLRRLKRDVAKELPTKTEQILRVEMSAMQQRMYKAILTRNYSRAKWHPFDAVLAAQHCYRVEKGVEPSVPLRWCRNAQGVAEETLHGLIMHGGKMVLLDKLLARLRADGHRVLIFSQMVHMLTIISDYLSLRGYVHQRLDGTVS

SEQ ID NO: 958320 - protein, 46 aa, Homo sapiens
GVHVAGHLLLHLLTPVITCGRQPGCGAGTFAAFSVTSVDAQRKLDP

SEQ ID NO: 958321 - protein, 42 aa, Homo sapiens
ARTVNFERYSADFVGKGTGSVEIWIRSTPTSPDRTIGRSEHV

SEQ ID NO: 958322 - protein, 38 aa, Homo sapiens
VVQQSVLERDHTTALTPGHTKTVKTKKKEKGYVPHKSK

SEQ ID NO: 958323 - protein, 37 aa, Homo sapiens
PVQESSGLTKEQFAQDDTWELPRLYFSEGLLRGAYNG

SEQ ID NO: 958324 - protein, 43 aa, Homo sapiens
IALATRRDLSFLLLIDILDGHEKEKAQVTTEEKNFRAFASCCM

SEQ ID NO: 958325 - protein, 33 aa, Homo sapiens
MPEPGRQGQSEEEASIYLNAISSPTLSLPQRYL

SEQ ID NO: 958326 - protein, 49 aa, Homo sapiens
MFPRFMGQRIKLDRAFGKFGAVERNAPAQNYRPGLRLVLSICLKMALAS

SEQ ID NO: 958327 - protein, 40 aa, Homo sapiens
RLLYEDSRCCVWGTGRVSGSNTQSSEVVGLTGLDMGAIWK

SEQ ID NO: 958328 - protein, 145 aa, Homo sapiens
LQVSDRRVHNTSLILLLAKSGWQRFYQPGVPRECHEHGKTGCTQSLGRGICGRYKSSKGSRVETQKSNLKYCTHDDNGCSTIDELPPDSLITLVQAELPTLSRLWLAGIPKIMHSGIYQPNILVQLPPDGGAIYNPETIDTDRLH

SEQ ID NO: 958329 - protein, 53 aa, Homo sapiens
MSVAWLTDADRLRGRRGTKMRSCCGHLCCCVVRGCEQVEAIEYYTKLEQGYRA

SEQ ID NO: 958330 - protein, 112 aa, Homo sapiens
SELILEDPSQVQQSMLKEIKEDTNKWKNIPCSWIGRINIMKMAILPKVIYRFNAIPIKLPMTFFTELEKTTLTFIWTQKRACIVKSILSQKNKAGGIMLPDFKLYYKATVTK

SEQ ID NO: 958331 - protein, 67 aa, Homo sapiens
TCRGWMNGVISAHCSLKLLGSSDTPASASQVPRKLGPQVACHHTQLTFIFCRDGVSPVDQAGLKFLD

SEQ ID NO: 958332 - protein, 59 aa, Homo sapiens
SKDVSEMSRDGWVPGFPRVYRHNLWLLPSHSDPRCHPRIHSLFPRRWARERVSSQVPPS

SEQ ID NO: 958333 - protein, 55 aa, Homo sapiens
RTPEHVEANISQLLKRFLVIRQSLGNCPTVADETRLLREEDVWRLFEECILIEHQ

SEQ ID NO: 958334 - protein, 116 aa, Homo sapiens
MSMAIPVYVVLSLVDWTLSIISSVWAIMNETIMSIHTWQARSHYHRPPKQLFQYRLSGSIKYEEEKKKRISVPLYKGRAMSSKAHQELLPRISPGRKSMHGNNEGFMKRKRMLVIK

SEQ ID NO: 958335 - protein, 36 aa, Homo sapiens
MVGADHMERGRGRCHVARVRSKDGRSGAATCQRPGS

SEQ ID NO: 958336 - protein, 121 aa, Homo sapiens
CNPERVGVWIGVVQCVDRPWCGVWIDRGCSVWIGRGYSVWIDRGYSAWIGRGYSVWIGRGYSVWIDRGYSVWIGRGYSVWIGRGNKLCGIGRDNSVWIARGNSVWIGRVYSTCRMGRGYSV

SEQ ID NO: 958337 - protein, 53 aa, Homo sapiens
MSSLQKTVGDSLNKVKQELAYDPAIPAPRYVTQKELKAGIQSKYLYSEYCVSK

SEQ ID NO: 958338 - protein, 44 aa, Homo sapiens
LYEDFSTARYHTHTKNHQTHSYTDIQTHTPDMHTHTYTQYVGVC

SEQ ID NO: 958339 - protein, 71 aa, Homo sapiens
DNSVKKQSNDLVKKKGAKDLNRYFSKGDLQMANRYKKRCSISPIIRENQIKTTMRYHLTTVYMTMYVKDRQ

SEQ ID NO: 958340 - protein, 119 aa, Homo sapiens
DRVSLCRPGWSATARSPLTAASSSWAQVILPPQHPQVAGIMGACHHAGLIFVFLVELGFHPVGQAGLELLTSADAPASASQSAGTIGVSHCARPELAFFLSSFAVFSSISFFFPFCRLL

SEQ ID NO: 958341 - protein, 38 aa, Homo sapiens
LHLVLVKERKSQGVGSGQDEADVDPQSPPRPEVKITSP

SEQ ID NO: 958342 - protein, 125 aa, Homo sapiens
MKPETPSLSLPDDNVGSRAVKRSKPGYQLRRSRIAWLLVAPSLLLLAAVAGWPLFRTLFYSFTDAMLDSPDDYRFVGFTNYIDLADGAHYYGVLADPLWWKAVGNTLRFSVMSVSLELVFGMLLA

SEQ ID NO: 958343 - protein, 83 aa, Homo sapiens
DGEDHFQDTELVGTISAGDRTFQKWAAVVVPSGEEQRYTCHVQHEGLPKPLTLRWEPSSQSTVPIEGIVAGLAVLAVAVIGAV

SEQ ID NO: 958344 - protein, 49 aa, Homo sapiens
PVNQRFNAYALAWEESLADGRSLEDYPAVISRLQGLWETLARALEVLQA

SEQ ID NO: 958345 - protein, 47 aa, Homo sapiens
RTNLPELVETRQQEKNFQKWAAVVVPSGEEQRYTCHVQHEGLPNALT

SEQ ID NO: 958346 - protein, 45 aa, Homo sapiens
HVIVMVVEFSQGVLWRERPTEPAKALRLVIGHTAQDNQMAAKADI

SEQ ID NO: 958347 - protein, 77 aa, Homo sapiens
MAITLSLSPAGTLNGGTTISHWGEDGHDGQVPKSSGEYTVDGPGALTPLSLWLYIPEAEASGIPALIPKDIPFQTIR

SEQ ID NO: 958348 - protein, 46 aa, Homo sapiens
MVTGEMTVNEAAGLGGEWLKTVVDAGRWSRGLFGGLGVLTGISTIF

SEQ ID NO: 958349 - protein, 74 aa, Homo sapiens
PINARHTHTVIRIAHIEPRPSRTQPPSTGLNLERHRRIGNHLNLPLHQLNPPLTPTDPRPGIELQPNPLTQLHP

SEQ ID NO: 958350 - protein, 36 aa, Homo sapiens
MSPEGALTLVGTSDLPAVRSQSTEIRVGATICAGHR

SEQ ID NO: 958351 - protein, 87 aa, Homo sapiens
ELFLMYHCNLGQGLIYTVNTVGLKKSSCLSLLSTLGPQGNANTPGYILNFLYEAGSPYVSQAGLELLGSSYPPTLSSTKCWLSISRH

SEQ ID NO: 958352 - protein, 100 aa, Homo sapiens
RTCRVGTNALEYSYNSSSLEADMGGLFEAQEFETSLGNRVRLQLKKKKMGAMECISHGSFTLSPSDGRKGGLQALASTDGTRGNHLELRSVGMCMSVSIR

SEQ ID NO: 958353 - protein, 112 aa, Homo sapiens
LILEYPRKWSIQTKQLENQDKEDFETLIFWTAVSRVDPEMRILYTLPQPKDIPDEVLQLIHERDNICKQIHLTAQSGSSRVSEAMLERSQACLEQGASLSFPCFLNDQTVSL

SEQ ID NO: 958354 - protein, 40 aa, Homo sapiens
MSRSTYNPRQLWKCEAGGSRGQEFETRLTNIGEHLSLLKI

SEQ ID NO: 958355 - protein, 66 aa, Homo sapiens
NGPNRTLLKAGHGDQTLPGDDGGQGTCSDITVIRYHITRGMMEDEELNQIIKGDQYQWCRILDKLT

SEQ ID NO: 958356 - protein, 51 aa, Homo sapiens
HRILHLRKDTSIGNHMICSWDDLPLVFFGSSEKAIYHEVKNLSIPQRSSYY

SEQ ID NO: 958357 - protein, 43 aa, Homo sapiens
SGLLPCSRGDGWGHFHRVKWQRLCKGSLATRGWGMRSLEPLCL

SEQ ID NO: 958358 - protein, 45 aa, Homo sapiens
LPGCWSSLDGSTIGTKRMRGPRSCNSLLGHSCPCARCQHNNPEPE

SEQ ID NO: 958359 - protein, 36 aa, Homo sapiens
RDHRSRVEVSGHSRASALEADGTWSALRSRMQKPLP

SEQ ID NO: 958360 - protein, 49 aa, Homo sapiens
LFCGFIMLLICFILIFFSTLWTQMLVFLRVIGGSPALAAVFQIISLVTY

SEQ ID NO: 958361 - protein, 35 aa, Homo sapiens
MMATAFLFVCLFEMESHSVTRLECNGAISAHRNRR

SEQ ID NO: 958362 - protein, 126 aa, Homo sapiens
MVILFFFFSFLFFFLEMESRSVIQAGIAVTPQLTAASVPRVLKQFSCLSHPSSWDYRHAAPCLASLVFLVKTEFVHLGHAGLKLPSSDDPPTVAPDIVGITGLTHRAWANKGVSMLGRPCAFIWVS

SEQ ID NO: 958363 - protein, 37 aa, Homo sapiens
WGRDGVWLCGPDGSQTLGLKKSFHLGLPKHGDYRYEP

SEQ ID NO: 958364 - protein, 163 aa, Homo sapiens
LTWKVLSSHLQYQAFCSGFRGTVDMIISSPGVSRYLSTDSGVLAAVVGSLTGSRARGTWVVLSKLWDVALTHTDMQYFFCVKVVPVAATSAVKEWGHFPSVTSKYQREIIARHGPVSACSEHTSQNHLFHRLCGGGGGGGNAGGSLCGFFVGFLSLFLYLITI

SEQ ID NO: 958365 - protein, 38 aa, Homo sapiens
VSRQHCASNAGMALDIHVVTESKQPLLEIVTANSLVWE

SEQ ID NO: 958366 - protein, 81 aa, Homo sapiens
MGHSEYIIQLKEVDPCLAVLDLRYFQIWVQLLEFGVTGHLLALINIHFLKSFLSSHVDSSWGFPLEPDSWDITGQGFRILQ

SEQ ID NO: 958367 - protein, 60 aa, Homo sapiens
MQNFTTSAVGYVVLQSKHISFCEYLQGPINTHPQCPGQENMTARSDPQALSLNFGLEQVP

SEQ ID NO: 958368 - protein, 47 aa, Homo sapiens
LIRETSEQQPTCLYMNLQPVLRHILEAVKANEEKKQYLGILHSVTTV

SEQ ID NO: 958369 - protein, 91 aa, Homo sapiens
MTEISTFSGERSVKGESNRFSELPFSALGDCVWCYDIQAAAAGTQCGLVKADDCLEQLRTLSPELLDPKWQEIMEEGTARSYQVMCSVFPQ

SEQ ID NO: 958370 - protein, 37 aa, Homo sapiens
NTAKASMNGYAGIFHFHAVATLGMWVDVGRRMTLLPT

SEQ ID NO: 958371 - protein, 94 aa, Homo sapiens
AHPAIAESQVCVCVSGEHAPNMSRDGVPSYPRGHAKPKEKALASINMNNVYSYYISTCVYMLASCFLARKYGAHHTPPAKTIHEGSFVPPAQFF

SEQ ID NO: 958372 - protein, 113 aa, Homo sapiens
HICNSLILLCGEVLSYSRAFLPPTDKSLSTSIHFEHFFFFFGLETESGLCGPGGGAETQSCVIATLTSGADRILPSTASRVAGPTGYVPPMLAHMCIKSRVSTYVAWGSSNPL

SEQ ID NO: 958373 - protein, 135 aa, Homo sapiens
MRTPHILHWTGCPFDKIQQPFMLKTLNKLGIDGTYFKIIRAIYDKPTANIILNGQKLKAFPLKTGTRQGCPLSLLLFNIVLEVLARAIRQEKEIKGIQLGKEEVKLSLFADDMIVYLENPIVSAQNLLKLISNFS

SEQ ID NO: 958374 - protein, 37 aa, Homo sapiens
MASNRAITLTAWPKVPFLGIREAKNPRSENKKLAAIL

SEQ ID NO: 958375 - protein, 48 aa, Homo sapiens
VIMPGPSSVGQTEMLGEEMMDLFDMLPILEEGDLRFWPCDVNMHTAHV

SEQ ID NO: 958376 - protein, 85 aa, Homo sapiens
EDQLEPDTALRTLLFKVHMAERASPRLHSVFASAATFNLPVTQCPYTQQMLALSPQMSLLGWATGTFAHGMRCSSADFLSSIAWR

SEQ ID NO: 958377 - protein, 88 aa, Homo sapiens [sequence omitted]

SEQ ID NO: 958378 - protein, 81 aa, Homo sapiens
AWLIGLVWGDDAGRLCLQHPAARRAQHVCYAHSFPLSHIRLWALQLLFVSTPALLVAMRVASRRPEKKRQFIQGEVQSEFK

SEQ ID NO: 958379 - protein, 51 aa, Homo sapiens
MIAGLAIRQGRTEESSMVSAYCEINHIMAKGHDGRSYSEVWCGFNPSMVQT

SEQ ID NO: 958380 - protein, 35 aa, Homo sapiens
TETRRENPNKLNEEMKQEILPLTPVEIPKILPGYY

SEQ ID NO: 958381 - protein, 67 aa, Homo sapiens
RGYVDESSTVQREETVKSPNQNLKGARRLDKSLLESGRDHRLLEATRSHLRNICLEMSSTDALSHHS

SEQ ID NO: 958382 - protein, 50 aa, Homo sapiens
VTRSLEIVSVSSIDVNMCCIHTHTHTHKYTLEINRCGIGPGLQGLDSGHP

SEQ ID NO: 958383 - protein, 43 aa, Homo sapiens
MEPTSIHEHWELGALMILRSHSATQYMIYILIETQLFTMKRET

SEQ ID NO: 958384 - protein, 65 aa, Homo sapiens
GIAGGVVARRTSDNSPGSAGHLVDLTGPRTLNVSGPGELVDITGHSDTGLSRPGELVETVHLMPL

SEQ ID NO: 958385 - protein, 41 aa, Homo sapiens
LEDPTRTAVARGGAPNENFMASVNLFVQYLPLINQSFLDVL

SEQ ID NO: 958386 - protein, 130 aa, Homo sapiens
PVRLAALVKEPDNSVFEMALNHTLELGFQFCSFTMSSQLPDNHTKPVYINDYPSEWNTVYKQGRFFEIDPVVAHCKRSVLPIVWEKKAFGAAPNLWELAQAHGVHLGWTQSVHDFQGVFSMLTRSLNAAS

SEQ ID NO: 958387 - protein, 84 aa, Homo sapiens
PHADMIKMPNARRSYRLPQAVELDKVNALHAAGKTRFGSEVQNVRGTLCRKCLRNATCLLVTQGEYGLLSCADLSVIEELVPRT

SEQ ID NO: 958388 - protein, 49 aa, Homo sapiens
LYDVSLMLQPSCNEVDQLTEKRQVWKFQGPVHCWVTPVVPDTYGKADVG

SEQ ID NO: 958389 - protein, 68 aa, Homo sapiens
VRYTESLKSSRAPTNDEALMRIKTEEVIAQIRNMDQTEPAKARTVWTVLTAGVSKIKDQENNREEKGS

SEQ ID NO: 958390 - protein, 38 aa, Homo sapiens
MLILEKMWGNRGSSSAGKNEKKIKPLRAGTVAHAYNPS

SEQ ID NO: 958391 - protein, 41 aa, Homo sapiens
MNGDVAYKYSLSLLESLADVQARASRSGLIISIEFNIDGVT

SEQ ID NO: 958392 - protein, 117 aa, Homo sapiens
RHYCLLIIGHPMGVKWYLIVVLIGVSLMANGVEHVFVCIWPCLCAFGHLSVTENYLYISFAQLLIGSYVFLWLSCKSSLYILNISCLTDTGVASIFSHLVAYLFIFLRSVSVTQAGV

SEQ ID NO: 958393 - protein, 36 aa, Homo sapiens
LAALHMRLTGCPRIIYPPAICACQRVIPAAPVPVAV

SEQ ID NO: 958394 - protein, 80 aa, Homo sapiens
ERVDEKKAVIDTSYEPCDQLAETRTVIVVRYFLLLLKTWPGAVAHDCNPSILGGRGGRITGGQELKTSLTHVVKPHLYLK

SEQ ID NO: 958395 - protein, 71 aa, Homo sapiens
MWRFVVLDALAKRLRKVWFASEVIVKSSEKMCMCCSFVLNQSLHMQQYQVQTGSLPVYSSVLTKSPLRLQG

SEQ ID NO: 958396 - protein, 79 aa, Homo sapiens
MPKLTRRSRVLIGVALAVVVLLLVGGRLVDAYVDWLWFGELGYRSVFTTVLVTRLVVFLIAGALIGAIVFAGMALAYST

SEQ ID NO: 958397 - protein, 87 aa, Homo sapiens
VVYEDPGVPLSGYEYNEYTHAYVSIENDLYACGVVYPGNRTAGSNDISGSRSLRNATLVYPQVVELTYVPSNSVKAFRMSPQACQLL

SEQ ID NO: 958398 - protein, 35 aa, Homo sapiens
SQNLKSREASSAAFSLWSTVQESKAEELELLFRAK

SEQ ID NO: 958399 - protein, 87 aa, Homo sapiens
HLGSESVVSSYLVSRVHVELMCHQRIVQSWVVQSYIPRSQRINKSGDIHKGEEEGEESNFRSGKGSPKIQHLIQELKGTNHTTVPDR

SEQ ID NO: 958400 - protein, 104 aa, Homo sapiens
MKTARLSVPGNATLPPSGSLHSSFECERPVPVGGTWAVGDGQGNKGVGLGKLLGTFALGIQLNKEKLVQGSAQKDLLIPVLSPTQGTMPLEVVVELQIRAVRDR

SEQ ID NO: 958401 - protein, 34 aa, Homo sapiens
LGGQRQRAGEVSKETWGVAPSTLEGLEVRGTPAQ

SEQ ID NO: 958402 - protein, 62 aa, Homo sapiens
RLVQVYKSQCMGSSVQSSLCGQRSKVPKLKNLESLFEGSKAPQHRIKDVGWNTKTSLDFSMI

SEQ ID NO: 958403 - protein, 212 aa, Homo sapiens
TVKAAVHAAVMTDSCASTNASCSRGIAATLAPSDDDAWEIDGAAVNGFGADKNIYIMHLHFVDQLINEQRVTKRLCCFRPMPYGIGRFQEKSSPGSTAELCASVDANASMSAKITFMIIPNEVDLSRIVDHHFMHCVVYADRSLDCVTGRASPSRSGPSGLVNLAHYSFAEHVTFKVRAQQTSQADLSGHFPIIGLGPIHTAEHMTDIQATK

SEQ ID NO: 958404 - protein, 120 aa, Homo sapiens
RGFKVLYADQVGAVIYTLAPDDTDRYLTIWLQGSDCNFDRFPLIMGGRLPIAKELLCQIIGHPIPTKPHRQSHLFIQIIRKTWQPIRHTQGKNGHLLEKTLIGSLGGAARCKTPWVYPLS

SEQ ID NO: 958405 - protein, 33 aa, Homo sapiens
SVTRHRRIHTGKKPYECSDCWKAFNDPSALRSH

SEQ ID NO: 958406 - protein, 57 aa, Homo sapiens
AHDRRVPEILVCQSLYSFIRTPFSSSIVRDGLDLDGLGVCAPTKCGLHRRSVLIFGF

SEQ ID NO: 958407 - protein, 64 aa, Homo sapiens
LSHVVLILHPRHRALPQALDIELMKRLSKVVNIVPVIDKGETHFNPGRQRVHLQTGGSPQNLVV

SEQ ID NO: 958408 - protein, 36 aa, Homo sapiens
MIRYLLTHLHARDTYNNKQGTSKCDTAKPLFLKPYS

SEQ ID NO: 958409 - protein, 47 aa, Homo sapiens
MSSNRKMSTWMAEMVTPLLSDGSMYTHFFHIFNYCIKLRSDWTRHRA

SEQ ID NO: 958410 - protein, 49 aa, Homo sapiens
MSAAGATEAAPSCCWGLWLTPPEYAWVKAGACITEEKALVDFGYVGIDS

SEQ ID NO: 958411 - protein, 38 aa, Homo sapiens
MLEDFAFLVSEINGRGVYELQLSEERDLLKGTGTGASI

SEQ ID NO: 958412 - protein, 32 aa, Homo sapiens
MSKEREPTGVYEYGQYCASVHGYWLDCLTTGD

SEQ ID NO: 958413 - protein, 66 aa, Homo sapiens
LGNNARIMTAAFVVVVIGGLGSFWGVVLAALLVGVVRGITVQFYAPAGEASMYLLMLLVLIFRPRV

SEQ ID NO: 958414 - protein, 38 aa, Homo sapiens
RSLEAAVQGKKYQHRRKTKGGRLSKLAHPTFFHLLYTS

SEQ ID NO: 958415 - protein, 33 aa, Homo sapiens
LSDESVWSLRRTPSECWYHKTVSGLRTEDEAAY

SEQ ID NO: 958416 - protein, 32 aa, Homo sapiens
MARLPRCDLYNAEVSLKAAHIRVNLFTDFDKY

SEQ ID NO: 958417 - protein, 59 aa, Homo sapiens
MIDRDLDNKLMETFRRLGEHGADNDPSGIALSSVHVTSPDYGIASDSCQRLRDASQMHR

SEQ ID NO: 958418 - protein, 34 aa, Homo sapiens
PYTLSVVQRILAFPCNQFGKQEPGVTEEIKEFAA

SEQ ID NO: 958419 - protein, 63 aa, Homo sapiens
MISTALVVDKGSGMCQARLRGRRCPPGLSSPSIVGAPHGTSGVIGGQWVRKDSSSGATEAHEQ

SEQ ID NO: 958420 - protein, 59 aa, Homo sapiens
HHRTYDRLMLSLSDTKHNYAARWETPFLPVSVLEMGVSNQQQQCGKREFSQSSVVSQRH

SEQ ID NO: 958421 - protein, 150 aa, Homo sapiens
WPRVVYVVCRELQNPVSADTCKSSTWAPFNGTSTASFSRDRRTSSSCFLLNVSSSLFLVKLQQSEVYPSKILYPEKTHIFMEGASEMKAKTRLEMSRNGRIPQNPVPVMEGWHRARLGEDEGLAHPCAAHGLQNLELPGSALELHYSSSA

SEQ ID NO: 958422 - protein, 32 aa, Homo sapiens
MRLSVVVFVLIATLLRHGVLRNRLHLNRGCAV

SEQ ID NO: 958423 - protein, 38 aa, Homo sapiens
MSSLELILHIAAIMPLNNVNQQNIYSALVVAGILQAEK

SEQ ID NO: 958424 - protein, 139 aa, Homo sapiens
QYDVQKKKMSTEPLMAMRKLPTPGDRGLESRTKALTCLLGQSPQPDGSSRQLSMEGTVAVPGPCGADTGGQGKGRMGSSQEVPGCRGGRMTNGRVHVLVVHSAYGRIHKGGRPICHDSITPSWMWPKDNVTAAGRAIVR

SEQ ID NO: 958425 - protein, 38 aa, Homo sapiens
MRDDRLLLKISEKEEVTTREGEWHQRRVYEIGGWPTAR

SEQ ID NO: 958426 - protein, 83 aa, Homo sapiens
LEDPGVPFVFLQLLSHSLPLPLFFHESRGPGKTLYWAPFLTVILDFSAVLRRQTSPVFIPLRIRIVFEKSKGVGYSGYVCNPS

SEQ ID NO: 958427 - protein, 42 aa, Homo sapiens
ADADVSHPPRRKSPENPWLMNGHWHQLEEEAPPGPNNLSGPL

SEQ ID NO: 958428 - protein, 38 aa, Homo sapiens
MVCRTLDLGHCQAPTVGNPNLSIRCLISLCRCWPERCD

SEQ ID NO: 958429 - protein, 47 aa, Homo sapiens
ANTPSLSRLHMNSMNRGIRQYTRLRRRSIKVNVGADGQLQKDDADAD

SEQ ID NO: 958430 - protein, 37 aa, Homo sapiens
AVVWCGRLGRDRGLLTHLQADPFAPNHCPPPTVTGDF

SEQ ID NO: 958431 - protein, 33 aa, Homo sapiens
MLRLNTFEFCYILNDEASCPPFPLFCPPTVTGD

SEQ ID NO: 958432 - protein, 48 aa, Homo sapiens
DAAICIQRAHQVAQGRQAVHGPGVGRRVAQGHDGDVPIALDLQTGMEA

SEQ ID NO: 958433 - protein, 47 aa, Homo sapiens
YVVCAHILKEGNLKQKEKPNHFEFALNSGLNLCSPIYSEESHTVTGD

SEQ ID NO: 958434 - protein, 75 aa, Homo sapiens
SIGASRFTKVLIKWERPEERWTDGLEDIANQSSGPVKLFLREPIKRWKKALLLLRDDRGSRNGEEAPVVTRLQVY

SEQ ID NO: 958435 - protein, 114 aa, Homo sapiens
CLAEHEAKMSSPSQSMRKVQDSKAERGAHDRKGQEEIVTLHAEIKAQKKELDTIQECIKGKHAPTVSFEERERKHKAAEKELKDQLAEQTQKLYVSREEEGKKNKEKLSTSAWQ

SEQ ID NO: 958436 - protein, 37 aa, Homo sapiens
MFVGEAPGRDEDLEGRPFVGGSGKLLDLMMGAIGLDR

SEQ ID NO: 958437 - protein, 35 aa, Homo sapiens
MPWRPPGNRTPTPQETQICLPFIERQVELVDPDIL

SEQ ID NO: 958438 - protein, 40 aa, Homo sapiens
ITHRPTPTGTLPHRPLWVPMRFQIPPKRTKSSQHPDRRVR

SEQ ID NO: 958439 - protein, 87 aa, Homo sapiens
AIITPVICMYIIHDDLKQVKNHKKKQNRQFLPELLSFHPCDLFLLQPNCTTVRVSYISWPESQELTTKHVVTPVPVHMRKIPFNCHL

SEQ ID NO: 958440 - protein, 123 aa, Homo sapiens
KSEQQQDFMVKTDRTKLPQCGRGTRKWLLRNMALLVRVLRNQTSISGVSSFQWVRGLADFKNEAADLHSKCYQLLKVVRTQRVSSSKIYGEDRKNKASTVWKGDLSGLPLLARVASIYSLICP

SEQ ID NO: 958441 - protein, 46 aa, Homo sapiens
PTPQLTATLDLNPLSKARIEPKTSWFLVGFVNQSHDGNSVHLMPLA

SEQ ID NO: 958442 - protein, 70 aa, Homo sapiens
AWSASGISERIKTDDRPMEQNKNPEINPDTYGQLIFDKGGKNKNGKRKAYSASIAGRSLNAASAVHLMPL

SEQ ID NO: 958443 - protein, 82 aa, Homo sapiens
NRARYVLAALSERPFAHKATLAFFSPSRQSPEGKEGLGCLGLPGPCSFARGFLSLKPTPNGFSFVEKQELAGKCLRSLNAAS

SEQ ID NO: 958444 - protein, 56 aa, Homo sapiens
SVRSRDFDSGRFLDDSEPTKKPNSDIYPKPKPPYYPQPENPDSGGNIYPRPKPRPQ

SEQ ID NO: 958445 - protein, 50 aa, Homo sapiens
VFPLSFFPLFTRLRERLAAHQDRVEQIAAIAQELNELDYYDSHNVNTRQR

SEQ ID NO: 958446 - protein, 71 aa, Homo sapiens
LAALSERLPTYTTAIATRDLSCDLHHNTTAHGNARSLTHWGRAGIPSASSWTLIVFLTVELQQALLVLYFT

SEQ ID NO: 958447 - protein, 70 aa, Homo sapiens
MSRYRASGISERSMYESKPGSNLSHYSDTRSLTHCTTRESMIVLNGILNGEFFQEVLQFTFPDVHLMPLA

SEQ ID NO: 958448 - protein, 76 aa, Homo sapiens
IRSYVNGTSHVLGQPTHKKVREIIPPIQSGEIFLLIKIISGTTNNEGKGEDIGLLSSVNTLDEYKNRLFRSSVMAY

SEQ ID NO: 958449 - protein, 73 aa, Homo sapiens
RASGIVNASSDDVDDVLRARRVKVVESHPSATREPEYLLFRLGIGGLVLLRLGIGGLVLLRLGIGGRSLNAAS

SEQ ID NO: 958450 - protein, 95 aa, Homo sapiens
RCYHHRIDVSMIIHCEYRSSSCHLDLAKSGASGVYLDKKPISGRVWWLTPVIPALWEAKAGRSRGQEIQTILATMVKSASLLKIQKLAGRGGTRL

SEQ ID NO: 958451 - protein, 134 aa, Homo sapiens
GVCMDTNELSAPGRVWAHGTRTQCIIRQENGTSAYWRLRITIYTKPMAVARCSGSCLSSYVLGRLRHENRLNPGGGSCSEPRLCHCTPAWAIGKIDTEASLCCPGKSQTPGLTRSSYLGLPKCWDYRQKPTRLA

SEQ ID NO: 958452 - protein, 66 aa, Homo sapiens
TAAKYIIACNFVSTHFTAHAAFRSSKANLISICAWHLRSIRQHHNSHTHASQHFTMSSTQHHPTGS

SEQ ID NO: 958453 - protein, 57 aa, Homo sapiens
VLQGPRGRSLCFTLSSCTCTGLRRGQGGRREQAVSPERTCESSLELSWHLPCEFAIV

SEQ ID NO: 958454 - protein, 162 aa, Homo sapiens
RAAECKWHRTDCLGAQARCCSRIRTALSPSHPREDPQEPWRSKSLEDPVVALSGHRCHPALAPYSPEPEIQPGTAQPHTGRLTDTKQLVHSFSEGRDQGMLPMPTGRSLYPDLHGTKAMQSLRLQRVACGWTRAALAGREHPGFTGSCCGQAAGVPTLLETS

SEQ ID NO: 958455 - protein, 78 aa, Homo sapiens
KQAHPAQTSEEVYSPLPCIRRYIKATDNAEDGRNHPVDTSNKKDTKSNDARHDSSTVVDSKSKPLLTENYQGMYFLTL

SEQ ID NO: 958456 - protein, 74 aa, Homo sapiens
IPLRGVCVCYCEDTATAGSKHLKPQSWPGTVAHACNPSYSRLRQENHLTWEAEGAVSQDCTNALQPGRQRETPS

SEQ ID NO: 958457 - protein, 49 aa, Homo sapiens
DPFDGSYYIAQAYLERSSDPPASASQSAGITGNPSAQPQCLKEDWPLVG

SEQ ID NO: 958458 - protein, 134 aa, Homo sapiens
KFLGQAWWLSCIPAFGRPRWADNLRSGVGDKTGQHDETPPPLKIEKLAWRGGACLWSQLLGRLKQENHLYPGGGRCSELRPRHCTPARATSEIPSQKKKGFLIFRPGLLPNFFGDLPLGRGDGGRQLLSGIKGG

SEQ ID NO: 958459 - protein, 82 aa, Homo sapiens
KQQDLNRVRRITQVRVPRAMVKIPRGHPSSDPPIKDHCHPVESGLGGCTQVWPGQHSGRVLVVRVRVRLHYREGGKWQLRQI

SEQ ID NO: 958460 - protein, 41 aa, Homo sapiens
HVNFLRQWDMSKHDTSRDLILPPPQLKGLILQHGPPLETLC

SEQ ID NO: 958461 - protein, 52 aa, Homo sapiens
MGLISRQDSSVVALRFSFLVVALGKVLRYSLSCNRAKTHPYRQPSKPPTNVM

SEQ ID NO: 958462 - protein, 39 aa, Homo sapiens
MARNVPASPSPSGVIVSFLRPPQPWFLYSLEDCESVLTA

SEQ ID NO: 958463 - protein, 159 aa, Homo sapiens
VNYTSHDCSATAEDPTEGAIVEVALEGYYKVKLFDHGGSSGSEIGEGEKLDLPYGLERAIQRMEKGEHSIVYLKPSYAVGSVGKEKFQIPPNAEVKYELHLKSFEKAKESWEMNSEEKLEQSTIVKERGTVYFKGGKYQRAFTQYKKIVSWREYKSVLT

SEQ ID NO: 958464 - protein, 36 aa, Homo sapiens
EDLQLFRTGLEYTPWLYAGSSAEGSMGLLISTLPGY

SEQ ID NO: 958465 - protein, 76 aa, Homo sapiens
RVSRSSVMTQDAYIVGFIYAIFNVTVLPNHPALTKIPCAKYKRNNIFSLITFIHNYSFAMSGPGKDAQQQAKQRNQ

SEQ ID NO: 958466 - protein, 76 aa, Homo sapiens
WCVSSFITCDSLVFWRAESGGSQGQEFETRLINYGEPVSLLEIRNERELVVTRLQSQPLGRLSQENQLNPGGGELR

SEQ ID NO: 958467 - protein, 37 aa, Homo sapiens
PSGLLSLGLDTGQQQDAQEFSKLFMSLLEDTLSKQKN

SEQ ID NO: 958468 - protein, 50 aa, Homo sapiens
LEDPLAGTYCLSVLWVIFAFSALFSYRIKWLAVVIMGVVLQGANLYGYIT

SEQ ID NO: 958469 - protein, 65 aa, Homo sapiens
IPVLSWIILKSQATITRCSQPSVGVSGKRRREDESMIKLGYGLIDLKDATLFNSSSGIFAGTTKI

SEQ ID NO: 958470 - protein, 120 aa, Homo sapiens
MVTIWWSSARLIHCSFLNASETIASEECAQQIDDMHCKLQRLQAALINRKAQFFFMTAPDHMSHNSCFKSLNKLGYEVSPHLPYSPDLSPTDYYLFEHLDNSLQGKCFQDQQDAENATKV

SEQ ID NO: 958471 - protein, 124 aa, Homo sapiens
MASNRAITLTARPKIPFLGIREAKNPRSENTRLATILEVATTILEVAYHHLGSGSPPSEELCEQGPPGESIYGEEKSSWYHTLPKSQKQVHITPVFISDIRDFFPFTFHYRMMQQEGPHQIPVL

SEQ ID NO: 958472 - protein, 69 aa, Homo sapiens
LGASGRWQFGSQCLSGPGSGISTHSHILQVVGQQFKHSNVSIKWLWQAFTHSHHHPVSEVGSQSTIIHH

SEQ ID NO: 958473 - protein, 66 aa, Homo sapiens
HRYRECRRCASTLLYASCFMIRLIDDAVIWYSLLRYCNSLKFPILSSHTSPGPATTLRESGRMKFR

SEQ ID NO: 958474 - protein, 31 aa, Homo sapiens
HELVRRFPCEQQSTQYMRHCASAPGGLPVLS

SEQ ID NO: 958475 - protein, 176 aa, Homo sapiens
GPASINWTSKGHEVRLRQRRFVQTEAPPTNVCIHHEVTPTFGGTVVTPHSRRVSGKMGWHHSNLGHNLGTGVARFYVQSRSMPLKSLWWWNSHIVAEKRPLGTPWETPVRGRTPLAVESCSARSLDPAATFSRITGAPDKLTSGNLNPQQDSDLFSNRARYPVSNLVPYSDIIAGS

SEQ ID NO: 958476 - protein, 51 aa, Homo sapiens
SNGPSASPPALNPGDRRSHSHQGFMSGQQVNAHLREQPGHPVGTHRRNLMA

SEQ ID NO: 958477 - protein, 110 aa, Homo sapiens
VLSGFIGRPGSPVSNGFLIDGYPRDVQYGEYFELTGPETMTQRLLKRGETSGRLDNNEETIKKRLKTYYNGPQNRVIAFYEKGGIVRKVTAEGSVNSVFSQVCTQLEALK

SEQ ID NO: 958478 - protein, 51 aa, Homo sapiens
GLDRFSNASCSTLNKLGIEGTYLKIIRPIYDKPTANMWVGLNGKMLDQRIE

SEQ ID NO: 958479 - protein, 42 aa, Homo sapiens
MVKLLNKLGIEGTYLKIIRPIYDKPTANMWVWLNGKMLDQRI

SEQ ID NO: 958480 - protein, 37 aa, Homo sapiens
SPAVVSSLMPQQSTSGGGGTPHWGALQLQGWCSSSIR

SEQ ID NO: 958481 - protein, 52 aa, Homo sapiens
MDSFFYGLDQQAACSPELGFYFRGTAQYVTRRVAMTASGKPAFCNCLCTYAK

SEQ ID NO: 958482 - protein, 76 aa, Homo sapiens
IVIIAHAWLSPFYVCAMTAGTCHLHSVTRAPGYGDTEDQPLRGGPSEGVTTTWSQDSASSSTDQPPCCLQNGLSNV

SEQ ID NO: 958483 - protein, 41 aa, Homo sapiens
WQVEIGGASRLSGADSAQAVRGASCQAVPQPAAVRFWSVGP

SEQ ID NO: 958484 - protein, 143 aa, Homo sapiens
SILSLNQMAGKTVEQVLNNMILAEEARSHHSVYPKHGYSRKDAKVRLEEMCSNGCNDARYFLGSSTRVPFNEVLSDLVRCYTISCALRGPGFDRYPRTRSNVISTDTVTIGVVWRSVKSVAQYESCEIESLGNSIGCVLKVVA

SEQ ID NO: 958485 - protein, 60 aa, Homo sapiens
TIQAIKVHWSQAKSPVYLSSHFSWAAHCKWHIILVLYVTNVRTSIISHCSANITGMLKPL

SEQ ID NO: 958486 - protein, 35 aa, Homo sapiens
DLLRRRSWSTNNLVRRRSIGCLSLRQPPAWPVALE

SEQ ID NO: 958487 - protein, 43 aa, Homo sapiens
QEQCGNRIVKHYICLSQKPVQSRSQRLWKIIPILQCHQPTSVD

SEQ ID NO: 958488 - protein, 55 aa, Homo sapiens
RLHSKTYYCQHVDSDPLIFVRRDQCGCQNELWRAPSVFIYPPSDEQLKSGTASVV

SEQ ID NO: 958489 - protein, 118 aa, Homo sapiens
TLQYPVLTQGANHGTLFGHQGRGRGPHEPKRMKQNVDGLLLDTLVRHLNHVDNDQEPPYSMITLHEMAETDEGWLDVVQSLIRVIPLEDPLGPAVIILLLDECPLPTKDALQKLTEIL

SEQ ID NO: 958490 - protein, 36 aa, Homo sapiens
AHTISRRASLHCSSQGWPGAFSSAHGQVHTSGGLFA

SEQ ID NO: 958491 - protein, 131 aa, Homo sapiens
MRSQVVLCLQMHRRINVHEPPPRFQKMYENAWKSRQKFAVHGSGGPSWITSARAVSQGNMGLEPPHRVPTGVLPSRAVTKGPPSSRPRNGRSTDSLHCVPGKAADTQCSQKGGPYPAKPQAAGLPKTLRTY

SEQ ID NO: 958492 - protein, 39 aa, Homo sapiens
ELGTGQTLNYVITDLIHTIASNTNVNNIHTMPYHIVQRL

SEQ ID NO: 958493 - protein, 44 aa, Homo sapiens
LELLEAMSGPAWDGLSALLLLQGALEHTIFTITITIIHTTHPPP

SEQ ID NO: 958494 - protein, 107 aa, Homo sapiens
DGPFQKRGQLMVVSFWEKSRDTRAMFSTRGCREPLSLTWKPSSQPTIPIVGIVAGLSCKAVLAVLGAMVAVVMCRRKSSGGKGGSCSQAASSNSAQGSDESLIACKA

SEQ ID NO: 958495 - protein, 98 aa, Homo sapiens
RYRHVSGIQQLAQWSFVSGHELPRASADWDAGQARCSHCASVVKHVCTQHCGTSAHSSTHPGGMQQLPSSNSCPRELADTTSPSTPSLHGLGRSLLGS

SEQ ID NO: 958496 - protein, 49 aa, Homo sapiens
MTTNDDDETVTGLLTGGYWTVYELTLLGGLLITYRILGHDWTLTRPDTD

SEQ ID NO: 958497 - protein, 85 aa, Homo sapiens
DIVDHLVTGDIWVYYEEDYTNAWAVMITLEMWSLPRRLPGWPSSARIRRLRCCAYGLHAQCAIDRYYVFQMSYVVYENIAVSRAG

SEQ ID NO: 958498 - protein, 48 aa, Homo sapiens
SRGIPFQALLRQFPTLGEIAECQHIPGCNCDKSRPGKTTFVSCNRRLE

SEQ ID NO: 958499 - protein, 41 aa, Homo sapiens
MSITSGNEFETSPANVAKSRLYHEYQTEPGMVVLGCNLAWN

SEQ ID NO: 958500 - protein, 70 aa, Homo sapiens
IARTFRLDCRPASGSVDCCLAGGLRSWKPTPNVFSFAEKADVDLKKPCVHWPLHPTPSHLGRAPPAIKPG

SEQ ID NO: 958501 - protein, 57 aa, Homo sapiens
SYCTAKKEVDKNSNEYLGAGASATTSAVRKSLDKAKQRNVETQQPVLELDQLTHDLP

SEQ ID NO: 958502 - protein, 56 aa, Homo sapiens
MDVRNATAGSGPPNWSLVIGAGPSLLAGISRSELEYPALVHYLVVVPNTWPGHHAK

SEQ ID NO: 958503 - protein, 64 aa, Homo sapiens
HAFHSSIQWLARCRVCTALPAPQSLGRPARGQSRLMSSSSSFLSFVSPSFCSGLALPSCTGHRS

SEQ ID NO: 958504 - protein, 40 aa, Homo sapiens
DGDYVWFRTTDYYHYLTYVLVGCDLLLTYRTTLYVDDLRT

SEQ ID NO: 958505 - protein, 48 aa, Homo sapiens
TGIIQSQPQSHHPCCLSILLVHQHTFQCSTSSTPSIMPSTGTHSGQHT

SEQ ID NO: 958506 - protein, 45 aa, Homo sapiens
KSAASITRGSNIPSIPSPGAGVSALFVFLILFTFSTHHAKHQFSK

SEQ ID NO: 958507 - protein, 88 aa, Homo sapiens
AKAHAATSWGLQQHHSVTLRSGIVHAPTHQPISANHLGSLQQSAFSVASFTSLPSFPPSYFQAAAHFIFVHTQLIVIIITTTTTTTTT

SEQ ID NO: 958508 - protein, 75 aa, Homo sapiens
MATLPPCGGCLRWVWAVLLMHLGGRTFFAFRGTHSARCCLFGLGHAPAWGRRSGTRGPNPLPRLAHRHTFQGFRI

SEQ ID NO: 958509 - protein, 58 aa, Homo sapiens
DLMVRRHTGAQQVLDNSADLAKRFRKLGAPVVMVRVGWSDTFAEALKQEVDRPSPANL

SEQ ID NO: 958510 - protein, 53 aa, Homo sapiens
LKVAGSNVFTVASKRIKYLGVNLPKETKDLYSENYKELMKATRDDTNRCLRTY

SEQ ID NO: 958511 - protein, 57 aa, Homo sapiens
SYGKAQASFGTSKPCMHIHPKQAVMAAILTTADLHSMHWASTTCAFAHHATGYLQTR

SEQ ID NO: 958512 - protein, 62 aa, Homo sapiens
GCLLRGLIFVAVYNTIITAQNHTPSGSLKVHDTSDYCSFIKVSSSQDMSCAPMMATDASYFV

SEQ ID NO: 958513 - protein, 47 aa, Homo sapiens
LEDPWFTRGFLHFAQHFSFLPAMEEHVCFPFCHDYKLPEASPALRTY

SEQ ID NO: 958514 - protein, 94 aa, Homo sapiens
MTLNEHAAFKHLFNKAHLAPPLIHSTLSGHSTRFREHRVGGKVTDQQDPKAEEFFLVQNKMKSLPCLPPSTQTGQPSDFSIFSPPFLRTYEGTE

SEQ ID NO: 958515 - protein, 78 aa, Homo sapiens
MVAGTCVFAKQSLWAFSLRLFPSEERPFSLKLRGHFAEFLNESSPAAFVFSTRPPPVGFRIRDTFGLARGTRARNSVI

SEQ ID NO: 958516 - protein, 69 aa, Homo sapiens
PAESTSRVIPLHRTACDGRSTSCFSASSKGVRPTDAEPSPAGAPMFVKPRFAKLWPNLSKNPAAAHVCP

SEQ ID NO: 958517 - protein, 66 aa, Homo sapiens
RVVQQDIGLYVWSELTISSLTTYPAQVPGTGETRRSSSSYQSRYWSQSVRLKENSEATTVFQTQQP

SEQ ID NO: 958518 - protein, 72 aa, Homo sapiens
MLDLMRISVIRQGQCSWGKAAWCTISSVAGSRVKIITYEIRKATIRVVPLYLALVHSARRTDARTSLIFDHS

SEQ ID NO: 958519 - protein, 33 aa, Homo sapiens
MCTDIYVLVVNDYPRHEINISYLIVPLFGPSHM

SEQ ID NO: 958520 - protein, 60 aa, Homo sapiens
GNLCSRPGTDEGYYQVKMRNIRRFLYDGYKCKVTPGLPGREITHQELCLAFPYAMATVAR

SEQ ID NO: 958521 - protein, 47 aa, Homo sapiens
MQGQVGAPYCCLSYSSSRDSSIITIQDILHPCLVPYISPCPCHMQGN

SEQ ID NO: 958522 - protein, 36 aa, Homo sapiens
MQGQMSCVGSGACAVISSRVEIKKATYWSALSLAHM

SEQ ID NO: 958523 - protein, 40 aa, Homo sapiens
EQTDEEVPSPGIVDSPIPGEGKTDTNQTDEEVSISWDGAI

SEQ ID NO: 958524 - protein, 103 aa, Homo sapiens
SNGCHAAGSDVAASRDLIAVYTAGSNCSSSQDLMAVYEAGSDVAASRDLIAIYIAGSNPAPSWDWDLMAVYTAGSTPAPSWDWDLMAVYTAGSNPAPSWDWAI

SEQ ID NO: 958525 - protein, 59 aa, Homo sapiens
RRRYLCHHHINIISITISTVIITITTINIITVIITIIRVITINIKSRTITIITIIAGHE

SEQ ID NO: 958526 - protein, 87 aa, Homo sapiens
SIVAFTICTMSAALLNSLCVTVPTMPICIVASAKDTTRDSHTAATLGRGLTKVFICKNLAVYANTGENTVDGDVCKWKRSGAQRYED

SEQ ID NO: 958527 - protein, 36 aa, Homo sapiens
LHCKAKHPLELERRGRLNHVTKCALAPCHSARRIRA

SEQ ID NO: 958528 - protein, 47 aa, Homo sapiens
AQCSCILQADLEYPSYASPKQVVYRPRTCAGIDETRRNSALCALPIC

SEQ ID NO: 958529 - protein, 36 aa, Homo sapiens
RYLLMQGKELCEGERTIEKATYGAAPLRRYLALPYA

SEQ ID NO: 958530 - protein, 40 aa, Homo sapiens
LHMEGKELCKAADTVGHPLELKRREDEPRDEIGALALPYA

SEQ ID NO: 958531 - protein, 70 aa, Homo sapiens
LLIPVIRGVSPRTVDVHGNHLERICKHTCQAPSIVAEQSHLQPDSGLGLHLLGHLPPRPGIQRDLALPYA

SEQ ID NO: 958532 - protein, 208 aa, Homo sapiens
GSAVKCCASDSRNTVDHGQFIFPDDETSASAAMRSGASSRYSATKVSAVPASVASNATITTDHSGRPSSSLCDANQAINNSNGRWMPRKVTASSLALKERGNTRESPAYKRIQHSGKRALSVAESVWSQRDGSLRPRWLYPCAAPVRLNKRSRARGGRAPAHAKRADTSRLKTPCLDLVAGVDRHDAAGDVLEGGTRKPGLAIMSLSD

SEQ ID NO: 958533 - protein, 215 aa, Homo sapiens
GSDRAYTHRYADGSDGRQRRRQRVDRLGDDENGYVTRYGYDVMGRIASIAYPDGDSRAWNATTQSFQQVAGTEYGLGAGHWRQTVATGNARKETYFDAFWQPIVTREYDLAAVGATQRFQRFAYDHAGRQVFASYAGANDALSTGVWTGYDALGRTTSVSQDSELGLLTTLTDYLAGNRTRVTGPRGQQTLTSYQAFDQPVYDAPVAIQHPEGAF

SEQ ID NO: 958534 - protein, 145 aa, Homo sapiens
FRGMIQLVTCLEQCAAVQASSRTRAGDLEVLDQYRNAGKAAGDEAVVIGQQRLEAGEQPYLAEDLALFAGEDVRGQVVAGVHSRSHWRASSGILVVNDPRRVTEYAGTGRHVLDHDRTGTDHCSVADMDAGQDGGVWVHDRMLTD

SEQ ID NO: 958535 - protein, 211 aa, Homo sapiens
MLALLALIYGDVVQRHRAYARCQLLGLASPAGGAAGALSCACAPNAVASTQAMVVYRMAGTGCAAQAPTGRVAAMVNRHRLIPSQDKVTEYGGAGGAGMRMERGWLLSARVWPVGAVLRDQCEVGPVCVTPKARCVALTSPCLACVRFRVEAQAIPFQGSIVRELSRLGMLRCSTSRFACTLESDGVYGKRCGIGAVLCYVADGMAKDVAH

SEQ ID NO: 958536 - protein, 33 aa, Homo sapiens
YDGEVRIVALQLHLFRGAYATALDSSIGAERKG

SEQ ID NO: 958537 - protein, 69 aa, Homo sapiens
LWDKLIGGSFSGRVGGSDRCEGEKLDVRDRSWNASCFFSYLISVSVALSDGICCLLVALAVKDSSFLWK

SEQ ID NO: 958538 - protein, 36 aa, Homo sapiens
MRLHHTTRLGIIPREGAFKLNLVKQKEVGMMKDGYR

SEQ ID NO: 958539 - protein, 41 aa, Homo sapiens
STFWRRYVLLPHSPHLVPTTLLHVDTSSTRHFYNTTVTHTL

SEQ ID NO: 958540 - protein, 79 aa, Homo sapiens
QRNFCSVKGQSDVLLSTTSIEMISSEDVSYFAWMALERPGNLNKVVEQRPDVGTIESFSPGDFRTNMNVVHQNKQLESC

SEQ ID NO: 958541 - protein, 47 aa, Homo sapiens
LFRIAVSPARPSPLSSPPFGRPRPAAPLRSRHFAHSLANMVQTSLIT

SEQ ID NO: 958542 - protein, 42 aa, Homo sapiens
DSRGSPTELYPVQTLDVKSGLWYLEDKEYQVIDVLLVLSDFK

SEQ ID NO: 958543 - protein, 108 aa, Homo sapiens
MPMNRIVRHINGYKEAAHHNLLVEVQHTEEPTMKTSKKRKQKKIWTSSTRGGGTQTNDKVDTTEQKHKETDLLILFKDDSFAKKTCSKEHKLQVEAKLRAKQEPEAKH

SEQ ID NO: 958544 - protein, 82 aa, Homo sapiens
VHRDGQKFKSDHHVDVGVREYFCLPTSKLRATRGTRARIRCPRHSFILAGVQQMDKFRNLTKHVDVGEENTLLPLASKLRAN

SEQ ID NO: 958545 - protein, 58 aa, Homo sapiens
PRAYGLCFAPGGSSWVNGGQSGVSGGLTRCDVRRSYRKPPTKLVTEVVQRSACKQWLT

SEQ ID NO: 958546 - protein, 54 aa, Homo sapiens
SEALVVKFVGRGTLLPSQIRSLTNSYLGSIKLVGREHLCLGPKLPAPSYVTRGN

SEQ ID NO: 958547 - protein, 69 aa, Homo sapiens
EVSQQPHNAGSLSGDFQTQELEKVSLLFKPPEWCFCYVQLEQTETGGSHRNTHCKATTVYFPVASGRIL

SEQ ID NO: 958548 - protein, 66 aa, Homo sapiens
MGPLPNRENEGIMPPCLNLADKETLRRHLHTCWFPGTWRQGDLQERKLRVFGEHNKGKQGKLPANR

SEQ ID NO: 958549 - protein, 85 aa, Homo sapiens
AVSGTKIHANGRHLRTGEKAVVRLRYLKHPEYLKVGATLQFREGVSKGIGHVTDVQAITAGEASGENGLLNPSGCGQFYRCPYNI

SEQ ID NO: 958550 - protein, 176 aa, Homo sapiens
RALMKGAGEVWSVARAFDVCANVSDASYSESVAWPASRMHPGLARRRSAGYGLDGRGLPREGWRDAVPDVLKSSSVVQVVRVEVITKYHAGEMAWRVGIDQQDPMPLLGKHPAKVVDGRSFVLTPPLWLNKTNRFAITELPEIIISIVSIGDGEPYLAPNGRHLRDSTGLKLPANR

SEQ ID NO: 958551 - protein, 89 aa, Homo sapiens
LQSQASNSQLSVYLSLAAMQCNGNRVAAHARSGSTSISAANVQPLQQCSSHHTHVQLVRWFAQAGNSNPSRYPTFTTLFTQHNQPVTQP

SEQ ID NO: 958552 - protein, 51 aa, Homo sapiens
GSFDWRELMQRLPILTSFECQTIEEYNSLTKMLMLDKRILCSPASKLPANR

SEQ ID NO: 958553 - protein, 42 aa, Homo sapiens
MHAYSLQPSFAVPEIEEFKSDQDVDVGEENSLLPTSKLPANR

SEQ ID NO: 958554 - protein, 55 aa, Homo sapiens
MSLRIPSIGGHLCTLTILTKLCSAKQYCKSSNLTKMLMLESRILCSPPSKLPANR

SEQ ID NO: 958555 - protein, 38 aa, Homo sapiens
FDWRAPYGFMTSEKRGGGSDDLPMALRPVKSAKLPANR

SEQ ID NO: 958556 - protein, 103 aa, Homo sapiens
PADGTLSPHVILLIVIKNLTDNRLFYFFSFETESRSVAQAGVRGRDLSLLQPLPPRFKRFLYLYLPRSWNYRHAPLCLINFCIVSRDGVSPCWPGWSPARGLK

SEQ ID NO: 958557 - protein, 39 aa, Homo sapiens
AVTLEVPERRVCNVGSLMVFSVRQNVDHNKPLTHCNTVS

SEQ ID NO: 958558 - protein, 49 aa, Homo sapiens
MHTQCHATLPARAIGTHAAAHTYTHTHALPTVHMLTHTFTHCNTVSQWY

SEQ ID NO: 958559 - protein, 57 aa, Homo sapiens
KSLGHHLLKWIINSTYPRPPQSVVCTQSSIANHGSPAHTCSQLVVDTMPLPQALTPA

SEQ ID NO: 958560 - protein, 39 aa, Homo sapiens
SLQVHCYISNLNSLRDEVSEITCCQEFETSLDNIATRSL

SEQ ID NO: 958561 - protein, 38 aa, Homo sapiens
GETCCNVCREARSGDHVARAVLRGVLRFNGPQALLLCV

SEQ ID NO: 958562 - protein, 141 aa, Homo sapiens
MSLLWTRVRGKYNKITITNDEGRMIKEDIEVWSMEAEMYSAEDEKQSGQGVIQAIHLSPDAFNMKATVEDEKLQGKINDEDKQKILDKCNEIINWLDKNQTAEKEEFEHQQKELEKVCNPIITKLYQSAGGMPGGMPGGRR

SEQ ID NO: 958563 - protein, 98 aa, Homo sapiens
ILPDEVSSHGSHYDIYANGILNVSACGQEYGKREQDYIITNDKGRVSKEDIDRLVQEAAKYTAEDDQQRAWCHPAIHCSSYALQRLKATVENKKLHES

SEQ ID NO: 958564 - protein, 87 aa, Homo sapiens
LSIDVTYDIHAIGYTQCLCMCDNEYGKRDTMITITNDKGQFEQGEDIRTYGPVKLTKYNSCKDEKQRERRCHFNELHLESILSYQHL

SEQ ID NO: 958565 - protein, 108 aa, Homo sapiens
MVHSLSLLWTRLRENETMTYITNDTGRLSKEYIERMVQEADMRYSAEDNKQRDKAARSTNSLESSAFNMKATVEDESLQQAKMNDEEQQKILDDCTELIRWLAKTQTW

SEQ ID NO: 958566 - protein, 98 aa, Homo sapiens
MTIDANGTLNVSAVNKITENENMITITNDKGRLSKEDIERMVQEAEKYKVDKYEKHRAKESSRTSSLESYAFNMKPTVEDDNLQRQSIHDEDKTEDLY

SEQ ID NO: 958567 - protein, 81 aa, Homo sapiens
DIYSQVSILNVSAVVQEYGKTENKITITTDQGRPTKEDIERIVQEAAKSHSLEDDQPRDNGAPPRPSFESYSFNMLCNCRR

SEQ ID NO: 958568 - protein, 84 aa, Homo sapiens
DRQSHPQTYSYSFHCVLPFMIAALDSITTSYSVQQRRGSNNPPRKSPPTSDKVTFHPNYTIKDAPQHIYLFLLSLMTIATRSLR

SEQ ID NO: 958569 - protein, 75 aa, Homo sapiens
MRSQEVTQNLTDVASICRTGGDGASIDLPAWYWLVLLQGGFLLQCTLSPVLLAPFRSSEVAPALKEIVVHPELLQ

SEQ ID NO: 958570 - protein, 79 aa, Homo sapiens
YRRVSVYQKWEFTGPSICNRKTGVTAACHCSLIGQVERHDILIPLKKHSFKSRSNFHLSSSKLSHNIYFVLFTNAKEGQ

SEQ ID NO: 958571 - protein, 84 aa, Homo sapiens
DERKPTGVFDLCRTWVDTVTLLGHWDGDFLRGLFDSRFRCNDIGRWTCLLRAVNYTDTVHGLTVTRYNDTRVTGWDLVVLTLRL

SEQ ID NO: 958572 - protein, 34 aa, Homo sapiens
IAFHYQCGDLLPRVWRNCSEATLREHPCCGSMQM

SEQ ID NO: 958573 - protein, 89 aa, Homo sapiens
VIRGFWQVEIRTILASTMKPRLYQNTKNQPGYVGTRCRRLRQGDYLNPGGGGCSEPRSRHYTSAWRQSKTQSQKQKKTNKNLFFNFIFL

SEQ ID NO: 958574 - protein, 105 aa, Homo sapiens
MARADELPLVLQVVDEIDEERLARSSTIGELVDVLHHHRPSRLRDVQLAGDHHVLVAVLGGQEEDAVGVGLVVQHGDAGLCTSLVWSSISVNLSGVYSRQVDRRG

SEQ ID NO: 958575 - protein, 113 aa, Homo sapiens
ACGQTESHSVTRLEYSGVISAHCNLRLPGSSDSPASASQVAEITDVCHHALLIFVCLFCFLSCFVSFFVFFFLRRKLCSVAQAELQGPRSRLSPRVPPRGCMPSPASPPDCWT

SEQ ID NO: 958576 - protein, 34 aa, Homo sapiens
VSRGSRDTLHYRLIYSGGLRQEDSWGPEFNAAVS

SEQ ID NO: 958577 - protein, 152 aa, Homo sapiens
VDRQYWLSWSADGTISTHCKLQLPGLYFSHASASQEAGTTGMCPKRPVKFSFSFFLFSWLRRIFARHPHWSAMARSRPTVTSDSRVQAILPTQPPEQPGLEAPVTTPATFGIPSREEFHHAGQADLKPSSDSPALSQSAGITVPYLCHIGLH

SEQ ID NO: 958578 - protein, 100 aa, Homo sapiens
FLAETDFRSVTHTECNGAISAHCNLRLPGPSDSPASASRAAGTRGTRHHARYLWAFLVETEFHHAGQADLKPPASSDSPALASQSAGITGPAYLCNMGLH

SEQ ID NO: 958579 - protein, 102 aa, Homo sapiens
RPELGLRQCIEYNKHQDLSDLPIIDCGPLWSLVPQTMIIGFDVVPVCLLYNSLHSNLAPSHPNNLSPLPGNRPVTLGTVHVQISTSHHFMNLYPYAETRGTE

SEQ ID NO: 958580 - protein, 50 aa, Homo sapiens
VFLPSSGAENRASWWRLGQKDSYVRDEAQSKRGTPDPRSTPFKHWHSSPS

SEQ ID NO: 958581 - protein, 34 aa, Homo sapiens
RPYAIQHPSQWCTRGNVPRVRSSQFVNPWSISCF

SEQ ID NO: 958582 - protein, 42 aa, Homo sapiens
DHKVVTRGNVTLLIWRSRGHFHESAPLYESVCPYDLALTRGN

SEQ ID NO: 958583 - protein, 45 aa, Homo sapiens
LTRGSRGHFHESPLYESCMPYAWHMAYRFIKWEKSSKRSVWVEQS

SEQ ID NO: 958584 - protein, 43 aa, Homo sapiens
MSGPAYGIQIHKVVTRGNVHSGHFHDSGPAYGIQIHKVVTRGN

SEQ ID NO: 958585 - protein, 55 aa, Homo sapiens
MLYALFLLRVGSYLGFVGFSSKPSPIYGGFSIALFSSVVRMDTPRVQRQLGYRSS

SEQ ID NO: 958586 - protein, 67 aa, Homo sapiens
ITDISHRRYYPGTYKRTERIIRPVTPISKLLELTIAATLSGSVFYITVGDEVLMTVCSIQKRTAISL

SEQ ID NO: 958587 - protein, 92 aa, Homo sapiens
VVLYYRPFAGNLGFAMKKHLIYPASLILMASLKETDQKTKGESLIRGLASGRGRDQKIRLSSGLQTLDLHIHQPPAPPDRERICVLAFQTPI

SEQ ID NO: 958588 - protein, 116 aa, Homo sapiens
MVVGHPKPDNQGKEKRSSEEPDKGGTHLRGRVGLDPDQGLDGLQGVAEGKRGGRCDVAETTLQQGPQTVVSRADCFCGPIWFGPVPGSLKLGTECLNMENSLFPSPKRSPSPYSIL

SEQ ID NO: 958589 - protein, 46 aa, Homo sapiens
KRVLSRQGLAGWFQLLNNNNNNKKEPEKRKQTIKICLARQKERVYN

SEQ ID NO: 958590 - protein, 74 aa, Homo sapiens
GFIEFIFACSQTVRLGRGAPHIPDDGRPGRYAPHFLDRMAAGKRRSSLPRLGGQAEGLLTSQTMGGQAETLLTS

SEQ ID NO: 958591 - protein, 52 aa, Homo sapiens
SDRELSAVSGFAVILPRSARFQFVQSLCALAAWARYERLNWQTRKYRHQTRL

SEQ ID NO: 958592 - protein, 44 aa, Homo sapiens
PGVVVKKLDCKIKCMLSSKPIPQIVTPIDSKERDEEKSTKQTPD

SEQ ID NO: 958593 - protein, 49 aa, Homo sapiens
ARYQHNAIIAKNANNHLSKAQQVIIFLMVEGLAMMVADYITGWYLEATE

SEQ ID NO: 958594 - protein, 45 aa, Homo sapiens
GFVAPRSQVGSARIFFSICPFRCRFPVIILCPHPQAVSTSRTCVC

SEQ ID NO: 958595 - protein, 36 aa, Homo sapiens
FIVCSWPVAAGQVHACRSRRRRSPAGRLIHGRVIFG

SEQ ID NO: 958596 - protein, 42 aa, Homo sapiens
MPSPHHHVSTQEEGPCQPPELQANPFLFMLKSSILGVLLRQH

SEQ ID NO: 958597 - protein, 61 aa, Homo sapiens
DEVLQAVGVPGAHCHVQGGAPDLVPGIDPGSLVKQQFEDDQMSSAAGPEHRCPVQQVSRVH

SEQ ID NO: 958598 - protein, 33 aa, Homo sapiens
ADQRDASSTQELASREFLVSETDLVLLPFMKTF

SEQ ID NO: 958599 - protein, 49 aa, Homo sapiens
MARVHRYWSTESSSMKGCRIYGRPYLRSYGDNNVVFAHRVLFSVIRLCR

SEQ ID NO: 958600 - protein, 116 aa, Homo sapiens
MGVPIKHKARPAGSRAGFEQQSNTRELVGGKRLPLNSGLGTTFSTAPWPASGLHQRRNNMQRRSHSPANPEATRRRLPPSSSTPARRTVKASGHLAPLALYQPLAAPGDNTPGPAP

SEQ ID NO: 958601 - protein, 54 aa, Homo sapiens
LIWQGREAYRRSTVGALLDGMASAWAPSLLWAQLCEPGTSSSPLQSACDQSVRM

SEQ ID NO: 958602 - protein, 31 aa, Homo sapiens
MPPAVGHDGGFDSGLGWFNAMRVLLRGGAAR

SEQ ID NO: 958603 - protein, 34 aa, Homo sapiens
SLTNMQNGLIFFAGTLARSSSSSSSSSSSSLSSS

SEQ ID NO: 958604 - protein, 32 aa, Homo sapiens
MSCEPGGNRITFGSSKLRTTIGTTPIDQSVRM

SEQ ID NO: 958605 - protein, 56 aa, Homo sapiens
MMSVWKAAVQTSNGYNYVLQALINEHTLVSMSACNYGTVGANPPDGCAGVTELRIR

SEQ ID NO: 958606 - protein, 72 aa, Homo sapiens
TIKEDNASSTQQMQLKTLSLAIIARSWETAVISLYNKRKFIEAILTPGLVNFVPATEVTRLTQVNRSRRKEC

SEQ ID NO: 958607 - protein, 58 aa, Homo sapiens
GSAPLGLPARSDYYEDYPFTKQLEMLVPRGQAHRNVLDADSDVLSREDVTVFYLCVLQ

SEQ ID NO: 958608 - protein, 60 aa, Homo sapiens
MSRLPVVCRTCYSAPLAPYGHNGVCSVAPGADLADYGQVPAAVLRAPPSAWVLGHCCFLA

SEQ ID NO: 958609 - protein, 61 aa, Homo sapiens
RLQESPECAMASSRLAKSLVVAEEKKMFGTGLWPWPGKHAWPMSPKPQWTCDWVPDARNSV

SEQ ID NO: 958610 - protein, 86 aa, Homo sapiens
MLCSSGRPVGSGSVAVASMMSEVIIVFAGGVVVTSESLEDFLDGARLARYVNDPASATVEEDIFAQRIREVLDDAGRKDIGWFVTV

SEQ ID NO: 958611 - protein, 35 aa, Homo sapiens
FPKLEICYINKVELVAILPWQAERSRSSDRGTRVS

SEQ ID NO: 958612 - protein, 40 aa, Homo sapiens
MLGRMKMRLVAECGPDHSKDIPEWLDTDYKDIDQNKQDQS

SEQ ID NO: 958613 - protein, 77 aa, Homo sapiens
LAHRLTRTLTITTQDQIYGHISLASEGLGCEKPLVQGPADREQHDWHSEGHREQHGQAHTEDERVLLAVHVQHLRFG

SEQ ID NO: 958614 - protein, 38 aa, Homo sapiens
LLPNEMLLVLLSVVLLALSSAQSTDYDVNYEDFTFTIP

SEQ ID NO: 958615 - protein, 36 aa, Homo sapiens
KDPLQDAGEVAGRGGSECRLWDPSPGPLTGSRCRPP

SEQ ID NO: 958616 - protein, 70 aa, Homo sapiens
IWRRRTTSSDRFHRQAFGLQLQRFGHGGVALAPGQQRVHAGLGQLADGFQADATGGTGDQGDLGSSGIHA

SEQ ID NO: 958617 - protein, 36 aa, Homo sapiens
MVMMVMVVVVMVMVVMTVVMVMVALGDGVMLVVVMI

SEQ ID NO: 958618 - protein, 35 aa, Homo sapiens
DCVLSLREAKIWPGGMVTIVVVMVMCDDGGDGGGG

SEQ ID NO: 958619 - protein, 73 aa, Homo sapiens
PRSLRYLPPLSSVRTSSLCCQRMESHSQEAPPTIRLPDCSPGAPILSPSRQLHAVGPARTATRRVLTRLLSIA

SEQ ID NO: 958620 - protein, 93 aa, Homo sapiens
EHRGGDLKDSAFNGLKRKAGVEQVLTIDGLSTQKLELLRKADPMVKLSREGAHGGQLSCVMKFMAINIRRKGKTRPSLAEPLVKKCVVKDQSW

SEQ ID NO: 958621 - protein, 49 aa, Homo sapiens
AKAVVPNMCAALNCPVQHAHQRVYNKCLTHRDGKLASVALSRPVPPNTL

SEQ ID NO: 958622 - protein, 40 aa, Homo sapiens
RIPPKRSTSSVWDRARWLMPVIPGLWETEVGGSLGYYALA

SEQ ID NO: 958623 - protein, 42 aa, Homo sapiens
MSPVNSLQQAAVAADRVPDVPCASACDEVHTYRRTTQRQPMK

SEQ ID NO: 958624 - protein, 66 aa, Homo sapiens
LSGQHYVLNKGGGRQYLATQDGGNRWMLVKENSGMPVEVFIGHMQEFALDPEHPCGATGIGYLCFG

SEQ ID NO: 958625 - protein, 78 aa, Homo sapiens
CAASAAHITPNMRRYAAPESATIAYRVAEMPSSQWLQRERCPHATVLDLAAARIQVPSSIRKPRRELLQAGVIGVQQG

SEQ ID NO: 958626 - protein, 39 aa, Homo sapiens
CTQIVLSYTQSSSYNMIIDILPFLLSWFICHGKTTSPTP

SEQ ID NO: 958627 - protein, 30 aa, Homo sapiens
MRTGLIHWCLSVACTTHCTLVAFAWHVIAE

SEQ ID NO: 958628 - protein, 74 aa, Homo sapiens
MRTELIEAAAFLPIDPSPERYELLQTCLVQTSDFAFTRPLVGFESFAEGELIARDGPHEIRALCDDCTGSVRSH

SEQ ID NO: 958629 - protein, 68 aa, Homo sapiens
CDGLILLFYNPQNVSENGSPIPSIDDTKAYGIHFVSLPLSHNPHQAHQQITLALPSKHNQNLVISPFA

SEQ ID NO: 958630 - protein, 41 aa, Homo sapiens
MRTELIGKEKRKGNERKGKGKKKERGAKFSLKRCWDQSVRM

SEQ ID NO: 958631 - protein, 36 aa, Homo sapiens
MRTDDHANGLIHANGLIPTPFQWTPLIHHSYRSVRS

SEQ ID NO: 958632 - protein, 37 aa, Homo sapiens
RQCNDGRVLTAVYTTASVNDGSVNDGSVHQTASVNDG

SEQ ID NO: 958633 - protein, 165 aa, Homo sapiens
MGLILLSVNNPLYLALALLMTRRYCTYISANDPENLQFHPHVVENEWTLPEYSVWEGLRFYASCHQEVGESQAIDSHRKIYTRPRKLKEKYIWVPHSKYADSVKNEKSTALFIPYSSQVTKIVVQAVKLGTNIATIRMQVAVHESADVQEYNLVARSAELGYEKH

SEQ ID NO: 958634 - protein, 37 aa, Homo sapiens
SLHRIGTRNWVTGPGHIFQRDEQHHPMASYRDGEPLK

SEQ ID NO: 958635 - protein, 37 aa, Homo sapiens
WVCDILQLVHYSEVTIDLVSVESILLLTTCDLFSSVV

SEQ ID NO: 958636 - protein, 96 aa, Homo sapiens
MATGKAHPTEEAAKAVQHNSSAAKSMHDHRANDQTWRPTMMEARNILTAGRDGYCACSTKDFIKSKPYGKLKSDHALRSLCMARITLQTYDLGSQN

SEQ ID NO: 958637 - protein, 67 aa, Homo sapiens
ADSTLVMHTAAHADKIPAGLCATAIDILTTVVRYTKPPLFPDFSYCQGFPVLLAQVYPFTQYYNAVI

SEQ ID NO: 958638 - protein, 35 aa, Homo sapiens
TCNWRHVSPARQSLRVCLCTKPASDIPTALFIAPC

SEQ ID NO: 958639 - protein, 38 aa, Homo sapiens
QPERLMLHRRIFSYHPRAYILITILPSNSHYDCLIRAC

SEQ ID NO: 958640 - protein, 36 aa, Homo sapiens
MNHANRIGSPRSSNTKSGVSSGECRLLLVRRGYIVP

SEQ ID NO: 958641 - protein, 35 aa, Homo sapiens
LLYEDSQSRRLYRLKRSIVIDYLPFLITLLFTDLG

SEQ ID NO: 958642 - protein, 71 aa, Homo sapiens
SCDVNYYTNGGFNREYYSIVNGNESHDDGHETAVCFTDSQALTVLSPRWGNAYAACLKHSGYALAGKGYPV

SEQ ID NO: 958643 - protein, 49 aa, Homo sapiens
SCDDNYYTNGGFNREYYSIVNVKESQDDGHETVVCSTNFRALTVVYPRS

SEQ ID NO: 958644 - protein, 63 aa, Homo sapiens
MIGCYSGNTSCLWQWACLVCWGETVNAAERGKGSRTQQFETAFHSLPYFQAFSYDDLTEIMLG

SEQ ID NO: 958645 - protein, 35 aa, Homo sapiens
MADTTYLTDVDVQWDDLLTTLTSRPCNTLSRARYG

SEQ ID NO: 958646 - protein, 40 aa, Homo sapiens
RAQLGTSHMATEQAAGMQTKRRSNTRKPPKLDDMLKQMAR

SEQ ID NO: 958647 - protein, 70 aa, Homo sapiens
MEWNAMEWNQPEYRGMEWNGMQWDGIIRNGMERNGMEWKGMEWNQLDCNRKEWNGINPNRMEWNGMEWNG

SEQ ID NO: 958648 - protein, 33 aa, Homo sapiens
YDGPPTLTRTTDGVLPSGLLLPLTHVGPCGPLL

SEQ ID NO: 958649 - protein, 38 aa, Homo sapiens
MALFAQAGVSAHSNLGPLDSSNSPGPDSRVAGITGLHK

SEQ ID NO: 958650 - protein, 71 aa, Homo sapiens
GDGTIILMKLQSPLVATPSLSPRSPLCSDWPSVFKSALSTLPGSPMTSSGSPDLQLAWGPSLLPHPPSVGL

SEQ ID NO: 958651 - protein, 68 aa, Homo sapiens
RWRFRMCLRPGAMGQSPKERREAKARGYLDLGPRDPVRLLGRILTVILPGLLYDHAAHFLGIPGKRLC

SEQ ID NO: 958652 - protein, 118 aa, Homo sapiens
KVNGMDWNGLEWNGMEWNGIDFYRVNGMEWNEPTRVEWNGIEINGMEWNGIDPEGMERNAMEWNGMQWNGMERNGINPSGMEENGMESNQPEWNGMEWNGMEWNALEWNGIECIEPDS

SEQ ID NO: 958653 - protein, 43 aa, Homo sapiens
AGTFPAGPCQLRGRVPVRARVPRRPVSPARPVYTAGTCTPRGP

SEQ ID NO: 958654 - protein, 101 aa, Homo sapiens
MIWTSNECTEWNGMEPTRVQWNGIEINGMEWNGIDPREWNGMQWNGMECNGMEWNGMESTRVEWNRMEWKAINPSGMEWSGMEWNGMHWNGMESNALNRIA

SEQ ID NO: 958655 - protein, 82 aa, Homo sapiens
DALDSRNSRAHSSDSYNHASSFLTPGASYPMDLTGALVSLVSVSAPHQCSHVMSLVIWHTDKQQQRLAGSTQSEDHTMETNY

SEQ ID NO: 958656 - protein, 37 aa, Homo sapiens
VIHRIATAKRRKLIQGDRQKQSICIAHVANKSQAQFT

SEQ ID NO: 958657 - protein, 40 aa, Homo sapiens
GWVLVVPFSSCTVEVGIQPTAREHCRKSSDCHPGTLCTCF

SEQ ID NO: 958658 - protein, 44 aa, Homo sapiens
YRFMLAYILMQELQPLGYTGQFVVHFHTTGPTAHKVGDIQFDSA

SEQ ID NO: 958659 - protein, 68 aa, Homo sapiens
EDPGSYRFIRQKLTGYRGMNSALDKAELIDIYRTLQPKLTEYTFFFKDKIKLIKIDHIVGSKALLRKF

SEQ ID NO: 958660 - protein, 64 aa, Homo sapiens
QELSSYRFNAYVLLQSRFMIMPLSLHSPNYFHVISSAVPSQASVRCQFSWDGLTMLCRVQDIDR

SEQ ID NO: 958661 - protein, 107 aa, Homo sapiens
MSYSFTYFSISVPVKVGEYFIHLHVIHAIDLPESVDMLSLSSKPFDSKFTFEILFIFFSEQNVPTLLFQNITFALHIKFTDPDWYERAEELHLDTWYKCGRQASNIT

SEQ ID NO: 958662 - protein, 179 aa, Homo sapiens
SRGCGSYPVQCKSTGSMKKQGNIKPPKKYNNPPTSDSNQKEFKNFQKKISKDDTKGKLSKIQENPEKYYYEIRKRIQDMNEKFTKERNIEKNQREIQKLKNSFYEIQNTVKSISNELDQAEETISELEEGTFKTSQSDKNKEKRYDANKLENLEEMGKFFDTYTLPRLNQEEVESLNRP

SEQ ID NO: 958663 - protein, 34 aa, Homo sapiens
QVYECTTLQCDPKHVHNWCAHGLQIGYSYSRTRT

SEQ ID NO: 958664 - protein, 36 aa, Homo sapiens
SIMAGIGSSQGQQGPTQGSLLSNAWQPFPSTSIFSQ

SEQ ID NO: 958665 - protein, 55 aa, Homo sapiens
MEWNGTQWNGMEWNGMEWNQLEWNAMEWNGMEWNGIDCKEELNRSNPNGMELNRI

SEQ ID NO: 958666 - protein, 107 aa, Homo sapiens
TARYPVNDTLHEMKLVCESYKVQEERARLFEPWSQEHTYLDKLKISSASRTPKDQSLEHKLEHDVSVLKQWSSAFQYRATFRSLEIPYGIRYSEPNSLPGTMLEIAI

SEQ ID NO: 958667 - protein, 127 aa, Homo sapiens
RTAIRFNPRGMERNGMVNGMEWNGMEWNLMETPESNGIEWNGMEWNQPQWNGMEWNGINQSGIELNGMEWNEINPSGMEWNGMEWNGMEWNGMEWNQPEWNGIEWNGMEWNQPEWNGMEPDSLPRTE

SEQ ID NO: 958668 - protein, 75 aa, Homo sapiens
MLRDSKLHYENSNPYSIVLVRKTDTYDPWNRIIEPRNNTAHLQTILIFNKADKNQATGEQRDFSLPLINDAGKLA

SEQ ID NO: 958669 - protein, 57 aa, Homo sapiens
MLAGLVLNSWPCDPPASASQNAGIAGVSHLDQTKNVLKNPEKSATGHFDRLIEPDSL

SEQ ID NO: 958670 - protein, 89 aa, Homo sapiens
KPSLPGHLPRECLRGSPTGTSVMQVTATDEDDAIYPYHGVVAYSIHSQEPKGPTRPHVHNFTRSTGTIRVISRWPGPGKKSPEYTLTHP

SEQ ID NO: 958671 - protein, 57 aa, Homo sapiens
DTRHAIRFNVYNVVVIEMIYDCGLNQKMAIVLEKMDGFKRYVKAGISKTSLIEPDSL

SEQ ID NO: 958672 - protein, 44 aa, Homo sapiens
ALSQKDKARGITLPDFKIYCKAVVAELAWYSIKPGSRPIEPDSL

SEQ ID NO: 958673 - protein, 100 aa, Homo sapiens
THTNTHIYSFFSLVETGGRYFGQAGLNLLTSGDLPTSACQSAEITGVSHCAQPIRHSSWLRGTDTNKLPGLRSTLEVNTRASDSEHGISQSDCMTWACVA

SEQ ID NO: 958674 - protein, 131 aa, Homo sapiens
KVSPNTGGICSCDSESVEQNFSSTESIFPNGGTPPKISKTVLLSTKSMKKSHEHGSKKSHSKTKPAILKKDIAVKEKIPSHHFMPGSPTKTVYKKPQEKKVCKCKRATQNPSVHTCRGQRCPCYSNRKACL

SEQ ID NO: 958675 - protein, 150 aa, Homo sapiens
MLAFFPSEILHPDVVLLTSDNVLRIYSLREPQTPTNVIILSEADEQSLVLNKGSAYTASLVETAVAFDFGPLAAVPKTLFGQNGKDEVVAYPLYILYETGETILTYISLLHSPGNTGKLLNPLPMHPAAEDNYGYDASARLCLPCVPNIL

SEQ ID NO: 958676 - protein, 79 aa, Homo sapiens
SRSKLSVITELLTSDTGATCLKLSPFLRTRTPVPGRDTGSVLGRLLPEEILSFVEEVVLPAPGVPWSLHEGQVNPLLEL

SEQ ID NO: 958677 - protein, 90 aa, Homo sapiens
SYRLLGPHMLHDRVLTTARIEYSDWSSYLSGTWGQRCGGTSLHAVGTESLQDVHFGGVHVELVSRLYAASCGGEPVMDLLTMLLNLDKLA

SEQ ID NO: 958678 - protein, 77 aa, Homo sapiens
RILQLSVHESPLITRSKGQHQHAAMQLKTLSLAHTPRETAVINLQHKRKLLSILTQVGHFVQPPGHTINPSQLNRIA

SEQ ID NO: 958679 - protein, 52 aa, Homo sapiens
PTARFREKHHQLLRSNGTALAPLTPGAGTSGSNQVSLCNPSNGPNASYHDLG

SEQ ID NO: 958680 - protein, 61 aa, Homo sapiens
SPNTKNKRRLLLTEVLATCPLVQRERRGVTLVRTGSKAVNSLAVASHKCAQVRTANRNLGH

SEQ ID NO: 958681 - protein, 109 aa, Homo sapiens
RTTERAAFENAPKPQKRPARTQRSVQKNTLEIGISRICTASSPLHRSEPLYTLFFALGHCQHERYDRAFDHNAPIRQRQIPEEDLQKLGLPDHTHSICSYSSAGVKTNS

SEQ ID NO: 958682 - protein, 75 aa, Homo sapiens
ASPTLFTNKMMFYGQVFWAPSLPVRVPGLFEFRTGTTGPWEACGRHLLWLGIFPLHLVSGRGGAFRVLSRISVGR

SEQ ID NO: 958683 - protein, 40 aa, Homo sapiens
MILPAGGASDLEELEQFAMTFKQRRIKLGFTSGVLGDNMV

SEQ ID NO: 958684 - protein, 43 aa, Homo sapiens
GSHVIANTLQHKLIHTRKHPHVHTPIPHSPPIPQPDIITGFSS

SEQ ID NO: 958685 - protein, 33 aa, Homo sapiens
TIAQHIPHPAHEYHESQESEELHTHDMPRNSVL

SEQ ID NO: 958686 - protein, 50 aa, Homo sapiens
LEDCMFANKQYSGQEDYYGDTTVMVDKSSEGMNQQYYPDGHNDYGYQQPS

SEQ ID NO: 958687 - protein, 34 aa, Homo sapiens
MLSQHEPKLLSVTPAELLILQVLPNNTNNRADTG

SEQ ID NO: 958688 - protein, 32 aa, Homo sapiens
SVMYATSAIVCVLCGTLMTGCLRTSVFTDDEE

SEQ ID NO: 958689 - protein, 35 aa, Homo sapiens
MLSANTSVCFFVSQNYATTFTEHFRKKDMSLSRMD

SEQ ID NO: 958690 - protein, 55 aa, Homo sapiens
MKMEEGSQRVIERSCIYSITNGPHGIQEWYCMLEIAMKTRNKQELFVATRSDIES

SEQ ID NO: 958691 - protein, 70 aa, Homo sapiens
DAQHVSASASEQTFGSKRDVESYGKGAPACESGKSSGIASTERARHIVIPVLLTKHILKSLLGFGDGREV

SEQ ID NO: 958692 - protein, 74 aa, Homo sapiens
ISRRRIKISQATLELCVFVTSLGMYSPCEYQILCEVVRVPDDKTLATPTGITILRQDPNYGIMESMDRKAVGGL

SEQ ID NO: 958693 - protein, 34 aa, Homo sapiens
VWEHRRQHPDSSRQHLMSSHGARYTLSVIAVHHE

SEQ ID NO: 958694 - protein, 43 aa, Homo sapiens
MCDPTHRCLFFSVENESLYIPHLRKAAQLGMNAVALTGEWIPR

SEQ ID NO: 958695 - protein, 50 aa, Homo sapiens
MMLTSSEELQNEENIDLIQLEIGCHSSTSVHTFLSNIPMVLSGQTMTIIS

SEQ ID NO: 958696 - protein, 53 aa, Homo sapiens
GRIQTALSSQGAVHTCFRQCGLTRHQITITDNSNQEPTGIMLRAQTEVRIIDV

SEQ ID NO: 958697 - protein, 71 aa, Homo sapiens
SDSSRIPNFDDAFRIDNNKDVLLKCKNKFKTSGRGQWLKPVIPALWEAEAGRSPEAEFETSLANMVKPRFH

SEQ ID NO: 958698 - protein, 37 aa, Homo sapiens
MTKSTICQVDSWAEALVLFYVVMLHTTLSQSSLNGPS

SEQ ID NO: 958699 - protein, 36 aa, Homo sapiens
MIASQEACKAKGAKPGLCTMIVSAKRKFLIFVNINA

SEQ ID NO: 958700 - protein, 44 aa, Homo sapiens
TNTVCSSQMSYMGCTSGREINTSITILLVCFKSNVKKLLLLKQV

SEQ ID NO: 958701 - protein, 72 aa, Homo sapiens
HQWLGYRSSMPLVMAHFDVDNPITPKGNTPTPRMYERGQAEGPKPMYQAQPPPFQKTPYLIPKGPETMVLTD

SEQ ID NO: 958702 - protein, 83 aa, Homo sapiens
MLNFDGRIHYLLEHQDALPEKHDLLSELLWSLGEVQPWNLFLGKEQLTPMTLIKANTLSQLSKTEISLVLDQATYDIEDGEAL

SEQ ID NO: 958703 - protein, 54 aa, Homo sapiens
IPRRTHSVSPPKYDVSCTNSPRIFPTEQVTCLMLAREGTVLQCKLCPLQGWHYK

SEQ ID NO: 958704 - protein, 51 aa, Homo sapiens
LNFTDHSITFQLQCCLRNARNLEQRQQRAYKTKSGNHSFRISANTAWAEVA

SEQ ID NO: 958705 - protein, 46 aa, Homo sapiens
TLEILGRIHRGYHSPHCCQPPEALRFAQQSLETYSTAPFPHLAFQP

SEQ ID NO: 958706 - protein, 91 aa, Homo sapiens
MSLRLGLFPWQRQRCWPTRKHHHMLLSHSLILSFHLNVLFVCFALASRSVLQAGVQWRDFCSLQAPPPGFTPFSCLSLPSKLGLQAPTTTP

SEQ ID NO: 958707 - protein, 60 aa, Homo sapiens
VVVDLLLKGWSNPNLGGGWSRLFPERPGLNPHRGENHQELVIEGGTVPASLEWANFPGRL

SEQ ID NO: 958708 - protein, 43 aa, Homo sapiens
MHAGIKVSDSPVDPDQAPTFLGSTSICSHPSCSKSLGLLGTNL

SEQ ID NO: 958709 - protein, 109 aa, Homo sapiens
MTHGRLLGVKTLAEELTADVVEIVRELGLEVETEDVTELLHLNSTACCREIFHERKSQQMQQTSLVSHFMKTAIVTPIFSNCHYKSITAINIEARPYASDKITSHWRLR

SEQ ID NO: 958710 - protein, 86 aa, Homo sapiens
LQCTRVCVIQRRKVTEACVFCDLCVACGIRKLWLEYEERRPLASDVAQGMRVIETYVKTYSCGTRRALIAEKIDCSESCNSLPSII

SEQ ID NO: 958711 - protein, 69 aa, Homo sapiens
MYRQHCSLLTHSIQFCSRLLCGFAMYSVILETYSWTRGYWYLAFGFSEDGCAHCAWKVLAQGLRYGKAL

SEQ ID NO: 958712 - protein, 139 aa, Homo sapiens
FQKKQKKNQKTKPTKQEKHSIEFFTMITFTTKPNTVNLLRFKCNHFLRSGRLQKLSVSILSLKDSQRGISENDPLVVPKKESIFHLVWKKLLPWAPALQKQERKEVLGLLQLQGAPVAMIWEGIWNEVTISQFGIGRQS

SEQ ID NO: 958713 - protein, 47 aa, Homo sapiens
MHCETILENTKIAGCVPLWTVLGAEMEDHSQGSDICYHVNLSQKTKQ

SEQ ID NO: 958714 - protein, 69 aa, Homo sapiens
RTPKYKNTQQMPLKNNDHHTLEARDTNINPCLTGEAVHSRHFPLSNNTTTSSLLELTHKALAQTQRSRG

SEQ ID NO: 958715 - protein, 44 aa, Homo sapiens
MYPTHRSPHCGDEGPEDLDVQSSLTQSSLMRAEDAFRNAYWELG

SEQ ID NO: 958716 - protein, 61 aa, Homo sapiens
HVIAKHKKTKNFPVLGTGGSTPVNPQPLWAGQGQVASTAGPGSSQHHAWYTHGDTPVIPLN

SEQ ID NO: 958717 - protein, 98 aa, Homo sapiens
VNQPQCNVMYRNGMEWSQNEHEWNGMVWNETEWNGMECNGINPTGLEWNGMQWNGMKWSQTDWNGMEWMEWNGMEWNGLERNGIEWNGMQWNGLNSGP

SEQ ID NO: 958718 - protein, 92 aa, Homo sapiens
SKHICDLHHRSRQSQILNPLSKARDRTRKLMVPNRMCNHCATMGTPTDLILMNEQKTDGVRAVIVGNRLGQFDDDDDCGYKEVEKEYAKEES

SEQ ID NO: 958719 - protein, 88 aa, Homo sapiens
YRNGMCSRMNTSGMECYGMKRNGMEWNAMESIRLDWNGMECNGMEEMESNRLEWNGMDGMEWNGVEWTGTKWNRMEWNAMEWIEQRTL

SEQ ID NO: 958720 - protein, 38 aa, Homo sapiens
MVKEPMGHPYHGIRSSHKMEQTFHTGNNLEEPQGNYAE

SEQ ID NO: 958721 - protein, 75 aa, Homo sapiens
VWLSPNTRNYPNVCNGEWLKNLWDIHTMEYDPAIKWNKPFTQATTWKNLKEIMLSEKKKKGRSKNGGYRHSSYLV

SEQ ID NO: 958722 - protein, 63 aa, Homo sapiens
YGYQSESEMTCQNSAHLRSIVIEQVGVASGAGQLRAERPRSSRHAAVVVQESKTSCLSEIAYR

SEQ ID NO: 958723 - protein, 111 aa, Homo sapiens
GSVVPDEHTSQHVSGNTSFVFWGFLVVGLFVFVLRWSLSLSPRLESRGAISAHCNPAPGFKRFSCLSLPSSWDYRRMLPRLANFCIFSRDRVSPCWPGWSRSPELATPTAS

SEQ ID NO: 958724 - protein, 62 aa, Homo sapiens
MEPYGYEKIMENLRAGALEGPSAVNNMELNEVMGPNKKRKALEVLVLITLEPCSFLGILRVP

SEQ ID NO: 958725 - protein, 80 aa, Homo sapiens
IPDVSPTPPSSRFFLPQTKYLVLNYLYWQHSYSDLTPVSEAVSNKSRGIAWTDGCFEPTGAPFLNCVEKVCSDEAFYYAC

SEQ ID NO: 958726 - protein, 46 aa, Homo sapiens
LSPHRTPNVCMVNVKNYGHHTMNTISHKWTNLYTGTTWKNSRKYAE

SEQ ID NO: 958727 - protein, 120 aa, Homo sapiens
ALEDPIYPNTGLFVTCRKSESNLTAWTHHGMKMVWVYCWFWLVFANRISLCYPGWSRTPGLKGFSHFSLPSSWDNRHEPPHLAGLGFIGWVWGFDYFFGGNVWARTCEDRDKADRGLSGI

SEQ ID NO: 958728 - protein, 30 aa, Homo sapiens
MGADFRAEYSNKLADRAELAQLVICCQSTY

SEQ ID NO: 958729 - protein, 154 aa, Homo sapiens
HTPLSHVDASVMSANGETVRKDKNMLNYWNSSATKAERKGMSEVPTNLAEYCIKTKKVAFPMTTAQICFTTDLYDDDIDDEDEGGGRCRTVMMMMILGNEGVVTCSFSAPVLAFHLRAKGGEQGGDLAIGPSAKKLFHKRDWGLQYGVPEARNI

SEQ ID NO: 958730 - protein, 70 aa, Homo sapiens
SPNSIKIKIIAPRMSASTRCAIGGSILASLYNFQQMWISQQEYDEVWPVHRPPEMLLNGLSRYVESGAVG

SEQ ID NO: 958731 - protein, 133 aa, Homo sapiens
MIIANKRTHCVSIAHVLGDSTSAQTHEHASMHAYSEETVVTQEMLLVNSFSTESAFLALPAACGKWADLHVPGQAWVSIEPLVLTAGSRGHCPACAFCRGLLQLGPACSCASLRGQLPTLLGIRNGVLQIGAL

SEQ ID NO: 958732 - protein, 85 aa, Homo sapiens
VDSEVEPNDYADGEARLYYERWDLTQMDDELRLDLGAERLGQARGDGCHTENKVESKGNSPPELRRGLSRGEGPGCRGYVEGITI

SEQ ID NO: 958733 - protein, 34 aa, Homo sapiens
WATMDGGVMHHTGLTQTKILVLQRRDHGVSLPLV

SEQ ID NO: 958734 - protein, 50 aa, Homo sapiens
DNARGATVATATTSTATSTNSGSNIAGRISAGCSLQVLVLPCTNTYRRSS

SEQ ID NO: 958735 - protein, 51 aa, Homo sapiens
SALGNLTNAENRNPSCEVTREPVTYTSYMTLACKDALSPVVSTSRSSPEAR

SEQ ID NO: 958736 - protein, 33 aa, Homo sapiens
KKTYMELTRLTSDDTALYFCAREQFDFENSFLG

SEQ ID NO: 958737 - protein, 39 aa, Homo sapiens
TAENRNPSCEVHQEPVTYTAIDPGLQDALHQCVTRRCSQ

SEQ ID NO: 958738 - protein, 34 aa, Homo sapiens
RGLLVEAEETVTIVPGPRYQKHLFQHLVVPQYLS

SEQ ID NO: 958739 - protein, 38 aa, Homo sapiens
MVAQTSLSLTGTRSLDLGSAGGRQLMAKLAEGAGNPTG

SEQ ID NO: 958740 - protein, 106 aa, Homo sapiens
NSNRHVLRMNHHQHATVLPESGIMYQKTLTPEYSLPHWKRLLLGDLERKRPASMAVMEGDLVKKESPPKPKDPVSAAVPAPGRNNSQIASGQNQPQAAAGSHQLHG

SEQ ID NO: 958741 - protein, 37 aa, Homo sapiens
QGSSRHTKHTSTTTIQKLSKLGYEVLAHLAYSHGPSI

SEQ ID NO: 958742 - protein, 49 aa, Homo sapiens
MKVGGTKGWALAQKAVHEHGGLNMGIESWIHGHGRLIHGQRRLVTWPLN

SEQ ID NO: 958743 - protein, 96 aa, Homo sapiens
MLRYSKIPWHVSVTWEAEEGDFELAVVGMLSNTVKSVSKTINSMDTETDTKEMMSPSDGAIVCKCREKKQLGKGLEQDGTHLSLRSNQALNTCVSH

SEQ ID NO: 958744 - protein, 80 aa, Homo sapiens
RGSGIDVACMHCCSTELSSPVDYVLMEYCCPVTVGPFVIQSSSVSKTETHEWKAEFLTVMKCFPDQFPRVTTRQCSFPHF

SEQ ID NO: 958745 - protein, 43 aa, Homo sapiens
MCDVDMARDVVAASRCDVMAEFPMSVCDVLHLHDAIAISLRDV

SEQ ID NO: 958746 - protein, 70 aa, Homo sapiens
SYKKEMEKLVRVRLGVHPQAQSLHDLPFFRIKKLISEPFPCCRSAGTFHSFPSVAGGMASHNTGDAQCPQ

SEQ ID NO: 958747 - protein, 112 aa, Homo sapiens
QIVAYGRFKTLKRPHGNKAECGGSRPVIPGTLNMLTRGGSTTSGVRDQPVQHGEIPSLLKIQKLAGHGGMHLVIPAYSWSAHSMVYTHLQLVDTGVCIEPRSRHCTPAWAME

SEQ ID NO: 958748 - protein, 126 aa, Homo sapiens
MFPETLDEGMQIPSTQFDAAHPTNVQRLAEPSQMLKHAVVNLINYQDDAELATRAIPELTKLLNDEDQVVVNKAAVMVHQLSNKEASDTLIMRSPQMVSAIVRTMQNTNDVETARCTAGTLHTFPI

SEQ ID NO: 958749 - protein, 46 aa, Homo sapiens
LRDSKDPPDDNRCLTFTLRDNARWSDGTPVTAEDFVYSWRRLVDPK

SEQ ID NO: 958750 - protein, 114 aa, Homo sapiens
MDPLQKRNPASPSKSSPMTAAETSQEGPAPSQPSYSEQPMMGLSNLSPGPGPSQAVPLPEGLLRQRYREEKTLEERRWERLEFLQRKKAFLQHVRRRPRDHMAPYAVGRKAESP

SEQ ID NO: 958751 - protein, 107 aa, Homo sapiens
GPEKSYNLVILTCYIAVRYLFYVRYVGFFVCPFVVSSEESHSVAQAGVQWRDLGSLQPLPPRFKRFSCFSLPRSWDYTYVPPYLTKFCIFTRDGVLPPLGRASLQLL

SEQ ID NO: 958752 - protein, 48 aa, Homo sapiens
AVNRARYPKVETLQPGSVDKDVASSQVAVHIVHLGQVLHAGSNAPQQA

SEQ ID NO: 958753 - protein, 35 aa, Homo sapiens
KLDDRRYAIVYDADFQVLASGNPDMIDRDLSSLSG

SEQ ID NO: 958754 - protein, 40 aa, Homo sapiens
QVATDVLGVGRRLHRRRFVQRPVVRGLFAQGSAHQAVLDH

SEQ ID NO: 958755 - protein, 46 aa, Homo sapiens
KAVNRARYQPCFTMCSMRVVMRAQPSAVRSGTPRKWLSVLCAQHQG

SEQ ID NO: 958756 - protein, 37 aa, Homo sapiens
GITLDQPRRFVLSNGHACALQYIMLHLMGYDLTMDDL

SEQ ID NO: 958757 - protein, 134 aa, Homo sapiens
SESSSCTVCQRVLAPPPAAGSRPACRRAACSAPGRPPRGGPGPSARRAVPASSPATPGAWTHGRSPSWRHTPPAGSAAPARCRTRTPASLRANAGTPGTGGRPGAHRPAPAGRPWAVRGSRVPDCAGWPVTTVP

SEQ ID NO: 958758 - protein, 46 aa, Homo sapiens
PGGLGGARCRIWSKLSVAVQVMNALLLPIVLGFLFLLARRALRGPH

SEQ ID NO: 958759 - protein, 105 aa, Homo sapiens
AGIMGVSHGARPIDPFQQAQRDEATRPRSSASRGSSGTRTQVSRTPNLDSLLHDTHEAHSSLWDFFNIGEPKETREALKGPAETVTISGSIEVQDSGWFTPDLPA

SEQ ID NO: 958760 - protein, 38 aa, Homo sapiens
LRCTHSYPPWLAVSTSGWGSPASPGVAAWLHANCTWVR

SEQ ID NO: 958761 - protein, 114 aa, Homo sapiens
MSLEYPLLGVLLSDFAQNADSGMINKVQAEVVSDGDEKLVGNWSKGDSCYVLAERLMAFCPCPRDLWNFELEKDVLGYLVEEISKWQSIQEVTWVLLKVFSFIGEAEQKSLENL

SEQ ID NO: 958762 - protein, 41 aa, Homo sapiens
RVLSRRTLHNPIQTPFFVCSVLITASPYLLTIISQFPYGLG

SEQ ID NO: 958763 - protein, 35 aa, Homo sapiens
WPSTKSRSDRWVVLEATVAISWSQLLVDFRFVTAN

SEQ ID NO: 958764 - protein, 68 aa, Homo sapiens
MVELFGEIPMPFRKSQAATYQNRLRKTPAIPSPLARRMGYTLRGALQIRSDLETPSRPSAKVPKLWLS

SEQ ID NO: 958765 - protein, 100 aa, Homo sapiens
TLKAPPSRNGFRFRVPYGTLLCVSDKPLHGEIKLPGMANHFYRERVDQHLRIGIRAVEILRQQRMDRLHSRKLRSFAEVAFQSQSGVTLARRITSPHFLV

SEQ ID NO: 958766 - protein, 39 aa, Homo sapiens
WNESNGMGSNGLERNLNGTEYEYDSNVMDCYVIDSNGME

SEQ ID NO: 958767 - protein, 59 aa, Homo sapiens
MIELGTLLLAVMFKYFYKEMYSHVTYVINYNRKKKTEKAKEINCYSSPFQAPCRLPSNP

SEQ ID NO: 958768 - protein, 45 aa, Homo sapiens
MECEDGRIGTALVYSSQSQRQTLKVSDGNAELTRLLRRSRYRGST

SEQ ID NO: 958769 - protein, 63 aa, Homo sapiens
SVAQDVASAIKLFRGELFYDTEKGIPYWTDGAGQLPPLALVRERLRAAALTVPDVADAVPTIT

SEQ ID NO: 958770 - protein, 51 aa, Homo sapiens
CDSKDLTIVSGSSPSCTALAIPRYVEPQHYIDHKQCQRDKATPGGSRIRIE

SEQ ID NO: 958771 - protein, 34 aa, Homo sapiens
RHLEIVNLDYYLCETCYSLNSVLLNHLLMIGTKQ

SEQ ID NO: 958772 - protein, 137 aa, Homo sapiens
CWYSLSLLDLWFSEWKFSVIIVSNISSVPFSISSTSGILIMCMLYLLQLYHSNWIFYSMFFSIFSLHFSVLEVSIEMPSSSEILSSAMTSLLMSPLNAFFISVSVILISSIAFGSFLEFPSLCLQSLLFLHSVYFIH

SEQ ID NO: 958773 - protein, 132 aa, Homo sapiens
DRARYREEESSSSCRDVNQGDFQSTGQTKQPLGVAWLQNQHTKISSIYDVPTVNNLKNQESNPIYNSCKKYKIPRNQSNQRNKSSVQGNKILMKETEEDTKKVEIYSMLMDWKNNIVKMTILLQTTYRFNAT

SEQ ID NO: 958774 - protein, 140 aa, Homo sapiens
EVILLYSLSLLDLWFSEWKFSVIIVSNISSVPFSISSTSGILIMCMLYLLQLYHSNWIFYFMFFSIFSLHFSVLEVSIEMPSSSEILSSAMTSLLMSPLNAFFISVSVILISSIAFGSFLEFPSLCLQSLLFLHSVYFIH

SEQ ID NO: 958775 - protein, 37 aa, Homo sapiens
NSMISSVPRMRERACTFCMYRSRETLARIEAAMICAV

SEQ ID NO: 958776 - protein, 101 aa, Homo sapiens
MTEDRQILVVSFIFEMERLGFDDELNIGSEVKGGTRDKYYGKIEEPLPSLLLFSYTEKLTQDIGNSLSVVTHACNLSYLEAEVGGSIEAMEFEISLSNQAT

SEQ ID NO: 958777 - protein, 40 aa, Homo sapiens
ESARYPKCICLNVKRETVTSKPQKRYKHLPNVIVRRGSSS

SEQ ID NO: 958778 - protein, 136 aa, Homo sapiens
ELGTRVAWLLERTLYCIRGRGFRIHINMDRCEKLYVEQKKSDTKSVHTIVIQDIGKFNMCGIEIRTLVAYKMVEIDWKGNWMEGTLEGYKNILFLFPFYEMEFRSCCPGWNAVARSRLTATSGSRVQAILPSQLPQ

SEQ ID NO: 958779 - protein, 36 aa, Homo sapiens
LFLFPVPDAASRNLRHDLTHQIEKLTQPRRIVARPG

SEQ ID NO: 958780 - protein, 49 aa, Homo sapiens
ISSVQGVGWEGSSLTLEHHYAPKFHGRLTIGADDDTATNYLELSSLRFE

SEQ ID NO: 958781 - protein, 38 aa, Homo sapiens
MGNREPCRAKRPLSIITTMSGATEELRNVLFPRQPSNP

SEQ ID NO: 958782 - protein, 88 aa, Homo sapiens
RLASNAVESVENTFTPTALTQVPTDTLERGCTTVTVQNQTRSPLRGISMPNHGILITSRTTLTHLPSPCWTMDTLRPNTADSRCTLAE

SEQ ID NO: 958783 - protein, 33 aa, Homo sapiens
SVYPSVLSLPNISPGSGGSNPCGASSQQSHCQA

SEQ ID NO: 958784 - protein, 107 aa, Homo sapiens
MGSFIKKRGLGGLTVPPGFGRPPILGGGQTRSEGMVYIGDRHKMCVRGTWPFVRSSDLVRFIHYLEISLGKTHPNDSFTSHGFLPTTQGVLGSYIPRLRFGVGPQPN

SEQ ID NO: 958785 - protein, 48 aa, Homo sapiens
LLVFTPLLCACASSACPCRWRPLQVGACVFECGCVAAPPTGAPLQRRP

SEQ ID NO: 958786 - protein, 48 aa, Homo sapiens
SDAAVTLRIPSLVSLMVVIPGKLASDADVWSFQCKLPSRALSPSTTKQ

SEQ ID NO: 958787 - protein, 39 aa, Homo sapiens
AGVQWRKSAHCSLHLMGLGNPPAPASQVAGTTSVRHHSR

SEQ ID NO: 958788 - protein, 38 aa, Homo sapiens
MHHISLYKPEANDPEMVAAGQLSFFHLNRDVRPAGWSG

SEQ ID NO: 958789 - protein, 49 aa, Homo sapiens
STGLLVLVEAARHGTCLLRPQVQELYFLALVELPEVFFLSLVNNCERSG

SEQ ID NO: 958790 - protein, 110 aa, Homo sapiens
MVKQSLYGSMCHTEQNVNMMRKMGDIKKSSSLQSSGKSNMTNVFLQPVETSRQNVAVTALLTTFSMELGEERRSLQRTECTQGAAEMWLVWGQTAEQDQFRNEGKPGMFL

SEQ ID NO: 958791 - protein, 61 aa, Homo sapiens
MAASCTSTGKPRLTICDVSDASHWSLLPPQWLWVFSALIWNGLYVLPVSHIDLDPQLRPWH

SEQ ID NO: 958792 - protein, 70 aa, Homo sapiens
KDEEEEEQGLRSREQEPDKESGASEDEIVILSQRRQTDKITHYMIPSNEMSRNGKSRDRMQVHSCPGLGE

SEQ ID NO: 958793 - protein, 37 aa, Homo sapiens
MQRTACSLFCLCGAGAGGGVAAATAVARFWRRWAQIA

SEQ ID NO: 958794 - protein, 37 aa, Homo sapiens
PFAKPCWLPGPGGRCWGASGMVDSSASRSASSPGLQR

SEQ ID NO: 958795 - protein, 33 aa, Homo sapiens
SGFSDTSCSLRYPRPSTDYWPQTKKLGKCARGG

SEQ ID NO: 958796 - protein, 105 aa, Homo sapiens
MGLPVYATDWILTLRDLMTLPCLGLPKSWDYTALRHRRPANINVSFGNDLSRAAQIQLFTYGAYVTAPVGQVATYSHPHGPCLGHPPRRFKQKSLWPQHFQRVRA

SEQ ID NO: 958797 - protein, 49 aa, Homo sapiens
LGTDQHAPGETAAHALELSVSPRWMRPVRTAWPRASGMEAAEVRADHPN

SEQ ID NO: 958798 - protein, 42 aa, Homo sapiens
ESHHPVDLTVACKIHISLLYLVYCFISPCVLSSLGYQTNCRS

SEQ ID NO: 958799 - protein, 62 aa, Homo sapiens
TVTNVHSEHLRAPDNLLYIINQDTESSFCHQHISDLHTSKTCYYPFNEEKQNKTPKNKPTKP

SEQ ID NO: 958800 - protein, 50 aa, Homo sapiens
MMLAVRLEPEDLELLMQRQGLVTDQVSLARLVERHLPLAVPSSCSSPSAY

SEQ ID NO: 958801 - protein, 42 aa, Homo sapiens
IIIASSSLRVRQTELNNRALSVSLHVSHMALVVTAILIQNPL

SEQ ID NO: 958802 - protein, 61 aa, Homo sapiens
MGVEAERRIPTQTCEEDHSTRCRQSRPEKKHFRNGELATKYNLRLFFTTYLLQRMLDTVLH

SEQ ID NO: 958803 - protein, 37 aa, Homo sapiens
GSRRSVLICIKKKKSKQLHAPNVQLKFPVKGSNLIRD

SEQ ID NO: 958804 - protein, 87 aa, Homo sapiens
MMLGGWCEELEKYVRGRVPGGDRKVLKPGHYWAGKTELPLYAQGMSSCRYSSGRCRSTSTCSETWSVTRPCRRVSSSRSSGFTVLWP

SEQ ID NO: 958805 - protein, 83 aa, Homo sapiens
RCYMLGVGELENIGGRVPGGTGKFEAGYYWQEDRVALYAQWMSSCRYSRCRCRSTSTCSETWSVTRPCLRISSSRSSGFTVLR

SEQ ID NO: 958806 - protein, 63 aa, Homo sapiens
RCYMQHLYKDRHYEDLLRVCVSLREGTGTVMGAELRHVLATLGEQMKEDEVEALMAGQEDSNG

SEQ ID NO: 958807 - protein, 79 aa, Homo sapiens
VGRRGAMMLVLFDFLGTTTGFHHVGHAGLKLPASSDPSTSAPKVLGLQVWATALGLVFFFFFFFGGDSLKVTGRACKWG

SEQ ID NO: 958808 - protein, 66 aa, Homo sapiens
GRRVPLLLLLTAVGGCVASHLLCFWDDVLSVVRPTPCGTDLRFTALDDGLRLLYRTLYGPYVCVDD

SEQ ID NO: 958809 - protein, 44 aa, Homo sapiens
PTPRLLISGSGPPPFVAEWRRQHLGNGTSCSLACTLLCAELAMM

SEQ ID NO: 958810 - protein, 35 aa, Homo sapiens
YTSTHPSPHCITLPIQPTISPSSVHQPILHPNTPV

SEQ ID NO: 958811 - protein, 35 aa, Homo sapiens
HISTPLSTSITVNTLHTHSHTVHISTHNSTKWRHP

SEQ ID NO: 958812 - protein, 63 aa, Homo sapiens
RFATLELSYDPDEPPRVKLLDIDTRLGRCRWRNCAPPERLGVVPLNVRRPDLLAEELTPGFAD

SEQ ID NO: 958813 - protein, 55 aa, Homo sapiens
DLEDLSRICDTSSSEVRRRYPEGKIILDVDINKDSRVETTLAGSVINTKHVKDPG

SEQ ID NO: 958814 - protein, 35 aa, Homo sapiens
VCETSYRIDLLKDAAITTVLRSTTEYLGLSRALLL

SEQ ID NO: 958815 - protein, 39 aa, Homo sapiens
MDGAIKRYGEITESLQERNGSRIADNIRILDIQDYLTDC

SEQ ID NO: 958816 - protein, 68 aa, Homo sapiens
RICDTSSSKVRRRYAGGHIILDVDSTRTAGGDHACGIANHTKHVKTQVLLENGGTVVIGGIFERVDRD

SEQ ID NO: 958817 - protein, 36 aa, Homo sapiens
PQGFCETHPVELLKMPRSPPCAVRRQYLGLHVLSVD

SEQ ID NO: 958818 - protein, 58 aa, Homo sapiens
RSTARGCAITTVRRSRRGLGLHVLGVDRDAAGVVSPRVSLLMSTSRMLLTSVVICVVT

SEQ ID NO: 958819 - protein, 44 aa, Homo sapiens
LKDCCELKLEGTPQIRRSENHPRRDINKDSRAETTLAGFGINTK

SEQ ID NO: 958820 - protein, 41 aa, Homo sapiens
THRDTCRIWTQLQEREEGRRNRLSKGKIQREEQYKDARSTV

SEQ ID NO: 958821 - protein, 60 aa, Homo sapiens
MLEVRAADHAGGYIILDVEQSTRTAVGETIALRASRPNTKHVKTQVLVENGGPVVIGGIF

SEQ ID NO: 958822 - protein, 82 aa, Homo sapiens
AGCLRNLFLTIFIDYMFHYTSTASSSKSRYQYRASIHGPGFMETLQKASRIYYGSTIRNSSDNYATAETLVADPLNWAQPDT

SEQ ID NO: 958823 - protein, 74 aa, Homo sapiens
RIVCDTQARSHAADHAGRNIILDVDVNKDSRGETTQCGIAINTKHVKTQVLVRERRHGGDRRHLRARVDRNEVV

SEQ ID NO: 958824 - protein, 35 aa, Homo sapiens
SRIVCALTPVDLLEDCADHHRAPFSAEYLCLHVLG

SEQ ID NO: 958825 - protein, 37 aa, Homo sapiens
EVIRSIGWPSFPGDTRRSASRVMSVRAARRHESQYDE

SEQ ID NO: 958826 - protein, 40 aa, Homo sapiens
CDNSSGRTARRLRRSPPCSVREQYLGLHVLSVDRDAGRYG

SEQ ID NO: 958827 - protein, 33 aa, Homo sapiens
ARICETHPVDLLKDCDDHHRAPFVGQYLVFTCL

SEQ ID NO: 958828 - protein, 48 aa, Homo sapiens
SRVAKLKLEGYAAITPEENSSSRWLQQGQPGETRLAGIGIRTKHVKTQ

SEQ ID NO: 958829 - protein, 34 aa, Homo sapiens
QPAKEPVLGAGRGEIRLSEGLIKHFNGEGKQCYN

SEQ ID NO: 958830 - protein, 73 aa, Homo sapiens
HARSYAADHAGRNIILDVNITKDSRARPRLPDSDQHQARKDPGTVRDRRPVVIGGIFSKVDRDKVSQISFQGT

SEQ ID NO: 958831 - protein, 33 aa, Homo sapiens
RIDIWPGLVVAITIPLVLAITFVVMYYWGVGLH

SEQ ID NO: 958832 - protein, 35 aa, Homo sapiens
MRDHHRACSTSTWSSRACVDRDAADGLPRLLLLMS

SEQ ID NO: 958833 - protein, 33 aa, Homo sapiens
MLEVTPHIRRTEHHPRGDINKDSRCETTPAAIG

SEQ ID NO: 958834 - protein, 67 aa, Homo sapiens
ARICDTSSSKLRCRSRRRENHPRRDINKDSRGETTLRIRINTKHVKTQVLLENGGTVVIGRHLRAGR

SEQ ID NO: 958835 - protein, 66 aa, Homo sapiens
QNCCDTVKLEVTPQIAPEGTIILDVDINKEQPGETTPAGIGINTKHVKTQVLVENGGTVLIGGIFE

SEQ ID NO: 958836 - protein, 42 aa, Homo sapiens
LRSPRCCNLKLKYAQIRRRHLSSRDFNKDSRGRHACGIRINT

SEQ ID NO: 958837 - protein, 33 aa, Homo sapiens
LRHLIPVELLKMPPITTVPPFIDMYLVFTCFVL

SEQ ID NO: 958838 - protein, 67 aa, Homo sapiens
QELRHSSSKSRRRYAGRHIILDVINKDSRGRPRLRDRITTKHVKTQVLFENGGTVVIGGIFEQVDRD

SEQ ID NO: 958839 - protein, 70 aa, Homo sapiens
CCNSSSKFTRRYAGGNIILDVCINKDSRARPRVRIRINTKHVKTQVLFENGGTVLIGGIFEQVDRNKVSQ

SEQ ID NO: 958840 - protein, 62 aa, Homo sapiens
DSASLKLEVTLQITAGGNIILEWASTRTAGGRPGLPASRSTPSHVKTKVLVENGGTVVIGRH

SEQ ID NO: 958841 - protein, 50 aa, Homo sapiens
ILRHSSGRLLEDSRSPACAFVDSTWVFTCLVLTAMPAGMFSRLVVLVDVH

SEQ ID NO: 958842 - protein, 37 aa, Homo sapiens
CRIVCETSSRSTCSKIAADHHRAWRCLDQYLGLHVLS

SEQ ID NO: 958843 - protein, 53 aa, Homo sapiens
VTSSSKSRADHAGGHIILDVDINKDSRGRQACWIGINTKHVKTQVLFENGGRV

SEQ ID NO: 958844 - protein, 62 aa, Homo sapiens
LFATQARSYAQITPEENHPRRGHQQGQPGRHACWIAISTKQVKTQVLFENGGPVLIGGVFEQ

SEQ ID NO: 958845 - protein, 56 aa, Homo sapiens
SSTFPGHGSPSRPQSPEKRIVCRPKVVVIERPECCRRFADSTRIRTRAFDRPFPGD

SEQ ID NO: 958846 - protein, 38 aa, Homo sapiens
INGKIKIRKASLPDQQRWDLLLGKQLDNGRTLYYDYNI

SEQ ID NO: 958847 - protein, 32 aa, Homo sapiens
PRDYFYVADLAGAEIDVPSYLADLPGIATTSC

SEQ ID NO: 958848 - protein, 140 aa, Homo sapiens
CIVSGSVDLQNHGEASKRSIPVLGYAAVPKLGEVETPSPVEPDKDNIRQEPYTLTQGFTWNALDLGDRGVLKELYTLLKENYVEDDDNMSRFDYPPEITNVGSHGHPIVSPSGTVGYKVASSREMGWVHKRHPSKHPLSM

SEQ ID NO: 958849 - protein, 43 aa, Homo sapiens
NRAVVCPQVIARTDGHAVTWRARHDGLEFRLHVFLVQVEVDNA

SEQ ID NO: 958850 - protein, 32 aa, Homo sapiens
FCLVTLRIRVVPVGVAVGGVEGAPGIHGGRVG

SEQ ID NO: 958851 - protein, 38 aa, Homo sapiens
MTNTSSAWRLVASREVDVKLRDKGFIISMIITVLLIVA

SEQ ID NO: 958852 - protein, 49 aa, Homo sapiens
MYLHGHVSNARNDEYDQANLVSLAIARSTNELRNLFEEFRFRKTHRERT

SEQ ID NO: 958853 - protein, 38 aa, Homo sapiens
VDLEDPDPRLVFGAMASPRFRRLRHGVRAACAFGVGGL

SEQ ID NO: 958854 - protein, 62 aa, Homo sapiens
DRVLASVPILRIASAGGIPASANNWANLSRVKGVLRYSTTSTSTPGVSSRIASVLRDVPHLG

SEQ ID NO: 958855 - protein, 32 aa, Homo sapiens
PACIRLATPARPLDGPSPVRMHHGDVVGLQLR

SEQ ID NO: 958856 - protein, 173 aa, Homo sapiens
PAGQLSNVPPYLLNIVVIEANWSDWLLWMLLDGLSPRTFWYFWTSCVPLVLLRKKGFVILVMTEDRIERTGEVGAVGPPAFAGEKGPSAEAGTAGPPGTPGPQGLLGAPGILGLPGSRGERVLTRCKTGAVGKPGPLGIAGPPGGPWSLLVLWVVLESTGAPGEAGRDGPPWE

SEQ ID NO: 958857 - protein, 34 aa, Homo sapiens
NNDVFFKLPHSLLKAQLISFSIPQMNAVVPELAI

SEQ ID NO: 958858 - protein, 47 aa, Homo sapiens
LADARPVLFQRHQKLALNQAGDVRVGRQLKLGQGAVVAQAPGLGRIE

SEQ ID NO: 958859 - protein, 91 aa, Homo sapiens
ANIVRSHRGQQWIRALSFGKVCGFDEPGSDAHVVRKSLKSCIPRDGRSRLTVLTGCRDCPGGSYMYTLANGHYRSANAATVTMDEAMSEKE

SEQ ID NO: 958860 - protein, 67 aa, Homo sapiens
LCLGILCVCWAILFFSPGPVIACRAASILAHILFRSQHSSLPSNHKSHCHFIVIVHISIYTAFHSST

SEQ ID NO: 958861 - protein, 33 aa, Homo sapiens
ACCLRSDTSLIKSSHKASVIVECRHYQGIVLFR

SEQ ID NO: 958862 - protein, 66 aa, Homo sapiens
EDPQRNSELSLSFQFCLTKEIIILEMRKWRWMIKPNHVSHSTVTCRTKLTEGNQRCIVAQQKAHQA

SEQ ID NO: 958863 - protein, 40 aa, Homo sapiens
PVRAAGSFEPCSCPGSREGLEVAAVLRIRAESGTKGLFTG

SEQ ID NO: 958864 - protein, 42 aa, Homo sapiens
LISAGIPFCSININSTHTGPGKHFLPCASSGSPQLAHSVTSM

SEQ ID NO: 958865 - protein, 44 aa, Homo sapiens
MAWCKLQASFEPTAALSPEKASHSCVLLAEDRAESGTKGLFTGH

SEQ ID NO: 958866 - protein, 38 aa, Homo sapiens
TLRVIPTGGERRYSDDRGLVLQEGSGALPPCHYSCSPA

SEQ ID NO: 958867 - protein, 36 aa, Homo sapiens
GGEELGRLRLVLLELNFLPTTVTKLSQTAAEFWRVT

SEQ ID NO: 958868 - protein, 108 aa, Homo sapiens
CAGEELKQDSMVPGRTFLAEANLMKQLHISDVIRLYASVTQEPIYIITEYMENGSLVDFLKTPSGINVDHQQTPGHGMPRVAEGLGFHLNDAVIIFIVTFGLPNILGG

SEQ ID NO: 958869 - protein, 65 aa, Homo sapiens
MAGESADSGKIIPAIARPQQPCKACVSGAVQGCAGSTEQVDSYKNGFLNLDLPFYGYSEPLAEHV

SEQ ID NO: 958870 - protein, 42 aa, Homo sapiens
RRLAATECHRPSTIRNLAVVAPEMQVKVLQSLGLKSTLFTWP

SEQ ID NO: 958871 - protein, 45 aa, Homo sapiens
ERSALPPVSPLKAALSEEELEKKSKAIIEEYFHDQLSGIRLRACE

SEQ ID NO: 958872 - protein, 33 aa, Homo sapiens
YLFFHHSYLSTSDLKCWLPPVYSSSKHVLFTGH

SEQ ID NO: 958873 - protein, 34 aa, Homo sapiens
MHVYVAMCHLNCCLVVTKLQIIKSQLIRKFSETR

SEQ ID NO: 958874 - protein, 55 aa, Homo sapiens
MGTMRSRRLAMGMLLRRGIEPLTVKVLQFYSDYLGSAILKQTLFFGRVSGIITKV

SEQ ID NO: 958875 - protein, 62 aa, Homo sapiens
IRLSWHITIMPSKENSDLTISGCAQWLMLMIRAVWEAEAGGSPEIQDFKTSLGNIGRPHHLV

SEQ ID NO: 958876 - protein, 71 aa, Homo sapiens
FTCGDAIAPVSPVRVLRVSVTLSLLRVPTGLYSLLQTCGIGLPWYYHLTFSFGTWTLCFRTSVSACLVLLR

SEQ ID NO: 958877 - protein, 62 aa, Homo sapiens
MKEHLGFQHACGPEGWHSSRNRKSHLPGHLSLVSLDARTAGATLQSGVVIKSLRTYTIYTSS

SEQ ID NO: 958878 - protein, 100 aa, Homo sapiens
EVIPPGADETALLGLTLEVVSHKVQSVIRFSAGDLNQGDSLNGFHHVWIALERFVERGFGFVQASLAKIQFAHLFIAYGLCGIPSINRFKSNSADAGSLW

SEQ ID NO: 958879 - protein, 89 aa, Homo sapiens
LRSTPDQEAGSLSACAMPLPSGFSGFAEERDASFQRALDLGVVRLVTICTRVRKFDGIIGIAERYDSVFASVGTHPNNAHEELDVTAAD

SEQ ID NO: 958880 - protein, 68 aa, Homo sapiens
SEQPTLHYTPSRCSECGKHFRCDSHLASHQSVHAAGNSCTGQEAGESPGARKRQRAVPVPKCHVCTEC

SEQ ID NO: 958881 - protein, 35 aa, Homo sapiens
MSMRVHDAVALGAPSAARAVHADRMHLVDIGHRLV

SEQ ID NO: 958882 - protein, 73 aa, Homo sapiens
RLTVRLISSATWAAGLSSRISRTLASAAPSAAYAECCSAARRAVIDDYLVFTVPGRFRLRPSMRMQVCGLRCV

SEQ ID NO: 958883 - protein, 68 aa, Homo sapiens
KGDRRKIKGKDEKEEGGGGEEEEEDEEGGEEEGRKGMNQIVRAWLKNPGVLPLAYQEFLVWEWNVGHG

SEQ ID NO: 958884 - protein, 46 aa, Homo sapiens
VYGDTRSIHAQAIRLARDRGITVQVGDAVLIQQRGAAFGPAVVAVL

SEQ ID NO: 958885 - protein, 42 aa, Homo sapiens
MWYIMYHMVCCLCGYVCGMFVQCVVVCVVCSVFVLCQCVCGM

SEQ ID NO: 958886 - protein, 53 aa, Homo sapiens
LLPVFPATRKAEAGEWSQPARRSLLAESRDGSTDTPALNDKAETLSQRKETQR

SEQ ID NO: 958887 - protein, 109 aa, Homo sapiens
KLTQFEMERSGMHLNGLEWNGMERNGTDPEWNGTDPEWNGTDLEWNGTEWNGMEWNEVDSNGMEWDGIDSNEMGWTRMEWNGMESTRVEWNGMEWNRMELTQFKRDESE

SEQ ID NO: 958888 - protein, 44 aa, Homo sapiens
TETAYTLEEEAVSVQREEEYEVYEEYDYKEFEEYEPTEEYDQYE

SEQ ID NO: 958889 - protein, 34 aa, Homo sapiens
EYRGSPCAAYDESSVAYSPELVSNLASLLMQLNL

SEQ ID NO: 958890 - protein, 137 aa, Homo sapiens
YQPKTELGQTGYRKTRNGSTTTVCRYWNGYNNAVPKYSLRLLFSSFLMGEIAAATIFKQMHYNSRELVFPEAFRNIGRDEGRHMAICMALMERDYPKLPVEDKALVTKQIRAGYLFLSAVLFEPPMEFQDLPEDFIP

SEQ ID NO: 958891 - protein, 34 aa, Homo sapiens
IYEDPPVLPYDESSGLIARAGEQPGIAADAALIS

SEQ ID NO: 958892 - protein, 205 aa, Homo sapiens
PADSRMFTRLCLRRRAVRRHDFVCGFAEPIAATAANAAAAATRTPLPVVLTTILGCSTLSRLACPTRLARLTGTGPRANTAAWPSPSTSCVTGCRNDGRANKCAHKISSNNCGEVAPRICGNRYVYYVRIMRQRLRAKPPSLFLQHRHAILRGRHQPLIESLGHSLDYQQIPQAVQQVFHETAWLVPSIDDVVDERNNSPFSSSA

SEQ ID NO: 958893 - protein, 80 aa, Homo sapiens
MVESEKHDGGQPMDAPEQRKPFGSYASDGTEVFSFLRQFLPGVGVCLHGEACSYDMSPDEDFIIDTLPDCDRLMVISGLS

SEQ ID NO: 958894 - protein, 94 aa, Homo sapiens
MTSPAALRSSPNETKACRHERNRHSHAYRRPRRRTAIACYTLWGLLPLLFMAMAAHGFTAPEILAHRAVWSVFIAAIVLLLAGQSAEARKALSN

SEQ ID NO: 958895 - protein, 90 aa, Homo sapiens
LAHVSPANRMWTPGAGCERFPAQALPNLAIEANATKPLEALSNILGDFPGRVLFTAESAGRREVLLELLERLKLRAKTVESWPDFVASKD

SEQ ID NO: 958896 - protein, 33 aa, Homo sapiens
WLTWSVERLEREAGSSHFMSKGLVLLSEETQSD

SEQ ID NO: 958897 - protein, 40 aa, Homo sapiens
PIFADVVAEVCGLQQRVNPKVWDFYTEETLALRALPYDLG

SEQ ID NO: 958898 - protein, 35 aa, Homo sapiens
NCCSLMYMHAVAGLPLSSGRRSIHATLLRTTPVAT

SEQ ID NO: 958899 - protein, 71 aa, Homo sapiens
VRHTQHVTQSVGKGAWLARSMPLTLGGWQSGVQTDLVQWSSAGYLWEPYPEQWAVSCPLYPPWKQSMQIDQ

SEQ ID NO: 958900 - protein, 45 aa, Homo sapiens
MLQHVVEWWRLCEENAGMSSEKKGEKPFRRMTKVLGLGYSALGKS

SEQ ID NO: 958901 - protein, 72 aa, Homo sapiens
SILSHIWSAGSFFMMALMIHSINLYYSLSASLLLGTQNIPSSPYTLSVPALASAISLCTSDSFSEEYLENKL

SEQ ID NO: 958902 - protein, 86 aa, Homo sapiens
VIAQKVKAGVVNGTGAPGQSPGAGRACESCYTTQSYQWYSWGPRCSGLGGRGDSCYCGLVLASLHLTGLAFSSHHISSNMSNKMRR

SEQ ID NO: 958903 - protein, 63 aa, Homo sapiens
MFGQTCRGLYGAYSVSRRIFYVQRFRRLRRRCRARGTLTSSAGFADTHIDIVALNTASPCGFA

SEQ ID NO: 958904 - protein, 35 aa, Homo sapiens
ISSQLCVPFGVISLVISAEPLASTNGPVGESDTAT

SEQ ID NO: 958905 - protein, 42 aa, Homo sapiens
VWMGFYGPESKRKFPSQCVKAPVPSVTLSNAQLKSIQSMRRS

SEQ ID NO: 958906 - protein, 163 aa, Homo sapiens
HPSIADTRFENLPARRSSASICISFITSTGQGKWVRHNGIVLLAAPMAWKAWAQSTRQGAPKGFLQIINVWTRMPTPAFTKYFEGEPAQKPRTSVTPMKEPGCHTVYGAWSTAKDLIHRAHTVTCDSTILALQNMVPVTECALLPILPVDPNVDAFLQAGKPK

SEQ ID NO: 958907 - protein, 39 aa, Homo sapiens
LLALQQSTYAYNGFKQGKDSIFNKQDTISEGSRGAHSII

SEQ ID NO: 958908 - protein, 36 aa, Homo sapiens
PKEIFNTVNHANTINTISEYLNHLTDASLQRDITLE

SEQ ID NO: 958909 - protein, 115 aa, Homo sapiens
MSRNASNLLVPQNSHSPGLLKHTSIMVNLFNLMSCFTLRLWKKYMLSILITYCTVTSVVLVYNCHLIFHLFMYVLAYLKRHHMSWYFLFFFLEPDLGSFTQGKRAEKKPGNSLKS

SEQ ID NO: 958910 - protein, 189 aa, Homo sapiens
RSLTRGSSWSMQLAEVCGRQACVIVTKASQSITSFCADYIERTWFWSISAQSQRQMHQMQDPGLMSSIRAALGLPLCQQNLWIAADGVSQLSGPGRPFGNPWLLGHNILGTTKKAFHLSFGKEEQLRLWVAHVTIWKPAGSQQTRKSCIHSSPSPFGRKGMAWVGGVYSWVLAQLLIRNSLLFGCWKLG

SEQ ID NO: 958911 - protein, 87 aa, Homo sapiens
SRGSLAVVGDLICTIESCIPIHATTPVLFSLDMKRITRMYMRDENEEKEVGMVSRQSDIGNKNDGRTHSIQSVPSMLILDDEEKRRI

SEQ ID NO: 958912 - protein, 32 aa, Homo sapiens
MEETLISEEMRGNLCNESWSWQQGMDPIEAQI

SEQ ID NO: 958913 - protein, 138 aa, Homo sapiens
RLVDRASLRLKTKQKTRKLPKDPFSYNIIPCGDATLTVRGFWAMTLSGYFLLKRGVEWETAARAPSGVDPRVFGGMAGLSMCGSVYGTIWSLIASRREEIFRVIVLTIRGPNISTTRISKRVLSKGVNQFHKEVQETK

SEQ ID NO: 958914 - protein, 62 aa, Homo sapiens
YDRCTHQTTDYTAHNAQILGKHELKKKTNPLISTWAYHKVRNKDFTLSMNTITEKPSNEGYE

SEQ ID NO: 958915 - protein, 44 aa, Homo sapiens
AVIIQIEEILRNLADHHCWCTDFFIMRVMDTRVLLAFFVKAASS

SEQ ID NO: 958916 - protein, 64 aa, Homo sapiens
MNTVQLVLPTLYPTFGRLVKDIEYTIRSTLNEIYFRKTKGIVYGLRSCAYFCRPVNTRSSEWIA

SEQ ID NO: 958917 - protein, 57 aa, Homo sapiens
KNARKPDLVLKSLCLCRPPRLDIFIRDMATGTVTCVLGASTVTWVYTMAGHTRPSGE

SEQ ID NO: 958918 - protein, 41 aa, Homo sapiens
MLIQEVIVTQDFVSHPSKPRPHRIKVAEEMCLSQDHPVNGA

SEQ ID NO: 958919 - protein, 37 aa, Homo sapiens
LTLEYPSEFATTSLRNCTWIYHVAQVGLEFLSSSDLP

SEQ ID NO: 958920 - protein, 48 aa, Homo sapiens
PDRGLHEDNRKIWKSKEKVKCGHICFVLAARHLGTPTSLINMEKPSNS

SEQ ID NO: 958921 - protein, 122 aa, Homo sapiens
IIVTELLRVVNGMPLAGCYCCEEGPIGFQRQRMTSWSESPRYHSSNIICGNLSRLALMLWIPWCHLRRGQRELIIGDRQIGRTPAAIDTYSVNQITSRLMDPDETEEAVLYLCCYWSKEIHC

SEQ ID NO: 958922 - protein, 37 aa, Homo sapiens
LDICEEFAEYNARQATYGEKKDESVGAHEQLQLDHVH

SEQ ID NO: 958923 - protein, 82 aa, Homo sapiens
DIDGFSLEDSIFLKRGELRIPTNKNLLRGRAQWRTPVIPALREAEGGGWLEYRSSRPAWATWRNPISTKKTQKLAGCGGACL

SEQ ID NO: 958924 - protein, 45 aa, Homo sapiens
EDPRFSFLFSMKSSSISACLTVRWNPSRRKPLFAQGGLQILLNEL

SEQ ID NO: 958925 - protein, 50 aa, Homo sapiens
FWHSCQVSATVSSPGSVPASLGTFQPTHHSTGSGPRGPAARTFVTSMVHQ

SEQ ID NO: 958926 - protein, 40 aa, Homo sapiens
TEYHLSYGGLSLELTSSETNGRKGEMLTQQSEEDFQQLPR

SEQ ID NO: 958927 - protein, 47 aa, Homo sapiens
DDHYSIINNSTVEILSICWLAVVAITPATPSTAVEANAVRITYEDQV

SEQ ID NO: 958928 - protein, 102 aa, Homo sapiens
MRSRSKDPPQDTSTSSWVTFCSIKVVCVISSESFSHAYSQVISLLLEIGYSLLEVLLFQVLISLLLVLSMLACSNPGISPGLCSGREEVSDLCTLLADGSMD

SEQ ID NO: 958929 - protein, 36 aa, Homo sapiens
PSTVLKTTEYAFSSSAYGTYSNIDHTIGQETIFSKF

SEQ ID NO: 958930 - protein, 60 aa, Homo sapiens
MVGTLNQHVPRRPVPVYEPDILQVAHPLSNLDSPVQQVLGTHAYAVFRAMVYEAALGHKL

SEQ ID NO: 958931 - protein, 34 aa, Homo sapiens
SGCDDCWHHLSSCRLTCSSGLTLVKSRHHCQFLQ

SEQ ID NO: 958932 - protein, 150 aa, Homo sapiens
SRGLPPVTLPQTIRGINLHLNPSNTRVSWNPTFNLKENSHTGQAQWLHLIFCIFIETGFHHVAQTGLKLLTLGDLPTLASQSAGITGVSHHAWLLFIIIIFCRQSLALSPRLECNGMISAYCNLCLPGSSDSPASASRVAGITGMQHHMQ

SEQ ID NO: 958933 - protein, 75 aa, Homo sapiens
LTETRSRPPRTPAQSYTGARGRAEVVARRARALNCSNHQSLLSPLGTELQFDEETGEGRIEEEVLLRKTWIKIAM

SEQ ID NO: 958934 - protein, 52 aa, Homo sapiens
DHLDAAWRMLDGVCLPNHFGADVLVLEPSNLYLIYPYVHDAGCVHCLKLNRT

SEQ ID NO: 958935 - protein, 63 aa, Homo sapiens
DSRVSWYPDQLRQIVSLASAGSSDHQQRAGRTEGTEKQHITLALEEQKLEEKRSFDSAVAKAL

SEQ ID NO: 958936 - protein, 102 aa, Homo sapiens
MTSDRRYNRHSLHVRYQASRQFGAANEATKSLGRTKQAAKGNAAAVLCGGATPSYPFYEADSSSKYLRAHLLCIGYFAGAGDRAVTKTLFLFLSETLVELMI

SEQ ID NO: 958937 - protein, 43 aa, Homo sapiens
MLSIKSKGGLFALYCRTNAWSLRNFCARNCPRISKKNGYPSLE

SEQ ID NO: 958938 - protein, 65 aa, Homo sapiens
MKPEVPREKLASRPTRPPEPRHIPANRGEIKAHFDYQFGYRKFDGVEGPRTPKYMNNITYYFDTC

SEQ ID NO: 958939 - protein, 102 aa, Homo sapiens
MGGAGFPTVMGSWQVLQYPTSGTSAASGCRRSLCPLEVPLYPLSLAIRILRLFLRLFAVFTLIRSNMLFPIFGRLSWSSRNVLGSSRTCPLLAKMATTMDSM

SEQ ID NO: 958940 - protein, 45 aa, Homo sapiens
EANADWFTSLSLKILSRYNREGGISSSKVQCALTENMHKEPVSIN

SEQ ID NO: 958941 - protein, 119 aa, Homo sapiens
VVNTYSRFHRGIILENEAALILSAESFKSKTRGVPEREFCLETAASHSHWMSSPRPHGWVSPSSPRFCLLFVLSLDPPCGPRPSSEDLPYFFRAALACWRPGLQSVPGCPGACSVTSQL

SEQ ID NO: 958942 - protein, 34 aa, Homo sapiens
DLEDPSIDGSHEYKTMKMWASGHAVLQHFERQRW

SEQ ID NO: 958943 - protein, 58 aa, Homo sapiens
ESTVSRSWAITNKTVMVKAMIEEVEFRVRIRMDQVGTFNANLKLFEKTTKGIDYSWKD

SEQ ID NO: 958944 - protein, 34 aa, Homo sapiens
YLRIPESTVLWSYREQQQAEDRASELCQAGSVSV

SEQ ID NO: 958945 - protein, 57 aa, Homo sapiens
VKITVSVGLASLEGNSPWLVSGIFSMCLHMVFPCVCILISSSYKTTGLTGLGDRVNL

SEQ ID NO: 958946 - protein, 105 aa, Homo sapiens
MQISRKIPPTGGGKINGNKTKNAQPIELRDRNFKTAIINVLHVLKNTSGIQAEGPKERKRHFHLEMKHIIYEKNTVDEISNRLNTKQKKRSVKDIKKLSNMKQKN

SEQ ID NO: 958947 - protein, 32 aa, Homo sapiens
MEMARCLAKTGTDLRGYAYEPAACLNIFSSEH

SEQ ID NO: 958948 - protein, 110 aa, Homo sapiens
MQLDPFCRPPQCLKVLGQDGRGEEDPVSGPEWIVGFLEPRPHSVEEQPPSLLLPSSPGLWLEHCLLHQEYGALTCDEGRDREKNTALFVLSPKKAGLGEGHQHVGPRHSV

SEQ ID NO: 958949 - protein, 150 aa, Homo sapiens
LDSVRGWMPNRSRSGRSNDSADTGTQLSPQPSWLTRCSAVQRSQLGSLCVSLYINLWLKFSKTPRVEFLQSSVQTVQAGDGREVLASKKLTGQAGLLLQDAGEHAPSPQGTGVSFEGVKGHLESVPDTYGIGESATPDYCHLRNSGGCST

SEQ ID NO: 958950 - protein, 62 aa, Homo sapiens
RADNNSKDRKSQPMGLWSTGGRNGGLDSRTNFSKAEEDIFMEHLKDIVEYYNAPVTGLTYCR

SEQ ID NO: 958951 - protein, 90 aa, Homo sapiens
NQPYSGTKETSYSRRATITAALTQASNSMCAEPPPDTSTLTDALEQMQIRTETAPTAAKAQQEPQEPWSLISSMEDTAAIAPVIEEGTEL

SEQ ID NO: 958952 - protein, 43 aa, Homo sapiens
DEAVLPELLLIGNWLSSALKPKRPEIGSCWEGFSEAGEWREPG

SEQ ID NO: 958953 - protein, 69 aa, Homo sapiens
STLESGALQAELEENLIHDMHVCGGGCRRGAKGHHFPDTSSSFRGRNETAVTDHTSPPPICSPQRRQIV

SEQ ID NO: 958954 - protein, 44 aa, Homo sapiens
MTYLTDVCNAVTILDFMSVESSSVGYEFFTYRPQDVRSAPDTDH

SEQ ID NO: 958955 - protein, 120 aa, Homo sapiens
FLIREEGPGPFSSSLKEPPQSQDEVQHPLSVLRVHSTNQNSSFNSCKPGHSIIVLFDLYGQLSSGSQNQSKLEDALDMPYRCCFCHPTLVPDFQSVLYQDLPPPSNTEAPPGETRTEARS

SEQ ID NO: 958956 - protein, 54 aa, Homo sapiens
KLDMVISTRAYANLEGFALRTSPVWWICSAQYIHSPSEPLPMILVDEPSIYRSY

SEQ ID NO: 958957 - protein, 34 aa, Homo sapiens
GAVGPCVLLLNTLGLLYGQPLSAAFIQMLNQLQR

SEQ ID NO: 958958 - protein, 41 aa, Homo sapiens
VVHISAGSRKAEATHRVCNRRNRTQALDCLRGQLQRLEMFS

SEQ ID NO: 958959 - protein, 49 aa, Homo sapiens
RGLLTVLPNATTWASTFACPCDDATSDCDLCVRSSSCVCYVPTYVPCVL

SEQ ID NO: 958960 - protein, 121 aa, Homo sapiens
LYWLVNCSLGLLGAAQVGLDILGDARGVIGEALGGKYFGKTGSVGQIQTQVEGNAHRPRLVRKLLSRVSGDQQQVINAVTVGFERWTPPGPCSRRANLHGFAAPGFVGEGLLRPRKKFRGT

SEQ ID NO: 958961 - protein, 53 aa, Homo sapiens
VATLEDPFVLVFESTKEQKEGQSSDEEVKTMTCQVVVLLLLTEEGEQQRLEQP

SEQ ID NO: 958962 - protein, 94 aa, Homo sapiens
TTWSTPPESTVSFGKRGSESGKKGEFRTPGPQLPIAWGSTPSTFSLVPYPYFQCAIAINLVLGTCYVGLLWVSSVSWFNAWEDASGGNGGLGYM

SEQ ID NO: 958963 - protein, 61 aa, Homo sapiens
MRIPGQRYSAATFLPCHSSGITGRGGAVVRFISAVTSSGASGAQSRKARRSSPAASAGENT

SEQ ID NO: 958964 - protein, 61 aa, Homo sapiens
ASWKDNVVVRGSAQAGFLLTDDDALVFDGDFVAKLKAGADDIQHAAVEVLKGLDDFSADAI

SEQ ID NO: 958965 - protein, 141 aa, Homo sapiens
IPHVRFNWNGMDTHGTNMDWHGLEWNTMELMEWTLMDWNGLEWNENGIDSKGMECNGMDSNGIRTEYDLRTGMELQLDLDHEWDGLEWNWNGMHWNAIERIGMEWNGTERNGTDTERTRTGPGNGPGSGTERDPEWKRNVM

SEQ ID NO: 958966 - protein, 67 aa, Homo sapiens
EIPSKVQLSTSAFHVHSGLSAPRVISNEAARSRKSSRHSESACALKQKLFRGSRNLAPIYARDHSSR

SEQ ID NO: 958967 - protein, 34 aa, Homo sapiens
APRYLGIEKGCPESRPPGTRCRRCSSRIRRSSPA

SEQ ID NO: 958968 - protein, 43 aa, Homo sapiens
LNQPPLRQYSRTRHSHQLLTAAGRLWWHQDRCSQRLSIPPVDL

SEQ ID NO: 958969 - protein, 36 aa, Homo sapiens
IEIKVRWEEVEVEGDGVGGVEGTGQGTVTSGLDSMV

SEQ ID NO: 958970 - protein, 48 aa, Homo sapiens
GDRVPGPGVVRPILDVGKISSLLMHERPAYLYSLEVQLTAQTSLGPVS

SEQ ID NO: 958971 - protein, 35 aa, Homo sapiens
IDDQGTAYIYSRNRRRHTSIFHLSNFHKSCLLCQQ

SEQ ID NO: 958972 - protein, 43 aa, Homo sapiens
MKVIKLSPIFQLDNLSAEIASRFTHKPQCKPRYFKTESFQSSS

SEQ ID NO: 958973 - protein, 32 aa, Homo sapiens
MRTLSADSTQQRKADRYNKELTKERDALRLEL

SEQ ID NO: 958974 - protein, 40 aa, Homo sapiens
GAGQLGGRPLLTELPAVSPSAPGLGALAFTWTNKEMPPEL

SEQ ID NO: 958975 - protein, 55 aa, Homo sapiens
MAIHASQAGKCSTGPHSTGRQLVPIKQFNGCACAGNSGAGTFKILALQAPSIAYG

SEQ ID NO: 958976 - protein, 33 aa, Homo sapiens
MSRRAQTDNACADNIAKASLAQRSTFECAQGPV

SEQ ID NO: 958977 - protein, 35 aa, Homo sapiens
AAGVISRLEEEEQDILAATPRKCLLTLWDKRRDLA

SEQ ID NO: 958978 - protein, 44 aa, Homo sapiens
EYHRAANNMGQLVVQFQSTGQQQGLQGWKPSSFCNLFLEWEPHH

SEQ ID NO: 958979 - protein, 70 aa, Homo sapiens
SSEELRIQLRWAMVSGDFGLDSKSSGSGGSVLGRGGALLAALRSKDSFSCKASRKYSSQGTAILLAVAPA

SEQ ID NO: 958980 - protein, 100 aa, Homo sapiens
QCYGATHFEMIRSHKTHNEYSTKPRGIHPKDPIISQQALPPARGITIQHEIWAGTNIKQYQRWWTAGWRAGGLGYLLFPEVTHLARWTSHFISTCLDFVL

SEQ ID NO: 958981 - protein, 103 aa, Homo sapiens
THWMAAEAEQRGRQALSCSYVRSSFCIRQHADYSAAWRLSGAQVSLYNSPSVPSQLGVVGAVAFLSKQGIFEEDDDDDWDDWDDGMHSGGGATGWWAGHQRAP

SEQ ID NO: 958982 - protein, 35 aa, Homo sapiens
DLRSMKRRLSSILPTVYDKQHPPKIVPIVIMGTAR

SEQ ID NO: 958983 - protein, 33 aa, Homo sapiens
MIAVRLQSELVIEGTVSVGFQQSEDLFTGHRHH

SEQ ID NO: 958984 - protein, 77 aa, Homo sapiens
TLRSMIAIGLLSAAQSPLAPSMDTCEHSCLCTSGTHLIQLKSENRTDSVTSPDPKAHICIMLISLMAMIHTGLIAYQ

SEQ ID NO: 958985 - protein, 65 aa, Homo sapiens
SYLRIHRRRSQERAVRAAVGVLDLQDWAADVQELSVLSSLLKLVLSVCLLLRLRGSRRSEGSVMR

SEQ ID NO: 958986 - protein, 63 aa, Homo sapiens
SGQLNTVVCRCSASTAMGLHALQNSAEPHLDSNCSSWRMKLKLGEMMLRLLHKLKDPHRFIQV

SEQ ID NO: 958987 - protein, 125 aa, Homo sapiens
PEVPLIADTVVCSTVRYKSDLNLPDYSYVLPRVDKWFAVSPTVKPQQTAKQHRLILSMAVAAGGLWMRYTCSMYSVILCKKLRGSLKAIGIVILDSSRPTLFFRMVHTLKSLLLNMGVGSDVLCF

SEQ ID NO: 958988 - protein, 161 aa, Homo sapiens
MTMHSPEQSREKSETVATEEIVECGKASDSEEAGLKLQKDLEFVLKDKLEPQSAEFLAQEERFAAVLKEYELKCRVTCLLCLPFSLMSRLWVSTRRWSTVTQECLLQGEPLFAGMLDHGLATLLDLGFPGSRCHLILKAASVCPGTMQGIVVFLWSCLAFL

SEQ ID NO: 958989 - protein, 57 aa, Homo sapiens
TDLHSHYYSAQQTQTTNALTVRIIILSQGTSNLYSHYIAILIDFYPSPRLTSALPPH

SEQ ID NO: 958990 - protein, 75 aa, Homo sapiens
EDLFSDFVLHRVKARARKVEREIREDTWFYTNPGASCAGGDSEPDEDRIRLRESQPLHEKLPRLAATLSLAGRPR

SEQ ID NO: 958991 - protein, 88 aa, Homo sapiens
MGTTQKARAGDSVLMLGDRRLRAVTAAGFQLTTSWVGDCVCDGYLLISKIREEYPDRIMNTFEVVVPSPKVSDTVVEAYKAGLIRLIK

SEQ ID NO: 958992 - protein, 70 aa, Homo sapiens
ETLKGGDPPPVRGTSGLLTIQELSLPNREELCAKAPPPVFYNKPPQIDITCWDSDPSSITRRRRFHAASC

SEQ ID NO: 958993 - protein, 34 aa, Homo sapiens
TLRIPIGYADRENVRCVGVGVLQRGSLGFRRRPP

SEQ ID NO: 958994 - protein, 167 aa, Homo sapiens
MLILPVLYPQLSIAILVSCLAALDPDEYVLARWCCPPHYMVDSLANGHVYSFCFSPPWNSIAVDLCFCHILHFVSDILLTAVDERARVCARAGPTSIQISVAVLPRAHLRAAEFIEQPENRPEVARILSSPERLGVDASVIQRTLDGCLKISPDGTIRESNRYLLVG

SEQ ID NO: 958995 - protein, 43 aa, Homo sapiens
MGRREGKEVNEKDRKKIESMCLAMMTKPEVIMSAAGEAHKWSL

SEQ ID NO: 958996 - protein, 40 aa, Homo sapiens
MATTLHSRCLPHASETTHADVGQPSPGHRVILYPLIRLYN

SEQ ID NO: 958997 - protein, 35 aa, Homo sapiens
CFVLAWYLVEEMKKREGFELVMEPEFVNVCFWFVP

SEQ ID NO: 958998 - protein, 62 aa, Homo sapiens
RTTGQRTQCLEVIKGVLFRIFIIRAILVGSAEGAPQDRRAREEPTRRSRNLPKDIIMNLHVY

SEQ ID NO: 958999 - protein, 107 aa, Homo sapiens
DLEDPIDERIGAHAEDIHCFALLHSDESGYDIDSDGPSPELWIESNYPQGPCENITLWCRSPSWILKHVLLLKDKTQMTWMRPSHKNLPSSIPYRCPHPLILRGTAL

SEQ ID NO: 959000 - protein, 58 aa, Homo sapiens
PDAAGDLEYPLDANLGGYNVIVTAHAFVIIFFIANTHHNRRLWLLTRFPYINTVPPSM

SEQ ID NO: 959001 - protein, 44 aa, Homo sapiens
LIYMTNILVHPPSSPYEAALANGFIAQMGHYRKFTKDNSLTHKL

SEQ ID NO: 959002 - protein, 146 aa, Homo sapiens
MAKLENEKKKREIAEKEKERIEREKEELMERLKQIGEQTIKGLKGPRRTDSKRSKTWIKNENEQKKKANDFEKERRAAEERKSCHSKTSCRPDEESGAGYQQNLLNSLARIALLEEAQKKKEEGTTEWQHKAFGGPGRLGTDPRRV

SEQ ID NO: 959003 - protein, 48 aa, Homo sapiens
MCPALVRDRQLGDQVMVSELRNKKSEKLLRHCERNSCHTAWKRAQACP

SEQ ID NO: 959004 - protein, 67 aa, Homo sapiens
RAIPSLTLCVRLLEVIKKLLVRVEFEVLREDYDATVSASVFEFARPNSSEDVSPWAIIRMTAPVKLQ

SEQ ID NO: 959005 - protein, 31 aa, Homo sapiens
MMEVGGRAKQEDVARGDQGQRRDQERTEDQE

SEQ ID NO: 959006 - protein, 82 aa, Homo sapiens
ALAENNWQTYNIQGADEEGTEYTHGQQASEGRQQNECGVDSTHSAYAPEDREDPRLQVMQKQDKATHKLRTGRNFLATQRAG

SEQ ID NO: 959007 - protein, 77 aa, Homo sapiens
LEVSPARIYPNLRLCAEAVYYNNVCVFGYKNRANAGLRRILMFKPETSSDSPSATSNGVRLVSATVEINHIMAKGHD

SEQ ID NO: 959008 - protein, 79 aa, Homo sapiens
DRRGLQQRLRNATSVAMEARLRETRPEEFPLALRAKAQQLCQELAWLCGAAGSWGLKRAEILPPKTDKSEAIWERILTP

SEQ ID NO: 959009 - protein, 55 aa, Homo sapiens
MRGQRSTKRGTIGENQITDEKHYTDKNPKKKIKSFLDRKKGFTEVKSPNGEFMTP

SEQ ID NO: 959010 - protein, 52 aa, Homo sapiens
IGYAMMQPLPLPSQPVFAPCFRAPTHADVGQPSPVHRVILLIPSYCFIPIGG

SEQ ID NO: 959011 - protein, 43 aa, Homo sapiens
MAKGPAAYSTVNRLRLVRTPLRQVESGTVWSPASAGDHIIIMA

SEQ ID NO: 959012 - protein, 42 aa, Homo sapiens
RRACSSCRKELCTGSGTDGSRSCETQTTERIESILPPFTFNQ

SEQ ID NO: 959013 - protein, 47 aa, Homo sapiens
AGTYPKSTIVCDEGRFPQGPHCLFSPISPDSSLLTDHSAPAVPELDL

SEQ ID NO: 959014 - protein, 51 aa, Homo sapiens
MILSHSQHLGKGEERQVWPMGKSYLPSHYTLLSLAITLARGYPQARYFAKS

SEQ ID NO: 959015 - protein, 42 aa, Homo sapiens
ECLGTLRIPIGYAVRGSTLLAIFEDMRFCCNILGMRIRVLRL

SEQ ID NO: 959016 - protein, 68 aa, Homo sapiens
VNNAYGVTCTELAPRLTQLPFTHITIPKAVSVPLHFKNLVIMISCGMLEHLQLIHFINPLDVMLWVLS

SEQ ID NO: 959017 - protein, 64 aa, Homo sapiens
SGTLGSHDSDRSSPQDIFRHFERSNSFTSHSGYDIELRALGAFTSGMISKTPIERQVIPFALIV

SEQ ID NO: 959018 - protein, 36 aa, Homo sapiens
SLAPTKDITANSISESEKGKDHMTQIMTAIRVCVCV

SEQ ID NO: 959019 - protein, 53 aa, Homo sapiens
ISFFPVPHPDNTWFIDGSSTRPNRHSPAKGGYAIVSFTSIIEATTLTPSTTSS

SEQ ID NO: 959020 - protein, 44 aa, Homo sapiens
IGSTRGVCGDGVLTRGWLRVLLVWVAYDGLVTNYVLTVLNGRRP

SEQ ID NO: 959021 - protein, 35 aa, Homo sapiens
RQRMCSPNGETADQTPVSDWSRPRGGPLMFHMACG

SEQ ID NO: 959022 - protein, 80 aa, Homo sapiens
RSSSHEHRYSLMLMLSLGTKFDTHDEILEGLNFNSLEIPEAQIHERFHELLRNLKQSESQLHLTNGQWPVPHTMALSYVD

SEQ ID NO: 959023 - protein, 87 aa, Homo sapiens
MDSTVQQIIRLQFVNYRTPRSDCVAVVLRHRWGAIPGQGLLLRLCRHITLATTDTTRVAIILVRVAHQACISFMFSYILLTMCRSLI

SEQ ID NO: 959024 - protein, 66 aa, Homo sapiens
MANSVANRTYHSWLACGAGVYTRVGSGYNCTGSPHKSHYLNTYRITRDQAVSTHLQLTSSLIENNR

SEQ ID NO: 959025 - protein, 142 aa, Homo sapiens
MPHPSHNSIPLKTSLQIRAVFTYSHPSHPYASFHINQHAVQRSLPSPSNPIGPPMVTEPTSTTTHGGLIFNSYILPPLFLDTGDLRLLARCTIGSYSRLKPHSYNNYITRRLALMSCPHIRLKNRCNSPDVYNTTLSPLHAR

SEQ ID NO: 959026 - protein, 107 aa, Homo sapiens
HSTNPQVLNHQTAFNTFRLGRTRQPQPNLRSQYMLKTSTQSKAQLTHHSHCIPITLAPNRQPQFTPTGHHTSANPSYLSRSHHPTNQRYYAPSHSMASSAPSPHRCQ

SEQ ID NO: 959027 - protein, 68 aa, Homo sapiens
RISGSPGQSVARSVVLCKHTDTPEPCVFYDLLHILCCVDFGDRVVGSLSHELWNSEALILEGRIIYQM

SEQ ID NO: 959028 - protein, 112 aa, Homo sapiens
ASASSLPLSSSGRISSSVAERQPGNRLQQSHLPSTGPSSPPGSLRHTQPSSPCHSASVSLSSSGPIQFPSTTIINHNNPCDTPNHPKDPLSSRSVLNSQQSSRLALHIYWGS

SEQ ID NO: 959029 - protein, 71 aa, Homo sapiens
MKSLEGLCVAIRYESFSNPSSVYSEKSAKDGPFYIVGHCSCQGKLCLSSLSNKVLHGCYGDFPGASELHVC

SEQ ID NO: 959030 - protein, 107 aa, Homo sapiens
QAALHLFITQSSFHPFFIATINSSASSLHPFHTNPPNSSHNTQPMAHPPSCSGRQCIHQAFRSHSIPHMPQPHFFTTTGHTSQPLHTPSLSSFIRQPIQSSLHSNPI

SEQ ID NO: 959031 - protein, 82 aa, Homo sapiens
DYIYHTAHYNTDMASAWAKSGPRNVYMYHAPENYSHGNLELLADVQIALGTTPSNQTMRGSNLCEEKSLSVTIMQHITHYIR

SEQ ID NO: 959032 - protein, 70 aa, Homo sapiens
VSNHQTVFTTFQVGAHSEPQPNLRSSHMLKHYTQSNSATHSSLHIAPNHTCTHTATKFTPQGINQTPIPH

SEQ ID NO: 959033 - protein, 118 aa, Homo sapiens
KECLSSTSASWQLSIHSMSNSHLNSSHRIVNLTKPAFTQFRLGAALGSHNRNSAAVTCSSTSPVPQRNSLILQLHPTSTCTHTAHHSSPSGHHTAPILILSSPIIHTIKVYAPRMSGS

SEQ ID NO: 959034 - protein, 41 aa, Homo sapiens
LIVDNEPLIAACTIGDVLQSNIEVVNPIVDIDSTNRIALFI

SEQ ID NO: 959035 - protein, 66 aa, Homo sapiens
SLSLNKRTFNSGCTIGDVLHPTSTVVNPYCQSIGLYSYDCAVILKGNLFRVVNLLDQLSILIRFDW

SEQ ID NO: 959036 - protein, 76 aa, Homo sapiens
SGHSAHELPTIRMPADICPAFVDVVTGKYSPRKSILKSRSTENSVCSDTSESSAAEFDDRRGVLRSISCEEATRSD

SEQ ID NO: 959037 - protein, 98 aa, Homo sapiens
ADLELSPLDSLSFIEIFNDIASSCSKLGFCILLCLKGGISINSSSSSLLPVGPSGSLERLAYLVTGCGQCKDKCVSHKQGLVERHPPSLLFQVRAFTI

SEQ ID NO: 959038 - protein, 100 aa, Homo sapiens
EYPRQRWDPLGHPYTRRHMRKLLSEVSTYIKNNMATTPHTASICSQLSGLELVTHMLRANVLTCPCVQGDGQCHPLRMAHASRNHCLSALDCILPPSSSN

SEQ ID NO: 959039 - protein, 59 aa, Homo sapiens
SAWPKRARGNVFMYHAPENYAAMDSLPSAGRMFKVASGASRSIPAYERGSFSLRRINQP

SEQ ID NO: 959040 - protein, 65 aa, Homo sapiens
DFIGLSRIDFFTGAYFFSFLIIKIIIIIIFIIILFIIIVIIFISSKFYLFLWYHCYHPPVELQRS

SEQ ID NO: 959041 - protein, 52 aa, Homo sapiens
MQRLLQVRFVHRLKSYVICVHDRMESRSVSIYFNIPPCYVRTMRNKSYDALI

SEQ ID NO: 959042 - protein, 51 aa, Homo sapiens
YPPQVDSLDIVLHDTYYVVSSLPSMSYQEELYLPSYDASFTDFPYSQAIPY

SEQ ID NO: 959043 - protein, 37 aa, Homo sapiens
IGFEIICKRLRSEDGQPNGAQTQWTGLLAEDFRDMMP

SEQ ID NO: 959044 - protein, 74 aa, Homo sapiens
PNSDFIWDGKSYPVLFTKNITIYPSPVLQAPPAPVTHVYIGRGTSHRPKVSFITCSLIPDLYEWLHEGSAVSYF

SEQ ID NO: 959045 - protein, 81 aa, Homo sapiens
CTIRRCTDPTSTVVNPIVDIDSRIVVALFILYGNLFRLVNLLDQLSILVRFDWSILHMYCCERWVLLRSVVPTVNFLCMFG

SEQ ID NO: 959046 - protein, 57 aa, Homo sapiens
DPPPYRISLVLFLQSPSSSLIIIIIIFIIILFIIIVIIFISSKFYFFLWNLATTSSE

SEQ ID NO: 959047 - protein, 65 aa, Homo sapiens
MTLQWDSERPPETRPFLVQKFQRFSSDSHHLQLVPTQCCHSRLTQVLRPSTSSAARAHLRLDCTI

SEQ ID NO: 959048 - protein, 44 aa, Homo sapiens
PTSYRLFGHTVRMRRSRRSLTFYAHPASEDGVNAHTLDVAKINR

SEQ ID NO: 959049 - protein, 36 aa, Homo sapiens
DTLKDTTLGNICYILLEQEFFIKMFFQVRKDKIKFP

SEQ ID NO: 959050 - protein, 39 aa, Homo sapiens
HHFITTHLSIKPPAITQYQTPLFVKIRPNHSSPTSPISP

SEQ ID NO: 959051 - protein, 47 aa, Homo sapiens
RRRTSLAGVSSILGAINYITTIINIKAPAITQVPKRSVFVCSVTSYE

SEQ ID NO: 959052 - protein, 38 aa, Homo sapiens
ANSDTLDPGCDSLGKNVGLGMFQLKEPVKLYNHHGYTS

SEQ ID NO: 959053 - protein, 61 aa, Homo sapiens
AKLGFHCCPWNILVVIPKAWKKEVFIAAPDQCSEAGTVTSHGAMAPARAAAGTLLAINMSL

SEQ ID NO: 959054 - protein, 52 aa, Homo sapiens
DIYESSLYQYPRDTAQSYLESISTIGFTTSMLDQDIPMVQPLLIGSFVQRFK

SEQ ID NO: 959055 - protein, 114 aa, Homo sapiens
RKPDFTGLGRRNGLSVGRFGGRMQIQSLKSSDEIPLDIAIPYGFTFHLLVYQMSCYLSWLQTMFVYPIPTTENWTHNAYMCSGVVVQIFSNCEVSDIPFTNFLHTLFWTVTVAQ

SEQ ID NO: 959056 - protein, 80 aa, Homo sapiens
VHRLIASLDNYLCATVVCLAVFYAIAGGLILERAYYYAFAAHHTCITDTTRVRIILSRVTSSIISFMFSYLSLIICRNLI

SEQ ID NO: 959057 - protein, 50 aa, Homo sapiens
QRCQRAQTLSNKESVIQRYLVPTGLKVWPGSVKALSKHTAYPARPCRILM

SEQ ID NO: 959058 - protein, 45 aa, Homo sapiens
DGGCGRKRLNRRPLLAGNYSHPGASVDLTDRSPYTLAGVSSILGA

SEQ ID NO: 959059 - protein, 71 aa, Homo sapiens
IPGPKVPEGSHPELAMESRNSKAYLCPQRQSVGQAVSTPCHSTLDTPGAVQYSTDLRSQSRCCARFGLTGF

SEQ ID NO: 959060 - protein, 38 aa, Homo sapiens
RGVEAHSLIRRTQWRDLSSRNFASRAQVIRQPLQPPQP

SEQ ID NO: 959061 - protein, 42 aa, Homo sapiens
HGTSSSSSSSYILLLYLAIYHLRLPELCCHAAGEALQLRTLL

SEQ ID NO: 959062 - protein, 32 aa, Homo sapiens
MKAACIVKDKGSAREWAGHSSGHQLTLPTVLR

SEQ ID NO: 959063 - protein, 68 aa, Homo sapiens
PVHRCPTCLQLRLLYSRTGRWHPRTTDVSRVKSLHETILIHKLIIFTEHVDPQLVQCSYFKIHGEFPA

SEQ ID NO: 959064 - protein, 44 aa, Homo sapiens
MHIDFTPGSELLITKAKNGHLAVAAPRLNSGDKGAHWTLHNLYK

SEQ ID NO: 959065 - protein, 44 aa, Homo sapiens
MTAPLVIKTTTAAGECQVVHRALCLDLEAVSSHTHDLHSRRPPT

SEQ ID NO: 959066 - protein, 49 aa, Homo sapiens
PHKPQSTTSLTSPFPDWHLRDQHLLVATGFQDFTVIIGSTFLTICFIRH

SEQ ID NO: 959067 - protein, 72 aa, Homo sapiens
MLSSYFRSQQNCHKLLLLSLVVAIILNVSADFLNNFLISLLPVMVAHMKSRVILIQSHPASLQKLATGRLSI

SEQ ID NO: 959068 - protein, 33 aa, Homo sapiens
RDVRSPLISSTFLSSSSCSSSSTSAMSSSSTTS

SEQ ID NO: 959069 - protein, 75 aa, Homo sapiens
IHRKSDLFPGGSGSSLKSSGTCHALWFYPQSIFPCPPTTYPKCLQNQPAGPPMAPTPMDHPCAPPLATTWDTDAR

SEQ ID NO: 959070 - protein, 54 aa, Homo sapiens
WGSRHFLRRVSEVRIAFGVTEDIPIPTEASNEGQTVFLNMWEISSLNLLYKRAL

SEQ ID NO: 959071 - protein, 54 aa, Homo sapiens
GVAGITAQSSTINQQVIITLTVNPTHGILISERLKKCKSELVQILPRHNRGYLS

SEQ ID NO: 959072 - protein, 47 aa, Homo sapiens
LTTGLLWSELKYVSLYSLNKRSFNSGCTIWMSCHKRVTETRNCVFMD

SEQ ID NO: 959073 - protein, 56 aa, Homo sapiens
GGTREYVTHYTNTSSSTFTCVKWFIRKSNLVKSMDCATHPVIHPKTMDCSLNSKYQ

SEQ ID NO: 959074 - protein, 42 aa, Homo sapiens
MLRRESSGFLASTVLATEPGRSFPTPVGRPYSQPSVTSSSHT

SEQ ID NO: 959075 - protein, 67 aa, Homo sapiens
MSLQASSRASSMRSAFSGAENAWITSARTTFACSALKAAGWVEADAIGRLKLSGSAEVNGKLTNEEP

SEQ ID NO: 959076 - protein, 45 aa, Homo sapiens
SLELVADVQFALGLPFYPAYDSGMFALEEKSLSLKVMHVLFPLHQ

SEQ ID NO: 959077 - protein, 47 aa, Homo sapiens
DYTGAFSSASHIKIIIIIIFIIILFIIIVIIFISSKFYFFLWNLATT

SEQ ID NO: 959078 - protein, 46 aa, Homo sapiens
QRCAITLRGRADDSTRGRSLHPCPAAPAPGKRNVTTHNARYVTTLN

SEQ ID NO: 959079 - protein, 54 aa, Homo sapiens
MSWYRKVGFTGGGSKGSKKKVKLAADEDDDDDDEEDDDEDDDDDDFDDEEAEEK

SEQ ID NO: 959080 - protein, 35 aa, Homo sapiens
DPLVCVSLTAEFLSSIHHVVSPRPGVCDHKLTTQT

SEQ ID NO: 959081 - protein, 34 aa, Homo sapiens
GTTYAALDNLKDSMAGQPSTLVLVIGEITNRQRM

SEQ ID NO: 959082 - protein, 35 aa, Homo sapiens
LQVTHTGSRRALALTPGSLRFGLSSQSNFYFIHYA

SEQ ID NO: 959083 - protein, 44 aa, Homo sapiens
CCIRMSTLSDPRLIDSGYRVTAVAGTNIEPTLGLVLAELNFRFI

SEQ ID NO: 959084 - protein, 129 aa, Homo sapiens
MIAQRIWLNKNTVNAVELAGSFMMSSIQRLTSHAWLYTPYGGLENFDSPTNVLAALTQRLKIPTDATRLLCFLPLQQQASQVLDNHLVLTPEAMLDDVFGEQEKTLKRYQAVNRQALLAELKQLPSLGA

SEQ ID NO: 959085 - protein, 35 aa, Homo sapiens
DIMVADGESMPCVYVYSPYVTIIIAIHTGVKVFML

SEQ ID NO: 959086 - protein, 38 aa, Homo sapiens
ELDQVWRSGCGEFSEGHSYADQTFLLKRGLLEETLHNP

SEQ ID NO: 959087 - protein, 33 aa, Homo sapiens
MSSVPIVPILTICFIAPTIFHFTSKHHFGFEAA

SEQ ID NO: 959088 - protein, 36 aa, Homo sapiens
ELVPSLAGLRIIFSPSGLTRCDLGHINSQILRSLFD

SEQ ID NO: 959089 - protein, 166 aa, Homo sapiens
VFKSGQHLLVFGMVPKASVGILTSGNPDSGLIAFQKARPLDPHHLQRKAARLGNGVGPHPAGRRGQPHHHIMGSGPRKDALRQMRGQIIADGEPADQNAVAFGMGVTDGVAVALELLHVGLGHHGGDLVDQFGLVFDGHFDFWRVAHRTCHRISFRWTGSLGPALR

SEQ ID NO: 959090 - protein, 43 aa, Homo sapiens
KDKDGYKPDVKIEYVNETGRKLTPKEASRQLSHRFHGKGSRQD

SEQ ID NO: 959091 - protein, 36 aa, Homo sapiens
MALELALPRGKGVGSALAERSTWCISRRVHKADSSA

SEQ ID NO: 959092 - protein, 75 aa, Homo sapiens
MLPVDLTTQLACHPRCPPPNAPRFPLTPSGAQIELQLFGGDSPCGVRQRPQRFCTRFSALSFPFKKEAPGSLYFS

SEQ ID NO: 959093 - protein, 40 aa, Homo sapiens
GPSTNSPGLYAYANITAGHLLMHRYWKRHPSNINQLALSV

SEQ ID NO: 959094 - protein, 42 aa, Homo sapiens
LVSAKNISLLRAQRDYKTEMADATETTLLDNPELQVDAVRSK

SEQ ID NO: 959095 - protein, 78 aa, Homo sapiens
YVQKITSNCFIPHVVSFHGYVSPGLWTGLQPLPSPRWSTPVACMPTHLPTKRLPKGGRARNPPMGRGDLLHDKVIFCT

SEQ ID NO: 959096 - protein, 33 aa, Homo sapiens
MYQNAVSVMILYFVKLRMVMLGLYGRTAIIHPI

SEQ ID NO: 959097 - protein, 63 aa, Homo sapiens
MAELVAQDKCTSQKDPGHPTQLILGWDRGANEDYNSPALAHFSKLIQSTHGWKLERNNEPCSM

SEQ ID NO: 959098 - protein, 44 aa, Homo sapiens
LTPCTFGSWMARQLDENAQKIQRRADFPAKYVDGPMNSPEKLEH

SEQ ID NO: 959099 - protein, 34 aa, Homo sapiens
IVQKHPLLCAEASLICAEDHLIVLKITLSVQKIT

SEQ ID NO: 959100 - protein, 101 aa, Homo sapiens
RLFRVCPCTYHSAKKAIVNTLDLSIAASEIKEPSELILPAIIRVLIALPSSTQSFTVTDEINDPVPYHQESSWPAMCSEPYQYTDYGGLVFNSYIRKRTNA

SEQ ID NO: 959101 - protein, 45 aa, Homo sapiens
LCLPFYPSNNPILESISTSRVYDLDVGSGHPDSAAAMKGSFVPRL

SEQ ID NO: 959102 - protein, 32 aa, Homo sapiens
MTIFGGGDLIAGGNINDHVLRRCRPRDCERQG

SEQ ID NO: 959103 - protein, 58 aa, Homo sapiens
ISSYRYQSEDFNRSTVTLRIIAQSYSRVHIINRVYDLEYLIMTSRWCSRYYRFVCSTI

SEQ ID NO: 959104 - protein, 34 aa, Homo sapiens
VPHLCTVAQLLSTSRILHDSTMPFMTLDTRASAS

SEQ ID NO: 959105 - protein, 42 aa, Homo sapiens
RDFAESRRGFLLQQCLDENPALVPHPGSAAHSQPSVTSSPHT

SEQ ID NO: 959106 - protein, 163 aa, Homo sapiens
MLVFPVQPWRVHYDRPGPWLADCAVENIIMALPPLRFDPAALYTVYSGHQISLEVLERCETFCRKILRKRLGDKCDLLLGTHPANSAVVGDPPVPSAWRNTTRCGSLSPEHRAQEEAMAPGRRPRTSIPIATGEAGLTTKYEFFKLLQAGRCVDPCNERCPLW

SEQ ID NO: 959107 - protein, 41 aa, Homo sapiens
VTQGTPTPLIPILVIIETISLLSATNSPGRTPNRYHYCKPP

SEQ ID NO: 959108 - protein, 50 aa, Homo sapiens
SSADTILTDLITRIVMKSSFLALFGARLKVLELGHLLLIIVQELVVIFCT

SEQ ID NO: 959109 - protein, 33 aa, Homo sapiens
RAEDPPQFNMQISFIFLYADSEVIFFTIGDLLH

SEQ ID NO: 959110 - protein, 35 aa, Homo sapiens
HVQKILIVGIVAGLAVWLSSCLGAVMAVVMCEEEV

SEQ ID NO: 959111 - protein, 85 aa, Homo sapiens
DHLGGMVWYGMVVGGMVVVMVMWMVVMVVVMVMVVGVMVVVMVMVVGDDGSVVVVMIVMMLVMDGDISDAGSDGDDSEEMVVVVV

SEQ ID NO: 959112 - protein, 57 aa, Homo sapiens
GDLEDPIVQKKESDELTSIARFENANQQENSKRYEDLPRYKILSQKIKSNELVLEGG

SEQ ID NO: 959113 - protein, 74 aa, Homo sapiens
TSDCAGIQFMRNSRRLFGLDGSRDTHPESVNAIVLPLVGHFCCHQERCRDLNILNIDILGSSKPTLSPGRASLK

SEQ ID NO: 959114 - protein, 37 aa, Homo sapiens
TKVTETVPGTDFFKPNLTPHGNEVINAGRRMDMVLQI

SEQ ID NO: 959115 - protein, 104 aa, Homo sapiens
MPTDVGVRHKSSTGRVQCLCRSPIYPLDRNKTYATLRVAINTQSLLKKRSCDHLWSITFFPCFKNSTPGTVSKPNRTLGAKAPCRDLAATPGAPANPNAEEVKG

SEQ ID NO: 959116 - protein, 47 aa, Homo sapiens
SLGLTLSKPSSLLSTVDQPPNYKMLQGGARGGCSWREHHNPAPPTST

SEQ ID NO: 959117 - protein, 70 aa, Homo sapiens
MVVTWNDSYFGVDVGQLDDILYKPQRHWNTITIILRMAVESWAQHLNLLIRRRAGPARRPSEVNDHIYNV

SEQ ID NO: 959118 - protein, 53 aa, Homo sapiens
SIHLHRPQIHCKTIPIILRFNCHVLGTALNLLIRPDLGQPGDLLGNDHIYNVI

SEQ ID NO: 959119 - protein, 52 aa, Homo sapiens
IEFSTNHKDIGTLYNIILSALAGVLGTALSLLIRAELGQPGYLLGYDHIYNV

SEQ ID NO: 959120 - protein, 181 aa, Homo sapiens
HRVGTMVLRTVNKVEYALENPKRDNWLDLLTAEECCHYAFSCGENTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 959121 - protein, 46 aa, Homo sapiens
RGVLARKIQKVTTWLDLLKLKRVVTSFFLSLKIQSWLSSIDETDNT

SEQ ID NO: 959122 - protein, 61 aa, Homo sapiens
MVCVPVNEALPWRIFNQRHHRHCVVGVEFVAGNGQVLLRILIGFAAALLLFLLASLFLAQQ

SEQ ID NO: 959123 - protein, 100 aa, Homo sapiens
MRTKGLICLPRRKARTRRQREQNPYIELASSHQRWHGGALLHQVEVGSLSSGARLLGLNPGSALPGRGTEAGSPTPASFLIWNVGMAVVPSVVVVLRMKG

SEQ ID NO: 959124 - protein, 41 aa, Homo sapiens
KLHGQQVFLRTTPIGPRTALNVAAKELAKTIANKTPLSGEP

SEQ ID NO: 959125 - protein, 103 aa, Homo sapiens
HVWNAEALFSKYCALTLKDSFAPFLKFKRENYVISSGHTRRQHLSVSAIMSKEIPTPYMWSYQPQMGLAAGAAQDYSTRINYMSAGPHMISRVNGIRAHRNRI

SEQ ID NO: 959126 - protein, 78 aa, Homo sapiens
TLTFIDKLTVRQDYTNPRLVNSSCPALVVTTINPMSVKTGAKLSGTTVRMMGILYSLPILVAACVLAVFREAIINAKT

SEQ ID NO: 959127 - protein, 34 aa, Homo sapiens
DITEDVVSTEEGDVSITPNLILVRLSICLASFCD

SEQ ID NO: 959128 - protein, 195 aa, Homo sapiens
LVAAGSAAVAPALAQVEVGSASPLRKLVPAETLERSAAQQYQQMLEQARAKRALAPPEHPQLQRLHAIAKRLIPFTAPWNERAGQWRWEVNLIGSQQINAFCMPGGKIAFYTGILDKLKLTDDEAAMIMGHEMAHALREHARERLAKTQATNLGVRLGAQLLGLGDLGNAAASLGAQLLTLKFSRSDETDVDLVG

SEQ ID NO: 959129 - protein, 57 aa, Homo sapiens
IIQRVAILYVKGHLTIGAGLGITKVKAISSFISWNLILQAANIVFVKSGTRGYQLQF

SEQ ID NO: 959130 - protein, 44 aa, Homo sapiens
RDFRDSHDLSLVWTVTKELISCVSPPCIITWSGIPTRQREGSVL

SEQ ID NO: 959131 - protein, 36 aa, Homo sapiens
PGIAETLRDEVFKEWLSLNVMRQRPGLSTTSNLPRW

SEQ ID NO: 959132 - protein, 40 aa, Homo sapiens
SGIFTNRRGIFTNCAASLPNERHLYYMLFYYMNRHLYYMT

SEQ ID NO: 959133 - protein, 55 aa, Homo sapiens
LAVQRTQRPLYYCADSYYWPVSLLMSGSLLMASLLMPGIFTNERIFTMYGIITNE

SEQ ID NO: 959134 - protein, 33 aa, Homo sapiens
MTGIFTTERTVIMSGIFTNERIFTNARHLYYWA

SEQ ID NO: 959135 - protein, 85 aa, Homo sapiens
GIFTNDLASLLMTGIFTNWPASLLNAGIFTYMTASLLLSGIFTNTPGIFTNDPASLQMSGIFTYLGGIFTHDPASLLVEPASLTN

SEQ ID NO: 959136 - protein, 64 aa, Homo sapiens
MLASLLMIGIFTTCGIFTNERHLYYPGIFTNERHLYKMRHLYYMPVPLYYMSGIFSNRAASLLM

SEQ ID NO: 959137 - protein, 36 aa, Homo sapiens
TNARHFSYGRPSCINARPSFTQCSGIFTNALASLTN

SEQ ID NO: 959138 - protein, 42 aa, Homo sapiens
MGMGHHSEVDGTPPLRLSGPHYNYEPFNTHQHYYPLWELDIT

SEQ ID NO: 959139 - protein, 34 aa, Homo sapiens
YSSERILVVIGIFSNERIFTNGRIFTNARIFTNE

SEQ ID NO: 959140 - protein, 36 aa, Homo sapiens
PLMMGGSLLMPGIFTDCAASLLMGGLFTNERHLTNG

SEQ ID NO: 959141 - protein, 57 aa, Homo sapiens
YWMVLSRWNDRRDQAGHMVPGLLLSLLLAAAELKWTTENPPCLYHRLNVSNTPWPCM

SEQ ID NO: 959142 - protein, 103 aa, Homo sapiens
MIPSLVVLSSELLSSAIYDNTVNLYRQKDDNWVYSPTLEGHESTVWSWAFDPSGQRLASCNDDRTVRIWRQYLPSNKQRVACNGSYPKWKCIFTFTGFHSKTI

SEQ ID NO: 959143 - protein, 121 aa, Homo sapiens
LVVLSLYTNLYTNLLNYNIHSHITSRILYTNHTYPHLGYHHPMKQPSITPEHKHILPILHPNRLPSPTHPTNLHSQHPMLTKHSTTHSHCPKTIKLLSQQLNITSLHNIRFPSSIHNHSHN

SEQ ID NO: 959144 - protein, 188 aa, Homo sapiens
SSTERNERPTGDGSLLYTADAYGATRAIQIHLPSKSGILKNDSRGEALLAYVSQEAFHGSPLNRTPGILSAMLLVHSLQVPSTWEKAVCVTRWGEIHLMVELLSLVHYFCELLMRHHFQEATRFGRSDVLDTNLSTGEPGAASSDTRNEKKLAAKPEPEEKAPILEPASSWAQWWDRSEAKHPYRDEV

SEQ ID NO: 959145 - protein, 69 aa, Homo sapiens
FWVLCHFGVILSHYPECYCCLVQLLGLLGVRCSFGCELYWSAHSGKHCMVSFGAHGPELIRKKIAMVFH

SEQ ID NO: 959146 - protein, 53 aa, Homo sapiens
WIIRAARCPYCCEDSYQQQGTSFSAIRQVYQTRNVRAIFYPEKSSKPYLYQNI

SEQ ID NO: 959147 - protein, 71 aa, Homo sapiens
LASMRADLHVRRAASTGWGGTTVLWTTSSRTISTAGFIEFVTSPNNPYALICASVLCSSAASHRRPRVFLA

SEQ ID NO: 959148 - protein, 120 aa, Homo sapiens
SSYPMPYDRGGARNGKWRKRRRDCSGNSCKDEESSKQAETSRLQEELAKLSEKLKKKQASYCRLQTEKETLFNDSRNKIEAITTPGRKLNHKAQLARTQKLQQELEAANQSLAELRDQRQ

SEQ ID NO: 959149 - protein, 67 aa, Homo sapiens
SGTTDTRDHAGNSICIINSRDKDFTMISQDGLNILSSLDLSLAWNNTSSSPGSRAFMDSRLNYIILE

SEQ ID NO: 959150 - protein, 43 aa, Homo sapiens
EAKVTTEGLSSTSLKLEHTSSSLVSSSTTHQCKITSAPHRSPS

SEQ ID NO: 959151 - protein, 38 aa, Homo sapiens
PCLPIKSRWCFYSTGQTSKCFRGINPAQHDNLINSFAG

SEQ ID NO: 959152 - protein, 94 aa, Homo sapiens
GSHCDKHVMYDYALILPDGTGVVGVCTEYKILPMHFEYNWITLSLDLMREKLPTSGLNVDGPSNSQRYGISLSRSRSLSIMPAIRSKQQESQLV

SEQ ID NO: 959153 - protein, 32 aa, Homo sapiens
MASSLLCLGDFSPTLSGFITLTPLLLFAFLGF

SEQ ID NO: 959154 - protein, 45 aa, Homo sapiens
SWWGCIESVDQFGEYCCLNNIKSSGWVPWLMLIVPTDRLQIANQI

SEQ ID NO: 959155 - protein, 69 aa, Homo sapiens
VDDTAVENCRQLVLKERNVLLITFFTSIFCFFSLDGVLLCHPGYNVVAQSAHCSLQLLGSAILQPQPPK

SEQ ID NO: 959156 - protein, 90 aa, Homo sapiens
SVVPSDCLPRETSPGYIQPVVTMCKVAHREFKSFPTSADRCVEFQAPLLIRFLCDSCPMGILYSSHLTWLCSLGHWLARSTRLRLSRTRG

SEQ ID NO: 959157 - protein, 43 aa, Homo sapiens
AIFILDIVLHDTYYAVAHFHYVLSNEELYLPSYEASFTDFPYS

SEQ ID NO: 959158 - protein, 41 aa, Homo sapiens
KRVLTLRKSCWCNQKRRALEKIDLSSLTPPPSAMAASMNHG

SEQ ID NO: 959159 - protein, 70 aa, Homo sapiens
CWGASSFSVCNMKPFCGTVRRESKGGHCTQIPTAENGNARFIITVTVSRGGTKMLAKGMNQKASEARRMP

SEQ ID NO: 959160 - protein, 47 aa, Homo sapiens
CKETALIESIEGTGKPRLKPPFPADVGISGVDERSMTITAAVPRPVC

SEQ ID NO: 959161 - protein, 65 aa, Homo sapiens
EVSAPSDAAGERKKWNLNCQWKHLFKRQGAADVHEAKTLTSCALCYKLSKPDWFRNQKTWFCPSH

SEQ ID NO: 959162 - protein, 55 aa, Homo sapiens
TAAHFWKVHSPVGLVSTTLRVLGSWSSPSRCHGQCDLRRVEAQGPASSGWSLPEV

SEQ ID NO: 959163 - protein, 81 aa, Homo sapiens
MAWRGSDVFQIRCCTRLAGPSAPYRIIVSSTLSLMMTPEVLHRLHLRVNHVVIFQHLTDNLPTECRLEESRQMLLLMSKGQ

SEQ ID NO: 959164 - protein, 41 aa, Homo sapiens
CTQFYRVRSLIKLLRRPLPYYYPVLILASNSHPSIYPTQQE

SEQ ID NO: 959165 - protein, 91 aa, Homo sapiens
MQDVVPQLVICCQDNATEERSILALTCANDLLTGFRQPNMSAPCNGDECTPTSLSSWTSLKRENMSRPGQVCSALNLCESLQKHLADEAGG

SEQ ID NO: 959166 - protein, 156 aa, Homo sapiens
NGCRDNGGRQTHSNQLSGELTALWESKLHIFTFPRFMKDTLSLLKIASVACIALSLGACQSLFQPAYLKPLDTTADASEQIKPGCSSPDCPLVNIDTVHFPSEPQLDQIIEQRLLQMARTSPGQAMPDTLNAYRDKFLRESPDRNSMYLQAKVREQ

SEQ ID NO: 959167 - protein, 68 aa, Homo sapiens
LIHNDSQILAGGVHKYRQEELLATVRMWQYSCGCILLEVANKHAHLGSPRTIRRDAPSGRKVRLIAAR

SEQ ID NO: 959168 - protein, 54 aa, Homo sapiens
ASQHIGKEELLATSTGCGHNPVEHPFGVCATSSTSATPSTIRRDPLVAAKWVSL

SEQ ID NO: 959169 - protein, 88 aa, Homo sapiens
TTFVLHARVESSSMCLGSDNAVRRLSQPGSSKSHENRIPLPTACNNMVADGDSSVEAPGEWREAWDVTFLRPSQVHVIVPGGVDDGLG

SEQ ID NO: 959170 - protein, 47 aa, Homo sapiens
MEQVMLTCLMHMMTEIMMRRLGLVEEHKDALSCSLSVAGLELGNVIF

SEQ ID NO: 959171 - protein, 55 aa, Homo sapiens
LVRMHLGGSEELPLLTHHYQSSLSKAPERPCRTTEGATLECRIGRWPCPTLSSHS

SEQ ID NO: 959172 - protein, 36 aa, Homo sapiens
MRQYVAQISRFLLVRMSSPPFFLINLRARLSLETFS

SEQ ID NO: 959173 - protein, 47 aa, Homo sapiens
DLACGISTERIAFWRQICEDTEEMPLLTHHYQPASEGPETLQDHGGS

SEQ ID NO: 959174 - protein, 36 aa, Homo sapiens
RKPKCMFGMSHVQIIQYGGMQASISAGNQLQPNHAR

SEQ ID NO: 959175 - protein, 51 aa, Homo sapiens
GGYTAKYSSGLLCAGELQLILSETTLVLLITQSPVLVAEGLVPCGQSTISG

SEQ ID NO: 959176 - protein, 41 aa, Homo sapiens
MQHRWPRMPEAERYSIAWPRRLVPPGGTGVYRPQMGYSAVN

SEQ ID NO: 959177 - protein, 65 aa, Homo sapiens
VLPLHDDSHSCSVGFLQSLALISQLFVRELVVMRMTAGGSHCSPGIHPEQSDVAAPVAMVNLLAP

SEQ ID NO: 959178 - protein, 38 aa, Homo sapiens
YHRSQCASIYVLSSAMHLLGARRGYKQKQHLLHSIVSP

SEQ ID NO: 959179 - protein, 58 aa, Homo sapiens
MHGILMVRGTVRCRVLYSQRCVSPCLCVRNTSLIWLDVCLVDPSLFTVSNTDDLTCGS

SEQ ID NO: 959180 - protein, 61 aa, Homo sapiens
MAVSSGSLFMSQFILLVSVQDRHKPGYLRVAKYPNHALDVERCWGFDDDQFSTRLSQGSCT

SEQ ID NO: 959181 - protein, 48 aa, Homo sapiens
TLVLTAAPCYLREAPDVRSGTLLVPPCHPDQVTMEAPRKRINTITNCP

SEQ ID NO: 959182 - protein, 55 aa, Homo sapiens
MSQNDDDAALLEPPSVVLGTAYLEGCNDFNYLSSNCFEITVKLSFEKFPPSTISA

SEQ ID NO: 959183 - protein, 40 aa, Homo sapiens
CAMDGDGARQAVQGLSVELPGKHKGSLKPHDYPKWEGGVN

SEQ ID NO: 959184 - protein, 56 aa, Homo sapiens
MRTVASAGWHLTDAALTAGAQATIARWCGASLLELPFLAAHGAVLLNLLCVAATLR

SEQ ID NO: 959185 - protein, 68 aa, Homo sapiens
ILSSVGSFIALEQQWNINNHHDTRASRIDSEKSVIVQAPSIEPGVNIWMPPTLPHIRRNRIHKIYTKK

SEQ ID NO: 959186 - protein, 62 aa, Homo sapiens
EVDRKQAPSLLSLNEVQVILRELVEEGDGSGLDGDATFLLVFRVSVKRVSPARAEPIMPALP

SEQ ID NO: 959187 - protein, 53 aa, Homo sapiens
RPDPDRITAFYQALQNSLGGENSRSRIETGVTLYYSLEHSTDYYTSFSRALEA

SEQ ID NO: 959188 - protein, 133 aa, Homo sapiens
SSRGAWTVHLYPGDGGSRCPYAEHTPRLRFCATLACTRYQGRRTEWSGKIQGPELSAYQAPSPPAHSGFHRYQFVCLSSGRISHLSPSQGEHNSRLLENGQISEPFPTMANLKQVTQFMIQNSAGLTNIPGSQ

SEQ ID NO: 959189 - protein, 67 aa, Homo sapiens
SRLVLGIMGEVCRELKLSPPSSVYSSSTVPLVATCFDGREGSLPSSVLSRLRRDGQGACRHSDDRGP

SEQ ID NO: 959190 - protein, 40 aa, Homo sapiens
MDLMFLSKVRQAPVNRDAELPQDLLCNPLGLFQHLVQAAA

SEQ ID NO: 959191 - protein, 52 aa, Homo sapiens
QTLTTTIFLGTTYDALSPELYTRYFVTKTLLLTSLFLRIRTAYPFRLIRELS

SEQ ID NO: 959192 - protein, 64 aa, Homo sapiens
NSGTDMTLVRIQRRCHFSLTTYQPASEGPRETLLTTEGATLECRIGRGPCPTLCSTYPGPEALI

SEQ ID NO: 959193 - protein, 51 aa, Homo sapiens
MCDRIDSLLENDLDSQSAHAWMSCRTSFSSRVPGIIDVALPRTGSSPRVAP

SEQ ID NO: 959194 - protein, 106 aa, Homo sapiens
FLTAAPAPGGGHDAGAGRFRTGLGRKGGVGRSYADAPEIDGVVKLLPPEKASKTLKVGEFTKARIVGAEGHDLIAVPVLTVGTAAWPPEGGALPAGAGGMHGNPKG

SEQ ID NO: 959195 - protein, 49 aa, Homo sapiens
SLKHPKPAMYNQLCYKKEGGPDHNYTKEKINDRRWESASCLGMMLSGMT

SEQ ID NO: 959196 - protein, 42 aa, Homo sapiens
GVTNISARGTAGHVYAGVAMNPSGCIRFGRLQTACTLGKPFH

SEQ ID NO: 959197 - protein, 42 aa, Homo sapiens
YAEVLSADTWRAAIAVVAPPRRMLHRIHEHIPYSWTCSSSIA

SEQ ID NO: 959198 - protein, 50 aa, Homo sapiens
SVVLCAPVVCVGGCLPPEPSLCGAHRKAEAVMAAVAGVRAPFSLGCGLFP

SEQ ID NO: 959199 - protein, 37 aa, Homo sapiens
NANPSNMVIEPAGGSNSETSDCRMYTRPCNSKNRAQR

SEQ ID NO: 959200 - protein, 87 aa, Homo sapiens
NNTSDMTSLKERIIDHPTDIVIITRKMNSRHELANARERNHRFLSLSKFLAALVLKYNVRHGRIDVNSLCYIKCLWMRYQHGTLAKH

SEQ ID NO: 959201 - protein, 53 aa, Homo sapiens
TYYYRDSADITHDMKQSRDSLCKLGRYIPPASILGVGSFATPLFTFKRISGYR

SEQ ID NO: 959202 - protein, 36 aa, Homo sapiens
TGTVWTRVLPDLGLPLLATLFFIRWYFVFLDAFLPS

SEQ ID NO: 959203 - protein, 43 aa, Homo sapiens
MEEEEAAKKRKKNLMMKLQQRKKKKKRNQRLRKVENNCLGTGE

SEQ ID NO: 959204 - protein, 101 aa, Homo sapiens
LLTIIVYAGKRHIGGTDIRGTSQLPKLRFGGYYYEEDYYKHVPVTDNRCRLCVVTLERLPWLAQLRLELRRLRAVLRTPAHAPNNRYSVPMSWWCVENSQR

SEQ ID NO: 959205 - protein, 54 aa, Homo sapiens
ALACCCRSSRIPIGALWRWLNVPRSTVLAAQPNVCCPPSGASQYAMILRYEPMS

SEQ ID NO: 959206 - protein, 39 aa, Homo sapiens
PHRFQPLAEYSPLSPNSNTILRRYHHSVRSSLRPLHNMT

SEQ ID NO: 959207 - protein, 39 aa, Homo sapiens
VAYSRVIPMIYLHTAETNLNPPSALAEGKSELVSGLQYR

SEQ ID NO: 959208 - protein, 64 aa, Homo sapiens
LIPTWYHHPMRHTAERLNAGHTSDVYTLDSSLTPLIALIYTHNTLGPLNILLLTLTARVTISAL

SEQ ID NO: 959209 - protein, 67 aa, Homo sapiens
MRKLGECIEEAHQITHDGYLKLWQSEQAFLASFDAIFVHEAQDWTPAIMNIVLSQPCGKLFVRDRPR

SEQ ID NO: 959210 - protein, 72 aa, Homo sapiens
EDPVLPAYAELSVVCITSTEKLGTSSARIRRLRAVLRTPAHAPNSRYSVPMSWWFVENSQRSANISNKLVMQ

SEQ ID NO: 959211 - protein, 64 aa, Homo sapiens
SGKSGVSTVSGPAYVGTVVSSGVLLEEEIHEAQMVRVQAVCTLSHGTLGTGRNATPDSATCGLD

SEQ ID NO: 959212 - protein, 72 aa, Homo sapiens
EDSGDVTEDQVGYEQYLLCPLSHQTQVQTNKKEGTRDIKMKPEIWTETRGRRDWKRRGEGTEKKYDRYVNHL

SEQ ID NO: 959213 - protein, 80 aa, Homo sapiens
TRWFYPISRNSLDRNTGISLSQSVEVQTPISSCNGVNRLGDYRVVDAGTTRPTSAMGIRCLRVRLQEPGCESLDCRPRAS

SEQ ID NO: 959214 - protein, 63 aa, Homo sapiens
DGLPCSLTYMYDEYHFTKPAPITSKQHEAKPITFATFDASSCDVDNVNCRLYNVVHVLNRALE

SEQ ID NO: 959215 - protein, 106 aa, Homo sapiens
MEFGLSSFPPFFFKKVFNVCSPLNFGEALSNLGGFQQNSLHNSSFTLPNYGMHWVRQSPGKGLEWVAVISFDGKKKYEHSLKGRFTISRNHSNDTLYLQMNSLRIE

SEQ ID NO: 959216 - protein, 45 aa, Homo sapiens
RWLPGAPYTPSSPGRGMSQKQEEENPAEETGEEKQDTQEKEGILP

SEQ ID NO: 959217 - protein, 92 aa, Homo sapiens
SYGFGGKYCFNNDLLEGSAAPFDYQGKTNHESHKDYVRGFGGLCGVQTDKHYKCDLGSDHDDMLEPHHSQKYYMTGVGRQFGVHSERQDSDA

SEQ ID NO: 959218 - protein, 81 aa, Homo sapiens
CVVVYMGSLCWCTQEDRVHERDIVVYTGGLCIRGGGINGAVVPLFTGQSADEGDIVVYTGGLCRPRGGIDGVMVLVYTGGW

SEQ ID NO: 959219 - protein, 50 aa, Homo sapiens
NELPVLMVVSSSAISEYRKHLLLVLQSHVWLRFQIQHEQQQRHLTQFRIK

SEQ ID NO: 959220 - protein, 76 aa, Homo sapiens
HRGGHFLFRQQVLFTALVYTEEVWAPLPLWAKISYLNRYHKLGCIQDLVSLEDRSDVWPINSFTPCLKLVSYVNLK

SEQ ID NO: 959221 - protein, 70 aa, Homo sapiens
LVDYLLASRLAVIINLMSKKVYNSYALTADEQLEEVVSGNYKIRMVFRKIKKIFEELTYMYGSRVHFFTS

SEQ ID NO: 959222 - protein, 106 aa, Homo sapiens
MVPKKTWNSQRKGKCAVLKHLYTTDVLPSCDRGWWMLKSSQPGDLVGVNKYSYLILETLPTEYDSRVKAMEVDKRPPEQYSDIGGEDTQIQELVQAIVLPMNHKEK

SEQ ID NO: 959223 - protein, 33 aa, Homo sapiens
YAVRPLLSLPGLAVSCCKILTDRNSTPPSSTPP

SEQ ID NO: 959224 - protein, 156 aa, Homo sapiens
QYTGTRKLSDLHMSEGTSLAVVSILAMTDIRVFAAFSRRPLYLGIQVLTVTTPSGIKFNQNIFIFIIHYFIKILCYHYLHRPIIALWDRSSLQVSLQIAIKVILQAPLQSLPITENSSCLTNFSPLAVLDSNNRNLSSSALQATLRKFMAKGFAAR

SEQ ID NO: 959225 - protein, 40 aa, Homo sapiens
MCMSRWPAVMLAVRRTASAIGMNRRRLHGFRSITQSWGYR

SEQ ID NO: 959226 - protein, 35 aa, Homo sapiens
CLVVLLHSGTAETGTAWKLTWTPPLSEFGYLQLEF

SEQ ID NO: 959227 - protein, 103 aa, Homo sapiens
SGGLLPCRATLPGPVGGWHVEQPVQNAGAQQHGGDGRVVGVAASGRRQSRAGQFQFMQRTVRVGIHPVAAVQHRQRAEQVGGKTLHLGQRRAAGARAVHGNGM

SEQ ID NO: 959228 - protein, 32 aa, Homo sapiens
HTCTVVYTCTWESTPAPGSPTTCTGMSTTFTC

SEQ ID NO: 959229 - protein, 75 aa, Homo sapiens
PQISAAIFTGGLYYIPILQASQILSTSPVSPFPDGIYGSAFIVATGFHGLHVIIGINFLTICFIRQSNISPLHPN

SEQ ID NO: 959230 - protein, 36 aa, Homo sapiens
EQINNNLFELSHNTFSAIRNAPTVTRITPVQVWYYR

SEQ ID NO: 959231 - protein, 33 aa, Homo sapiens
NISALLIYANHPTIYKPAMAHPLMSGRSDYKAF

SEQ ID NO: 959232 - protein, 64 aa, Homo sapiens
RILNGCTISTVSTTDVIDGLIVYHEQHNQSAPGLVLELVTDENCRSSTYTLWKAERAAAKWKTP

SEQ ID NO: 959233 - protein, 52 aa, Homo sapiens
DPLLIIAAAIGMSVNIEVVNPIVDMDPRIGLAVIPRVTCPVGQVIGSIEYSS

SEQ ID NO: 959234 - protein, 70 aa, Homo sapiens
FSTGAAGPGHVLTPENLNAIVTGSSIPSGMPHACGVTTGYQPGSWGTKRLYLSCALIKSTQHSTLSVQST

SEQ ID NO: 959235 - protein, 59 aa, Homo sapiens
SHTSRFTISESGQRRLVTYTTTAPPQSSLASNKCSRLWGMGPSIGCYHQDAAVEGCRCL

SEQ ID NO: 959236 - protein, 37 aa, Homo sapiens
LPRVIRRVHDIEVSTTDVVDGLIVYHEQHKSECSHGW

SEQ ID NO: 959237 - protein, 40 aa, Homo sapiens
LVMRPSQLVQWHSLSIPNIFSSSAGFPLTWYPVNCQVGIE

SEQ ID NO: 959238 - protein, 64 aa, Homo sapiens
GREIPPMCSKICEPGYSPTYKQDKHYGYNSIQRLHIAMKDYHGQRSTQNGPVQGSFLVCIRDFL

SEQ ID NO: 959239 - protein, 56 aa, Homo sapiens
GCRSMLSGPSMNTRVIILLESMDTLQPGKSPTHTTSCPLTNNLLVKVGVALPLRLR

SEQ ID NO: 959240 - protein, 36 aa, Homo sapiens
RLTLVVIPTCTVIPLTSPSYVPITSPFYFSNQSQLY

SEQ ID NO: 959241 - protein, 55 aa, Homo sapiens
VKIRRLHCSFLFINKFFYTGPDQLCRLVASHCGSVHRHYIDVTCLFCHWSLSERL

SEQ ID NO: 959242 - protein, 87 aa, Homo sapiens
EPELHRARRSPARLVQGCLNAPASQVLVDQLVSVQCKRATNCSEIQVNDVDLIHHQSGRMHDAKALHKRQDVVAVLAIVRTRQVHRP

SEQ ID NO: 959243 - protein, 42 aa, Homo sapiens
KPSPALQKMKTVILNPFLRATWWQGSVCLLSEAVVEMAAPVL

SEQ ID NO: 959244 - protein, 100 aa, Homo sapiens
VFTTGATFPCKKVLLLLWIDTYLCTLCGFDGAAEHDRLRNASILGLPPSYCMDHAFKVTSQYESTLSTSICFQILIEHQHKRGRREHKALIKQDNLNAFN

SEQ ID NO: 959245 - protein, 40 aa, Homo sapiens
MTGHFTLLSNISEQVQRITLDIPVQVPVQVWDYRCRYGEI

SEQ ID NO: 959246 - protein, 117 aa, Homo sapiens
FNLLRCLGADAFRTSHYLYAEAVDADVYRYGIVVIDECPGVCLVLPQFYNKVSLHHHMPVMEAVARRDKSHPGVVMWSVANEPASHLESAGYSLKMVIAHTKSLDPSRCRCPEQVWD

SEQ ID NO: 959247 - protein, 45 aa, Homo sapiens
PHTHGVTLTVSTLTVSTPARERVFSEDRAVLCAEIVSALDYLHSE

SEQ ID NO: 959248 - protein, 127 aa, Homo sapiens
MASRELTPVESHANDSSLLARSGSLKQEHSKNIGLSIFLVAGHIMAVTTTLNVHGGSRMNRYYEGVKDVEWENEKGRYIIRNVPFHVYEEYTNEAVYSSDVTLKLLLLKELMEENEIPSEIDFMKAK

SEQ ID NO: 959249 - protein, 174 aa, Homo sapiens
PRITTCSSLALMSYPLMWLTWTAGLCALCLATVVPLGVRRLRFTTGMTECILRWLACCAWGLLTDSMEQGRAVCAHAQHALRGGGDGHGFLMSVQELKVSGVLTRICPTPQDKTELCNKQYQLIKAESKSYNIPVNDLVNIPRYRSLCGLKCGSVKEETQNSQDSMKHFTHSTQ

SEQ ID NO: 959250 - protein, 67 aa, Homo sapiens
MLTHQSTWIEIGQFLERSRSIVIPIGSNEQHGPTGLLGTDWMCPEIIAHEAQKNADILIGPTFNIGM

SEQ ID NO: 959251 - protein, 83 aa, Homo sapiens
SAAVLLDLWRCIICNTYIDSNKGTVDSVQARCALDKATVTPESVYKVQSVTIVCEALKLGQRILQCNASYCLKENQGYSYRGY

SEQ ID NO: 959252 - protein, 68 aa, Homo sapiens
QKDKENDNETRFSLKGKKKCILNPYTYHALLLPITVKFQHASSEPTHYSLCLMFLTVVVFYFLLIILG

SEQ ID NO: 959253 - protein, 71 aa, Homo sapiens
SIHLLDEDERQRLHKAHLLKPYLTTRHQEIDAWNQQLDAPESVLNHRQMTNIGTFRAYLNEYLRHHPRIRK

SEQ ID NO: 959254 - protein, 44 aa, Homo sapiens
SSSVLAAGGGEIRYGQQDKVTRPCQGMCQPKTGTRLTSEQDASY

SEQ ID NO: 959255 - protein, 140 aa, Homo sapiens
LRSDRELDGGDIADGLRRVRYTLYISPVVNLRCTAPHTHHACNLDIHNTPGIERHRAQLVWLRVNPLTVLGHYRPARHELHLLVVKESLGIAVFFACPDILAEVAGVHRLTVRPLFGFNLDELLRCTGRLVNHHHIRLHL

SEQ ID NO: 959256 - protein, 54 aa, Homo sapiens
HTALRAQGACGVIRMSHSLQHSVPASPFGPGRTGGSRWSHAQLWQHPIHHSWPQ

SEQ ID NO: 959257 - protein, 84 aa, Homo sapiens
YTGLLIPFLHQRLHLSESTSCISRDMSLLSPACKETRANKVTHFLLQRFPNRKQIQGPSGKTGQALRSAHEVSPTLVMHVGYLS

SEQ ID NO: 959258 - protein, 60 aa, Homo sapiens
VSIPCVDESCPSVDVCPPPQENHPQHLQTCRHTNQSAGPVPPGEHFIHCLWAVRSSSSGV

SEQ ID NO: 959259 - protein, 44 aa, Homo sapiens
MNENLFASFIAPTILVPTLPPYCIILIIPRILTEQDGGYRASKF

SEQ ID NO: 959260 - protein, 78 aa, Homo sapiens
SAHPDGMRAHANNDLSVVGNGERARDRNNMGKPPFPLVVVHGAVHQLERDLMTAGVREAFNSPNLFQIHQELTRKEVL

SEQ ID NO: 959261 - protein, 64 aa, Homo sapiens
SGVSIWLTRHTPRKPYEDDLLLDASGGPRIHLILFTVGRLTGLLLTKSSLDIVLHDTYYVVTHI

SEQ ID NO: 959262 - protein, 81 aa, Homo sapiens
LDDSLGDVVTSGPLDEVSALPETDLHRSSTHAVCRSGSGLVGRQFEEFLNQSSRFYFWMNGAPHRLPAVELTGSKTHILDV

SEQ ID NO: 959263 - protein, 39 aa, Homo sapiens
LTVPEPTRRPTVIVITLPLTLTITAGELLVRSVSKCTPP

SEQ ID NO: 959264 - protein, 62 aa, Homo sapiens
ASCWPHFNRKCTSVGARIELIAALCVAKAKVLCCVAVSSLERGPVSAASVSCYPTVERLLNM

SEQ ID NO: 959265 - protein, 34 aa, Homo sapiens
HLCFRHHGRLCHCLSTLTVDCSPAICFFLSFYFY

SEQ ID NO: 959266 - protein, 56 aa, Homo sapiens
TYLSILRFHTSLSTSWSRTNLSVGLNGPAQDSSLRRVTRLDAYHAVISIPHLDYSR

SEQ ID NO: 959267 - protein, 46 aa, Homo sapiens
DCVATSAATGPVRDTINGYTCTCPRSAVGPWVGGVTEGSTEALGAG

SEQ ID NO: 959268 - protein, 165 aa, Homo sapiens
GYDIVVITDDSHHAYPDHRRKARSGNKDLQELGIELDEATRWIKGLDRIHRVRRISHCFDLTGTPFAPTGKTSTETALFPWVISDFGLNDAIDSGLVKTPRVVVRDNALPNAQTYKSKLYHLYREPEVGQDLNRPGAEPHEPLPQLVQEAYTLLGADWRETLKAW

SEQ ID NO: 959269 - protein, 185 aa, Homo sapiens
SVRSLRPDVDRKYRYAKRKARRAEETDSTKLIGDEQLSGGAFTGELDNAVDNDRLQEPATGATLGKIGIASPDDIAACCRECARRSEGMGLRYSDNRAAVFPKVVQVATERWDEIVEWIMRESGSVRAKAEFVPEGENGEEGRKAPGQAGASDPPAYTLNRNSITSPSWTTYSLPSWRSLPASRA

SEQ ID NO: 959270 - protein, 125 aa, Homo sapiens
MSRGTDANPGKPPLKRDKPFLENALKGSGFIPNLLAVLDNAPAALETYITVSGLNAKSDLSLADREVVQLIDDTNHGCDFCVAGHTAVARNKAKLPEDVIDALRQRGELSNERYETLAAFTREVI

SEQ ID NO: 959271 - protein, 39 aa, Homo sapiens
DCVLTRTTSVFPSGLALGLSDPGVSGSSPQLHLGPLGVP

SEQ ID NO: 959272 - protein, 79 aa, Homo sapiens
LTYRIPVQWYCVGVVVTVGQRKEVLSPEKTQALSSVVTGHNKDLGTQTYICNVNHKPSNTKVDKRVEPKSCDKTHTCPP

SEQ ID NO: 959273 - protein, 178 aa, Homo sapiens
RRMTVVQKPAQRQKSSGKGVSSDHEVGFQERHLDDGHQVITSSTVDNGITSNIGRGPFPEAPEPFLSGNGLVGIDGALVSPTTSSPGLSLESDLYHIRGLGHSHSQGTCGAACQEAAPNAGMLRALGVELFDRIIQADADRGKAHLALRAGNQPIVEASGALSTHHGQNGAHHTAVLG

SEQ ID NO: 959274 - protein, 40 aa, Homo sapiens
PPRSEQILSQFFLGYLFLLGNLLFWFRNHLVLSVILISNV

SEQ ID NO: 959275 - protein, 41 aa, Homo sapiens
MSVSCSALCFAVTCSRLMVFVLLGLQVVVVVTAWVYGEFGP

SEQ ID NO: 959276 - protein, 98 aa, Homo sapiens
RVLRITDPVDIDVVGFDGTELAEMVSPQLSTIEHALAGYRPPSGSRLLTELKVEESCTRSTESGDVWTGADISRSQIPETLSTDNAPDTCANYRFRVG

SEQ ID NO: 959277 - protein, 33 aa, Homo sapiens
PPGSSECLANKWKLINIFKNNQYGPGDTPMAQD

SEQ ID NO: 959278 - protein, 51 aa, Homo sapiens
YGCRRSAVIDNSVYRTVKVLAIGITPITSDPDLDHWYRDSFKILEWECLAS

SEQ ID NO: 959279 - protein, 74 aa, Homo sapiens
QLLRVSLHHFRRLYGSTFLCSHRLPRSFPSLLAQSFPALSASSCQLIFHFTSKHHFGLRSRRLILALLQTRWLV

SEQ ID NO: 959280 - protein, 120 aa, Homo sapiens
TCWERGPRKRSFMYHAPENYGHRAALEDCIGEMFSLPWGFPSTQPTRGSKLWRRRACQLKIMQYFTHFIRSGNPNYPYEFTRKVPTFATPWPDLCTPAGGENYKEYSELLPNRQGLKKAD

SEQ ID NO: 959281 - protein, 34 aa, Homo sapiens
CDSIAIPGFTFICSDRCPRIWGTARERDQCGQRV

SEQ ID NO: 959282 - protein, 56 aa, Homo sapiens
MRKRSCLSGDRSQCRGEQVDWLAVPRRSVAEDVIFVGNDGRRIRRLPAKLPIRRIA

SEQ ID NO: 959283 - protein, 39 aa, Homo sapiens
SPLFSSSPTPLHIDRSIPRRPPYDSRVTETRHSLIIVTS

SEQ ID NO: 959284 - protein, 119 aa, Homo sapiens
WCCFAFHGAVAGFAGRINSVVLPVGKNKITVLSILQACISVALTMVIALWASAALETRLMQLPTAHMSLKVVLSRVGRALLILLALLISLTIVGIDLTVLSVFGGALGVGLGFGLQKIA

SEQ ID NO: 959285 - protein, 33 aa, Homo sapiens
MTGTCSRVHSGSNPAPRKPTPIWSATCLDLHQV

SEQ ID NO: 959286 - protein, 127 aa, Homo sapiens
RSPFSTGAISRQGEIGFPKAAIVMKASFPMAGNTVAGTFVYKEPIDGVSKITGRWEYDRLVDSGSDVKIYSPEEVAEYALYKESDELTRALDVVQQSDAKQIELYSLVVAGYGTEEVFRRESKFIEN

SEQ ID NO: 959287 - protein, 75 aa, Homo sapiens
MLITTHRPTCMMSLRQYPLIEHYRIKKLAMLVTYHGVDNKKNKGQLTKSPLAQMEEERREQVAKIKKMEMEMEQV

SEQ ID NO: 959288 - protein, 44 aa, Homo sapiens
SSPIPLLSTWYFHNHDPIFSYVQTPLSTTPTTITYPSVVLYRIS

SEQ ID NO: 959289 - protein, 43 aa, Homo sapiens
PEHKVRRKAMTIKVHADHMISSINVSAQCPPEVCPDKPGQKAD

SEQ ID NO: 959290 - protein, 61 aa, Homo sapiens
MLKPETSSDSPSARSKGVRLDSASVEIHHIMAKGPAGRRTQRCTCVVIRVERLQEPLISNV

SEQ ID NO: 959291 - protein, 56 aa, Homo sapiens
LSASPGLSDILLAGPVRKLEAEISELHALDRHGLLIHHLSARSTRPQALILLNYSL

SEQ ID NO: 959292 - protein, 75 aa, Homo sapiens
VPGNVHMLYPKEEQENRILLYACGNCDYQQGADNSCIYINKITHDVNELTQIIADVSQAPTLPRTEYLPNQGVPS

SEQ ID NO: 959293 - protein, 80 aa, Homo sapiens
YLDCAQHPQEQIYMGSVHILDLYTQTELPTYPFRFRASVLKNDLPESNIALCFDIYVICPFENHRFNEVLSLIDHVSYTV

SEQ ID NO: 959294 - protein, 33 aa, Homo sapiens
PQKMRFGQDGMTTLVSVTDSLVPNHVAENGIFI

SEQ ID NO: 959295 - protein, 31 aa, Homo sapiens
MLFKCCSSLLSSSRFRTVPTRSMSDKPGSRQ

SEQ ID NO: 959296 - protein, 33 aa, Homo sapiens
MGNDPTMTADDDMCTRIYVRRVSGHRKNRGRIP

SEQ ID NO: 959297 - protein, 47 aa, Homo sapiens
MLFRRGRCVFADEDAVSPMKMPFRDEASRCSADGRYRFRMKMAVFGK

SEQ ID NO: 959298 - protein, 86 aa, Homo sapiens
ISSALISVRISGDHSPSDSGTPMTFMCTGGTHLCSGAPCGMINDLIINMAQPDLLITTTNFYDQRTDTFNVLNDIVKINTPLKAMC

SEQ ID NO: 959299 - protein, 60 aa, Homo sapiens
QLIGDNDQFPLPKLAAEHLLQAKMIVLSGPGLAMSLRTYSSKRTVNMDYLSLLRDALGTA

SEQ ID NO: 959300 - protein, 65 aa, Homo sapiens
TQQAFQCIDHAVAGFIQTLKLYKTMTMSLCITASLRLIAKYFSVERRGRSTRCTRNYLLKATLSK

SEQ ID NO: 959301 - protein, 40 aa, Homo sapiens
ISWQCWGCWLLTPLSNTLQCQVAATSQCLRMQAHRGRPAS

SEQ ID NO: 959302 - protein, 39 aa, Homo sapiens
VVDSGLEEPALKIEWNIYIEATQLQGTDDASMSVLLFEG

SEQ ID NO: 959303 - protein, 34 aa, Homo sapiens
PYKCARILSTACGSLYDITRLQGAVFLELGVGEV

SEQ ID NO: 959304 - protein, 37 aa, Homo sapiens
LEDRVSYTDSWECGSISPQSHNTWEVLEYIQIRLVGY

SEQ ID NO: 959305 - protein, 119 aa, Homo sapiens
EVERFTASSFGHPMFKLLRNGDYQAVQCRRKGLLVCGRQWTEMHGTRQQGEPTSCAEVQSCASKGSRAVSRLYFGTTGYFKPARACSLPQTTTMGLSKSSPNLHNLTTHDQRALCWTLG

SEQ ID NO: 959306 - protein, 97 aa, Homo sapiens
RGPEEDIVEQSCIRLRAGALFQDRAARLGKSISRLIVVASLIDKPTQIEEGPVPGPVRVFGGFSSSYVGSLSVYQATKQFQPPQCSLQNSGLPSSWR

SEQ ID NO: 959307 - protein, 43 aa, Homo sapiens
MSPRDRVSSGKSMWQQCAWSDVCCPVSYAGPGQSVRWTKDGEE

SEQ ID NO: 959308 - protein, 162 aa, Homo sapiens
RRTYSWTTRGTHSLVDTHELPSLSDTCTSANHHSGISGRTGPVIFSKMVLLHPNQAFLKPQTPHRRQRLLKPRTRHSIHLNLPNATAVKRRHRRSPWRQSPSDPGDPLLSGTVHPTPGIADSTTQRSTAGILLTRGLTGAETGLMSETLTYLDKGNYIQPIH

SEQ ID NO: 959309 - protein, 46 aa, Homo sapiens
SWYRATDVWGRNWGGFRTVHTCTFTFYRLLRLLVDVRDDLTDGRTT

SEQ ID NO: 959310 - protein, 45 aa, Homo sapiens
PLTTPDGHYLWYELVYLYYRTTTERRTYAEGVFALCSQGWQGAFH

SEQ ID NO: 959311 - protein, 77 aa, Homo sapiens
WSIEIAFPSPILIFCELTETQGPSAPMTGTIGKVFVQAGDEVEAGGSLMVIIGLKMEHTIKSPKDGTVKKVFYREVA

SEQ ID NO: 959312 - protein, 86 aa, Homo sapiens
LLGYSRDPVRQIMLMSASLEGIARKIKSCSGRRALEDEALWASAGWRPDTLEEQAMLEVKSWFLARAGKVRGQTPKVGKQEKKKKK

SEQ ID NO: 959313 - protein, 60 aa, Homo sapiens
IRDPYTRPSDSATLVSATNSEQRLTSSVDAPRLDRKLDVFCASSRALSYRSCYLGAGHEV

SEQ ID NO: 959314 - protein, 182 aa, Homo sapiens
PPSTSDGQEMSDPKCICAIPDHRDWKELKLVLTLVGVGWFLLLPWFLSLFLFSNFGLPVSSVKSSNPQGRNHIILCSSCLGERATLYGAVIFLAVPCLELMFTLTQQLCHLGGWHFGLGSLGLCLAKPAEGKFAATFGCGHILCKVLTPCSVEASPANMARWLSLPFWVPIEHKLSSEEAGP

SEQ ID NO: 959315 - protein, 38 aa, Homo sapiens
RGSRLPSTSGEEEDRLLSMAQLYLNGELVGRSCRRTES

SEQ ID NO: 959316 - protein, 44 aa, Homo sapiens
STSDHMYQKMIVFLSGFFTFIDLDLSQLVDYQKLENRSETSMVG

SEQ ID NO: 959317 - protein, 90 aa, Homo sapiens
SYPSHIEAGKAGLPGRVCGKEKRVFWGPVVRENPVSQVLDARVNGFLFHFLHSFFNSFRKLPVLPLCRVRVIHLGALSGARGWGLGKWVT

SEQ ID NO: 959318 - protein, 40 aa, Homo sapiens
PKQQHIWSQASQQRLHKGSSAVAKQLNQVASSPASENGKL

SEQ ID NO: 959319 - protein, 70 aa, Homo sapiens
VLQYLTLSYVTCITSSECLPALRLTGLPSEPHLRFCIYHHTARLDVLSPYISVHTVYSRVKILGTGKSNG

SEQ ID NO: 959320 - protein, 64 aa, Homo sapiens
KDESSSSVTLPRPNPARQLSDYSELQRVKQELLGEVKKELQKVKEEIIEAFVQRAEEAGFSLYH

SEQ ID NO: 959321 - protein, 86 aa, Homo sapiens
GNVDKQFSWASCFNLGFPVYPAFSPLEIVWWAQMYAHQYYMQYQAAVSAQGHTSNFKPNQATTSQALNLGMFLEKKPPTRSKTNWG

SEQ ID NO: 959322 - protein, 89 aa, Homo sapiens
LKHAPVKRLVVWKRMEILSIATTASLSTPVYHVLFRPMLLQLIVLSQSSLYEELAYVLAVGHPELNYFSIFRLLNYSTIAGKLYLKRLH

SEQ ID NO: 959323 - protein, 86 aa, Homo sapiens
MRVTVSWRDGSISLSKIGRRGSRRETGKAQILRAGAGHSCMVERPDNHQSPHKLCYGRVSQGLINRAARHILGLDSVEWDESIVYA

SEQ ID NO: 959324 - protein, 43 aa, Homo sapiens
MYNAFSSEIEDLRTFQHRNVICVVGPASPITVPLRESSPKKEE

SEQ ID NO: 959325 - protein, 32 aa, Homo sapiens
SPLALNSEYSAMLLPKGTLLGKYTLETRVSVE

SEQ ID NO: 959326 - protein, 139 aa, Homo sapiens
PIIYPRIKPGGQIQVQSQLQMACGAWLVSNATHVLESETPNGQWFTGILGSLKIADTQENAYLGAANQATGADPNNLQSFLIWQILRSISGAKLVKVVGTKNNGGVSPVGFVDVQPLVNQLDGWNNATPHGTVYHLPYF

SEQ ID NO: 959327 - protein, 117 aa, Homo sapiens
LLRSESSASAPIRAGARRRPGLEERPVELFAQERFIGAGTYDVTRVEPKTIENNRVKSVFYTDLTAAVRLKDGYRFFLTVNNLFDRAPPLAPNGTLFTFIPTNPLLYDVTGRQFTAG

SEQ ID NO: 959328 - protein, 126 aa, Homo sapiens
TINRGWIPNVNQLLTIYSKTIYPHSSCLLSILFSTPQPQLKCPFRKDAFSATCLDYSQIASLFFWYCDAGTVYVWLCFSQTEGILGDSSNTNWMGRQVIKQSHGYCTEHSMPHKDSGPSKSDSSRA

SEQ ID NO: 959329 - protein, 71 aa, Homo sapiens
LEDGKPGRLLRLTGEDGIVRMDLDEQLTILHPPLPGEAPGSLKHAGPVDFVRMKRDPPSFPGPWSVTHDPP

SEQ ID NO: 959330 - protein, 59 aa, Homo sapiens
ICQTVQVAHTARGGGTYVGLYDKLAVQLVPQRSQVIALIYRHAQELLGIWVRHVTPDSM

SEQ ID NO: 959331 - protein, 138 aa, Homo sapiens
QETLLVVITSIEMVTACPLSILFHTAAVPEPVQRYAILTCALFKVVDLYAWLLEGSAVSYFYPVRIDLPSEEAGMTQQDEKTLWSFNLLMQPVPKKPTGPETTNPALEISVGATSEQMPKLRGVHAKTSPVKANYYTL

SEQ ID NO: 959332 - protein, 92 aa, Homo sapiens
SSNFFELRVLKASGAAVMRDGVLLMPERETCRTTLNRLAMDVRDGGGTALVLRIEEPADSYFIDLFDRSEDYATLLIDITKARDTMSTDTVQ

SEQ ID NO: 959333 - protein, 90 aa, Homo sapiens
LFRGPRGSRTPRGRVISGGRAFARSPHAHLQGEADEVGGAGDAELGLDGGEAVGHGLVADAQAVGDFGEAPTLGEQAEHFQVPKSKEIRA

SEQ ID NO: 959334 - protein, 50 aa, Homo sapiens
LSPRTDTTLVLLMGMNGVHGLFDHHEMFFYGLPPSACSCTDLFCPFPFTA

SEQ ID NO: 959335 - protein, 64 aa, Homo sapiens
VVGFSRGPDALHESTMCSDAPLPCRGRVQTRGPVLHPPLPLADSQTTTPYCTQIARIGSEEVSH

SEQ ID NO: 959336 - protein, 98 aa, Homo sapiens
TEEAESANSLRPGALCFSRITQDIPKSQRSDPAGASYAAATLQASSAASSASPVSRAIGRTSKPQESPKGKRKLDLNQEEKKTPSKQTSPAVAICPQA

SEQ ID NO: 959337 - protein, 68 aa, Homo sapiens
PRHVLSYGEFTGSISAARSSLSCLRVRPSPHFTYATLIPRVCQHTGRMRGLTLGYQIPLVISSPLPIR

SEQ ID NO: 959338 - protein, 187 aa, Homo sapiens
RQFLQHVELVRPVVYPTQSQCGPEELGTSVKNPKDKRPVWFGESVTDGFHVRVWRSGLRSLRDVAIQLTFLRLSVHRGLPEHHLIHCKNSVAYMDQHDWQPQNALILQGSYDIEIRAECNSSLRASGRQVSMAATSHTGAWGKTVIEYHITMSSRLPIIDVLPLDVGAPDQAFGFDVRPVCFLLLPQ

SEQ ID NO: 959339 - protein, 49 aa, Homo sapiens
RCAALSARLRLYSPKRLPHNTFFTAQSSTSLWTPRKAKLRDLSAASTSA

SEQ ID NO: 959340 - protein, 47 aa, Homo sapiens
MLGAQREVDSSIVGPPRKKSPNELVDHLSKGAKEHGSCSFGASDQSC

SEQ ID NO: 959341 - protein, 37 aa, Homo sapiens
MPEGPVLTAPFSVSNDVIRQAGSINELIRFDTYIPSL

SEQ ID NO: 959342 - protein, 35 aa, Homo sapiens
FRRLAGFFGVISRIILVFSLLVTFYFLSLSPAQPG

SEQ ID NO: 959343 - protein, 94 aa, Homo sapiens
RYREIGAGDTLTARSAFHIPQFAKVHVTPHHQTHAQTGRNGAVITSARAGSGRFALSVQDVSFVGFNKTTGHATHVAEPPSQLIRKMKIDGIND

SEQ ID NO: 959344 - protein, 48 aa, Homo sapiens
AHTQVVLSEVVLVELCWSQVVQVAKLCWCQVVLVPGCAGARLCWAQVV

SEQ ID NO: 959345 - protein, 39 aa, Homo sapiens
LAHLGPSTTFMHNLCDQHYTWYQHNLLPQRDMHIPGDSA

SEQ ID NO: 959346 - protein, 36 aa, Homo sapiens
PELCCRKAKNHIRLSLSYSSSTILLTKDPGTRHNLA

SEQ ID NO: 959347 - protein, 57 aa, Homo sapiens
ARTGSGLMLLQCAPFGGGKFTLVLDSVLQGHGLVQLVVVSAYPCAGTARSSSRMSFW

SEQ ID NO: 959348 - protein, 39 aa, Homo sapiens
TLTRPDLSFINYTSYTIKVYHNHHPIILFHPPQLSLAPN

SEQ ID NO: 959349 - protein, 35 aa, Homo sapiens
PHKTCKQYRQTSIHRRSHSHNRPRTYILITILPLQ

SEQ ID NO: 959350 - protein, 35 aa, Homo sapiens
DPHKTCAANQAYTLSHTSYYRNHQPTHSTNSPGRC

SEQ ID NO: 959351 - protein, 48 aa, Homo sapiens
TTCNSNYHLPLTKAHKIKIKQTLQTSNAANQYRCKPVPLQTSNRCKPV

SEQ ID NO: 959352 - protein, 37 aa, Homo sapiens
TQDLLLTSLVLMNRTAYPRFRCKPVTLQTPLQTSSKP

SEQ ID NO: 959353 - protein, 48 aa, Homo sapiens
VPFVAHADKAVLRCQQGIADRNAFTFGGGRLRSLAHEALNSAQILADK

SEQ ID NO: 959354 - protein, 47 aa, Homo sapiens
PYSGTTNSYTVHMKKVSTHITRVTLLDLICLHTHYNRPKSFPGLHIQ

SEQ ID NO: 959355 - protein, 38 aa, Homo sapiens
TIGGMLFEFISNSAVAAGTWLAEILVSEGLGAVPHANH

SEQ ID NO: 959356 - protein, 59 aa, Homo sapiens
RPDTFKMEFVNSATSSHHTNHSSVWLRRYLLGAGGHLHTGSSWSQGLREEGLGEGHKQE

SEQ ID NO: 959357 - protein, 42 aa, Homo sapiens
GTPHKTWQKQEAPLCAVILNIGSEHLLVNDIFCQSLPGSPFK

SEQ ID NO: 959358 - protein, 104 aa, Homo sapiens
MRSATSTKTAFSKEQDEVNVGTESSCHEGCVALLGERHPQSVPRRYLTLCSRSVKAKKQKGPTENSSGDGGRSSKKKRQPRPTEGSVRNAGSSVYTVFKKIQCD

SEQ ID NO: 959359 - protein, 64 aa, Homo sapiens
PARLILWYARPVYICGLSIRPSPAPHTNHSSVWTDENILLGAWRASSHGFFLSLRILCEEHKQE

SEQ ID NO: 959360 - protein, 121 aa, Homo sapiens
FIEDSVKNAESGVLFLVTHAPGRLLATIRSRCRRLSFPIWTPDRLTTLVRNRTGVDLEDAEHAAAMAGGSPGAALALAAGTTFEMDQLARQWVEGDIDRAEALSIADKFRGAEGQERFETL

SEQ ID NO: 959361 - protein, 35 aa, Homo sapiens
IELGPLLLLRKTLLPASRFLLLPLPASPFLDAHHD

SEQ ID NO: 959362 - protein, 55 aa, Homo sapiens
YYLYKPITHRHWNIYYLLFLALELRSSLGSALNLLIRSELVQPGHLLGNDHIYNV

SEQ ID NO: 959363 - protein, 74 aa, Homo sapiens
MTSPKSALASQCIPINFYQQACYFITVFWPSRAKTTWYFPLGPPGGPIQARYNLAGSTPQGPPGILSGVPRNSS

SEQ ID NO: 959364 - protein, 55 aa, Homo sapiens
MPLITLIATSLDSAYERSNNSSHPNRSTSPSPPLLTLTKISPTLLNPIKRLAEAG

SEQ ID NO: 959365 - protein, 141 aa, Homo sapiens
MEEFHGMTLHDDDSCHVIPVLPQVMMILIPGQTLPLQLFQPQEVSMVRNLIQKDRTFAVLAYSECTGKGSTVWNNSRDIAYREEQDFGIEIVKVKAIGRQRFKVLELRTQSDGIQQAKVLNSSRMVLPSDMAAVQLESLNK

SEQ ID NO: 959366 - protein, 127 aa, Homo sapiens
SDPRLPHLPLTKTLLDNTVSRALPEFDGNRFQNVARKGVKFDEREKTKESRDSETPDVSLLLNWMKDKALKDKIEEAVVSQRLTESPCALVASQYGWSGNMERIMKAQAYQTGKDISTNYYARQKQE

SEQ ID NO: 959367 - protein, 32 aa, Homo sapiens
SWFCLTKTSGLTTDPVLLLPVLIISEGGENSS

SEQ ID NO: 959368 - protein, 46 aa, Homo sapiens
MRFSGEVTPLRIEISYRMAEAGRHSGIFFWRGLRELFTHDRRQKQE

SEQ ID NO: 959369 - protein, 35 aa, Homo sapiens
DPSPDPGRSRKQPFGRSRKRQKQEAGVLVRGRSRK

SEQ ID NO: 959370 - protein, 48 aa, Homo sapiens
DLHTRAVMFLYTGFSTGTLLEYGLQSFPKNVKFHHVLATIGLRVAAGR

SEQ ID NO: 959371 - protein, 52 aa, Homo sapiens
FCFCHGDKFFDVLLDSVCRSSSSDVLPASARLLLCSINSQQNISSLTCVLPA

SEQ ID NO: 959372 - protein, 56 aa, Homo sapiens
MAASCFCLLLLQNGCFLLLPLSCLVFLLLAASCFCRFLLLPLSLSLSLFLSQGLEE

SEQ ID NO: 959373 - protein, 111 aa, Homo sapiens
TLEGRTSFRYGGLIHRYTVWRGAGSRRLKVSWLVIKAETRYQRKPVTSYVRTTINKNARATLRQHQTHDPARTTYLSRTIACGGIRRASAILRSQNPVMVKRKRTRPTKSS

SEQ ID NO: 959374 - protein, 46 aa, Homo sapiens
PHKTLAEAGSKEKNEKGALKRRAGDLLEDSPKRPKEAENPEGRSRK

SEQ ID NO: 959375 - protein, 36 aa, Homo sapiens
PHKTLINRWRHTEIVRPHLQNASIRRGRSRKRQKQE

SEQ ID NO: 959376 - protein, 48 aa, Homo sapiens
SQDLNHQYDYTFDWTMLRQKQEAGRSRKRQKQEAAGTGSKQQAAYLTT

SEQ ID NO: 959377 - protein, 36 aa, Homo sapiens
MLLPLLLLCFLLLPLPASAMDQGLVRGYPTLDTSYT

SEQ ID NO: 959378 - protein, 56 aa, Homo sapiens
QDLVGRSRKQAEAGESLEPGRSRKQVWEGQKQEAEEGEEKKGKKIKTHHAPGRSRK

SEQ ID NO: 959379 - protein, 78 aa, Homo sapiens
MLPTMPKTNNDIAVHYIYSHKLSTTHSLFTNIVPIAILNLCRLRIIEWSRIPTILKSPINHIVYDYVHNLNLPHCFRA

SEQ ID NO: 959380 - protein, 40 aa, Homo sapiens
PSQTLLGWQKQEAEAVLSIFFLDAPSTLADGRSRKRQKQE

SEQ ID NO: 959381 - protein, 44 aa, Homo sapiens
SSWGLFAWLVAWPLAWLVVGYLELYGPEVGTRCRIQFTLCYPHA

SEQ ID NO: 959382 - protein, 53 aa, Homo sapiens
MPVASHSIPASASAPLLLPASAFCCFLLLPSLCCFLLLPRSWCRGSRSSHIRN

SEQ ID NO: 959383 - protein, 39 aa, Homo sapiens
SQDPVQLGILRGRSRKQLCCANGGEENFGSLPGPRAEAG

SEQ ID NO: 959384 - protein, 34 aa, Homo sapiens
FCFCRFLLLPPASAASCFCLPAASCFCHSSQGLV

SEQ ID NO: 959385 - protein, 76 aa, Homo sapiens
LVVTKRDAARVDDVVKSMYPPLDPKSHPKSPAKSSTTSHAKSRTTSHTTGHPKSHTKSHPTSPTTRHPKRTPGASR

SEQ ID NO: 959386 - protein, 39 aa, Homo sapiens
LLRFLLLPLPASAFTFSLLFLLFFTFFIFFFLFFLLLLL

SEQ ID NO: 959387 - protein, 67 aa, Homo sapiens
HRVYCDHHIFTVGIDVDTRAYFTSVYQIIAIPTSHEPRNEPRYGPRKVPPNAPLNEPRKEPHQEPHQ

SEQ ID NO: 959388 - protein, 36 aa, Homo sapiens
DQLGTNIYNQPTSHYYPHVTQHRHLHKERLKKVKGT

SEQ ID NO: 959389 - protein, 42 aa, Homo sapiens
ARRPVQLSTLLSVYLLNPATSHTIEPREEPPTMPRKLSRVPE

SEQ ID NO: 959390 - protein, 58 aa, Homo sapiens
SSYRVMWAIDEKAVEALVSSAWLGIFLLLTIWRSPTDKSATAVSRSFHHARPIVNSST

SEQ ID NO: 959391 - protein, 63 aa, Homo sapiens
SRQDNNLAAGCRRSCGDWRFWGQNNGPCASKLGHGGQPKFQKKRCSVNDVWQELWRQNNGPRK

SEQ ID NO: 959392 - protein, 40 aa, Homo sapiens
IAFWLLVWLVGELPLPPGSTVLTSGSQGTTVTTLLSFHQG

SEQ ID NO: 959393 - protein, 41 aa, Homo sapiens
ERMSRYRFCFCPHQNPASPPCTYEFEQHTPGFRYDQLIHLH

SEQ ID NO: 959394 - protein, 102 aa, Homo sapiens
APWVGESTDRLPVTTRNIPLSILRNPSSQLPLPEVATRLATQSAAHGVCSLCLRNSQRLSLHNEAVAAETPGHCAPGSQLPIYELSLPSTLVGLWFLSSEGF

SEQ ID NO: 959395 - protein, 63 aa, Homo sapiens
RMQRIAFARWQSARTRDQWRTGMLNRLVAYTGWRDMLDRRAGRTLRRKPNRQRRTSFRHYGKR

SEQ ID NO: 959396 - protein, 37 aa, Homo sapiens
RWELKLADFGLARANVSAHKDFSNEVCDLCRYLPPEE

SEQ ID NO: 959397 - protein, 37 aa, Homo sapiens
ALCCTSHLDSGNLSFLQSCAAVQVGENPVFILHEPPK

SEQ ID NO: 959398 - protein, 44 aa, Homo sapiens
RSVGIRFAHHAKPVKHYLNFTSSIANPTKTLTKILNPLDPLCLM

SEQ ID NO: 959399 - protein, 129 aa, Homo sapiens
MGRHSLPSSSAKLIMHAMAEWYMRGEQYDQAKLSRILDVAQDLKALSMLLNGTPFAFVIDLAALASRREYLKLDKWLTDEIREHGEPFIQACMTFLKRRCPSILGGLAPEKDQPKSAQLPPETLATMLA

SEQ ID NO: 959400 - protein, 61 aa, Homo sapiens
MGLKDWIGQTSDLIFQGETNVLGYIPDLLVTDAHSADVSHMAAQHRCVLSPNEPHNMGPIN

SEQ ID NO: 959401 - protein, 58 aa, Homo sapiens
RLGRKKRKKLLGHNDGRMNHVQIKRPINGVAAPIILSILPLRATHESPATSHARSPTM

SEQ ID NO: 959402 - protein, 35 aa, Homo sapiens
LEGGSSRGSLGGACGCALGGGHLSLILHKRSRVYQ

SEQ ID NO: 959403 - protein, 78 aa, Homo sapiens
MPIEGISCRLLLILFASAFSLKDNGLPAEQENKHRRYVEHSDTQELYKTRVNEPHGFSKISTGLLKTLNCPDSKPIGD

SEQ ID NO: 959404 - protein, 50 aa, Homo sapiens
SCVALGVARCGARIVCTLSWRLGWLFGWLFGWLFGIRSDPIPSVPRLLHV

SEQ ID NO: 959405 - protein, 41 aa, Homo sapiens
TGPEDFTSMLIKDPVSWLPSSSSCPSVYLGSPSILSLFPRK

SEQ ID NO: 959406 - protein, 40 aa, Homo sapiens
LVRGALRWLFCGALGGHIAGRVVVRLGWLVRVLARGCNNE

SEQ ID NO: 959407 - protein, 47 aa, Homo sapiens
LVCSHDKPEEHPTRHPKSHAMSHPMSHATSHPKSRANVATRTRHPSE

SEQ ID NO: 959408 - protein, 44 aa, Homo sapiens
EITISRGGGTKFFHSEVYELVVTEIGAYAVRIHKNREVRSRVLV

SEQ ID NO: 959409 - protein, 33 aa, Homo sapiens
LVNVFDVIKGEKEDRSKPEGVFDCVVRVEVYYI

SEQ ID NO: 959410 - protein, 34 aa, Homo sapiens
ALRWLMVWPFVWLVEGSLGWLVAWLVVWLIEVAQ

SEQ ID NO: 959411 - protein, 33 aa, Homo sapiens
TAAASDPEQKYQSEHSWQHQMTDLGSSVPPLCW

SEQ ID NO: 959412 - protein, 102 aa, Homo sapiens
RGLSAWRLCCKRASWSGVCCADIMTLSMDHVLIPYLYASTSCGWDQEFLKVPWGCGGLDRTLLLGRHQVFPAPLPLHTHTHTHTHTHTTHTHTPSDTEGSAR

SEQ ID NO: 959413 - protein, 44 aa, Homo sapiens
TRSDEEAAAERLALEWALCARTQDFLLVAHPASSVCVLSYWYLS

SEQ ID NO: 959414 - protein, 42 aa, Homo sapiens
LNTGWYLSKLIRCVMQTTSITAAAVGCFRCLSYAACGRGSRG

SEQ ID NO: 959415 - protein, 44 aa, Homo sapiens
EPEEVDSSTEEVVSTEDGTSQNPERWHIFLFYTLVVLPSPPLCC

SEQ ID NO: 959416 - protein, 31 aa, Homo sapiens
MPHNLDFDARCRQMVVSWVAFVFYHPNPLAE

SEQ ID NO: 959417 - protein, 47 aa, Homo sapiens
MVPQHRGGGQLDGQQRENLLLVDLPKNNALQRLSGLRVGLLCAAPPL

SEQ ID NO: 959418 - protein, 45 aa, Homo sapiens
DSTEGGVILMKTRLLVEVWGSVWYVCACLVYRASQLRNSWIISLF

SEQ ID NO: 959419 - protein, 78 aa, Homo sapiens
RTRSTGEKGLMLLNFIFLFFSVFTYWRYDYVSPMSTISYYCFRDSTGGEVTRIIETFGIIARVELGTLETHPVAEYRS

SEQ ID NO: 959420 - protein, 44 aa, Homo sapiens
TGSRQHRGGIVWQSSYGQVSKKQAERTTTTLKSKFKSKGESSSV

SEQ ID NO: 959421 - protein, 44 aa, Homo sapiens
DLSPLGRQEVEGRGKSAKKDHETHVNKSGGRPIKKKWSRGKVRD

SEQ ID NO: 959422 - protein, 53 aa, Homo sapiens
CLQDPKRRKGTRNTKLKKKDKGEAGQRRNLLSADMNIFERPWGLLYPPLCPPL

SEQ ID NO: 959423 - protein, 47 aa, Homo sapiens
TAQRRYSLESLYGRSATKKRKNNNTQKEQVQIQGGRWLLCVGTDARN

SEQ ID NO: 959424 - protein, 49 aa, Homo sapiens
RSDEDYLYLVGRCRSSTGTVRSPTLNVAFSREQSHKVYVPAPANSNDRQ

SEQ ID NO: 959425 - protein, 35 aa, Homo sapiens
VVTLDDPDSTEEERRHPNETIHPQPALPPLLLCAV

SEQ ID NO: 959426 - protein, 54 aa, Homo sapiens
DSPLGQQQRREWRPLRGVTPSWSERTRSDHIYKYASIRRAASNAKVMFGSNSEI

SEQ ID NO: 959427 - protein, 39 aa, Homo sapiens
GLEALGSSGPPGGSSFLQLPEPVGSGHPVIHHLFHPCLP

SEQ ID NO: 959428 - protein, 36 aa, Homo sapiens
TLQDPDSTEEVDSTEEDYSKPYLSMLSTSSVLSHRG

SEQ ID NO: 959429 - protein, 40 aa, Homo sapiens
GCLEDPRRGGVPPLLSVLSSCPPPLCCPPPLCCPASSVLS

SEQ ID NO: 959430 - protein, 57 aa, Homo sapiens
MRGRPDHTGRCSLLRRILRRSVRLLPMKCSNCQQGALFADVQLLSWSFGDTDAFEFR

SEQ ID NO: 959431 - protein, 43 aa, Homo sapiens
ALEDLTEEKLETWHAPGHRNYGYVISHNPETKKTRVKLPSSVL

SEQ ID NO: 959432 - protein, 46 aa, Homo sapiens
EDPTEEGACPTPSSQPTLTMRQGLEVEFLAILAFRASLALPPPLCC

SEQ ID NO: 959433 - protein, 66 aa, Homo sapiens
AQPSDHYTIIFNTFVMMQLFKLRSTPVKIHCREEVFDGIFSQPPSSRTYRFGALSEIHDCHLSESA

SEQ ID NO: 959434 - protein, 69 aa, Homo sapiens
DSEHWGGTQAQRYRCGGTLELSEICWEEHQRSGIIAEVAELRLKDNAGKDSSSGITLGGIHAQGITLGI

SEQ ID NO: 959435 - protein, 36 aa, Homo sapiens
TAQRRGHCERAGWLREQQDDPSTPCVSCPSCCPPPL

SEQ ID NO: 959436 - protein, 43 aa, Homo sapiens
ALEVPKHRGGAGLGGTTPVRRPYVSLPCPASGWAQSFQSFLLS

SEQ ID NO: 959437 - protein, 85 aa, Homo sapiens
LRFPHDSKHWYAVVMSPVEPVDGLTTAKHRPRKKRSSPLAAVRLGDRTARHRGYRSVPSVVPTWVRLAYDQCSTTVYTCDIIPIR

SEQ ID NO: 959438 - protein, 39 aa, Homo sapiens
GQHRGGGQHEEVDSTVGGNQPERLNAGTYFLFYTPLLCA

SEQ ID NO: 959439 - protein, 57 aa, Homo sapiens
GGRLTVRKTRRPGDGLDVAVPKLKGVRWGSQNGGNVPASHHSALSTHSPPMAVHLLC

SEQ ID NO: 959440 - protein, 69 aa, Homo sapiens
IYNIHSHVSKIIISQDDVTRMRILIVIYTSMQAFLWGKKITKIYADYVEHKPMVRRRHRVTELAIRHSM

SEQ ID NO: 959441 - protein, 36 aa, Homo sapiens
DSTGEVDSTEEVDSTEEVDSTGASNGETLEKITNSR

SEQ ID NO: 959442 - protein, 64 aa, Homo sapiens
TRDEVNDFLPYHQIIWPPVVLKPTRYTDYGGLIFNSYIFPHYSKNQATCDSLYVDNRVVLPIET

SEQ ID NO: 959443 - protein, 37 aa, Homo sapiens
TRTTTTEPVLSFIFPSLTIVVLEARSLDQQHQHHLGT

SEQ ID NO: 959444 - protein, 40 aa, Homo sapiens
MSSTLYGILISRSDRCSTGPLSEWGSYHRETRQGFDLYMC

SEQ ID NO: 959445 - protein, 56 aa, Homo sapiens
SQDLSRSDDYEVKFSASKGHSEKEVADSPSGLNEELRVDEETQEVLENLKDRWSER

SEQ ID NO: 959446 - protein, 50 aa, Homo sapiens
TTYPRRKRPTKYNLPRLSVHTGRCVRQLSTSSVEERPWGSQRMGQPPSSV

SEQ ID NO: 959447 - protein, 85 aa, Homo sapiens
MEVEVEGEAVLGVSFLLALFFFLAFLLLLCAVRTEEVDSTEKTFQTALFLDRLLDGSPLPQEVVMSLSKCYSSYCAVHLPLGSEL

SEQ ID NO: 959448 - protein, 59 aa, Homo sapiens
MPVIGLTVRVIMTVSVDCTFGPLIVSPVLNLTQAYAEQNVFMLLLLTLVLLSGDRLVRA

SEQ ID NO: 959449 - protein, 47 aa, Homo sapiens
TTQRRGQPEGAEENGNSDTKKKAKRDYAVIQTPAHLDCFLSPPPPLC

SEQ ID NO: 959450 - protein, 36 aa, Homo sapiens
LHRARTDIPIQSTGRIGAWVKEYDGVVVVVNFNSVG

SEQ ID NO: 959451 - protein, 45 aa, Homo sapiens
TEEELRSKGDRQDICQHRVQVLQLQCPPTVPVLCQQRPPLPPPLF

SEQ ID NO: 959452 - protein, 34 aa, Homo sapiens
SPYRVATSPSYLYFYLRLIYSTSITLLCTLYGGS

SEQ ID NO: 959453 - protein, 37 aa, Homo sapiens
AAQVGQHRGGGQQEEEQKLEAHSDWVRDVAWAPSSVL

SEQ ID NO: 959454 - protein, 49 aa, Homo sapiens
STEEVDSTGSQRPWVYVSEGDRGTLLLQCLGAQGAGQWKSHVGGPLLCA

SEQ ID NO: 959455 - protein, 43 aa, Homo sapiens
RVMTNSLVWLYLETGMDTMTSLDYAVAEVLIGDFLTPSSSSVL

SEQ ID NO: 959456 - protein, 55 aa, Homo sapiens
IIYQDFGIISHMSLTTPDKKEPFGYHRYGLSYDINWHSYGFTRVSTPISLPVDIA

SEQ ID NO: 959457 - protein, 37 aa, Homo sapiens
ATSSVLSSAVTSICAVHLLCAVHLLCAVQLSTSSVLS

SEQ ID NO: 959458 - protein, 40 aa, Homo sapiens
LFLPTYSARVYPLPLCTILSLLFPPPGIAQPSRRACSPLW

SEQ ID NO: 959459 - protein, 53 aa, Homo sapiens
QLDQLVMLPLLLALRFLTELIRGTLCLIYASLWLLLCFPSRVPNPYYPNLPIS

SEQ ID NO: 959460 - protein, 143 aa, Homo sapiens
HAGMTSDNRAKAASIRYLEARIGAIVVKRHQATSSIRACMWGRGHYKGFAQGHQLSWVALKQVWCSNQCSMSIHRQQQGQQHSQAEGVFALCHKGGKVHFHRHMGKVHPQGVGLHPVSCTAIGRWSAARAAITCTGPRMTVQR

SEQ ID NO: 959461 - protein, 179 aa, Homo sapiens
PEDSVARTITRWFYHQLIPTFGIKNRIQNPDVKSILLSPLTRPVVYYVSCSAICVAKHSFMPIVRAELITSGPDSSPISEARSPLQQNFQDNNSRVTVVCGRPGRECNYSREDKDRQKMYATIYELKEDKSYNVTSVLFRKKKCDYWIRTFVPGCQARRSSRWATIKSNPGLTSYLVRA

SEQ ID NO: 959462 - protein, 44 aa, Homo sapiens
LYHIPVDNKVIFPKKEPIEDDVFQKICPLSKFIVTDLVIMMVRA

SEQ ID NO: 959463 - protein, 50 aa, Homo sapiens
MSAADQKTTREDKPSAPIKPTNTGHWRKDNYNYPLITVDYLSSSPTSSER

SEQ ID NO: 959464 - protein, 71 aa, Homo sapiens
DIVFPNGRAVAMGARYRQQLEVYPIYSKLSAGAPGDVHMAALDLYTTNVSFMGAHIVWYVDNTDPRTALRV

SEQ ID NO: 959465 - protein, 67 aa, Homo sapiens
SDSEDSGRSDIPLPLCRRYGVATGQLALRNIFYVNSVWRYSHGSQSLLEASWATACLVVRRGRGYRC

SEQ ID NO: 959466 - protein, 64 aa, Homo sapiens
VRPNYLRLTSDRLVGYDIYFRMTRKLRIGVGIEWGLLLRRGRRTVVLRLRSVSRIVMVRAEPGT

SEQ ID NO: 959467 - protein, 37 aa, Homo sapiens
DSTFAGTGTVWHGTVRLDSNCNVWLWNCTVRQDTRNI

SEQ ID NO: 959468 - protein, 83 aa, Homo sapiens
VPDTSAARLRFGDPQPIWARTVFLGFLRLNRAHCMPRGAAARLHLYAGLGLWYHNSGSSAGMLVPPLSTIGHLCSSDADRVPI

SEQ ID NO: 959469 - protein, 54 aa, Homo sapiens
FRSLGPSREGVSISTRWVSLLFKASISSSSRESVVGRWSHSLKIFRCIVCRPTR

SEQ ID NO: 959470 - protein, 40 aa, Homo sapiens
GALSWSPRHSSKLPYSEPMLEQPGRPSRYLIHIYCVIVRA

SEQ ID NO: 959471 - protein, 72 aa, Homo sapiens
ARTPPFWAPFISRSEIPSLTWLGPPPQLLLPVSPPRVWRLACVRRSVDFCGAKKRSAEVMSTSAVRRLLVRA

SEQ ID NO: 959472 - protein, 60 aa, Homo sapiens
GITVLLGLSFHLLGASEFFGFSLHRIRRRLRLHLAGIHQLPRTSRHYWLNFPHYLLRPSG

SEQ ID NO: 959473 - protein, 32 aa, Homo sapiens
MLDEITGPQVLGLKLNIANEVSTQLLVAPTRG

SEQ ID NO: 959474 - protein, 77 aa, Homo sapiens
MQLLPFARTHTSGDHTSGPLKREGMLASTVSQSNVFIAPAAIAKAVRGDLSPMSLQAPGVPEFHSSILVTDLGHGPS

SEQ ID NO: 959475 - protein, 40 aa, Homo sapiens
RNLAGTTIYLRQVSISIAYTLFGYWFGYGCLVEVMMTGFD

SEQ ID NO: 959476 - protein, 43 aa, Homo sapiens
VIKAQKNLRKITSEVINRIIPYRRAFLDRWCVVALDVLSRRNE

SEQ ID NO: 959477 - protein, 47 aa, Homo sapiens
MDGAMTTQDSEYVIEDGFSDETVRYAHEKLNAWQGFFATLVDVVVRA

SEQ ID NO: 959478 - protein, 47 aa, Homo sapiens
ARRGRREEAYRGLQAKVNRKAADRALPLPQISPLPVKTARGPPWSER

SEQ ID NO: 959479 - protein, 60 aa, Homo sapiens
MGKLGISSLRHRNPIQVDHYSHLFGGPSYIAFRRVHRRKQEGFDEGLMTGFDERFDEGFD

SEQ ID NO: 959480 - protein, 88 aa, Homo sapiens
ALNRDVGFTVLASAGRRTPDLSVIHSVLASRSAWDSSAVSHCCHAHFHVLDPTPIPQCFSLMQEMSYDKVCYFCVTATRAQMCISYTC

SEQ ID NO: 959481 - protein, 36 aa, Homo sapiens
THSCRPFITCWSSNPLQLKPINHDRILICFTIGFRL

SEQ ID NO: 959482 - protein, 36 aa, Homo sapiens
IIELAPLTCIKPFIKPCHQTLHQTLVQVDHYSQRLF

SEQ ID NO: 959483 - protein, 103 aa, Homo sapiens
DHLHLNAAGYLLTAFVVFCLVFAAPNVIAPPTLRIDDRGMTWKSWRRSATYLWSDIDKFLVGRAVRGGKPKIAFDFLPGKTPSQVNATALNRSVNGYDRSMAN

SEQ ID NO: 959484 - protein, 50 aa, Homo sapiens
EPNPSSTLSTFIKRETAESNQITAIIGCSGQLVYGFRGYDDRISMTGFQM

SEQ ID NO: 959485 - protein, 51 aa, Homo sapiens
SNLPAIEMEHREVVVIGAGPSGAIAAALLNASDCTDRTLLIDIRSRVYGFD

SEQ ID NO: 959486 - protein, 33 aa, Homo sapiens
AGSCLWDLDFISPFPFSLGARDRDLLRRFRHTP

SEQ ID NO: 959487 - protein, 33 aa, Homo sapiens
LPLADRDAEKEDYICVRCTVKGRTKPKVKTQHN

SEQ ID NO: 959488 - protein, 33 aa, Homo sapiens
MSSVRYGASVTESVSERSRLLGVCCVGFESNLA

SEQ ID NO: 959489 - protein, 42 aa, Homo sapiens
QARSVRLLRVCCVARLLNPLTDAPLTDAPLTERLLMLYDAPL

SEQ ID NO: 959490 - protein, 38 aa, Homo sapiens
MSCTSSGHSSVEYAVASSTPMTSRLCNQHNIPPAGVTA

SEQ ID NO: 959491 - protein, 48 aa, Homo sapiens
LYKRSISKRSDNAEHQYSISKRSGHACWGYVVLEEEEARRWHKICLLR

SEQ ID NO: 959492 - protein, 35 aa, Homo sapiens
ISTRQSIEIYREKHIASKPACLVSHTLHTGHRSSH

SEQ ID NO: 959493 - protein, 39 aa, Homo sapiens
SDQVQADEAQYCQLVRQMLDDHKVCGDPLGQSGLNVRRR

SEQ ID NO: 959494 - protein, 41 aa, Homo sapiens
MEYGLHPTWDSYEATSKPVPFLVPEVPTLHAPRVNHNYSGG

SEQ ID NO: 959495 - protein, 107 aa, Homo sapiens
MSTHIHSSIIRNNQKEKQPKCPSVGKWTQEICLVRTVDCYTAFKRKDILSYATTWVNLKDIVLRERSLSQKDKYCLIHIYEVPRAVKFIETENRMVIISGVISVEME

SEQ ID NO: 959496 - protein, 35 aa, Homo sapiens
GHFLHIILCNPNPFPIAVSSEISSYLRIIDLGLCS

SEQ ID NO: 959497 - protein, 41 aa, Homo sapiens
PTRDFQFFYLPYFEKLIAAQRGPLRHGGAPLALFRSPHPVG

SEQ ID NO: 959498 - protein, 108 aa, Homo sapiens
NFYSQDIIQESFPNLARQTNIQIREIQRTPVRYSTMKINPKVHNHDSPRVETVYEIDTFIFLHTKVIRHMCRVWRYIRVLLHMFRIHSGGLIKRIPMHDKREDYSKKG

SEQ ID NO: 959499 - protein, 33 aa, Homo sapiens
YRKGTDVNALSMTLPILARPPTPSYSFTHSAME

SEQ ID NO: 959500 - protein, 33 aa, Homo sapiens
TTHDKYLFFQCLSLATLSNTHNKYLFFQCLKLV

SEQ ID NO: 959501 - protein, 35 aa, Homo sapiens
LNFYTLTICLYFKGYISDEEIERQLKALGVEADGK

SEQ ID NO: 959502 - protein, 87 aa, Homo sapiens
LEYPGYLATPDTDVLEVRYDCYVIKQTDSCRGCHQSSWTRRLLAAGEVTNVCPDKLRQAKMNIIPEIPATPTLNQSVEERSQNCMYQ

SEQ ID NO: 959503 - protein, 76 aa, Homo sapiens
TSYPDLEFVTSYCSLYITVRNGITHRYAYDLNCNSDEIHKVVELVILMREECQYQQLHVQFYKPNNNYAEPCKQAP

SEQ ID NO: 959504 - protein, 41 aa, Homo sapiens
SCYTRHEVNECQAYYTIAPIAGSIVLAAVLLKLGGYGIIRI

SEQ ID NO: 959505 - protein, 95 aa, Homo sapiens
MGGHIHTWYEALWLYRNLTARLRGVGLSVLDRWIHISTSRGPGDLHTHCRGLPLVGSHGQKGLVLYPRLYGSHPPRSTKWAPPDSGYELSMRKHL

SEQ ID NO: 959506 - protein, 41 aa, Homo sapiens
MTSRRQNSSVTKLKKEEKEEESKKKEKTVTKEEEQLRRRKK

SEQ ID NO: 959507 - protein, 37 aa, Homo sapiens
AAFSHGKAGATVAGLGPVDPERQMWMLLEPTSVKGSS

SEQ ID NO: 959508 - protein, 36 aa, Homo sapiens
QCKEQRTHLPTGVESDKNNPQNIYLFTDSQIACMFT

SEQ ID NO: 959509 - protein, 33 aa, Homo sapiens
MAEVKVLFVRNLANSVTEEISEKAFSQFGKLER

SEQ ID NO: 959510 - protein, 33 aa, Homo sapiens
LEDPVTCYTFDWRIVLETTIWALTYFFTESLWL

SEQ ID NO: 959511 - protein, 47 aa, Homo sapiens
MATCDSLTLTIEYVLLIEALIRIIITSQDVLRCNYYTNGGFNREYYS

SEQ ID NO: 959512 - protein, 59 aa, Homo sapiens
VDSTTYSVPASPHLYFGGISLLFDGDGITIDDKLPVLSLDGAMEFAMGGIILEHVYNAI

SEQ ID NO: 959513 - protein, 45 aa, Homo sapiens
ADVGLVLWVPTYAEGGGCGPLSSMSSQLPPFCKAQGPGLHSGRLL

SEQ ID NO: 959514 - protein, 60 aa, Homo sapiens
IEVGWVQWVKEYDGVVIVKAARVSAVNTYCRYMVCSHDKPWNSYAVIVYAVQIVYAVIVY

SEQ ID NO: 959515 - protein, 88 aa, Homo sapiens
RLYRILDRRHVAASGEYKEALQVTGHAISSVHAHEDIMSTPSCWEISSMPSTGGPSHIRAKSFSWYLQDREDCEDTADGSREAAGTGH

SEQ ID NO: 959516 - protein, 166 aa, Homo sapiens
YRILDRRHVGRQTRMRLTDDQADQEDRDKQIATDIAGDFIGSRIDVVEHERRMSQLYEVRHPNEDQAADQGDQHDRPRNGPARIAGFFGQGTHRIEAQEWITGNRRAAHDQGHLHIAAEKRCHRPQRLAGVTADVVDRQEDKGHQHQHHEAIDIIDLICPERRGVC

SEQ ID NO: 959517 - protein, 66 aa, Homo sapiens
GLWARRSATIVMIRGWGRSHGSSVISIGPTECTETYGFIQVTLLVYHRGWPFCVQDILLCTSNGSS

SEQ ID NO: 959518 - protein, 58 aa, Homo sapiens
AYTLPCLPVPHTPDPPALSTAPAAPSSGSRRRCRTFTFRVSPSQYSGPSCSIHRAHNP

SEQ ID NO: 959519 - protein, 35 aa, Homo sapiens
RLRIVAILQGSAILSQPEACDGEEEADPPHNHAPQ

SEQ ID NO: 959520 - protein, 93 aa, Homo sapiens
MALLPPGMPRLILHSLSSSTLPADPNSLLWVIRHMVAMTLAMPLGLWLLLYLVYDTGDVSSKVATPIWLLLYGGLGWYRLGLNRRDEYQGVPS

SEQ ID NO: 959521 - protein, 60 aa, Homo sapiens
QYLAFYHPNRGMGSLATRRRIAHQIQSRMADVAFASEAIEKVREFSGQHYSPAEAITGGW

SEQ ID NO: 959522 - protein, 139 aa, Homo sapiens
SSSTMPTSAVLSTSTRIFDCQLLRIGQNRSPAVTLCSQSRDDWKLQTALQAYYCPMVAESSEDSDEESKGLGKENGIGTIVSSHSPGQDAEDEEATPHELQEPMTLNGANSADSIPPLYHLYTTSPTFTILQYKKGYRA

SEQ ID NO: 959523 - protein, 35 aa, Homo sapiens
MSGHAFLSFHCVCMCACVCVCVLRCVLFLSPGRGG

SEQ ID NO: 959524 - protein, 33 aa, Homo sapiens
MACLDHGRRTTVFMGPLKKELKLQIEEGSVNSR

SEQ ID NO: 959525 - protein, 106 aa, Homo sapiens
HRNTDANKRTHPTWLAEKQTKAFASTCQKWKALTISGAEGQRGSRQVPPHCGHGPIWGAARHPLVKLKMGWVRWLTPVIPAVWEAETGGSLEVRSSRPCFYRSLKT

SEQ ID NO: 959526 - protein, 43 aa, Homo sapiens
MSGHVRARRFGVGLFLLVLSYREEFEVEETDLDYPGLQARYMQ

SEQ ID NO: 959527 - protein, 47 aa, Homo sapiens
PGKPILGAGRFVWSFHLHVPGSPTCTAGATAQRRALATCTLGTRYMQ

SEQ ID NO: 959528 - protein, 82 aa, Homo sapiens
MLAESGYWYLREWADPIACPSRGLHTGCETSNMSVITKWIPELSRPRASKRYEEVVKGSLAAYIKKIGYNPGKCKGMGPVHA

SEQ ID NO: 959529 - protein, 45 aa, Homo sapiens
MKPEQWKNPESSAGCAGPKIHSQARPVPVEVVQKFCRIDKSRYMQ

SEQ ID NO: 959530 - protein, 31 aa, Homo sapiens
MSPFFSMIVVGLVMLATCLVAKPTPSARYMQ

SEQ ID NO: 959531 - protein, 72 aa, Homo sapiens
GGTESEDEIIVVVPSPENTCSSLFHHLVVFVVMAAADSKVGTEVDGMPLLGGKGGDGFDNNVPLFIAWPVHA

SEQ ID NO: 959532 - protein, 58 aa, Homo sapiens
KVKSVEPLLFESSVRLKAQVLRSSLFKNFNLRPCTGKPPWNPSTFGGRGARITPRYMQ

SEQ ID NO: 959533 - protein, 36 aa, Homo sapiens
DPPCITGEGGAFPQAVGVKPQNLLQVLQKVQLDSSH

SEQ ID NO: 959534 - protein, 46 aa, Homo sapiens
SNSLLHPPSSPRRLPSARPGSCQVGIIEEFTKNNSLIIPTIIATIT

SEQ ID NO: 959535 - protein, 40 aa, Homo sapiens
VGPILMRSEYRRIILFVQNSFDSECLEITADVSFYAASPN

SEQ ID NO: 959536 - protein, 132 aa, Homo sapiens
NVIDITFPLRVNCETSVHSFMILHFCDDFLMGNDFFLEFEIWTLIGCFLSRDLEPPRDLDLDGDWKYLDPFIEPDLDLLSEADLDLRREIDLDRRGDADLDLRPLLLLREREYRLPLDRECDLDRDLIDNVI

SEQ ID NO: 959537 - protein, 65 aa, Homo sapiens
AAQGVKVYKDGKFTFNTDQAVEIIQKYVELYAKKAMPPEVLQNNYLGNSKLFLQDKVAWTTGVPS

SEQ ID NO: 959538 - protein, 76 aa, Homo sapiens
MVELTCIITAGQLLLRLTWERHPNYISHYASLYTYDLHNSNSSDYPRNRCRLNPSLRFHTSSKPLPGLGYLGYVYL

SEQ ID NO: 959539 - protein, 33 aa, Homo sapiens
PTDTIELCTPGRPNLTRKATKTISQHQISTSII

SEQ ID NO: 959540 - protein, 47 aa, Homo sapiens
LSSSQVLNSTTILANRCRLNPSLRFHTSSLVYLDDNTASNPEIRSTW

SEQ ID NO: 959541 - protein, 33 aa, Homo sapiens
LESSSGTPGRPNPGSQVDLTQVDLTIFSLHLAV

SEQ ID NO: 959542 - protein, 145 aa, Homo sapiens
SNLSSVPEHSCPAPPRPWGLRRSSPAAGHSRMTCLACSCRKNGGVFRLLLLAGKTVVVVGAQDPPSLLGVVCHLFGCVEEEDPGGLSEKDFLVGLLDAPSDLIPDSVEQDVNEEGVALGGDVTLGQEHFVVAALHQVLLQGHECS

SEQ ID NO: 959543 - protein, 74 aa, Homo sapiens
NVVIAQLPYVLSTPSSADRLSGRMQVGGALMQVDAVEEHTCVSVVCYSQVLSGPGGGGHECLISRRVHNMIIRQ

SEQ ID NO: 959544 - protein, 69 aa, Homo sapiens
MILKRPKSIGERTISATVVRGALLCIIFFSKKYGSREGDRGVITDRGGGSQHYPEERHVVERHGRDTNV

SEQ ID NO: 959545 - protein, 66 aa, Homo sapiens
NIRHHLLSAIYRHLQQNPDEGYKVSASTHVKTLGQGVAHEVARNGLHFLPQKPTIALMKLKGRRWI

SEQ ID NO: 959546 - protein, 44 aa, Homo sapiens
MFVRVPCRYWLPERHIGSSDFCFLKFSGCDFNQPLCVLYMDTNV

SEQ ID NO: 959547 - protein, 82 aa, Homo sapiens
MIQPSADPQHSCHIYAHFCAYAPPGVYRVCQCECRCLNLYPETQVYPHVHGIPRPVLDLVSDLLLLTGIKADPELGMGTRMF

SEQ ID NO: 959548 - protein, 88 aa, Homo sapiens
IESSSVPEHSCPLVDTLVDCELGEAAIVQYHRLIKIEGLENLVHLDLAGLCLSTEIETIEGLDTLVNLEDLSLFINRISKIDSLDTNV

SEQ ID NO: 959549 - protein, 34 aa, Homo sapiens
FEFARHDIVIDVSPWAIMRMTAPVKLQWGLDTNV

SEQ ID NO: 959550 - protein, 148 aa, Homo sapiens
TFCFRYLYEIHEDQLSLTLTSDYVTCPDIESPLKQEVEKILCSFVILLPTEPNKSTGPETTKPALKFSVGTDSDQNPTSEQYMLRLHQSKRTTILNSSNNLTNGTSYPRDNSSNPILESISTIGFTTSMLDQDIPMVQPLLKVRLFND

SEQ ID NO: 959551 - protein, 36 aa, Homo sapiens
LPITKVSHWINLINQGTTTRTPSDPKPGLTPSWSYR

SEQ ID NO: 959552 - protein, 82 aa, Homo sapiens
GHTIYGIWPVLPLTASPPVCFAHPTLASSLSCEHAQPCNFLKDFVPLFRLPGIFLLLDISTTPSLFISFRSPLTCLCGHECS

SEQ ID NO: 959553 - protein, 61 aa, Homo sapiens
MLDQDIPTVQPLLKVRLFNIKVLRDLSSDRSYSRSVSIYFILPPRTKGRLLYRTRMVHECS

SEQ ID NO: 959554 - protein, 42 aa, Homo sapiens
HSCPIKSLYCQEQWLMPIIPGIFGRPKLVIMVTQVITFYDMA

SEQ ID NO: 959555 - protein, 42 aa, Homo sapiens
MIQSSSVPEHSCRDEKLYEAAAGLSSFMISPVRETYNALTNW

SEQ ID NO: 959556 - protein, 133 aa, Homo sapiens
NIRVHGKAMQVAGTQERVLIEILCIDENTVTEIREIVICYQSEFGRDLEQDIRSDTSGHFERLLVSMCQGNRDENQSINHQMAQEDAQRLYQAGEGRLGTDESCFNMILATRSFPQLRATMEAYSRMANRDLL

SEQ ID NO: 959557 - protein, 111 aa, Homo sapiens
LSSVPIRVDKPTESKSYQTCIKRFRSGATSEQNPTSEQYMLKTSPVKANYYTQLIQLTMTNGTSYPRDNSQSYSRVHINNRVYDLDVGSGHPDGAAAIKGSFVQRLKSYVI

SEQ ID NO: 959558 - protein, 46 aa, Homo sapiens
YNYAKAPTIVAPMWLLQPFADAIKLFTKEPLKPATSTHSASGHECS

SEQ ID NO: 959559 - protein, 71 aa, Homo sapiens
MIHSALYLIIRVPTRCMPTVYYNPFADAIKLFTNGAPKNPPHLSSALYITAPILALTVPFYFIPPHDDTNA

SEQ ID NO: 959560 - protein, 50 aa, Homo sapiens
MLAVIPVLTKKINPRSTEAAINVFPHASYRIHDPSNSYPLQTIYSPDTNC

SEQ ID NO: 959561 - protein, 78 aa, Homo sapiens
FEGAHCQMQYLEHFFAAPSRDFPLPCLILVVELLSQKDTVTWSTARKLFRLTGLKNTEKWSWRLNGLHMEPALGHECS

SEQ ID NO: 959562 - protein, 52 aa, Homo sapiens
LCLNTFFTKSHEEREHARETDQAAETYEVAESSFRISMKPDCDDWEIGHECT

SEQ ID NO: 959563 - protein, 76 aa, Homo sapiens
HSCRTVYSQRIAIQKIMDAVCLRTNFLWRLLWKRRFISLVLNWNKSYHVYFYAYSGSKSVRASRCDEMCLPRLYTT

SEQ ID NO: 959564 - protein, 97 aa, Homo sapiens
NRALYLNIRVLILYGSNNLINGTKYPRDNRRNPILESISTIGVMTSIWVQDIPIMQPLLKVRLFNIKVLRDLSSDRSNPGRFLSTSNSSLYERTRMY

SEQ ID NO: 959565 - protein, 33 aa, Homo sapiens
LIHRVGQYIVREIAIRMIMDAVACCRKYLMAAS

SEQ ID NO: 959566 - protein, 92 aa, Homo sapiens
YNRALYLSIVSSVEYCAPQDRMLQISLRILVQLLCLPVDAPPVSSAVSAVAAAAEACVLFEPEILGSVGLSFLEGCKEGAEGGGNGAGAGGS

SEQ ID NO: 959567 - protein, 98 aa, Homo sapiens
TIELGTIRVCRYQPDSTGPACVCSQLGPSVVWCQMCAQILGMMGRAISDPTDCPAERKPGCCMATDRRFQLITLKTSRACYAGKRAASLLCRFVAKAE

SEQ ID NO: 959568 - protein, 77 aa, Homo sapiens
LKQQPKIAHCILFNQAIGLVAPVILIRYRRWLTGVCHSHNRPRTYILITILPRQTQTTNALTVASSSSLKDFKLYYH

SEQ ID NO: 959569 - protein, 91 aa, Homo sapiens
NRARYLIIVSHAYLLQHTTLCCSGVIIHNLYQGTEIFDKNRRSIQEPYLSVQSPSPIWLPSISRNTFPHRFLTPVDHYHRNRKHIMRTRMF

SEQ ID NO: 959570 - protein, 56 aa, Homo sapiens
RIELGTFVVCQIPSHMQCPGPRTPKTLHAWELPDAYSLVFQRLALYVKSLAFKWTR

SEQ ID NO: 959571 - protein, 40 aa, Homo sapiens
MIQFELVYLNIRQLDTECKKTLNLELLRLVPNYTEDTNVQ

SEQ ID NO: 959572 - protein, 57 aa, Homo sapiens
MDGIRENYLSQYSEIAIQIMMHIQDQLTLKGDLCAGLGSVMRVKEHDPLHALSVAPD

SEQ ID NO: 959573 - protein, 44 aa, Homo sapiens
DPRVYAELMLRMVLTYSAIKTYCLPLQTSHLTKMLNMPSTDTNF

SEQ ID NO: 959574 - protein, 37 aa, Homo sapiens
VGVMPILLHGHPEGQAVVDVGNNIGPVIRQLLASLQK

SEQ ID NO: 959575 - protein, 44 aa, Homo sapiens
PSVALSHLILQILSYPPVVWIRHRSSGTSQSAIARVSRALRTLF

SEQ ID NO: 959576 - protein, 75 aa, Homo sapiens
EASSVPVSIRDPNEERVGASTALRLPRKSWLLSQEIQVLSSTPKGILNAISSLLALGHFLPDPALCSVVVRDTNV

SEQ ID NO: 959577 - protein, 46 aa, Homo sapiens
MTHVSPVTLHNNICVTKTLASNLPGSYDIRTEYPRISVYYQRHELF

SEQ ID NO: 959578 - protein, 91 aa, Homo sapiens
NIVSRVQEEIKRNSDDLEQKIVTDALKKKTGTSPVQSFVDTGTGGGAWDTLRHTEHQHQGRRDREGGGEEGERGYKESTNTRYGDGGTLNV

SEQ ID NO: 959579 - protein, 153 aa, Homo sapiens
SSRYLNIRVSPPACTCVMPYRWYITVKSYEKDNRPACHADEDKLWANMVLPLCSTPQEVELTDSKDDDDIDLFGSDDEEESEEAKRLREERLAQYESKKAKKPALVAKSSILLDVKPWDDETDMAKLEECVRSIQADGLVWGSSKLVPVGHEC

SEQ ID NO: 959580 - protein, 38 aa, Homo sapiens
VLPQTEGSEEAAEPRMDTPEDQDLPPCPEDTNVQDTNV

SEQ ID NO: 959581 - protein, 127 aa, Homo sapiens
HIRLSWYRNIRSLSPEDLKTAVSSEATTPVSVQHMRPAIDEEAQESSARSSLCRIVVQVMEMGFPMKEHEFALKSLTGASGNASGLPGVESLAGRLLDHSDIQVTELSDADTVSDEYSDEEVVEDTN

SEQ ID NO: 959582 - protein, 39 aa, Homo sapiens
MSPGTLTRLRNQLSLEMVRANSVESPTLRSSDRRRTVRL

SEQ ID NO: 959583 - protein, 73 aa, Homo sapiens
SALYLIFVSALHYQSLSSTINFSHTGLSPTMASVSNAVLISRLAKEDYGSCRFRSLTTFWNLGLDTKCSGAIL

SEQ ID NO: 959584 - protein, 41 aa, Homo sapiens
LRTRAEYPRYRALRVPFTISDGIYGSAFFVATGLPRDFTVR

SEQ ID NO: 959585 - protein, 75 aa, Homo sapiens
VSLPIRFVRFEDSRDQRMLFMAQMVMIIASVCFVWNSPGLMEVVVGGPGVDCVCANYKKICISEFLFQVCSFQTE

SEQ ID NO: 959586 - protein, 66 aa, Homo sapiens
MINRARYLNIVSLRQLGSPSWAPAVAAHSLYLAKSVSTTNIAGHFNDESPLGLRRILYQSTDSLNM

SEQ ID NO: 959587 - protein, 36 aa, Homo sapiens
ELSTLDKGKKNIASSSPPSYATITLLKPLLLPWPYR

SEQ ID NO: 959588 - protein, 56 aa, Homo sapiens
MIQSSSVPDHSCPHRCIEYVGAFRIGRESCCVKKVRCTPINIISEHGFRRLVWSTG

SEQ ID NO: 959589 - protein, 57 aa, Homo sapiens
MIDEYGILAVGLVYGCSLRRRVKSVEVKPPYDWLNSSSLLDPLSEGQILVEVDAAVH

SEQ ID NO: 959590 - protein, 69 aa, Homo sapiens
NQLCTVNIVSFIVPTEESVSMRSLITWPSAGTAASVAHCTVISVLQNQCAFQLSFVFFFFSITVVSSLF

SEQ ID NO: 959591 - protein, 152 aa, Homo sapiens
RDPLQELMKLEKTPTVFIGYLEQTIKQVVITISEMSPKALVDTSCSSNRDSVASSSHIAQEASPRPLLVPDEGPTALEPPTSIPSASRKGSSGAPQTSRMPVPMSAKNRPGTLDKPGKQSKLQDPRQYRQANGSAKKSGGDFKPTFPSLPAF

SEQ ID NO: 959592 - protein, 148 aa, Homo sapiens
MLSNVLQLNEDLLHGAARNGAQITQRKLEAARDGVAVLRDYLEGECVQWLRRYLENGKDKLERADPPKTHVTHHPISDHEATLRCWALGFYPAEITLTWQRDGEDQTQDTELVETRPAGDRTFQKWAAVVVPSGEEQRYTCHVQHEGL

SEQ ID NO: 959593 - protein, 37 aa, Homo sapiens
LIRPDDSKCEESSERCCGRVYPGVLYVCIWRLETLWR

SEQ ID NO: 959594 - protein, 34 aa, Homo sapiens
ILFSHSINPTSIANPQNTHQDLKALSPMPQDTNV

SEQ ID NO: 959595 - protein, 52 aa, Homo sapiens
TNSSFVPVDRATPYYMAICNDGRTADLGHDAGLITNGRRPLYPPYKWLLTSP

SEQ ID NO: 959596 - protein, 123 aa, Homo sapiens
MVSIASHLIRSILVSRDAGSPEPPKRERSKAQIARGLCQRHDQQEAPEGFAHNTGYHGKRITNDRHPAEQQCPATEAVISLLGLFQFAFADGKPAFVPVVLDRATQQPVQHRAQHITRGTQVV

SEQ ID NO: 959597 - protein, 52 aa, Homo sapiens
KSVGAGSPGSCSSVCSTGVHFFFLKTPRRSQRKPSASSKGTTLAPLPGHECS

SEQ ID NO: 959598 - protein, 75 aa, Homo sapiens
VRRPCSLHSGLLYSPLLLSDEHSMGSEYRQEEPANKERSRVKAVALWKKREVSSKGMALEVHSDKAKPTGFGAES

SEQ ID NO: 959599 - protein, 74 aa, Homo sapiens
AGSHRRDDAEPERLEYSNRRVRRPVQVYFYVSRGRRKRSPMPELQVSAGDLRIGAPTGLISAGFPLSIGNPLWH

SEQ ID NO: 959600 - protein, 36 aa, Homo sapiens
KKHVITLYNPLILPVTQAPIFISFFIAKKRDGQPIL

SEQ ID NO: 959601 - protein, 51 aa, Homo sapiens
MPHVPGFCSQQQMHPVNHQDLALHVVRTSSASINSTSLQAAHWLMHRSAGM

SEQ ID NO: 959602 - protein, 42 aa, Homo sapiens
MITVVPGWHSPAARREGGIVIQWSAPEEKYHRSSSTRRGHLE

SEQ ID NO: 959603 - protein, 158 aa, Homo sapiens
LEVSVEMSEIEKEAEMIHGHPSHILKSTTHPIREGQADYIDWPPLLTRKKHLLGDSLQDLGQENKSRGPTCKSRGTRAVLCSWNPSSPDSQKKKKWPGRCVQLVYTFFPYFFFFPVPGKGGSWNMWPGGGPESRGHTTPSILVPPKVCGTTGITNGTG

SEQ ID NO: 959604 - protein, 44 aa, Homo sapiens
SFTSYPTILTKKAVWQVNSLIFLCSEVHCCAVAAFHIVDPAVIP

SEQ ID NO: 959605 - protein, 34 aa, Homo sapiens
GSPPPTPRKHILVDGDTLIYHGNSGEVGCYVCFS

SEQ ID NO: 959606 - protein, 43 aa, Homo sapiens
TTAAEYINELDDGSVSLTGYNARYFLEIPNGYEILRQFVTRWV

SEQ ID NO: 959607 - protein, 153 aa, Homo sapiens
YSERCAFRWDLRFFLQQYGRDIFWSASVSAILVSLVYAQHSCQYRWEARVVHRLNSKTVFVESLALWSMVKFDSIYQESDKGEELGPGNVQKEVSSSFDHVITETTRELIARSAATLITHPFHVIISEIYGTVHGKRIQVLWHYRASIIPIYR

SEQ ID NO: 959608 - protein, 67 aa, Homo sapiens
PARWEMHVRHFLKELKAELPFDPAIPLFGIYPEEYKLLHHKGTCMHMFTAVLFTKSHAKSPPRAPPC

SEQ ID NO: 959609 - protein, 73 aa, Homo sapiens
TGPKKVIRNLAPGSRQQIRSKQHNIQHGQPNQDVEMRWVEHEHRLHTRKALPCNMDVMPEDQQMGEPNHSSAR

SEQ ID NO: 959610 - protein, 73 aa, Homo sapiens
DLSWRVDTSYFEDVGEQQFHERSAGEIVVCGLGLRDSVEPKTHDGKEDTLHTCGSLSNKSFNGKYKLLILISI

SEQ ID NO: 959611 - protein, 105 aa, Homo sapiens
RPPNISSIPTNHQPTMNNQTNLTHTDLTHNTHRHSHRHHTQDITLTLHTELTHQTHIPHPQNHKHHTQTSETPHTHIQNTHTTHSRPHTHNTQRPHTQRPHTQTS

SEQ ID NO: 959612 - protein, 102 aa, Homo sapiens
MFSFSISEYSISLLSLLNRSSSCAEDVNDDCICLIVLCDSSTLTFHLFPSRSTLLCSFCKIPSVSARTDLYQTHSSCSNVCISSASFNLCSRTLTSSDPEVS

SEQ ID NO: 959613 - protein, 114 aa, Homo sapiens
SSLISNRESTSTDEHQMHQSTRPGSQYYNMESTTQMTPPQERASAPITAPTEVEVMDETKCCCSSQTKEKDNHTAPQMTLDTDRSWGVTYVYICCLVMDISLCSDHVICSRTHS

SEQ ID NO: 959614 - protein, 52 aa, Homo sapiens
PVHSDRTTPYLMYFSVVLVKGTLHTSVERPREVSLTMVFWAWRILSLCSVYG

SEQ ID NO: 959615 - protein, 52 aa, Homo sapiens
LEDPIPGLDCWHHYTTTDRNSSTIFYDPAGGGDPILYQHLFMIIRSPLKCQG

SEQ ID NO: 959616 - protein, 211 aa, Homo sapiens
TWTLSVPHSEGSLLATGQRSTFTPQGLQYQDHPVLWTRRMIEDASSKSQRISITFAPVQYPQANLRLQQAGHSGSTPVPAQKERAPVSGTQEKNKIRPRGPRDSSYYSENRSQLKCCFSTRIGSGSLATGRPVTWHGDVAVKILKVVDPTPEQFQAFRNEVAVLRKTRHVNILLFMGYMTKDNLAIVTQWCEGSSLYKHLHVQETKFRCPA

SEQ ID NO: 959617 - protein, 134 aa, Homo sapiens
SDAGRQSKEDIEGMVQEAEKYKAEDEKQRDEGVIPAIHLQSYAIQQCNSELIEACSNTSTGTALTHAGTNTASMLAQDVMQIIELDLISNPALLQKARICTINQKALKKVSHPHHHQAVPECRRHARRNARGIG

SEQ ID NO: 959618 - protein, 114 aa, Homo sapiens
MLSEGNPKLNLAFLSHPSLTAYPALHNPENQDIDWGALEGETREERTYRNWMNSLGVNPQVNHQYSDLSDALVIYQLYEKIKVPVDCNKVNKPAIPQSGKHYDEARELTLRDSI

SEQ ID NO: 959619 - protein, 36 aa, Homo sapiens
RLVDEDGSDEQGRLVLGYGRRFHIDNCCDEIDRPLS

SEQ ID NO: 959620 - protein, 58 aa, Homo sapiens
LSLRGAWGPSISSQQLSNIKPPAINPTSHEEPHNGPREEPHNEPHKEPPNEPPNEPHD

SEQ ID NO: 959621 - protein, 38 aa, Homo sapiens
IYYEADRNSTPASSTPPEEDTPFYTNTYSDFTVTLKCQ

SEQ ID NO: 959622 - protein, 66 aa, Homo sapiens
WLTCDLLDMSLDTPSFMVQVVLERHTSHHQRQLCSTLTALKASSDYESLRDIHDFMIFTRTASSHN

SEQ ID NO: 959623 - protein, 51 aa, Homo sapiens
MAKEKNDFFRFFFFGRQLLVVARGGVRGSTRGPGRPQHSGAEEFFQPRVPC

SEQ ID NO: 959624 - protein, 51 aa, Homo sapiens
HVLWLGLEADSRGAKQIICQSHQLKPATSHHVVAGHSVDISAVRPFSTSTG

SEQ ID NO: 959625 - protein, 72 aa, Homo sapiens
LCRVRASANSCAELYEQWENYPACTKLKKLHLVYAGPMLFDSNLTSEMYWWVDKRSYFNEKVVLATRLVCAY

SEQ ID NO: 959626 - protein, 34 aa, Homo sapiens
MTGEHTLRGLAFQMGGHKDWVLSTHRAGLKQVII

SEQ ID NO: 959627 - protein, 81 aa, Homo sapiens
QQIAKMHHVPQAGLTLGIGELHTDYPYRRTINAPITAPTEVEVMDETKCCCFYKRRKRKTSRAPQMTLDTDRSGGVTYMCI

SEQ ID NO: 959628 - protein, 33 aa, Homo sapiens
NGLRVRISSLLLSMCFLLIQGHCSSTFCKSMVI

SEQ ID NO: 959629 - protein, 52 aa, Homo sapiens
VSDHRAPVWSCQGYSSSSQNSSLWFHQTPIKLVWSRTNCCIHLFNTMIQSQN

SEQ ID NO: 959630 - protein, 40 aa, Homo sapiens
PRKGIASPLLKRETKDWIRVVGEMGPWVTCQIFVRHLKYC

SEQ ID NO: 959631 - protein, 83 aa, Homo sapiens
MCMTDLRTSEDQWGVPTCLYPPGQRQSIIVAAISVEMEKWVEDIQTAIDLAYKSSSPAHEFLASSPRYNKSPDEATAAEQESE

SEQ ID NO: 959632 - protein, 72 aa, Homo sapiens
RLGQNKEKLQPPLNARRNPQEEDEGTRRTLYSSSNHHFVKGLFHQRWDHHWGGLGPIWDYFPLQGRSSHRMD

SEQ ID NO: 959633 - protein, 94 aa, Homo sapiens
IYEDSLKSYRSDHGARLVYKTLTSPIIDALITFHAPALIIIYLLCFLVLYALFLTSHNKHNSYNISDAQEHQNRLNILPAIILVLIALPSLTHP

SEQ ID NO: 959634 - protein, 43 aa, Homo sapiens
KSYRKKATTKWSQNTILLSYLKVSRCIVHHKPVFYSLNWVTEL

SEQ ID NO: 959635 - protein, 55 aa, Homo sapiens
PKPTVLHYQTCIKNFGWGDLGNDNPHRPSSYMRRLHQSTANYYTRLDPIHLTNSN

SEQ ID NO: 959636 - protein, 42 aa, Homo sapiens
MPLFLKPHNTNYTITNNLSTLMEIEDLSELFLPANHTYVLIC

SEQ ID NO: 959637 - protein, 182 aa, Homo sapiens
YSESIVKRCRGSTSSCMLDKLTVVSPPRAIDLNLTMLRECLPLIIFLRNRLKYALTGDEVKKICMQLIHYNRWRRSELIKPTLLDSLDVIQHRQDGREYPYQIYDTKGRYDVHRITPEEASTSWQSEKDLMWAQNGLPHLMTHDARNQIRYPDPLIKVNDTIQIDKETGKITDIIKFDTSNL

SEQ ID NO: 959638 - protein, 134 aa, Homo sapiens
GVLEDPFYIGVKSKPTRRPRLRICTLYYIPSSMCDCNKTALQRPRFFHQAMNYSEIRTRRQERGGALRGQGSPSAITIYGASVSDCVINVKMFYSLGLFLKQGSRHKTSMSGVSVSKMQHQKPFTPWEEGCLRA

SEQ ID NO: 959639 - protein, 221 aa, Homo sapiens
VRLFNCRLDDIPGQYGPTKGWRLQCEGLHTNKELARSPTLKGRDDGHRKQVWEISTSPEGAEQKTCILKIKGSITPPVVQWLPLGVDDGEVTSCGRVSWEQVEVAAQVLQYSDISLHPVEFCARSITFPILDKCVHLNQHVGHVHITSPLRKHLSKSLDVPGTSFGVPHGGSPFEAGKPHIMSERVGSLIFGNFSLPASLSSHPGDPAWFFPSCSPHDQSH

SEQ ID NO: 959640 - protein, 142 aa, Homo sapiens
MVWIEDLTSHNIPLHESLIQSKAPTLFNSMKAEKGEEAAEETVDVDEVGSRGLRKEAITINIKVQSEAENVNRKGAASYPEDLAKIIDERSYTKLILHVDQKAFYGKKMPSRTFIASEKLNAGFRVSKDSLTLLLGANAADI

SEQ ID NO: 959641 - protein, 113 aa, Homo sapiens
VDIEYALQCSMDSTGGCSPSKGMSGIVLCAAVPPHSNNNWQQHGVWACPQHLCGSLASKVVRSRAGGISSHQLCADGSGHTPGKQFLPNAGSRDALFMQSYVVQAQHLALTQT

SEQ ID NO: 959642 - protein, 146 aa, Homo sapiens
HVLWAMYGILPAGSVQKPHRHQSIALDFIIDCPKGCYSLVGTELDADGQIRNPQRVDWSPGLAFVTPPGYWHAHFNESDSEAFLIPIQDAGLQTYLRALDIRFIESLPVRCFAQSFNDKVDKTPDLGRYDALGRVHKPHRKAIRGD

SEQ ID NO: 959643 - protein, 30 aa, Homo sapiens
GVASPGPGNPVSPGSNDSPGPAPQIAGNTG

SEQ ID NO: 959644 - protein, 87 aa, Homo sapiens
SSVIAGILFNNTGGHGLIRLTLILNPRDYPLSLALPCTMPMRHNYTKLLSAYDNQTYNRSLHTLQVSHIATRRSHEHSHRKPPEGEL

SEQ ID NO: 959645 - protein, 119 aa, Homo sapiens
TQSRVDILYAYIHIHASIYIHLFTHSYTYVHTHVHTCLHTDTSMYTHIHTSVCTHMSVYIHVCIHTPLYTHTSMYRYICTHIHTHSYTHIRTHICGDRGQRALSSGSVVIVSLVLASFV

SEQ ID NO: 959646 - protein, 90 aa, Homo sapiens
RQIMRRGSKADLVSDIGDTVEDPYTSLVKLLPLNDRRYASYDATYETKESKQQQDLSISYSGLLQSAPFTQSKHAFIAQRLKACPIKQAQ

SEQ ID NO: 959647 - protein, 66 aa, Homo sapiens
IIIPTIQNSKCSSSKPMHQHMGWARPWWLHPVNPQHFGQASRWDGSLCSVQAVRSTQPGATSVQHP

SEQ ID NO: 959648 - protein, 66 aa, Homo sapiens
YQSVYTRSLQSRKLVGTSGFSKGTYSQVTCLSTLCSRCTYRALMTHREAKVSSKKQNMAGRRGSHL

SEQ ID NO: 959649 - protein, 130 aa, Homo sapiens
SYTTPLKSEQRPGTVAHGYNPSTLGGRGRQITRSRDRDHPGQYGETLSLLKMQKLAGHGGAHLWSQLLGRLRQENHLNPGGGCCRELRLHHPAWRQSETPYQKKKKKKKLHWLPKFFPHNFCLQFGHGCG

SEQ ID NO: 959650 - protein, 106 aa, Homo sapiens
SDRSVILSYSSDSLIRKCYCREITRIRKKKHRKNSRKHKKEKKKRKKSKKSASSESEAENLEAQQSTVRPEEISPISENRFLMRKSPPKADEKEKEKQRERKGKRV

SEQ ID NO: 959651 - protein, 49 aa, Homo sapiens
VKVAGQTCRIASVFKPNVGTAHECKYVLCCSYYTNGGFNREYYIACQRS

SEQ ID NO: 959652 - protein, 115 aa, Homo sapiens
MRMTAPVKFQGVWMGMAVTHAGLCGCIEAVCNERISGLFVVRLCMAACHNSCLHQGIVQGKGSAHVYSQGGLQQCRCAGGNHTHSPPTVLQSTGGTVLLDPAGLGGSAMGFRESY

SEQ ID NO: 959653 - protein, 67 aa, Homo sapiens
VCWYLRRVSQPYEEPWQQPSEQWIRHVLSRGSLTFETEKRTHQLYVRGVIMDSCDELIQSISFIVVC

SEQ ID NO: 959654 - protein, 63 aa, Homo sapiens
DIRVSSDLQYEKNGYTSKFADLSGGWQRNNDALRQAKQESTEYRRQVQSLTCEVDALKEAMSP

SEQ ID NO: 959655 - protein, 67 aa, Homo sapiens
NKVSKPGKHEVQQVATCNIKHTNADMAKAQSMKGGSISAGRIQKYLPQEEIKSQRLAKIYAHAITHI

SEQ ID NO: 959656 - protein, 66 aa, Homo sapiens
EVSRPYINRNYVVDGLSYCYLSTISLGNHISSHISNTILSLLLMEHQEFGLRNYEIHITKDMMRTS

SEQ ID NO: 959657 - protein, 68 aa, Homo sapiens
SVTPKDSYMQSGNQKQEVIAVLHQIKQTLKKQQFKKDKKSLYNDKRINLTRLDNLKHIMYLILEHLDS

SEQ ID NO: 959658 - protein, 52 aa, Homo sapiens
HCYTCAPGKSVFWVVLCVSVALNHSLYSVAHDGGGSAVCSAEWLSARVFCLD

SEQ ID NO: 959659 - protein, 55 aa, Homo sapiens
VPPVLPALSAEEKCLASTAIPYGTDYDVRVLLRFPQRVKNQVTADFLPNRPRNNW

SEQ ID NO: 959660 - protein, 155 aa, Homo sapiens
RSHLSEQQKYQHVSSSLMTAVCYSAIFETPLRGGRCSAEKRERKAAAENTCVTKQKELQALYALQALLVTLEQAPKLLRIVFDALYDEDVVKEDAFYSWGRSSKDPAEQKGKGCGPLNLSQAFFKGGSVKQEEESDPQLRAGVATSNVAHLGPED

SEQ ID NO: 959661 - protein, 34 aa, Homo sapiens
VLIPIYNYIELEDPLTGGEETWLHMGLYLWDLIC

SEQ ID NO: 959662 - protein, 71 aa, Homo sapiens
DTPLNTTRRHGKSESLCGVSQPMAASLSTGASSRLSADDEIQHLTVAAPVSSGLATFLLARKCIKEKLTVA

SEQ ID NO: 959663 - protein, 103 aa, Homo sapiens
ECQNLLLTTGANFNKKDKYGRSPLHYAAANCDYPCLFALVGSGASVNDLDARGCPPLHYAATSDTDGQCLEYLFRNDANPGIRATPGYTAVHYTAAYGHRLCL

SEQ ID NO: 959664 - protein, 45 aa, Homo sapiens
MARTCSGEAVRNTRGLMRCPTGVAEVAPLVYLPVAIGDGQLLHGK

SEQ ID NO: 959665 - protein, 46 aa, Homo sapiens
KCRQVENLEDRGIRKISGTGKALAKTEKYEHKSEVKTYDPSGNSLN

SEQ ID NO: 959666 - protein, 57 aa, Homo sapiens
MFGDLLHSQDVMVVGEPTLMGGEFGDEDERLITRLENTQFDAANGIDDEDSFNNSLN

SEQ ID NO: 959667 - protein, 34 aa, Homo sapiens
MTLVKIADCRDNVWIAESPVCEETPIDMHHTPHM

SEQ ID NO: 959668 - protein, 150 aa, Homo sapiens
WSATDSKGQFWLTSRSDHSPRYSVLIYLTPGSSRALETGYKTSWASIAESSEGQSWQLYFQPPCPTSSTPRGAEYPETNPGFVTLSYVGPPDSRQLTHSRPSRSETPVDTGLGTNWITARAAVGPRGKESGLNLYLVRKPRHQDPSWDPF

SEQ ID NO: 959669 - protein, 56 aa, Homo sapiens
MRGPSREKLLTSTEGLCPSALSETSRFDNDLQLAMELSAKELEEWELRLQEEEAEL

SEQ ID NO: 959670 - protein, 37 aa, Homo sapiens
MDFFFSHKDSMVTLGLPPLHRNYCHSYCNTLVTGTSM

SEQ ID NO: 959671 - protein, 65 aa, Homo sapiens
TRNMYELIKKSWVGGEGNDGSGVISELHVSNSWECGAGPSDLSAHPGQDNTGLRRSWRSYAELGR

SEQ ID NO: 959672 - protein, 99 aa, Homo sapiens
VLTRISQQSLSEGCHEPEGSLITVFPELGLHIHIGDFSQYHVLGILILTVVQSTMAIGVHTPDFTRVLGLMLNDVASSLLEAATRVGGRSASRMASYDA

SEQ ID NO: 959673 - protein, 38 aa, Homo sapiens
MGPAWLDGTRTGEQNPPLVSIKNIWLRSGTVAHACNPR

SEQ ID NO: 959674 - protein, 44 aa, Homo sapiens
TICISNSTQVQPHGAAPDAFAFLHRFIQLLALHISGASFSAVRT

SEQ ID NO: 959675 - protein, 135 aa, Homo sapiens
MLRSVSCQDEHQAETLRSSTQHGTFYVIRLKCHTLPLNSVIRNYISLSSPCYKTAITEAEQHIIKGTEDSIDSPDRHGQRQAHNHGGRRKRSKVMFCMDAGKRACVGKLSFIKPSDLMRCIHYHENDMGKSHPHD

SEQ ID NO: 959676 - protein, 91 aa, Homo sapiens
TRLLTGDEREVQAAFARAAFNVVFHNRDDHPRNFAWRLGRDSRWRLAPAFDLTFSEGPAGQHSLDVGGEADVITRQHLLRLARDNDIPAAV

SEQ ID NO: 959677 - protein, 113 aa, Homo sapiens
LGTPPPESGSTRAGSHPQPQLQIRIQALPAAATPNGGGVKSWVAQGSWARLHGVSGSTSLGHVHWGVGRHRHPSLCLRPSKPERMRTEETNKHARSLGPRAGSTLLAAYLSLA

SEQ ID NO: 959678 - protein, 30 aa, Homo sapiens
MAESSATFTPMAPQVMWAIDEKAVEGVRWC

SEQ ID NO: 959679 - protein, 58 aa, Homo sapiens
MGDLQPKKVCGLVSTNYALSMSDSYHNVSSLLGQLRGDVSSDDWQNLDKRTSLQGSVH

SEQ ID NO: 959680 - protein, 39 aa, Homo sapiens
MAGPLITILLGNSTTNAKLSSAGFGISPICNLLLRKKRT

SEQ ID NO: 959681 - protein, 54 aa, Homo sapiens
ISNIRYDNNSTMPNSWQTLIWIQAVMNKRIRNAQLAQYNFILVVGEKEKISGTV

SEQ ID NO: 959682 - protein, 48 aa, Homo sapiens
AFSYRVKRERLEYTLVSGYEEGGRVKDYSEIGYVDRLMNYGALYNVRD

SEQ ID NO: 959683 - protein, 48 aa, Homo sapiens
LAGSEQVTGMNAACKLIIQQGAQSTAFGMGFLLNSRLISQCKLQGHCS

SEQ ID NO: 959684 - protein, 76 aa, Homo sapiens
TLNHSTAHGYRTFISMAQQVAPDPHPVRTHVSTVNQQCGHTQHMAPPARQQAQAKQTFWPKQVFIHAHLAGKQAGT

SEQ ID NO: 959685 - protein, 34 aa, Homo sapiens
ISDLMITLPVAPNVLTTYRRDRTHPAYVTYILKI

SEQ ID NO: 959686 - protein, 31 aa, Homo sapiens
MGVQLGQVDHIAAVGGGIGVRRRGQPVRELL

SEQ ID NO: 959687 - protein, 51 aa, Homo sapiens
GREEKEKERVPMLRSTGMILEVVETVDFQPNEQGNFPPPTTPEELGTRILI

SEQ ID NO: 959688 - protein, 36 aa, Homo sapiens
ERRTPQLRKKLMRRILDSAEFIKFTVIRPFPGLVIN

SEQ ID NO: 959689 - protein, 52 aa, Homo sapiens
TLDDPTPSEAEKSYISYVLNSCDSVKISSVSRHQTWKMSPDVIDMWYLSSNY

SEQ ID NO: 959690 - protein, 48 aa, Homo sapiens
MGRKGDEGWILKGYALGRQPGLVRMIAPCDRSSGRRLTATCGRLHIPV

SEQ ID NO: 959691 - protein, 106 aa, Homo sapiens
CLSLSAAPPKLLRTCGELQLGVSNETVVMSEEADRVDAVMPRMARDWWGTEATAPENFQGLNPSTVVTNAFHPEWNRQILARAQEVSIKRGSSENVSKEKGFRAND

SEQ ID NO: 959692 - protein, 57 aa, Homo sapiens
CCPGHLLLEEKVELKRRSLPFRVHGSVCQLMKACSMSVCAVRACVGMSACRCDRHLG

SEQ ID NO: 959693 - protein, 96 aa, Homo sapiens
MSSPLFRITEAIHEVPPKSTTQAQVVEDLQLPVHAGAGHGDPTLEGSPSAAGSATRPTSNCLVCGTTIETNNLTYLLLRNHRSSKFSSLQCSSCDK

SEQ ID NO: 959694 - protein, 35 aa, Homo sapiens
AVENTLQSLSWLSQLSESLLTPSHTPPASLGMKDL

SEQ ID NO: 959695 - protein, 107 aa, Homo sapiens
VGTAVRRTDCLSVLYLWRSCCINRPVLHALGSILLSEVLCAVLDAVTVEKVVIQTLASIGSWSERATAKHMENSQVASNYLFVYFFYLLDFLHKGLKVEFSNKPVSV

SEQ ID NO: 959696 - protein, 73 aa, Homo sapiens
AQQSGRQQTCSQCTLISWHSCLHNRSLACVSGPILLQCRSGVLYLDGVNGGEDGDTKLSLCIWQLGLERATGL

SEQ ID NO: 959697 - protein, 40 aa, Homo sapiens
RSYWQVFLTSGLAYRQDGCEYHRLFLRRCEWVGPQGHPGL

SEQ ID NO: 959698 - protein, 48 aa, Homo sapiens
VSLYHIPSTIIASFIDNVRFLREQLEAKDLGTPNVVPCQKEQGYQDCE

SEQ ID NO: 959699 - protein, 124 aa, Homo sapiens
CISVPLVQFQTGMVEAEFLKASSKPEASGLLPRLTFQNSAFDSLSWIGCCQSLRHLDLSGCEKIPDVALEKISRALAILTSHQSGFLKTIYEPNYFYCCKSRDITMQSTKQYACLHDLTNKGIG

SEQ ID NO: 959700 - protein, 34 aa, Homo sapiens
LGTLSAGLPWRTAVTTFVVPRKFGVLKPKSLCPE

SEQ ID NO: 959701 - protein, 81 aa, Homo sapiens
KWCLKLANRLYGENTYNSFLSLGFQTQKTYGADLASRGSFSDASEDARKTINHVGQQDRQKEKFRERVRLRGSWLNNSDRN

SEQ ID NO: 959702 - protein, 41 aa, Homo sapiens
TFLEANILPLFRWRLSKGSPGLCQFPELQQKELQLCAWEPS

SEQ ID NO: 959703 - protein, 44 aa, Homo sapiens
MRTSPNSEVYAAEGRKPFIWEMKISTEIWPFEPGFPQLGTTQKP

SEQ ID NO: 959704 - protein, 31 aa, Homo sapiens
MAMRCSGVGCGLGLGGGGSVSAKPWRNEDTE

SEQ ID NO: 959705 - protein, 52 aa, Homo sapiens
MTRCRQTQNTSTELFDGSQERAAALSAEALGAGTAVGLPFLSCASSQSFSRK

SEQ ID NO: 959706 - protein, 48 aa, Homo sapiens
MQTAGTGLCRMDLYILCFSPSFSPPWNIREQIKTSIQTRQNKTQHLPK

SEQ ID NO: 959707 - protein, 33 aa, Homo sapiens
IHVLWTPCCLFVDCCCLLDLCLSRCVDAPGTAP

SEQ ID NO: 959708 - protein, 64 aa, Homo sapiens
TQNRSAESTLVINGVTDVAARSSSHPKSCMNSMNATAEAIKNLIEEQKAQCPKGKNEKNFKRGI

SEQ ID NO: 959709 - protein, 38 aa, Homo sapiens
LQVVEARDQVTDRHRTHQQNYPGEQVTASEFIRTKKGE

SEQ ID NO: 959710 - protein, 62 aa, Homo sapiens
SPPYGTLASSRISDVLNVLSVGPRSIAFRSKYRWECLDILQHPDLLECLGLRRRNPHGVKST

SEQ ID NO: 959711 - protein, 35 aa, Homo sapiens
YNNLKSLEAASEKVGGWLELEGGLLDFVLFFSPGY

SEQ ID NO: 959712 - protein, 56 aa, Homo sapiens
AVSGHACPLTLNLRLRDAYTGAPALGVNRRRTRRCIDKGVTIHTSPVTYEAMGRRV

SEQ ID NO: 959713 - protein, 40 aa, Homo sapiens
DVRGVEGGRGLNSACEGHCPSHRDCFGVTDVEVPPAPLSI

SEQ ID NO: 959714 - protein, 44 aa, Homo sapiens
LLLRSPLTAPPVPGDDDGLRHDNHALPTPSSWTSSPRDTAPRDQ

SEQ ID NO: 959715 - protein, 34 aa, Homo sapiens
WDLYLIFVISDHCTLRNRVFAFDMDNCIRFKIPG

SEQ ID NO: 959716 - protein, 119 aa, Homo sapiens
PRGDVSLYATEYGQVAKSTTTQCKKNKKKTDQLTCTSTPNTSYGPVGTSERTGYTTLTTFRVTARDEVSRRAVYLLRASSYNDDCQAAKVEAFLVQQGLQNLNFQDRVQRNYTVTMPES

SEQ ID NO: 959717 - protein, 46 aa, Homo sapiens
MHYSPDASVDPSEEIEASVEDAPTPEKPRKVHAKWILDTDTFNLNW

SEQ ID NO: 959718 - protein, 70 aa, Homo sapiens
MAHKRPENSPTKASKTDDQAENGNGESWRSPERTKASSCPSLSHVTGATESPPDEPAHVERDRVGRRSGP

SEQ ID NO: 959719 - protein, 34 aa, Homo sapiens
APDYIAPWPARRAGRPGIAQNLQDADAQAQVPLD

SEQ ID NO: 959720 - protein, 113 aa, Homo sapiens
SVLATRVLLEPHDITPVNVLGIVLLSLVLFSERIEAFFDRDAECTALLSDSRKPRMNRSLIVLLAALFTQGAWAETHSIKAFLADPVTVLDEQGKQQRELAKKDAPTQPLPVL

SEQ ID NO: 959721 - protein, 122 aa, Homo sapiens
KRHPHLIHHEPHEEEESPHSTSTIQATPTSTTEETVYPARNTWFGNRLALKDIATTPRARLPFHNSGQLQTSASYPAIQMQRKDTHHSPVGQFLVLHFFNTISHPNGTSVIKTGKNGWICDS

SEQ ID NO: 959722 - protein, 92 aa, Homo sapiens
MVDGKRRRIWAYGIQLDEKILTDYAPYPILPTDVYFVCLTLVKSSPSSENVRAIRGILSVRQHCPNTPIILVGNYTLILGDDKDTIEKLKEK

SEQ ID NO: 959723 - protein, 69 aa, Homo sapiens
MGIFKCSLGMNIHIWGINVHFWAFEFSFQQLVQLHHTSPFTLCTLHSSTSTFMHCRSYGVLTTHIEDSV

SEQ ID NO: 959724 - protein, 77 aa, Homo sapiens
MVEQHQVPVGFFSQAGFQFGNAGYFDQTYIGAKAQDYGLMQCAAKQRVVIGNQDFVCGHWLNDPVFYGSSDGFRVHQ

SEQ ID NO: 959725 - protein, 66 aa, Homo sapiens
PVKAHPVDAHPVVVRDKALIEADEVAAQGRHEHLDLDRVFRVGDELDLGVDVPQVVGGIFGDGNSQ

SEQ ID NO: 959726 - protein, 70 aa, Homo sapiens
LLATPLKGGSKTRHADGPEADAGIEEVELTAVDRITATPPKKTAAIWYQMKLYLKVRTGLSSEHRHSVNA

SEQ ID NO: 959727 - protein, 60 aa, Homo sapiens
MHDAVSILLILPQRLRYDLNVTSSIAPDAKISLSQLSVSAHSLRAISNFECIIRKALGIL

SEQ ID NO: 959728 - protein, 74 aa, Homo sapiens
QLFAIRRTSNNSMRFCPTICVRWFTESITACHAQTPKSYGYRRVPNTKRDELCYILSMGIKYDMYPTAWPLTLP

SEQ ID NO: 959729 - protein, 117 aa, Homo sapiens
VDVAVLVITDPAEYPAISSGVFFFLSQDVFEDATGSRVFVTDVLDYLAVAVYRIRSATRSSYTISFKVLPATLLRMGVFRQQVGVELRLAAQLHDTLGQFVGVLGFLGRMFQELIGS

SEQ ID NO: 959730 - protein, 49 aa, Homo sapiens
MLEGLAGRYRRIPEPVRRDRLAYLFVPAVIVNRCWSVRPGLLNTGVARR

SEQ ID NO: 959731 - protein, 78 aa, Homo sapiens
LLATPKTAALGAHIVDRIRELLGENGLSIAELTELEPPSPNGLIQSLTLLLSGSGFSTLINRVTARNACSGHQGMGGN

SEQ ID NO: 959732 - protein, 36 aa, Homo sapiens
FNLGAPLMIIICLGALTWAGTHLLDPYRPIDRIKPG

SEQ ID NO: 959733 - protein, 41 aa, Homo sapiens
AVVGVHIQAQGHFPAQHLATQGGAFQHIQGAETRSRRVKYG

SEQ ID NO: 959734 - protein, 109 aa, Homo sapiens
YPDLATPLLQQSPDLHLMEAKQRTQIDISLNALTGSEMSAGETIFEYPNCQFPYLRMHKNVERKESIPRNHEEIFLFFDRYFPFAVKHLVVNRRNRKSTPCATTGERSD

SEQ ID NO: 959735 - protein, 32 aa, Homo sapiens
DGRTGAPVQPLGEWDPVKIDVRDRSDLRFHVP

SEQ ID NO: 959736 - protein, 55 aa, Homo sapiens
MAATSIRSNRMGKESQGFTLIELLIVVAIIAVAVPAIGVSRCTSQPGAEGVSGAD

SEQ ID NO: 959737 - protein, 37 aa, Homo sapiens
CGNFCTYQDLVELSASLLPMPSAEPVWLRWDASAVSM

SEQ ID NO: 959738 - protein, 44 aa, Homo sapiens
TLERSLLLATLLLATLLLATFLLATLLLATRMMEGIEECKRSVT

SEQ ID NO: 959739 - protein, 101 aa, Homo sapiens
MHTHWMVWVMARLPLINSEKPTAKIRIEIRYDTLAPTCAGIELRRPSSKPRLNNSNVMGPGLKVMVAQNNRKKRNEDRVNALVMASTLNKEKQQQQGERGQ

SEQ ID NO: 959740 - protein, 52 aa, Homo sapiens
MLDLFLAGMIIIRPQISGMRGAHPRTRQQRADTWAECDGGAIPMGRHFTSYT

SEQ ID NO: 959741 - protein, 102 aa, Homo sapiens
LLATPHTTGLDLGMIVNLGQLQHFTHFKHVDAIQLFAIQAEKQQSPGDSALPAVCAGLLNPSHLPCPDSYILGVRRVPNTKRHELCYLLSMDIKTTVSRHPG

SEQ ID NO: 959742 - protein, 98 aa, Homo sapiens
KAHPQVPDGVEVRGKQVAAYTWDDRQGKNLLVLAEQVGERDDDGTQSAFVYAAQYVLGGERPKRVWMLYDDVQHCEFDAGLRFDRAATKVTDLLGDGN

SEQ ID NO: 959743 - protein, 67 aa, Homo sapiens
MWPRFATVYRLESSPPPAPAPRYGPPITSTCDQRSPFTGSPGQCLRFVIQVDPIQTRGLYLRIDAGC

SEQ ID NO: 959744 - protein, 100 aa, Homo sapiens
CQSTRACTLFDLLRLLNENTPSVIRDMDEWFQDFPADAAWNVYSDYCVGNPDKANDSFSFVITLNHDTDENFSEYVSSVAPKDLKNTRQASEGLISYLNS

SEQ ID NO: 959745 - protein, 58 aa, Homo sapiens
YLFLVHASLSLWRRLVFSVYSCDAERQENGVNPGGGVCSEAEIAPLHSSLGEESETLS

SEQ ID NO: 959746 - protein, 70 aa, Homo sapiens
EPTGLVNHVCMMNSIKDRALLSYVTFQTRLVNSYLSLWEVDRPFKSIAQTSGSNKSEIHNVTNEPIPCQG

SEQ ID NO: 959747 - protein, 50 aa, Homo sapiens
RNREISREEKQNTEEKKLQQKSLLAEQWSDLLAHLENTHSDHFITLRWCD

SEQ ID NO: 959748 - protein, 59 aa, Homo sapiens
GTSLICILNIRTIMLLFTHALKNPVRPCIKPTVFVAFLVFGCSEFMLKIRMQRNACFLL

SEQ ID NO: 959749 - protein, 67 aa, Homo sapiens
PSYGTLLLATQEIHLLERVLRMGVAIVTSELNKAELYLAWTCSMQVHPFSIDHPSRCFYKLIGVHLW

SEQ ID NO: 959750 - protein, 100 aa, Homo sapiens
MGHAGHDGEPDSPRGCYSSRGLTAFCTLLMAVLAPCSQPEVPLHRISTGWTGGRQVRRPGTDLLQQAEVKGDSGHGYWRGNDTQVTFQRLKPYDIMIKDR

SEQ ID NO: 959751 - protein, 35 aa, Homo sapiens
MQTKAEKGKRERTGTQGTPGCTIDTTEYKPEYVKS

SEQ ID NO: 959752 - protein, 63 aa, Homo sapiens
RYLFLATPAALERKHLCTGDHAVYLGIDHHAADDSRQTRSSEQIEDRKVKAGPSQALARYTPL

SEQ ID NO: 959753 - protein, 110 aa, Homo sapiens
SEIFVPTSQGRHANHRFHTLETQRFQSQAVPRSLSQAVPRSLNQVVTRSLRPGCTKVPEARLYQGPMSQENTPRSHSQEEIRSLTKATSKFPEPGAIKSTETRIQQSSCA

SEQ ID NO: 959754 - protein, 67 aa, Homo sapiens
SIGHAQWLRLYPGTLEDKWVDHKVQEIETSHGQYGDTPSLLKIQKLVDVVAGVCNPSHLGDGNMRIT

SEQ ID NO: 959755 - protein, 68 aa, Homo sapiens
MQTRQRECHRMLETCEHYRRKRERGETDSRHTGEGQEGWTQKPQSYLGSSILLVLHFICFMMHDLRVP

SEQ ID NO: 959756 - protein, 118 aa, Homo sapiens
MRVLTRNVAVVQQAGPTLLGATDERNTVQQALNLVCSRISLGAAQVDAVQLRLVHFFQVPFPAGADHGEVVRCLVVGGRVERHISARTRQELGLTSGIDGEERGADGPWSAFGDYWNA

SEQ ID NO: 959757 - protein, 40 aa, Homo sapiens
MEDVESRACQKMVVSFLVCRVLYQTELMNDLGEVSCYPVE

SEQ ID NO: 959758 - protein, 119 aa, Homo sapiens
LPLIWPRHRAQRGMDAQLAKVKDPSLTPSAQVLAAMAERKESFAQFSLHQSEVHAEYFRKEPSAPEEQAHFEELARASLAQQAELEQNEVGDFDVFVGSYQASQHPHYSASLKTGFAIS

SEQ ID NO: 959759 - protein, 39 aa, Homo sapiens
MNGVKFLLFSSLVTHAAVLGCHVSPVPGFQPHAASLVYL

SEQ ID NO: 959760 - protein, 74 aa, Homo sapiens
PLTGHASVAEEISMFLPSVRTCKSQVPEIIVVRGFVAQALEDLAGGRGGDGDVGPADIGEVDGLALFRFCGVCH

SEQ ID NO: 959761 - protein, 52 aa, Homo sapiens
LTEHKRDPMQTQATGHAIGAGTCEHYRRKRERDEDLAPEHTVRRATKVGTRK

SEQ ID NO: 959762 - protein, 35 aa, Homo sapiens
IHAIQRLRSEIDHVKKQCANLQAAIADELSSVARR

SEQ ID NO: 959763 - protein, 69 aa, Homo sapiens
RDIQESQRPRREQDPGGLISQHSRLSQPGYGTSLSNKNIINRQKQFIETNLKGINSPGPKRSMAGSHEY

SEQ ID NO: 959764 - protein, 50 aa, Homo sapiens
TDTEGHGNHADRRETGKREEERNQDKLSGYTCPNLLAIACVTRRQYPTRL

SEQ ID NO: 959765 - protein, 39 aa, Homo sapiens
ISLSNSFTSYFGHQASWLKVGIKGQHHCFGHKSYKRGQK

SEQ ID NO: 959766 - protein, 72 aa, Homo sapiens
KASRFAGSSSAAPPSGGAEVPAGVWIGWTRPCHGLQLAMDSSSCPNGSSGESWGIERHEGPMKRNMEQSSLN

SEQ ID NO: 959767 - protein, 71 aa, Homo sapiens
SEHKDSRDRLYKVPEPGCTRSLSQVVQGSLSQDDQGPMSQDASQFLSKDTPKFLCQAKQRYQSHVLQRSLQ

SEQ ID NO: 959768 - protein, 35 aa, Homo sapiens
IGLRLCHRVSSPAFMLSWDCSSISRPWSVRLSSVI

SEQ ID NO: 959769 - protein, 40 aa, Homo sapiens
TLSPSSSSSPSSLNATEHTVDRKATHAITNNEQLYRQQGL

SEQ ID NO: 959770 - protein, 43 aa, Homo sapiens
MATVYGRCRREAQDAEDIRHDLEQEIASYRRLHRGPETPRMIG

SEQ ID NO: 959771 - protein, 66 aa, Homo sapiens
DTRSGPETLRTDYLTTGWNSPGYLSPTVSIKTQLSGEHTYRLGPSVYSYIESFASLLPHLGGGNVY

SEQ ID NO: 959772 - protein, 95 aa, Homo sapiens
ADPCLWSVGVLDNSPREDVRVIPLSENPPGAGKMVYTRGRNYRPLTGQLPVRILQRPGKKSTKLGGAHVNVGLVIAAFANQLFKQDTFLKVTSTK

SEQ ID NO: 959773 - protein, 127 aa, Homo sapiens
IRSECRAPLNSNVRRRKLQIPVRTSRSICVAPRPQRLHPPTSDGMARLRAVVAIVGGLLAPALDAHPASNFIIEVVEQHMLVLGLSHLLPSRTAKRLSALPHPSVDDRLMKRLVDGPVDVELPDVNR

SEQ ID NO: 959774 - protein, 161 aa, Homo sapiens
SRDPPEPSPIGRLAGLVLVFDFHQVRWAVVLEPGLDAHAGQALGDELQLAVLAAGVVHLHQGAVQRQGGGVEVPWVFGRRVHEKQRKGMVVGFAHQLQGFGPGFFIDDHRQHLCREERPVVDRDDVDLVRQVLPRQGQASIGRGGFSVFGVGIIVEVGIWK

SEQ ID NO: 959775 - protein, 118 aa, Homo sapiens
DPERRMLIEALGSAGAEMILKASLRGGAAHLGAHLLKAENEHVELHEVRGFMAGDVKGAMKEAQAVAQGTRCKQFLFSVSLNPPEQEPVSVETFERAIEKIEERTGLKGQPRIVIFHE

SEQ ID NO: 959776 - protein, 42 aa, Homo sapiens
MASITVYSDYVCPYCLLAEQVLSNVIGDRDIRIAWRAFELRP

SEQ ID NO: 959777 - protein, 55 aa, Homo sapiens
VYTYVAIKCVQKFDSYLYCTLRMDWASSFKSLNIKTTISSIHITCTCTEPHTGYR

SEQ ID NO: 959778 - protein, 44 aa, Homo sapiens
MRQKFDLFLICTLRMDWEVLLTSLNIKTTISSIKVTRTVFGSSF

SEQ ID NO: 959779 - protein, 68 aa, Homo sapiens
MEPTHRFVASVPEDTCTLTCGAKMGNGTEEDYNFVFKVVPIGESGVGKTNLLSRFTRNEFSHDSRTTI

SEQ ID NO: 959780 - protein, 46 aa, Homo sapiens
VEYEVLERRLLCDCECVRSFEFAQAEKLLRILARVRLLKYTAPVKP

SEQ ID NO: 959781 - protein, 49 aa, Homo sapiens
RSADRLGTAVLHRIKGLGFLFVNTTDVANVMGKVRAQGVVANELWFHVH

SEQ ID NO: 959782 - protein, 73 aa, Homo sapiens
MFGVRSKGMREASQTYVRRYSGQMRPKLSFLAIKKNAMSGANPTPHHPENTIPMEHGDGSIMLWGCFSSTGTG

SEQ ID NO: 959783 - protein, 73 aa, Homo sapiens
TYVYAGPSHDERCPCRHHVDSGGNKPTRGYRPRFLAPKFTGKKDAWTRQVGCELLQLLLLTAPYQFFFSSLTF

SEQ ID NO: 959784 - protein, 104 aa, Homo sapiens
CRALECYGVVSAHCNCHLLGSSNSPPAAFQIAGIPAVHHQAQLICVFLVESRFHHVGQAGFKLLTSSDLPTWASQSAGITGVSHRISFFFFFFFLRKAKRGEFF

SEQ ID NO: 959785 - protein, 44 aa, Homo sapiens
PVAKKGGRSVAGASTSHDNRHIDVVGYPPSVDGLLCEGQRRASW

SEQ ID NO: 959786 - protein, 111 aa, Homo sapiens
MDEQSVKITMLIQSLLWLEYLPEEYSRVCWGPRPRPTPENSPGGPGPLVSETTSGPGSPHRSGPGAKNGPFFLKRLNIWELFPTYRKIGKIKIHTNTYILPIHLLSRFICC

SEQ ID NO: 959787 - protein, 65 aa, Homo sapiens
IDRSVYGEHAPATTEHFKNYLRLVARACGPSYLGGGGESITQVSPGGRGCSELRWYQCTPASTSW

SEQ ID NO: 959788 - protein, 40 aa, Homo sapiens
MTTRYDADVLQLQIHLAHHLYSLKESPSERVQMTHGHAAR

SEQ ID NO: 959789 - protein, 135 aa, Homo sapiens
DKCEFANCAMRRYYTLFVTIRANAGVRELKAGIWRPFSRKAGRLIRVRREKTRRRDGKKLEEFEEHENIRYGPAELPEPVRGGDRTGIIPHLGGEYTLDSGVVHRWGKENWFLLENIGDVMKESAQAAFSYVRSI

SEQ ID NO: 959790 - protein, 88 aa, Homo sapiens
EAAGPEGECWRPEFKLSTSIRRLLPSSAGLDELPGADCAGTLTEVLRLINIVVSKELLDDEEYEEIGEDVAVRVQSKYGVVESIEIPP

SEQ ID NO: 959791 - protein, 48 aa, Homo sapiens
MVSPPYCRHRLSYGTKPRTSVGLTVRLLEKMPATGALCSISVRPVEVS

SEQ ID NO: 959792 - protein, 98 aa, Homo sapiens
WVFYRISGMEVAWKVAIEVALGVGFGGCFAGGFVDFGAVVAAILTGNEKITMQNLNDRLASYLEKVRASGGGHADLEVKIRDWHLKQSPGSPERDYSP

SEQ ID NO: 959793 - protein, 29 aa, Homo sapiens
RACRLLAAGRLSTSYPAQSLVLLGPSQLP

SEQ ID NO: 959794 - protein, 46 aa, Homo sapiens
MTAQSMADGCHISDTVDAGRCQIIPTISPGSCTLTGEIVGTEATKF

SEQ ID NO: 959795 - protein, 56 aa, Homo sapiens
SDSGLPQVLPDKVGITTAVYRDDLKNICYETDVSSAISEKTGCIRSRFKRVRISTT

SEQ ID NO: 959796 - protein, 67 aa, Homo sapiens
TTEVHAVVFVYDMTNMASFHSLPSWIEECKQHLLANDIPRILVGNKCDLRSAIQVPTDLAQKFAEST

SEQ ID NO: 959797 - protein, 34 aa, Homo sapiens
IPIYVWKVSGSCSEISPMAIILPLQTEQRSFTYT

SEQ ID NO: 959798 - protein, 102 aa, Homo sapiens
DAQVTNKQSTVDDTINGKRKTPKNIMRKLRMKEREHRDEERQVSEAEENGKLDMKEIHTYLDMLSTCASVAAADRGLLQMQTHPFCKKASLHPGQNGGRGAS

SEQ ID NO: 959799 - protein, 89 aa, Homo sapiens
LLRSHSRLPGIRSQFFAAPVGHLSLMRVHGTSSDVLGATARKVGWHQIHKKAFSTSIERLSMAVNPGGQSLQEAEIAPLHSSLGDSQPP

SEQ ID NO: 959800 - protein, 84 aa, Homo sapiens
MGDKAITNDITKNLYHLRALVTACMNFLCNSSGSCFFIYIIKAQYHKMHELLIDKYSCNLELESVPRLTADGTGPGTIPQKQPS

SEQ ID NO: 959801 - protein, 92 aa, Homo sapiens
IRCGLMCQHLLGSQLEYFVAIKRGFPFQPHGAWWWPMNVSVCSDEPKGTYFQICVHCSGLCMALHVCVSVSVYVEVSTSYSDCKVVLLHLFP

SEQ ID NO: 959802 - protein, 82 aa, Homo sapiens
EYRPTRTYWEPELCRTRPEAVRLVSDFLPSTLTLSITRCMMTIFCLLLKSTSRIGNAPCTAGTEPTNSYLALPPCFSLQELP

SEQ ID NO: 959803 - protein, 114 aa, Homo sapiens
LTIEGHASVHLVGWHWLLDTFGCLGLRHFEGGRPHAPCGWHGSLVLGMHWFLTVEGCAMLFHLLPANPEGAGTAGLLLLLRQLLLQHLLAPDLKRGNTPVFVPFNWSGPYSRVF

SEQ ID NO: 959804 - protein, 46 aa, Homo sapiens
ACWSSLAGSPVSSPDSSPYSSYLSLSSAAGFTILLSDRNLRHHAFF

SEQ ID NO: 959805 - protein, 45 aa, Homo sapiens
EFCRDSPPSWAPPGLCPGNPPRTHQGAAAFSSKFGVAAPMSLPSC

SEQ ID NO: 959806 - protein, 102 aa, Homo sapiens
VPEMTRAERECDEAWMTGSLGFSRFWPQHSLSVSRSRGTGGLGGACGGAGFGSRSLYSLRGSKRISIGGGSCAISGGYQQSRSAAIALVAPGVDLVSVVQTG

SEQ ID NO: 959807 - protein, 64 aa, Homo sapiens
MGAHALTFWAGSFVLADTDVVRPAQRWMWACDEAPGLGAPSISLAVTDAALLHTCSWDTAIVSR

SEQ ID NO: 959808 - protein, 104 aa, Homo sapiens
DPLTDPPGPTLRRKALLCLKLACGSHSAASTGIVNSVAVMLALSTVAVRILSCSSSIVLYYWLYLTGGPRGLPLVPVTDLHLQLSVCLLQGTHLVQVRDRLETG

SEQ ID NO: 959809 - protein, 119 aa, Homo sapiens
MCVYLTAVIRKHELLQIGEYNYITRIMELTTQRRCDRAWVCNTHADFADKCPKPEMLTIRFLNAENAQNIKHKVRRMQDTQIDRESKSTGRIRQNLIMPEEVRGKARRSLGDGGAQGGC

SEQ ID NO: 959810 - protein, 92 aa, Homo sapiens
MHSTANCSAQVAPHGDSYSTNGSSGVQISSWSSSFKVHCLWTTFTSCLVFSLGLFAGSDLLNGHGPQAPLCACLGLLVILMLARGLNATYER

SEQ ID NO: 959811 - protein, 47 aa, Homo sapiens
YTIPRGSQHTTHVTVDVRESIRRAQVARLKGAARLAPAAGWLAEYLE

SEQ ID NO: 959812 - protein, 44 aa, Homo sapiens
GSPVHRSCLNYPTVLIGLRIPSDFRFVALTEPHSCVNCVRSGPS

SEQ ID NO: 959813 - protein, 42 aa, Homo sapiens
GVWHENGCYYSVAIWLIEESAMSDFTSVCQLPPIELVIIMPH

SEQ ID NO: 959814 - protein, 76 aa, Homo sapiens
SSYRLGSRHDLCFVVLLLPAPVSFIYVCTSLVISACDGACISVMASPCITRQYPLVNPQPGSIEHEVRGFFVNGLH

SEQ ID NO: 959815 - protein, 63 aa, Homo sapiens
WSPPIALITSATVPHLPRLLPLAAAPALFHHGEARPGPNLAHDMTALLGAKNRAGPRSSNSLN

SEQ ID NO: 959816 - protein, 101 aa, Homo sapiens
RLSRSPARSLPSGVPAEITFHVSMMGCPIAPHPEMGRHLPSSTIPIVGIVAGLAVLAVVVIGLCVRYCHVLGRRALVEKEGATLRLRPATVPRALMCSLTA

SEQ ID NO: 959817 - protein, 89 aa, Homo sapiens
SHDPGTIFAKISHPSYSRLGVKTQRAVRSGGILGMWQPIPVTTTLLLQNLCSTNSTLNLAFQVVRWLRDCVSLITNVLAFVSIFQHLDI

SEQ ID NO: 959818 - protein, 76 aa, Homo sapiens
IAPARLAVADLQRSSSGDLMLALPPERGRPIINGLRRAAAMSSLCSTDCSWTMQDRRSREVKVALPHHGSNEPLDT

SEQ ID NO: 959819 - protein, 43 aa, Homo sapiens
DLSRIPGTIFAERDSVSCWLVPHPRSGLRSPFFLERVHAGVQS

SEQ ID NO: 959820 - protein, 44 aa, Homo sapiens
MVDLYTDPRRFCTVHALCVFVDSTSLAKEFEFSIASVYCTYPLI

SEQ ID NO: 959821 - protein, 37 aa, Homo sapiens
NCPIVPESWWLTPATPRTLREAKAVRSLGSGDSRPLR

SEQ ID NO: 959822 - protein, 45 aa, Homo sapiens
MSTGSPSVYRVLIGLIYDNFCAIARLIGTKTCRQVYEFRVKESSI

SEQ ID NO: 959823 - protein, 101 aa, Homo sapiens
MARTACDEYQELMKTKAEPWNVEIATYRKLLEGLSNARLSGDGVGPVNISVVTSSVSSGYGILAVAMAVASCGGLGGGLGGGLAVGSSGSYYSSSGDAVRI

SEQ ID NO: 959824 - protein, 53 aa, Homo sapiens
MFCLGQTTRSSAHRPLSLLVVQREDKVHLEHKQLPTPTSGPGAGMGIHLTLHA

SEQ ID NO: 959825 - protein, 103 aa, Homo sapiens
YSLVLSALTEAFRHSRCRSWHLRSKESFRCFWMFDASSFTDCSSSICLRIFFPEHYKCWAPIFFSPFGVPEFCSISTIKLAALGFGASVAAMVSFPPQWYHYF

SEQ ID NO: 959826 - protein, 35 aa, Homo sapiens
ANYEYCPRCCKYCLSPVLAALLPDFVRAMASPIIG

SEQ ID NO: 959827 - protein, 120 aa, Homo sapiens
HVEIEFDLIVSSVCPDCYLPAAHDHSEGSKPPSPVLPATPGETAGPETKGHLSSSACSQRRALGLCYREQQTHSIAVCSARLEDDVCRLLDGQTAASHRAEASPHGSASARTEPTSYAQT

SEQ ID NO: 959828 - protein, 65 aa, Homo sapiens
SSTLTDPRDVESPRGFLRYPALGLRRFCDLHDCLRTWDHDVLNLPILALLRPYACCSPPVTKRGI

SEQ ID NO: 959829 - protein, 93 aa, Homo sapiens
RNTLPDSPYRGACGFSVWRRPPPHCFYPSRVRAKGQPAIPFCMSARPGPIGAIDANVLRPSGALEECYVTVIDRHTYAVRFIPRDTGVHLIYV

SEQ ID NO: 959830 - protein, 59 aa, Homo sapiens
CSLSSCDWDSVYTPYTSNLRTFPLISGILTVAFSLFSLVDNLCADESQTSCLQSICAWP

SEQ ID NO: 959831 - protein, 35 aa, Homo sapiens
RAHILHTSIAHTSSRTHPAHIPRAHILAHTSLADS

SEQ ID NO: 959832 - protein, 60 aa, Homo sapiens
AAQINLSGDGFARDMRPIRVLGLTGLAQHRHIENCITPPPHCSAKRPRIYAVNARNRGRR

SEQ ID NO: 959833 - protein, 79 aa, Homo sapiens
RVLVDIDCWRVAMFSGILLRIVLQLTCRIYSPLKLHALERRALIRASLVVESVLKAVFAKDVFAKDVFAKDVCAKDVCA

SEQ ID NO: 959834 - protein, 105 aa, Homo sapiens
SSTIISPADCASILPMSSSLRASHDSELQGGRRPTPTIEWYKDGERVETDKDDPRSHRMLLPSGSLFFLRIVHGRRSKPDEGSYVCVARNYLGEAVSRNASLEVA

SEQ ID NO: 959835 - protein, 118 aa, Homo sapiens
NFSAIYTHTGSRIYDEKIAAQVHAMEAASISTLILTTHLASQGVHLLLRGTYFRKASSSLRFSICISRSALAKVSSSRTLRRPYDVGLHTQAQGLLCLKLGAEVHQRPDGHCQSVAGC

SEQ ID NO: 959836 - protein, 36 aa, Homo sapiens
MLQVVSPAAAEAEEGGVQGCYLLLTNSCFKCVFFWY

SEQ ID NO: 959837 - protein, 72 aa, Homo sapiens
MRLLERMQEAGHGELAGGLDLRVPSGLSSSCNLMDSPCNDSGNNRDSCLKLATGEDDDACDEQQQVRTTAPV

SEQ ID NO: 959838 - protein, 43 aa, Homo sapiens
CPLCPPTEPLSICLSMKPKCYQWTHRPRYSNMTYIDHCHAHHL

SEQ ID NO: 959839 - protein, 111 aa, Homo sapiens
YYGSCEHAVVTTTTFTGADGGSGRPVARLYVWKSGLGHTVENWMQVGAVEVARTDWILTIMFNSGRQHSLLTGLTVGCDRKTTDVKDNSEDLSRSSWKQEADVNGDGMELV

SEQ ID NO: 959840 - protein, 55 aa, Homo sapiens
SVAMFPTHGLKHRKINLLILILDPFFSNSYGRGNYVPFIVTGPNGHFGEVLTSSS

SEQ ID NO: 959841 - protein, 51 aa, Homo sapiens
SLRGDQDEDAEDHCHPQVIDKETRTLLPPSFFQAAGKIADIQTERAYQKQP

SEQ ID NO: 959842 - protein, 134 aa, Homo sapiens
MYTPEAPVGVCSRCSFSLPSIGSLCYTAQLDPLLVARTEGYFVSRVLALWCTGRVGSHLGLENECKVLLSGSSSQPMGEPERRWSSSGVGLLGGPSSPPTALAKLHLVQPVDGLPECWHLLVCSSTGVFPSRGY

SEQ ID NO: 959843 - protein, 60 aa, Homo sapiens
MILIFMDAGQPETVISNLHPDQTMPRIHGRCRPQSTEIGSTGSLQDVHDHTFMTGRCPGG

SEQ ID NO: 959844 - protein, 35 aa, Homo sapiens
AHARRELSWMVSTAPTDSVRTSTPGAHFTVFILYR

SEQ ID NO: 959845 - protein, 69 aa, Homo sapiens
LTSNSSYHGRPQAYSILLSGKDISLDNHYGKANVILEKLIEMTQQDKSPDGLGKTGCFPLFLVVVLRHN

SEQ ID NO: 959846 - protein, 47 aa, Homo sapiens
MDNSEERTHPPTTPEPQRPAMNTGPRTIQVKCLEERQRNGAKMSEQV

SEQ ID NO: 959847 - protein, 46 aa, Homo sapiens
HIRQNPKLLDEHIKKPNMEYNILTQDIYEKPVADMLMQTTVRPSPP

SEQ ID NO: 959848 - protein, 36 aa, Homo sapiens
ESARIIASQRGTSSSNSVYESGLIPITGPRKSPVFE

SEQ ID NO: 959849 - protein, 37 aa, Homo sapiens
TCQADSTKPHKLLSTESELWLSHVFPPDIRKHYEAIV

SEQ ID NO: 959850 - protein, 78 aa, Homo sapiens
RIIARKDQVVVSNTATALSASYYLSFIFFNLITGKLLYILADFLIFFFFFGKGIPPLWPKRDVQGHHHCTSRSPGPMC

SEQ ID NO: 959851 - protein, 102 aa, Homo sapiens
RLLIGRINAAELRLHSSSHSNSSNSKGSFGCSPGSQIGAHVGLKPGPARSQNSNPSLKLNNSPNEGTGIFLAHRSCLPGDRLLLDWHQAQMPTISFLLIFRH

SEQ ID NO: 959852 - protein, 48 aa, Homo sapiens
PRLFDRIVEKSSQSSDRRLDKRNTWCVLISQFGPVYFLIREAEFISEL

SEQ ID NO: 959853 - protein, 70 aa, Homo sapiens
YGPAQYIQQQNKKWYEFIREQIQQYGIIMRDRTFLLFVVAGILVAQMFMQLDLLTPGELRGTQLDIRYIM

SEQ ID NO: 959854 - protein, 49 aa, Homo sapiens
DPSHRVCGEHHNIHRQPRSCLTWIVLRQVRNGRSSQQVEDQGAVDGQQQ

SEQ ID NO: 959855 - protein, 84 aa, Homo sapiens
CVEGWPNCRVSRQNAHRNRLPQRMLARMDARWHLHHVGKSESHGQAVVANVDHILACLQTVQRFLNSAARFRTLCTQGFFSCNR

SEQ ID NO: 959856 - protein, 71 aa, Homo sapiens
DDRRRSVIEEVKRVQPVQACVSYKSAEDLPKVRGGLGVSIVSTNKGVMRIVLRALPGVGGEVLLHCVLEGG

SEQ ID NO: 959857 - protein, 65 aa, Homo sapiens
DSKIQYRVEQVLCRGVCCTLTKDDEDTERAALFDHTELTGRHDRIDRLIALSRFRAWWCMAVLSL

SEQ ID NO: 959858 - protein, 83 aa, Homo sapiens
GTALRAGWLAAPGGDGARHSSAHEVLSPLCRLVQRTGRLSVTSQASMTHSEVMACTNTMFSGVHDTRGELSGEPGGFRNFGKS

SEQ ID NO: 959859 - protein, 81 aa, Homo sapiens
EDPCRGVSWWAAENGCLVYNKTNVKFLASTTDCLQILAYGTKKASSSYWLVVDPTALVNIMRTYTLRKYYCGPPSRVLEGS

SEQ ID NO: 959860 - protein, 45 aa, Homo sapiens
MIEVSKVWIMLTNFSPSCIKGAQGSTRDCTGVDHDGYIEVIGSPN

SEQ ID NO: 959861 - protein, 108 aa, Homo sapiens
VTAYFSQLMDKLIEREDRNAARRIHIVQSGFDEPQKKPTVRCFLTPGVNSVTQRKTVVCPGCCRRKVVTSTATVHGAAVENAGPLSATRGEFPLWPLNPLGFNGYGRE

SEQ ID NO: 959862 - protein, 40 aa, Homo sapiens
RVRVGYFVLVRVGKRVDCSEKNISAIGLVEVAMRVIDRAQ

SEQ ID NO: 959863 - protein, 38 aa, Homo sapiens
LVDGYRNRHTKSMHTPGMRRAIICHLSCPAVRFRVESN

SEQ ID NO: 959864 - protein, 74 aa, Homo sapiens
CVSSVPVCWLFAHGDDEADFLVTYCDRQESDRRSTSSGTGAPNSGIAVVTDDYPKEILQATLGADYRALAQLKG

SEQ ID NO: 959865 - protein, 47 aa, Homo sapiens
IDDNLKKLYSKATIEKNDAIRTEKNNSKRIDAPARSGERLCRYELES

SEQ ID NO: 959866 - protein, 176 aa, Homo sapiens
QKALALDPAGSGVRSSRRDLVQLLDHLRHLVTFDHLLFQAVEQAVALWVTHAETRKYSAGQGFLVFVDIRRVQQLVQIKLVVEHQAQVDLAGLEVFVDRAFADTHGIRNHLDGDAVFTLFEEQAERGVENFLLTAAKFTDLTGVLCAGGKVCKGRKIGRVAQGHGYVGLRFTPKRL

SEQ ID NO: 959867 - protein, 40 aa, Homo sapiens
RISQRRLVTTPIRPTAHRGGKKVVDLFGVQIYSLVFQLVT

SEQ ID NO: 959868 - protein, 89 aa, Homo sapiens
LEDPEVHRVKHQPTDEVDLHWGSVIKTQNIAGALKPTVILVDYSDFGGKAATGIRWYVWLEVRDLVGNCLDGLGSAKRGRVSVNPWAST

SEQ ID NO: 959869 - protein, 37 aa, Homo sapiens
TQRDVPLRTYWITREQVVTYCYVLCMVSARTRDESDF

SEQ ID NO: 959870 - protein, 123 aa, Homo sapiens
SHRVGTVPWLRSGANSICPGRSSGWIPVICTVAAGNPARQRVIILVDNDRHRIVAAGEREGQGEAIFSDAAARFVDDLEFRTITTVIDEFIEALHQHEVRANCGPVLEKGWHSTPEADGTGGK

SEQ ID NO: 959871 - protein, 63 aa, Homo sapiens
LSEALALDQQVRRPKKVFEARSCAAPRHLLAPPVVGPLTTLFFQAVEQAVALVGGVPKGQCGN

SEQ ID NO: 959872 - protein, 113 aa, Homo sapiens
MTNRDDMDGEAYAFALIRWLREAALQNAADDVHVVNGIQNPAYRPTGGNFFPFFPGIPVGGARIVIIHVNRKTRQSHRCLFLVCGGEKKASCCVSNIRNFTGLMNFPGLRKLG

SEQ ID NO: 959873 - protein, 67 aa, Homo sapiens
TLDGSHPRSGLVAGMKVQLGNTALMEAAALTTKVYKNVQSCWPLKLSIIYLAVDGVLAGLLSGLQTR

SEQ ID NO: 959874 - protein, 49 aa, Homo sapiens
AYVQQLRTNRCNAGVCALNGSYTSEVALIHMVKQELKNSDVFDPVTNMW

SEQ ID NO: 959875 - protein, 71 aa, Homo sapiens
RALAVATLEVVQRRTLYSSWGQVHCRPAHLLSFEAVEQPNDWVVITCAVEHRLDTNGRAHRYVFENNSVRQ

SEQ ID NO: 959876 - protein, 150 aa, Homo sapiens
TLAGSLSGQHESPGVRHLSSPPDACAVADGLVHALLDLRLGQPDFKGFGIREENGEKYLAYEFQNPMPVRELNIRGAHNQSNALAALALGHAVGLPFDAMLASLRTYAGLEHRCQWVRDLNEVSYVTMTPKPPTSVPALEAIAGLGADIR

SEQ ID NO: 959877 - protein, 96 aa, Homo sapiens
SGYDFMARLLSISTNNLFPGVSLELEGPSDRQLNRVGHPHAVCYKVLGLASSRVQPGPGSYHIQLRLGGDRFGPKSSNHSLYRIKLPAGEGWGTEA

SEQ ID NO: 959878 - protein, 72 aa, Homo sapiens
MKLTSSWKLVLFIHGDPQRPAEAGASSADTNTGAVVAGETLVTATESGAARPHLDPLPLMLPTSPCGGGWHP

SEQ ID NO: 959879 - protein, 100 aa, Homo sapiens
YKETRYGPRIYMKAGTSLTMLHYGQAHTVQPLDFSGLKEVRTRSVLDTMKNIHPIYNIKSLMIKRELAKAFVNVTTHKDWERLYATDSNTKNVNKTRVKL

SEQ ID NO: 959880 - protein, 98 aa, Homo sapiens
DPNTAYRDTSNYPPYSVKLGQPQTPEQGDIQELVRKDLPNFLKKENKNETVLEHIMEDLDPNADKQLSFEGFIMLIGEANLVPPHGERLHALLNLRVT

SEQ ID NO: 959881 - protein, 103 aa, Homo sapiens
IEVLSSAHINFTDASADEAMGQHTRCCNAWVVSFIGRTCGYRDFQDFLDALSSRKAANMLRNRAATQVAGQGIEFEWLQGHELRNPSGQYVYACYANTYAVVG

SEQ ID NO: 959882 - protein, 39 aa, Homo sapiens
HRSPLPFSVKVLQSIHSIRVDRHLGAAAIYLCANYYLHN

SEQ ID NO: 959883 - protein, 37 aa, Homo sapiens
DQTRLTVSYVDTSKLVFDGLMEEGDSNAALRVLVSSS

SEQ ID NO: 959884 - protein, 65 aa, Homo sapiens
KYIYELELVPCGGDEVAPISRAGRPLLTAILQWWMILLLPPVMHRPTWQTVAVNMSVRKPGSDGL

SEQ ID NO: 959885 - protein, 61 aa, Homo sapiens
LGPVHTSAGPGQLKVLGAPSVAVPDAQNTMPGVDFLIITILTGVRWYAIVVLICISLMISD

SEQ ID NO: 959886 - protein, 37 aa, Homo sapiens
IDSSWYHVGVDDRIRPVTLAHGVSCHRLALVTDAHVY

SEQ ID NO: 959887 - protein, 32 aa, Homo sapiens
RLELVPFTDFPYSAFYTLDQTYAKIHFTIIFI

SEQ ID NO: 959888 - protein, 46 aa, Homo sapiens
ELELVPRRIVSALSQASTSEYAAALFALFFIADYTIIIIINTLPIL

SEQ ID NO: 959889 - protein, 44 aa, Homo sapiens
TPSVAVITSPIHKLARAPCSRSDPGNGERLFEVLAPTSATLCAP

SEQ ID NO: 959890 - protein, 109 aa, Homo sapiens
VVPRLCPLYVLLESATECTEELVYQRLLGSGARVAGIYCGKDVKELGPEAELGLVGELCLLRKCFDEGVVISSAVQGGKGPLEAFHDFQMGMGAIEGQFHMCQREGFPG

SEQ ID NO: 959891 - protein, 58 aa, Homo sapiens
MRVFMILCILTPRSPGVPRSCFAIEALRKGTYERMFRWLVLRFNKALAKTKRQGASLH

SEQ ID NO: 959892 - protein, 75 aa, Homo sapiens
PRGARITLTGSAGAYLTRAGAVNPLRPIRDGDRGLHLFPMNEEFPVGAGHKLALIKSLPLEHTARRYYRWDGLGR

SEQ ID NO: 959893 - protein, 64 aa, Homo sapiens
TTYFRDSPGFTHSGLPATLTTKDMGQESTAFHSSSDATGTTPLPARSTASDLVGEPATFLQSFF

SEQ ID NO: 959894 - protein, 35 aa, Homo sapiens
YILPGGSAVSREEGRAPWRYLRFGESRLPPPRKYV

SEQ ID NO: 959895 - protein, 106 aa, Homo sapiens
TTYFRTRSKGPYRVFCSEHQVQALRQNEIRGGMLPCIRPLELQQLRVRQPCRPKLEGLCLRNTAEPCQRRVPDPCRLRVASPCRPRLAEPCYQRVADPCPLRAALE

SEQ ID NO: 959896 - protein, 33 aa, Homo sapiens
DYRASPTTYFRNFNTTFFDSRLEEETPLYATTY

SEQ ID NO: 959897 - protein, 104 aa, Homo sapiens
PLPGYLKRIATKAVAELPQFYLTLGRFPLDKSALNRLQVRSIQQTMARQIHQKRTPDFHDKYGNAVLASGATFCIVTWTYRATQAGIERNLSLVVRVTRGGGGT

SEQ ID NO: 959898 - protein, 90 aa, Homo sapiens
SPPHPEICPQNPLNPLVNLTRSPKRNGSLDTRKKPCRESKKFNTLAITAHSYSRGHINNRTYDLNVGLGHPDAAAAIKGSLVQRLKSYVI

SEQ ID NO: 959899 - protein, 36 aa, Homo sapiens
MLQKQKKEKVTERILEEKFYWTGGKLSNLEEGQFKP

SEQ ID NO: 959900 - protein, 105 aa, Homo sapiens
TPRVPCIPKTKEPCQPKVLEPCQRKTNDRCCTKMPKTKELMGSEPYHLTQLRCEMEQKTQEYQILLNVTTRLQQNIATYRRLLRGEDAHLSSKHASGQSYSTRGG

SEQ ID NO: 959901 - protein, 70 aa, Homo sapiens
LTLEQPRDSQFTTDLVYRLYEAIQNAAQSEVLGNDTDMLKKLLLLSLATDTHKTCNTQSYLLTINYRIFI

SEQ ID NO: 959902 - protein, 112 aa, Homo sapiens
KNPPPPRVCNHKWNPFEFQRVPFAFKQEEHLVNAELRRTARESSNFPTELVCSLIGLKPELVVEPGKGGRERGPEGPRAAGWRRKWSHPPPTPGEDPGDMLLSLAPGRGTEL

SEQ ID NO: 959903 - protein, 47 aa, Homo sapiens
MVCPEGPEERVPDSLLWDRLRERHRLPSTDAALFREAERDRDRPVMQ

SEQ ID NO: 959904 - protein, 113 aa, Homo sapiens
RASLPAPSFHGLTSRIITMSWFSKDFPNGVVTIQHPRKPFSPRHTRHLVTPITRTLTSHRTDSGAPLSEVCMGGSTWGCTLMTCFCPAALAPCPVGVGHLCVAHSCRPYILIM

SEQ ID NO: 959905 - protein, 80 aa, Homo sapiens
MRGAGDIAIKLPEAGGKGFTIMAADFGDLLQHGLPFDQRRRHYFWYRFSRGRSGNGAQLVDQLFTRGVIIQHIRQCAIRR

SEQ ID NO: 959906 - protein, 80 aa, Homo sapiens
PDQARQLTKAMMRKAKASRLVTQRDGEVQNLDSFISKDPIQKPQMNIERKEKKGYTIGMPQANGHTPCGSQGGRKQGFNL

SEQ ID NO: 959907 - protein, 68 aa, Homo sapiens
TSLKTQRVILNLKVNVNSLVIEQNQMNKAPKMRRTYKAHGRINPNISSPHNMTPTEKEQIVPKPEKEA

SEQ ID NO: 959908 - protein, 30 aa, Homo sapiens
MAAYLQWRRFVFFDKELEIPPLSYGAAPGA

SEQ ID NO: 959909 - protein, 41 aa, Homo sapiens
NNNPPPPPERKSQAASAVMWATLPLLCAGARHMDLAGCGAA

SEQ ID NO: 959910 - protein, 40 aa, Homo sapiens
EAEAVAPCSAAARAVAPDLFVFAAKTKQRRLTSAASLPLS

SEQ ID NO: 959911 - protein, 44 aa, Homo sapiens
GVALSAGCEEGGSGQAIAMAVAVAMAEVLIGSVPGPAEDLALLE

SEQ ID NO: 959912 - protein, 41 aa, Homo sapiens
METHISCLFPELLAMIFCYLDDRNNGQTAFLCTAWRDSAYH

SEQ ID NO: 959913 - protein, 35 aa, Homo sapiens
VWNNNLMLTVALTESQAQAQIGPWPCFAFETGRQG

SEQ ID NO: 959914 - protein, 106 aa, Homo sapiens
QSPELGGPETGRTNWGTVAPVSKWSLGQSEARTDAAPPTGNGAEGGGGGLRGRGGRGCPPPSPSPTPTAQRGPLQGCHTMSCPPWDTSEYKTEYNKKQHGETGAKK

SEQ ID NO: 959915 - protein, 33 aa, Homo sapiens
ADPKWELSRARLTLGKPLGEGCFGQVVMAEAIG

SEQ ID NO: 959916 - protein, 42 aa, Homo sapiens
RKKINMHLFDTVILIHTVMARPHATRDCAVRGRGPGTDGHMA

SEQ ID NO: 959917 - protein, 60 aa, Homo sapiens
NNPPPPPPLGPILYSSFWPGEAHDLTCRRPLRSLYSQDSTHWQKPSKETLTDLAGSRQAR

SEQ ID NO: 959918 - protein, 39 aa, Homo sapiens
VKAVVSCDRATALQPGQQSETLYQIYGLDGGYDQVCSLE

SEQ ID NO: 959919 - protein, 96 aa, Homo sapiens
SVLGTEISPELVPARPGEKIQSTQAKIGPYELQDTLYHLLRHGMRPSRIIFLSHHAWRDASVGSWPPGFRDEDRHSYDLSAIKDWTRLFLRRFVGN

SEQ ID NO: 959920 - protein, 132 aa, Homo sapiens
EPGDHEGGVFPGYLGAHLAGVDEFSDQVCPLGAQHVQAGDLSVTADDDETIDPVFEEISDSFQAPRTFAHPLATEGSDHGAATVEDRADVVPPEPTDAIATIDHSLVALVYRIDLGSHTYAERTTARTAAFM

SEQ ID NO: 959921 - protein, 51 aa, Homo sapiens
GLSCVPKILVISRLSNKSMVSQSEPKGNGNINKRLPSIVEDEEEEEEGEEE

SEQ ID NO: 959922 - protein, 82 aa, Homo sapiens
QNVSLRRGLLLSRNECVQVKGLVQIQRLLKLLASSFFLLDWSGQCPPNANQCTLIPVSVSCSTVFLISIALQPRRSSFVTIN

SEQ ID NO: 959923 - protein, 78 aa, Homo sapiens
PVVHPTLMKVALQGEDLRELRRHVHADSTDFLAVKRPSQCVFPACTCTCFFFPSEQEGAAGGERPVPKPPQEAEQLSH

SEQ ID NO: 959924 - protein, 37 aa, Homo sapiens
QSMPGAAGRRCPDRSPPFGPDFGSTGFFYAPEAREHE

SEQ ID NO: 959925 - protein, 56 aa, Homo sapiens
MVVEHPEFLKAGKEPGLQIWRVEKFDLVPVPTNLYGDFFMCDVYVILKTAQLRNGN

SEQ ID NO: 959926 - protein, 38 aa, Homo sapiens
TSMYGKGKSNSSAVPSDSQAREKLALYVLLIICSMELR

SEQ ID NO: 959927 - protein, 48 aa, Homo sapiens
ESLSCARAPREPTQHALRAHWFPPAAVVIVPLRSRRCRGFMVLCVQGP

SEQ ID NO: 959928 - protein, 108 aa, Homo sapiens
GKGPTEDGPHPASSPLCGAPSHPQTPFPFRGEAPRPLILSCYLSETQEVSCALLQAQPAKGRATAERVGATDTRSGEDTEKTLPRCQDPRGGGTVVVTGLFAGPGEVA

SEQ ID NO: 959929 - protein, 94 aa, Homo sapiens
YQIPESLKSITWQRLGKGNSGQFLDAAKALQDGLSKEVMGWCRRMFFSDPKEGLKDVDTRKIIKAMLSYVWSTDRPDLRARVAISLGFLGGARP

SEQ ID NO: 959930 - protein, 80 aa, Homo sapiens
FKPNVEPMEKEFGLKTENKAKSGKQTFNELCQELKKVIEAYDVVLEVLDARDPGWRCEVEEAIVQSGQKKLVLILNKLGE

SEQ ID NO: 959931 - protein, 77 aa, Homo sapiens
TGLVACFIDVVENLAGLKYRVIKGNIKLTEKGGLSFKVDVFTLNAAFVLVDSVIVAFIEPLADGIPQIKCFLNVVKI

SEQ ID NO: 959932 - protein, 105 aa, Homo sapiens
GGTRGAPGAAMRGPGPTPFPTPSPRKSWEPVFDPEPEPERDPRCGAVTPAEAPGAGRALRPGGCAAASTMGAAVSRRRALRSEAMSSVAATVRAARALGEVPSHR

SEQ ID NO: 959933 - protein, 158 aa, Homo sapiens
TRCTVLVNLGILRIVVTGGSGLVGKAILEVVADGAGLAGEDWVFVFSGDADLTDTVQTRALFVRVQPTHVIHLAAMVGGLFRKYNLDFWWKNVHMNDNVLSFEVGARKVVFCLSTCFFPDKTTYLDETMIHNGPSHNSIFGSSVAKRMIVVLNRVYFQ

SEQ ID NO: 959934 - protein, 85 aa, Homo sapiens
MAATAGAGLIAAIYAFLAPPYEVSSVLRPAAINELDALNRSEIYTLPPGDALVRVGASLESYDTRLGFFRSNQKLFKAFEQPGRT

SEQ ID NO: 959935 - protein, 132 aa, Homo sapiens
RRPSGPGGARWYEQNDSLLGATRGSQYPARQNHALSISTVNDIVIQISTVDVSNFQLAARGWLDAFGNVHNSIVVEIQACYCVVGLWLHWLFFNAQCAAGGVELDNAKTLQDLIHGSQRLSLLDVWDMAERK

SEQ ID NO: 959936 - protein, 51 aa, Homo sapiens
MDGGCLVATSEQGLVGCGQGAVGGGPVRAGEVSQSASMLRIDGVAHSVPLG

SEQ ID NO: 959937 - protein, 126 aa, Homo sapiens
MGYCEELIPEYLNFIRGVVDSEDLPLNISREMLHQSIILKVIRKNLVKKCLELFTELADKENYKKFYEQFSNILGMHEDSQNREKLSELLRSYTSASGDEMVSLKVYCRMKEYPEPVFYITGETKD

SEQ ID NO: 959938 - protein, 122 aa, Homo sapiens
GEVALIIRFSSPFDICCTSTAFFVIMSITGEKGGIQQVKGPFRSNSISLNLFPSRVSCLHVQAQLLWFKSIFRVGLSNISCETADASTELQQVILISVGTFSLLSVLAGACFFLVLKFRGLF

SEQ ID NO: 959939 - protein, 142 aa, Homo sapiens
VYIVHFTQAAALERAQALTSVNFCSKEEEEAIAEALGGFRFTTGFGKTLSRLVRHGIGVHHAGMLPKYRRLIEVLAQDGLLKVICGTDTLGVGINVPIRTVLLTGLAKYDGVRTRHLKAREFHQIAGRAGRAGYDTMGTVVV

SEQ ID NO: 959940 - protein, 118 aa, Homo sapiens
VFQLVPLPTRREVDASEHRIAHHDAECARVRRDGTLIVGAERNLFRICLGSGVGECLPFVEQARVDLTDQLAQPLDDVFEFLGARFRRDGLSQRAVGVGEVAQDEALGPGESVMAYQL

SEQ ID NO: 959941 - protein, 103 aa, Homo sapiens
ALQGPRVLATPSCRISRDIISSSCDRRGPWCFNKKETPAGFFYFSCETRSRSLPEDLVSLFLPCWRQSVQNRGPGVAQGRLTCHSWSSRFQVQGFSSVLTPTI

SEQ ID NO: 959942 - protein, 104 aa, Homo sapiens
GRGRGWGKRGPNTEPGSYRGRREVASLGPSSLPGLRQALGVAGAPTRGSRSTLPGGLLWARGQSPGGGGCGPPETRRRRASAWVCGEPLMGVGRPDTLFQGGRA

SEQ ID NO: 959943 - protein, 38 aa, Homo sapiens
EVCPRAVFAGGNAAGRGVGADDQKTEWKSEVGPPARPA

SEQ ID NO: 959944 - protein, 123 aa, Homo sapiens
DNELGPHPDGGCYARLPALGLAPRTEKKKRCAVAWDLASLRCSLGAFCECDFRPDFRKDLKSWVQGNLTACGRSLFLFMDKMPPGLMEVLRPFLGSSWVVYGTIYRKAIFIFLKWLPQLGPHG

SEQ ID NO: 959945 - protein, 34 aa, Homo sapiens
GPETKVREAFQPQEPDFPTAPPDLEQLRLTDELA

SEQ ID NO: 959946 - protein, 39 aa, Homo sapiens
LLWRPKWRLRRRQRPRRLAAQAAQTAAADLLYLALLVFA

SEQ ID NO: 959947 - protein, 102 aa, Homo sapiens
ECGALGGALRTGRGNPSALQQQQKQKPSCFFCPRIRCLEFVSPPHPSSRPSLFCHLTAPPQTAFPEETGRPRPEHPPLLGGRWRTRRLAAGARLGDAGGPAS

SEQ ID NO: 959948 - protein, 107 aa, Homo sapiens
MKPNDVYSRGERENRCSDTSDPGRVQPHESSPCSPLGRDLVRGPRGPPTAAQGQTLGSQNADCRGRARLKKRPTPGKIKITSFNVRLWEISTPGCLSPSPSKSPLTL

SEQ ID NO: 959949 - protein, 120 aa, Homo sapiens
EGGPRQLRPHEEGRKMPAELLLLLIVAFASPSCQELSFLRRVALEQTFFFCERLALALAREQITAIIEVPAKARVEVDIFELQRDSQYETTDTIAMARRMEFCDSPRPASGASPSCEPWT

SEQ ID NO: 959950 - protein, 37 aa, Homo sapiens
GELDVQWRENAEDGETEAVAVCPSELSGAGPEFDRSR

SEQ ID NO: 959951 - protein, 35 aa, Homo sapiens
AVWAGKRCSSCQAVPRPARPEPRKKGAVPGVLKQL

SEQ ID NO: 959952 - protein, 49 aa, Homo sapiens
SGERGLFSFLVSRRGLGPGMGMKGMKEKKGRGAAKTAAKMEKKVSKRSR

SEQ ID NO: 959953 - protein, 34 aa, Homo sapiens
KLQALVFAAAGGSVRRTGDGPLDQNSRAQTSFQR

SEQ ID NO: 959954 - protein, 33 aa, Homo sapiens
DTAQAASSSKAHRHCRRCSQGCYEGRSGSFRLL

SEQ ID NO: 959955 - protein, 180 aa, Homo sapiens
GPARVSSQYRTEELRNMILTGPVVNAYMLVQIDNARLAAVDFRTKFVTEQALRLCVGAVINGLRRVLELPLARGVLEMQIVNLKEELACLEKNHGEEMNALRGQVGGEINVEMVAAPGVVLCRVLNGMRGLIVKMAEIDHTDCLDWFFSMTMGLNREVVPNINLVPSDKVVIVSAPAPHA

SEQ ID NO: 959956 - protein, 38 aa, Homo sapiens
MPLGILPHTEEYVFGSTPNHIMKSPLGCFGYDQRVSNF

SEQ ID NO: 959957 - protein, 37 aa, Homo sapiens
GGKDGGGQVLEAFATRSEAFIEHRGRCRRVFYRNDLP

SEQ ID NO: 959958 - protein, 40 aa, Homo sapiens
ETKLPVPAALAPRVRPAPSRQAWTLRVDLGVHAPATPAVT

SEQ ID NO: 959959 - protein, 33 aa, Homo sapiens
ELEQYDPPELADSSGRVVRDKWSADMWRLGCLI

SEQ ID NO: 959960 - protein, 63 aa, Homo sapiens
EAGPQQILDPESPGQERNLSRTGSERILLTWIRKSRSRDRFFFEPGIKIAKSRIAEHRPRSGL

SEQ ID NO: 959961 - protein, 93 aa, Homo sapiens
ERWSGLRHEGQWSPGRGPGQRRELRLMAAVRFPDVRRPSTECFFAPHPLPLGCGSVPLSPGVLWRRLYPTLVPRQAGSRLWAIPGPGPWWAMY

SEQ ID NO: 959962 - protein, 35 aa, Homo sapiens
DFMFELSDKPLLPCYNLQVSVSHGPCNWFLFSDVL

SEQ ID NO: 959963 - protein, 84 aa, Homo sapiens
GDRPPSVSSVHSEGDCNRRTPFTNRVWEDRPLFAGSTPECLHALIMRVQAGVMVFPPPPGLPAGSGPLVGPHHAWDEEPKPLLW

SEQ ID NO: 959964 - protein, 85 aa, Homo sapiens
LLVLGAAQFVLQAAAAPLDLRPRGRLRGQCQGCSLASGRWAVVALTDFVPAEAQRTLCPGCHWPRLVVGKVRRMGRFVFFVFFLA

SEQ ID NO: 959965 - protein, 115 aa, Homo sapiens
MPVELYRNGIMMLDGPFQPFYDPSTQRCLRDIWVLFGCVCSSSDWAPMIFFCKAISCSSYHTFGDVEEEWGYTASPDTSHSEGKPLHSLGDPSLMPSRRISLKPGWEGSGEARNR

SEQ ID NO: 959966 - protein, 77 aa, Homo sapiens
TNIDNSTTIQKLFKRITKQFKAMFRRKAFLHWDTGQGMMEFTKAKSNMNDLVTEQQNQEATTEEEGEFKKEAKEEVA

SEQ ID NO: 959967 - protein, 39 aa, Homo sapiens
ALRAETAAEKKKTPPPPPEESLRGGAGETQAWRFKGEGG

SEQ ID NO: 959968 - protein, 48 aa, Homo sapiens
TKAGIGPALKGQALRAETTQEPPWGGRLPAGAASGGQTGPEAGEGARK

SEQ ID NO: 959969 - protein, 102 aa, Homo sapiens
ASAFLAALMTSDVFLSGPLPRVSVISIIIKHNRKKSCTGLVTPFVHFFIQLALFFLEAPHLFRSLRFLLLGKLSHDRPGSLAYHLIVFCLAARPASALPFFC

SEQ ID NO: 959970 - protein, 85 aa, Homo sapiens
MRVMAPRTLILLLSGALDKKTCACSHSMRYFYTASRPGRGEPRFIAAGYVDDTQFVQNDSDAASPRGEPRAPWVEQEGPEYWDRE

SEQ ID NO: 959971 - protein, 35 aa, Homo sapiens
MRRQVMAALVSGALEQGGEKARGGGVPRGRGVFQF

SEQ ID NO: 959972 - protein, 43 aa, Homo sapiens
MFGLGSDSEGFSRQSPSALCGTLVSPRDVELAPLAVADEALRY

SEQ ID NO: 959973 - protein, 36 aa, Homo sapiens
VSRLFRSTAEVAVAVALVAAAAAAAETLGRVVSGAA

SEQ ID NO: 959974 - protein, 100 aa, Homo sapiens
LAFLLPEAENREPSGDRWARELLLGSWMVTVRPETGHRRGCPAAGGSRGGLFSPSSLLGSYNPLTLGLFLVYFFLACSAYGLTVSAGVFLPSLLFGAGWG

SEQ ID NO: 959975 - protein, 104 aa, Homo sapiens
SVRGGGGGGGSGGGGAVGLVREREARRWRAVFLLAAACRSGEQRPRLAVRRSPAHNSGARSPRPSPRRAPPRAPSAPLRLTCHQGVGGHWSPPPARGRSMGVWA

SEQ ID NO: 959976 - protein, 36 aa, Homo sapiens
IFSFACVIKESTPLLFFLATLLQSSTTHVQGKDRDR

SEQ ID NO: 959977 - protein, 110 aa, Homo sapiens
PPSPRALGGGDDGGTGGAGVPALRLFWITGFFSLTPSSQDPAARVPGLVLFRARCQVPGPRREVGRKRHAEEPGTLGASGRRRRPSSRPLWAVVDGSRNWPPAGKGLPAL

SEQ ID NO: 959978 - protein, 38 aa, Homo sapiens
PVFGGEAAVAAEVRRLLAFQDRKPEKFLNVCEPFHWIY

SEQ ID NO: 959979 - protein, 101 aa, Homo sapiens
EKMLLSLVLHTYSMRYLLPVVLLGTVPTYVLAWGVWRMLSDFLPDRLYQALDDRYVYQSMVLFENYTGVQILLYGDLPKNKENIIYLENNETVEWIVDILA

SEQ ID NO: 959980 - protein, 27 aa, Homo sapiens
MKMDAKKRNEQLKRWIGSETDLEPPVK

SEQ ID NO: 959981 - protein, 119 aa, Homo sapiens
NYTEDEYLGEHNSKFEIQPKKTSEEAPRKGGQRCLLSGAAVVNAFYSSGRNQIVFPAGILQPPLFSAQQSNSLNYGGIGMGIGHEITHGFDDNGRNFNKDGDLDDWRTQQSARNFKEQS

SEQ ID NO: 959982 - protein, 110 aa, Homo sapiens
GDGCGATRPGTSERKDSARSAQPSAFMEFCADSLYDVPVVVAAPLLSARVNRSQSFVGVLGSHERGPRSFPVFSPPGPPRKPPALSRVFRMFYVVHPAVKVPISERLYLV

SEQ ID NO: 959983 - protein, 62 aa, Homo sapiens
AARLLLLGIFLLLLPLPVPAPCHTVVRSECKRSHKFVPGAWLAGEGVDVTSLRRSGSFPGDT

SEQ ID NO: 959984 - protein, 47 aa, Homo sapiens
EQKPVLGPASKAQALKAGAAATIIPPPPDLQAEPGRRKRHVRRRKEQ

SEQ ID NO: 959985 - protein, 34 aa, Homo sapiens
TIPPESNPLNRFLIRVYHPLLLKVLHWPKTTHEE

SEQ ID NO: 959986 - protein, 117 aa, Homo sapiens
VLCARSSSAVSRQSSLGLPGPPGPWTCLTDGFSELRGEIFFLRPKEVELLLKTWLPGEGAVQNHVLTLLRWRAYLLLTTCLPLRVDCFSYLEVQAMALRETPPPVTFELESLRELVL

SEQ ID NO: 959987 - protein, 39 aa, Homo sapiens
GGAAIFAARTRSERLRESDTLSASIQIAEPAVSAAAMDD

SEQ ID NO: 959988 - protein, 46 aa, Homo sapiens
GSVGSRGVVLREDPGVLAVFAAGHTQDTSAVFAGDCSPFPEYSPLS

SEQ ID NO: 959989 - protein, 117 aa, Homo sapiens
MSRKVCLSFIDSSLYTFVSFPVQVCLGDWQLNEGARNVCRTRLWQACPAPAGCNPSSWNSTGYLRGTKVGGREEVFNRTHIYGQASSLTIQVHPSFKDPRGQQRGPPSSTGGRFFTL

SEQ ID NO: 959990 - protein, 136 aa, Homo sapiens
MRLIHKRQISLKIPPDLLDAAGTDCTIGTLQQKSSEDQGIKGRIEKAANPSGKKLKIFQPVIEAPGASKCIGPGCCVAQPDSVYCSNDCLKHAAATMKFLSSGYEQKPKPKEMKMKPEKPSLPKCGAQAGIKISSV

SEQ ID NO: 959991 - protein, 35 aa, Homo sapiens
YESYLGRRGPTPPGNSTGRGRSLTFQVEVTELKFI

SEQ ID NO: 959992 - protein, 63 aa, Homo sapiens
SPGEPGGAAPEREVAGGGQGLPGCGGGGAVAGGGCRRFVAGGEQEAQFFVAAGEGDIGPGLQG

SEQ ID NO: 959993 - protein, 112 aa, Homo sapiens
FPLQCLRGGDGSTMDPRLSTVRQTCRNPSVVLTALAIYHVIMPVLLFIEHSVEVAHGKASCKLSQMGYLRIADLISSFLLITMLFIISLSLLIGVVTNPEKYLLPFLSLPIM

SEQ ID NO: 959994 - protein, 46 aa, Homo sapiens
RRSGAGQSILRPGAGPCGRQIAYFGPAAEPGRNTDFVFMTTHVTLE

SEQ ID NO: 959995 - protein, 35 aa, Homo sapiens
EAVLCLQLWQRTVPLDTLKGLGVGFPGPVLRGAVF

SEQ ID NO: 959996 - protein, 46 aa, Homo sapiens
LLVSGVSAMAALDSLSLFTSLGLSFLISRETLKNSALSSLCCARPL

SEQ ID NO: 959997 - protein, 119 aa, Homo sapiens
PPSKGEALYGRILMGLVCFIDIAVENLSGLKFRVIKGNIYKFPWVRTLLPVAGGHAERRLRARGLCDCGFPTAGGCWQRNPPDQVLPQRGEDPPRGAAQDVGDQSGRGDPARRRPPPPA

SEQ ID NO: 959998 - protein, 69 aa, Homo sapiens
KAQCLLKAQSEGSEGSCSSGRDTISVGGFCAHTTWWRAIISKVGGAHLWESPGPGCGVVLLPSASPTGR

SEQ ID NO: 959999 - protein, 106 aa, Homo sapiens
AEQRVESVERMELCPERLTCCSSRPNSRPTRGRPVPAQAAGRPELALERPTSGRFGPAEAAGRPKLGLEEPTDRRPFGACRCHRRAGAEPEATVRPEPGLGSLAPG

SEQ ID NO: 960000 - protein, 46 aa, Homo sapiens
SKEQCPAQLRGQMGQIPEALRRSLLLMMFDQTHPTLGSHLVPAVIA

SEQ ID NO: 960001 - protein, 58 aa, Homo sapiens
RPVAAMIEQQKRKGPELPLAPAKRQRHVKAGEERRLAQEPGSSRRRREPSCKRHLQDA

SEQ ID NO: 960002 - protein, 107 aa, Homo sapiens
PIALLASTVIDQLLAQIAGNAPISIAFLFMSGRAKALNPMRRLLMRAFSKTLAAVLLCGVASLAQAADTAICYNCPPDWADWGTQLKAIAASTGVPSAPGQQELRPI

SEQ ID NO: 960003 - protein, 41 aa, Homo sapiens
EEAWEGPVCSEMIGESIVPCLRHQTLLVASLFLPAQPAFFS

SEQ ID NO: 960004 - protein, 43 aa, Homo sapiens
SQWPTPGSVGIVLVPSVPLQSSSRYRNASACLAEEEQRMQDYL

SEQ ID NO: 960005 - protein, 137 aa, Homo sapiens
SRPGPDPRPQEEQAPPPPREGAQTERREEQPGAAGAGAAPGLDSTFFNEKDSELFHSSVEAIVNAISHARAQRYVNTLLKLIPLVLGLPEQLRQAVQNGDMETSHGICRIAVALGENHSRALLDQAQHWQSSLALVN

SEQ ID NO: 960006 - protein, 74 aa, Homo sapiens
MGLQACLLGLFALILSGKSFSGALPEELPPGCLSLGRADPEEELSLTFALRQQNVERLELVQVVSPSSPPSGNS

SEQ ID NO: 960007 - protein, 36 aa, Homo sapiens
VKHSFVSESSMKTSRVCVVADGAVLGGKRANCAHPP

SEQ ID NO: 960008 - protein, 164 aa, Homo sapiens
FQPPYHPTARAAQARAEAVSAPALALQSGPGRRPGGEGGDGSPGAEAVEDSGAPGSPSSPERGAGDSDGAPGRRGLRPGGGGWVASAPALSGEERPGGCCLPLLGRRFLRPGSGRSGRFWGFGVPRGFWSSPPPPRSALLPRRPSPFFPRPCFSPRLALPSLLR

SEQ ID NO: 960009 - protein, 115 aa, Homo sapiens
ISQIRGAVSSFQFFNSIGSRQGVPGGKGCRYNPKSVSKGVFSYTWQLWSSSAESSAAASPPRGTADLASTSPAWLFITAEDLDLEKKASLQWFNQALEDKSDAASTSVTETPPIT

SEQ ID NO: 960010 - protein, 101 aa, Homo sapiens
LVMAALSLVAACWGRAAVDDPVHFPAAPGSSARASETMVSVTMATSEWIQPFKEAGIPPGPAVNYAVMFVDNRIQQSMLLDLAIMNDLRVSVPRGSVGFLR

SEQ ID NO: 960011 - protein, 46 aa, Homo sapiens
AAVAAVAAFGPRQAASVAEVAGRVLGLGREGAAGADPPALMPPAAC

SEQ ID NO: 960012 - protein, 64 aa, Homo sapiens
EKTRIVPPGHAAPALGTQRSLFLRGCAMAAGKTLNPCAVVARALAVLAVFLRAARALLDVLGTT

SEQ ID NO: 960013 - protein, 58 aa, Homo sapiens
MALNKITRVGFGIIFTESILLSYDHVELTFSDMKNVPEALEGTMKGTGYVTPGGGMFL

SEQ ID NO: 960014 - protein, 38 aa, Homo sapiens
REVAPNRKRTKKITVRDAETNRTRNYKEQEGSISNTAN

SEQ ID NO: 960015 - protein, 71 aa, Homo sapiens
TKKQLAPEGHPPYPKVQTAANVGDQRSTDWPPQHSKTPGAGRENGTETPTHENPEREKARQAPASSKAGAA

SEQ ID NO: 960016 - protein, 125 aa, Homo sapiens
KNHKEACLPRGERREAGETEQNTAHSRNPPGDQIQGREPHNGRTAPRTRGRGQNGNTNQRGKAEDPRAVSQTGTAHPGEGITGTPPGGGEDRKPPVKKGDEQRESEELGASSNKVVGRHRHRPST

SEQ ID NO: 960017 - protein, 77 aa, Homo sapiens
GKAFGFDNEGDSNPGRQTPKTTSNEPKKTSDQDSDVDIFPSDFPTEPPFPRPGGTKEAQYLPESDEEEDDVDFAMFN

SEQ ID NO: 960018 - protein, 85 aa, Homo sapiens
MPKALFRCLGWVLPVGQRSWTMSSWRESKVLNISHVMLPMPNYVRILGDLTSSAAVALLRARFCLEPTPSPPGVRLSEGVRARAE

SEQ ID NO: 960019 - protein, 94 aa, Homo sapiens
GSTPGMVKGPVVLGKNRSANGSAKSPECGGFCGASSTIGGLLYSEPESGCSSDDEHGDAGMRVGAEYLARIPEFDPGATKFPALDRGGMLVWSP

SEQ ID NO: 960020 - protein, 63 aa, Homo sapiens
QGPAPRGYRSSCQDAGAPGVEEKSTGATFTPPVAQGPNAPGPWRCFRPECDYWAARGAAGAWG

SEQ ID NO: 960021 - protein, 53 aa, Homo sapiens
GSFGRGPSPPRGAARVWSHVPPPGPSFTPPLPTGELKCGESGPGTIKLVTGPG

SEQ ID NO: 960022 - protein, 49 aa, Homo sapiens
MVPYKGCGMEGKKTWVPELLLAVSNSQCGQRTQALKGSFIPPKLETARA

SEQ ID NO: 960023 - protein, 100 aa, Homo sapiens
VQSVERDLVVEQFKFTVGSIPVENHIIARNVVRASLRLHIFTSIRESTLARNPINVRNVVKALVGLQVFRPIREFNWREVIHMYCMWERLYSEFKSSSPS

SEQ ID NO: 960024 - protein, 109 aa, Homo sapiens
CPECGKGFSRRADLKIHCRIHTGEKPYKCDECGKIFRQASNLLAHQRVRSGEKPFKCEECGKSFGRSAHLQAHQKVHTGEKPYKCPECGKAFGDSSSLIQHMRIHTGEK

SEQ ID NO: 960025 - protein, 76 aa, Homo sapiens
CPECGKAFSHGSQLTLHQRIHTGERPYGCPECGKAFNWSSHLQIHMRVHTGEKPYVCSECGRGFSNSSNLCMHQKV

SEQ ID NO: 960026 - protein, 139 aa, Homo sapiens
CPECGKGFGWSVNLRVHQRVHTVEKPYKCGELWKGLQVELNLDMHQRVHTGEKPYECNDCGKPFSRVSNLIKHHRVHTGEKPYKCGECGKYFSQASSLQLHQSVHTGEKPYKCDVCGKVFSRFSQLQSHQRVHTGEKPI

SEQ ID NO: 960027 - protein, 52 aa, Homo sapiens
ELEFVEVAALSAPKAWYPAQGIWWGGLLVKVDALGAEDNTRKPPAADGNRGQ

SEQ ID NO: 960028 - protein, 46 aa, Homo sapiens
EAEDGGDEEEEEEEEEEEGISALDGDQMELGEENVFLGGGRLGPDG

SEQ ID NO: 960029 - protein, 46 aa, Homo sapiens
LTKLGRDDVLLELGPSIEEDCQKYILKQQQEEAEKSLQVAAVDSSV

SEQ ID NO: 960030 - protein, 42 aa, Homo sapiens
EVPAQLDRGVFGARRSLAVPSTSAAATLVECLVVASGEEQTL

SEQ ID NO: 960031 - protein, 93 aa, Homo sapiens
VEAAGEAHGQRLQEHLRESRGAEQTSRAELHSVTRKLQEASGVADALQARLDQACHRIHSLEQELAQAEGARQDAEAQLGRLCSTLRRGLGLQ

SEQ ID NO: 960032 - protein, 48 aa, Homo sapiens
AAKMEPAVGVPGPLIVNNKQPQPPTPNTPARTVTTRGTAFRRGPPAWG

SEQ ID NO: 960033 - protein, 38 aa, Homo sapiens
SAVAQEEDLEPTRRPPLVHVWCGWIPEVSIGWAEKMEI

SEQ ID NO: 960034 - protein, 37 aa, Homo sapiens
GPRSHGGRRAPSMAVSAVEGKDSESIRCRVVGHSGPD

SEQ ID NO: 960035 - protein, 31 aa, Homo sapiens
IPPPPGGRVPEWNMATCAEILRSEFPEIDGQ

SEQ ID NO: 960036 - protein, 36 aa, Homo sapiens
WQFLVPRLGDSPQALPSGSSLSGEGQSLLVPVRPAE

SEQ ID NO: 960037 - protein, 47 aa, Homo sapiens
REELFQGDAFHQSDTHIFIIMGASGDLAKKKIYPTYEGRSGVVFCPK

SEQ ID NO: 960038 - protein, 83 aa, Homo sapiens
MRTPGPPRRGSRRSLLPRPAPCPPTLFTVASGSQWFAGTDDYIYLSLVGSAGCSEKHLLDKPFYNDFERGAVDSYDATVDEEL

SEQ ID NO: 960039 - protein, 36 aa, Homo sapiens
RPWPEAEEVAPGTELGSWRKRGWRSSVPDSVCSCDC

SEQ ID NO: 960040 - protein, 47 aa, Homo sapiens
TRGKTLRLSECSFRPEHVSMLATGYEQVFFRRLTLTQCCLGQKHLAI

SEQ ID NO: 960041 - protein, 38 aa, Homo sapiens
QWRPGRDSEPAGLNQGDAEDDDQNTRYKPFSARHPLLA

SEQ ID NO: 960042 - protein, 43 aa, Homo sapiens
MAAKGAHGSYLKVESELERCRAEGHWDRLPELVRQLQTLDMPG

SEQ ID NO: 960043 - protein, 48 aa, Homo sapiens
QPLSPVPQQQVVLIALFVQCFGLGPSAFLRSGTLHPAQPCYLFFMEEH

SEQ ID NO: 960044 - protein, 105 aa, Homo sapiens
AQPVKGGCVCNKDRGRCIVLELQEGGILRPPLTPCDRFGSLTRSFGYKSGRTGGEETARGTGRNGLSALNHHKPWLRKGHASPSRRMTPIRDPQRPVHVDSQGNF

SEQ ID NO: 960045 - protein, 36 aa, Homo sapiens
MAESLASAQAPSRVRYGRCRPEEDEGACSVEAAARL

SEQ ID NO: 960046 - protein, 59 aa, Homo sapiens
PPQPSLAPREQEAPGTWPLVETSGIYYTEREREREKSASGRPSWAAVVGSPPLAHTSLL

SEQ ID NO: 960047 - protein, 31 aa, Homo sapiens
VPGYSSRSVGGSEADYPAAERIKEIPSWTLR

SEQ ID NO: 960048 - protein, 39 aa, Homo sapiens
TTEARAGSGGSHSSLRDLSIYGLLNRLCLLGACWLREPA

SEQ ID NO: 960049 - protein, 89 aa, Homo sapiens
VCPKLAVRCVGLVSGWVCLSHGTTSGPPSFFGQRQHVLNHFLPSGEMDEVAVQKCRNALKLPVLEVLPGGGWDNLRIVHLGRVMALTYS

SEQ ID NO: 960050 - protein, 170 aa, Homo sapiens
HGRQWHQAELAVSTFWPNEYQVLFEALISPDRRGYMGLVDILLLSYPCAKAPHFSRLGDVEVNAGQNASFQCMAAGRAAEAERFLLQRQSGALVPAAGVRHISHRRFLATFPLAAVSRAEQDLYRCVSQAPRGAGVSNFAELIVKEPPTPIAPPQLLRAGPTYLIIQLNT

SEQ ID NO: 960051 - protein, 52 aa, Homo sapiens
MNLVKFCARTTPSRLSSIFTLYSAFPDLEPYRPNPVTFLPTANWMLYCPRYR

SEQ ID NO: 960052 - protein, 48 aa, Homo sapiens
LTRTPSSEEISPTKFPGLYRYWRALTSLFFLDEPPDVGSDDEIDHGKK

SEQ ID NO: 960053 - protein, 44 aa, Homo sapiens
TYYPPYFWVGPSGKMAAVQAAEVKVDVSDPRLCKELKRRLLSEK

SEQ ID NO: 960054 - protein, 43 aa, Homo sapiens
WNEKDAKNRQGEADRMSRKAHITEKVTIFVSMGRDPPAETQPQ

SEQ ID NO: 960055 - protein, 44 aa, Homo sapiens
GQRVSKAGPGAQALTRPGSELAAALADISHPRGAAAPCMRGPLS

SEQ ID NO: 960056 - protein, 98 aa, Homo sapiens
SLMEDSDDGPSLPTKQNEEFRPFIRRLPEFKFWHAATKGFMVRTFFDASLFFRPILMFIMLFCITMKRQIKHMIKYRYIPFTHGKRRHRGKEDAAKVS

SEQ ID NO: 960057 - protein, 83 aa, Homo sapiens
LFWGSPRCQDLVSLVVGLDQKVPRSGAYLVTGALRSGTDTASLSGPHPRGLPAPLGLAQWWGAFPSVGVRLTHGPGCARLSAA

SEQ ID NO: 960058 - protein, 32 aa, Homo sapiens
NNPPPPPSREARWLRQGVALGLTREVGDTNEQ

SEQ ID NO: 960059 - protein, 34 aa, Homo sapiens
APTLGLFSNYSTMDPVQKAVLSHTFGGPLLNTSR

SEQ ID NO: 960060 - protein, 64 aa, Homo sapiens
MENTSLSVFALCFLLLAVFFSLFGSALSIDETRAPLKEKMMRFGGRLALNTKEELATERLLSLK

SEQ ID NO: 960061 - protein, 96 aa, Homo sapiens
MREPEPPAAAASASPPRTGALGLVALALPAPCPVPRAVMCLRCGSCCCEAERMVVVDDADADAACVMDVLCSVILDAVCCACCLLLWLLMCGSGLA

SEQ ID NO: 960062 - protein, 470 aa, Homo sapiens
MWLKPSSQMNNGRGEPAMWSWPTDEMLTCVILTWGVSRSNGTLPAPALVTVPETAFHGRRWMLQALGTCSMRPRKAIEPMHDPMNSQRAIWPWMVGTRRWPPCRCDGIVGLVGLLLLLGSKCLRPSAPPVPPCLCPIGIASTLYRGTWPRYLRSCTAPGHGIALGADPNEANFSLIIFLGRGFGRFSAQKGAQWWLVWPLLNTHVGSAIRFWVIWSPNALFWPLLGNQVRPPNGRRGLDSRISLPSLSFTRSDAFLINSGGDVRCRAMHIGVSLWALGTDVRFPLGATEPRLVVSRYFVGPLRAWGPSMLVLDSGLNVKGVREPSVQVPLGGRPFPASFGDAVSGARGLACGEHFVCGICGMHNEIPVTRLSKGITPHPPRVTIAGGFPRGAHWCRLKGGPSNWGAGLHTPGWACTYRRDTGGFNVWFIPCTVRHRVVFIVCSSADIYCCPRWSLGTSQARDWRLSATSI

SEQ ID NO: 960063 - protein, 128 aa, Homo sapiens
GGPKFLYLEGMGPNQKILRGLFGSQLYRKEVRGTPQTVLCHVPWVCTRESSTPSGIVGEIYAPRAIAFSFTHVALHRGCVCLCYKREIYISAHKRTRYLESARSHTSLCDATNVCVLTGVCSPHKYLL

SEQ ID NO: 960064 - protein, 72 aa, Homo sapiens
LPWGSLADSIPCPGFTFGHIHHHEFSVMLITLVAIYCVASGLGMCVGLRWAPEWTYYFGQLVGYDILVNVCA

SEQ ID NO: 960065 - protein, 256 aa, Homo sapiens
MCCDANAVPLCVLCDAVMCPVCVPLLVHVTDCLTPEWMLSDALLDASISVSDVLVLLLCMHLSMVPVHLPFHHYFMQWPDHFLPVALVLCHACSRQPDLLPSCGCSCLTALYLLWEMYLHLSLLAANPFACQLRAPAQPLLPPALRRPGTLTDLLLSGFLPPITPPEKFLLSQLMLAPPRETLQKRRLRQIALMDVGNMGQSVDISGLQLALAERQICIANGKAKASFPKYSPVTQTRESSNSGFGQSVASQITEA

SEQ ID NO: 960066 - protein, 265 aa, Homo sapiens
MLLCEHVADNSVVCEPGCLLGPRGFVCQWFFGCIYGFHGKSVQAFSVGAVYVTDKWLTLSNEVMAPNVPSNPPAKSSGKHGVLNGPLSAKREGAGDCGVLTHWSRHPHSSCLGLSLLAAVGRHAQAALSAVGAVPGPFAAGSCVHGRSMPVSLEGFLCEPTVLPLTHDAETCLRGARRGKLLLRPESGHSLVSTDVKERPDSSEQVTGGDDHDGPSDGDSYGLILKELQNLAFAGAVNRGPTEKPRKGTRGASERAPGSKDRRQM

SEQ ID NO: 960067 - protein, 85 aa, Homo sapiens
AFGLSIRDFCCRCPSSVFGFGRISGAPCYVSYYFQLPGVGSHWSSCVCHCRLSVVSASVVFPLLSSGHAHCNASLLFYVVGIFAS

SEQ ID NO: 960068 - protein, 68 aa, Homo sapiens
GRARIRRDVVLSRVPEQEEDRTVSLQNAAAIYDLLSIIVGQKFSSVLSELERAMIFVGEFHLWYQVAL

SEQ ID NO: 960069 - protein, 150 aa, Homo sapiens
MAYHAHGAITQIMDTDTVGMDDAMLHCCLVIAARGGSGEWFPGRQVPPLRSENVPVLPWSGSEGSYTKGIFSSPCLGVTEAFMKKFATQHLLEPHCRAERALSVVVESMPFDMSTPSCHVPAALPSWKAVSPIAKSSSGLDELPQRHLLH

SEQ ID NO: 960070 - protein, 48 aa, Homo sapiens
PDGAAGGCLASTLTFWAGGPRTGQAVAATGARKSSFSWFCTELCPDAV

SEQ ID NO: 960071 - protein, 281 aa, Homo sapiens
GVVEPENLARERKMQWVQLQRLERKVHVPIYPGEMELLLNPVPDEPTACAGYMDGSVVPGVPVPHCVDDDYSLVPSSCEWCSCLCLNVILHNDAMSVAPMRPPMAAAQVPCMGDVPATHQHAHHPFSSANTTTIHRTPNAGIIPPTLLRVSGRDHGDETCECQKKGACWMAGNPAARGCLINVQEEMEGSVDISRPIHNWEGPHPSFPYSWDRQQWTLWAACSILRQRGPHLTVALEPRDHSLPFPHPLVGKERSGPSTVSSRCDALHKQQLKNGKLDLMT

SEQ ID NO: 960072 - protein, 103 aa, Homo sapiens
MPRDINSPYYPGHYPPNIDCTWNIEVPNNQHVKCAASRFFYLLGARAVPAGTCPNGLRGDQLGRNTAGDECPSSVVTMQHATMITCSASTHDHVLHLTPGFLD

SEQ ID NO: 960073 - protein, 46 aa, Homo sapiens
VARRRAVLPGERAAPSRPRQRCAHSALPNPGLSSFPRLFPFRARDE

SEQ ID NO: 960074 - protein, 173 aa, Homo sapiens
GTRTTVAYHHPEESRASPPRWGSLRGRLKVWFHEPQSKGEENQREEVACSNRPAAATTCRLRRNTASPASARSSEKCPRVPCSSGVFPASLSVWLCPFGVLVGQLCGGVLNPTCHPMLTHRGVCQRQSKFPGFDAMMGAWNSCLDSSSEETSVSVRAQIGNKTLTSTVILMDG

SEQ ID NO: 960075 - protein, 38 aa, Homo sapiens
PASGSFFLCMWLAAAEQFSSLTPRRPSLGLSSRHWSHG

SEQ ID NO: 960076 - protein, 35 aa, Homo sapiens
ETLGTGGGNCSKPSLALESTRIFKAGPLRGGWTHA

SEQ ID NO: 960077 - protein, 77 aa, Homo sapiens
ESKAERTRSRAGELRAGRVRPPVPPGARGTRRQGPLRRGLGFLLPLPNLTITYIRREMSKPLGLGVKVSSGLGLSKP

SEQ ID NO: 960078 - protein, 42 aa, Homo sapiens
LPRWDPGLAGPRWPPAQATAARMDRKALAATCALNQGALDFF

SEQ ID NO: 960079 - protein, 38 aa, Homo sapiens
AFARLWSVVISALDPGPASLFPGVAAVASPPPLSPPPP

SEQ ID NO: 960080 - protein, 39 aa, Homo sapiens
ESPGQERNLSRTGSVRNSRTWIRKSLRPERLSRNPDLRS

SEQ ID NO: 960081 - protein, 50 aa, Homo sapiens
MSGFWEEACRGLRAQGKPLGLPPTSGLCYLLPAGLAYPAVGCGELGRGSG

SEQ ID NO: 960082 - protein, 160 aa, Homo sapiens
MGRGTARGHTGHPRGGEAIPYLFPCWLNPRVDHLLCPSPRTYRLARLGDSHHLEGGCPPACALVSGNIPGLKFPLSSSLLIPGYHRTFSGPRVSAPFPVKSAAVLATQDPHLTWRVVDHSFPGYWGPPGWGEFPEVLEKEEAELGIPGGWGPTSGGTQLL

SEQ ID NO: 960083 - protein, 290 aa, Homo sapiens
MSKPGPRGPPNPPPARGKDRPKPLFLLGESLGAAPKRELTPSLGGLGDLGGERRDGSPLFRAASRGPPKSPSGCRRAMGFALVEVAREMYEGEPLLNDKRVPPSARGGVCWFAPRVRLQPRSLIEIECGTHSHGGVVVCAGAVFVEKPPLRVGGRRPSVGVVIGAPVLTRRPPRITVEYSSLNTCFVCMMLFFLRSTKFPPRWKETAAALCVRLCEPRVSPSGGGAHSGSPPLCLCVLTWRRSIFKSAPRSVGLPTWGTSEPCACSHKGGLSAVLPRRRELLGEGGVRQP

SEQ ID NO: 960084 - protein, 113 aa, Homo sapiens
MCGRPTVFPRGAPCDLPPTMWGPPCVCGGPPLERSVVAEVSSICGERSVLCVRREGLSHTFRATSFSRGGGGLNPVERDTWKAAYWRGFPQCVLFPATRKRHCFCSPTSSPTI

SEQ ID NO: 960085 - protein, 78 aa, Homo sapiens
CRRHPAAAASFLPPQDLAPAPASAACGASTPCPAAHGLMSGVCLPCTASHVFPCCPCIVTLAIGPRQHVSSCSSQARA

SEQ ID NO: 960086 - protein, 70 aa, Homo sapiens
RYHGNVNQYKGLPSLTLSSCWIRASENLSGHRHNTTRDCTCQMDRPDQKRASEHSITREIDSKRQINGKR

SEQ ID NO: 960087 - protein, 113 aa, Homo sapiens
SFSFLVYIPLVFNFYDGRKATRLVSLLSSTLLLCLTFFSTFCCDPVLSSYLGVLPTFSRPFSHVLRGTFNPLIYSCGSPSGVLPCFYPSVVSALCPVWPSSFLLLGFPCSVTL

SEQ ID NO: 960088 - protein, 77 aa, Homo sapiens
MDRYPPKSCVYAPWRCRMFGAKQNKQGIAFCVCPTNCPSPGGVVPQSPNCNRCDTETWVSPPTHYWGVTTTSHIGAD

SEQ ID NO: 960089 - protein, 183 aa, Homo sapiens
SQVKSKAKKSVDKHSDEYKIRRERYNIAVRKSRDKAKMRNLETQHKVLELTAENERLQKKVEQLSRELSTLRNLFKQLPEPLLASSGHCYARPPRASPCRPGLRLRGAPAPAPSPPHHTDGRPVKTIGNWGTWQTTGSHVGAGRDQGHRFTKIDANQVLKQWLNALMYTGLTQPTCNCQPGPE

SEQ ID NO: 960090 - protein, 114 aa, Homo sapiens
MFCCPAHCLFMQFFWVQSGLDKTMQRFPVSTQPIVLQPHQLRPEDSGLATALEDVTTLNQKSSYCSTPHKSDQRMDQARVLLGGSYGEDSSTLTGTVSRMEISTRGMGYEVGEA

SEQ ID NO: 960091 - protein, 180 aa, Homo sapiens
LAFLSCLVSFWGLPVAWLLPLVVSYHVCLFGGGLLCVSGFFPTALCRVLLVRSVAVMCGSSVCGSPLRGRIVACAGAVSGVCSVSLYPCRDELVRKLLGALRPCRAPCSVLCSGPPNMLRMFFDATVLYVGRGVARMLFYSWESTQGPSLISQGKGVAHYILSTAFFKWLREAEDESDHN

SEQ ID NO: 960092 - protein, 117 aa, Homo sapiens
FVTIHILSLFILIVFIGCSSSLTFVCSHPGVYRVLLFCVVILVVLLGLLIRWILSSLIVSLMLVPLSVIGVVLRHFVSSGVVLLCHWLIRTYPWFPSGNSLSMVEWTVSLSAQVVCH

SEQ ID NO: 960093 - protein, 192 aa, Homo sapiens
PLNYPLFINSIYLSGLYASGPGYGGRGVWQGKKRVKQISWLHSSLIASKIPTQSPVCSLCVHLPSPHPRGIRRAGSLIKLCRCRTSGSPHSLFHNPPVCVKKPPEGFPPLIGDIFSIVGLCGHLDSCRGFPLLLKFYYISPREHNSTLLRGVCSPPSLERRDAHNFLPLWNHNVWVGPNEAGARDGEKIPKT

SEQ ID NO: 960094 - protein, 264 aa, Homo sapiens
ALHCPAGSAPALRVHMCCSLPAPCLPGLNCARLRWRISADGDEGDLKSGAQSCAAAHGRDVDISPKQDEGLLKGRQERGLQVHEMPMIGDRVFVHYTGWLLRWHKCLTPVWIARTNFSFDLVKLGRSSRLGDIAIATIEGGGGVPHSPANQNMPTVQQCMSSKDFPPIVQRLYLTVELFEFKGEDLTEEEDGRDIISPEYRLAVAAIAKPKWGCYSVAGCPGGVLPGREFFAGGARFDIARGRRCCLWLGGLAWAGGSPFQPVF

SEQ ID NO: 960095 - protein, 347 aa, Homo sapiens
CLLNIFFFPSPPLCRGGWNRGKPPPLSCRESGRGPIFTLISLFRHKVPSVWPCGGWEMRWSLQPLFSSRGLGPPSLTQISHAGGERAVVVCGEREPHRETRKSEKKRVFSLSRERRENTECVSLSRALCAPARAASLCVRERESERERDTLSTSGRHTEKRVSLSRESVSLSHHPQCVRQRDERHHTHIECLSHTLCEKQVVSPHTHIYISRRERERGETQIMSPTQKNTRCVSHHGVCITLSHTHTHIEKDSSLSLSETQREIALMNTLKNTYPETSLRRKPQESKKVVCVCTHPLYEIKHSLSVRTKYKVWDHAVEKGEIPLCVWCALQQLCSPTREGVCAHTHL

SEQ ID NO: 960096 - protein, 189 aa, Homo sapiens
SIIVTDDVKQGRCNRTRSPRSGLCVAGLLGPLRVSGAGGHCSAGALALANGFPSAHEALKSAPSSFAARWEVPLLPPCALALPMQQLGPVMMLPLVPLCMPNWRPCDWLPAQNSLPLAPCGITCASSVGPAVLPRDVMCCCMGWPCVKLGGLLSGEFCEGACAGAPVHPVSPHPEERVKESLHPGAVMV

SEQ ID NO: 960097 - protein, 105 aa, Homo sapiens
QPAVYAIHHQQLPHGFTNMAQCYPVPMSKLESQQPRPLTPGGAHPAQVMLRAPTPESWGAPLKARCPRVGCRALSASTPSPYPYIWTTPQGEQPGQAPGISRRSR

SEQ ID NO: 960098 - protein, 549 aa, Homo sapiens
MLPRVGCPCCCLLPAACLLLASCCLLLHCLLLVAAEWLAGWRGRAAEVLVPACPAPCSSPECCLSALPCSVPSCHCVCCHATVLLGLGLHCLCTGNVQRLQLPIGAVMHLSLGEGPWWLAESLACSVVVACACDFAEGCRCGSLQCRFVANSLLLACWCPIGWLAGLSKYAPTPWVAFPGCALVPPFGRGCLGLGTVCAPAGGCHPFGYNGDCLALWCNLPWSGYFGASANGPSVEGAEGGFWREEARVKRPELEGSKDLQGKNRGKWPYGALGDGRSPSLVFGTHRLTPFRTASYYMGGLGAGWNVATAFGFGAPGEMAPLSKHVPGALTSTICGRPEGRLVGYPGLAREHRRSSLLSANGKPRGPSEVCVRNIGVFGRRDAIINPLLCGPFGNGECPQMKRVFARNAKPPRLVPRWHLSPVVPERGVETLASPKGCLLGRPWKSFPNPIFLPFSGAFHAGGPPFLLMSPYIKLPCWRISTLTWFDKSLWPLLRTLRRDCQGECTLRHGVTSCGWEWILLCDVSTRHTTCRSCKSGWRSRTTGDGDPE

SEQ ID NO: 960099 - protein, 139 aa, Homo sapiens
GRPTTLGPTTPRSNIMKIYFKSRFLLSPKQLLCRRTAALSRWCVPMPTIVLTTAEGLLTHRVSNPRIEERAGRVQCAERSVSHCTHVGPSSEETSFTQASTHWVAPRGDFSYPSTLASHSPYVSGFMIHLGYHLLLLRI

SEQ ID NO: 960100 - protein, 232 aa, Homo sapiens
MRVRGSGKKIAGPGHRRAGENREEVECAGARGGFRAVSASLVINEMREDIAFVDALSTGGLYLRNRSKLWEMDNMLIPDSKNAGGGLGGERPQPSSRPPGLTRTRGTARSKRCETGRGEGQGGLRRWQRMLVERGPADREERVVVSAVGGNQPMDSGQLVEIGLTPWRSRNQRAFGFLFGPVYALSHLTLRFVLWSVVDDLHMSLDCNVFCGTCFGWQVLSLPDLGLNVRLP

SEQ ID NO: 960101 - protein, 186 aa, Homo sapiens
AYADEAKKRSKPICEDFTFCLTSSRQGKIENTSIKRDTSVNPLYDETLRLRSQNSLLAPCSDRCHVSHIWQSVVVLAEYTFLGEAEIHDGFLECLIRNWIIASLYMERLSAEIPDVACHHTKASWLVSLKVHPSLQNLLLEADRKKSNGGEGGELHGVDHREAKNLTAAKAGGTSDSFVTGVPRFP

SEQ ID NO: 960102 - protein, 135 aa, Homo sapiens
MGPSAFLPREAQQTGIVVKCEDDFPKDDPSKSGHLTCLPESIQRVWAVTSHSLAGEVRLGPVYPKCRDKEGECRLVGPGVTILYDVAAYRMVRLCGNSLGTNSWHKPPYQMRPSRYPCANGTCAVVVVGDYLVDG

SEQ ID NO: 960103 - protein, 323 aa, Homo sapiens
MPALSSASLSESTKARCRRHNTCVDLETKKKKKKKKQNQTTNTTAQPPARDKAGGRAEHTTTQEPETRNEEARNDKHHRIYNRDSTPRSATTTQAHHHKHKQARSRNTQQTDSRKQRQDAQQLTAPSTAQRREENKRQREETGKRDPQGQAQSRANHRKQSDRRDRADRPSKTTPRQRDAKSEENRRKQARKGKATKADRRDNETTNETHQERRHIERKDTKKTNEGEARDRRKQTTAEKKNDTNRSSLENATEGELRRRDDDTEDSGCDDDREDAERDRERRQQSIRDKTEQRANQEITQTPERLVRKVQIEEREPEQRPEN

SEQ ID NO: 960104 - protein, 172 aa, Homo sapiens
MGVNSSRCLHDQVGAVEYVFSLRSSYDIGTRPILRIMSLLEKPGRHRQFMPTCPCTRIATVLHEAMSSREAKLIIAEGRTVITNRYYPPSHTVGTDREFNWNLRRLRQVEQSHPHRMLDLSLASCPAWMAALASTADSYSCDENGIKITRYESPPHSDEDHLPPLVRNRKTP

SEQ ID NO: 960105 - protein, 153 aa, Homo sapiens
MCVCREGPTVEAPTSTPTRLLRSGAWACPLRLVFLARRVEERRAPISFCEKCLRWGPRCVREWAWFPPGRGRCCGKTPLTPALVCSPCSGGPRDLFFLLPFFKAFVSRESLLQPSGGPPQCGSPQYRPRGFPRKGCKTPPNWCGGTEGGYLRP

SEQ ID NO: 960106 - protein, 118 aa, Homo sapiens
MMDCCELSAPACWDYIDAHHLILLVLNGARRDMLPPSLPGLQGSDAGTELGTTCLSTWGLLLIAALKGDFETLERMCLIQLGRRAEGMTRECCDKEVCGRNWSQGTPVVSKFENAQKS

SEQ ID NO: 960107 - protein, 92 aa, Homo sapiens
GLAMLRGPVAASFGSFSCCCSRALPEPRGCLQACGMWNLTDACGSVPVCSGLVLSMLPAVSSSCGWLCVPSSNAGTWTALHACHVCCALTDL

SEQ ID NO: 960108 - protein, 105 aa, Homo sapiens
LYTVSVTNLDGAFNVLLICMLMYMLCGSVSCCALRTTPLPFLAKPTCTPEFLRKFPAGKVPAFEGDDVILVCSESNAIAYYVSNDVSLRGEVRPRSAAGPSGAVG

SEQ ID NO: 960109 - protein, 70 aa, Homo sapiens
VRSRRSWYNTCVLRNGSITMLRSPVPAGALVAAGLSRGHRGLAHSPLTTLHTCLLTSKMLGCCMLQMCVL

SEQ ID NO: 960110 - protein, 108 aa, Homo sapiens
MARENLCELGQRTVQEAQSIDEIYKYDNEDMQQMKSWLAKPCDYSDHHYFKYLQNLSICALLKMCDALPDTGGNFGSDWVLMLGKVDGETMIIMDSICFWLWRALKTE

SEQ ID NO: 960111 - protein, 289 aa, Homo sapiens
DRAIAVRCGPAQCPWSPCCQYEGPTNASLLQAMWRNSSWLGTAKVSEFSCGSHPHEKATGLRPGAADGSRYVLSQHFWARPRPGWTHRVSRDVHMQSSPAPPKCVDNPPSAHSLTYHISISIISKTHNFNDKTLVDGVAKRLLPVSKGPRHMAWRVRCSRDCVHYITSRWKLPMAEVREESVQSGLCTSAYQFVRRDARISQAYRKPSMVLARCNVIWEATYAYRYRDKDTQEKRSAVTPKVERTDTESTRINEHRDVAPLHNQTCTGTEKRQGRYHGMRITTARGGST

SEQ ID NO: 960112 - protein, 214 aa, Homo sapiens
IDPASVTDKDTLTIHYLMLPRVREELIDKKTERAVSQMQSVIELEEVSQSTEKAIPIEVSLGKKLWLVQSSIQKGVLKDIKSVEEAVSLEELNVRKVTLSTDKNKYGIRLRAEPDHMVLGKRLEGSLLKAVMTSIKQLSSRGAGAVPEDWDHWLWKAMNGTDEDIRHMYTFDHGHRWDCAHLTAHSDAQAQGLLDVHSMTSQKVDDGNGRGRHT

SEQ ID NO: 960113 - protein, 219 aa, Homo sapiens
GRLESLGPGATLQERRDAAGLGCRAPGTVDREPAAMGWRAVRSELVLTGMLLAMAQQHEGWLQELVNTFFSFLRRKTDFFIGCEKKGGREAYHTDFHATTIMLAHEDPGREKEKPWHGGLSWREKAGAGLARLGQRNAKSETSGPQIKEQLDEECRGVLQTTRYDQKKDAENHEAQLKKVALTPQWKAGYMTEDEEEDEKDKGQLKPNLVQGTDLPITA

SEQ ID NO: 960114 - protein, 216 aa, Homo sapiens
MPYGDDPRALSCSHLEDSAHGAVALDAAGYHVEPDFSSLVSPLMPAEWMASPGFLLSVSLVLSAATDIFTVKTKKKAIMVRVHDPMPEGPKSEPTDEVNEVTIIKKCVGQVNPAPTSVDTKQRSDGHQQWRSLEFNLNTTLEIAATHTDAPNRADTRGSKVRVPHDPEAKSVQVKTTGDGKTRDRQHTKRTKRRAERHDRGKQRRTRSAQTKNHRT

SEQ ID NO: 960115 - protein, 44 aa, Homo sapiens
MNHLKKKYQGPDDEAVAKEPNIPGKNILIAPILGLSCYLTVNVA

SEQ ID NO: 960116 - protein, 133 aa, Homo sapiens
DSQGGKTEVNYTQLVDLHARYAECGCVILAFPCNQFGKQEPGSNEEIKEFAAGYNCQILICYSKICVNGDELPTLLMEVDEDPTQGQWASWEMPSMCEHYTKFLICQELAAVVKRYWTLEEPLVIEKDLTQYN

SEQ ID NO: 960117 - protein, 227 aa, Homo sapiens
SWGWEGGRWVALRPAAAPGSTWSAAPVEEEVDFMCFPVDWKNLAQNLLCLCMWCLMLVMCMLMACPERMCFLLLMTCAVAMDLQPCAAWARLMDARTRGRSSQALGRSRRDLRAAWGVWVAGPRLHKYGTEGGLWGWPQFRAKLDLRVLAVTSGLGSVLPLLSWFGSLNCIVAVSPEHGHRQERGTLPWPPSGNEFRYFQRMTTTSISRKVTRIWVIMGYEDLFLHS

SEQ ID NO: 960118 - protein, 211 aa, Homo sapiens
MLRRSTYLCRSQLEEEIAALVIDNGIRLCKAGFAGDDCSPETVFPSIVWAPQTPECVMDVAWAKKDSYCGLTDGTMMQAVHPDPVSTPYEHGIVTNWDRHGEDAGTTPIYNELRVAPEEPPDAADRGPPEPQGQQKKKMNSHNDRDHTTPPAMYRGPIQRPIAVPVLPPLGLQHNGIGHGLLETGVPQNVPIYEGYKLNHAHPCSDLGWRP

SEQ ID NO: 960119 - protein, 186 aa, Homo sapiens
MNGRNKFEGEVTKENLLDFIKRKQLPLVHEYNEQTDPKISGGEIKTHILLFYAQECVCDYDGQLSNFKTASRELQRAQILYHLHRQLTTPTNQRILEFYGLKKDRVPGRAPHTHLEEEMTKYKPEYGGADGREDQQSTATDFLEGKIKPTPDEPGAAGGLGTSRQYRMLARRRTQTDEDYRMRHTN

SEQ ID NO: 960120 - protein, 90 aa, Homo sapiens
MLPVLAPHVGCGYDELQTDGNPAACHSRLGRMMADSESQEDIIRNYCHGTIAQCLGTAWTCSIPPGLVNGPGPASSVNTSLVGGGPEQGP

SEQ ID NO: 960121 - protein, 124 aa, Homo sapiens
MYILICLLYTTTLIVPPSLHHACHSSLSLFLPLPQSNVTLSALSRLPSPLHSVPCTHFVLTTTYPSLSAFSLSVPPLRPFPLLPIWLRSLFLYRFLPAPYHLSQSLLPPCLLPLLLAFVLYPGP

SEQ ID NO: 960122 - protein, 147 aa, Homo sapiens
MARGGAIRRRWREEGACSLSQPSPAHALALDGMTAAWNLWLLNKYSRCWMCFCCMQDALCCRPASRVCVEFQCSGVTLMPMCCLPAWMPIAGMPCVAHDLPVKTAGPGWFQPLCPGLSRGPWQPHVGPLAICQWVRLRVLALRMNIA

SEQ ID NO: 960123 - protein, 168 aa, Homo sapiens
MKVVIPSISSETLQGSRTPVYMAIPHQSSNTPIDASWSDIHIYTNFAKHPHSFMVTESYDISYRHDGPIVDALSTITRGCQAGPQSGKRNIWTSAGRPIWNSTQLIFGYTERTTWVTTATPGQDRTDWLQRVAMDQNTHTNGHKTTENKGEQASHGTGSINPRQEHGD

SEQ ID NO: 960124 - protein, 172 aa, Homo sapiens
MHTMCRTVSPWGVTYEHSKTHTITNVDRPRTRVCDLAHPKDNNDCRGTTWMTMRVIYMSAILEKGGDMQQHSDCDFGVHHKVPSDLAVWVATTYRKFNLGVTNIMGSTTDTVGRLPPSYTATNCHVETHLADRFDSMGDGFHLYPESHTIFDSHQPIHISPPYLSTHMVGAN

SEQ ID NO: 960125 - protein, 118 aa, Homo sapiens
GACPLSVMNGCAVALIWVCRCARAMSLQPEVDACVAWSPDALMPDACDALMLMLAVDDLLPPAFCAPAACLLCHVPLAFVMCCDVACVIAYIASYIECLRVNSHDCDDYMVCVAKPLR

SEQ ID NO: 960126 - protein, 152 aa, Homo sapiens
MLHQQLQLLLSHAHVEPLLMRFRMVLGAIGTQWKLENPCCMIYHRYCNHLCTMCIQKRHISPLQHQHLIVVEHVAIPGLPINIHKLLWSASQADVSKPRFGVSWRGRSQSSMCMMWPHASKGYSHVSDLDLPQVANQAVPDHFATSRSSYGG

SEQ ID NO: 960127 - protein, 175 aa, Homo sapiens
MIKVFRGYKYFSSGKHKFLFTLAPWIQFYNTVGEPPVGHLVKRGVLVGHALLYSLGGVLDSHTLQALTHTYTKQESVTSLWRNLSEHIYVTRTVLVDIKSHNLSHTHNNMCARVIFNPNTQRKYEGVTCATHDEHNNKKRGHKHPPAHHTPTTPHFERYVVALCDEKRERATPES

SEQ ID NO: 960128 - protein, 130 aa, Homo sapiens
MKVDSTTKGVVSWIFSPQYKPEGEPPCVARGCQRGVAVCSDRSRVVAKHFECGNVEECVPELWALPVGLGLYQKLSVVESLRKRGLYEGHTQYRGCGVGEGKNYLFISKGVTLEHPCGKRGKILVGNIIQ

SEQ ID NO: 960129 - protein, 208 aa, Homo sapiens
LRLAPPGAAERRVMLLVVLAGGVPAGAPGGAGGKPGPSEGGGMLAVMQPMWLLVRHRCGFLLCGVGLCCAVMCGHATPVLRRPKGRKKNEKKNEGEREEKAETHARPTNEERRENENEKERERRSNTKKREKQATKKRKKKRKKKRKKNRTRKTGPGQARQKERERERRKKKQQKENGRSKRANKKRKNNKESQRRQKKEGERKKNKK

SEQ ID NO: 960130 - protein, 320 aa, Homo sapiens
QSIATPDSGVLRAHGSTWGPERRGEESSGHFLVCCHRYMWLVGMAVGHLIICAMIPNACVDASPNLPPTEKIRAHPTISTREEQYITQTNNEMTHREKERQKDKYHTQKNNENTHRHATPHTNRLDSDNDTRTAEHEEPTSNEGAASGSEGASRYRQTQRDEHSERQPGGATQPSGPQESGRELQTAGSKRTTNDETSTTPKGDDPDRTTCTPKQKANTHKKQQTKKTTPYQNHTGRNPITKDERLDTTNIDKKTEKKERKAQSIQTGGNHKTDNEQLNPGSHKPQGKQTRTTRLPKYQTRGHNKKEGREQKQKTETQHK

SEQ ID NO: 960131 - protein, 132 aa, Homo sapiens
RRSAVRVSLTGRKWKNEIDRRMDHMTTGLRHVQMLAFAGDLTLPETVFPYPSSGAPDTRAVMVWHGARMDSYSGDDGPEQCSGILTHECTPIDDGIVTNWDDMEEDLAPHLLATELRVDPEEQPVLLTDGPT

SEQ ID NO: 960132 - protein, 102 aa, Homo sapiens
TDRGTIPLLNNIPMDNLLLLIVPIHNRNGIPQAYRTKNSEAIYNIRKGPNVVGPIRAYYNPYRCRHKTSSPRSPVKTDTSTITLYITRPRPYSHLTDQHHIY

SEQ ID NO: 960133 - protein, 107 aa, Homo sapiens
WGSLTVILPQYHPRRGGRLGKALVGARSNRMGTGDRICTGKEAKEAQSKEATSKVTSCGSRRIASPFRTYPHSHHYSWQTHQLQRGHPTNLFRTSQLPQSRKNSAMW

SEQ ID NO: 960134 - protein, 206 aa, Homo sapiens
ARKHPPPGMVLKAFFPTCCVSAGQLGCWWDGGCRSMSSAVVLAGPALSLHPHPWSMQLLAQVRQAMPGGLWPCWAPGATAGRSPRRAWACSWEMPGVRVLHPIEPMASWLVPGMMMAGTVLGCCEATHLASCPLDPWLPLVEDQVMLIFYDQRQVLLVSSYNCHLSCHDLQAGATTDSTGGPGLPVFDTVARSEVLFLQYRFDEGP

SEQ ID NO: 960135 - protein, 69 aa, Homo sapiens
LGPHPARWDSPAYPYYVHPLRLAVDNGVEGICGAWCAPAYVPPAVHWCCCAVLCCPNLKVLVTVGDVWP

SEQ ID NO: 960136 - protein, 118 aa, Homo sapiens
GHHQACSPDYARTQFLSPTHERIPTRGERGKSLLRAQRSDEAKVLLWVLMEIGLPAVLPHSLKCPYCHWTPDQPGCLLRIHAYSPRDCYESSMAPSGLVDWRVCVRLIDFAAMCCLKG

SEQ ID NO: 960137 - protein, 194 aa, Homo sapiens
ETRPRRRRQQLQHHLHPPAMEDEEEEEEEEEEDEDEDLEELDGAWRWNALPPVACPAGPMCPPAPCLPGAPSDGLLEMTSVPAWLPRVDPLPGLLPAVAPGGWQPSCGALSPGVCLTVPCAIPAVVLPQSPPSPRITRRTTDASGPGLPHKQHNEDKKKQQKQKREGTKENKKQINYNHTRHTLTTPPHTKQLT

SEQ ID NO: 960138 - protein, 104 aa, Homo sapiens
CCRGLAAGEAQILSGGSATVTGPLPQQDPGTPRQAQGWGGWAQRPSTQHILSHVHIVTIPYPHYRFCIGEIVFPDCSGHRPTIYEPRTPDSVMDIASTIDLSIL

SEQ ID NO: 960139 - protein, 70 aa, Homo sapiens
GLQGSHRCSVQRGSVSCVLSAPPHFHFCAKPTCTPEFLRKFPAWQWSHAFDVCDDCDSCSVLMMPTAYLP

SEQ ID NO: 960140 - protein, 171 aa, Homo sapiens
FPLFLDHPYLHRVSFITCCLLEPFLSAPMLGDGEWILAAGMDSLCDLDGAGKCLKSPRVRCACQVMLCQLASVESGDMSGVLCPASPHVVKTEAYVCYACSLTHTTHHVFNDPFYLGDDKQSNCGLAILSKLLLPMSWPVAPVLWPCPCPHVHVNLGLDCFPVPRNSSSLY

SEQ ID NO: 960141 - protein, 70 aa, Homo sapiens
EIGLGAFDAGLLWALAFSAADQWCLLFVVVDDFQCSSMLSVWDCSRRNMNLAEIRELQMTQSWAVGFNPR

SEQ ID NO: 960142 - protein, 108 aa, Homo sapiens
MARGPTVMHSALLGGTEHGWCVITCPVSLFERLAHIEPILAMVWAISLPLPYLVLPGGVPSAQEDSITPGRAPQAFSLWPLTFWLQVTVRQNISEDKKMITKQNRNLS

SEQ ID NO: 960143 - protein, 220 aa, Homo sapiens
MRGVTQYRLGLANQIQRTSANLHVRRYTAKASTSYRDSNSNNRNNATTGGTTPAKQKTQSYTENMTQTTENSETHESTTSQTTHRTDEHKHHESKATEKTERGIARTTEDTTHSNLANELAPQEKNARKHVSSRHNVAAHSTEPYKKSTTSKKQQAHKRSNQPEHKTQPTLNSQPKYTKSIDTGNQHTSPRQYKRQQAQPDTSRTQQEKSSHSCDETTYT

SEQ ID NO: 960144 - protein, 105 aa, Homo sapiens
GVRRYVGVNYVSDDASGGVCKTRVAEESYYALYMWVISFKNSISFYLLDCLFSTNFKARHYMCLVLPYQLWGWGVHSYRLLCAPVAILGCHPPLSRLWRGVIKVD

SEQ ID NO: 960145 - protein, 107 aa, Homo sapiens
MLHQCSMCILFAIWWTTIVPLSVSWVLMLLQCEVATCHPVVCHHPVPSSPSVPRAAEATWWDTMTLAMPHTCPYARVTCACCCGLCLVRPHPLHPVVHWHRSPAPCA

SEQ ID NO: 960146 - protein, 70 aa, Homo sapiens
MANGAFLHPFPSPRTEHSARDTLCFNGKLTPPGRLHIDRVGAANHRADSSGWPCRLPGFAMGRLFVGTRG

SEQ ID NO: 960147 - protein, 215 aa, Homo sapiens
YNFKWIKTKLLKPQFLGKTTGSGLSGYLSSNLDLGPPVRAMRFKSRTPREDISLCDDSFGSKGISPQKSPVWAFRVMCSYTTFTKDFYSWTPLWRDLLLCPCVQLSTCAGGSGLQFTAHQEHVAVRARLVRGAITQGVLSPMNETCGVPEISVHSRVTERPLFPRFSWNLAHFGRANPPRGGRAEADGGGGGLWNAQEESLSARAALETEGLRFL

SEQ ID NO: 960148 - protein, 249 aa, Homo sapiens
VTPPCPALHLHRNPHGTVETGVDCGNRGDCGGQGKQAAGHGTGSGRLNGKQRRPRGQPRVDWAHSRSRGGPAGSFHPVPCQMSPGQPDLRHIGHRTGSKRWPRGCMWPPSHILSSQRGHLAMAAADTSWDPGVHPVTITPALWVPSGDASRKGCHKVRRELTFLWKKLVIPLSPATRLKPFTSSVDGQRDSPPYDDRVQWLTPVLQRRLWDELVSIDQFRDPAEDSAKVLHHQRTPACLPLVDPLSRAR

SEQ ID NO: 960149 - protein, 113 aa, Homo sapiens
MAMAFLSAYRTKNSRLYTSTQRPNVEAPTGYYNLRWGHKIFTKEPLEPVTSTITLYESRPELSSSPSLFYYEPPLRRTDPWSTRARPPICSEPPLAKPFTQSSDEGEHSNLKN

SEQ ID NO: 960150 - protein, 128 aa, Homo sapiens
LWLLVAVAGLGLAVFALLDVCTWCAFRAPCCARACCSLRVCDLLAEQRFPGRCCPRTCDLLLHMNNCAATCCEADFAAASAHLTLLRGARGAEGVAGAHGCLAGLVALRPPPVRLRLAGGPSRVAAPA

SEQ ID NO: 960151 - protein, 96 aa, Homo sapiens
METDDEEPDSATGKRCSLTTDEEDDVDTKKQKTCRGMTSTGNMKETVKLRIQKGRRSPIHPSTSRSQNLKVVTFDYERSAVPPWAVPTADDRGHHN

SEQ ID NO: 960152 - protein, 268 aa, Homo sapiens
WKKQVLKWYGVSQGNEGPSPGPNKIISQRLHERRGLGGGCAASREASSRGPWCGRARGSLQLVVRGPPGVCVLRAPHRSRAPAPPRSGRTRFHSLPPEVGECIVPATEWGSVTPEDLAGCVARCCTARCVYTCVRIPLGGRRASLVLWADPWGGAYWSLRNGGLSLFLCWPPPFRWVCWPLPHCWGGGLLHACGPSPERHTMSPAGRLWAPESSGATPLSVVTPAVFPPKTRGGFVWPDMLEGGPSGETVPREPSAGRDAQLSPGPVD

SEQ ID NO: 960153 - protein, 171 aa, Homo sapiens
MTSVEWLQSVVPVAPDCPECASVRTQAGSATHQARATPAWWSSVGSVCRNVGIVPRGRASVVTSYKGPENSGRQKSSIHILPRGVPWGRPRVDIRRAGSQNQEKRLAKGGENWGPGRTKHRGNSVAEGENPTIFYIGSQGVWPRDQALNRRWARAGIRKWQPKEGWGNSTA

SEQ ID NO: 960154 - protein, 246 aa, Homo sapiens
PGPRWTLRELLVLDVPINGPPCVEYVKPCVQWDENGAMPGEAGEPGPSWDEWRAPRGPKGERGENGLQSVPFSVLPGPPCDPNGPPGDDGPKGSSWSQWVFLEILVPPGEPGPAGQDGPPGDNEEMMVNPWQTRIPRLLLVNHGPSGPPWKKGSPMCPVDVPLMCRQWDEEEGPWVEAGLGSALLGGLGPIGPPGVPLGKARTGWAFDGDPGPVGDNGLAGSQARMVPLGHGPQDFRPQEICPMSE

SEQ ID NO: 960155 - protein, 403 aa, Homo sapiens
QNGPAPAPQASAQSQRPSGTSIRSFEDQRRGDELPTKDRQHRPLDLGRCHLFGSRYLAVSARKRPRRPVAAVWQSRGKGCSEAHPRSGVVTPRRDPIAAANAGPSVMDDPALCRSEGSRHTGQGGLTFPCAMTPPDVTDGGMSGPARVRPPCTPRLPRPPASLDCTEVHVATRLSGACVAGQGRGLSTAGGVEEERKREVRGENTPVHKREHTRAQRDGNPPGGRNGQDGRTPLCIALGEASINEITEQRGPRDGGARVGVGGRSGAAGDLGRCVAAGAQCQGVARMGRWPGYRMPGPWGSQWAGRALLYGLGRPSEGSSTGRGVVAAGPRRQSRGAGVSLCLWPGGWHCWGFECQPPFARCPVFSCGIVVFPSWRHLPGYLGCGPRLCPRQVGSTPHPRCLH

SEQ ID NO: 960156 - protein, 103 aa, Homo sapiens
MARWGATSRGIIPVAISLSDVEPGVHTTVIRRIWSGSVPLRVVSSLVPRSVGPLLPFQEAFLFHRTLCDCLTSPLFHRGCYGPHHQCWSLILPTWIYSLWAPG

SEQ ID NO: 960157 - protein, 86 aa, Homo sapiens
MRGGRRRGLLRVYTGFHFPFSSLLSPRFGGKLSQEPVAKPSRQVVIPRGVTWYRAESVPRHEFVGSQHDEKLSNREKRSHRKTEDY

SEQ ID NO: 960158 - protein, 172 aa, Homo sapiens
MAKVLTPRACYAELSAKSTPSGFTLDDVIQTGVDNPGHPYIMTVGCVAGQTRSPTEVFKDLFDPIIEDRRRRIQSPDDDHKSELKPEQHCKGRETDHGTQLRAELAGAHGPRRNPMEFLPPPRQMKDRGRGAETIDECSIDRMPYTGRTDKLGEAEYYRCTQSMTSRSSKRT

SEQ ID NO: 960159 - protein, 68 aa, Homo sapiens
MRMDGQHGRAMDRRENWSKKDAIAGNDGGAAGDNRGRTGTGAIRQTETHDEIRPPVNWPERNVRMQKQ

SEQ ID NO: 960160 - protein, 120 aa, Homo sapiens
MLGFDYVRALLGHQRQCSSVCLLRAPPNVPGYSMLLACAQLSWPARARRPRRTACLDTSSAAAADPYETPRQRGAREPGLRSRLETQRKIRAPKVSGGRVWREKKDPGGGPTHTMGPATV

SEQ ID NO: 960161 - protein, 147 aa, Homo sapiens
MGCGGGSHRPEIHLALLLGAQRMGRQKGGGVSNPPALRKNGGSSHFTPPFLPGPQDGATSGCGAVGPQMVLTLENVRTTNKIPIKLKLLVSQKKKQKKTPPRAPDKFLTHRATGGGRQLHLCAPTGARRANRSRTEEERRAGRARAR

SEQ ID NO: 960162 - protein, 78 aa, Homo sapiens
PGWEKRMSRSSGRVYYFNHITYRQPVGAAQRQQQTVCVPKTGAVVEPAMGPALLCYLAFFFGGGGPFCKQKVCPPKYP

SEQ ID NO: 960163 - protein, 254 aa, Homo sapiens
PLCAMAVQPQWTELLCSICLSIYQLTLVSLGCEHYFCRRCITGALGAVQDVLHGLPCCLPLSAWRTVLPEPCAGCPASMLANICGCATCSFPAGLPSSTLLPAPLRPCQAHDKVKLFCLTDRALLCFFLLLSLHCTEQHQVTGIDDCLLTELQRELKDQLQALQDSELGTTEALQLLKADNWRRPSLPPRACGPLSGEAFERMHRLLRERQKAMLEELEADTAATLTESSRKSALQPAVRRSWGSQICKNGGEQ

SEQ ID NO: 960164 - protein, 113 aa, Homo sapiens
MSVLGAKPAAAGLLGADDERCWLNADGCRTLKNRGYAQACRSKRLAACCAAVCCDGLMLLPCLGLPSWTAACCGPMGVPCLCPVELRSLQGSAVTWANPRAAPWSGDPSHLFL

SEQ ID NO: 960165 - protein, 67 aa, Homo sapiens
SSAELGSGEPGECEGLVCPECLSPLLCARRNEEDEPPLHLGVNPLVRTRALAAGPPAGMMWLCMHQH

SEQ ID NO: 960166 - protein, 209 aa, Homo sapiens
PLRRRCFSAGRNGMKRSAALVIDNVLRACAKLVFAWGRLLPEPCFLPSSCAAPDTMGVMVWHWCQKDSYCGATDGPEQCCGILTLKYPIDAWHRHQLGTDMDEDLGTTPSTTELLLWPREEHPVLLTEAPLNPKANREKMTQIMFETFNIPGHVLWPSRAVLVPTYASVGAHLDIGHWTLGDGVTHTVPIYEGYAPPHAIMRLDLDGRD

SEQ ID NO: 960167 - protein, 235 aa, Homo sapiens
LWARVSGEHERGGFIGAGQLAFALCQGASQQQASLVAHNDKWLAPQTWTCATVSALRNAWCGEVDTPQEGDWCSTVDVLFLAVKAHTSSPYILDEIGADIEDRHIVVSCAGLASPSCSIEKKLVSCLRLRRPMGHPLHDQQLQIVVREGATVYATGTHAPGGRIGRLMEQLMSSVVFCTEGVSRTDRMASRGLSGSGRLRIQSLDSLADGGVNGTPRRWKSARAMPHGVQDVWTR

SEQ ID NO: 960168 - protein, 205 aa, Homo sapiens
MATEDPQSCHGLGLPVMAGWGYGSDKRLVKAWGAAPSPQWVAVTGDEHNQLLLEEHQARAWQGAMWRMARLAGEHCQCGNGVREWACLVALVCAWGTLAMPAVLDVGCGADVLCFWAQCVVHFPMCATVWVAHVLCCGLVKVVCCDVGHAIDRWQQESPHPHPHPPPYPHFTLPLLSPTRCEFSGWADALLNLVARVPSNLGGSF

SEQ ID NO: 960169 - protein, 190 aa, Homo sapiens
MRGINLWCPPCVALHTCYMCGDLHMCGEVYLVMSSAPCVERGVTRSLYSACVLSVCSAREGVWGSLCGSREVLRPTQKRGNILIVWAGGVWGDSFIERTTAGGGGVCVCKRYHRVCGAIIHITFIRALSQRRGLFSRDSLARGVLQVPRGPLYPRGARRVLQISLQPWGRLTNVYRQTTCGVVNPLCWVG

SEQ ID NO: 960170 - protein, 142 aa, Homo sapiens
TQVCRATTDGDGEPDVQRSCGLRMLSQTQVPPDYPRFVESVDEYQFVERHVTRDINRIPGSPQSMNIILPHSELEDHHQKNHQQTKTWTLLYDTEQLIEMQQKSPIIQRNNHSMRKPEDDCEIRESGKETSGTLQKDSEKIY

SEQ ID NO: 960171 - protein, 41 aa, Homo sapiens
MVSRLPVSKDEPDTLTLRSGPSPTERLGMESRGASRTNNYE

SEQ ID NO: 960172 - protein, 172 aa, Homo sapiens
MRELGELSLLATAAAFVLPTVCRANVLCRHSSGECTLAGAAAGCNSYKLAVDSGGWAWVSEALVVVSAFISFFSGVIIRPLCATDTDRVLSRPCAYSTGVMVPSVSDPRIEVHVRQLMAFSLLMSDCTDVLTRAGHAEVLVSCSARGSAQICACFWSRASMRVPRNVKAKLA

SEQ ID NO: 960173 - protein, 55 aa, Homo sapiens
MVARGGMARFLWPLEARVNPTVGGVPMSLKEMVSKLKKPRGNILLDKGWQAVDVQ

SEQ ID NO: 960174 - protein, 110 aa, Homo sapiens
MQKAGFDLGWPAAFSGTQGCPSPCAQPTQVRAGLGAYAVAVFTPAGIVRSLEMSSHSTPPTSAIWSGQYTGSSAAPRRLDPSPLYPAAFKMALLLHRNILHAGVGTWGGP

SEQ ID NO: 960175 - protein, 279 aa, Homo sapiens
SLQLPCRHAIAPSLEWHCLECPTSTMDWHAGCCGHVCSTMPGPVMILQTVMCPVQCQWLRLHLPLLPLLSVVPILCPSVLLPHWFWYHTECVLLPVPAVRSMPGCDAHVVCLAIHEESVCRGTQSVHYVVVIPEDVRDSNVHWEVPACANCCMLCLERMYLFQTHPHSPWKPSGPQMKWRHVLAEELKLGHPADRPVIALSWNVYKKGELLESSLMDADRLSAAFASLRIARSTPGSSGLRAKRATGCREQVVCTETKSLLGLESAGSSGSPVVFSWDQ

SEQ ID NO: 960176 - protein, 211 aa, Homo sapiens
MYQQRCEDDLLADPLTSLAEAAGLLDLWPAHLSLLAPRLCTMSSYTGTAHWLPQLSSPPPWAGPRSPWTIKQQIDIVSCSGCGEVRPRPLLSAMYLCDLPRTLLRWGWPYSGITLKVKGPSISSRVSGFGHPLRDSLRAETVVLPLGSDLRMPFIVGDTQTKQQYCSVLICLRTWGPAAFPRGMPKRPFCPALSLPGLPASVPVNVPSPRS

SEQ ID NO: 960177 - protein, 154 aa, Homo sapiens
RRRVRSRPPSAAGSQAAPRLELPFTKHLTTHIDTVRVRPAVSDSVCRLHLHTVASSCAERAGSSGGPAVPTRAYGGIINDGPLRVRHHLSEAQPRWWAVLLSGTIKPSANTSCLANLARRDSRHTNLMQRHTPDEPLETYPGIEQYRFESTRLT

SEQ ID NO: 960178 - protein, 64 aa, Homo sapiens
MGLQPGDKYRGDVFILADRAPTAPRTGPPCSDGRLCQCPVSVCGDQYWLPLPELCVDAVEMICS

SEQ ID NO: 960179 - protein, 104 aa, Homo sapiens
SPLGILQDAVRRVLRRVRALPRRRPEWLSRNASEFSLSLLHGDFHASNYSSSKRYLVTAGDVPSILLEVAYLLERDTSVWILKKGAAVSYKDIGDGIAARYSGA

SEQ ID NO: 960180 - protein, 256 aa, Homo sapiens
GSRVAEPWADAPSPEEKLHRITRNLQEVLGEEKLNGDTEGAGDLEIYVGELATTGNTTCGLLCAQCREIADFLKEGVRYTNSVCVTSTHILDNDEMPLWELQNSESAYYEQCDQWQMLVERRVCPWRSSEFSLKAADYQLSRRVHTRCVQTLLRGHTARIPRMAGAEVVEQVEHPLLSGSLYPGGAGLGLKESLTRRCPFWRRDQQKDFHLCEEYSCLGYSNGPLVNHGSGYRGRALRGPVAWPRGCPEVGPWEGG

SEQ ID NO: 960181 - protein, 252 aa, Homo sapiens
MELVVHEAGVTPTLAFPEESLTQLAAGHVFGVWVWHSPCCACEFGSLETVATRACALTCAAPVGCGGPVLAFTNVVICGDTPGVLYRGHILKFSAPENLGDTLGPQGRRKAQFNSESAYKSAETENTIVMWTSGDTPPEGPFSENLCGRVAHRGEHEREPSPKGPSQKEGVVGRDAMHNRVHSPRKESVRETAVVETPCACGDEDAEGLCGPQKCGLSVSPWGKISRCGKTKAPSLVWCLPSVLVRFPPQNI

SEQ ID NO: 960182 - protein, 267 aa, Homo sapiens
QRRFFIPLRARRSCATPWMRCPRRLPQGTIKHEPVHMMWWMGRAATGQKFSLCILTPEKEHFIRCGDQGDLSDVVAWMMLMVYPRYHTSQQSERRRRKVEALSHTHGSPGDLSLDGWHVHHAVGQTAAAGSSIPSAEKVPTHQDPALWSVKQERGAAHGSGRREGRVLRPCELVLRFLSHPAGPGSGAWWAAWGLSDSHWAPAALLRSFGEAVCGILPGGGRSAESASGCRFHDGPGLMIDLGLVLAAQGALGASASARGLTGSGAL

SEQ ID NO: 960183 - protein, 237 aa, Homo sapiens
MVGVRRPAGVRWRSGWDVRGRGCLAVGIPDDVHTSRERAGGIGRALHMVLPLAPRGVLLGRTSCFLSGRAGMLEGLDQMLTGAGAALQHFVAGVASQLWDSAHRVRGCPCTLSMDASLLTCEWTPGPMRCSFSPWTGAPPRALPAVACWTAHLLEWLNEWQKAPAVSWPRSSSGLKRPPCYAGTLNNVVCDLVRRLRRQRGRGYGAALPWFGTWRVESYKFGLEGIAAVLLGSRLGC

SEQ ID NO: 960184 - protein, 168 aa, Homo sapiens
ILLMSDSVSKEQTPWDAIKLICEAMRTKPYVLLCSSPTKGQDFAQWSLGNGMPSHKVIGGDYLVCLTPYGLPRPLPWSVLALLRWQSFQEGTMLYRLGVSTVGASGCPYVILCWWDRTQQIPSSWGMLCTGRHSCPEDWGRFAPRGRGVWCALTESSFWYCVNVSDWQ

SEQ ID NO: 960185 - protein, 145 aa, Homo sapiens
AAAWSGWSHGSGACGSSETPRGPSAACSALPPGHVAAPGALVGPRDLLCLCHVPPPASWALSALGLQGCPSGASCLCSHLLQMCFCPCDGVLSRAVLAGQWNIAHVLVDMWPWPAHALDALPARPCVPPSFGPDPDEPVWTVAHV

SEQ ID NO: 960186 - protein, 246 aa, Homo sapiens
MCPPCWGGCKTPIFPIKGDGTQAVLPIFYEETKNILQPYYFSHTSSLIYERPAHNTPAVGPPIFLKGKKAPNVLLSPTPHEVRGKTPGECSSSCGVTPACCSPTAGHNYNAGGVGPKVCPLKASQTLITPQNTTSPRPSVGRHSTNGGHLQATKQRRHRRQPHGLGAPSRAWSPERPPGSSREKTRRPPKGSGTHPGNLFPPFREGPPGATLGDRRPTETALPQTRAHTRGAGQKPPPQRKPTPWP

SEQ ID NO: 960187 - protein, 118 aa, Homo sapiens
MVSCSVRSVPAARRPGLPVPPSRPRAWGCVRRLRLGMGVLVQGEMGALSCVGILRFLLACPVLAAFEMPLDSAFLSIFTSMLCSHSLLSPVVTLFHHLTCPSRPVRRPSCVVTCSLVP

SEQ ID NO: 960188 - protein, 265 aa, Homo sapiens
MRDSSEIQKRRDHTAVFQTGRWEGLDHEEEALSSGRCARGRSHVDEPQESSGGLPDLCTVIIVNTPSLLPQDMMSYIGPKRTAGGAGGECTGRSCNIIGRRYVQVVQADVFDLMDVLACVLLADELPEDKVDAREKRRLVKSRAWARRSSRSVDSRPDPKVPMSVYVGACEGPVRRSVAAFAECLGAVGQASSGGLSEYVNEARVRVKSPNGVRYTSAYKLENAQGIPQVYTHQGGRGGHKVRTGTVYKLTKGDVRTSRVTTEGN

SEQ ID NO: 960189 - protein, 191 aa, Homo sapiens
MSWEGKWTRITSEEDDEEPIPESSELDTSENFREKKEDTRKVLEWDPLETELGVKTLDCQKTTYPFEEFINEPLNEVLDLVQIIFQSRNREQSLYDMSLYMMLSKAVILADRLSDEILSTGSHGRVIHLEPQYWPLKMAAGKILETALKTFGCGTGGGPNPGGTPKGHNTRGTKGTRGGKAPEDPKEAKNT

SEQ ID NO: 960190 - protein, 205 aa, Homo sapiens
MGLLVPATIRGCRAKREHPVEQRGEYEKPPPQDYFSTSILGVPHHTRKHLGRKIEVSKKARRVHPRGATRSYIYYYEMTIMRQIIIFINKGDGVHLTWCPPRHFSIMWVGFQTQGDACDVTKLSRSLRLRPSGGKGGSPPRGGQKADDSFDKEGGVHQRGAYSPLCWFGYSNGEGQEQLGSPRVLPLAKQGVFYIVVVSAPSETR

SEQ ID NO: 960191 - protein, 161 aa, Homo sapiens
RLLVGSCANNAFAFGPELRSLITPLAIQTHNFAAVAAAAYYRQLSSSSSNAGPWLPPVAAAGAAQRDPPRRGRLYLPRRPFSFPACQRRLSDVGRVRTRRPGPLDSACQDRRQAYRRAASLSSGRLRRLLMSPSLGSLAAALPILQPASSILRGLRPRGRQ

SEQ ID NO: 960192 - protein, 102 aa, Homo sapiens
MQTRGGRRKNNTLYYSTVEESTDAPNRGKEGGRVDTHKRGSEGPEDYVGRAPKKKMSPVSSRNQQHTQSDSRVVGDKETIHNRREREAIHSTLTMQEEESPP

SEQ ID NO: 960193 - protein, 563 aa, Homo sapiens
FGRLIPSPQEGLIFSFQLSGPSGFLGSFGPYMPERSRGVGQRAITEELGEGLVKFLSSSLQVENSEALFYSFFIEALSRGERGLVKRGSAVHSFVGVCHRYYRYSLPTQKVGYLPFSVSGPRERSILVGETEEDIEYLRDSRDKSPSSQTRDSSNTDESAPCAMGETLSRVRQPVCNPRALTLVGISLQQENYCAPTTRGRPQWRHHLISSCGVGGIFGAPAVRQPSRGGDVVSSHHKRGLSDIRPSVGRPVAARARKHHNTRCVGVFTPPRNTPVVRWAAIGVTPTRRIYVRRPLGVMVGAGIPPENTRQYVATSPRSCAHSIFAPPVSYGPRLLVGSALFVAVLMGPPSSFHSLPLEQEVHSPFCQQGGAPPGRLLVCCFSRVPPKRVFCVGPPTRSVPPELFASSYSRPPLLLVSRANNESGARRAALLSPETRNLTVSVSRQMYSPVSGSVLAPPQKCALRAIIIHSPRGVSPPRGSRRRRFGPHPRQSVGRSSLLVRTAVGTRHSIHINARILLTHDEGRRQSSFILSANAPSSVGVHVLGVDHITRCHVLSSSLVCV

SEQ ID NO: 960194 - protein, 158 aa, Homo sapiens
MREWTMATEEEILDNIGEDLCRGFRNRTCRASCKEIVDSYHPCQSVDIIKGEMSRPGEVCSAVKLCEYLHEAPSRAESPEAAVSPSKIPRAEHDRGGGPFMANIPLLLYLKKAPKQGPQPKGINGGRLAVPASALVTGIPTAGTDHSALVQALWCTVR

SEQ ID NO: 960195 - protein, 123 aa, Homo sapiens
MKGLCGNTRCVVRKLRSFITFRKEKPVVGFTPHMVGSGGNYPWGVENISYTYNMWEHAERRKHTSPLGNNYLRGGHPPTKKEAGVAPRKKTPLQGGAPEGGKKFHKIQAGGQKTHDEKTTRSG

SEQ ID NO: 960196 - protein, 125 aa, Homo sapiens
MPPSFWCLGLFYILRCYRRQMLEIYNETFWMYLYPRFSSLHLLQNVNGMRYPMENVPLHICGGEVMWSKKLFPGVGTQQSILSTGGRKQNSLGDFPTYLPLCGALSTEIYSPQHKHLWLMHPRIF

SEQ ID NO: 960197 - protein, 268 aa, Homo sapiens
KTHRVFIGSNTQRAGKIRPPGRGAKSRSGGSREGYPRGGGPPSRPTLRNIISPYSVQALANRGHRLARGGVGKRPDTTRAPAGSSVRSWSSSRGSTLGARNTDTWRESLRLTGREENVAPAGGEAWVGPGVIRSFRSPGPPSPRRCQPAPGAGQGGAGNPQCYLPEDPGGDEQTLPGKRALQGVKPARPPAGVFMARSHGRGGGSPCGRHKESCPVQNPDPRFRGVPARETVPTGGGAQYALTVGDRGWNGNSQSGKRVVTAMGPPQE

SEQ ID NO: 960198 - protein, 204 aa, Homo sapiens
MGEMEQLRQVSGVSSRMQIAMMPGKGLCKTCTPGQYVVDVWPRGGGHAVQSADAADVKGTPGQAFTPLQIGPTDSTLLVSASREDGDSCLRVVHHASTHSSEVRADPICAPPGSSDLCLCPISGTSVACGGLDDMCSIYLYSREGKCHVSRELFLLTQVSLSCVSFLDAPTIVTDLGGHRVCLRGPRSGRETGPGDPGAWLTRR

SEQ ID NO: 960199 - protein, 148 aa, Homo sapiens
MPCPGGVNLKECVVALLPRPVLPPSLGCVTVLWLTFRCLLQPRVSFLAGLSVSWVEKINILSGDETVKTLVDMWTLLGNDCPEQDSAPPDCSWRQKCASYVLALSALELQCLTHTWWPWAVPLPTDPTGVLDPRLLVGCAVAVLAVHW

SEQ ID NO: 960200 - protein, 131 aa, Homo sapiens
MSWRCTMVDSAGTLSSWFNLKGTRNSCACGKPLGGLSRITVRATGPGESPRFGLADIHKRHRDPGESKGLEGERETKNPEVPRVKTICARGATVTQIPQAVSAKEDTHNDTGGDKWRDAQDEKTIFIRTMV

SEQ ID NO: 960201 - protein, 170 aa, Homo sapiens
VNGLYGSLGEPTQALVRPSGALGNFSLEHGGLARCPESMYRELRPGSPYRVSPTVLRPRPSACMSRKQAMGELLPWRDPFIMDLCSSAVSRVFLGVGRGPSSQNHGTPTSRLISVMVRRGDPEFYPVASTVKALEAVEAVWEIAKSDQADARIAPRVPSLVWTDGVRPEL

SEQ ID NO: 960202 - protein, 67 aa, Homo sapiens
WCLALPALSVTMEINAGLPAARRCCYHPVTMNNGCPVRRVRMFKDDLLQCLLTVAQLPAGNAADASS

SEQ ID NO: 960203 - protein, 162 aa, Homo sapiens
YTYPEQLEGFTALIAAQYSGAQVRVLSAPPHFHLGQTNRTPEFLREILLSGNGPSDLRVMMDICVFESYAELPYYVSNEELLGKFSRGSSPGGASRVSFADAGYSAPSASTLGVPRPLGIMQHNETGHLRNARGGSEGEFWGCWMLTLKYEDFAGGRTSDIG

SEQ ID NO: 960204 - protein, 229 aa, Homo sapiens
KVSDSGGFQSAPLRVSGGRPRTQTVHQACSLSDSTTGYCAGLRSRRCSGLSRAQGHAGAKALDSGQEMGSGLTQLVPAGRQSRSSGLHLGLGLTVAGLLGPREATPSAPAHAWWHGALLANWQHVHDWETRQSPGAWKAALLPGNVWLLGVLGQLHSGVGPPSGHQLIDTTQGRLCGGQVTTLGAMAIDIHLMASWAIGPEPPRQCVADYDRRLTPSRHLNLGRKLRKT

SEQ ID NO: 960205 - protein, 216 aa, Homo sapiens
MAPRVAETCGGLFVKKNIQGPPHNLGVGWGGHCGSCLQAQEEYQNVSNSMFGARVPEHLSRDGEGSKENPRGWGGSLFGQSGVSSGYWPYPSGWGMPPSPYAGFGVGRCAQLETPQGARCVGVCQLLPGRVGPQSGLTMGLGALPRGIFGRALAPPQVFFLARGLHAGPLALPSVARLSPMPSHGWTPGASPYQRADLEGVDKPHWPLRGNTGARR

SEQ ID NO: 960206 - protein, 157 aa, Homo sapiens
MAIVYSGSIRVWGCSTKCGSLTLRSREADRVEGRRESSGGLLRPGNKTQEEKPRMHGVVTKLLSTFRWVPQATLALPSPGEGLFPRLLYAERPKLVPIGQTGTGVLEGFPSVQHAGVKLKRLTPRIPIIVNPAWEPPIVPQMWPETNSEPQARKPER

SEQ ID NO: 960207 - protein, 181 aa, Homo sapiens
KQARYEAWVAGIYAYGLETPSGIQQRGHSTWYSKGYDVMAQARSGTGKTGTLPYQILQQMELDLKATQAWVLSEPTRELGSAAYQKVVTVHIGGLLVVRLLFTPVIGGDQTCVLRCGNVQMEAPHIIVGTPGACVGYAWIGDTCAPKTTSNDVLYMDEADEMLSRGFGDADLMTYSKSSRA

SEQ ID NO: 960208 - protein, 248 aa, Homo sapiens
MALTQIIGVCGPDAGDVSQVACPIQVNLHGPGALELAKSESEEAEQVAGGNRGSQFEAMASFPSSTSDSSRNRVWAPSCKHWWLQALMISDAWGLSRSLPWEPLPLQVLLFFFLLGEAPGQSRAGRGGGSGGASPGYGGGPGGEGALSGIVEGRGEAWARAGRPGTQAGPVHAIVPEAMAGRTIVPQPSEAGGSALVRLSEANTTVALVAPPGSSGEAPTGVAGGFGPLSPGSARLRGGEHRHFSGAP

SEQ ID NO: 960209 - protein, 175 aa, Homo sapiens
PHIALKLLLLNIDAKILNKILANRIQQHIKKLIHHDQVGFNPGMQGWFNISKSINVIHHISRTNDKNHMIISIDTEKNFDKIQQPFTLKTLNKLGIDGTYLKIIRAVYDKPTASIILNGQKLETFPLKTGKTGMPSLTTPIQHSDESSGQGNQAREINKGYSSRKRGSQIVPVCR

SEQ ID NO: 960210 - protein, 261 aa, Homo sapiens
MPPPIDILSGFPTAAYPPKLRSKSKLSSLQHTGLTTKGMSHFLHFSLSALLQQRNSRLYCFQQGSLTSALPPLYDTLFSLSLLPSATSTHAAPLSTHARVLHTPRTSLCAHTHPLLLHATATHLYAPGCTRTHTLTLALTHATSNPLHSTPLAYTSTTASYLSLPTPPLCTRTPSTRAPFTPWAPLPLPAACPPLAYSLSYPSFLTSSPPSLSDPSLTTPSSPRSPRPRHAPPPTAPNPASPPHLPPHSASPPSPSPWPPA

SEQ ID NO: 960211 - protein, 36 aa, Homo sapiens
MFANAGWNLCKASELVTNEAGGTSIGDDGKVVLRNV

SEQ ID NO: 960212 - protein, 189 aa, Homo sapiens
ITGRTQQCRSESAAFPMLFEMNGGRTYNRNVSQCSAAWHPALNRLFTAGRDPTHKNYWSCQLSTTQASTTIRTPTGHTTTDLAKRTLVLLLRYTCATPTLYLLCLSLCTTDPASPPPMDTATTTRRTPPHCSPTQAHPPSQDLYASQPPLTPPTATGTTAHYLRHSALASATAPNSFPLRTVHSLLTAT

SEQ ID NO: 960213 - protein, 110 aa, Homo sapiens
VAGGVVRALPRRAGLVSMKCFGFIFHGCRVLPCLYDSSSRDWDCCSSVLYFLKSVFLELIRSWWILRESGRVLSIGEWVVWHRRYSGAERIATMPERIHWLREVVPSERI

SEQ ID NO: 960214 - protein, 294 aa, Homo sapiens
QVDESLLNRHAMAWAPEEGDAEVMHAGCPAAPCCRGAARKEHERCTGNMKDEYSKRRHTKHNQTTKTNDNTRDNTSHATAKHQKTHHNHKPTDDTPQQNTPARPTEHRQDNAPKENSNTQTRTNKQRTKRAANDEKKHNTTTRNKQNHSNTHANKQQNGNAKKPTREHERKRRENKNDDNKEDESKNRRNTSTRNARTNTHTHKRRAPRTPRKQRRQEKTTTARTPKRKNRNEAKPQQPGHQGQRADEKKRRNPHQAEKRDDRRAQETQETTQEHEPEKPTTRNQRRQARTGKR

SEQ ID NO: 960215 - protein, 71 aa, Homo sapiens
SPRMVSIPRSETLPGRGWCMFRGLAQADGALIISVWILGFSLVWHDEVQGQHSSDPTSCATVRSWAPWRLL

SEQ ID NO: 960216 - protein, 195 aa, Homo sapiens
LSVGFIGAGQPGFCPGHGLRMQQASCAAHRIMASSPDMDLATVSALRTMGVKDYPDNSGMTVQHSDVLILCACERLRHHSLFYPGSEHQAPTLRTEHIVVSCAAGVTISSIEKLSSVSASPQGHPLHDPSLQSWCGRGPPCMPQARTPSVDVTVRLMDAAAEQLCVLLALEVREDLIVCRHGAQWQRSRLRIHSP

SEQ ID NO: 960217 - protein, 160 aa, Homo sapiens
SCRSAWGCNLELSQRGDTFSPLSLTEEERPSSRHKEQKKDKQIKRTRSKKPPNSKNNTTPRQTKKQDNHQHPDTHNTNKKKRKQSEKDETQTTTTAHTLTLTNIRRAQKHQPTPKMEQTRQSSHEEKYHMTIHTKRDTAKKPTTKKQTPKMTKEKDEDTV

SEQ ID NO: 960218 - protein, 161 aa, Homo sapiens
GAGDRDGDRERLGSLAALPFVASAGSLRQSEPPAQRGPASLSDVHLPCDVLAMLVALTCTHPCGAACLPCAALHVPAGDGMNEKPWLPLLTLDADEMFDPGAEELTLSEEATWSEEATQSEEADQGEEMNLEPGGDPGPEESTRSEEVTMGGNGVQLVLTC

SEQ ID NO: 960219 - protein, 182 aa, Homo sapiens
GSASRQQIQARSSRRWDRPPADHPRRARDTTAPLQDPAHQPWKPLGSLVFPCEAVIALPCVMPTKRRLRGRSACGVPPLRVLRRPAQLAPGCGPLAWSLPCVNIGTRAATREEGQRFREQREAEMGRGHHRHNRGPQPFTQQGVGDPRERNHPPAEKENAPGEASENAHTRHEETAHRNRWG

SEQ ID NO: 960220 - protein, 106 aa, Homo sapiens
MPTLMTKSRLKAILSAVTTRPEETWTRGRPITLGWRVPPPYKFSPLQAWDGTACTSAGSHYNPVDCKPPREYKPRQISMDHNFTSKNRLTSPWGVTRIIIQCEQNA

SEQ ID NO: 960221 - protein, 197 aa, Homo sapiens
MEHVLVQAENNGSHGTVFVVLDAGNVSRIPYTGFILSVVCHALRVLHQESTLRVVPVQTGGKPRKETRIQVAKSYDPSSSQYAEEISEECMSSYVMDDICRSLSIADAMTSETGFWKSVQKTGSSVWQHPTGHRKISIKMDSKRANCVPFDSSLEGNIVIQSSSDSGHRLPEEGNLLLREKSTELTSEADVEAVMGK

SEQ ID NO: 960222 - protein, 154 aa, Homo sapiens
MSYMFCGMNLDVCMLRLCLSDLMNTDLCVPSLLVTLNVHCTKLSCYLCDDDSECNVTCMCAYVYLPSSDIFPGETRTLTLADLDPKLLSALRDFHPRTERSLLLALDSAPSSGDFGLMRRCVHLSPLRFSSVLACPLPVLFVHAIMMGFGGRVV

SEQ ID NO: 960223 - protein, 68 aa, Homo sapiens
GWEARVVAAELGKSMKPGKVVLVLAGRYSGRKAVTAEKHLMSGTSDSPLTASGFVVWRGIVTAYPAQS

SEQ ID NO: 960224 - protein, 102 aa, Homo sapiens
LLRSETAGDVGRAKEMDETVAEFIKRTILKIPMNELTTILKAWDFLSENQLQTVNFRQRKESVVQHLIHLCEEKRASISDAALLDIIYMQFHQHQKVGMFFR

SEQ ID NO: 960225 - protein, 88 aa, Homo sapiens
AGRLRFLVLLGARPAFGTERSCVAGPLPVKVLPCESLTSCALLLALCMKLVFDVMLACLPAVACMSCLTCLALSDVMLAGTRWSPLPD

SEQ ID NO: 960226 - protein, 112 aa, Homo sapiens
PVKESQVAMKEMSKRDGNGEKRHELSDEVSCENAMMNGKAPAEDVFKNAPASYCEEVKRVPLHLNVCKPTDRASCGEYVSDDSDYEWVNARCDVNMTPPPQPLHERQPQKRE

SEQ ID NO: 960227 - protein, 247 aa, Homo sapiens
LVPLGQQEQQVPILGEVLLSLPITEEGACLERAALQEELQLCKVAGAGTAGPRVTQQGAEDGGALCLDGGPDRPGSPHSSELPWMLSGCLRVIQLNWEPAGMELAHCAGPGEAQACQEDTSCITRGFLGLPGNSRPCMDTCRGEHAQPEDDGGGGARLARYTWLYTAHSHNEALGSRPHNTTCYERIEDKKRQPERGEPPEPLESIAQAGVLQEAERLAQWPEVDPEEPDRMSEEVRARIHGVNCRV

SEQ ID NO: 960228 - protein, 208 aa, Homo sapiens
MLTDLDDMNLSEPFSVDIYAYWSVEESPSCPIPRAGEAMLALVSRRLMMDVAASAKSRERGERTGHTLPLIDPWQQIGYSYELLKKDLNAYGHFGYLSNPTARRLASASTSRRSVRWPAEGLTLGVHPCHSPVIAGGTNSRAVSEVAMKELGRIGIGCSQHSIVRGIASGTVMFRIMAVTLESSADPRIYYDLKTGIVTGALNAERRC

SEQ ID NO: 960229 - protein, 121 aa, Homo sapiens
MGCSAEIGKNTSAGLSVWGSGVLYKGGFGTRGNNGVVGLALGEGSVGEHLVCVKVAPYKGRSKGTEQKVKAGEGRLVSVVSNVQGVATALNFNTRKCGSVSIPLGGGCVLRTPRFSGARKY

SEQ ID NO: 960230 - protein, 106 aa, Homo sapiens
MCRCPVQRIIVLCTSRGCALRLHPWSHPFITRRRPALRTATGPPLIEGFHGPRQFPGLVSRLGRRYPLRGVRAIQLGEFRRFSVWGDTLCVTNGPPIFWRKPERYY

SEQ ID NO: 960231 - protein, 74 aa, Homo sapiens
SPATSSAKPSTPMAYGHIGRKYQLNSRWKLNLFKLTPFMVNSSVVCKGRVDSIKEPIRLCVNDLIENTFICASA

SEQ ID NO: 960232 - protein, 62 aa, Homo sapiens
MLQEKYTPKVKQYLVEREAGSRKSTKRKRHNTSKEHTQEKNRNKKKACGGRTKQQNKIASKS

SEQ ID NO: 960233 - protein, 205 aa, Homo sapiens
GDCPKGQTGLLGQQRGKSGGGILATRSSSSFFLSGIRSFEEPLAAFDELNLCQAPQQVALKCLRKAAFTSALWCTAARVAVVHSGRQGWNTSLTAVCRSLTSLRGRAQCGVCVEFLSAGNHLCVDVMWAFHQRPCRGVSSPVCDARVFVISLEGLCFDGCARTGAMDRFLGAVWLAAPWLSSWDVTGGRSTMGALGALGEALGGH

SEQ ID NO: 960234 - protein, 227 aa, Homo sapiens
QAPWIPHESRLVCSVPAWLTQSVVAVGSAVPPGWGWWGSSLLPQLSTSATTCCHTMVVDDCGVTTGLVDAMLPSCSTVKPKLWVSVMCLLPLERVPPVIYNRMDPRAHNPYVPGKVPLWPMRNFLMCANLIHDGCLLWKDMLTGALQHVVLSACLIDTMYLVFLQEIGPVSTSFPTLVINAFQWYRLQKSNQYDDIANQEKRDVSDQQQSQLRCRSATVSRDDLEPW

SEQ ID NO: 960235 - protein, 157 aa, Homo sapiens
MGVTMLQEFVGSSSVYSFGGVDLLWLNALMRTSVAARGEKCDDIFYNVYVGRFDVVTIGVSRPVMKFWLIADGHEAPVRTRTVRLMDISCSISPLGTEASELHSYGGCGGIVTSLNGGRLQIVHLMRFFGLSEYCYTWWFQYLRRCPGARVSLGGPG

SEQ ID NO: 960236 - protein, 151 aa, Homo sapiens
AGGSCRPPVPPAGAPGVCGPSGATLGPRGLSKTQYVQSHVRQEDMKGSCGDAYVGQNGRQRHCENATSAELLLQATWYPATTRWYSYLARVYALLGGPSDFLPLAYMRGVPCGDFHTDPRVDIRARCSEAQQHWMTAHVLVMSDQLGARIV

SEQ ID NO: 960237 - protein, 214 aa, Homo sapiens
TERPGAEIRQPGRGSFEDCYSILGRQLKHGFPAEDEFPDLSAHKTTWPMVLTPELYAELLRQEHCQSCASLRGLTVIHDMAVDNPGATLYIMTCGAAVCCVLTDVSPTEVVQWIVFDPKSSDGPVHWLATMPSCMMHKTDLNPDNLQWLCDDLLTPTTCLSSRVRTGRSILWLLPPPALRAAGSCRAIEKLCGWKPLSSLYVRLAGRYYGAQEA

SEQ ID NO: 960238 - protein, 140 aa, Homo sapiens
MCPKTLFSGPSDLVSTAPSELSSRIGGRVCPLTLRGNYPPVAPRYKCALSAKVHPRGCKWASCGAPRLRENSPHNKVASQRRLLSQQTEQGSLGPPSAKNSPLIINFGVREDNHIKTTKYEDNILGFCGAPLELLRCTSE

SEQ ID NO: 960239 - protein, 197 aa, Homo sapiens
MTGRAGRPAADNVCRVKLRSERWFGIRHRLIEKKGRHCERTTPEVDIDEKREANNLIRAEEIAEEEETVYPHTAKTNVKHRESRALLKLSMNSPKMPRNRQQKKEEPVIKNDDSLLKTKKFEKEKGCPKLTMEDVVSSKTKKSDKINDGSLLEEEIDAPKPKKMKKEKEDEMEKLERKAPKAERMDFLILKPDCNPR

SEQ ID NO: 960240 - protein, 75 aa, Homo sapiens
MIPSTCVTYPEEKSRPLASSLDTKLQSSDDLSNWSLCIRPVFRALKLAVLDGGRGYVWLPFAEEARQMDGEGVDS

SEQ ID NO: 960241 - protein, 137 aa, Homo sapiens
MRADAWTLRGARAGSRHCGAWYWALLSPSRSQLATKGAGDQASQRVSTPGRTRRVCVFGLRGTRDMPIAAKRGKSTAFYGNTRELLYLIGNELQRRPRKEDYDWSDGLLKEGHPLSSSEEQREARQKRNPSRKFELP

SEQ ID NO: 960242 - protein, 68 aa, Homo sapiens
MCAHANSINRPPMDAQCKVIGKDKRRERKKHNNQRHQKIAKPNGSRSTPIHKKKANGKIEHKPKSKTK

SEQ ID NO: 960243 - protein, 271 aa, Homo sapiens
WTDESLNKKTHVHQLSTHISRNPDKRWTSVLHLGGVAVLHSPTTSGMWFLFSHYVGLKGLNVLSVAGFHVFPPVCGIFFLTSGVDKQRPSSVKAWWSLKCASCWPYRCGKSHTSVSPLTYIAHEEEVCVVPSLEGPNKSREVLVVSWRVVPHIQPKSIHISHHMWQKRGHVARNIVELSEGVSERHLPLRHQQENCEKCVAAPYLLVWPPEVTKWELYKRDREERGGGGETPCDSAGIKTPKKTTSREKSEVFRENTLWGTHPGGWPPEGQ

SEQ ID NO: 960244 - protein, 106 aa, Homo sapiens
MAGGTYGCIRAGELILASNYPAELQAVLRERRPQETCSGDTLFPRSSRGTSRIGDIVTGGECRPLSKTGRLQGAQVTRLPAPRSSPRSSEADIGPFPTIEITVIFS

SEQ ID NO: 960245 - protein, 190 aa, Homo sapiens
MAAGKMGDIQTERAYQKQPTIFQNKKGVLLGKTGQGESLPADTYKKHRTRGLSRKPKGGYERATLHVNKESAPSHVDKWCSISKRRNSFFVARWCDTKKWKKCKGTMCGQLAREKTIQRDNKTFPHKYNNPASRKKRRHQKKTSAPGVTTLCVPRVAYDKGETRLNKNSGVTQLGYTKEGDRKCAREPPQ

SEQ ID NO: 960246 - protein, 261 aa, Homo sapiens
MESNVGCESLSRACPLMSLQSLTVLCRLLQQLLRWLCGSCSVPPLPPVPVTLVLCVPRWTLQQHCAGPPVLFLWLCSVPACAAGPLCCVMLCGCVVVLCCAVCVCCDMPVCVAAALCAPHVPIGCAECVVSLDAHITTDLCMDRLTDSLYLTCVPLMVDQVHAGDVTAYQLSCKWEPFWYKGLTGNEFRGTLGMRRIALRTAGLALGDTCCDVMPQVLLRNGSRGRAPIRGRKSSPCSRPSEQFSQMPCEVVTPIRSKLPA

SEQ ID NO: 960247 - protein, 180 aa, Homo sapiens
MTPRARIVLYIVITACRRPEYKLCKVRRIFVGHYKESLYLCDIMMTRYRYVRYPESPHQRVNEYHSDLSLETGKITGSSSSSTLVNLCIRDWLVLNLGRIGVITTMREGTLESCDVVHAERMPMANKLGHSTFPTLVYRQWAKTMDFSSPRQGFRLTIAETRAKDGAKEAGSMAWGLSLA

SEQ ID NO: 960248 - protein, 211 aa, Homo sapiens
MRMGGPSTINSPLDWGSPQDLLNGVPKSPRAKDRCRYLVEQWVAQSLSKCDYPHVGVFNVVFLVVCLFSWSSLVWVSFEGLLGWTQGGKMCKICAPTFNSLGALVWSLEFVLMFSLGYSPLRRPSHMFPPVVLLLVAMRSSHTYFFLCGRNHAPQGGGARSLGSCASWGHTLWWPGMFNLSRFAPFRWFYPTLGPSLGGSKLSGGPVVGRV

SEQ ID NO: 960249 - protein, 150 aa, Homo sapiens
MVKKRRGEHSVSGSFPPQFEPECVRQRGRYLRGGGDYPRGTSECVGKTYNDSQLLFSGGTPEGGFTVKVRTKRGVVNTSQERGVVSSSCGVACVVTPRGAVCGEEKGSLSKRGADRTNTYESLHEEIKKSSFVRNMKVIREKKVEEEGGQ

SEQ ID NO: 960250 - protein, 125 aa, Homo sapiens
RGVPADPQCPRAVHRSVWTFRATLGPRACRDPVVQAPWTRTERSAGSHVADGPSVLQMHLRGALLSPGPCYPARSSLLAELCTHLGATSRILPLRTSCRGVLARGQLQLNLAEESATKCMEGQSE

SEQ ID NO: 960251 - protein, 147 aa, Homo sapiens
MPTVRPAWHMLLLLCWWQLPRSPLLPPVPRDYFVLVCHDVTLQHATVAVSPLCWFTLWAVGILGPALVAAVNLLRWWQGLGRCWFGSGVPAPGAVVWREMAWGPKWTPCGGFGWQPFLVGGRPNNNILAAPTLVALGGLGITAGFGD

SEQ ID NO: 960252 - protein, 41 aa, Homo sapiens
MGSLSLTRSRGYFTAAARRQNTSTMNLSKFHLNKGIKQVYM

SEQ ID NO: 960253 - protein, 129 aa, Homo sapiens
MGNQRLKNVKKADGKPGEKAGTTEGRAEGFEESPSAGLRQVTLPCGPWAGWSPGGGHYGGPWGGTPPGTGGDWPCVGGQFQGMCRTISGDVLGWMRFDANGLPGEELAGNVVFDLLEGGILSPPPGTGA

SEQ ID NO: 960254 - protein, 139 aa, Homo sapiens
PLGPPLPLPAGWGKQSQRKKRKKKKKTKPAVSQPGEVPQRQNVISRGVKKIFWLDPLPLLAGGQLASWISGPCPPSPGLVPPVHNVSYIWDAHLVSLSCHSPLWGGPRVSGTMKANKMISDVSVWGEGRPRSLSSAMIW

SEQ ID NO: 960255 - protein, 196 aa, Homo sapiens
MREDRAQSRLGQCGNQIGCQVLGGHQRVSMGSNPTGSYQWMTVDSASLETNQQCTTIEAAGNKYVTIGAIRGVILEPWHLVDSVRSGPLRTKILLDPDQRICASADGVAAGNNWAKGHYTVGSRAGSTRVLDVDEEGVPRAVTVSRAYQLEPLSVRGGDGVRDGHPAHQLRSGKSTHDRIMNTFSCHALTQGVRHG

SEQ ID NO: 960256 - protein, 259 aa, Homo sapiens
AGAACCVCCCDVAAWHSCVPAAPRPRCSYPLPAVPVRELGICCHPAGCLCLCDLLSSCVLMPAVPPAVWPVCCVLCVSTSMSCPAFTCCCVTAVASSPVPTPSVGPMMLLGAALHVLEADAELLLLCPVAYDPCCMHLIVPHGSVSTVPCAILTATLSALPDAPLRPFLLGGPLHCLLLMCAVHAFHVTLACVCDCPLAGWPNPMRPPWDCGCLWLWPLLCGGWLPVGFRRDSPMPPLGGPLGDWTLLLPTLGSGWAPW

SEQ ID NO: 960257 - protein, 100 aa, Homo sapiens
SCECFCCSQSPVLPALLLCVLNSMCCGVTLMPVLPAACDAMLDACVARCLDAAVLLSTHACLAGQHPCGPALPCVCMDVCAAETCTLCPVNAPQPPLPHP

SEQ ID NO: 960258 - protein, 171 aa, Homo sapiens
GYCYRGFIGILHHGIHARPSVGECNDPLTSSPVPKLPGLYSDALTSSPVAVTFHHLMIESCGAPRHRVAPGCEEDVIGEDAHWRWHGNGDYLRHLQSCIAYESRGTVVWDEIERQYGGAETATSRGHGMHELEPCGRVTEECLGLECLGPHVPLGSCMTSDDEYEETPLCL

SEQ ID NO: 960259 - protein, 246 aa, Homo sapiens
GLGYRALMANKIEEKNADPKPTPVQAGEFSISPHTMAPEHRVCALNASPQSDMSGALRTEVRCILMPPEYNCPCGLPNSQMVDGCDEKMCMCMGVSPCVFMVGAHPTPSKQTSPALSGLGIFLLLGHPGHAMGGMRWCATMMCGLCWGLRGHLVCLQAVLGHPLVCMPASCHEWFCMVSGVSGISLWPCNVCGSISVWVVDLVPYQGVFRLPVVVGSCPLCNEPLFQALRSQALCLACCMSWLTLA

SEQ ID NO: 960260 - protein, 69 aa, Homo sapiens
GVGALCPVGELEQPTPVRVGAMDWPECSCVEHFLLSKCEPGHRSAVVALEAKTCGWRSWYLGCSEPSLC

SEQ ID NO: 960261 - protein, 248 aa, Homo sapiens
GVRGNLTEGAAVGWRDSHRDGEEKTVYGDTHSREGRADMRQQQDDPPKPEEDSLGMQMHMPAPVEGTDFPGAVRQCLGALPALFLPVCRPQPSSPSDLVPHDVLAPVWDANVAWISRSDGARHTEVCGGLGVSVAEGGLPMIGMHRGVNSKQLQHLTRLHLAGAGVRGLSLPGCVSREELAAEVPLPDVLRRVVVPRTCRAMVAPAWIGWSQARGCRAESETRSARVCRWPGRHSVAWAWWAGSRVRF

SEQ ID NO: 960262 - protein, 240 aa, Homo sapiens
RRTERPAPDRTAARRAMPWGSSHNALKLRFPAEDEFPRLSAHNNIMAKVLTPRDCTRSCAPRARRAGSGCDDVIQTGVDNPGHQYIMTVGCVAGDEESYEVFKDLFEPIIEDRHGGYKPSDEHKNEHQPRQPAGRERPGAQYVLSSRVQHGPEDIRGLHAYPTGLAARGRSQSNSKKARRMERPPVQDWDGGHMGWTNTTMHKNHEVSGKETDQSEDKYLIKKRRFCHFVDLGIARSWRS

SEQ ID NO: 960263 - protein, 181 aa, Homo sapiens
VSCGWTWLVIGRILVYGNRAKWQIFVKTLTGDITLSVEPSDTIGKCEVARSTDKEGIPPDQQRLIFVKAKQLERWATSLLSYNIQKESSLHLVLRLERWDVDLREEPELEESIHPVNVEPSDSIENVNGQDTRIKKESSPEQQGHLCRQQLEDGRTLSDYNIPEGVDLHLVLRLRGGCRSS

SEQ ID NO: 960264 - protein, 89 aa, Homo sapiens
MVPGKAHVLMEMLLPWYPASRPAFCLLLLTLMADCVACKAVHSMNLWDEDMMRDVRPCNGHQCRLHEWPQIGLGNVDSCWAPPWRGPSP

SEQ ID NO: 960265 - protein, 101 aa, Homo sapiens
KNPSSINGNYTKIVNPLLQNVSNQAGVFKPKVYVGYVNRVNIIYVVGGVKHKKYEEQFEPNNVTVKSPVGNPVVAYQKTVVEPVEVPACGNVAEGETRKYS

SEQ ID NO: 960266 - protein, 164 aa, Homo sapiens
VAPARRARCSIVAAWGGGAVWGAAAAAAAGFVRKEGGLGPGLRWWGLLRAGGSLLLCLSCSMLRPTFPLAGGGGARKRGAGDEGPLQRWKRAKEAWAGCKEEISLTGIRAQIGCVCIERVSEKYFGSSIILKIIRGHPGRLRREELHYSQKPSREKSSGNEHEV

SEQ ID NO: 960267 - protein, 191 aa, Homo sapiens
MTGLVQLAAVPGGPWVALAMGNRGGFAWSVSGQWHPGVVGSAVAWDEGPGDRTVRGKSRRDAQGSRYNWYVDVPFTHSMVPCWVNGHESITGPWRVDLSLYSACPLEESRRSLILLPGGSLSKDEVIEDRCQCIMQIRAGQRIRFTGVMCAIGGYNGHVGLGVKCAKECGHAIRGASFWPALHVPVGKGMG

SEQ ID NO: 960268 - protein, 52 aa, Homo sapiens
MALQCFVVVLAQYMPGELAERCRNVQPAAAGVGIIWHHGDRAPSCKRGRGAD

SEQ ID NO: 960269 - protein, 83 aa, Homo sapiens
MSSWERMWGDQSAKTASENLHPIVYKEIARRNIGAATVQATDVGHKSTKLTNSDKKSLWETDLRITQLTARLEYSKTLNEAQN

SEQ ID NO: 960270 - protein, 178 aa, Homo sapiens
QAAGKMGDIQTERAYQKQPTIFQNKKRVRRGETGKEKLPGYYKKHRSGLQEHPREAMEGTYMDKKVPLHGYRVSIRGRTPLGRWVTKMKMQRTMVIRRDYLHYIRKLQPLRESATRTVSVHRVPRASGTSRSGDIVTGGEVPASEQDRALQRAQGHQGCRHQEAVPEVLRLTSARSPH

SEQ ID NO: 960271 - protein, 144 aa, Homo sapiens
MRGDWMQTAIREDGASLNEAGLQNAKRKPVAERYVCARAWLSCALVGWYGTELPGMLVALREYRLKGCEQAPGRRKHLYRLHGHMVSPSECHNVVAWRGRPSAEEVGQKPGIRCVWHRVRDSSTMHEGVADGPNTTRMDGLTFR

SEQ ID NO: 960272 - protein, 261 aa, Homo sapiens
GAGGLLALLALLCVACALGGGRAQYERYSFRSFPRDELMPLESALPATAAGQCSSGRRLRGARERWCYRGRSRVGACTCVARAEQLRPFMPTCNMQLPAACSLWALPAWRSAMLVPEACCTLSGVALAAACCCTCARMLRAMQGRLPCPSCAVPSASLLMVHGCDIPAASECPYNVPCEFGRYFKGEDKSPRNAICRLLHTLSKLEASLIDEDDEGGTLAYYKSLPGAEDYIKNLETKSYESLFIEQCGHTTVRTGEHPSQ

SEQ ID NO: 960273 - protein, 210 aa, Homo sapiens
MPLHEKGGSAPPMSGLCAPWDLAPPGPSRPERVWLDKSLFRPVHESSYLPEELADVACQRMAGLRAVGPVVGLVHPSGSQVVCHHCDLGDLGSTSPPSIRLTRCLRGVGPQGRCLHRYLRWCKLREACGDSQHQASKCGLSPELWPGSRKPTWSDGASPRWAVLQALVVREVWLEKSPVMMLCRRVGFYEALFDGHPPVKCRLQERAGLA

SEQ ID NO: 960274 - protein, 109 aa, Homo sapiens
MSNRNGIPNAYRTKKFYAIYNYGKGPNVVGPYGLLQPVRLTPIETCFSQGSRRRKPAHIYHQPVVHHRPRRCELLTSRCVLLKRSPLPAIAANLPAWVQSLLQRVMGLR

SEQ ID NO: 960275 - protein, 191 aa, Homo sapiens
AARTRSRCAAGERCGTGSPRGESCARPPGAREDAPAQPARGGVLLLVILNGTGLPARAPGERGSKWNLFWSGWGENSVQKYRRVGAAAVPIDCTGHLSMSAQPRVSYIVCNKQFLLTNKAISEAEPASDMHIQGLQSRYSASSDCWGTNDRVYNVGTIARLPVLSQLIEQMRIELVRVLDVYTAEFALLVS

SEQ ID NO: 960276 - protein, 130 aa, Homo sapiens
MCSRGNSRRTMKDGMFTTCAVRTRGSSDKGEGGRGGKNGRITPSYRTTLASSTHPVKAATVADPKALQDRCAPDSSRAPPGDSKGTRPESPKRLQMTFSTPFYRRNSESIPPKNHKANEDGRVRAPKFRV

SEQ ID NO: 960277 - protein, 97 aa, Homo sapiens
MWANYEGNNKRRTPTTLRQRNHWLHSGRGGPEAYHNIPRAAENPYVGGPRGNRTIGHQGDSNYSARRHPNADPKEQPGEEKGVRRPHTGEKNTRDID

SEQ ID NO: 960278 - protein, 133 aa, Homo sapiens
MALANVNIGMPHLQCRGLVDLLPAAGAAPAVMVLPPPLLLLQLRTKKVEAKKRRILRSLTDDMGYGSFLEPKSLLSYNMFNTKLDTFKHTTHTNTTRALNELRRCGTTMHVPPETVAQWPISVCSLWTQLPGP

SEQ ID NO: 960279 - protein, 271 aa, Homo sapiens
HIKITVLRAVQRRGSRYGATMNDLLRQHLSPGPRGARMDNRLSAVAVGLGVCGWAVVDVTVDWIVRVASCPSYHNQAPSEEDLLPELHPSNWERRSGVLRGYAFEIRVRRKLPMTSCTGHGIRGYGAPYCLGMAFGPCVASRSVALKVEIQCQTSQAYPFLPWVSVGWSKLAVVTTHTNASDSDPLLSAPGLASARRDTQVIFEWAQFAVPDDHHRHLLTKDGLAMDVVVGTASAGPHFPPGISYSGHSGRLKRRWTVLGEKPGGVGMGAC

SEQ ID NO: 960280 - protein, 268 aa, Homo sapiens
AVLRLLSSPKPRLSRLPLPARLLGEQNTFHQDHLSQVPHVEIKASKQVYMSPCRQGVRKSRPCIICDRGYLEKDVRCKTPEPCDSEPYMCVEDVAMSGDLRVAHSTFTRRDGLPISDMYRRACMLIVVWDARFRKEPVSKSVCYVKFFKYKSKACRDQFEVTAVNGVMDMVSKQQPWFRMEQEYTLMGTDGHAPWVGFQTAFPGPPGSIITVVWERDKSLVAGSIVDGQYPGLVDAGSQKAGPSRGKTAKGNPMALEENHGSLGGPHS

SEQ ID NO: 960281 - protein, 67 aa, Homo sapiens
KPSGQYEAAWLNLDSGLRSGVGMERMEHQQQVGLVGPGRGNSSKCGAGGSTVRAVLLLSYLYPCYTY

SEQ ID NO: 960282 - protein, 95 aa, Homo sapiens
MSLELWNLTHVGVVASSDMINYFRHTADILHEDRHAIVVRSSSRAWHAVALVWFDALGNAMDGQGPLGSKTRSDLAETPGIILDSVRNPAYWLRL

SEQ ID NO: 960283 - protein, 109 aa, Homo sapiens
LGKEGRGLIGRGERPEEYEEGYNDGEVDDEEDEEELVKKKGVRSENENLKMREKMMTRVEITVLCEKIPSCEFDCLYTQKSTLVRAAVLSNTVSLPWISLHYMYLVRDD

SEQ ID NO: 960284 - protein, 237 aa, Homo sapiens
VPLSASLLAAAASAARLLRRRGLRQVYRQQSLNSRFLFNPLHRIDRRAPPCLDASRITPSSADITDHRDLRGDSNGMVVERGSTNVIEVAPADYTGRCLHEVRRVGEARKVVITEVVRTEEAKVTVVEVDEEELIEREVIGEEKDGECRLGNCVGYVVKTGQTVEMMSELHRLGRITERRQRGPDDVMSPTADHGLLLAKIVNSPPCTSAALRLPVQILKPRVLEIMGPACPGWQAP

SEQ ID NO: 960285 - protein, 157 aa, Homo sapiens
AVSSLRHGVCSPYLILVLLLRKRGSHLAKDVTLPVCYSRLLLRPGYCELCSLANLAQQTITTCPYACQVNLSTVIRLVLNLAGTGRAVARIPRVLRWWDSPALASGALWYNHCVVDGRHVCIQPIIWLPFGIVVVNTTHRNDIDHLLLPWPASGPTS

SEQ ID NO: 960286 - protein, 190 aa, Homo sapiens
DAVCSGVCARGALCVPWDGEPGGFRGGFGSGIRGRGAACGRGPGAECRGALRSAMAEDKDVDARHQMLGRLVKDMKINVPVRRSISSPCPLMESEIIDFFLGGLSQWMSVLKIMPVHEARPCAWPAAPGSRHFVAIWGLQWPRRSGVLSAPMECGHLPSVVAIILAKLSICPRAAECYLGGTRSASPTLS

SEQ ID NO: 960287 - protein, 108 aa, Homo sapiens
WLGLMAGCLNSASMAPHVPVYVPWRSRHFSAHVPWTADGAWWNPWRPALLIPCADTIDMLRALPDPAQLVCAAFSACGVLATRCAMCLGCALVKMAPVYISVRSRRVL

SEQ ID NO: 960288 - protein, 235 aa, Homo sapiens
MALACGKAFGWLLHAAETSAAATAGEKPHHCPGVWQGLRARLAPVHMHLRTALCCALLAPQCALCVLPMVLLCHVSSAAVLKTPLRTAHCVLSCALPCVLHVAVQCAFCGMMLWLLACMHHAAHTLCLSCPYLLPPLAAKPSVQMLQLATPPAASTLVRAGPTACPHCSNGLRPDAQLLLHAPARAFGRASLSAVSSAGSAFGQASSLTKHKRVMRVQPVLELPGAAAEQRLRLG

SEQ ID NO: 960289 - protein, 188 aa, Homo sapiens
LVLSAEAPFRSAVFLRMDACSGLEAAMAPSRNGMVLKPHFHKDWLLAAVATWFNHAGPVMILHDCNVPCAMPNGCCLHSAPAPRCLCVPFLAHLCCCPTGSGTTLNGALPACGFSLEELSGGLAFTRKVARTIWHFCGSDGGGTSPQESLLGQLCSWLKEYRSKLILFPRKPSAPKKGDSSAEELKLA

SEQ ID NO: 960290 - protein, 218 aa, Homo sapiens
LRGDQKAKMSERKVLNKYYPPDFDPSKIPKLKLPKDRQYVVLVMAPFNMRCNDVRENTSTRGRNSMLGSETVCRTSVYLGLPIFRFYIKCTAAAWQTITFNEDPENTDYTMDAWMPQLEFPVLEKLLWVSDVTKRVHEGCGEGLSELNNPMTWCWMNLDQWTPMLEMEVLENLQELKDLNQLAGARGLRGYAECSHRLSEEERRRQQHEEDEQETRPV

SEQ ID NO: 960291 - protein, 233 aa, Homo sapiens
RQGANSSCTAVGRVARAGLKWHMPTPCVAPDEIPYLLDLALFLGRSLTLALTPQWSPQCVCLVWMCMLGVCVCQHDVCVGLMEDMCVLHEHPGCASLDATVWPVPALLITAHAAVCALTPCAPSPESIKKCAKEMDLVGAGPAPPLQLAFMSDGVSQHAVLSAWKDSIKNYRSRADIFSERRWAWKAAAVRTQQGMPRRLEWTEARQREQEFYIPYLAKDLESEAGLSIQRGQ

SEQ ID NO: 960292 - protein, 280 aa, Homo sapiens
REHRSITRSMLGFIFVTMEEDEAVYGPGYGELGEQEEEKKKKKKKKRKKKKEEEEEEEGAEKSSSPFAACDVVEDDCLLLRVLGSEGGSPDPVVQTQLGSCRTLAPTWSCHNLRASHRRGLCACVFVCAPVGGICVAGSLDASALLLRSSLCCVRLELRGLSCHCHVLPDCVCPSSAFLEAAVLCNCGGPPCDLALCCNLPLHVLGDLLCKPCCAVVGGWPSPGGTTVRAHALPVVERGCWDACVDAVGLQLRLCRATLKPACTTILMLTAFIGELHLLR

SEQ ID NO: 960293 - protein, 102 aa, Homo sapiens
MQFMKYMVYPHDLLLLNCLTAVYQYFTNDLCSIVWVLPACPPAGCPDGPGALKALNLEPCCLGPRWAACCCWSALLTLPCLHVERLRTLLVPHVWCCCTVYD

SEQ ID NO: 960294 - protein, 194 aa, Homo sapiens
MSCNTHREGLQLHSKPARPGTHQEEQTTPDMPPLRAVTLTAKVCGFTPKVSETTNPTKETPDTSEYLKEQTPDTPSLRTVTLTARVCSFILEVSETKNPPEGTNSGHIVTTKGLLPITKRIKAIKLQMVLQTETQMSSTNNFYRGPLDRPTGPFTGLESSPLEDTTTAGPLFAPVQQEVARAVIAQFQQQMGCP

SEQ ID NO: 960295 - protein, 105 aa, Homo sapiens
WKKIKQFNGWVFLEFTPQSPKTRRTNIFLSHASGHNECSGTKRQPQVYRWRGGCLRLHASALEFSVFPTRRVVGSSDVVAHGGEREGRAQNPFKLQVEWDLASRS

SEQ ID NO: 960296 - protein, 168 aa, Homo sapiens
MKARYEAGWESAMTHQAVGDSAYKGVKREQEKWLWSAKKDWYDVKAPGYVQYKKYWKTLVNRTKNKIDLMVSRAVVCLKESGDLQNDEVRLRKFKLITEDGQEKLLTKTFHGVDLTRDKMWSMVDKWRTMIEAHALELGSDYRWLLASSVLCWFTKKRNNPSIYPGRL

SEQ ID NO: 960297 - protein, 169 aa, Homo sapiens
RSGIPKCFTERKILGYIQLRKGPNVVGPYGATSNPSLTPEKLFTKEPRKTRHEVYHHRSIIYSLPDQLALTHRSFVRMKPPLVRAYGQHHSESKSSRRRAVLIVAVYAEAMLRLRPLTGNAFWMQGGTSCKSQIYRLLYTRRQRDRARSRPNSKFYMIERSTPKAEAVC

SEQ ID NO: 960298 - protein, 243 aa, Homo sapiens
ASVLARRVSDDRAFLWPQRQEEPLPGWGVPAGEGNTTSVVVILPTHRWGEGPTQGRGFTRAFLTPPSPPQAGTCPSCRFVRATDIEFLLWDHALTCGGDRSPLYKQSRTDHNTVGDHGALRRRRCGSHIYLQGRPTTLGRQHSYKEFFLSERACFIHTPRLLSSFFYIRIVRDQPTRGCVVRQHPPRCYRMWGAGVGVSKRLVSRTHGAPPLGFFFHIGVGEGCVVTNCVWCGESERVLFDDG

SEQ ID NO: 960299 - protein, 168 aa, Homo sapiens
MSHPRLCSRERVLSGHLGVVAKLTHKSYKHPVEKQNKKKKKNTNNNNKQNNKQTQNNKNTQTDGLTTSQIYVREGERKTQTERENKHEGERASDELRTNKRDQDDSKPPRTAHTCCEDKSRDEEDKQSSARATHPPKKDGRAEQYNNHNQNQHAELPLVFIICWLSAT

SEQ ID NO: 960300 - protein, 167 aa, Homo sapiens
MCVLVQMCPVPKEGKFDSRGMPFAVSTGGFRGSAEGQFSIPGTSVCNVAAESEAKSTIVVLVRDSLVAYGWAAGSLFQRGRASLWWDGPLGVLAIETTTRCGQGAHAQSGPCVGTPLQAVRSGDVSLRDQEGVPKCAAAEALGSKRPPVGPRGCPRPENKRDVQAPR

SEQ ID NO: 960301 - protein, 134 aa, Homo sapiens
MAMSTLPTRTDPRSDETPGVFIGRSQSLYVVERMSDVEAIFSKYGEQLVGCSVQYMGFAFVQYVNERNARAAVAGEDGRMTCWPGVVDDYTWAAEPKVNRGEAGVKRFCSWRCTAPLLTGTMTFNVDYYDRMYT

SEQ ID NO: 960302 - protein, 105 aa, Homo sapiens
MNELGSAAGAHLSGHRRTVVRGHLDDSCDAAADDPACVASPYPASSPDHNDRNYDSGSGCICVYIDLGMLLDSSQKLAELKIVADQLCAKYEQRNYGNASVATNH

SEQ ID NO: 960303 - protein, 127 aa, Homo sapiens
YTISLLGILVYRSHLMSSLLCRRKDYVLSLFIIATLITLNTHSLFSQSLVPIAITESLPAVREQRVGLALLSRQSSHAVWPRLRTICYAYSIARSNRPNNYITTTDMTFPKTSSIVGHSRQQTTRQP

SEQ ID NO: 960304 - protein, 70 aa, Homo sapiens
GRGEAALALPWRRAARRGRRLHVGRLVDDRCVVDALSAPVETCDQSTPLMNVPGVLAFVQWMLLHYCNLA

SEQ ID NO: 960305 - protein, 171 aa, Homo sapiens
MAAPSPASSPGGSVLQWWPCMALQGPYLVPVKKCVHGQQAHEGQGIDAPHRELMSREEKPPSQHLQPLASGPVQRRASMLALRDVEHAAWSCWPTRLDLQMGPRWRFVLRPLDFMPAIAGPLLSQLAPSATCPERMAPGCIPLAHAMSLSEAPWAWLQLLRPGVQLQGSRR

SEQ ID NO: 960306 - protein, 233 aa, Homo sapiens
GAPLFCFLKRDIKKTHTTGSKKLLPNSLLIWNTLVGKYFLALRNPLSSPLCAEGKRSFFPSFLLLPCVPSSRVATVFSLFFIEFLTLWVLNISTQVGVFLREVIRACVLWCKNIKYTRRCVYFSLSKYTLERVFPPRCVSEVSLCVCSSRGVSISLPQRFIERVCAFLVCVCTISHTHSLTERGYLISLVERGAPGVHPLSCGWVQKHGTHTEISLCLKSGKNSGGGECGEDV

SEQ ID NO: 960307 - protein, 181 aa, Homo sapiens
MALQWPLILCLVNVCVYIAAMQGPMNGQRNMMPHNRELIVQVMRMPPSHAPDSHWRSEPPVAASGRVHCMAHPGEWSDTCLACGCLAGTTAAVDPSQKWDPQYGGILCSRTPGESHAQDNGEAPLVVLQTLATKVAHLGPKARLGFPVPPIPLFERLLHSCCLQGCATLEPWVARHLECQR

SEQ ID NO: 960308 - protein, 212 aa, Homo sapiens
MAFLRLDRTNKFQAIYNYAIGPNVVGALRGYSQPLRCTPRRDYFSQWMPHKTSAQSTHRSIITRPRPSSSQLIRSFYVLKRPRPRSTRTPHSWVRQLVTDLGAVPDVKCHIARALPRPLERRSDVQVPLESRVDALRISNLMTPAYARTTWPRPRHAPYSKFYNGSIPSTPLRPSAVAYRSSHHLTYTTVGLTFETCCHRRVHKHKNLLWLT

SEQ ID NO: 960309 - protein, 270 aa, Homo sapiens
MDSAYIRLYRECYTEQTLHATITKADRQTCTMEPCAQDECPTEQLAAHIYVHTKSVEIEGTECNKAREPRPILDRMQRNAIETLNAVTLRHIIAHPKPYIISNDRAGKTDTSEAHIIANAVTNSRANPTLDNTHPADNQPYRHNLNNTIDTPRKNKHRTKEINKYKNQNDLYENNNKENSTNTQTRTKGKQRNCTKQQIETHRTQANPGSIHTTSQQKANKTARSVVENNKRAQLNYKADTKRNLVKSTPTAEQSNNKNKEAKEKQRQQK

SEQ ID NO: 960310 - protein, 219 aa, Homo sapiens
PDVEEEEGGGQVEEEEEEEEDEECLRSERLALEWALCALDDVTSCCEHIRILKVLCGFLIHVHGHVSCHVLPALRLLLHLIFCAICMSSDDPCHLGCLCGHACHATFLFSPLLLLSFLSSLHCADSHLMFCAFLIACDAVSCVLNGTCISDELLLFYYLWTACQSLHEFHAGPALMLCTPCTWPCLCSPILYVQPQPCLQEFLRQLLTFYNGGWLAAGA

SEQ ID NO: 960311 - protein, 86 aa, Homo sapiens
GLAYCHHRKDPVPGPEAPRTCYIIDEGAELNAGRLLDKVRSLVHVPTKTYLQLMCVLTHVGTFAPLILVLAGESIIKYIHPHSFDY

SEQ ID NO: 960312 - protein, 135 aa, Homo sapiens
MISARIIALGKIAFPLWLRFVATARGFNVMPFFGTNTTVTGVNAIGYRTQSRSVGRQSFPPYTDHGLETATRAWSAFATLISNGVETQIYPPRLKTTRGNVKPLRLYWHRIIQHHVGAREPVGGTKKSQDPDVFP

SEQ ID NO: 960313 - protein, 242 aa, Homo sapiens
MPFSNRHNALKLRFPGEDEFPDLAAHNNHMANVLTPELYAELAAANEHARAVLHAVTTVIQTWLWTRRATLYIIDQWAAVAVAELSESYEVFNGSHSEPHHRGTWHWLATMPRLMMHTDRPQPRRTLQGGERPCDPNYCAEARVVAHGAEAYRWRYLTSPPDLQACGEDAEPIEEASRWESPCPALELAITGGSEYYRAYGALTEAGADSRLIERSATSSTKPVVAPTAGLGHCPRQADARV

SEQ ID NO: 960314 - protein, 163 aa, Homo sapiens
MREYKRGEAVAPVAGAPGHGQENITGQHSMAGEQRVAPICHAWPTPREKTAGDREDSHAWWPRGAGGHMRRANTREEPGAPEGGEASIENPYSQPAIHGHGAVGPTLQGHRETWNQGRERRSTAVDTLGARCHPRGCPSQGRRNNIPGIKKQNGKPKQEKLPE

SEQ ID NO: 960315 - protein, 102 aa, Homo sapiens
RSEPTLPMLLPETQSPAALDVPAAPGALMHPGKSLMPRCPCDVPWACCLPAPWIPLLSPADACLMCLPCLPAPAGHVPAFLPVCPAAHGLPPDLVSTNLHVM

SEQ ID NO: 960316 - protein, 85 aa, Homo sapiens
AMVWSPGYNLAQRLYESSVWTRWVDAVGAPCGTVLEPEQALAMCASAHRLYAILMDTPGFWVNCCGTSLLEDILTAVNHEWHVPS

SEQ ID NO: 960317 - protein, 213 aa, Homo sapiens
APRWQQEQLVPILEKFCFTPHTEEGCLSERAALQEELQLCKAAGGMALQTKGDPACGLKTGGARTGWGPESPVDPSQHGTAPACCRLPARLQLNGNLHAGAGAGAGPGEAQRCHDGPSAQRPPGLPGTQGLPGHCRGRNMPSLKMKVGGGAGWHWSPVFPTSQCLLSPILLLQLSYTAPTAPQALEAAQAELQQHDVVQAKWDPQTLPSALGG

SEQ ID NO: 960318 - protein, 224 aa, Homo sapiens
PSRTSTARACPCASNISVTAVQLHPVDLIGTCWPRSPAWWHASGSGPALPFSMCVLLQYHKQCATWDVPGQWQLGLPCCELLLMCHGGSSSDVMKKTQWCTTMSACHHQLPGPLVSPCVALLVAFVLFLAGSGASWCLAETSSTGTSSPAFILLQLPPGSVVQLTMSPEVHQSNCGLVLQVGDSLPTTTSIVTELLLDVGEGWYLHTAIVAHIIHDRLRKWMSI

SEQ ID NO: 960319 - protein, 199 aa, Homo sapiens
RVQFGIGHSWWVPGASLQLTTSGLCLTCRHRVQIWDVRALQQRDTAYAPDALDCQRYAAHLSSSGQCTSKQLAWSQRAHLALLTCLRAAIHDDDVCRRICSCRCVQGCLASVACWGRPTARHGSWLRSSGGPRSRWCAIRAACTGKRTLLGHWIRHPTGSLTCSHPRAAHRVVQARCCQRIDVLWARDLVSATQSAAPA

SEQ ID NO: 960320 - protein, 71 aa, Homo sapiens
WIPERKGGRPDCELLVPILRPVLVDTEPSVVPWGLDWMPVTSLPPLPLPLPLPALATPCSLPQWSRPVCVC

SEQ ID NO: 960321 - protein, 87 aa, Homo sapiens
MTHKPGPAESTPYLLIQGHSLTDSTDNNRNLLKGATNPHKSFDLQHDANRGLQPHTERTKHSPDATHKLGATHSATTLQSHYPVGPT

SEQ ID NO: 960322 - protein, 153 aa, Homo sapiens
MSSQETLARHQDRGPGKRSRLQAGWGIEDYTDESSKSAKILTPPLTPVDPSIWSPESMQYSSAVPELPSGIPNALERSRLNSSHRPWPLNEHRGLPCPRHIERSHYSRGQLPTTHSFLTTISSPRAARPKHRTTYRYHDTHPRGILHSPTDPT

SEQ ID NO: 960323 - protein, 209 aa, Homo sapiens
SILKCRCHNTLPLSSSHLNVYSSDPQVTASLDGLTSSSCPADLTQKRELTDAESRALAQIERQKKDNHNLIDFERRFNINDRIKEMGMHDPQGPDDLDVRWNKGTILKASVDYIRRMQKDHAKVQGDWRTLSPPGDDQTRQTLDSDIQELEMQARVHGLPTNIPEYGMNNGWAWTSKVVKQEHARRRGPEEAMMQAAEVQDHEHCKQPD

SEQ ID NO: 960324 - protein, 89 aa, Homo sapiens
RHEETTQCRGAVNDARSGRRDRLHLRRTDENSTYQRGSPESNAEGRPHGATKSVSGTRGVSAAAKYRVVDFQAEREVRHFCILRHQEGG

SEQ ID NO: 960325 - protein, 140 aa, Homo sapiens
MEYKSSYYISRGRKSKSTKNPNYVPNSPIDQFPHLQPVWLCPLRESRVFSLWGSLSLQPQATCGLWPPAESLYVLFLRGALYSLASRPPKLSPIIKVYKRPRRQTPHSPIAVCVSSRGVPERSPHPNCDGGALLCFPEKA

SEQ ID NO: 960326 - protein, 240 aa, Homo sapiens
GGKWGLMTLPRRVSNSWLKQSSHLGLLKHGDYMSEAPHRAKKFPFKALLKVDEPFISCGGRILGGCRSGLKVREQGDLLYSSTSGFPFYTPALKLSGGEHSWSVAEVEGVGKEELTLGGENFSKDLWLCKVVWGLVHLVYYTSAEYHRECASLWCCLGTGGQGTEYAHKEKRTHTVLALCHSQLVHRSGKEEEGLQGVLKVPRGQWCPPQTNDHLCGVQHARGLNSILLTEPSAAQDERA

SEQ ID NO: 960327 - protein, 253 aa, Homo sapiens
MARYEAGCEIAVPVAMEPAGPCGFCPAGELLRLQRSSQPPSNAPYAVLRQQRRDRVTSLGEAVPHAPGPGCPCWPIWDSCVMLAWLPVADKMLPSDAGLLDAAGDVPVAVLAASMCCACGVLEPAGAWTCMLLDGCWIMPRVVTLRMLDARPCDGPLPDSCERCLLPLDALLCRLMLGSLDDVPVGPALPVVPTRIPAIVSLSRGQSRRSCASSCPMCCSAYAHTLALYHGGDDALSLTSVPHCSAFPEPGVP

SEQ ID NO: 960328 - protein, 212 aa, Homo sapiens
LPRGRPGPGLAELGMCGLAALGAGPLTVLLPPAAGACLTPAYDAAAENDTGARRGSVLLDFCDFYGGAGRRLAQRAELLWPAWRGGFGVDHGRWLEQSCRRAPSCAKQHAWECWLVLCLHVAEAPWLLLLRLCCQRISACLFRPHSGNAWTVLAVALPWCMLAGPDLAWRRLHVPLKPGWMGGPDRPGQLTWVLLEHGIALRNWFSSGFLKP

SEQ ID NO: 960329 - protein, 234 aa, Homo sapiens
AGASLRCALALAPCPRWCAMLPVWPAGMMPCDPELVFLAHMCTLCLCPGAWHDPCGCGICCVLCAVPMMLCCAISAPCDVPTVVMCHEVMDLCLSVLNALYCAWGLPVCVLADGFLTVAGHCVQLTLCQQCQAACDLSACPCIGSLPCPGPEGVAFHVLHSVVPWLLHGSCDNVATFIWLVASVGALVVPGGLLMFETEDLVLRKNEKSVVLCLLECGCGVGHAWGLLAHASCS

SEQ ID NO: 960330 - protein, 243 aa, Homo sapiens
GVIPVGPESTPSHITWCVPWCGPGACLTNGAASPKCQPQPQACGKPNNEPSQQPHQCSLPMSPTNGGASTWWLLLVTKDVPQCLTNVEVALPVAAVCSTTAQSTPLVPGPTDPMSWALMGAGPTLSHRWRMVMKGFEENCACVLHVAMERAPGADGQCSRNTSSIASWFGLKKSKLPALNLPHRGPPRTMEGAGGGSPLRREVKMEARKLEAESLNISKLMAKGEDLRRALEEEKPTKQRAGK

SEQ ID NO: 960331 - protein, 221 aa, Homo sapiens
MSLSEEQARSFLDQNPDFARQYFGKKLSPENVAAACEDGCPPDCDSLRDLCQVEESTALLELVQDMQESINMERVVFKVLRRLCTLLQADRCSLFMYRQRNGVAELATRLFSVQPDSVLEDCLVPPDSEIVFPLDIGVVGHVAQTKKMVNVEDVAECPHFSSFADELTDYKTKNMLATPIMNGKDVVAVIMAVNKLTAHSSPAKTKMCSGDPEFARCPKII

SEQ ID NO: 960332 - protein, 110 aa, Homo sapiens
TARYEAGWRMYTYLKTGGPSRLSSLLSTAGLSVLRALRTTPLPFWPNQPAPLNFSANFLPGKVPAFDVCDDGFLCVLRATAIAYYCDAHDVMLLGNVLHECMHAQCGAVG

SEQ ID NO: 960333 - protein, 125 aa, Homo sapiens
MAASSGAGNSLLMSGYGAVWGLRAECRLRAFPERLAACGGRGRGVRQCAVHVPPLAPGLACLSNGLLRCWEFEALRSCFACCGSVGCWAPSPLPMPFPSKMPAGPRLSFAFPVWFNGLSCLPAVL

SEQ ID NO: 960334 - protein, 289 aa, Homo sapiens
HADTGPRPRQLNLRHEAAHRPSTPPAARARIPHLPRLRRQPAPPPPPLQDHLQPPYPTPKPRRTPPASPSPPPSTLPPFPLSTRLAPPRSPPPTPPPPASSAPRSPPPCLTPPSPPPAPPPPAPPSPLGPPPPPPAPPPPPAPPSPPPPPPPPPPPPPPPPPPSPPPPPPPSPPPPPPPPPPPPPPPPPPPPPPPPPPPAPPPPPPPPPPPPPPPPPPPPPPPPPPPPPPPPPPPRPPPPPPPPPPPPPPPPPPPPPPPPPPPPPPPPPPPPPPPPPPPPPPPPPPPPP

SEQ ID NO: 960335 - protein, 104 aa, Homo sapiens
MGVMEKTCNTQKKGAPVAGNGFPQGWVSGDLPQYRQGTPFGLAHLVGLGTQEAWSRTLWALNDVPDWDSVGGLSEPVWSSDWVLGAPIPRVCWGGGKHLLLFKA

SEQ ID NO: 960336 - protein, 125 aa, Homo sapiens
MGECRSMVSSPGWGNIARPVSIYKKKTKKTRPILEGGNNRVHTRGVQIINTIKGAGSPKGNVGQHTQHNKKTTSGGSTMAGAGHTGNMGIGHTWSRNRFWAPGEQRARHKRRQTQNTGTEGDSEK

SEQ ID NO: 960337 - protein, 136 aa, Homo sapiens
LYVLGTDGMVLLTLCTDGLCAGVGPSACWGCVLGLCCGCLAADQPVDMTEHQMPLLLVYCMCERVAADVADNGAAVKHMMLLLDVLRAVDLYCGAPTDLLLSTTSCCDVMRAMLPACGQPLFTATKHACMMTCGFR

SEQ ID NO: 960338 - protein, 189 aa, Homo sapiens
SLVPLETVLDMLRDAMVAKVNTSKGFLIDGYPRECACNGEEFGATGFVTCPHLLLYVGLQALETMNQLALETVDEDQAGAVLTTHEETIKKRLDDLLQGHRNRHLPSMRNWWAFVAHRSTLRAPWTVGFFPGSCTTLECPKVSNCWMPRFPRVQSARATPVADEEGFLHWVPRKLQENVTKPYSLSLFT

SEQ ID NO: 960339 - protein, 53 aa, Homo sapiens
MKIRLHKNKNKREEDNNNMKKNKQTQNTKTNTSTHTIVVTQKKDKHTQTDNTP

SEQ ID NO: 960340 - protein, 110 aa, Homo sapiens
APFSAPCDWQMVFLQKYPPPLIPPRGEVNAADAFDIGSFDEEDTRRNQVTWTCDQDALPATSPSTDLSYAVCACMDGGMRLSSDTDQLLRHDLAGWLARNAKNNACLGHE

SEQ ID NO: 960341 - protein, 120 aa, Homo sapiens
MERKKPGLVNPFRRHVVQAEAGGMHTVCLSKKWQVYTFGCTDEGALGKGHISGGLERWSLGRRGARNEKVVQAVSRRQVEKQPSQMMAVSSLGHLPGQKRWDRTGGPMKKTWCWAGELKC

SEQ ID NO: 960342 - protein, 271 aa, Homo sapiens
VPVPRGGAGTVLWLPGADQPVDMMSIKAFTACLCCVSGGAADVVLTRMAVNIECCGVLLAVDLYVGTNCCFVYHFLLDVRGHVPAGPDHVHCLTKAAVVRHLGFKKPVKRAACCPQHSTVLLGACVTTPYSLVNMLEPRASAFGGPHQGWHATFALNENPVSWGPLLCRTFASSSVKRRTIQMFLFVRGTVLQIVKEVSIAEQSLAVAFDGHFLCLGLTRQSIIRITCHVVSMTVPYCSEEGGDRRRWGGVCAAGGCFFRRVPGRGSVVGV

SEQ ID NO: 960343 - protein, 47 aa, Homo sapiens
MGNDIQDGPQLGSTQSHCRLRVPQQETLSDHHARFNRTLRPAYNSTN

SEQ ID NO: 960344 - protein, 112 aa, Homo sapiens
MPAMALFTSYQSHCGWRTNWSFSSGSGGGMSLSPGAKCEGGGHTGYDRAHVANDRFPRVPLFSWSRVGELADPQKGRQKIPMGPVHLYVVHHTQMKAPCGKTHRQDCFTKGG

SEQ ID NO: 960345 - protein, 353 aa, Homo sapiens
RLLISVIVDLSLSLVQSILTGRRLHLLPSRPAEAIAHLLKMAKFMTPVIQDNPYRLEVPERFPRQFRDMPYQPYQQRRSATERLADWTASPHNHRLTRYTQVKLILLSLRLAAQRSNMLYFPMHAERLENATPYPSPELGTYQPAANNHHNPPAPLPNAAHTSATPAPPLWPPTPPRTPLPRPRNETTTSNSSSRENPLCLGNGSPKPTSRRKNRLDAVITHASPPKQPLHHKRNASQPTTIPNFTRTLGPTQPPQRLPPNANHPKPPRRRGFKHATVETLAAQLPTTKNVQTSHTATPPANVNPTAHPRHPTARIPAQALNTRRQNSWNTRPSSKKHGGAYLTSILKTLAHF

SEQ ID NO: 960346 - protein, 223 aa, Homo sapiens
EEDDAEGQDQDKKSPKPKKKKHRKEKEERTKGKKKSKKQPPGSEDGMLCGEPVCMKWLLPDVMDAAPCRDVHANSHPTLERFLMYNIDLVSILWGMSCSELTCHVSLVCHLLLVRTVMHACISTRACELSCARTTLKCHVMAPACRGYLLSTIGVPCAFPACPRRLQLKPSIVFTIQSIVMAQKLKGTLSFIAKNDEGANHEKLDFRAALQLQLLLDHQSLLQ

SEQ ID NO: 960347 - protein, 233 aa, Homo sapiens
AGLLGSMDGRLLSLHSPAAEVMAGLSAVRVSELCQWVIGVCLYYLQFSLTPVWATWSVVPECMCCCMPAVNVSPCEHPMMELEEMPHPQSLHVSSDVTATWMLGNCSVLACVVRPLVAIGVLCAQWPLDSLSLCGLSPCDVHAQWTLVVTCDVPWLGLDVQRMGTVMWAAVLVPNAPVQGPSAVPTVEGTSLGWVALWLHTRRAMARLPLPCPDVWRRFRHAPFLALHLQVHA

SEQ ID NO: 960348 - protein, 266 aa, Homo sapiens
MACSLMDELLCSIWLSIYQDPVSLGCEHYFCRRCIIGALGAGMDWRMGRPRSAPSAVAHVRRSPRWRPDPPSLAETIDVSAYQSSIARWHANPSTATPQLCADPCSRRTIKGQRLFCSHGIRRQLPLASFLLYRSRLPNSRSQPNVYTLRQALGLIWNLTDLSVADVLGPVGEALNVGSETVSAPCKGSRTRQGNERPRESARTTGSRVELTWREAPSTSIEEPADRLSGEARSEPAGDPVLAGVDTAEHEAMLEELAGWTLARHA

SEQ ID NO: 960349 - protein, 194 aa, Homo sapiens
HTDALAFTSSSPSLSSPSRTPPPILARNGIKQAPRNHLPLPIKIHRSHPLHTESQTTPCGITSRSFVCRVNGHQTHIRQRETYLADPRRSMTHSRSHLKQRHHPTIKSRSEYVAPECSLVTISRGSWPVTKAEEASCAPITSRMPQSKQLDTPPPKISRSSNRGKSRTQRMTEVKTEASKNESDNHTTTAKGRS

SEQ ID NO: 960350 - protein, 114 aa, Homo sapiens
WSPEIQKLIAMAQCSEVLWVLNEPALMAELLQSDELGLAAGCPAPVPDGCLLWMQLVMLCDEDDVLLCAMHVMLLNCALCSCVPCSTLDACDACWCAACMQLAAVLYSDVCGLM

SEQ ID NO: 960351 - protein, 179 aa, Homo sapiens
SPLPPLNHIPLGRRYPGQGQSGLITPGNTKDTRRHRRHKRKKQEKRQERNTSTKTARGEKKNQKTGTTQKNKQQEKHRTNTKSTKRRQTKEATHKNKGTQNENKKTKRQNNTNTNKHHKKHKHRNNTKETHKTKEQANKTTKNKRTQTSPDSTQTQQRNKAETNIHNHTQRQHRQHENP

SEQ ID NO: 960352 - protein, 172 aa, Homo sapiens
MNRLGDVCQNPCGSKACLRLFVPSVTAEQLSLDCDAANVLWLHPVRPCELDVNFDFVTETPLEGDFAWELCAGGLGPCPSSTFPLGAPGWVPGIDVWCCDVHVLDLWHLTLLLLACGDMHDVNDPCCDLVTLSLYPMCARISGEHVLERGPQCVTLGDSSGVRKTAVARPCN

SEQ ID NO: 960353 - protein, 107 aa, Homo sapiens
MKPHASMDNASFPKNPCTSMHATECDAWMSTMPAPWPRLCCTLVYSSDMMRTMHVSPKSYSAGKSKCKTKCSVLLPYISIFKTRNSSSPNLVYGESGWMSSEDHCCS

SEQ ID NO: 960354 - protein, 121 aa, Homo sapiens
MYTRVSAGSKPWVEQHNEGANNIRGSRVDIRTAAVQQGGNSPGSQRVCLWYPPIKHNAFTTGLSSDERGGTTTQLREGSGGNHPQTKTYDITGRNCTTPLLTKKYNAESSMHQQEQTTHNT

SEQ ID NO: 960355 - protein, 98 aa, Homo sapiens
GLASLAGRREALDGSSRCVVWCSPSLSSPSAPAPAPGPPWRRLMLIQNGQCWPDAWPELLTDDMATCMNGSDLSRAPELSNEERNLLSCGLQERGLGA

SEQ ID NO: 960356 - protein, 267 aa, Homo sapiens
MAPSSVLPALSSLPSACCSCTCLCYTWAAWECFLCVVSGPHVPCVSSLCALVLGCGVSCLLCLFQLVVMLCLECPSAILCVVCVCLFNPHVPHYVAQVVEGSHLLSVAGADVAGDCSVDPMLEPTPKRAWQSSINFTLQLKVKDVPPSVGINMPQPVSPAVKRRDVAQAGVAQAGQSLEPGGSYPVSLRIQACSPVFLCLAWGSSVAPMQRHRWIRGVHLWLLALHLRESISSPVSLCRWVPRVGDPCRLPAGSAAGVVLLLTPWCC

SEQ ID NO: 960357 - protein, 68 aa, Homo sapiens
QANNAVLAPAGLAGALLTLLCMGLLVSAVYHLNLSPQRVQGTPELSQPNPGPPESYSYTDVLHLQLND

SEQ ID NO: 960358 - protein, 264 aa, Homo sapiens
MSRACGAACWPAALSPWDSPPSLADPCCLVAVSVLLAVLWHVVLLVHVVMMWLCSVLWVYACLLLHALPGCLWMPCDLPPAFFLHAVLPSLPPCASVLPCLPSCLPAAPWLCFAICACDLVDVCCPACCLSLPCSVLCALCPGPGDVLLHCPLLALLAAQPLHALLIVSRSWLISCACGAVLIACAVLKLSESITVSTVQPVESCCRGAIFLPANMLPNPAKPLPCGPGWSSCACAPLCSSILLAGGGSLCFVAKNSMVTLSAS

SEQ ID NO: 960359 - protein, 143 aa, Homo sapiens
AFRLPTNNIVVKTSGVGPTNLRIEYQERENSEWGLLSYVVVTIHSLTQLWTGGGSHRGSTLLVCSEVCAEGISAEQGPRKPPREAGTWFTFYLDHNRPLPAFQPPIFCGEHLRGEGSPINKSGPGCHSWGRALPTRLKDYWEN

SEQ ID NO: 960360 - protein, 242 aa, Homo sapiens
RLERPGVNQAEGLPYNLANNCQVRMLAVLSLVGCYNLSFIPEGNAGAQLLLESCHEEPAVGMAFFGLTCVPAAMTAVPVLSGLFNLNVHPGPSCSTIARGLGVLWSVDEDTILCCILSVMLNLTLDSAAVLTTPMDLFQHALPCTMLCNVWRLQGSSCLDEPLSDSVLLAPVANGRQLAMQRDGLPDLSLGRVPNLMDLHDATSFEKLVVARGGPTEQGSMGGSCGGITPVTDDRVNRQDCQ

SEQ ID NO: 960361 - protein, 154 aa, Homo sapiens
MEQECNPSTCGLCVFRSTAQPRVSCSNLTVWLSDLCDTGGEEWTAQTPQVQCDGGPGMQMYAWALHAPCCENVHRGDMQKHHASRCTLKDPCWCLMGVPMLSHHDACPQGLELVAGCMRQLGCVEMWSVVIKNHMQNSDPHAELLGAIAIPPRH

SEQ ID NO: 960362 - protein, 111 aa, Homo sapiens
AEPHLVVLFRPPCQLPVQTSSLVGAPPRQPAPSRSALPRGGAFFSPPRKVPSEFFGIFPAGGKFFPQVGGRQRETPYPIRAIAFPRCRYPQRFKVFPCARPFNPSCEPFPD

SEQ ID NO: 960363 - protein, 240 aa, Homo sapiens
MVRIPPSDLHCQVPTLALGAHSTVLVPSVSCTMVTVLACGEIFEWERLCMTVCVPTASSAISTKISYKDGLDELSVLGFFCSFMGCDLGCCLIPCLINDVQVMDAHMPQLRSRYIYPYRMLPVLTGFWDSGTPPACRSGPLCFAPLRSVVHLSRSHLGLGTPVPPSPRSPVLFTLSLSCACFTSSGSHFSPGDSVCPGVVVWLGACTWCLCVAGCLCVCGEISAGGLLGLFSLPPCGRPS

SEQ ID NO: 960364 - protein, 120 aa, Homo sapiens
MACFNCADVGAAASVEGVLLLLIWVCLLRQSQSLQPEGSLGPGALSPEPDAWSPELSWRETCAPCLVPLLPPAVAMCPVQWMWSELPEVAPHINMNATSHPAVATVGATWCVPRSLHAVF

SEQ ID NO: 960365 - protein, 121 aa, Homo sapiens
MNQGVEKGRGQKNNRGTGSGGLEKHMVVGPQNAGQTRYIQRRTSHTSPQRKNENVPGKYEAEKPRVTLSSEQGCGSLEKPGNGNTRGTGANQRTPGGLVGPTSKWPHTNLHPKVTGRHSRV

SEQ ID NO: 960366 - protein, 73 aa, Homo sapiens
QDVLYLHLGWPAWGGMSHTGPAASKMSSTFICGTCTGHPCELFNAASPSMFTAMFLCARPSCTGYTVLSGACD

SEQ ID NO: 960367 - protein, 219 aa, Homo sapiens
MASDVLVCPVCCVPCAWAWCHVVMCVPVLCMWCCGAFMLKCAAGCTLAADDAAGVELAPCSREVGGLRSAACPSPALRASALLLAALTPACALAMCCDLCCAMHAPCVLDVPAPLANALCVSPVRLTAHWMNFLKCCCILNDVLTMLCVAVVPECDVLAPGAPGPFCRPGCRGAVHMRVKEVQQMIRNLMAFCHLPSIAHASHCGAICLQLACWLGPPP

SEQ ID NO: 960368 - protein, 212 aa, Homo sapiens
MDDEEETYRLWKIRRTIMQLCQLNCGYLVTQDELDQTLEEFKAQFGDKPSDGVLSAGALDLTCAGGPQLMTPTDTDVCCSIPEEPKVVHQDTIKVYCQRMQEENITRGSHRWMQQGMTHLLPSSPMVRHGTPSTITWSSICSSELLINITEHELSLSNVVMTKAGGDTRLLALIYCVREHQAAQDPVREDTVSRYYGNKRVQVVKSIGPVKR

SEQ ID NO: 960369 - protein, 126 aa, Homo sapiens
MGVTCMQHVGCNPNLANRPLGNYCGQPSEDSENADVPSVIINALLTGLSDRCPLVEHLAWFDLGPIEAERAARLLDAIVQPAVVFGLAPPLCALQVCESSCHIHSMGFTLVPPEEIRSVYLNARTL

SEQ ID NO: 960370 - protein, 193 aa, Homo sapiens
FKEARQNVAEVESSTAMLQQAIILSNTLYSTCIMEVIYSVKQLSSVQAHTSPKQTQTYWRKQTQYIIPKAQNIAQAWQHGPQSSDYCKFSPQSPSAKGFCSYPCSTRKTPADPNTENSKSTPKKTKDLIAHSLVTVMAEKQFRAQQAAQALFCMHSTASKGFYKPVFHCLTDSDSGDDFFMGTVSTDTHSTAK

SEQ ID NO: 960371 - protein, 148 aa, Homo sapiens
MVTQQVLKMVCALDWIGAQIPLVPLTAGTAPVVVGCLQASAQREPCSWSWRRCWPRRGPSCQRTPLLRRLLDSPALKGLPGHLPWRTCPALKDDGGGRCWLATVTCIPCIPGLSAPHRLLEAELNGHDRHPRPVGCQCELKKHDVARQ

SEQ ID NO: 960372 - protein, 198 aa, Homo sapiens
KGINCHINVNDCRWCSVSMWGTCKDLVNWVPDVCCPRVASVRPGIAELELMTECASSPCHMLLASAEDLADWLPLPLPPVASPWPLCEVDVLTFVSQCPCRNGARCYNLEGDYYCACLMTLVARTCSVPREPCPGWGLQSDLMAAGHDAVAWDAWHSSLLACVAPMDAASCQPGGNFSCICDSGFTGTYCMENIDDLP

SEQ ID NO: 960373 - protein, 154 aa, Homo sapiens
MTPDLLNFKKGWMSILDEPGDASLPLDSPTSLYFAVEETLDDVLDRFKVVKYYEETPLLRRQMSWMVRIDSAYRAQECHCSTAVQRNLWLPDPHRMDAVYTLSCHDLMASGRNWIESSDERTVRPNFSPSIVTKLSDSNKENALNSYSTQKGPP

SEQ ID NO: 960374 - protein, 138 aa, Homo sapiens
MEVSRVSPMSMKEGEPRIWVLGSEVMRACRPSAGLCTLPAPGPSEGPRAVRRPSFQLQHFSIGLQQIKPLRIAEDRPLQKSLAGWDPKLRKANSSSCPFAGRITVPCPTPSMSSKLNLVISSEQLMSLLHPPLLLDER

SEQ ID NO: 960375 - protein, 50 aa, Homo sapiens
MQTGIRLWIAWCQLGRGQGRELIIGDRQTGKLNAMTQIINQKRSMMDLMK

SEQ ID NO: 960376 - protein, 71 aa, Homo sapiens
QVVARQMREEEEEEEEEAECLESECCPRRKNGPTVVLEPPPEPCATRRSWKWLRVGRRLWLWMDAGKAWVA

SEQ ID NO: 960377 - protein, 66 aa, Homo sapiens
GRFSARKKLTKRLSDRLTSCGRGIRQRVVLCMDVGFTMSNSIPGIVIPIEQAKKVITMYVQRQSDR

SEQ ID NO: 960378 - protein, 206 aa, Homo sapiens
MTLAVDSGCLPVCYSPKCHHHVTSSIAPVWQDLVSGGLWPPPPESNLDLHVELPPCSWPWRPSDINKDPYFMKNHLGSYECKLCLTLHNNEGDYLAHTQGEEAPDQPVPCADVMPNVMCQWMCPLPMPCQPDECVNGVSVKKFVNDLAALGYKVTKQRDSEMGQQSLLFQIDYPEIAEGIMPRHRFMSAYEQRIEPPDRRWQYLLM

SEQ ID NO: 960379 - protein, 188 aa, Homo sapiens
ARYEAGCWREACFPSVCRPDAALQRLGAVLAGYGVELRQVTPEQLSTLRDPGCSYVSQGLAGKNIPGRVFVQVLLEALEYLTETHRSEHGRHVVGRASSTASESSHCPACILSYDFWNNAPIVPDAAYQRLTLKVSMAAVAYDAHSSSCSRSAIGWPGSRLDDIHVPARREQDRLADWASKESMSRNW

SEQ ID NO: 960380 - protein, 79 aa, Homo sapiens
LLSAVIGEGWGERCRSCLAARAASPRSPMPGAACSILGSWAPVCDGSADQSEKAAGRLPPGIMSAKDELGQGDPEGLQT

SEQ ID NO: 960381 - protein, 176 aa, Homo sapiens
ELVPTCAAKAGRLLRPAALPDAAAGGGCAPCACVFALICVLLHLCVSGYSNAHESKQMYFVFNRNEDACRYVQCHRGAGLPVPRLSSWLVDAYFPQISNATDLQYLVIGDLLFSVVVLGLPVPTSCYNGWLLDELHPELRLTPLRDPKTCYCLLPSVHLVDNYQQPAYHRRTAETT

SEQ ID NO: 960382 - protein, 235 aa, Homo sapiens
RCCELRCLLALCALCCGHGLKLIIPNKQPKAMVAYPTQPWAGLFPAEQSCPTGQQMLHVCYMPCPRNTSVLCAMMQLFFLCARARTCYVNSVKLPQGICARLCCEYVHVANECLPNRLYWCMPCPHYPWTNWHSKAMHHTCMQPLGEVTGVCMYLHDAACYWSKATMMLGDAYSTCSLSYWMGQAAQCYGHDKRKAIHPPSGGYGTRMKQVQNGEMVVEGGGVEVEVTMAKINPP

SEQ ID NO: 960383 - protein, 279 aa, Homo sapiens
MREIVHMQCLGQCGNQIGAKFWEVINDETRQSTPRDTYHGDSDLQLERIKRCTTMSATGGKYVPRAVDLVDLETRTTMDSVSARGPYGQIFRPDNFVYRSEWCMGTTGPRGTNTEGAELAWTRMHGCEVRKEAESCDLPDSGYQLTQLTLGMEGTGYRGWNTLLHTSKDTGSEVHTDEDQSSTYRVGRLRPKDVRTQGEEALHRQRASKHQHSEKNNDETYGSEKKDFANERRTKSDNAHYGDWNLRWMHKRGNPGGPKRQEEERRKTKRENRRTRKGK

SEQ ID NO: 960384 - protein, 218 aa, Homo sapiens
CSGGARGALVALVIGNRGGVRGVFRQWHPGPWVAGLWTGPGPRPRSSRECKAEDKGVDARHQVGACLVKDMNDQVPGGDLSSSRLPIKESEIIDFIPGGLSHRIEVFGEINSAVQEADPVPGPVCIHVFKAFCLLICEVLTIGTRRYQECEKCSNGGGHLHTVVAIILAKLSIVPVRRGYLVVNKIGKPHTVPCKVTGRCGSVLVRLIPAPRCTWNRL

SEQ ID NO: 960385 - protein, 220 aa, Homo sapiens
CPHCTECTSVFSSGAADSELAHGIAWVVPFLVLRAPVTLRSLRTLEDGPRTSSSEFPWEPRLRCIITSIAQNDSWTLTARMPPLTKATLHACFPGPPRALLQPLRETEACELVYPGALQWSSAHGMTVSGRASPRPAQPQDVSHQQLCLVWSAVPVVCVLCSCETGAAGLSSHPCCLPVPLAARVNTDKRERKDFCSPQVTPVPPEPWVAVIWVKLGECP

SEQ ID NO: 960386 - protein, 42 aa, Homo sapiens
MRSRHNRGMKPDNWIPPAQGNLGQIWVAGRRAVSKYSAGNEL

SEQ ID NO: 960387 - protein, 208 aa, Homo sapiens
LSLFYSTVFGQYPQTRWDTAPVHTSIPGLPSQGSLKEASFRGQGSGRLLLSLSPFPFGPSLNVTRGVVGGWWRAPLGSPSPTVASTNTPNEEARGGLSLSVAHSLLLPCLSEGARVPLRLCPVNSSSSLHGEGGRNSRGVMKPGGTTMGLGGWDKQAQGGNEEAAAAEECTPVGHRPCNRGAGPGWPAWVRVLHLLNRCFHQPEEPIY

SEQ ID NO: 960388 - protein, 96 aa, Homo sapiens
MANNKPALTGNSQPQHHGRMACMLAHAISMHVAVFVLDVLLAKAGLVSCAKHVADVCSLLMGQLRRHMNASSSHDPRPTILSVALLQMYSSTSSRP

SEQ ID NO: 960389 - protein, 219 aa, Homo sapiens
MLSHDVWMLMVCCRVLLWLLCPEWRRAAVELLVVWLLLRCVMDDVSCAWPAWPRSFFTCMELGSILQSFTTCQLCDYNEVSFTKVTGYHSPAQDSTDVDFSIPEFFHGQKANGYPPDKSSVIQEAETISAGFWKEKPQQHNFTHQTPGLQLLNDATVLWNIYFALDFSSNGKYLATLLHDDLTIQHLEHQGLPSMLMITCMHDSQLLELDNATLVRFIP

SEQ ID NO: 960390 - protein, 211 aa, Homo sapiens
PRNFPTVVYRASSGLGPLDLRATARLGRRCSPPSPVSLKAVKCLPAPPRALGSPPSVNRASPSGTPVTAERDAEPASKNAPWWDLVVNIDNLCALGGEVSCGGRSSAGDGRTERRSRMVRRRRLAATFPHLRRNNGPRAMPWPGASRRPRLPARRAAGACSFPHGLLPPGPSFPTLGTRSDLHRADPTEPPRPGLPGPDDPARQSGQAPGP

SEQ ID NO: 960391 - protein, 241 aa, Homo sapiens
EGTPVNGCSSPERLALPDYEYLGSGDIVLTYMERCSVPAGYQKQVRILSHTMAIRQASLTASIFNYAVMTQRSDDDQFSYVVANSRLSIAEADRPDEIGVSIMLTWPLLGDAFRNVWGQRTLCRYLLDACTENSQLLLSRKLLCPDFPLELTHNSTQDSAHGTMPLELLDVVFQDCLFAFQCPVLLLETVPGTVLAAIYEDLLSGMNPDTVIVPTSSSGQWRDSDCLGLGPARWRAWGVLS

SEQ ID NO: 960392 - protein, 69 aa, Homo sapiens
RTSTTYPLGNKVSMQRMTVSGDKQGQSQWPVSTNTVGQLSKERGTGKFTKQVARKFRNIYCNSDTQLLI

SEQ ID NO: 960393 - protein, 251 aa, Homo sapiens
VHGLLPHAPIHSASLCTSARRRLATRETVRGHLRRREDFLKTVEGRELQSVKAPGGLPQGNSIIPFVSRIGHIDTAKITSTVIAHGPHPSRLAGVIGWMGWCSQALLNGAHRGDPQKVSGKRERMRVSTPRSLSPMIREGMHPQRGAGHDSESLGKRELPEEANFMSAVPVDGPMGWHAAGHGLETVRRCIVRACNQVVKPRGQLTEAQGVRAGLLAERGPGLDRNGPPDARPDDGSKERDSSGGLRAGAA

SEQ ID NO: 960394 - protein, 258 aa, Homo sapiens
RERQEAPLENGGGGDSGSRSLELGCGAHYSVNTSPPRETVSPIPGSQRAGEDLPGKPEVGDPGCAMSWLMPDGEADPDCDGWTDGVTGHDGVRQQSHGEQLHDSEEGPGDKNKGLAHVKPNETTDKNMCCCPIPNPVSGLHKSNLLVIACLLSATTWGCMNCETQKTGTSLGPRHSVQTRDLRTGGPTGVTMHASMWDHHEAQREQNPGCRRRRGTSGTRPRYKRKGLEKGLQQQDEKQRGQLERASRPAPVQQAKPV

SEQ ID NO: 960395 - protein, 176 aa, Homo sapiens
MGADSKETPVVTIDTQTGRIEDITMKRLDRGDTTIKLMDYNPQITTQRSIDTEHAKTAQKTKRELTMVSRLSLEDDGEYSPYMRSLTKPEQQQRLEKDVNTHRVSTKTPFREARMQTRQGPLKTVEKERDHRRNTHGNKKNKIPMAGQATGNTPKGRVAQDADRIETVENNHRKPI

SEQ ID NO: 960396 - protein, 34 aa, Homo sapiens
MPYHLAGLACGTALDGGNTHEEGKRAVGNNTMGD

SEQ ID NO: 960397 - protein, 130 aa, Homo sapiens
NFSDKLGRQVIRHQKDLPAVGLLDQRYARAPVLGKLPAWIRARVEVKATLGPAIAAVRKFHRGESRALADGQPQHCPGAVPFLCRCPLETVFVVGVVCWGSCYGTVNSQEESVESSSRWQVPRAQALRSA

SEQ ID NO: 960398 - protein, 132 aa, Homo sapiens
IPRQDEAWFKSGRGPPRPILGEPPYYSALSFLPSPSLGARYDACPGSTYTIATYIPTLNIADQYTSRQSTVIRQNETKRYPPGKKHDAHTDMMSDDMRDYVISVHCFLLDGHEGRLMQHAATTDHALMIMEC

SEQ ID NO: 960399 - protein, 143 aa, Homo sapiens
FVYFLLLPRRAAAIMREIVHLQCRAVLATKYVRQVLGGDQQIEHGIDPTGTYHGGQLTCSWNCITVYYNDVPPGGKYVPLLAVLVDLEPCAPWTPCCSVGPSGQIFRPVTTSYCGQSGAVEQLCANGVHYTEGAELVDSCAGC

SEQ ID NO: 960400 - protein, 131 aa, Homo sapiens
MAISCGRLAAIVARECTAGGLEGGGLYAVNVINISGNFYRNNVECTCAFLRRMLDEDQPLPGGPYHFRGPQPASSGLDLCDGMLPHKTKRWPGLLCDRLNGCFDCASHLPYDNEKCWIVCVPCCPQVSVAV

SEQ ID NO: 960401 - protein, 155 aa, Homo sapiens
LCGLWTKREYQYAEIAKDDSGAPPWGMNMISGLSYGALNASYQCRPGRDAAFPLLNSPGMLEPWLRQQPAAPQPLMTWVPLVEPVAQQQDSERAAPLALPAPSISRPCVQVTWRIQQMAEEDMACPVPPLGATYRQRLVGLREDERSLEEELAGE

SEQ ID NO: 960402 - protein, 267 aa, Homo sapiens
SLSLLSFDLVGCVRSPTPRRGVFFSLVGWRVCLGCVFSSLFFFSLSSRGVVCAARGGWVSPTPPSLRRCGCAPPESVRTILLVCCVVASHPHTHLVCVCCAVVLCMHPTTTRFFCVVEGCVWCVWRRARPHTHARVLARLAPFHVCVLVLPLCVLCVLVCVGVYDLLSLFCVVCGAHSHTLHYFVVVCVCAPPCRVCVTCVSSLSRRDCGGCVVCVPPLPVWVGEIYAHAAGGSHSLVWVVFDEHSFWPAPHIHWCLVSPPSPMVVD

SEQ ID NO: 960403 - protein, 256 aa, Homo sapiens
RGSDARLIAIFKENKRPSKEMQVTIRSSVGLELNTVSNFFMNARRRCMNRWAEEPSTAPGGPAGSHGHFLQRPEAPLATAALTHDYNGLGAVPPQSPPQHPARPGDHDHQGGKLKRGAIQETRHNNQRGKAAKASHNDASMDHNTLHPNKRGPGNYITHQLLTELLPYKRNTDNSTIKQNPHNPAIRKQPSKRDTTPSTPHTNERSDQTRTRNKKTRGQHGRERTARAQQPPHLNTINSDINNVDMNTRTTPKNTI

SEQ ID NO: 960404 - protein, 169 aa, Homo sapiens
PTARYEAWFADWEAPGCPSKRRKIESPDVDQASFSSDSPRDDTLTEHLQSAIDSILNLQQAPGRTPAPSYPHAASAGTPASPPPLHRPEASPPFQSQRWTRRQDVDQITPGRLPIPRSPSSTKTPGPARVVRPQTPGDLEPGIPRDGITCLSNKSHKGLLPCRLLQLGC

SEQ ID NO: 960405 - protein, 175 aa, Homo sapiens
MVDLFPQAPESEVEAMRCQPPRMLEHATMCGLNTICHPERRGISLNKLHQSGRPQVEESYRALRNQRRILETILTECCLTVALPMKTATQGTRSGGTEYNPGWWQLEERKSNTKEWHSDRLPEELRPRGGPRTPVSKACKEKLTKRVRGSRRTEEERTEKAREWKKVQETGSEKR

SEQ ID NO: 960406 - protein, 169 aa, Homo sapiens
MRERRERAPRRRGGAPLGGGRCRSGLSPPALSVCRRAVSSLSPRLVGLLGRAAAVVRLYLLLLQLCARLRCAGPSARCPASSFPVKAGAADSSLRRSASHLCPHLLPRGQRVPPRHLHLLPRSLQDVPPSVFSARSFIPHSPTLEEVDGRTDATQQPAPTREAASSFIL

SEQ ID NO: 960407 - protein, 181 aa, Homo sapiens
GKKRKGLILKRLRVSKRGLFGFKKGQGDTGGLRRGPWVWGAGPSHPQAPCPPGPPSAGSRGMAGDEGGGLGRGWEAGETPPGSPLNTEGGWGLGGHTLNKTENKVNLKIKPGSPASGLCWARGTSHEPSGNRRGPQGLDAGRKGPGLWDPHRGNPLAPVKGGQGGKKKVASLPGGGEKMTL

SEQ ID NO: 960408 - protein, 262 aa, Homo sapiens
HSASTEAACESGRGSAREQEPRLCLIRRPYTPCRSSPWMMISACARLSTTGSVHVQWPASAGDDAPRADFPSICGVLPQCTSGVMVWHVVMNVIPYVVLTEAQSNEDGILTLNVPHRARHLYTQLGRHGENLGTTTFYKELRVAPEEQPLCMRDLRPPLNPKGNRENDDPDHVLKSFKTPPDSVQYAIHGLCISLYSLLVTYHWTYVMDSGDGVTHTVPILRGGIAITPCHPASDLAGLGLLTTHEDLTSAVRSQHGDGMSY

SEQ ID NO: 960409 - protein, 142 aa, Homo sapiens
KLLYSSVLALFDACRCYAADTWAVVVHESVVSVNTLMMALNEQQDQKIQQISYGKLIRDTHLLKLLKTEEGHAYGVSYMHGVQMTTILVLVAQMTALSFGYGIVTNRRTKDKNESQIYMKTSNDKCGLESRWEALYVTGGPA

SEQ ID NO: 960410 - protein, 86 aa, Homo sapiens
MTPWATESSCGAVEYLCRVLDEDPAVGAVSMLAEPNDRKLELTVDASKHVGADDLVSQLYKIANADLSSTVSADCETWPRNRSRTH

SEQ ID NO: 960411 - protein, 104 aa, Homo sapiens
MPSASRVCCCLGRCWNCLHGLSFGGAAASRTPVSLEGMRAFTAVLTVDSEEPTLQGGCLWSEDLWRLFVPALAQYRRIADLSHPSGPLRWSFICVRLRAEGRAV

SEQ ID NO: 960412 - protein, 226 aa, Homo sapiens
MKIALYLYSLWFGYFWQQKPPGSKVSDVIPERVQTWKSGPGVVGAPRGPLSLLWARRPHPQGNRGSPGGPALTVHAWPPPLIPIYRLTHSLCSSRGVYTVPTCVCRLHTVPCEMWAPELSTPLCDSPVTERDNSVTTSAKIARTELSVTVKRGFCGAQTKSVIYLSPEMCSLCASTVDPEETSAATKEAGQGGALLLSQKRCESPSERRHSLDGNTVGISSPTLSL

SEQ ID NO: 960413 - protein, 209 aa, Homo sapiens
GSDIVFKPCVAFPERTAVMPREDRATWECSIYFLKIIQLLDDYPKCFIVGARQVWAPSTCCTSACPFAVNGCVCCMGKNTMHALMAILRAPGNSNPCSVHEICLPQYRGECAASVLHQGSDLTEIRVHVAWPIRCQLLPVLVPIAPCEVTCASPEHLVSGPRRPLLFPGLGITTENLQGHHCKSCSDVQLIKTGDKVGSQRSHAAESCS

SEQ ID NO: 960414 - protein, 175 aa, Homo sapiens
AGVIGRGPDLEVCHCWRLTCERSWIRWSCSCLGTWRSWMGKRTVLNARVEEGWLSLAKARYSDGLPMSCSVPLQYASTHGCPSVCLHSQLRPSEGLQKFNGGESWCPQTQEEVRASLKQVCVRRKGPTKDPMNTGCPLSAPQDPLNWLWNPSSSQSTVSAQCKTSGIGLKLARRH

SEQ ID NO: 960415 - protein, 220 aa, Homo sapiens
GGPGSLVALGIGNRGGFLRRFLAVASGAVVAAVDGAWGRWPRMLAGGKAEDKEWIALSPSWACLCQGHEDQCPWMEIYRRSPCPLMEQEIIDSLPVGPLLKDEVWKIIAMCRNAYPCRTAAARFNGIVLLSGTTMATVGRGCNVLQGGVATDIRGAIILAKLSIVPCAEATVGNKIGSPTLVPCKVTGQWDLCWYASSLHQGHCIVSAPVPKKLLMMLYR

SEQ ID NO: 960416 - protein, 228 aa, Homo sapiens
RSRCEAGLNSAEGDGCWSLAALGADPAWVPGWGDVGMPANAPTECLRCLGLPSPPWLGCHAWVMPWATAELAGMRWGRLFEELDSNNGWPAWTVHDVAPWVLAMAVAGGNPDPGAQQGISSEGDADPDGGLDLEEFSRYLQELEQRLLLMFHSLDRNQDGHIDVSEIQQSFRALGISISLEQAEKILHSMDRDGTMTIDWQEWRDTSCCIRWKMWRTCCISGSIHALF

SEQ ID NO: 960417 - protein, 69 aa, Homo sapiens
YRQLLGVVFEFTLTGRRFTEDSSPDDQFFLTAIRLLWERQCQPPRGSGEHSEGPAVMASWLKVFNCHLL

SEQ ID NO: 960418 - protein, 31 aa, Homo sapiens
MVLDIIGAIPKSDAGPARGRVHRARNSEVCP

SEQ ID NO: 960419 - protein, 228 aa, Homo sapiens
MAAAVASLRRGSVGPAVARGSRAARARGLLCSARPGQLPLLTPQAVAFSVEVWLPFPVGRTGDACLAAGACLGRQGVAGLDCGVCIFGVLRCHVRLEQCNPTHDYLVVSPWPPSRSFVIAHAASWRGSPRYISKACAASCHSHCDFDWAYQHSMVGCVLHWMDDRRQRMLAAGSVDWFKNRALSDSIGEIVHSGSGEGCIDLFSRKAYRPRVDGCVEAADHTERWPLS

SEQ ID NO: 960420 - protein, 68 aa, Homo sapiens
GTLYTYPENWRAFKATHTLLSTAGTQVRVLLRHTPHYTISVQTNRTPRNYTTDKLSYRQGTQTYMTGR

SEQ ID NO: 960421 - protein, 321 aa, Homo sapiens
VCAIPWGLDLENSRNLGHRWPGLRVRAEAFSLNETFSELDVLGQRVIQVDGACSRTLGPRSASPLLASRNEGYQIAVACLSFIGGIRRLLQQLTIAQYAHRRAQERDVKILHELNAAKWHEGLSTCDLRRVGLATTQPCSPSSTMIDLASAWGAWGRGGVECPAMGFGSAVQGLWGSPCGEEHWHCHIGLALCSPSTMRSSHCACDRESIVVAGGPPTVGVPPWVYGDAMLAQYFLEGLYTLQVRGSVLGRTLLELTGTPPIPRAAISFNLAPRQGRDPSLVGVVALAGVRWGKSEADALFRWTPGPFERQDGEGHAAGGL

SEQ ID NO: 960422 - protein, 288 aa, Homo sapiens
WLHKAAAGSGHRDAAGGVLSRVMPGSGKLRHLTGLSLLLAGHGGFGAKYCTGLLGVYETLGHYGGLLTIWTGGAGRNVRVDSASRDLSAETNVRNGGRSPDSEMLNPKCTWPRCSRAGVWTCFMALCVAPRSAHEEGVGRTYSFAWSAKARGWGRVRLGMAEVVASGMCIPWKEAHGLMGAGAPSPQCRALSPRAVGDLCAARIVLVRGSCCPTSDTCFGAAETPHLRECRLYGPRRLRELLSREGGQDRALRGLDPGKRPPNIKRESATWNWVPVQEPGLGLTEESR

SEQ ID NO: 960423 - protein, 209 aa, Homo sapiens
EENGGRVGAVPDSGPDGGGGGRLVKTRTATIRVSRKVEDELGDEEEWRCVLTDELWHWCDAASLQPACADCMHATARTSACSAGDWVCCLPCAVLMAWGHASQCCVMWGAGKKHRQRCTHWAVHGITTMMCGVVTTKEHHRMHTNSIGPFVDLLLLDALATIATDGTPMVINANWQAEKSPVQGHPLVWRRQGNALTATVSDLNQQVVY

SEQ ID NO: 960424 - protein, 154 aa, Homo sapiens
MEPLERNLRKGRACMRTVESGRPVNVYAWDLEIIPANHERWNGGYHRFWNTPPLAGQVMMSPGNVTHDDLVQCDCRPGTTVVALSQKTMTLQGNNPQRLILVYCILEVCSGSRLGSAGAHIVEMPWLIISQLTLGLRTPRRTPLRPYRVALYSD

SEQ ID NO: 960425 - protein, 257 aa, Homo sapiens
MTLSAPVSVLLLPFLLPCPATMTEQAISFTPKTYLCRRHQPPPSPQTVPVCSRSELWSMLLLQCPCTASNADLPADNAVQWCIVDLHLSCIPKCCMWLCLSFWSVCNLANLSFCYFPINALNFCLQCDNVQRMIFLWCVRGQCTLQFLGVYYCCGKPWPPVPGAGTGLQKLTYCYRCTLLGFLPETRTGSVTVWKCSCAHELLMFLQAWSRLAWMKITKVPTGICGLYPWPPVSPCMWHHHLPGGYFGVYIRHGMYP

SEQ ID NO: 960426 - protein, 252 aa, Homo sapiens
MARYEAGFQIGAGDARCYAAGLPAVLKTRRAVRLALWLLRQQIHSVEPWDPEHAPDSPCWPWRAGCLPVPAIGPLTLVCLPETCGYRDLPLRYLSPVDEVCPAAQGASERWLVIDRKEYNISDVHPAWHPWGLPGSSATTPGHVMPLGSHFVAFHINNGPCEEVYELSPDLENCLQSSPALSPPRIKELQIEYLGASGATVERMGLMKCQPCLLPCCTCLPSCCWMVLPGSPFGSWDGLLPFLVLCGAVSAV

SEQ ID NO: 960427 - protein, 204 aa, Homo sapiens
MARYEPAVNSAEGFASKDQSLLIRRKMDVLCLTIIFQDSQLNLLTLVLILLGSGKHQMADDCRVHAGWALVGPVCALGMGEPAVCFRCECFWQCASWVPGGRWPVCLGPGGLSACSELAVRCKVHDGIMDVGFALITNVVGRICVKWNIERYNVPCDVDESILYSPLPQLTGNQADTFEFSIPVRGPSYSNWHRRVFMTALSTM

SEQ ID NO: 960428 - protein, 198 aa, Homo sapiens
MREIVHIQAWSDVATRSDCQVLGGDQMMNMAVDPTGHLTTGTEELQTGPHHLMYYNEATGGKYVSSMTILVDLEPGTMDSVRSGPLDQIFRHRTTLVFRSSHGAGNNMGQKATTQRAPSMDDSVLDVVRKEAEEQVTCLQGFQADPHHMGRRAQETLDMGTHHYIQQDPRKEITLITLMTYLQCGCHTHKSCMTRVEP

SEQ ID NO: 960429 - protein, 166 aa, Homo sapiens
MCSVTCHWHSNVSQCAADFAITPLAELLLQPRGERLLARTTIYIKVVLPAPRTYVYHLHLLCLRIVCKLAKLATGRKKFYLMEDSLASLLQWLDYETCQADDEAESYLAKRACTTITAKQLETLKSANNTSPSRAHVRNSSRPRRLNRVCSWYQTRASEELNDRED

SEQ ID NO: 960430 - protein, 75 aa, Homo sapiens
MVGRGSLVSEGDTVVWRACVRHSCSPPAELTLLAAVVVNDVENVVAEDVVCAPGGWVVAYTPVVVQLIHPTYRWG

SEQ ID NO: 960431 - protein, 212 aa, Homo sapiens
GAQPITRTCCRMDAHGRTFFIAFFLRKFIEQTVLSMAEIRRVIGDFGVPIDTSSSWCYVDYSIEDTYTQKLSVPSGFVGDCPRKEGLGHQPPWEEKSPFPVWMMVCQPAAPHILVFILIFMETQITHSSSSTKKERMLQKGSGFHLDLMTHRGHGLDICALFGLPWLDDATCPLCHSRTTRSLVMSRLWHLGTKPQDSGSQGAGVKVLWVAC

SEQ ID NO: 960432 - protein, 96 aa, Homo sapiens
MPMRATGRYKYRTQLLYLRTGRTGTECNTQQERQRAANKTPHTYPVLTQTKKTNCTTPWYQRVTSPLRGTRRISTEGKESMATWHLKGGRKRDRHL

SEQ ID NO: 960433 - protein, 239 aa, Homo sapiens
ACSDGADSLPCHAAGWCHKMPHACRELACRMEAALLQKYVTPVEVCRPSGGEPSLMCQRPAVRLLESPRTPAACQSVDVGSAACVVSRAMLRTCPVLATPWPSRFPSRVVSWADNDGSAERLAASVALTCSPSGLRNGMPLVDHGLMASLKDRIRSGRVAHRTSSPGGGRSLGAQTGRSTSQGEVWTFSLIPLPSTIVAVRAGCALGIPHTAHHAAPLAPCMLRNILAVSHGSPWDCAL

SEQ ID NO: 960434 - protein, 267 aa, Homo sapiens
MQLCMADSANNLTLTEIAQHALLVMGGKNITCRQLRGNEENGATINESRPETSTKLEMETANGTRETQTEEKTRDHHKNQQEAEENRQERHNNTKEEIARKHNKQDNKTDKQRQISENTQRKKQETGDFGHTQQNRKENQSKNMRTHKRGRSQLQQRKLRTNESKRNTGQEPHAPPNQKGQHLVRRDKTAQDNPGEKERTTAPQQKDTRARDSYQDTEKPVRGTAQHTASVQTEEHRKHKRQGPGRPQGRQQTRGRNQQPEPAPRTQ

SEQ ID NO: 960435 - protein, 115 aa, Homo sapiens
MSLLEAQIRRYRLSLVSEVDRQLEILLHSRNSKQTYVCGYPSQLLPDMELVGTFEMAQVLWKYSLFTVGSISTIASFSGESLLARILTVLSIWLQLRHRLFCLEQLEQIWNYAQV

SEQ ID NO: 960436 - protein, 220 aa, Homo sapiens
MVRRGAVVLLCVAVLYEVQSCRGIAAGSRVFTPVFDGDVAQTCVCPFQPVTPPFLVLIFSGGALSLLPQPRLFWRWVVDGGFTVNTEVFFLIEACYNVLMYRLSRYVTKPNSDDEDDGDEKEDDEEDKDDGPWALNVGGSLRDPVAKKTGWGPALRVHEQVCPVPPGTIAFGTISVGPKWNNARQVVHPANVTSMGQRRTPPEKVMPANCIVGPHKTYIT

SEQ ID NO: 960437 - protein, 146 aa, Homo sapiens
PPASLPPCSLISDCCASNQRDSVGVGPSEPHAGYNLPVCRFLSPLEKRSIRVGVTRFSRCRLSPLSLTRKGNSLTPCASRVRQCLALLQLVHGALHPLSCAPCLALPSEMNPQMEMQKSPVFCVAHAGSCRPELFLLGHLGSTTLR

SEQ ID NO: 960438 - protein, 139 aa, Homo sapiens
MYLQVRVYEVADLVYTYVVHRKPVGKVWTIQVCDYYTLLLRKSDRILEAIQKKLGMKVGETTPDKLFTLIEVECLGACVKHHVVQINDNYYEDVTAKDIEEIIDELQAGNPKQGQSGRSLVTAEFTFGWTPGLVGSAAK

SEQ ID NO: 960439 - protein, 57 aa, Homo sapiens
MLGTAPEFPGYDDGNHLGGSLQEDNSCELRTESERLYLDQIPIFFRTIGSKCSSLGA

SEQ ID NO: 960440 - protein, 156 aa, Homo sapiens
MGFFFFVFPSPPPPGFPFFCEKIFFWACCSPSFFFYSLILPPPRRGGAGGVMRRTTSSPRNIKYRASLFSWDHQERGAQTRRWGVVSHTPTKHSEEKKTGGRSSSIIYTPPSTYSLHTSPPKRESVAPHLCCVDGSASEAPTEIVRSSHRQRERVV

SEQ ID NO: 960441 - protein, 242 aa, Homo sapiens
GSALVPVRGVNCEAPVPRVPVTSAVTPGAMKQWGLVCGACGCWTKAETCLPWLEENNEPPPGLPGPQDVEMKEEAADVCGGSTWGGHDGKTACVQRLSSSQRELDTVTLEDIKEMHVKQLEKAVSGKEPRFVLRALRDCCLPHHAASTTIVLYKAVQGLLHFKIIAHSMTFCSPSLEEAHVHRGLIYQFRPPREKAAVRHPSLLDVGSYYQSSWSSSLINSSATSMPEDSYDLIAQISTRTR

SEQ ID NO: 960442 - protein, 179 aa, Homo sapiens
MENTKWTLFSSRFPAWAVRPSVSESSSCRAGLSCRMTRDRVSGAVTGSSSPGGLDSGPASFSNYPGPSVRPRRWRLSPSCAADRSFSGLTGLAGFKVSLHDGCCSRLHGCGFVDCGAWYCAGPRVGRGPAGVAMAYVLSRWNAGLAVPAEPVPQVAQLYYSSRSWRRYGRIVQRTLLFE

SEQ ID NO: 960443 - protein, 117 aa, Homo sapiens
MPRPPRGCGDNGAVSHQCRAEKPTLITEGADSWLDSGALEVVPEVLGVGDNPGGVPGGSVCTGGLSESRLPSLGDHASGSPISASPGLSLFPPGEANFIGIEYLNGELLIINLGGFD

SEQ ID NO: 960444 - protein, 261 aa, Homo sapiens
AEILRSEFPEIDGQVFDYVTGVLHSGSADFESVDDLVEAVGELYAMRFPGGHAMDDCWASCGLCAMRMYNTLLSGLSHYSQGNSQCATCDCPYPVVKDNWRTTTCGTKLPVLLNDGNMSSTVNAKKLEKAEARLNGKAGMQRSEKDTLKTSEPSSLRRGISPAKAGSTTTESPVGTHLGRTHNPMHVRILLDLLTVSFGRYEYLLAWSWIVTPVLCARPLQGWLGRHWVWAIQLVLKIVGPRSLGVQPTFLVAVDPRSGMT

SEQ ID NO: 960445 - protein, 137 aa, Homo sapiens
HHLLPSRPGRGHCRFWKMCTVHRHPVIQRQPLRLEVPVRFPEHVSVDMPYHACSCKCDDLCYVKCVSMTCDSDATIPDDTDVYQQINVTPSHAFVCVVNDHILLYISDRRDVTENATPYQDLCVITSGSHSDERTVP

SEQ ID NO: 960446 - protein, 191 aa, Homo sapiens
WVKVRVRGHGPATVARMDDKDNDNRNMNLLLPTTMWRKKNEENKGTRMLPSENCHLVYDRHTQFRYNTLREGYERDLKTIVSRWRREFHYHRSGTNGTPLVTKMLQTEDTGSKVDDLRGTPMYSRNLEEIIDDNHAIVSTICGLRTLRQHSFDYEDEDLLEPGCSVLLNHKVHAVIGVLMDDTDPLVTVMK

SEQ ID NO: 960447 - protein, 80 aa, Homo sapiens
PALRSTSVYCSTLRFLLLGDESQWLKFTMSILKIHAREIFDSRWGIPLLEVGSLSPQKVSLQSIAVPSLVAINLVSMSAL

SEQ ID NO: 960448 - protein, 272 aa, Homo sapiens
MVVTLPDPARETAPYHPEPAVSVLEGEKLKEILNVSVELKIYLVRTGNHCGQDQHVCYDILLPYVKTLCMTFIKCASGCDVYTDSLYLQDTPTHYHVIDMKCPDGKLLRTSDVQLLLRHVIRSKCCESNWIGALGRKLKVTPPSRQLINQTTEEEYNTRLCTRHLTHVAHTESEFPRQGMEHAGWDKRPVGSHPVMHEMSSYTPDMQALELKEYTHNVRMRNEAALNQEKDNSAIAEKYYHAHWLYKTGPSDNPIDQDHQAGNRHQRGSTEP

SEQ ID NO: 960449 - protein, 245 aa, Homo sapiens
DCTTPHPGEIAVISLDSFALLSRCAGTSPMTVFWLFGSPETMPHLCVEPAPASEISPPARVLCAQQVPSMDVESRELSTVVKRLFNDPEPQVAMHLSCTVLIGCASLACLPSDMPMTLLLGSRLTLCHCPPGLLSLTHEARDTPRKGEGALGPMAPTHTHSHTAGALAGNFPWDPPVALLPGGLGAATRPPTPGSRNAANCLSDNPPGRAPKTRLGPPEGPPPEPNPERGKLTPMSDPRSPATSI

SEQ ID NO: 960450 - protein, 115 aa, Homo sapiens
MAALLLAAPLLLLLPLLLAEDYTSGLQVALASWLDLAFCWCELLCLQNVALRCICCPLALTDLPDWTTENGSPDGRGKQGPWTHERHRWETLAPCMTAHLVKNRFLTITGFAGWL

SEQ ID NO: 960451 - protein, 116 aa, Homo sapiens
VFRRFVEVGRVAYVSFGPLVPENWSLIVDVIDHAHQGFGRWTLLSTCGALAMPFKLPCSSRDSHPSKFPALVPTQKYVLIEAWRDRQDDQYKMGSPHVWAKERFEGLRREGAKPTD

SEQ ID NO: 960452 - protein, 83 aa, Homo sapiens
MRLIPHVDGIGLLISLPPLTTGTPGQSYKLSLRTSGPVMVPFLPSRLPQNKATRRRMPCPIYRPPCPGLGGSCGAPLCVPPIG

SEQ ID NO: 960453 - protein, 120 aa, Homo sapiens
MRAAGAGAWPVAAAVTETLWDVAVCALAVDGPSSVICGETEKYQTASIATASSILPKAMGIIVVTAPRVARTGRWPPVGPLSGPVAWFPRVPQCYLELLTPKGLLAKARFSVSRGRRLGR

SEQ ID NO: 960454 - protein, 200 aa, Homo sapiens
MFRVRVQRAGVVLVRPAGVRTLALLSVSDAGIVQVKDCEAALWRLSTLCGAVYALGIRAAAEQRWGRHCVGAGLTPRVRQPELSRSGRILDPLGEPGWGSWDYPALLLGTCQPRQGVGAMLLSTFPRLRFGRNPHFVPAPGFTQKLTHTLTSNVANILGLQSRALAPYSLVHLITIFDPRLPRPATFALFPTYFWRAQLD

SEQ ID NO: 960455 - protein, 233 aa, Homo sapiens
TACSSSSLAAALDIPDRNTLSLMVPSSSNGSDGVGGADCGLAVCGLWVTMQCPDGFWLLIMPENVDLWAAGSILGMPVGPSVKGESSADRVNDISGEAHLGPKSSPGSPNGLPILKLPIDPPCFLPGALGAPIPQQNSLGPQSSIPYALMSRPLPTYRALSGYAAQQFQCPLDRFHLAGLQRQTHGYTPPLSLPSPAMSSPQVVRNTPNSSAQCQDRLPRFAPADPSALTTVT

SEQ ID NO: 960456 - protein, 234 aa, Homo sapiens
CCSVAQRPGLALNYYKELDYGVTALRICKDYVPSQLEALQEEYELGSYKNGGHGRVGGIRGHNARTLREHVLDDVHACACGLATSNVRDSVKQLAWRENVLWMKAAELSIKFLPPQRNMECRSGCRTPADLEFGKHMAAAELYLNLDLVKECNDAFIEGEDVEQGEAVVAKELDPRYDDYVDQASKEFLKNQGNVDSLVGVAVDSCMGPVCGAGPWDMCLEQLTSRLPDSAQYV

SEQ ID NO: 960457 - protein, 126 aa, Homo sapiens
MCARGGQNKRINVKRGPQRAHTHETQDTQPYSGLPRRTTHSGARPTHTNARQGGHIQLPAKKTAQAAPPPGTITQDNPGDQHRTPQAATTPPHRQSTPHTHAPAPVATAHNSHPHHNRTRTATPAA

SEQ ID NO: 960458 - protein, 125 aa, Homo sapiens
MNRGWGCPSEPMRVSRTCGAGALLAPVGTARQLERADLVYWRYIVLLDLPSMVGARWSRIGTRSTFWSHEDYHVAMRVERSVPFGRAQVDCWGVTLGPLCPKGVLIPITHTRVGRARALKGTRGD

SEQ ID NO: 960459 - protein, 284 aa, Homo sapiens
GGRVYLDSCLVPRCGCCICVGTSLGLPTCSPTCWCASCCGPLWPGCCSMADVSCLCCAACLCAMNYNHAAMWSSSWEGTMLQQNDHVPLVACQPVLTCITQCVSTVLACELHEMHPPVGWSPPGEPYLWSSLKSDTTMCLSPCLQFHHGLDNASHFNLMVWQLDLPVVLGFGVPLACCCLLCLNPLPIAVSCAAHVQASCVSSTTAFTTNYNVKPWHFGGLLVGGPTLGAPDVWHTPSILGGNHEVVKAPWAGTPSDRTGCCSLDPNLAVVTIGVTHDLLSALF

SEQ ID NO: 960460 - protein, 249 aa, Homo sapiens
NVPGRVELLGRAYGKAKMQLCDKNGVPRFYIRILAEPRGLYLMSYWEDKEGKNEDEKGGNGQGSDASCVMKITESKSDDIQSHQYHKAKMREGHETVCWDEDAMRKMMEDIRMASFDHAVMSDECREIKDDRENIHIEERKSRRAYHFQEEKPAKDENINKTMVMKNEKKRQSRKNSEGTEVTRNMGHTRVHTKSHDEEIPQKPSQMKANMTSGNKNTRQPWTYSKQFPGKHRHPQPKTTEERKKGKDT

SEQ ID NO: 960461 - protein, 254 aa, Homo sapiens
SVGRNGFQAGGSSRSRGSPPRLGLADSRGSRSVPGGHVAVNQWGQGMLRWTAAPGGRAPSRAETMLQLAVGQSGYTSFGGYGVLVRDYEHDCARAVECAQFSMQVSVWLLDNSCPPVKSAMRGQSSAVVPLHALWTLIRASSTTSVLLWGGRNDRRRGLRMCSMSFDVKYAQCGSAPPMCQGQFLGPGDGHSGCVLWQSPVACLGATEHAGGAVCSTDVSQARYQSHWHASYLFRGACGWGTSFGHGGGLVVGA

SEQ ID NO: 960462 - protein, 174 aa, Homo sapiens
MAPPPRGGRRMIVKMMEMSERGKIDDSSGEEVVIPLEERSRRLLKPQEMKVCRLPQAKYRLHVGSRPANESKLSLQANDVQHCNTCLEKDSILQANAVTYTCARRGATPWQSIGSNSVVRRVLASQAKGGKEWQECQKDDSDEEEDDDQLREDEEDDEDEDEDEMNWTSRMKAE

SEQ ID NO: 960463 - protein, 232 aa, Homo sapiens
SSYPGFPVSGPTDHAAGGLNAACSSGPVQASCGCLHGDSGHSCVHASGAAGHHEGHHDLNMLDCSGVAASAWAIPTIWVYVPVDPELIQKANWSPLASLNLASSSANWTAGWFPGLVSAWLSTVLRLTVRQGCPDFLQSTRTDVQSGGTHCMKHLGGKSSEQESTTCWLGALVTSIIASLRLTVGLDNVHVALVCHVVRVQCHCTRSNPAWAGPRCTCKSHQACRNKQEPPS

SEQ ID NO: 960464 - protein, 194 aa, Homo sapiens
GPGEVEMCEVGRRTDVVPCATLQLQYIGEGAYGMVSSVPMTTVRKTRVAIKKISPFNIMTYCQRTLPGDPDPAAASCHENVIWHPDDILRASTLEAMRDVYISASDLMETRHQYKYAEKPAAEQIEHICYNPLTRSMRGPQVHPLPPNRATKQRILERPYPNLDTYNKQHANHIKNIGEYHALARGYGRTRMSS

SEQ ID NO: 960465 - protein, 69 aa, Homo sapiens
GLCIESVADFVFLVSAAAVICLRVSVFGYVCAMVMPEYQTSSAGSSHQDLSQKIAVICLVPGARQRVCD

SEQ ID NO: 960466 - protein, 262 aa, Homo sapiens
SVGPQIGLPPPPPALRALPTVFHTQLAHGSPLACIECDITNVKELYGKICRSAYPAMHNCLMCDVLAPWTPTNVDDGQAPGVGPESVLGVTSSSPTVNWACSNGRAASCCSKCRERSHSAAHHSLDTLGTLSYAFITAHSQATWPALTRPPVHLHSAVGSRAIDSGGAQLKLGAMMPLAFGLSPVHLSSWFGPWAMASKRSPAPHQRPVTLFTARNPSTGEPSPHVHIRQTDSTPDVLQLGFGLPLALGPRAWPLAEETLRL

SEQ ID NO: 960467 - protein, 218 aa, Homo sapiens
PREQAGWQNSIRHNLSLNKLLSGRCRATYCLTLGNGATYCDAGPCLMLTDVFIWRATRGKHAVLPAPPPRGPMLAIQALVLRLNLTGLTFMDRARLHSTRPMSPFLSLHTPHCAKKHFEVTTDTTSGLTQDTTNALKIRVDSELACGKKQLPFSNRQRHLSRWTRLFKRGETDMTRNQLNGRRRYDRHRMPLTDRNGALRQGPKTLNHGSATLNSGTT

SEQ ID NO: 960468 - protein, 216 aa, Homo sapiens
PDTRLGWGSSVVVENRHPKAYLHLCIVVTAPTCFNVCVHTRQPAVPKWLRCATPCTWHVSCVILSHARRCNCLGFSITHLPVHICNGIAHVPILQRLGHASNVVTHMSPPLHCHDVSACVLPLCAPDLTCDTHNCTSVWHGGGLIDSKKLVDSRTQLTRKHTDTLLQLDWVQQPPTSHDVTGRMQYTSKIHQVEPPETHIGKLEQDPKVGVNPFTI

SEQ ID NO: 960469 - protein, 253 aa, Homo sapiens
RLESDVQVGGEPSLLPPLMFYSSLTVRAAWHMLRAGWGSCSSPRAPGPDTCAVVPRWTLQACTVRVPLAFLWLCSVPPVLRTSAGVGAVGGRACCVGRDMPVVLHLWPPWPWRRMVDLSTSTDCEVMAKSFLEGPEDKQREEHYFCKDFVRLKKIPTWKEMAKGVAVKVEEPRVITTDMQLNEKNLPAPQATSPKAGVWTPFVNACNSSCSECGGVGRLNSSGRVPCYRRLLDLRAVDLQARSRRFGPASTSH

SEQ ID NO: 960470 - protein, 248 aa, Homo sapiens
MLCGCAHVMRGWHAWIDVTCGGACGVCGKMRVRPCFTCHLVAELYYDEKCVTKQMANACYGRHILANSRTMDDEGEPDTFGVSEPRATEVSTLIHCTLHFTSKTKGSRPPDPHVALFSNTKVVFPTRNATGSDCAYTSTAPWMNAYPPQTSLIAKTQLSHDLGPLWRNTEHGHDPVTPNVTTGTAMIPLIMAGVTFIPGAEPPPPSAPTTHKTRPPCNRELDQRKNARRKETQREAHSNPTPPDKQNQ

SEQ ID NO: 960471 - protein, 138 aa, Homo sapiens
GQGQQAMCHEACHEYLGTRLELERWLLYTFIATGFDVYEFQLQSSHPEEHLNVSAGPIVYTDVEKDRYISLSGLPRSISFLFCSIPSKQAGALTVIDVFRNNIITVECSQFYAEICLSAGRFNKVEFPQAQLLVKKCV

SEQ ID NO: 960472 - protein, 186 aa, Homo sapiens
GRGPNFIKNQTGRLPCPRSSAMALGEERDKLGPFCQARGARGGTPWLGDCPGCGPPSSSSWAVVPGARCESLGSAWWPHSVVASRCRWDNLRGSASASHSRGVRMGQQFGSLGATLANKEANAFDLSASGPRREKQSFVGIRMGNVVSGRFSTKGGVRPRGWIRWLWGKIFLLALSQIFPKSGQGG

SEQ ID NO: 960473 - protein, 280 aa, Homo sapiens
PVTAGFLGRAGSAVVTVMWLQWAWDMVLPCQPRLLAGLMSAALGQPPLPLLLPLLLLLLRAAALPSVEPGLVCDAPVLLLPDVPLCGLAQVCAWTYAVCCLNHFPGDHAHLCLLVNQTHMRSRLLVSCGTRMRCSLRSLADKIDSPVMLAGLCTVVRRHVLQQGPIPIGMRQVAGRCSLVMLCKLMHTTHQPTRVCSPSCLPACVNFVSEGPAWCLKAAGFFAPSELHLTTSDEFNPLRAFRAAQEACSSQGLILHVLGASLTCGSDGPGCGRFAALKDP

SEQ ID NO: 960474 - protein, 219 aa, Homo sapiens
MVQPRPMTTDNADEVEKYSSGMPDSASKTQTNISASLYLTPSEVLEMRNKIRRTKPDKMEVHDVWPQYPATCASVNCREEPEAQSTDDAMLMSNGETDVIPKDDIHDEMTVCPITLSAKLTDQGVWRSTNKECWTYVNEHKNLTGDGHMKLPQEEPGYTLQRSSKPDIYYTAVTTTPKILKRTQTQRGPILETHPIQKSYRTGQDTREDLKTTQSPSHM

SEQ ID NO: 960475 - protein, 138 aa, Homo sapiens
GLGLREPHLAGFQWRRLASCRWPCSVELILSPFAPHAPHALTARSSCLAQGLLLGHHHPLAMTLPCEHPLPCNCATMLLPPLLADWGLLSVAFLLLPLPGRTLCMPCCLNVLHCLPGTKCWLACLLSCGLLTMVFLRT

SEQ ID NO: 960476 - protein, 70 aa, Homo sapiens
MAGKKVGNTRIVGPSSRPPVIPRIATGRRAGLVAPVATEAEGNPYYPRTWEQSILAHVLWAILLEKPGEA

SEQ ID NO: 960477 - protein, 74 aa, Homo sapiens
MLPPDSGNITYTHTNTDHHRTLTWNKKLKRNEQAEDQNNNQTQDDTSHKQRRQATQEVNSKTQSTMKPEKEDRQ

SEQ ID NO: 960478 - protein, 71 aa, Homo sapiens
AGLGCMGWPLLALRAAVVLRCVPCGPRGPSLLVLPLARGGGPPVTLVSWTLCGCVNALTVLETTVLCICLL

SEQ ID NO: 960479 - protein, 212 aa, Homo sapiens
ELLRSQLILKLRQHYRELCQQREGIEPPRESFNRWMLERKVVDKGSDPLLPSNCEPVVSPSMFREIMNDIPIRLSRIKFRAGTPSACSLNYARAPPGGSSSSSELHPLTARERWLKLECGSTPLAGFGRTTQPPRQRLHCALAWHHLRQRTLWPPRLAPHAKALRWHTASAAKIYHISLELRQTDSERQHLAILKAANISEEVPAPEVAPPL

SEQ ID NO: 960480 - protein, 106 aa, Homo sapiens
MQLRMLAVEVLHDGMHAQCGCSGGALLDSDICAPSQYLGVPHLVAIMHHNKQCHRECKCEEVSANSGVLLDAYLKTRTFLCGAELSDIWLTSQFVCTLLWLYNAWF

SEQ ID NO: 960481 - protein, 205 aa, Homo sapiens
QASAALSVPPRFYLLRSHPDGLCFSEWSGAAILQCPVVAPVTVRLRAPRVELRVVGMQRPRGVPEAVLQPQLLPGQPPCLLVVSRLTMMPVTCGVYRGASLASNVPVSAGGMWPPRSLPRMAEAHADSSGHVGCAAAAPQPTSAVAMPWPLRLDMGCVRLAPGGLGESQYCHSSGHLSAIHGGWVLSCLCLVCLTGHVPQSPKVP

SEQ ID NO: 960482 - protein, 215 aa, Homo sapiens
MLQLQNGPAEMMPEADVAELCTDPCCLNADSLRVQCLWSVLGCCAAAADHPGPVMHLLWTMQLLLTVPLHTWDDACASCLVLQLWSTTMSNYVFVFLGLILYCVVTVPYVAWCALCCLFRVPVTFSILRTLESKLVLFGLRGDAQLHQYALGLDGISFPFFLAGWLRALAVFWVLGSHPGGHLAPTLAFHQIEAVDGEELAMDPCEVSSGTCVLR

SEQ ID NO: 960483 - protein, 222 aa, Homo sapiens
EKGELNVVGRQQDAKGAGPSRVRHLVPWSWPSKRKTRECAEPGKQVLLAQGGLRIAGNSYFVSVVAEWLPIVSVHKAEGLGTHRKCGPEVLAQPECAARSPASRVPPCVRSLSLPESVGLWDCCGPRRKIEAPSTHNPGAVGADRFISTSLHNVRLRVPPSSPCLVRVCPGGCGCPPRPPKSWAGCVFQSPILQPPQYLLVCRHHHVAKVNVPAEVIRARAR

SEQ ID NO: 960484 - protein, 224 aa, Homo sapiens
NHQSSLDLLVDDGWYCQCRCVPIAKLRATVVLALPVLACLAGRSHLHLTWNAALWVIAIMCHCLDVSAQSPAHPVTVMCVWDVSLKGNDESRNCAPCLPLQNCVLHFQSLHVHWPMCSQLSPIVMSSIPMSFYLQECERRIHLGGQIVMVLGCLPHNVPTVNVAMTPGLTVPSSWLDRRPGTSNRSTGFPCVHILRLDWAGGCLVDLSCSCSLGSAGWVNPLCS

SEQ ID NO: 960485 - protein, 226 aa, Homo sapiens
AGGGPGALVALGWGTAGGSAGGFGSGILGPGSAACGLCGLGPDGRGARGGNGLMDKELDALSPSWACLVKDMKIKSLEEIYLFSLPIKESEIIDFFLGGLSQGCRVVTDYAIAEADPVPDMAPGSRHFVAIGDYNWPRRSWVVSAPMEVCTCILWGPSSVGQALHRPRAAEGYWGGTKIVQSPEVSLCKVNRPVGSVLVRLIPETGALGIVSGLWLEGVMMVVSIM

SEQ ID NO: 960486 - protein, 208 aa, Homo sapiens
EGTCAATVALGCSLHAEPGGYSCGLDGHYAMDNITSAEPILRYPMSSNKKTESWLRDVRPLCNGACSMCLSVHEMKTEMNAMEHPPASSLPEASQLNARQACNSRVERGLMKKTWWTGCTLSTERIGGAALLSLLLKRMTMTLMIPLLLLTPINLRPSTIKGWTRGSRVSGYHAQPIEWLCIPCGQERPWPSYWGQNGAVYASRMTLH

SEQ ID NO: 960487 - protein, 204 aa, Homo sapiens
EEGRSSNSPACATGLPPNSQTLWRSSCCRLAHEMFPATAEYADGLLRSTGLRCCGCCMCAMVLHTQEERKCSRTSRPEQHVTLNGWKLQRLHRKIALQHWPWFPSALMPLSCVRASAYDVLWMKYTYWPMFDYKELVLQIDDNVTSAVEGINRIDQSSLDSLGPELVPEDLPSIPLVPVSCSEEVEFLGFGEPQRDGKSRSKEP

SEQ ID NO: 960488 - protein, 229 aa, Homo sapiens
FLNDLCAVMWFTYLLLYLHSCARLHAPAVRWWLLLLLGQVALTGLVHTCSVVLLMCLTCCLPCLLRPATGPAAMAWHLVWHLSAVLLSFPFIFSPCLGQCVVLATALSGLALLYYCALFICDLPVCAGPPHMISHLSLIPGALSPTDHDEMVDAHWHSVYAVTVSWPTITCLRLPPGSCLHLAGGSSRVDAHPRHQHQRPAGGPVTCPVFLEPVPAGGGCRRRVSTVFT

SEQ ID NO: 960489 - protein, 197 aa, Homo sapiens
MTSWSELQWMPFGVNVIHARSAVETQNTDQPTYDYATTLLTNVNVVSNTLARQTSSLKKNVKPTDHWILTNYLLYSTAAHRLDAPARNITRHQHSRPHGQLLPSNGKHTHSDCLPLLLQLVPWAIATTLPNATSLGAYTPNSNLPRRNTSGAVLAPSATQSTHQPNGGIHTRYRADQQPNKTGSQHHSNTPRAQGNP

SEQ ID NO: 960490 - protein, 126 aa, Homo sapiens
AERNKDPILHVLRQYLDPARGGVRVLEVASGSGQHAAHFARAFPPVPDVCMPVWTVGPAAAMDMWALQMQQEGLAQTQVALAHHRTWPYAITWGMISPQRQRGYFDLIAQMQEPRNGGFGTQRLLV

SEQ ID NO: 960491 - protein, 188 aa, Homo sapiens
QCRPAGMQWACWPGWWAVVPACCSCAVAAGADPVSVWLWLGTQSFVFQREEDMLHVFGCCACTACVEAVCMMWHVDVWMLCCVCGDAVDAKWVPEVLAIPCDLVTWCAMPMTPGLPLLPPALAWTTSLAFSLVLICWSLLGWACTHVAQPVLAQTKELAVGVVLVNCGVGIGIGLPLLPSCNASLSRV

SEQ ID NO: 960492 - protein, 133 aa, Homo sapiens
MAGITTIDGGEAARSSVLHAAVQMMQRSSAELPPAEKYEGEMCGPCGKQWLRLSVASLNRRIQLVEEELDLCQERLATALQKLEEAEKAADESERGMKVIENRALKDEEKMELQEIQLREAKHICRRVQIGRY

SEQ ID NO: 960493 - protein, 111 aa, Homo sapiens
MVSKLKKPRRIILLVKAGQCCRMIIIDEIGTIVDTGDIIIDVRKLLNIGTPQDGCRDLKDQGEFHLCGELESVVESDGARYGPSLMPVRDKEAWPHIKSIFQGIAAKVGTC

SEQ ID NO: 960494 - protein, 171 aa, Homo sapiens
QLTGMDTGTVIRKLVFPAVGMSGIVITPHTIISNLPDVIALGSFLALISSPPAMVADRKSRIEFTNATRWVQVEMYIIVVVVDSNIMSCTCVLTLTLQLQSRTDINIMTLYSYVTFKTKKHSSNAARANLLRVVAGRGTDSRYRRELETAIGIEITIWVLIWTIASDMYVS

SEQ ID NO: 960495 - protein, 106 aa, Homo sapiens
ASKLPVLLAVLYSCSLVLPPQCELMAMESTATACLSACWSWFLPDKIEDVPAPSTSADKVESLGCVIVKLRNYWVYGQKHLVMGGYSSSCQCIPWKQLVFYGKNGM

SEQ ID NO: 960496 - protein, 86 aa, Homo sapiens
MRKEYITHACHLSRTVAHTGVDETGLQSDAPHLLNIYCLTRLPTDWCLRADFTYMRNCFGATLPRIVPEPGAVTCSLYASPLISRA

SEQ ID NO: 960497 - protein, 265 aa, Homo sapiens
MGKVKVGVNGFGRIGRLVTRAAFEASGKVDIVAINDPFIEPQSTMVYMFQYDSTQWRNSMAADQGMKNGKLVMQWKSPSPIFQERDPSKIKWGDAGAEYGRWRSSWRRSGQRMEEGWGSFARGDARNGSSSLPPLRDAPMFVMGVSHETYDNQTQDHRVMGSVQRSNWLSTPWPRSSHGQTLEYRGRDLIEATSSMAIYLPPHERLWDWPLRGQSVGVIGPAGLSQKLMPWLLLGAARWWQGLLKEGRHWMTTGPLASARGLDAL

SEQ ID NO: 960498 - protein, 177 aa, Homo sapiens
RVCGRNDAEAREKCSQGVRSVPCTMIMSPAMMSDVFGYLVLALDLLPHYPFLGWPNQSEDLSVFYTLWTQLERPVSMTILFFLVCALDGHACGLNAHWAGCPIRDVSPPCHLLRDAHWPGRMSKSLGNVIDPLDVIYVISLQGLHTSLLNSNLDPSEVEKAQEGQKADSQRGFLMCH

SEQ ID NO: 960499 - protein, 215 aa, Homo sapiens
PQPPLPCDLQVLDWSLAEDTVDAPEAAEMDGSSMILKESHYVDAQDQLPPWSEQACIEARIGYEELGNGTIFEAMGEGDEPSITHVLEWVTCLDDPVHERRMPGERGHVRKAEPSRELWAEDEAKPWSTDTHQHRSHHSGILDFSVEILVPEIETLTRYWVYPSRYDGAWQIHQLVHGTTEYPLSPPSLLTEPGWQHNWTTSQKLRSMAWLKAGK

SEQ ID NO: 960500 - protein, 174 aa, Homo sapiens
MRYLITLEKICFLLQDCILSLFTHSQPSSPTLSNVWQGYRGALKQAIERSRLNSPVRRSQLRETASDDDSLQELFMSPELTIVYLESDLKRKVDVGHLLMTTSYWVSNLSLVEASEYSRVSRSSHGRRRFYGSAFVVAAGSDGLHVIMGQFTHYLLHPASNISPSSKHQWVSKR

SEQ ID NO: 960501 - protein, 225 aa, Homo sapiens
EAADGRAGVAGPGCWLRLRCFLAPTASPMRCCGALAGPGRRRGGEAPLQWSRMTMHCPWGPYPPSHVMIRHRMCLLTPCPACGKYINEEMGDFKLVMIGSTSSDTTSKQLLSARAQLESYTRPPSDSDCISWRGGPGKALMGVEGRSARCISAGSSKANDQASGILRVLDQIVGLTIRYSRGSRLPGAGVVGHHASEPKEYLANQRHEITIIDLVGSGRLVKGRL

SEQ ID NO: 960502 - protein, 198 aa, Homo sapiens
MLLQWWRQPVAVPELECMEDVILISMGMCHADVCCHVEMLWHGCLGYGVHLHSCCVSTMSIYPSPLRLCSNVVAANTSPVEAVDLSDHFATCATVPYHEVLATSPYSSMSTRTASGYMPFPGHPSALIYVIQGPRPCTFHVGPQILGKLPECAPYDIVGYGVSIQKEELRLRSVKAELSLQGRKETGLHLASSETGSL

SEQ ID NO: 960503 - protein, 105 aa, Homo sapiens
MDQSNACDAFVRTTAPQVEVMIDHVPSQCYPVTHAISLSTGESISIPILFGYYDLYSLSSCISISILLADDPFRVLLRQSGDGGRLRMSVSPSIGLRSLAGPLDP

SEQ ID NO: 960504 - protein, 172 aa, Homo sapiens
MILSVNYLQIFKRTQWVTCIQVVCCTASPWSREIADLLSCGGQLTYTTKELEQAFEEVFQNANFRSFMIQSSGSIVETYNDESRIKGPRVSVTLKPVDYREYGRRWFMSIRSKCVECERQRADRPEVCTGLTESISSHSVTILFSYQARFWWGLNLLPVVLDLVQGSRGGSR

SEQ ID NO: 960505 - protein, 222 aa, Homo sapiens
MENTEDGGRGRGTGQIAVPFRILSQLTGTEFMQDPDEEHLKKSSQVPQDEKPQPQPHLHAQLSPVPGPSGPQHLPARRQRLGCGALRMPEQHMPPDKNEDKQMLIPGIKYADLDALPHCIAARSHESITFGAGQRAVSGGMHQGKGVYVITDGRSDLNLMFFNPDVNHMDQYRGALHYNGYVRNDDQQQDNLSRCRRIMKMKTQVLVEGSLGKREEDKYENN

SEQ ID NO: 960506 - protein, 75 aa, Homo sapiens
DPVRSLSQTMPEETQTQDQPMDRGGGGDVCAFQRMKLPRLMSLESSILYYSNKEICLRELISQFHSECYLDKIRL

SEQ ID NO: 960507 - protein, 149 aa, Homo sapiens
DEYDYLFKVVLIWWTQCVGKSNLLSPLHPATSSTWRCNDAPSVLWMFIATLQHPCVDCAMTIMAADLGDTCCASDALPAAITILLYYQWLHVWQPHDMVVLTICTRHLDLLKEQCELLGLNGSLPGDPLPETGKHSVIHCIGVGASNGS

SEQ ID NO: 960508 - protein, 145 aa, Homo sapiens
MCLSHVLPLVPRVPVLVSPQPPHYACRPALPTFSACLLGLHVGPNLVPLVRLLLAKSWESCLSPTTPLLAQHHYMGSDCLGGLNTRTWSGVAKPRGRAGPTLEPQHAPSGKHPRPTCVLNGSLPPSPHALQRVPDLPIQTNDNLL

SEQ ID NO: 960509 - protein, 107 aa, Homo sapiens
MGDELIDSIRSHLVGRRRAFDPTRKNNRGGDHLGKSKRRVRLTERLKGHVHPPKLGSVLGVLDSDIIVQKIQPYTEAEHRNGIIYVQNEASPPDLQKAIEVAAMLNE

SEQ ID NO: 960510 - protein, 111 aa, Homo sapiens
RASLPPQLQDDLARRRSTPFSPPAPPGSDTPPAPSRRPGDLAVAGVCLRKAEMLAGASQPRNGPVLGRSEPGTACPPRRCVPEQLDRIQMEQWPACLLRLAARNVPVGFGR

SEQ ID NO: 960511 - protein, 134 aa, Homo sapiens
PPWARRATVGKSRRDKFYHLAKETGYRSRSAFKLIQLNRRFQFLQKARALLDLCAAPGGWLQVAAKFMHCIQPLYVGVDLVPIKPLPNVVTLHAGHHNQNRMYGMALQATDADRPWKGRLSDASTDWVPPHVWG

SEQ ID NO: 960512 - protein, 132 aa, Homo sapiens
MRASQGTSHAACVGQGHGQGSLQHQSSIVGDTFLGPKASSGVNHRQQAVQISGYSSSSTQDPHRDIRGSYNNPSGEPTPEYNGTSRATEDTPQYKHAAKTKQRTWQQPRTNKTTQPEGPARTATRITRAITH

SEQ ID NO: 960513 - protein, 96 aa, Homo sapiens
LRENQLNADEEINPEMLNKCAVPGWVVACASGSFVDSAGVLLKMAVSCVLCVPAACLLLLLLHVSPHWPSMMNFSEKCMIEDAECVTMKLVLKCTS

SEQ ID NO: 960514 - protein, 151 aa, Homo sapiens
FLPLRLSRISAGRNGRRDLPLLVIDNGSSACANAGFAGDWLLPEPCFLPSVCGCPRHHVAVMCVCICAMNGLLLCVLTMAHDAMRVHPDPECTPLMLASVTNWRLTCENDLAPHLLQLMLRCGPGVMHPVLLTRGPPEPQWPDRDEDDSGL

SEQ ID NO: 960515 - protein, 104 aa, Homo sapiens
AFWCRRNALAQWAALTREPGYMCCMEWFPVNGSAPAGGAVPAVLKHSSTVACPEMHPCVLCGYDFNLLVELPAALAVMCLLATTCASNAHHTSGLLLYMQCQLP

SEQ ID NO: 960516 - protein, 110 aa, Homo sapiens
MELFYQAICWGLGQLLPPPDTLLPLYLGILDLWVWDHGVGMEMDVSINMQWWACWGLGGCNPTNAVVCGAAQEWLASFWAPVPCYTYYTQLAKDSVESADMLVVGGATFP

SEQ ID NO: 960517 - protein, 79 aa, Homo sapiens
RDAGILQLKGSRVVMEDLRASVETLKRGGGPVQLRGNVLGETLVVAAPDHHWTTCCDANCVCVMLDVMLDSCMMMWHVM

SEQ ID NO: 960518 - protein, 218 aa, Homo sapiens
RFRVRAAAAPGLRARSCAAEAVLAPMDFQQLLAELEQEVDAAAAGWWQDVMQLCEMPSSAEFLPPWHWPECLLTHCMDAALCPRVPGLVTEYMRVPRLQTSMGLLQRLDDMYLDGEAASTWVPVFTAPFCQALLEELEHFDAMDMPKGRPNTMNNYGVLLPELGLDEPADDTTAGMRFLQPADGPAVTLTVAVGRLDSTGPLWSNTAPGHDLELGCTM

SEQ ID NO: 960519 - protein, 131 aa, Homo sapiens
MLLHACMTCLTTCFLLPLTVAAVLAAAPDACASCATQLVHVPAPVQWLAFLLTCWGPVTWLPVCVAHAGTAQWLGKCHQCVCAMDDALLLWSMMLAPSVCACSAGLLRRNCVHAPGYGPVFANQDEEDLTG

SEQ ID NO: 960520 - protein, 202 aa, Homo sapiens
MCCSATGALTTAIHRPSAGSEIFIPWRRARPESSMTAKPFLGQVHTDCISINGGEEIIERGVCVEIQIDLTSNSDGLQGGQTCPIKNTEMEDPSYDLGHQNDLKFPEQIDERVHGRWTVINTYEQVRVAKESPKLGPAPLTAPPASNEQAIGLPETTYVQVTSGGAHETHGVVTTMSLRRDRGINSNRDHETTRYTGAVNRT

SEQ ID NO: 960521 - protein, 233 aa, Homo sapiens
MSGPLARLAAMARANGQCRARLRAWPPVPSGPCTPVLLLCMVPLLPDAAVVLPVLLPCCTLCCAVAWMYLDLLMILGWLAVAHAGPLTDNEGREIIPTASLQLGRSCELSDGSSDNACCGWLLTDLPSGGCPAQHPGLCCCPMKTSCHRWGPKAPSGWQERPAKASQWKYKKGPLCPVAVPAMGFRHCQPQKALLRVQQLASLTICGGPSDSWELAVSPFPLVATMATSDVRT

SEQ ID NO: 960522 - protein, 172 aa, Homo sapiens
MLAARGAVALVALLLRGSLLASGLLLLAVPPLDCPETPVVLYVPAAWMCLGGGAEVWPDSTWILEPGLRTYLITCSKDLDPICAESTRKYVINCAYEQFGCDSTTIVTLQIDEESLKPERIIGPLQGKLRCGRDPEYSLTPSQTQTSHEIRARKLSMDKDFRDRESLNSQTL

SEQ ID NO: 960523 - protein, 108 aa, Homo sapiens
MGGITVNAGPSTRELAPYDENWFYTRSCFLSRGTCTSGVALVVGSMYHGSMGDVRVERRHAQSTSAVGSKTCWSRRVPSNVPGGAEIWWTNGSIVWRFANLIILSGSI

SEQ ID NO: 960524 - protein, 128 aa, Homo sapiens
NNRLVRWLGLKFGRGAPEHFFCAQCGAFLGPEGFHEKDGKDVHVRKDYFDMFAPKCGRLHPEPYLENYIISPQHAVASMSALVCRECIHAISMNGKHSFRARRAAPTVRVHYHERLQDSLMIHGLANQ

SEQ ID NO: 960525 - protein, 233 aa, Homo sapiens
MARYECLWFKSCRGSGPVAGAAVSAAGREPWCVAVLCPRSGGPSSGIRVGDEKLPDGQHCHCQCILPRPGIMWTAQCADWRPPVPVSVQPRPSTTYPGSAAFLRRVEAMVIRELNKNWQSHAFDGFEVSCTVYPGLPARPKTQGLHCDQHLLLNSTGSCGCACVLTAGWDHGDWEHCLSPSVCAWNLVTARELVSQQNVGRVWMVPTRCPVYWLPPHAASHVAVRAVTGEGMG

SEQ ID NO: 960526 - protein, 82 aa, Homo sapiens
PQSVPCGAGTGLLIRLRHLSALRGGAMSEPGWWMSCQNPCWQQGLPLPLLAHVCHAEHAEPLTVMLHNGWAASRRPCERWNF

SEQ ID NO: 960527 - protein, 106 aa, Homo sapiens
MRLNWQRLACTLATDYWAELTDALLAHTQRALTDSAFGEPTGARRLAEVYVLVNVEVRWVIFCLLHWLHVNLPVTEYLALDVLFPLAIVHKDMRSYDREFLFVDAN

SEQ ID NO: 960528 - protein, 225 aa, Homo sapiens
MRKPSPYYTHTRTQRTARTQHAQTQAHTQRHLLHRQLPPRQPPSRQLRTLQHPTLRTRQPHNRARTHHTPNSAQIGRTRAHRPTTHRSTQTYAPATPRNTLTRRSATAAQLPPTPTARKRHSARTSARTHLRLHHASIQTRKRLRETPHLQPPARHAHSDYLTTSTKRKLPTPQPSPPPLGLHHTALLAHHPATTERISSHSSRTHNTTPPRLHAATPHALHYTT

SEQ ID NO: 960529 - protein, 197 aa, Homo sapiens
MAVRLVRLLSPSNEDGMNSKEMKNQPGKYSQLVCGGPSVVLGERNGSSLAKIYTEAKKVPWFDHAECGCTYLNVTLINGCWCMNDLLLQVNGHRLPTGSFKLNLQEAGGRRGTQCRGSPVRRHTAPDPTWHKAKNGMPRGAAGSRRADKKPARGPRNRKKRSHKEGRCRPEGPRRQASIRRPPGPDATNAATQGPKS

SEQ ID NO: 960530 - protein, 243 aa, Homo sapiens
KLQCLRHASGPEGLSRLGQKPVMENDGWPRAICENAFMWYIWDPGGGPHATECGSTTLASLPLCPGFLLYNPLTGVINLNDNTLSLRSGAVGHVTETLKTLLAMVEWIKLWGQPGDATKCVQVAICKHAHPAAGLTKASQADRGKQEEARSTQEEEDEEAGGTKQEAGKRKQAAVTGEILGPSNTEGDATSPRSMYLTQTYHGRTSQNTTLSDNPSFQEGGCLALKRPKKPPSVRSVQYKLPR

SEQ ID NO: 960531 - protein, 111 aa, Homo sapiens
DPPPYLLRNLSSLALALPSLVLVWCADAVPGVATALLPPAAPPYPCVWDVVLHPFYPRSASVPCPSAGCPPPSVLQLLRVLSWCDVMCGAWSHAGCLHSICPAPGAKAGVC

SEQ ID NO: 960532 - protein, 108 aa, Homo sapiens
LRLGTEALGVTSGTEALSAPCCTDASPLPDPAALSTPCRQLTMDDDICRARLSTTCSVHVQCACVFCCGLTDAPLCACLPLHLCVCCPMCNLCGCDWLCALCVMNVIP

SEQ ID NO: 960533 - protein, 154 aa, Homo sapiens
MVTGHVLAFNSIWLPSCIMRPHWLSPRMLHVLVKWLCKCDSMQQMCVPNVKPVLLAVWLVAWCDTQMDAECANQQPCSGVECTSVLCTIKVLTLCALAISCLVVLVLVCADASGCRAGLCLLANSSVLVPCLPGPSPSRCRMLLLRLVVVLGLR

SEQ ID NO: 960534 - protein, 222 aa, Homo sapiens
MSLGWLLLVVLCWACPSPVAAARKGSPAGVARVMLAVLLGPGGDALWACTTRLRCCTCAPSDLICMMRSCLRMLSLSMPALQLDPVPVQDVSLLQQRSEPSSTSIALHYQVVEVNPVRRAEDQVLLLQTVPILLAQEGRRLANNYMNPPVDRSAPQDLPGVGDGTLLNASLTYYPAHEGCARAAPASDRASALGSGSSHGHEPSQFAAAPEPASCPFATLSP

SEQ ID NO: 960535 - protein, 264 aa, Homo sapiens
MADHRQHSAAGPVYIVELPQDFLRITPTQQQLVHVSMLGRPVRAQQTACTVMAAGLEHLWDRLEHHVLVHVQMFGQRTLLCIDPGIGTTRTLRGRAALWLTAVDVTDGLPSSVLPQNVWLVQIENYPPRIGENEWVNPNIATECPQVLLETLYQLILQEAVVSESRNDALSSQWGNMSPVIFALVKPLEIQAIPPGECYPCECGKERQMIGECDKNVGGTEPFEDEGKVPSGGTDARGMCAFDANTVLVNGPLTASVGSQGLPM

SEQ ID NO: 960536 - protein, 273 aa, Homo sapiens
MLLSVVAKSAALIQQATTVKNKDDQEIVLDGIYVSEEMEMTSELVANSARLDLSKPEQFKNKDHQDNFGMVSMSLKEGKVFSRLMNKIYELPGYRKKMPDDIKTYLWIYNRTASNQTVMTIGTFSLKQEKKSRTGNTKNKSRKNQKQENKTTTQRNPKQTERNQREKEHKAQAQETQQSEHTTPNNRPSKHPNPDKEAHTRKTNHRSAHKTRPKSTNRNEKKEKKTEKQTRAKNNEASNQDPHKTKEKDRAQYTTSTTKRTIRPTTHHQRTTT

SEQ ID NO: 960537 - protein, 252 aa, Homo sapiens
KAECVNQDEATNGGVNLKLVCVSLQRQGFHTVGSRCKNRTGAEHLWLTHISGTHIVKAAKVESYLVSEAAFNAPGGELRGTRYTADLAYGMYETVGQLLGPWSQVADAEGQRLQGTRSPASPVGLRCYGVDLLTHIPPWKEQLYCAHADVTDPRTSQRILEVLPWQESRCDTRADMWTQCHRVPGTSIMTGYIRTVHRTYISVTPDILEPGEDIQGQTWAGSQSQRYRGDWQQESRLAGQQLKQRKKNRRIR

SEQ ID NO: 960538 - protein, 69 aa, Homo sapiens
GTRTGPGVITAPLTDRADLALTIAALDVCPRADAVTGVLRLVWLPALLLLLIPGGRRACDASRELPCDS

SEQ ID NO: 960539 - protein, 104 aa, Homo sapiens
GLQVATRISSGILRVPYYLYIRIRKHGLRCWLYLLMVYTQGVQRHEWCVMSSTPEEVKKRKNGGALSSLEKKDKKNIHTMEEGKEIPWMGDSRARLVDDTLTTT

SEQ ID NO: 960540 - protein, 195 aa, Homo sapiens
MRGLLAGPWARIRNISRIRRVNNSTRRGASGDYADSQYWKQVLGHMVIEEELLGERDTAISPKAIPTRADPGHVKPAPLKIEPSWVTTTGTERAYTTGKEPPPDIGHRRGEPQKSPLPGPGVIGAHTVPHPVGTHLGKPPCKPTRAPHKNNRTECTPEDPLHGQPLLPRGAKHLHTNGTHPSATNPTTKQHTSNK

SEQ ID NO: 960541 - protein, 108 aa, Homo sapiens
MKCHQIEDNSCGVTWSQEPKMDELQFVPGGEQSVCLKGTGREEKRVCNQYLSDDTLVLMKHDSGGIDVVRNKPSMYGLWGLSSDITPCPDCEGTANVSNVLPNVMIML

SEQ ID NO: 960542 - protein, 245 aa, Homo sapiens
PCPGLPALPALPCPSPTATRRLKLRFPGPDWTDVPPDLSCPQQPHVPMGAGPPELYCCELLRQEHCRAGFTAGLTVIQTVLWTTLCATLYIMTCGAAVGWADRGVLLKCSRISSTPSSEDRHGLATSPAMSTRPTSNPDNLQGGRRPGPQYCAELAGCARVHAASVASASPELSLRGAPSQSENARLVARPLSMPATWTLVVADTTAGSNECIETGQREQSSKLPLELNTVIPPIDKCPVLSHAS

SEQ ID NO: 960543 - protein, 260 aa, Homo sapiens
LGSLLYRRFCRVPPATGYPATSIALAMMGHRPVLDASARTQSVNPEEKFNTGNINAAKTIARYHPNNVMGTKDHMTEDAILGANWDGHCDVTQMMAHAQYYQKRIQVQDIQKGQDHIESANIDVKTPGMKTRVGKTEEPQITINFIQLTRSNLHNIRNMTNLYTCEHKRNITTNTGEVNTQVDNTQKKTRERTKNNNKKKPLNKHKNKRNNANSNITKRTRKQIKINGENPTKQKGNKFTITTKDNKKHRTTQKSNQDNS

SEQ ID NO: 960544 - protein, 67 aa, Homo sapiens
EQETSDVKTLRNTFENQKHPESIIKVSIEKRHMEAGNTYRDYIQVYAPFKTKEHIPTTRIGQDTSKH

SEQ ID NO: 960545 - protein, 110 aa, Homo sapiens
WLLPPYSRRCMLRIMTGNRALAVPVHVRQPNRRQVLGGDQQMSTGIDPTGTYHWGQRPCRLERINVYYNECHLAGKYCAPRRARGSGARTPWTPVRYGALSGRSSGRTTS

SEQ ID NO: 960546 - protein, 80 aa, Homo sapiens
ASNALTEEEEPEREQYAGVGTMVCGSPAIDGVVTRKIQVLQQQARCCYEDAVADLPPGEKLSGERRAREQAEAECGLLEP

SEQ ID NO: 960547 - protein, 85 aa, Homo sapiens
DPRLCADRLGLRAMSVDCAVGWAGRSCEELTADPKPDRSSSDAGLTILYINKNADSEQAPRKVEPRRSEPGTSGEAYKRSALIPP

SEQ ID NO: 960548 - protein, 280 aa, Homo sapiens
NRRLLARRGRCNPWMEARRRATIMPGRLTGRLRLRGHQPIRARLFDRRIGPLRGLLKAAENKKKEAVRVAGRCVGPVGARRRRHVSGLRDQSNSNAAGRIMLRNGVSREDRKNPAGPPALAWLTEKEETARRSVGALNGKNGVRRRWNDDLIYNLQGEGDTIPGLEDQEKGDRRSLKRLIGEKAHFGQGNSGVKGKANILQVGLRPGFNWDAERYSQRVQKRGSFGTEVVAGGAREDSGERGPGGKNGKSESYVAEAVTIDIGHTWEIRSNSGHEQEDQT

SEQ ID NO: 960549 - protein, 108 aa, Homo sapiens
MTRVLWVNRHRGDAGPGISSRGLKIEHERSQRERMRNLRGRGGAQRCSMIAGTCDQVFHTSGPVPNTRLARAPYLGPTVPRNAAAVIMGNIFGNLLKSLIGKKEMQHP

SEQ ID NO: 960550 - protein, 190 aa, Homo sapiens
AGVSAEETRESGVLMHVHIDGRFTTTNKKVKKQMQSDPHKQDVWTETEFLSRPHRPQIYLEPSTTPMTLDTDYKRKIIMSDMDACTPNMGPPYKGTPINVITEKIYFKPDKRQHRDHINRNDIKYQQGPRPEKRMENAFERRHGENPFRLQHQTSNVRATKDENPDGARTIKTRHSRQHWKNVMHTKALR

SEQ ID NO: 960551 - protein, 115 aa, Homo sapiens
MSWGRRAAAQRRGGSTRTSTPPWQRSGTDGTTSLAPRTASGAPCSSQHTRRCGIALSLPLSPLLGLPLFRLALPCSGPDWTGTMRLVVSYPLVPGDRVLCGNVPHHPWHVQAYRD

SEQ ID NO: 960552 - protein, 221 aa, Homo sapiens
RTEACGEVLQRQQPRMVQWVSISRFRYSAPSQYLGVPHLWASCTTTNRPHENAKEEVRRISGGCWMLTWRRGLYLVGERVTLADITDCLHPCSGSDKQVLEPSLPPGHYPIPTDGYLTMAYNQTPVTGLSMGEDETDVRRWTRNDAKKYAEPKTKKDTHNVKETRRSQGRQTAERPTRAERERQEQKGGLAQMLTEATTQWDTLVNKETQRRINHKYPENQ

SEQ ID NO: 960553 - protein, 69 aa, Homo sapiens
RHEGSPAVISTLWNRSWERIQTRHRGTQRRLPCQNLAGDVLSEPMRQQMAMPDASSVPMCDMLMHADAC

SEQ ID NO: 960554 - protein, 262 aa, Homo sapiens
MSFLGCLICSDVGHAGTIETVTSVICLLTVQLLVTAHPGSPDLSMHCCVPACDHLQCSMLATTMICCCHYLHVRCCGHVSSCACFCFPCCACVLCCDVIDLVMCCAPVTFFLMYFSVCHPILLLEVPDPFPCVLLSLCHCDIDATCANVSMELVVSCHACAFDACFYLHLTYYPVVPGGLCLLFVPDVSSCAWSLVKTQSCGPKGGLFLANVIFVSCCAVAWKSWLLQCWSCVPLHLPAPLSDFSHGDLTDPFFVALQIGCC

SEQ ID NO: 960555 - protein, 349 aa, Homo sapiens
MGLHKSHTQAVYYTTGPQHINAPKAWWRYHTRGDKKPRQRASLFVAPPPDGVGGGLHTGVNRRTCWTPPKTKGGVPPRRGGGGKNKAGPMGDPIRHKREYITSPPQPEVLLLENPAEKRGGGAYTNTESAPGGGPPHNQQQSPSLPAERAGGPPFFSLLPAGARAAGNITTSTSSSLKREEATIFYAESADTTPFFYNHHPHPRGGGVIHPRGAPAASLVVVVHPPTPPNVVVVFLWGRSPPGSVARNRKPPLCFLTPISLLYARSMTLHNPPFGGRILITAELTHERRTHIIPPLLDENPDMSRQLPAGRNTQPLVSRRDNPAGGEKTSLVGRKKYSPPSCHHKRDTP

SEQ ID NO: 960556 - protein, 153 aa, Homo sapiens
MIRGCAGMTDGCDVLCMPAVLMFHCVPCTNVMDACLNVLCYGMPSCWCTAALLGATCFACLFLALCLCSVHCIAWCLCVSISCADAACLDVRRCYSVLTEVCWTHSETCPYYPASGDLQCLPCGPSCCWCQTLCCGLDMWCVYDLTLMLYCIG

SEQ ID NO: 960557 - protein, 97 aa, Homo sapiens
TFCGLNTTPTIEDSYRKQVVIAGETCLLDILVYRRPVRSTVPMPEQYMRTAAGLPCACVLPSNIEPSLHDWTFQTSTRGITDWSTGLAKVNFWGLDG

SEQ ID NO: 960558 - protein, 142 aa, Homo sapiens
RLVYEACVVRAECRAAELESCCAGAELPPWPWNTLSSRFLPVWTSDEFDDEQICGQSSDGGWLCVLAVRSQAWTRAEVDGLLLARWTCFVAFHAALLGTLPVNTKNQAVNGAEPSGVVLKVLTNFKSSEIEQAVQSLDMKRR

SEQ ID NO: 960559 - protein, 288 aa, Homo sapiens
SSVSSGALLFIKSPPKKKKKNISGPPGLAPQTEINPTNIAGPEVVLLFYPRDQTYSLGAEEPMTPRKSGFEEWPQKLRRGAAPITALRRLVVHTNSASHRNTHRARAARGGALDKISACLAPSRVEPHSVEGEATKEAAVTSTKNPRRWHGSNSRRPTHDYKTVTTRGEKPNHRRGTLTFSRRRGHLHTDPPSWEQDGSTTTRPAHITTGGENEKGSPNSLSTRSSPPASETNNGEKRVPQHKKYTQKGDTHLTGAREWRPITGESAGPNTPRKITPTFTPSIIKYFV

SEQ ID NO: 960560 - protein, 90 aa, Homo sapiens
MALLIIRQLCLLLTAENIFHSHGMTSCCAEEAPHSSPRSMVHCPQTSILLTSTELFQLRNQAEGPADLESRTCLLPVPLLVPKPVPTGVP

SEQ ID NO: 960561 - protein, 234 aa, Homo sapiens
MELLKCLDYLGADQRMTTEDEKDDKPIRCSVLSGDIALLENLMVSSTYSRAGSSKLEEMTFTRNIRQEEFNRSSLGINTKSDTGLVPDQHSGHLAAMDSSTTPEVNTRFTRVARVYHSMSQMLIREDPIIHYSERKMQVFAESFDGGACSWISVAAYQTLECTGMTSGACEYEYYTYQDSTIPLGLLKIDPTVTMIDELGEKLMSHTVMLAGCQEPIEETAEKYFEPIYFIQRG

SEQ ID NO: 960562 - protein, 226 aa, Homo sapiens
DHHPNTQRRDRCIPVSTCGFIYPMLPGVAMCGPVCLSDVACVDAAPSAYTSLPWMCPVCPDTVMNMEECVCALVVVLISENVETAVLCCSCPVVCSASSLCLCAVDHNVLHVDDPCGHAQLALCMCPVAHAELTTCLCVICDLCCCHVMVHAEISFFFLEPYLLVVLHLLFFLPGACLADQGCGWCLTMCHLATLRQGCEPIAGGLTGAWCGPCLGAWLPTLLPLC

SEQ ID NO: 960563 - protein, 206 aa, Homo sapiens
MGMMFEMVEGKISPQYKYSKISPPFSPPGPRGRGRTLGVFLLRLQGCGERDARGGAKGEEGNTRCANKCAWAERVLLCRVCPLCPVFPVEAVPCVALLCVPSLSPGVPPPVCVWRPKPPQLCVLALCAPVRERLSRAHHECCALSSISLYSLLSHRAALSRECCESRLSVCPPSLCVGISVSSTVARTCGYSLCERYCGHSPLYTL

SEQ ID NO: 960564 - protein, 134 aa, Homo sapiens
SQGMSFKCEAKSVHNTKSKNHTHFPHRAPGEGGSVGVPLALQGCGEDGRGGPIKGRRNTEATEAWLEVSCCPRARVLELPLALLCVPLLPGVHACVGGAQAPNLCRGSWPLKKASGHRACSHFLFSFFQAPFEC

SEQ ID NO: 960565 - protein, 254 aa, Homo sapiens
HPEVPFSPSACNCEVYARGRLDVPGPDEAAALGLSQPSRMLVLPSRLSLKPLASLSSDGDRWMGPSPSELAGSPDDLDLPSSSLSSSAHGFIVLQRPHSTTCVIGRLRVSPYDRCVVDEESQREPGASGAPGAEKVLQNATVCSRVFEYMSYLQCHSITHSEVKPFECDICGKAFKRASHLALEHSIHLAGGGRPTAARSALAASGMRVSWPSHSRFALVGERQFRVHTASPFWSRHLLTNAVELLSRLPVAQY

SEQ ID NO: 960566 - protein, 246 aa, Homo sapiens
WLETAGDFCPVVHCEPRDDSAGTASMLKCASRGCGPDGALLAHADADAAGSGCAGCLAACLACQRWLLCLWPAGVPSDSPGCPGSRLRVHWHCPQRRVHCRLPCCPLMPMQGVLLQSPEEELRGRGAAAARDRSCSRRRTLGAQREAIRELTGKLARCGGACGRQGRCGAGGHGQKDTMGDLRWDPGTSWSTLSRSLQTLKDRLRASSPAQSKRFNAGCGDFARCQSGGELERVLQVKLETESPVQ

SEQ ID NO: 960567 - protein, 109 aa, Homo sapiens
LQPSALHPGLRHVWVFVVVCVCACCSCASCVALAVMTHPLHAVCCPHAHALTCCVPAPDCAVSIPVMWTMLAANHLLLPKCMCCLPPGCCICCAVSFVLHVVLVTVHCS

SEQ ID NO: 960568 - protein, 239 aa, Homo sapiens
LTLEGGGPACCQLFWEKKLSGLNAFDIAEELVKTMDLPKVPAVVVVTWSARSDDAAVWPSPVALHTSTMPITGTCSRACLWMNEPLAVIGSYTTAAPSANAFMCDLTEVTLSECRKSLVQQCAEMRLDVRLLMADMLLHVDVSWPVTGMAPLDKACADGLTTSEELSEEEELSEPDPGPGDGARLGQCAAVATVGAALDVGVLAVGDCLVNTDVLGMTGAPNSFLSLEEPSVPSRGVAK

SEQ ID NO: 960569 - protein, 369 aa, Homo sapiens
PALNLGIAPTLPAPQNPLPSPGASRELAAQDGRTQAHAAADILLPLLLLLIAQEWDAGPGRVLVPEGPLYRGGWHSLSSISLQLLTGYLRALAQGDEPFGRGFHVVVPRRPPRYWHMGSLVRYQKGIPPGFIRIACHSEVPEVGGEGVDALQGCSTALQSADLPVVMAPKGHLAPALAVGPHAQLPRSDFNLSFAQRSPRSTLDLPRALTPCGTKSLTTAWDQGDEEPLARSFTFHQELPTIPPEACSVSLGSRCHTYVCPPTQLGPMHTTGTHVENTHSPTPRHNMAVFAPRVRPILPRAAAQRRHHHLVPPRGIAHSPLVRARATKSATRAKEHDAPTTRPFGQVVAPIWVRANYWLTHEEVSTPRV

SEQ ID NO: 960570 - protein, 151 aa, Homo sapiens
MCARVLSLSPDVITTRVVGVCVYHALPPVSLVVLHLYVSRCAHNISSFIYLSLRPLYTYFFYYLCVYSTILCGTCVDATPFLVCGPPLYLPLFFLCSPPTHYLRNSVYCKRGFVVLSPLWKTVWGFSSANARGGHIPPGLPRCRFMKTTPL

SEQ ID NO: 960571 - protein, 322 aa, Homo sapiens
PSSPPAAAGYVTITPREEPQLPQPVPVTITSNHEQLRPRPSMLMCPHHGVTHDPHPWLSSYPLVPRRQTASDEINYVYTAALSYLSTNSRLCTTGVNRTVLSRLRRHRNDDYVATTRTLHIPVGSQTLLIDLLTRPIDDLADAYSTSTPGPHAPHTTSGIINASNSGYRPSQSTPTTNTGNHSNIYHEIAQKLKREHATLTANFHRLSRHTYRYQQQWSRTLSAEASKSFTNDRAPRSQRISQDFFPHIDTTRRIHIQTLRQRDLEPDSRASSKRTFNAEEDLLYDEALTQLLNSQPRFPRQYTLQRLTDTGDRLASTIYKS

SEQ ID NO: 960572 - protein, 138 aa, Homo sapiens
MGGPPLVFPSLWGARGGGPRGSGKTQRPPPCVYPRGEPSTSLITYISHKIFAPGRLGAQAAALLTPRHLGTGLGARKMGIDPGQGGALACGRRNMGPIVLPKPGVATTARPLLKKRGGQRTPPGNLVACQWAPFALEL

SEQ ID NO: 960573 - protein, 237 aa, Homo sapiens
LVEPGSPARRRGVAGDRLVEVNGENVEKETHQQVVSLQSCAALNACAACCVCLTPDDWTEQCCMKLWLSSVLMMDACLRCPGMRLGHGLMPAWPACRVCMGGLATKMSLAEADKSHPGAARASASALYHEEGPQWLWLQTCTADKSKPGQFIRSVDPDSPAEASGAPGPRIALWQVNGVLHWRATAAIGGRWCAAIRAGRGRDHAAGGGQGHLTESSECECPSHEPLMVLPVPSPWG

SEQ ID NO: 960574 - protein, 103 aa, Homo sapiens
MEARIPPPEKSLVGGPPTGGAGYADRRYYPHSPDELRYISYQRIIRNNPKLLSCAARARPPTRRGAPSLLIEIVTPPVGTDGAVYADTSYGWALLPGEIPPSL

SEQ ID NO: 960575 - protein, 126 aa, Homo sapiens
MWCVPLSCRRFVFFTNARRAEEELSFHHPPGSEQPGGAAPPVPRKVWSPHECFPPATPEGGDLYKEGASPHSEAGATHISWAAPRGCLFPPPPIVLPPHQTGVGGGGLITKEVNSPPLDVGQHSFF

SEQ ID NO: 960576 - protein, 156 aa, Homo sapiens
LQTMPGWHLHAAGNKLEALHGHLPSFGYPCLHLPGLSPPHGMDPKARRFLWNLILDLIKTGPFQLVRCLSPRAVERCARALCTRLAIMVNWSPAGAWAASSTRRTGFGDGYMITVRTKSSQSVKDVVRFFNRNFPEAMLKERHHTKVQYQLKSEHI

SEQ ID NO: 960577 - protein, 108 aa, Homo sapiens
TSSDSCLTHLHQPTQLSINLAMAIPYERAQLIKGFRSKIKNALAHCLTTRAHRTPLIPILVSYRTPVRPYVIQPSSPGPYALEPLNIWCRRTYVMHLIRKRHPSNINH

SEQ ID NO: 960578 - protein, 158 aa, Homo sapiens
MWGPLKCRGAVCGPPITRWGKSCGPAQTPTPWWGTPPTCFSPRSSLSAPQRIHVVRPPSIRSGGTPPGEVSPPERSDGRTTIGARPPRVPIPLGWFVPHPFCVAAARLVVSFPRRSLSINERGGKLIYLPSRPARGPHTQREFTPRFDQTRAAHYFYT

SEQ ID NO: 960579 - protein, 115 aa, Homo sapiens
ELAAPELTDTLRSWNGERADGRVRGASMITSAAGNYFSSVIDMIEPTALRTLHYTKLNAVVIDFWADIAESVTTIIEVLYKYKVPGVVHVAALVASKGFYHLGSLPEESLNYSPL

SEQ ID NO: 960580 - protein, 374 aa, Homo sapiens
LPPPPNLGAWHPPAWGIPVEPACPSWDPALGPSTNELRMSATVVLCCSLECDVVVHGGVCHTPAMRGQWLQCMLWSPLLGVDPHAVSGAGWLCLLATPPTPGPAGCAVYCLTCGPHPRLGRVVSPLFQMVAHVDPHVLDPLDACDLHLAQSASPALVGMPVQHIPAQCQPWSLQLTHASVSLSDVGLWGSPSPQDIAPTISWLLASGDAACVPEFSVGGTQPMWPKVQCLLDPGECVRVGEPDTPASLGAGRWTQAALAAGAASVLTLVTCPPGLWALRPLWSVSCVRGEFTGFDTQTEERGEKSRDTCKGDTLVDSFPQKPFSERQVRQTHAQSSKGTRRANSGVHTPTMNDRDADMSWTHKEEMNSQTTENS

SEQ ID NO: 960581 - protein, 67 aa, Homo sapiens
GSGGAIGDVGIWWATIEPTDRSVSGRCPRAGVCLGVLGPLLTAPWSDSCAAESAAMDGRGDRWAGPR

SEQ ID NO: 960582 - protein, 47 aa, Homo sapiens
MGLPLWTRPLSAAAVRAFTGASGDNRDWNTDRSVYMASVSSPEKPIP

SEQ ID NO: 960583 - protein, 280 aa, Homo sapiens
MGRLNTRLYREDRRARTHQACGLKFSQSPCSGLHGRIPRLLVSTRFTVHLVVPLMELDVSVFMTQHGHSLGLPCVLVVHAALRVPPSCNPSVGADPGGDSSYSLPRVNLPPLSLWNGVFGLRPTRGCLPECTASGWRPSRAHFWRYSNHFACAFNSRFHQKTRSRGPPVANVVRTYPRWERRGPISLNVGITGCLGNIVLCAKGGPTICVGGTPIITFSFCGRQVYYWLLLWTSDETKRPLLRESGPSASTQRADSWRRALYPPRGALSENGAVRALTGV

SEQ ID NO: 960584 - protein, 103 aa, Homo sapiens
FFFLFVGSPGTLGQNMQGPEQGAFVHESLHGHSSPHAPPFLHVGKGCLLISASRVRWRAGKECGAQVIETHREGQISLQGQRAEHQRRPKPSVGKVSGAHYPY

SEQ ID NO: 960585 - protein, 123 aa, Homo sapiens
MPARIPAGRRHCPPSSSSPRETYEEDREYESQAKASQDRGGGDRLLRPRKARTGREATPRGGRGCAAVGGRSFSQPEAGGSHHKVFCSPVVHVEDSVNLVVEADLVGSAGKIWDNMLCDDDAI

SEQ ID NO: 960586 - protein, 68 aa, Homo sapiens
AFKMIFFAGCCPQKYQSYMPVSGFINKPKPMKPLTLSLARVDRGTRCRGFPVLAKGIHSARRKLFVQR

SEQ ID NO: 960587 - protein, 274 aa, Homo sapiens
HAAVSASWACLCGAALLDAATHLLLSCCRSSLVLTPAANGPRAGDAGSLGCPELAPNFGLKFACCLSPPPLLALPVLCLLDGMLCPLGMRLPGVPRGCALLLLLLLPLLCAAAGEQGCCLAELRVLRAACLDEHGVPEDEPAWRTADADSISLELRKPDWHPRLLHRRLQEEDVKGSYRALILGELEKGAEVNSRPSALSPRLQAQVEIIPKWIAMAKLRQKNPRAVAEGRTEVGSGASAHECRCNYQPGGHVSPISNVFPSRNRLPRRRFDLL

SEQ ID NO: 960588 - protein, 340 aa, Homo sapiens
EKFMEAMGFGLKPAWGGSIPSFLVKNLMYTGFSRSVWLGVGGTPYSSPPGYMEGPLYYIGTFSLSKAEGVLKSVKIYYNYYTVRVLARTCECDPYQQCTSDVFHTCVACMCISEECLQRINVRGHIPREIVPEETRVLCVGRDTESLDTFYAPPHCHYCLDTEVCHNSLAISGGTANAVTVEGTHHKARQCIHPVVAKPQIKRREQNTTRDETLSEQRHLRTEDRAIARATTTLSTDRLTTYNLLEKMQATTTNNGGGEHNDEQSTPKTKQRRYQATRTATREAHTNDDKVESTASVGTRESIHRNTHKTQAPKGTTDQTDKKHATSPQNQRESEHKQHE

SEQ ID NO: 960589 - protein, 113 aa, Homo sapiens
MSQHVNTMIKTIRNAQEQTQTEQVRKSYIESQCKTEFNPTLPSLEPRALLLPQASPRAQAQPSPSMVGHQQPTPVYTQPVCFAPNMMYPVPVSPGVHLYTHTYYAHASESATT

SEQ ID NO: 960590 - protein, 253 aa, Homo sapiens
MIHTMHLTYTFNLLRRAYRDVRTIRRGSPIRTIRAVNYHLIPFIRLPNLEFGPFYIGPLWGTLGPPTTAAYIYTRKSNPSTDAPWHHYSLCGRMTAHKQRRRTAQRYKATNRRKSTGTCIGQGKGQNAIAKGNDPTPEGPTPKRQRGEGKDRGPKPNAQDTPTVTMTEAQGGMHTGQGAKHKEPSSHGDMETKALEPRPRDCTKDQGSNDPEKPRYGPTDVTIKAKAIDGLEDAAAIGQRERRNGGTETHKTP

SEQ ID NO: 960591 - protein, 348 aa, Homo sapiens
RIVVLDMAESSESCHHGHPARGWRRRGNDPLTYQPCAEAPGVLMPSPPALCRDLPPFEDESEGLLGTDGAPGTEQEDGEDAPFGDGSGEGTTAPVPELDAYAVPGGTGRLADEDVEESERLSSREGVARLSGPCGSRVAWEVGRGLGRCARALLLTAADRVRVTRSARWRWRGGRARGGRRGVWRRRMFAPVEVLAGSQWATSCPRDGWSMSGRRWAILPPVFLTAWAHQPEGTTAGNFSGSRLAGLFLGITRESLVVEQLRMGSKERIAGHIVLALASNGTWYRSLRGWAYAKIRRTLNADPPPEKEPLCSHSSNTCGIETHIEYSEEMAMPLRHKKRKKRHKTEGQ

SEQ ID NO: 960592 - protein, 221 aa, Homo sapiens
ITLTPSAETDVSLALPCASSTQCCLGGPGGPGAEDVAVWTRAQIAYTSWSRMARGPDTENMEEVGRWVGSSGARRRWRLHAALGLLASSLCPGRDPPVCDVEIHGPRSIRHRPALGLAVAKLVLWDRTGVPREAAEISFFFLEPYRSSSCTSYSSCLGCLGGSRAVAVCLTSGTCHLCQGGAHCGDDGAGGSLLVLVPTLCPLCEEHRELAIACTQDPFCE

SEQ ID NO: 960593 - protein, 227 aa, Homo sapiens
KEKQFHESDHTNTWMPKSQAKQRQAEPVAAMETFELMMQTEFGRTVRKGGDLGLAPSARSRQSLFLCREGVFNSKPQRGVVIGSSFASVCGNVSWGGIGAAGWGPRRLSGGRPLSSVDDGHCYPQSLAVGYIWRLVGLFEKRKGPQIRNASIRDYVLVGREYSEKPRLAACWHLPLSQSALVPVSLSQLVDYVHCRIRSMLDLPVVFASFALGQPICIEGREGAQVT

SEQ ID NO: 960594 - protein, 249 aa, Homo sapiens
EADGRGRKLDCSRELLEAAGWRLAAEPGNLCRLSGTIILVLSVKGGRCGKCTISTGAGPVHCCHAGKKCVESCDVVTLCGPMYTPACSGAAWAGLCTSADLQAGAPCLPGPGAEHLAHVCVCFLLLRMPDEAVDVERPQEKRADTAVLCPTWPWGELDYLGGVTLPPGGPPDAALWPPIRSPCVPTSPCGAHAGHHGPKAVTVGEREARDGPTEEEGCRLTGNRENMAGDQPTCRGHSDSQGAARLPLQ

SEQ ID NO: 960595 - protein, 289 aa, Homo sapiens
WSLRSSLGHMALPETMVDALRLSCEAGGGEAPCAHPNLLLLPCILPGPLEMAASTWDELASLGKYQRLALVLLRSVPELVCPNLGFDFCMTLCLSSSDGFFYGTRHEQKLDLTEHFNLSSCHAPPGVLLATVLGAALLVQLFILTVRDCFGLLAPPGLSRDFYTLTSICAIGILNQMSQEYLQTKLDKRGRELTYHYFEEAFPAANVSRCRLSWDANPLGPWVGAHQSVTWGAGSWVSVKSSRVVPRNSGYYRNVPHVRWEQSISGTDERYEYDLVQVASDSMADTGRR

SEQ ID NO: 960596 - protein, 208 aa, Homo sapiens
LKTEARAGSGGSHSSLSDLSNYGLLPSSDNSWVLAGSESLPVETLGPASRMDPESERALQAPHSPSKTDGKELAGTMDWRTGRSSRLKALSLAALLHSRRLRLNGHPGTGCCSDGAASLLAQADTATLHGQTCRRPPLRDTACATRHTGPGRPEPSTEPAFNPQSTLATQRTEGRLLQQLTMTPTVAPARALRETAGPRGRTHSSRAS

SEQ ID NO: 960597 - protein, 150 aa, Homo sapiens
MDPAAEPAECWCGVTTCGTSAASSSTQQSALCLAAVMTVPPPPAAAPPLPRALAKPCLSSSPVNLLPWKCMDVNWLNAPNSLRRTSNHVSAVCLSTPSSSVCGETWQLEDHTVCLQFLYEAWLQQLNDMHHTVSLDAPAYVCRLLCHVRI

SEQ ID NO: 960598 - protein, 108 aa, Homo sapiens
GSPSIFIWKRSKGASMKQGRGAGRKQRLNSQELCRQHKQAQRGHHVLHTPHTSQARRAFGELARLHFRQSGPLPTQTHRTPNKASPGKTRESQTHSCDPGTEKPLGPT

SEQ ID NO: 960599 - protein, 163 aa, Homo sapiens
MRQFIKPSWVGAYRASGGQLATGPAILVQISWSLRGQLGAAIWCPFPPFSAPPGLGGPWGATLWEPRLKWLGMTPYSLTSPINLGHGANPSATPGGTGAALWKQLRVEPVLIVGSKLLVLGQLEGIHPFGDFQLPGLLEEGCQSSDELRVVHVFTVTPGYRAG

SEQ ID NO: 960600 - protein, 146 aa, Homo sapiens
MVCALCSEATGWSIAGGSSGGAQCQLSCLSKAAMRAKVFQRGAPWQQAAVSISRVSVCQMPRKDWLVKCCENRYQGHVLRGPGSSRLQGHVDAQRRVAPSAATVTSSAWSRSPTAGARPDAIEAGPGEADIYCLKPDRDSKPWCKS

SEQ ID NO: 960601 - protein, 264 aa, Homo sapiens
ILAAVAWSESRGGTRRAPQESRDRRVPKSRACVREIPDPVMGDTSEDCARSIDLEGTVILDLSGLGGLIFASPNSAVMRRSMSSEAPASPLLLLSRSVDLVAFPENGESETEKDDGEDEEDIPKSPPTRTGKRARMTRRMLRNAGLVTRLVKISGTYDRHYRSARVETPSHPGGVSERVGERSRQRERERREHGVYCLVQRMKWLAEENSRDETIDRERDRDEGDRTFAQQRSEREWGAERSPGRNEPRAMNYQDGQPEVRKRD

SEQ ID NO: 960602 - protein, 62 aa, Homo sapiens
MLVWWVPVRRRPMEEETQLDAAPWADWGLRPQQLELECWPSLRLPSPAGWLTEAGAPRLSSC

SEQ ID NO: 960603 - protein, 124 aa, Homo sapiens
TEKNWANSMNAILRECGHGRFQVDTGYIVLGLALMADGCGGSVGGGGFGAAQRLRTDMCRVRHPNKGMLGPRVVLPWDMMVGAITSGEVWLTGLGRRQCLLILASQLNERLYALSYYILNRTRG

SEQ ID NO: 960604 - protein, 226 aa, Homo sapiens
MAASGPGCRICVLVSRGAIRQPSSLRCSRCWFPGLVLFPAAACPLAPSGLTLESPRPFADWHRSYQAGKPYIFVLSDESQSPVPAALLSHLGSFGWVAFLSSNRGHASAYCFFYRVDLTAASCYSLSHSIPRPVPYALCSLDLLNTASRGQVDVELPGGFYPTLVLFAHCLGSHHQSVLLDEGGPLVSRHGFVRLQSWFRGSCWVASWVIPQNFFLSNVCGLSLRA

SEQ ID NO: 960605 - protein, 183 aa, Homo sapiens
KPLDLAGAEMKHILVGNKVIYKALKRYEGPLWKSSRFFGWRLFWVVLELESFPGFRKQPDAVHNIYRQGCKHLNPAVCPGKSHGWLAFFLFLMCLVDTSLLASGVPLRISLSSSLNDEDLAWKQEKNILAYSTHYCSQDQLTDEEEEDTVSAADLKKSLEKAQSCQQRLDREISNFLKMIKEC

SEQ ID NO: 960606 - protein, 109 aa, Homo sapiens
TIHSGMSLCPSAGGRGFWVHPTRRELHFPISFIPGAHPDSSDLGTDSPTTLCSFFPRMSNLSAGQTRGMELVRPVVYVVEPENGQMMMGEGIVGAGHARLRPPTPPSRT

SEQ ID NO: 960607 - protein, 247 aa, Homo sapiens
GQNGGRRQGRWWEAQFEKRCRFWVPGGRRPIFGGPSAEAAAERPKKIKSGAWRRLASGPAGAWRFAQFPWKTVRLQERTERGLVAQRPQCENTLSPGTGGPRGKQGRDKERDTKVQKKKFSVLLKKPPLRVVTLNPSRTLPRVPCPQETSFAHRGPPSAKKSQAEGAVYGRSWAKQGQVCPGMVRQGPGPGSSTFLQHGPSPGPRNTVKGPSKPVGLRNPWKAVVGQIISWATRKGGMQNLHNASPR

SEQ ID NO: 960608 - protein, 157 aa, Homo sapiens
LAVCQYMDLISASADLAGKRLMQVSHRHLDFLPPGLLLSAIPGSSTADGGPCGDPACQPRPEPSSPPYTFRHKISFILYQNLYLGNLYRLGWSLSLCPLLTQLLRSRIETLLAGAAHAIPAPSFPLRDSVSGWGRPDLGMFLSLHRVSFSGPVVKLK

SEQ ID NO: 960609 - protein, 136 aa, Homo sapiens
MIGGLMYLLGNDHIYETFLVTAHALVIIFFIVDTHHNGGSRQHELDSPYSNSVPRDYGVSAAYNDISFCLLPPIVSVAPARICYSGGRSRNGLNSSTLPCSRELQSRNPKKYQRGNNKNGYLRYNNLKEDGRRGFG

SEQ ID NO: 960610 - protein, 250 aa, Homo sapiens
EAGRGLVVGVMWELFQPVMPPLLLPAWASPGGSGKRWRSSSFRVQPAWRAWAPSPDDTSEESCSFPELLWTCGRWSRCALSARCVVVRLRTCWQCPSPSGCDGASDGSGMSLSLSDTPCSQTSYNSKGVAHCGRGERSSMLLYPEFHDLGVGMTCVQDELVSSRGRWKVVGARGRAVWQECPLLRLCCTSGASAPGRMMGSSRYNDGEGDRPPICAPLGPQEFYCDFIEFSYVRVSCEDWMCPARRGGQI

SEQ ID NO: 960611 - protein, 63 aa, Homo sapiens
MVAGLLAPECAADKGEHWLRMLTPESKGIGYNGKDKGVRKHVSPVQVTRDSKGEEQHKRMKQP

SEQ ID NO: 960612 - protein, 157 aa, Homo sapiens
SPSSFFFAPKNQINPPPLLNGGGGREKRQEPDQTPRGRPPTVPAPPRIYIRAPRVWEITGDTHMLCATEAAGEERGEGGERALLGGGEIVAHTERAPPLWERDIPQRGWRVWRERARTIVARARAGVLSWGRQRVGACAPPQKTTIERGACEREGGV

SEQ ID NO: 960613 - protein, 72 aa, Homo sapiens
ADAVLWNQRKRAEEPTFGWSPRNISSPSQSRKKCKDVRTDAEGIDCASPAHLIQSLGSRSCIQEPNFVAIES

SEQ ID NO: 960614 - protein, 130 aa, Homo sapiens
MSSETTVTEGAAKIAFPSANEVFYNPVQEFKSGPDMCCDHRDLLRIQLGAKGVQIKVPGEKDTQEMWSWTCHEHEADEVELKDSENLVLTWDQPRDSGRWGTSVRKACCVLEVPGASGLRSIRLALDVLG

SEQ ID NO: 960615 - protein, 104 aa, Homo sapiens
LEGNCTISAHYNLHLPGSGNSPASASRVAGTIGACHHAQLIFFFFLVFLVEAEFPPCGPGCSRSPDLVIRPPRPPKSAGIHRCELPHPAIINYSLSLSGHMQSL

SEQ ID NO: 960616 - protein, 101 aa, Homo sapiens
MCEGNVLAHITGGATSWRGLTVGGACPEYVSLGGRVAKSVRDTGFAPISALSYGATRVGPAFYAKCSAPRIPPFGPQFGRKGVPPLLPHRGATPVGGFLPG

SEQ ID NO: 960617 - protein, 215 aa, Homo sapiens
SLTHRRDAQEDRRPGSPTTSLRSSNYLDDYPKCFICGEQTNCGAPRQNAADPHVPFAGKGCGWLMGQRTPMRQGHPRPLENNPKLLGETGWLIFRGELLGFGWFPQGGNFHLEDSRGTIVCCGPLSVGRLVGPWLGCHCPHCEVPCASPRTLVSGPRRPPFSKALGITTKILQGAPFEILSDVQLIKTGDQVGASEATLLNIAHISPFSFGLVIQ

SEQ ID NO: 960618 - protein, 353 aa, Homo sapiens
MVQDEMTDVTGRVLQTTSILYGGRNKAIATPCPGTSGTCGTSSSTRDIEIKGVGHCSAYDPPDSQMQEVHTEVLTQSSYRKISRDARHAHTRVTDSDFLAKYSDRECWTTEEAPRYPDNLKEQRNAEPDKLRRVVNPQHQGKDNPDVQHEGHSRSGEKQRIAYGDWANTRCVAEEKRTGYKKGTTRPKRTPWDKTAMTLKEYKQHKQRKGTMKKKIQERNTKDNGQTERNQKEQDKTKKKTKTTKKTQQQNREKAKERQTKAGRRKRKQKKNNTKQKQTQTKTKKRTQKKTQKQEQEKNKRHQTPKNQERDNTENQKKITKQKKIRKDKIRTKETTKDDENEKHTEKEYNKHT

SEQ ID NO: 960619 - protein, 74 aa, Homo sapiens
RARGLTQDDMGHPEIGDAIARLKEVLEYFCQYGGKYNRGLTGWIEHYRELVEPRKQDADRSPSGDLDMMRLDDV

SEQ ID NO: 960620 - protein, 132 aa, Homo sapiens
MSCDVVYCSRVLVIYRGLAARHPACSCEFMWIPTYDVMKLVHVLGKLLTMIECQWLDVEIIKLDLVTYLNTALLLDGNEQLITQSNAIYALHRYASTTCVVDDLKKKMIDVDIIENQVMDFRTQLIMALLQL

SEQ ID NO: 960621 - protein, 99 aa, Homo sapiens
MCCACPPSWPIVPLSGPVWPFPTAFFSQVDVLLCLRVQCGPYVPVGGLGAASRGMFPPRALLFPPAPYPLGLASCVTLVQPSPLGRGPPLVSSGAPLFV

SEQ ID NO: 960622 - protein, 81 aa, Homo sapiens
RHEAVQRGHAVPRGIQRELYCLQKHVLSLLDQYPVAQCWDLYQTLYVCRCDEDVRSSMYCWWCTLHAQCSMLLSLLPPPAQ

SEQ ID NO: 960623 - protein, 257 aa, Homo sapiens
MLEEAGEVLENMLKCVLFCLSGFIVFLPAVLLLVCGRLLSCLRDVLLHDVHLCTCECSTYGPAEGHALSGNTELQLLTQRRLLHRWRAGSVLEPAACVLMRATGLLATSSTRMALRQSCRAAVVIILPRAMCRLCPSDVCPVQFMEIEPGDAEAMETCPSPCTFAVEDEALLSIYKQTQGCLRLPVAPPSAAEVLLLHWHCHGFQMVTSGVQSEAVSDWLIAAWRAVTGWLVGLPIVCGPRCLRAPGVWAARPASCS

SEQ ID NO: 960624 - protein, 250 aa, Homo sapiens
LGTRPGVNRPRGSLFFAINLATAYSLGPHCFYEAITLTAKVCSYTPEASETMSPLGGKNNSRRAALRAVTLTAKVCSFTPEPGRPRTQQKEESPEHIRNIRRNKLQCATLRAGTLTHGGSAGVHFLEVTWRTTEPDTFHEHVVGIATMGPVSPSRASWWLTNRRASESTVLRVICCTPRIVASQSGLQDSVLYIVDIPTCDQFNLGTLYYRGSRLDRTRRGLFALCLEEFASGGYLDYEGPVLRVYARGK

SEQ ID NO: 960625 - protein, 101 aa, Homo sapiens
WPLMHFPPACLPGAYVTITPLWDGCLHVCLHAWPQSPSPATMMHADVPDDPMHAWPCLPPLVPPPSAPPPSWFLSCAAYGCLVLALVLVYLHLCSAAIAQR

SEQ ID NO: 960626 - protein, 241 aa, Homo sapiens
RDEARQEVVSKHVMPGRAGADQAVTRGTELRHQSPCEPKVPRSVMDGGPALSVNANQCQPGTGAYRVCVVLVLCRSLSRGLLSVSLVLIGVPTAAGPGNNGPDSGPSGPEPHPIWKLDPFTMGHRPVTRPGLGLPSGPDSDEAPGRPLAYQTTFTQAWQPPGRCNVPMPGARQHLGAILASASVVVEGSVCWRYYSSLLSFAVDTGCLAVTRGYLFPPKLLDPGPVHHGLLEQHLWDVASG

SEQ ID NO: 960627 - protein, 206 aa, Homo sapiens
MGLLSDPGSPARALPGLVLRLNCAVCAVLSYVAGHQPGTWLLVLPCLLTQLHLHCRRTPWAPPWWSDAVMRAGDRARAFALWTSPPTARMSVGSASVPGLNVTMRVIKGWEVYTQRLSPGNCPSQNETHELLYGVVAPNVYGNPAGPGDAASTESLVHNRCPVALTLPTARLWGCCWHWLTTSGGRYIGPKDIVFHGNRHHDRTGH

SEQ ID NO: 960628 - protein, 303 aa, Homo sapiens
RAGFNSVTDGMVSEFSSRLGRSVASMTVYCLPHIILAGRRLAHQCGQKRSVNTMRPLGVPPGSAGERRHPAAQVPRCPACLRTSALAPSSTPWCPCPALGAGRHLRLGSEFGKLCCHVACLEYSRGWPGALGWALVAGGLPLLRPQLPTPCNGPWAASGLVLSLGPCSPSGLPGREPPFDSQEGLGSLPPPEGLAFLPCCAFLARQGPLEAAAGWPFDGWRPGAMPAALYLAHPLAWFFEFGQGPPDSHPAGCAGRTTIFGRRELVRSRRGGWGLFKPRGRGTRLFLAPVCAGGVSYRVTRLS

SEQ ID NO: 960629 - protein, 211 aa, Homo sapiens
MAASLVHQALIDLKGDYRRVMKLHSVEGSSSDQQRFPRSHAHMLPCSSQGNCLSEEATSRECSHLTSGSSRLSQVSMEVASSRTQCATRGTRVVFTKRKRIRAFTYARLGARSRKRGNSTDGVQSKFEGRLQQLDDNASRTDWWLLFGNTATLKKPFVPRTAFPFCHVKSPQGVMCLTCRQCGGTPRVQWARLVAQSQYVQRGWALSWCIM

SEQ ID NO: 960630 - protein, 259 aa, Homo sapiens
VGRRVVVCRGAGGRPGRHVWPAAVRKRGGEGEQGPELTFAQVCAPSVSSSPGHTDAHLPWPPSTPFLLNGCVHRTALQLPRAVQVAGLRALLVEAQAQSEAPVARLVPVLGAQQVLVEVGQRQAGPEVCAQHADGRHRMAALVTGPLRATVRMHCLHCTSQRRTVSSWEPSSTLPSVDTDRQVTWFLYPLKTFPASCSGWKLLSLCAGQVKRSTWKKEPSLPPQNKWSSARAMGTAMMDTSKRTESSSPPEETSHSFTV

SEQ ID NO: 960631 - protein, 400 aa, Homo sapiens
ACRGLGFRCGPRSGRPRTPARGETLAGLLPPEWEAGRGRACPSCSPAFKERVADGEHAPDWRHAMMGYLGAARLCCLMPHAACPGVCVLPAVCCGLAREAFPAHMWDASLLCGLCHRLLACDHAAVLTAGRLPAGEVRTFNGLQCQTGMPWNLTWCRVILCGHSRALTRPYYKRLRRLHMLNPCLGNDKLTVFSQARRDGYPMARLGCDALDIDTGPTWDYDVDGSVLRSLYSTENLRPPTSLTYHLHDWIRRSVPTIEIHSKPLRDTRHQLSLGWPLQRLAWTPRMKLQRHRGTRSPLPHLALMIYSPLAAASRAAPSTCWSRTDSMSGGYPHTALLPESPNLSPGYTPCVGVYSDNTGTFAVLYTRRQSVVPPPGKRCGTPHVLCAPPTGGNHLDTTQ

SEQ ID NO: 960632 - protein, 334 aa, Homo sapiens
AGRWRRRRRWMLPPGRRAWAGPSPGRCGVRLDPALRLGLVCLGAPRRLLMPQAMVPSRQDVEPGSHALAAGPVDELVPVPRESSMPGGVCVDRALLSSPVSDRGPRSRRFRNTSVPRGGLEEPGQMGKRDIHEICVVDVRDSELPVEVRASAQLPYAQIAVSLNRRWDVGSWAPVKDRPRWGTSLGMNTLTRAREPAVTGEDTRQFKRKGPPRERGTAGNVAEIRGDRWLREATLCAIWERTDTPGERMALNRDRRRKLGAGNVGQGQGKALARARHMNISGHRNPCEKARLGDHPKSARKGVTHGTQGQMPGSPSQGSEGEGKDEPNKGNFRE

SEQ ID NO: 960633 - protein, 108 aa, Homo sapiens
MRGVGTLHVRQCGTLPRGKARWVSQVQQERIHSEAHFSQALVRAPVGLSVCERRLTEVSPELCSLSKSVVCVKSHTCGKEQLLSPPPCGVQSLYLHTTLLCGARARSI

SEQ ID NO: 960634 - protein, 105 aa, Homo sapiens
MDEDTLTMNPDNPEACWTSLSEINNAHAILTDCHKKEHLRQCTGYCCVSLREAEQFWVNDELGTPTSVLVQSRVVAKASSICTSCCVYLHCVCLTSVFSYFLISY

SEQ ID NO: 960635 - protein, 227 aa, Homo sapiens
WLPARGAAFCKPPERTLAVGSLVDRDHRPLSPAVFPKMSLSNKLTLDKLDVIGKRVVMNVDLQCSYEEQTRVQTSQRIKGCCPNASNFVLGQLDAKSVVLIDATYGRPDGVPYASTEYVLSSHVCCTYTQESLLGRGCCCVFDRTVYGPSRVDVHMPVPGPVLLRSCSVPAGTIPPTFIVRGSNGKWQLDCFWEPGLKPSQPYIEASPSFTFHARGLSMSMMLFGTA

SEQ ID NO: 960636 - protein, 264 aa, Homo sapiens
MKKSPTSLKGRHTTCQTAPCWGPLCVSRRSWAPPRPCPARGAQASPHPVAEASVSAHALPRESCTVHAAKSGSGLRGSPGATLLLARAASVRGKEASLGLRRKPRNEIQVSFQDKKSPGEKESQRIVSLTNLPGAVTCAGRGATWPGKGAIPCSNTWGLKEDPVKKQPGLTAISQGSPPQGWLDTGNQMAVPSQEWKLIQGFGGSCKRSGLSNRKWTMAPMLAISQAWDPAPRRFNGDSTLNPQTKKDKKEIKKRRHQNKRNKT

SEQ ID NO: 960637 - protein, 81 aa, Homo sapiens
LGCRSGVNRRGERLQAARHLWPALCPLAGLARMAADAASGRECSSSLPNAHGTLLAPYCALSPTPDSLPAPGTSFAGSAQL

SEQ ID NO: 960638 - protein, 334 aa, Homo sapiens
MYEPVVNRPRVLCSSSFAPSGLASSDGMSSVPSSDAEAPELKAFTCSRPALSPPPLSMTRPKAGNRPPQSRLSSKAPRLFFCDFQKLGQPCVFIVSVSDPVLPSPPGCPMKFPIIPCEKAVFPPVILRIFAQFPGHEISGGPDLGTIGESSEDGDEPGSEYTTFMTPGPSPALRPAAGPSVVLSCGTSSRVLGPAHSLALRAAIVQNPDIAKRRGDCWVAPVAPALFFFPFPSPGPRCPRVGSPPACSCCQAPLVAMMCLPWGPADWLCRGWVVLVLHEKHRSTGLFVSFAGLARAPGRSQVAEPGSPPIVLSCPGRTLDGASTRSHHWSSPDT

SEQ ID NO: 960639 - protein, 148 aa, Homo sapiens
GHVHPWRRTAKQLLMLLKLAQQCTDQRQSKRRSRDCWPGSEKKAAGKGDVPTNETTCPSSMDVNTVTTLVDEHTKAQLLVIAHDVDSHRSWLSSCLRLLSYRMEWIPLAAIHQREEGKTWRPFYVHSEDPCIHLIDRSAQDANIRARR

SEQ ID NO: 960640 - protein, 338 aa, Homo sapiens
APMPYTIHSGMSFCHRWRKGLHWSPPRRSCLPHQLHPWGPSCTPLPGDDSPTTTVLLLPPDEQPEAGQPGLGGRPGSKRRMPGRAADDGEGDRMGACHCQTQCPLPLLQDMKQAEWSAGGGAVTRVEGGPACVDRGSGPYNRELCQIMPTAGGHWLQSQRQSHWDPGVSYIGFGTWVCVEVPPVNACPGTSTPGTQVTMGVTSVLVLLRACARVGQGVQHRREKSPESSPNQLLSLGNGYTSTYASELPSTLNATQDATSLNGRRLAYTESVAKHSTGKHISYASDADPAHRRDIVPSCPRACDQRRHILRAQGWPDAYDQCRAIELLNMHLIDRVYP

SEQ ID NO: 960641 - protein, 176 aa, Homo sapiens
MSSKQQVDSETHNTGNTDNTQLEPKDRKTTTRKKQTTDDTTRKAPRTPITGDTATHTLKMLDTKEQKKHPLAQINRTQNKMTQLNKHIQNEENTHKYTLIIPHKRETAPADKGNNTQHTQHHSKNPPNHNEHHNAQKHHNQQEPNTNTNEYHRHPVPTRPYNHNKIKQPQPHNQET

SEQ ID NO: 960642 - protein, 115 aa, Homo sapiens
MGILSHDVFQETGPILHFGIGMTLSIVSSSHILQDKSRLWLNAIALAQKHMTRTIYTSPIEGPVATRSSGDFRNTFVDVGLLTGDVQLHPEASCLIMTTEILRSMLYSGSYVIRD

SEQ ID NO: 960643 - protein, 97 aa, Homo sapiens
GPAPLGAASKCECQRLSWLTEPVPRPPRAQGASMAPVTTWTEHPVNGPSLASGQSCAAHLTPQVNCLLWPARRRLQDPLKKRETGLQGPWSPLAAGM

SEQ ID NO: 960644 - protein, 225 aa, Homo sapiens
TSSSREYLEESENHAQRMTSHMRCPGTASITLVERMDEELPKECKILTLTPKSTWSTMKDEAQECAIIERDAAHTMEEKGNYEEALPKSYRDMRSPDTHIHTSSIQGPLSRQHDPDLRAPQKSEQDQAENEGEDSAEMMERHVQDNIYTKDRKRPGSEKCAIHRTTSYTTLPDTSRWYQDRKHHGSSDHIDRTTISMTEPNKADPIKTATMVQRGNHVHITTGQN

SEQ ID NO: 960645 - protein, 444 aa, Homo sapiens
MESGSVAQGEECRGAISAHGKLGLPGFTPLAISLRGPRASPKYSVGHTGRPPPAPRYNFRVVFFYSIENGGFTSVWAEGVVFSKPRCETLRVCTSRAHTMRCPPRGGVGNFTSGCESLSVAPGGPRGDTIFIVREHKERTRAASGAGTLSRECVSRARGENRERRKRGVCGGVVTKREALEGGEERGVRVAGRVASVCARPRERAPVWALCGVLITRESGPLQEGTRGAQKHPVAHCGAERHTDDSPPVGVCVWVGTPRVGAGRVKEKAPVGKRGALCGALPPWGEAHHLGGGRPINTQGGEGRRTSIYLGALVGAPVGPPCVAPPNFYSPRRGAEVLLVVPNMWYPLWAPFKRGHAEKCPPPPEGAWWCPPHTGGEHITGGGPIVVRPKQAPWGAQRGPSPGGGAPIRNRALSKGHPPGEHIPPEAVVAPTKCPPRGGSSPGD

SEQ ID NO: 960646 - protein, 243 aa, Homo sapiens
MDEDLWLVWHRGTSGGLKTPYPSEWQPCGPFAARSLPDMEDVDGAASAHLLQPILDLTNELVSVDCGGPAGAEYLDVMLDHDLHFFLTECAKTTMNFIEAALLIQWLCLLYSKNVWNTSTHSVYHVPLIYISREMMAGQCMLLFVLHVMDRANGGCQLRGPPVRHENDVPVLLDDFPDSRTNCGISRMIMTPSEVLIIPLLPMAPVWPLMTCEKEQQIPCTDEQGEVLASQEGFRMNTCVTQP

SEQ ID NO: 960647 - protein, 97 aa, Homo sapiens
MDLEGKGGTVDLVGNVKDRRRDGKGNKRHEGMKGLAQRIAPQGVHITRKRSEEVVSIKAKHLVWQRVSRTKGPTATRDAQIRANGSHRGATRQGEKR

SEQ ID NO: 960648 - protein, 87 aa, Homo sapiens
MDLAVLHIPLDGACLCKSINPDQLSTSCSAYIPSIFSKTLMKATKVSASTPRKDVTVSVAHEVAEMGYVFYPETRYAFELRSSVSDP

SEQ ID NO: 960649 - protein, 235 aa, Homo sapiens
AAAASAPATPPQPPFPPRAAVAPSPEQLKVSVTSEGSAGGGEEAGDAAEGTVGEPGRCVPGDAARWLVGTGASIHARPPSPSVPPSRRRRGKSLRKREGGLAEVYTFLFVRVRWGRTRVLVWGRGIGGSPSEREQEAATKDGPAGGHSLRGPTLRRGALRPWGAARMQAKNPGVRGLGRGAASGPQVAQAPESPDPRRENPDIHGKKARRQSTDKGNRPSPGKHTETRETHAKTT

SEQ ID NO: 960650 - protein, 146 aa, Homo sapiens
EQREGEEVGERGRERSRSRSSKQAGERTPSPVPPVRRFPRRRPASMPGVARLPLLLGLLLLPRPGRPLDLADYTYYLAEEDEFGGPLQLTKEPLCQGGWAFPCARTFCPLGPERKGTLEWGPSPGFQAKGLGWEFFKEPGQPTRLR

SEQ ID NO: 960651 - protein, 220 aa, Homo sapiens
CVFFFTKIHCKTIVLVTEKGGGGDGAWHGYQSPSPRQTSELPSSCSGETASQERLPFLLRDMDPRRVSPVAVRHMLTHGEGGTAQGMPRCSQVACRIPWDRLYYGARHAQNRDAEEEPGPNPKRKRWRLHSGPVLCSRAQVVAIGAAGPPYSGTSANVTDPGGLLGGAARISVPQLLQRGEGLHGAPQRQGVTPPGLCCMSTTSRLTARWYPCGLVPTHC

SEQ ID NO: 960652 - protein, 126 aa, Homo sapiens
LSEFDVEISIREDVYPRIVWLPEKVQKDSLRPEAARYLVAANQAGAGEMGFNLPQRGLSENIKRIMKKREPSVPSTSIKNLNEDTTFLPFTRPVSYGRAPRGTFLNSAGRRWRHGKLNGHPSSTPD

SEQ ID NO: 960653 - protein, 276 aa, Homo sapiens
KVFLLRHKQLQSSWMAEDYMIVYLNGASPVRSDAWNRLELKKCYQMIDRGVLQEKPEVLDHRPPLDGSFGLCWPSLDPFISDQVHQTRSSTVHSYGRPGATHPIWNTIQIPDCVLQYRRGKTEGQEGELQRPQTGVRACTRTEEKPEVDTSWKTGLLWSQEDQEPKPFQPLTQIKLMHTEETNETQTTKGHDNVHRSAKKRHNKRTWANTCKKPRRTRRQNGRWGPQNHNPAPTEDPTTRGEDQPNTLKTQNTNKGEQQEENNKTNKNQKGPTKRK

SEQ ID NO: 960654 - protein, 223 aa, Homo sapiens
MDMIHIAVRLTGRPASFMAEFLSVRSESSNSCDGRINSEPLNEDWDSSTLMQVHTAVQEPCFRLYYTRADTLFLGVPVYNRFIPTHSCHQALSDSSYNQRLMVTRERGFQMLDSRAYRGQSFLGTCPRRIYRHTDLETNTYISPPGGWLLYILFRGGGGSIQDRCSERSRVAPLCLPYGGYLCPGHSGGCSRLCVSLQVFRERSRPAGVLPPLLYWGELARNS

SEQ ID NO: 960655 - protein, 107 aa, Homo sapiens
MASTLPGCLIGRCGEWLECSWLGCAVLRCAVLCVQCRAVTRDQFWLHVLDNECRSGGEWWNAGETHSECNHTSLDLLVTPLLCCSCLLCDLVCCAVKTCAAPSQWEN

SEQ ID NO: 960656 - protein, 151 aa, Homo sapiens
MYEDVVLREHAQWRWPMWSVTYTVQRNILDLPPACFPLQWTSGQPAQMADKKLSEFDVEMSMREDVYQRIVGSSEKVQKDSLEARGHARYLELAESSWAGEMGFTSPRETQEHIKRIKKKLSLLCLIHKNLRGTELLPLAPELEGPEEYGL

SEQ ID NO: 960657 - protein, 248 aa, Homo sapiens
WRATGSRLQAARWTLRPRPRSRPGMIAEAAGRAGVWHVAVTSVPSGMLLVDSATWTVRGPRRADTHALLAGLSVHSWGIPPFARVDLLLVQGAMDDDVLVTSTQLCHRVSLRVARLVSLAVWTKMLASPCDSLLIPCGGKGVLLVYPYHLRLDGHLRGLSLYLYRTQVPTFWRAEGRILTTSKGGPCQTGSSLLHFLDLYKYGEQVGFDEPLDVVRVAQGSVGARGIGIISGLVLLSATIHWYIVFGG

SEQ ID NO: 960658 - protein, 232 aa, Homo sapiens
ARYEAWVIGRGPPPDVDLNHLVSATMSGESPPACASQASSSADLRKLAVNMVPFSPSLPFFMPGFAPLYQPGRASSYRALTVPELSPEQMFDATETLMCLPATPAVAAYLVAGLARPLIQGGLTIVLLECEVRTDDKQLDIVPYTLDKSGIYLVEWIPNNVTYVLSCDIPTFWGSMKMSCHLSVVPSAACQSSELFQAQSPEARSRRTVPGCKAFLSLVHVASAIVHDMEST

SEQ ID NO: 960659 - protein, 132 aa, Homo sapiens
RVVAAAVERGDMPARNNRYREREELQRLKDRYGDQRQQQRLQIPSRTQDDERVELDPQPGAGLYTKQLSIVEEEGPPHLSERCHHSITEQTSVIRQCRRTQKPWRSRRTVRPMYLTDIREEGYSWRRQAKIC

SEQ ID NO: 960660 - protein, 188 aa, Homo sapiens
MGCVASPLWIIHTISFLAAGYFVDLRYVCGCYPKAVEVSWGGLRFPCAAMCFRVQLITLCARKSHLWTSQGFVPISCGHTLFSVRTQKNKHKRTCGCDISRWREETLERPCGYSAQRKPHKHCWSKWYNIYPYSSQLCVTSNKSGVVHSRGLHSRVGPYIEAPVEPGCAAPQKRPYYVWYIVRKCAPS

SEQ ID NO: 960661 - protein, 42 aa, Homo sapiens
MSDNGGFKRPYRPQAGLHWKAGQAIGGLLTRCSGPIRGNPTL

SEQ ID NO: 960662 - protein, 264 aa, Homo sapiens
RLVRGRVLIGRGSNWLRLSTRTRVEAQHRAHEGGEGLHHYSQNANSLLQEKECLYVATPGGPAEMDEATSAESPEREAQYFLFYTLVGSLPLLIATDLHVTSIRAQKERAEQERGVMLSSYTCNSLDKDLYVAEASIHSGSPGGAATTKVYKKQGDLELEIIVLNDRVTDLKTNNKTLEEKMREDRDSLVEDYTVQTAEYCRIQAWRNERLKASLCSNGGQTQPGTPRGPAAEGSVKNYEEVIAIIRVGDETDWCDEYCQKKRE

SEQ ID NO: 960663 - protein, 220 aa, Homo sapiens
RRRVGSHGAQPEWHGLEAPLPQVDWQRRVATWFNQPARKIRRRKARQAKARRIASAPRVGSHPAHRALPPRFGYHTKVARPARGFQPWRELRVAGISQERWPGTHRHFCGLRGGGPMSTESPCRPTCQAALKELPLQTHPSFPRKAPSAPQEAENSFCLKNETGPPKFDRDRFMPVRERSIKQGESSESSLEEKRKIFKAFARSPVWPVPTAGLFGIRGK

SEQ ID NO: 960664 - protein, 142 aa, Homo sapiens
MWRHTLRARRRQWVNGRRPKICGAEPQMCAPRNPRRRTAARRRRGRPGYRRGDKPARKNLQDRKNKEEPGQKGGRNLRGGEKTPPGGPPPTKIYARPFVPFFMRTYNNYPSGALRSRGTSVSPTKGWAQKCPAKKSFEKGAP

SEQ ID NO: 960665 - protein, 242 aa, Homo sapiens
TPSPCSRRCRCQTQSLPLSVLCPVCWPPVLASLAVTAGQPMLRLAAQLHRLRAPVCYLANDDEACLQILSPVGANTHRAIVGLPGCHSARTLRGPCLLPVLAVGFAIPCACTFIWSDGSMLLLAVCSTFDATLNPSRHSIPSLVQTPCDCDRAPRGTGLCRAKTTWDVIRSEPSPYNADVSMQARPLGECPCVLVRGVNCPIRSGASRPTNSVWLSGCPAWRIFTAPATSLALRLDMTSEPP

SEQ ID NO: 960666 - protein, 249 aa, Homo sapiens
SAPAPAPPSTCAHTLQPCPMVWPWVADGCPVWVSPHWPGSSAASGSCVCACPSDVTASALACQPLCPHRERVANREENEILPPDHLNWGECWRWTGTSIAASTQECLPRQVTWVALIEDAEPAAETGVKLMCRSLYPRMDVNTDLEDQCQGDAAAGSWRKTDEHFQGGHGRRAKTHFRAVDLTGTLHVVWDEYKCAQYKASKGHSEKEVDDAISVKSNQLYEEHRSPGKLKTVYQGQPWTEEEEDLIPP

SEQ ID NO: 960667 - protein, 105 aa, Homo sapiens
SQQSWTLTSDLEKKRRGVNVELGVLAACARWEPATPVSPDLHFPVSASAAADLECCLRCHIMNVLIAVHSCLLCFCVCCAVCTCLCIVRAIHVCMSVIYLHYSPS

SEQ ID NO: 960668 - protein, 127 aa, Homo sapiens
MCSLLLSLWRCLLPRSSRVGRRWAVGGLVASHALSSVARHGACVVRTATTRPGVNRPARAHHSRAVVLESGPLSLLVRVGRPSSRAPLGGGATGRELFTRGGGKAPFRGGALFAGALSSRVRRGALL

SEQ ID NO: 960669 - protein, 244 aa, Homo sapiens
GLRPSLPMAASSLRLSRRPRPTGLLLVGVGLVRLGEPRRWTGAFLTEGMNAMSPGPLTFSYPVFCQSQLLQSPPRPPRDPPVHPSASPRSFLVLLLAAAFGGGAAIPPDPLDDPEWPFRSEGMLLEELLLCWRLEADDSWVGVGGWMTRLPGQAGLAVSWVELLASAVIHLPAVPGGRLAPVPLREVTSEPEAMSKHGALGDGLGIPRSSEDRRCYRETLVEVKRWRRILQEAGPDEGKNKRKK

SEQ ID NO: 960670 - protein, 111 aa, Homo sapiens
GLGTKFNKGSLKSTYPNLQNTCRPRKPGICWGDVAVGHVAGRLSVLPHPSRDLVKCGGVGGQISPHSCGVLHNVPHRVCSRQGALYGGPNSYHRCGVSQGGHRRSDLFTPC

SEQ ID NO: 960671 - protein, 121 aa, Homo sapiens
RGVKADTQQHACSSPGGGSNSGWLAYVPEPAGLPYQPYADPLVTLSYPTTIGIPPRYPDRYRAGETSILVAILYYWIYYQQHYRHLDGRRTSTQPGQHNSELDGALQHTVDTTYITPRTKD

SEQ ID NO: 960672 - protein, 106 aa, Homo sapiens
MDDDICRARLVDNGSVHVQWPGFAGATDAPRGLSSPPSVVAAPWHHVDCDVCGYGVKNVIPYCVADRWPMSKRGILTLKYPTEHGIVTNWDDMEKIWHHTFYNDAA

SEQ ID NO: 960673 - protein, 258 aa, Homo sapiens
GDSRGCDAAGACGGSVRCRTGACGVASCPRSGGPSRVILRGMTKMLPDGQHCHCQCILPSARNHVELPNVCMTGCAPWLPVSCACPCPSTTYPVLAAFLRRVEAMVIRELNKNWQSHAYDGFEVELDRAAADGVLSVYPGLTLAAKRRVLHVTSISWNSTWLCGGLCPTCGWTMGTGALLKSFVCAWNLDRRDCVPATVGVWRSQRCTVSGFTPAGIHVAEGDSGECGVELPFEDVMWEGLRITKTFQCCPLTDVQLM

SEQ ID NO: 960674 - protein, 174 aa, Homo sapiens
MWSCGCPAPGNKGSTPAGVACCGGARVGVCGRGPVVVPCCEGLPSSPLEGTVAPANPPTLSRRAVKPKVPVARKEERVAPRQATVASGLLESESMCARGRPPREGGGAHSSWGRTQCAGAAHRVCRREPPNNSAVAPEEREESLMRAKAGVGNKSALMGGGDSSIPQKRKRGET

SEQ ID NO: 960675 - protein, 252 aa, Homo sapiens
MTARQIRSQLTAGLISTTTALAGRSTWHAFLYSCQQQLTPCLPCLAYLACWHLAPELAHVIIVSMQRGHLLAAVALALLHAPLSHCPGTAAPCCAPAARTSTRHASLSCPGARTLRVHAAYSLNSHIAHGQPLLHCALQLKPTLSCPAVTPVPLAYICLHHTHTLLDNTPLARPDHVYLASLSLPSLSFFSLHVSTSAYRARTHPQTLSHMIRTWLTPMAENHQESDSAQTASNTHKGAQQPRDTRHISSRA

SEQ ID NO: 960676 - protein, 228 aa, Homo sapiens
DVLVFSPPVSARPCARDAGAALRAPAGSGLLSCPCCLLMPACCTPQRAQLLCKQWCSCADPVLFLLLRGTLLDVPWTVDCQTCVNACSVPAVVLLVSLNVQMSSQKTCLRTSEPCALGENVCFGYKVLHLSTVVIPSFMLPCAVRLHQPINVHMCVEVHLLWSRFPDENFTLKHVGPGVLSMCNAGPNTNGSQFFICTIKTELVGMGKHVVYGHVKEGIDVVKKIESI

SEQ ID NO: 960677 - protein, 212 aa, Homo sapiens
MPRVVIWNSTPRLPWQQQCALGKMVETISLLPGNVVEDTSQREATRLSVAQWQDRQVEGVSHQSNIAIDGKGSLGWPICSATSPRRARTHANDGHLDQSLVPLINYYQPPPETGGVRRSTLNPRGYSRAWLPAGTPRVSLLHSLDREASARVHYAILWPSSQRDLRTPSHSPFIAPPSRLLFCALVARSFHAQPGTSDQHTALRGNRKLNHA

SEQ ID NO: 960678 - protein, 38 aa, Homo sapiens
MRRPKLIKQLGYYKFILGSLILALPYKASEVTSRSPFT

SEQ ID NO: 960679 - protein, 83 aa, Homo sapiens
MVGIARPSTYQVKLEALWPHIRRPETSKHQDSKSARMRTPEEHDPTSTIGPPFVTTRKRSGTSSQEATLQADTKIDSDGQQPW

SEQ ID NO: 960680 - protein, 215 aa, Homo sapiens
MGLVLNPVLGGVRSLPFFGLRFLLLFRVSLECVCVVGVGGSPFLLPSEGLVEESSLLFRHFSALEAGRLSQPSLGRQRPKLLLLKVCLLLWSHELRVCKPQLLGGVISLSYTPRVCFVGFCSKSPIIHNSLSALERGKCLVTPLCKTATFKNPRGCVASEGLPHCVPTHICGTPHRREQLCAPRETPGIYIAPFAPIPQEEEAPQRGTLGVFPRP

SEQ ID NO: 960681 - protein, 237 aa, Homo sapiens
WGALTKRLLIFKTEKPLSHSYWLLSPFKVTQEEGKKRKRVCGKRRGSVGQLCVPPVLLLPSFCGLYRPPGVWLGTCCASGARWKAGGQCSGRSGDTCWRQCVPRVGAGARGEGELPRCSPVRTTQYRRLLDSTQCGRLGLPGQCGVTSASVLQPEASGLQVQDYASGVRVPHTPACLGAPGQLREGPKWGLNLELPGGELSGKGDPLLGGSVLTLGPCVRTRNGVHGKGIHYYGKAR

SEQ ID NO: 960682 - protein, 303 aa, Homo sapiens
PQACRLHGAQPEWHGLEAPLPQGLCSGAWPGGSTSLARKIRRRKARQAMARGSARRPASGPFAAHRALPQGFGTTGGVRRWAGGFSLEGAPGVAPENYDKGRVLARAPHSGIFRVAIPGGKGLKTMLRTGKLPCVMGPNSCSHDGELKGRCTRHSRKLTNCIFPPQGKAPLWGAPPKRNGCDRTDVYQMAMKKQNLLEKLWGTNPHKGIEKPGNAGVYKFAHQVPGGNHWLLNYDERAGSKQGSREVFNFQAWTRKSGRNKTFFLQSGPLFRRIRLPPRDNLAPGSPKAGRRRIHTRGKYGGP

SEQ ID NO: 960683 - protein, 218 aa, Homo sapiens
MMLRAEDRAYMLVPWTTAVKDNHPEEVQLVELTSDTIFPNAVDFNIKTLEHRGFKLNILWMWVDRSPLVDPTGGTTLRAPDGLIWCQWTMQQTCTAACSDLTPWMLQEPAGGGAACAWSKPSYNTLHTKQAPACEPLSSYTPIPTRPMDARHSHPATTTTMGLQSNGHWQLDRSTVGKKDIDCTDELDLVLLVMNIIPSTAIYTTHELTPTSTIGPPT

SEQ ID NO: 960684 - protein, 46 aa, Homo sapiens
MGWDQLKLEREKTQGTSFDFSEEGDLRSRTNYRYERGSRGRHMPGH

SEQ ID NO: 960685 - protein, 56 aa, Homo sapiens
MWGATYGGAPFEDDWFPPVVTPGGLVPVLVPTEGGTQETLLGGGRPPRGLSVVEDS

SEQ ID NO: 960686 - protein, 112 aa, Homo sapiens
GSPNRFNLKNRDKGQLCEKKPKAGAIVGRCYIHLPLLLILLLGNSKYFVDFLSCKPPRQVRGVAFLYSEPSSFLRGNVGAECFSGGTHIIISVGISFARKYICVSLYMSDLL

SEQ ID NO: 960687 - protein, 171 aa, Homo sapiens
MFSGFGSGEAGERGWGAGGGSPFSPLGPEETGWVEHLVHTTPWGPGDRIRGPKERSPRSPHLPGSSWPGLWKPGPSLGGSVWSRWRRRLGVDGDPEHRGGGECPEEYPGPEAPLAGKVTHSPVAAGTAAWHRIRPDGAAGRTGWRELSAESRAGPWGTTGLQGISRGPRAA

SEQ ID NO: 960688 - protein, 97 aa, Homo sapiens
QEGAVANMSGWESYYKTEGRLREAEEEQEEKHCQSKWRRIEIIAGTQTRFDFCLVDASKGYCVESSELRDECDTCFDSERSRCTRKSCCYNRGERTL

SEQ ID NO: 960689 - protein, 106 aa, Homo sapiens
SDPESTDDGSLSEETRRTEHPTLTQGPTAQPYTHSRYAEIRMNCVCARSGAFKEKRTEARTSDEENGPTSIARPGPHRGEHAARMDACREAEDTQDHRGPATDTRH

SEQ ID NO: 960690 - protein, 103 aa, Homo sapiens
MINEQQVEDITIELHSTGPQCHRPCVRFTIVSLMYFAFTRDDSVPEDNIWRGSPLVYMNFFLYHQCVSFPQWSVHVDLIQPYGEWFEGLSVLYFRVPGIPYSS

SEQ ID NO: 960691 - protein, 114 aa, Homo sapiens
YSEHKEAIPWRAQHMETSNMDQTASSPPSQASTQTKKKRKQNTQKTTGKRKRQTRRETKREHETNTDTNEKENKTTKKKMNNNKQTQKKQKEKTKRQEQKKSKTQVMCKDEKEK

SEQ ID NO: 960692 - protein, 168 aa, Homo sapiens
MAILPASPPKSVGLQAPATTPSVIFVVFFIVENGVSPGWARRGLELRDLKVIRPPEASQRGVGLRGVRSRAPRPQVTYLVRNKETRQWRDLSEGYSRGEEGERVLGGSKQPQGSWCCGVHVRARKRGYGVYQMPSGKRARTCTGTAQSLCVVWDPVSAERPGGVLPPL

SEQ ID NO: 960693 - protein, 185 aa, Homo sapiens
APRDTEEHLYVNTQVWTAPEPEDSPKKDLFDMRPFEDALKLHECSVAAGCDMHAPLPLDGPVAQPPYPAGAPVAPTGVEHAAVRSPGTTAWMMPAWCGRDGCFELTGTSLCETASPTPVASMSSPGMHCLWTCPSTCCSLDPLKGVVRDERNVLVLRASANSSTKHLEELGSHIVGRREVSLNLR

SEQ ID NO: 960694 - protein, 207 aa, Homo sapiens
THKVDMDNAPGGGQIGLEDFIFAHVKGQRKECGVCSSRRMHSCAHHHGQRVAGYAFIKLHQGGQLVSDHIHLISCGLNDLRPYNGAEPAGLPGTTEVALAAQMELPRGRTFTLKAHGASQGHIDMISQSISGWTDLALAHNMGSGRGTLRRPDARGPDKVEDLPLPLNEKAIAAKVDDLLESNMGIRDTELAGTHGGSWDKGEKETG

SEQ ID NO: 960695 - protein, 201 aa, Homo sapiens
MCPFIMGHQILNLIDTAITAHRMPPTRGLTMEAPSSSGPCSLDADAQDHRGIMAEILTTTEDKDDIQGSCTHISGKNSACQDIGTHHRIGATHSENAGGGLQCIPRIDQTQNTYQKCNTKKHNTGKRANAQRRHNEMATHIHTQARKIGQDTGKRKSQTKKRGQNATRNKNNDDNQPSHKEDKPQRPRTQSHTEAKKTRAQ

SEQ ID NO: 960696 - protein, 80 aa, Homo sapiens
EALGTVAVPFDDDDQIVGGYTCEEQFSPLPSVPAILDSQLLRVAPFIQSKQWGWIIQPGSRCYHDPASQCGKLGRATTVT

SEQ ID NO: 960697 - protein, 74 aa, Homo sapiens
YGLVRGWVLIGRGWGRGWDRWRGEVWALQRLGLRPARGGASVGGRCCEELTAVPTPARYVSSASLVERVFIQPQ

SEQ ID NO: 960698 - protein, 33 aa, Homo sapiens
MLQTQPKITDVGQMQEDDSGKDYQEDKLRRSRG

SEQ ID NO: 960699 - protein, 130 aa, Homo sapiens
MMLGRSRNRGYAGPEFIKTRGVLKCKVSWVDTNYCWCVDVHGEDVASLLLVPSGSIGNVGWRCVLIIYINACGGYPGLMKEIRGEGGLAGVNPMVGNPGELSSELPPSDRGLPRGGSRGGLLGPSGGGKI

SEQ ID NO: 960700 - protein, 113 aa, Homo sapiens
RGAPGYPVRRRFGGAWVDQPGQRGKPEQFCARYGGHGVLAANWLSGVNVVLVMAYGSLVFVLLFIFVKSASSLRFAMKSRRGPHGPCWDTMPPRDLKEEIDIRSLQGSWIFKL

SEQ ID NO: 960701 - protein, 235 aa, Homo sapiens
WLLGPERLSAFVFPGELLLLLLRMIILPAGGVQLDRLAPAMPGPLARSAVLVLPVALLFFLCQPLLALLSVLLCDVWLVRCARAACVLPPPACSSDCSPVGDACVACCLKSAPSNGGARFVPVILLRNIFPSNLGVMQPFAHTLPPMKRWNITWNQGEGALWGRSVEGDDILGAWYVFAIVFGVGACGMLGAWIGSLLILLLQTPSIDATMVLVSWESVLVRHCGASVFLVAWQG

SEQ ID NO: 960702 - protein, 112 aa, Homo sapiens
MIMPSRSQCQMNVEPQKMVVMLWPKPDTVQTLYSPTQHPPTSPRAIARQNIGSGWSKALQWPQRACVTNHCPWSTQESAASMDSSGSPGPAPTGPIGRHRAGAAERDQSLNT

SEQ ID NO: 960703 - protein, 135 aa, Homo sapiens
MKCRTLIIYALANIIVRPSALTSVNTLFLEYKGRGAYSKTSKTERPHEDTAGEHWQKAEGEERRYKAHGASHDCKGFTPERNRMCYLTQLGRYLKMRAVLSLSDPVIDRGEGDHPLDGRPDSVDAAIAGHDVWQW

SEQ ID NO: 960704 - protein, 211 aa, Homo sapiens
MPWPCALPACCCSVLLLLLLSLCLACWTCADYTYDLAGVRTDSEPLNYKDPCKAGCLSWGHCPGRRGPDGPSRYSRLWISDGTHARKSSIKCCSSRKHFYPQLPEHQRAASEGSLWEDGEVDPVAGGRRRPTRACVARWVSSPFCHLGGNFTVEPEVQSSAQGHEALGRRHHLVVTFPGSGTDEDSYIVFPIDLRSGPPLDWPASVAAYVV

SEQ ID NO: 960705 - protein, 139 aa, Homo sapiens
RARGWRWATGVPGSSGVALAVLRSSCVEGCPGASGSSAWAVGDFLCDPLAADVLNVCMWTFACAFPLLPVPHLAGGSIFLMTYLLCCDMCCLWVSLWPPVPVLLPMLAPGNAVFPVFWTAFHPAAGDDASLWNGSTVLA

SEQ ID NO: 960706 - protein, 203 aa, Homo sapiens
SLTYLVVGGSGNQALREVAAGPSIFPSATIPHNPVCSVDLCRAGAAAQKTLYPVRVLKTVAVKVVCVLEGVYKRTPSRGSRGEPPPRPWIYKSLSIYSVSYVPRDYVCVFTTRAWSTIYQKSPRHDVETQADVKMERLYYLSSEKKWEEELWCKEVVVEYSSEKNYSAVWTKSTQISINYAVMFPHKTTVVGHTQPLFKKFSQ

SEQ ID NO: 960707 - protein, 187 aa, Homo sapiens
MTPSSSISHGTSSPFLEKDRRFPEYTDTCGGAPVRMTSPWLKGNKRGDPGISGSHVVLKYHRVGCSRSWTTFPIHSDRRRSLKVGVASANTVLWITKGRPQKGQKCAPKAFPPAGQWVAHIRSTFGPVPEASRFVSPLFTRPCCAHRHRVAHEVWLPFLSKDPARVPTSNLTRGPCGWGAPHLWPPC

SEQ ID NO: 960708 - protein, 71 aa, Homo sapiens
ALPQPPEPPAPGGPAPASQLLHSRMPPRPPPGTWTLTLAPPLPPGGILPQLQEAQERGRLQQITAPIVYGL

SEQ ID NO: 960709 - protein, 247 aa, Homo sapiens
IPQAAAGFSLRWLVKQRCQKRRTTFPATAQVHPCEGPASTRTSPTRSPVDAPGLHGARRIYAGVECLTCATRRRRSSLPAWPGGSCGLLGGPMFGLGLRVAASCSRLAATLCWFSACLQRPSEPTSSFRFHGVLSASSEPRFVHDRSVQADWLLRLGRVRAGCRPLDSSSYSPGAAGVMLLPATMFSRVWLHDGHRDHDWCPDLPRALAGSFRTAHTGWHTGLGGTPRDGGPVNIFRRSLPSTPLCP

SEQ ID NO: 960710 - protein, 193 aa, Homo sapiens
ALIIIFLICFLVLYALVLTLTTKLTNTNISDAQEIETVCTILPAIIRSSSPSHPLRIPLHNQTRSTESLPLPLNIKLGHQLGTEPYDVHRSTVGTEIFNRPSIAYATIIPENPGDHVRTALTVDKSSKYSRLEAPNSYKYFTTHKDVCALHELSPTLRLKNTMRVPQDDHKTKTTYHPLIDEPGGYTYGSNAS

SEQ ID NO: 960711 - protein, 241 aa, Homo sapiens
NGDGEWLVPIGRCMCKAGLRGALRMAPVCRGCPSGTFNGQPMGDDGLYPHCPINMTGPLLKGATNCVLPAIGVLQMQTCDPTVTCPAQPSPPAPQACDFQCQLMTLHSLTRRLDPYPDDITWMCRQSDLDLTNIILAKTLGVLRAVWVALTPWQCRANQIGNIVTTPNAQAEGTDPGGHRPFLPSRRTLARGPHQPNDYTHFDEFQELVNARNMTQSPLYRPSSRALENITTKPGRTIGAA

SEQ ID NO: 960712 - protein, 299 aa, Homo sapiens
GGCVPVARPGLVHRVSVGVPGPLAACGLGLAVLRPEVAGNATALAWHVVNCASRSPNPEMPQCCWSLCVLAPAPASVLFFYGQWCRSTCPGFVMQWCDHGLTCSLAPPWAERDLPASGLHELTCGTSSARPACAFFFSSYSHTAAPATRRRPPSATPRPPPPHNSRRPQPNTHRATPPHKSKSAPTPRAKYTQTKNESKNKQKKGTQNRHKTAANTTTQQEKHNGNDQTVEKYKLATPPYTTTHNNNPNNHTSKRKPPSIKNPPTKTHSTHNEQAAGPPQEVVKNQKQTDEAKKKNDQH

SEQ ID NO: 960713 - protein, 213 aa, Homo sapiens
RSIPARENALSVQERHTGILPLVPLRNPPSVCRCCCCYLLTRRARLVPPGSEVAAQQGRRPLRLSSPDYRPVLPPVPTSEVIAMSWQHVMGHNPATTKPSPAAHMPAGTILIQTGTCLQPAAGCALSGPGPVPLLLRVPYPHTPFGHRTLPPAAPSARGWSPRALAPPSPSASARASRSHCCRARLPRHPSSCSRALGIPPCPSPPWPSPGHR

SEQ ID NO: 960714 - protein, 198 aa, Homo sapiens
MTICSYRPGLLVHTVDPLRSQTLVACRHHQSTFNTSSTVNVGLARLRNDKDPASSSRALRIPLTWPASSLEVLTILLLKLPACSQLLHAGHAEPAQEESLDTPAAYSLGLALLGSGRRARALQLSLALGFAGIFTKVDYFGILKEARVTVYPFNILDNPCTGEAQPTTWAGHQARQPTVLLLTELWPHYIMVSIREPT

SEQ ID NO: 960715 - protein, 244 aa, Homo sapiens
SVSSDMVQDKEGSWAVGMGSPVKVPPELAWRVTCRGDELTRQPGVNAPAAFCCAPSCCMCPRSLLPDAWHCCPLPSLHMGSADVTLAVADAPVLCMELACMKQPLTSPRVSCEPLPMIPVCLALPPASVAKIGQSVCLGYKDLAAIPKDNGHPGHLSGPDLMIYEPHFTYSLLEHVELPRSLRAARCHPNPHHQPNIPEVWRTAVAWTHLSGLRPQSIGTTDRLTHTTPELPQISSQKLHIEKS

SEQ ID NO: 960716 - protein, 82 aa, Homo sapiens
RLRARAWRAAAQQMYQSLAELGTLPPDELVSWAWCPPLFSLCGTAPTLLHPHCATWVQSECPPERQTCGTRECHVPPVRRAL

SEQ ID NO: 960717 - protein, 252 aa, Homo sapiens
KGQKLTFLNGKGDEDNGEPPVTPVWKKKNRQRGGWSGGPRRAQVDSQEQGHCVALPKFSLGIIFWISYTTHSVFLIRELGRHQQHVLETSNSFNYSKKGPISVYPQGEVKELVGHSAWWAPLPVVAPLGYLITLTKNSWSCNGPCQRAQELVIRTEWWIANTEEVTLTFPLKGQIFTQLIFLEVSLEQNEVEHRPEAQPTLIIQSSSNGGLKDPAPFTPDRGRHPQGKGTVNLRGALKEAPDQVRLAAECQV

SEQ ID NO: 960718 - protein, 253 aa, Homo sapiens
QHKHTYNYTYFYDEPCVNWPEGPRTNMATSRPRCPEYSVLGALGPSAAGWAFSGEVLTPRACSCLSLQDCIVKLLTVPLIGPADVCECQHLISTDNGFLNEPLKHSDFFNCQWNCFPVRMPLRCPSPSGTQMLCCLCTWFIVSRTFFGDACLDHDIIDLEQTATAPPAGLNFTAHMAYRKGIILFISLHRQFSVPDLRTWPVTVAEYCPHICYFRGACIADQRCASSLAPGPDLPDLIIFLHTLNNIFEPHVA

SEQ ID NO: 960719 - protein, 69 aa, Homo sapiens
MREYRETLRDRYRKSAPETRCNPIACTLPLAARIWTAGNNNKRPPKASYTQKTYGVGYPGKSSRGLDYY

SEQ ID NO: 960720 - protein, 107 aa, Homo sapiens
MGGVLAGSCEKKRNFLSVLRCHSWVTLRMEGFCLLAAVLVYLLCLGVPAGYPVWLCLLPTGVFCCWPWRRGLSSVAVLKAGPEAPLIVCACCCFPCCILLFYRCTRW

SEQ ID NO: 960721 - protein, 225 aa, Homo sapiens
MTTVSRGHWLHHDCRWPRCSVGGHGERLTQCREVVLTTSKDHPGAGGCAMPLQCYACLTASCICPAATMATMVQNANAGWMLPPPCTVLTMLAWCHDACLLQSMVMSRHACTDYECPALLTMEQLNGGLCACWALVCGPSETCDQSSAVPDIDDDYHALDALMCAWSQCPLTCQKLSPKWCFLDAITASRFYSDRPEPSEHLNYVTEIAQDEIYILDPELLGASA

SEQ ID NO: 960722 - protein, 240 aa, Homo sapiens
MPMWLISHDCHNPDSDSTPAHAAADCVHGYMLLTLRTPAVTPGVLGLEPWRALLETGFPQLKLSGQTMDDSQRAVPMEPGLLADLAHIHGQWALVSEQTPRDCCCMNILLTAPESSILMPDVGSEMPCAMHLHGWSNPPDKMKHVAVQPWMQQLPDARCPPQILDSSVCCAPVPGCETDGLTTVSCFMHGMCDQELSPPKSLKGMLDASSLTRSLNLTFATPLQPQSVQRPGFGPQTPAR

SEQ ID NO: 960723 - protein, 172 aa, Homo sapiens
QRRQWKLRRRCSLFGGISLRSGGGELALEPRWPPPPRPPPCTKRRSAAPWLRPGSLAALDKKPCQGARSLEQLLCTMNGAAVLPMNVTNVLCNGQERLAVPAWWANEGVKNGLAKPSCPQMCPKVPAKVRRVWPGQMLAWRGLFGVFWFFYPNVTVDFVRAHAWPGPAMAWS

SEQ ID NO: 960724 - protein, 253 aa, Homo sapiens
MRPLLLALPGLALSEPDEVDKFNAKVPDMPGTTVNVRLGWLKCRTSFSNDLHASTSVAAATVSRARVTYSVSKRDFVSRLWLTYRRDFPPLPGGCLTSDLWLGGMLRQRPDDAGTCAFCCISCPEESRGELLRRPRLVVYRFSGLAVYKADLAPLLPGQTQSDWKSGASWFPFDWVAETLSPVFFALGYWPLRCDCPVGHGVGSRALLVPQCVPGASCGPGPYYVSPCVFAGGVPGDPWPLRIVLNARLVLLL

SEQ ID NO: 960725 - protein, 245 aa, Homo sapiens
MYPHEPLKRGTKSPRSSIRVQQPILLTCAMSSMQVWINGAVGARTRRDSPQGVDFVLSVQFVRGGLNFVLCAVPSHFPLTTPRYVTGLVHYATASWLISGKGVTRVDVALSSPLVHLVAADNVSPLFAPSRLLCPFVNSPLFVGLIWIDSSDTCVYAAKPLDRLRIDARWMVPGRPLRVGALGGPWYRRVKTLDLCGRFLAHIFPLFYSTVRQGNGGNLLDKGWAFGYEAFDLKPTTLFFATWFA

SEQ ID NO: 960726 - protein, 178 aa, Homo sapiens
PVTEWRNWCRLQGLDGQNTRDTRENEIWHLREQVSRLASENAVSWVLQLWPDLRDVRLLACGCAALPVRPMALLRAGARAGAGAAAWSCGLGHRVGLAVCGQDCLPVWPMELGGGEWASERSLRRPGLKTLPGELALVQEGDGGTPDVCRPAPDAGEGPGALIGPGELLRRRCWAVVP

SEQ ID NO: 960727 - protein, 222 aa, Homo sapiens
YGGKEARTEGDEVAARGADEHGHGCTRSPPTVYRTPTEALASFDLPLVRAGGIGSGMPVCMRCRMSPNDTLVGSSRSPSVSITQANARLTAAGALGRPSDTRCCGGTICSEGLPDEVWRWLAMMGERHLGPVSLAGAMRASNLLISEISRARAWMVAVCDAASMYTGDGRVYGMCNVSELYPSDLSTPTAGKQIANDTLVGYPSARVAADRQGARHQTREGA

SEQ ID NO: 960728 - protein, 178 aa, Homo sapiens
MREIVHIQAGQLGNQIGAKFWEVISDEHGIDPSGNYVGDSGLAAWSVHQSSYYSEASSHKYVPRAYSGCDLEARKPWHMLSVSRGLLEHLFSAVTNFILGVMSWGAGRRKLGARGGSHNCGYGGPGGLGRRFPGSPWAFGPVGGEPGPWVEEIGADFGLAGGLSQAWSPTFRWGGGRA

SEQ ID NO: 960729 - protein, 152 aa, Homo sapiens
MKQANTSAQRHPHTRIRERALSTPQDTINERPQTNKTTQAYTPQTIRANTPRTQHTRETPTQRHGKKHNKTHITTDNKRQKPRTTNTRHHTPDIPTDNTNVPTTNNEDNNTPPPGDSLKARNQTTKTHKKRNHTDHDTNKQPQGEHIKKKDN

SEQ ID NO: 960730 - protein, 102 aa, Homo sapiens
MCGYCVFRRVLPQEKGASRSPNVGRLPHTRLAAVLLGERGCAGGPHPVGGPWVGVRTPFLLANVGYVPYALSVRPGPDGPSKASGGTHAMGERWDATIVGRQ

SEQ ID NO: 960731 - protein, 117 aa, Homo sapiens
SLPPSRSMRPPAHPVPPADRLLGQGRRGPAMESYDIIANQPVCHRQLCSGVIKAGFEETMIPKYLFPKTNVVCWPEVTCWVMAVSPGVGDLFIWTKSRWSTGLLLTIRYPMEHGVVR

SEQ ID NO: 960732 - protein, 69 aa, Homo sapiens
SSWGARANKELELLWSLGRCSREACLEGGGQLLRWRGSPCSCALRGFLRRAAAVPWYLDMPVQGSCCVA

SEQ ID NO: 960733 - protein, 209 aa, Homo sapiens
MGKVKVGVNGVRIAIGAPGSPGSSFELWIEVDISCHQVTPFIDLKLALVYRVCRIMSSTLVANSMAPSRRENGKLCRQLEIPVTICQERDPSKNQVAAMLAAEYVEESTWRRSPTMEEGMGLIMQGGSQEGSSSLSPIWLNAPMIPQWDAEPVRSYDNERSRSSEQCHPGTSQACGMHPMSQGQATDNSGYRGRTHDHRPCHHCTQKTW

SEQ ID NO: 960734 - protein, 298 aa, Homo sapiens
VLKALPASASRAAISFRLYHELVGLAQIVRRRVGARQETADNGDDTGQRKERIEKTREESDLIEGLKGDRLHEGAADMTETGTYSGTNTWKRTHIPQGNHRRVGDRAHSKNEAPGDTVSAIRKMTRATLTAGMNELHGPTQREPHDRGDHIRRITLSRKEYHQYRGQRSNSGRNVLPIRIHTSNRAPGRINDSGATREEDRKRPSGAQRPKLHHSILDRPRKTHETAKRQAQPRMELWPYIGKEPTGGQRRQAAGRTASTRRQNVRTAGTHVSTEPHQRRHRLHTQSKTKSRACEDPP

SEQ ID NO: 960735 - protein, 149 aa, Homo sapiens
MGWARVTRRGPAGLCSPGLRQARLAGAGEGETEAAAEKSCVELHTPGSESEESERMEHLAQLRKKVRGGQLQRIELLLGPAQIPTVLSCEKPQDEWLEVQGQEEAMAVACKRSSEEAEHHGQLGPRLKANESNSPIRVHKARREGPGPP

SEQ ID NO: 960736 - protein, 232 aa, Homo sapiens
WQVCVWGRDLHEVELLSQRSNHELPCAIPRPQVCYPPAAPGGGPWVSVLPTLLLPSMPPIWCWITGATYAGGSSTSDYLSVECACQHVLGHLEEPTCPTCTLVAPVGWLPTSAPMAGILGSPTSAQQNCYLPMGCIHPPVRKHTPYQDAHISAIPKEPLCRASPATTTDSSPQGPTTGQAHSELHLVSLQMTIPGQAEANAGIPWIPGVRDSNHACTQQEEPEHTETRKTIK

SEQ ID NO: 960737 - protein, 127 aa, Homo sapiens
MTTHHPSLVLELHRTIMAIPAKVPSSLYYTAATWQFSYLIENIGPVTVAEYAHTRYFRVRLLTNAAPPLCAPRSACRDLIIFLHTLNNIFEPHCGRERRSQMNIPTVGIVDTIEAPAIPTLYRHDNP

SEQ ID NO: 960738 - protein, 72 aa, Homo sapiens
QAPLESIYQMDPLKLVATFMTNTSRREKSCYGIMFRHLPMPFHWNAGRTQGFKTGLLEAGTSPEVGEIHLLR

SEQ ID NO: 960739 - protein, 214 aa, Homo sapiens
PRPLPQAPPQTLNLGYQVRRYMQKVKKPPDEELHASAWSDWSQSSGYSRACFGDIGQCRPRDSVAADMGRVMADDWYHTAMCTSNEHNGTYQIDNHNGNEHAPATLPPTHDNKDPLITRETTRTGDEPPRTDTERNELSTNITTHQIPPQPSDTDPREIIPPENTPRQTTHRTSPQPYMDKSPQTRSTNHQVGDPSARQTPTKTPPERTRTRIQ

SEQ ID NO: 960740 - protein, 265 aa, Homo sapiens
MAGVCSPLRLCVPCRWDVGAAMQRRWPGLMTAAVPDMRCRDTDPEEERICGYAPGVCVVLACAAGAPRLPAPCCCSAACEAACPELLVEIFCCLLACGTGPTQLGPGLHEAGLRCVCWPGSGPPCDVTMPMPCPAQGMMCGQQWAQMGHLVSDWWLMPGVIACAAVPEQACPVCVHGACLFCACPVGVSSRNEDYPRTCSDVFLCAQASSLGHVLHQPWTQPRGLHPSSDEDRFGYVLAGAESFSLYRRVKPLPGRQICVPKASM

SEQ ID NO: 960741 - protein, 227 aa, Homo sapiens
TEAEKRDPQELVASFSERVRNMSPDEIKIPPEPPGRCSNHLQDKIQKLYERKIKEGMDYELHYPKEERIWNPSIYEKLIQFCAIDELAPTTQRICLIPMAGSEDSYYEALAKDPDNLLTMDKLAHGQTSEANKQLTYRDGAPPKRHHDQRPRPPPYHCQTQLLPDAQKRKSKLGQRLLPSDQTIAQPTIQHHHTPTLPSLSKQDTTHAHGLKTPYLVSATAKTAHAT

SEQ ID NO: 960742 - protein, 253 aa, Homo sapiens
MAIPERTAVMPRKTGRPGSPTYFLKIIQLLDDYPKCFTCGMHDELVERPTASCSSNPASVPVRRGRLMAADWCIVITNVCAMAIRWVTWKTTQLLEKLLAIDLVPARVIVGASLVLPTHEGMGTSHSYGSVESLALALRHNRRVPDLAARWLVATCPSVHGQLGRQRPKETTWLSRARRQRPSRFFRSGSIRVVQPIVTLVRWGLLLQESLKMHCRQPDSEHWADNRGGSSRSPRLLHHCSTLCPFSFGLASC

SEQ ID NO: 960743 - protein, 115 aa, Homo sapiens
MRSQLACAISDGVVLFIDAAEGVMEQQNAPGPLGTFQKGQIAGARKSAGSHCVHNRLTADPGAEACLQLMRYYKLRHCGMKVIIGKFLKRKRPIGNFQRDENLPFPTPGYVASPV

SEQ ID NO: 960744 - protein, 86 aa, Homo sapiens
TEFLYNLYSSEGRASSTCRTNVLGHLQQGGATNPFERNYGTSCGEGQLWLSENLAEVPEGGGCQAPNRRNSLKKGGYRLHKTFYLR

SEQ ID NO: 960745 - protein, 267 aa, Homo sapiens
PGVNRPRLCPGLWASSSAIGLALQPTRDVDGPLLLRRQRSGRCPGSSALAWTAQSGGFWGVSALVVVLLLLPWGPGLSLCSPLVLHACMWPVVHAMAAQPGDGMVLKPHFHNGLCMRAAVATWFNHAWPCNDPADCNGPGNANGCCLHLPRAPAVCGPPVPNLLLLAPLVLCTTRMVRAWPAGFSLEELRVAGIHKNGVPWTIGISVDPRRRNKSTGVPCRSNCAAAEGSTCSKTHPLPQEALGPKKETVLLKKLKLAPLTDGMPSE

SEQ ID NO: 960746 - protein, 254 aa, Homo sapiens
GWVCGSRRVEAAPYRARVRLGWGSCRLCLPAQPWWPEVLCVWTCGVGETCAWRPMDKWSNFDPTGLELLPPRLAAAELDALCCYANGCPESWHMIACDAWLLQFVSNMSNAQMMYRCACLWMQLNDAEHDPGAACACCDDVRRMTLELMDDPGHAPCASGPVSRQAGPGHAATDGPTECSSNFSMSENLREAVRSPVQEAGSHAASHRGAEEMDAAGTMNEMLRVEAEALVLLRQGLSGRMQTSSCEQIPPEGG

SEQ ID NO: 960747 - protein, 278 aa, Homo sapiens
LGVRTLQACVAVLPWLGSDVVPGAGGRGPSRGTTPAGLLPPEWEEDEERMSFLFSAFKRSLRGEQHRLVTAMMVLLGCLLCADATACLPWVCVVLPAVCCGLAVRPFMRKEELSLLVAWPPCCFAVTCLLSMCGAAAVDVRLHGQCRQQLDLLGVFGVFLLKPLKWTLSNMLGDNNVPAEEVLVAVELLKENAEEVYRLYQNSPLSSHPVVGPVRAQHPTVLTPAQMRRTFYLVLLQLQKEKMVQSSSKRGEDWEVAKGTCQVLQSLNLFGVSVFNEI

SEQ ID NO: 960748 - protein, 185 aa, Homo sapiens
MLHEDLPPDDLEVDKWTCDRWGLWCHLCFIRTWTALGISDAPVTGMVSGQNCCEEKRNPSSSTLPGGGVQNPSCRQEFAGYSISDTDSSDALMNYVFDRKVSPRKCHQVLSPSPGWSWEAWPDGSLHTHLHRIHTHGSRCNDPFGDLIKPSRLADISIVIDRKWIQEIMLHIHPKTGSPWDTQRV

SEQ ID NO: 960749 - protein, 261 aa, Homo sapiens
RQYELGGERVRGAVGLGGEQSTDVGRNHQPGKLDLVDPGRLFWKRSLTPPEAYMPQPHVSPGVGAKGRVTCEWAVWFCKKCGAGGHGPRRMLALEGDFRMLRGLADHYWDLTPLRPGLHPHLPSIPNYSNLLLSGHHTLACLIVDTIRGVSGIGVRPVTYGLYDYEGSKLRMTSPSPEGEKFHYVLNDTDGDWWEARSLQLRRKLAAFPATTWPLCDFYSMLEEWYFGKIVEMDAGEAAAFGMQSPGGLTHRESENSKGGY

SEQ ID NO: 960750 - protein, 178 aa, Homo sapiens
MPLVTSCICHCCDCHGPLLGTLPSRNDLSCTLDTIWTSSPSCRTGLHRVLLRHPVIDVAHSDLILHVRDVSHPAGGAPAICSCSVHAAWPAAALPAPVTPWWRFTTTVDLVPGVQPHWNRPVVPCVCPAGPTALQDPDSLSSTAGGLRRLTGATDPHSPCDAPVAQLSGCLLRPPSEV

SEQ ID NO: 960751 - protein, 78 aa, Homo sapiens
SPPPLHHSPRRRFPGRGSRSHPTATHQETKQEQMQTREDDTKKHENKKRRRNNQHKQTQDTQKRQKNPHEQNKKNTNN

SEQ ID NO: 960752 - protein, 217 aa, Homo sapiens
MDRTSSQMHAPGTTPPLLHEPVFCGRSCAPWTPPVCPPLCVLSDCLSLCMPACIAIPVLPCVCMCCDVCVIPAVWCCPVCLCPATACLPPAAAALGHGSRRDSGLGQRRPLLLSPPTATASVKMEPENKFLPELMAEKDSLDPSFLTAMQLLDGSTLCDDSRKETQKRMMRRITWIIPHKNMKLKELSADTCQAVSQVNSVGQDSWTTMEYHQRLLK

SEQ ID NO: 960753 - protein, 106 aa, Homo sapiens
MRSATLDYILTCTLNPMQIGVDDCLCSMQLVVGALVSARVVGGCVICVEPAERAYQQRSGFWASMAILCVPGESTAETECEQCVAWVGTMKMQGRRASAVESANLP

SEQ ID NO: 960754 - protein, 308 aa, Homo sapiens
MYEAWCNAAPRLRRAPYAVPSMYPCATTTPILRPAAYPGVPMEVMEVTPQPGSSTEQTSRPVYYCRQHYERVLLSCHTNGCSILFLEHATARLTTTLTTQAHLSPVPLQHGNSHLLHTPRSSSSNDDDWTQRAHARLDPTHRLDNRPTPRHHHDHTDRPACPPPPHPLLTTHPPPAPPDCPTGNDVPIPHDTLHAHLPTRRHTAPGLDDISGATLSDPADSPTTPLTIHLYPSANNTTVNAQTNATAYYGIATTPPPPTDLTPTTTRDAAPTHALATPPTACRALPARRHRQTTRPTLTTTATRPPLT

SEQ ID NO: 960755 - protein, 119 aa, Homo sapiens
MYEARVCMNPMGDRVEPWLDGMKMSNAPRGGVRLAAVLCCAVWQLTCPVALGDGVSCDVVPGEAPAPDCVVDELYLPVCSQMIYSYMSPEQMLWNAVSPFSEENSCYTSRMSNASGETI

SEQ ID NO: 960756 - protein, 116 aa, Homo sapiens
MSKLAGESESNLRKPNEEAEKNAPAIIFIDELDAICSQKRYNYIGDGGAVRIVYTSMLTLHGWPKAEGTCDRHWQQTNKNQQPLTQLYGDTAALTGQVDIGQPEATDAKKSSDPYQ

SEQ ID NO: 960757 - protein, 91 aa, Homo sapiens
MSLTLNYSRVMRTRSAHPCVCPPYVSDTWRQCVLFATLGMWSFPHTCPASFTDLEPDLPGRHWWAAQTPHAGWCLTVCWLYYPCVLYSPPH

SEQ ID NO: 960758 - protein, 95 aa, Homo sapiens
NIRHRCEAWDYDAQLRPPGSIVRRWDGWIKCLVSSDLTSAVTTGAFLSTILHLTILMNDDSVLLTCYYPTPPCSHACVPTTVVLVTVWPDCGMCA

SEQ ID NO: 960759 - protein, 99 aa, Homo sapiens
EMAETGPGAYDDGKIAVKTQTRGSWMAYHKERRQSVSVMCEDDGKLIRLPNVSVMLTQMCENDSTYRLREQQLFQLLILLLLTIVLILLCPLHTSESSY

SEQ ID NO: 960760 - protein, 132 aa, Homo sapiens
MARTARLIIRYGPPCADLTDLDCRTMDAPRQVVNFVAWSQPSCLHSVLLDDTKGIIMTTKELAKVVLEIDVTVSSRFLPRLLTIHDESLCCVNLLCLFQNNYNVLIFLANGMCVVLCHVHVVLSLLTLSFVL

SEQ ID NO: 960761 - protein, 243 aa, Homo sapiens
MYEAGFLARAAETRPVRFRGQAEGLCKQWLQRAWCKSGAVLLREPRYTLLVAACLCLAGVWCITFIGSFTWVVHTHEIDLECAYIEPDGKNVLSVNVSTIMTYYPYLLWAVLPGPLCVPSFGFRSIIHITRARFVPYIAIPMSLIGYLCTLPALCPLSTSTHFSPYGTILYPLVSLTSYALCFLLSFIFDSLFYLYGTHCHKALTPSHLLWFLISLPFRFVCLLPGPSYYPSLFPTFPNSFLV

SEQ ID NO: 960762 - protein, 210 aa, Homo sapiens
MSQPEAEVLRVTSCRGPRELRLCCGRYCRTDASSCPARVPTGVLPGRPGTHTLTHAARGALAEEHGPTRLASTHLLPSLLLTQRATRAPHTHTRRTRTAPTRTDTHSRALRFHSPHHPGDLRIAPPGCGPGSLATPSGTPGDPHPGPPHTSPFAFLPLPPQPPPALPHRSHCCHRLLATAPPRSPPYTRFFCAPPPFFLSPLAPASSLAP

SEQ ID NO: 960763 - protein, 114 aa, Homo sapiens
KLGLIRGGFARAPQRLRIALRRCCLGPSSFTAPSPPLHVLGLLSWRRSYSRSPFVGPGRSQLVDGGEGRGTGSGEEAEETSQASARGQKMGRILGTSREQESPIQPGASMDFPG

SEQ ID NO: 960764 - protein, 95 aa, Homo sapiens
RKKLGREAEMALSSELEPSYPQQTMLASNRLWPSLVAVNGSVTCTSESHPRTQSLGFPKTPSGTPSSIRPTQHRIRDPKRDQQTRPSEIMTTHNY

SEQ ID NO: 960765 - protein, 218 aa, Homo sapiens
TARCEAWVALVDENRGTGGLALLPPVIWTGGGQWWHLDPGLSWVLLTLCVTAGDPGGVGSSSDGGQRCSRPSASVVGSWGSGSTLPGDCVAGGVPSGCWGDHAGCVAPSNVAIRQMWPLLCQVPLGNPEEDLSHPGRALGPAGPAPTPASAASLRPSLRAPGRPVGALVAQIEIQGSLVAVDTLRPFCWAELGRDLGGLGSPPLLGLCLPPFIVLGRA

SEQ ID NO: 960766 - protein, 238 aa, Homo sapiens
MTPVQPGGAGGLVALVLGTAVASRRFGSGIRGRGRGVDGAGAEAAELAGGKAEDKEWMPVTKYGPLVVNDMKIKSLEEIYLFSLSIKEIKIIDFFLGGSLKDEVFEDYCQVAESMTLCLGQRNQCSSAILLAIWGTTTVPRLVWVLSAPRSVAPAIRWGHHPGQALHPSPVRQEATLGVNTDLWSPHLVLFMVDKGRCGSCCLVRPHSLDPSGALASSSDLSCLRKACHIMVGSRLNW

SEQ ID NO: 960767 - protein, 175 aa, Homo sapiens
MTQKTGEGGRGGHLAGVLGRRMHVTHAVPACSSLEEQLPSGTGQLLLPLPIPRSRASFPQGPKRSVDAAVVGPASPRCRSNLGAPFYLQGVSLGDQAGARASGLGFFEVGGGATRVTRLWTGQGSGRGIRRRAQPRVISHRFCPVRCTPVLNVFPAVYACAIFCAMRCLVAATSP

SEQ ID NO: 960768 - protein, 189 aa, Homo sapiens
RIWPSPRGLLQRDTVLYLACWRPATGADRWNPDGHVTMKRCSFVLSLGTTYPSLPSPGYPVGGPQANPLPHLSAQPPIPLVGPVTHRHRAYSRGPRPTEQGTMPHGRIPAHKSDAERPRESPHKEGENNAAAGELSHNAQQRGANQATPTRRTHTKHPTAARGARAPNKGSPRKNGPQKEGGASTAQRR

SEQ ID NO: 960769 - protein, 116 aa, Homo sapiens
PLTLRRVEHDEAQEGDQWMCLAPVSHEECCKDVLLSPTLRNGANAWVTVACCLRCEPLTMARFPLLAKAVSDVMHVLVHAAALWDALWQQLVPPNDPLDKGCAVLCFGDVNVMGPQ

SEQ ID NO: 960770 - protein, 256 aa, Homo sapiens
RGLCVVRLGILRTSGRVQCSRVLRSCGWEPLFWVSLGGCQMLQCHTDYVPSCLLFPCKMAVMTACVHAGGCALCGPLGEPRGTGRTCCVGIPAVRVSVHVGIAVRPGWVGMCLVVNCGCPVGARDGPGGEASCGAGAKCALACGISWERWGFRTRSTQKDMEAPPPMWGVQRGDPLRRRFQQGFPPLVPRRQGKIHLKSPSDITSTAVGPITLKRRQHFDRERQFQMLENVTLYPVGGDGPPNRSVERGGEIDHGY

SEQ ID NO: 960771 - protein, 160 aa, Homo sapiens
PAWPWDSDPRLPFPAPLAWPRASVSLAVFPLSLSGAQGLQCICALCHSNAFWCCWAAVLVILCALVSAASPSVLPWLPSQGNMLNLERCCLREFGLSANESSWLHWVCPQCPVSCPPWNGSGVPIGPITVGWLCAREVGLAGPWEEHTHCPPCWVALCAR

SEQ ID NO: 960772 - protein, 70 aa, Homo sapiens
GPASSVPLRRQVLMRDGNRGRLVVRGECAGPAREPLTFPGGDLRCETSGYPGLPEAHEDGCGPTAWGLEH

SEQ ID NO: 960773 - protein, 305 aa, Homo sapiens
APRTSSCYSRGALALTQTWAGSHSMSVFLHILCPWPGRVGAPLHRRGPNVGRPRQLRCGFGQADCLLKARRIGACWAPVDSSSEGPGGIGGPGETTGIVKGPRSRDYDRVWNLGEPLQLALTNKRKTREGRGYLTTIPMNTLLLRLHERVVGSGTGAASPITRRVRHTAGDMWTSPINSNCAYRRHLRISGPPWKNCSRTLCGAFIFEAPRGGARCNNSLATVSIQEDVKPRKRRRQTALARLAAYGPPNMNEGGRRARDSSGGKRPINRWGNFGHRDCDCIERDRAHPGQEIYPFGEATWAETV

SEQ ID NO: 960774 - protein, 208 aa, Homo sapiens
LPPVSPALPGRAPTSPDWWPWGLIWAGCAGASPHPRAPSLHPVPWDLTLGGVKKKTFTPNIIMSGRSMEDAQWKQCNLSRKDEAVKVDRDLTTERGMDGLARPSMNVIQSHSIFEHGPMPKMIEEKMGTGIRPVGCVRLGTFSYHQAFKEREERDQTKKLNQILRYAGRSDDFLMTPGLEERTLENIACCSLPAGITQGWRFKGKNND

SEQ ID NO: 960775 - protein, 234 aa, Homo sapiens
TSTVDAHGTACLDMMCSIRLLQCSRLSRRGLLWARFLLSGVAGSIRSWRGVGDQGRCHLLYRSMRGEPGIPGPLRRPWSSGGSLRCSGPLCTCRTSPMSPVRVAIVVGTMHHMWSAASGQSLVGPMCVGPARVVPVGWPLVGSGGSRSDCPVGGPDWAASRQVLGGARGTRCPELSHKGSPGGASWRCVSSPRDPLVDMGGPCAAGENPWEQEGAFQALGGPPGGVSLVARGVK

SEQ ID NO: 960776 - protein, 101 aa, Homo sapiens
NYGRYEAGFRIQEQVEKSAYEFAETESMLKIAELSVQDRMYRDMYDLLFLPPSFPYGGMENPCLTLCNSVLYWQATRVNSSNVDCNMIISHILDRQSHVTN

SEQ ID NO: 960777 - protein, 156 aa, Homo sapiens
MLKRDSGDEMRCRLSTSWLVLRHHCSKGSRATQVAPAASAPTPALNRYELGIPIDTAKGLCTLMYYRSRSMTRGGEPSVVLLAGPWVACSLVPWSGWNRDSPWEYLAEFGVPEYQREGNASFPSLGLLDTWSLGASLAPVGNPLGGRSQRLPHGIR

SEQ ID NO: 960778 - protein, 112 aa, Homo sapiens
GYRRLKWKRFGGRGPDSGRGAPAPGQFYRIPPTPDPFMVPASALYRGPITRTQNPSGDRNLSSSAKVPRAELVIAADMLELLRPPWLVPATSLALCEFNNMSHGWVCASGKI

SEQ ID NO: 960779 - protein, 39 aa, Homo sapiens
VFLGGGGEAPEPGLFLALALAPEKAVRSLLPPQKGGAPG

SEQ ID NO: 960780 - protein, 104 aa, Homo sapiens
SSGQMTLNGNGFPWGLTGRGFPQPPRWSVSLEVECSVRKWGPINIYSPRDVGSPPRNSSYKWSPEEVSSWHKGTRVRALVLEPMWCDQSLSSQERCDIFSHRGV

SEQ ID NO: 960781 - protein, 126 aa, Homo sapiens
MEMKKKEKNRERSKERRKKTKRKDNNKKQKPIEQKTNKNKKKRKSRKYKKKHNKQRTKRKRSNTRTHGTKRTHKKTKRTRTDGEIKTHQKKEEKDKTKENEGKQREKKENTQHKKEKKRTTTEQKK

SEQ ID NO: 960782 - protein, 74 aa, Homo sapiens
LVTRVAPCAAMVGLTVRSPDEPLPVVRIQWLYMLAVVNMLAEHAVLLNLPDVPGAGSDPVTCCLVSVLLCWPGC

SEQ ID NO: 960783 - protein, 96 aa, Homo sapiens
MYAVPRKVTEYQTATVNLSPCQVTHQKAHKTTCFRKGLTVAIQVANSRLAYGNDRTWQRHLKIHTGDKAHKCDVCGMCFTRARQAETHMRCHRGVK

SEQ ID NO: 960784 - protein, 252 aa, Homo sapiens
MLGKNQQGSCQVQSMHRPRPKGGGMCWGRGWFQVHPTAWSSGISLVARRGCGGFSLSVGFSSSSRIGVVQESSCLACVGGQRTWVEWGGVEAAHSASTRGPWSCLQETISDMWSQEWKKPQWVSRIVILSVIRVGHLLTRGTFYKGFHILPRSGLVTLLAGWVHRQSTRVKADAVGPSGTMDGSNQPSSSHRQKHGPAVTSWVSNRDAVTRMDGGLNSRGNSTTHRGDDALWAGVRQGAERTQRVGDQWRQK

SEQ ID NO: 960785 - protein, 78 aa, Homo sapiens
VGGGTTPKKFFFNPPARGGQINPPGGGGKKMILVSRRRTKQASVEENGNGDAGGIEREGANEVLVVCIPPTSFEHIIN

SEQ ID NO: 960786 - protein, 66 aa, Homo sapiens
SVGARGAAGLPGLLRALGSAVQLLLALGSSRYCDTSVHVALSVECSRPFPDGLEMWLLVMLSVCIC

SEQ ID NO: 960787 - protein, 174 aa, Homo sapiens
RSALPEKEGEELGEGDAARWMDAACAGAFVGRWRWSVEDGYLSDVPVQSCINAAAGLLAAWTTSRMAFSKEKMEKTKVRTRENLDEDCASRPMENLEKTLATLEKRMNKLVHCCLCARRAGCEKHEWLSAGTMLRKSFTPDHVVYCALQGPAVYKVPPFTFHVKKIREGQCGSA

SEQ ID NO: 960788 - protein, 78 aa, Homo sapiens
MYTVQDPMTDSDVTVYLTESEPVLELVQHHLYLVPACLLRPPSAECVCAHMCCPHLLMWPTLCANVCDAMDECGVPMM

SEQ ID NO: 960789 - protein, 317 aa, Homo sapiens
LVSGDNYPPPNPGYPGGGPQPPCPPMLSTTTNTEGPLTQHATLTRTHNEYETRKVLHNERNTREQKDKAQRRTTEEKAEAKRKRDNKHTTKEQNKEEHETAQTRRKKRKGERKEKQEREQRTSRKNRGKRRNRRKRTASRRRRETTDNRDRKQQNQKAHRRKTSVERQPNERRREGRTSARDRTETDSRQRRQRQQKQHGAKAQKRNKAEGKPETGRRQRRQRKTSKHSDTAAAKTGEPQTRTSAPHRHKREQTRQAQRNERATDQRRAGKPDNNEEGRPPKQTKQQKSSRQERQTRSNSTKAAEARHTTTDRQQTR

SEQ ID NO: 960790 - protein, 103 aa, Homo sapiens
ACSDRRQPWRPAWNGMVLKPHFHNGLAAGAVATWFNHACALYMILQTSVPWQCQLLLPASAPAAPAVCGPILAHLLLLAPLCSGTYTECVLLPVPAVLHALVM

SEQ ID NO: 960791 - protein, 263 aa, Homo sapiens
CRPCSQPDGFLNLLSIKWPAPDPAPAAPAALPGHPCVLHADAGLHDCVPDVAVAALWLLHVDLMVTCCAPHELHCVAWAGPASPGLDAAAMVCSAVCLQGVLCLVCCSDYNDLEKYCHLPMNNECVGPACTWLACMASILAVPWSYGLFLDKEGVTNDCLTPPLQMCCHHQMSICAWPSPTPRILGSGSGIVADYVIPAQERTSFLLVTNLIVTPTSWQNCLCAENEGIPDGACSNDSDCHAGEAVQLKTEWMTGAAAERNFG

SEQ ID NO: 960792 - protein, 69 aa, Homo sapiens
SSSLDLRNNQWVSEDYTSAEGFLVPGDMPSYSKHRETRSVGSVEDWVLNLVGWVSDDPHDLEQQEKVCV

SEQ ID NO: 960793 - protein, 261 aa, Homo sapiens
GLSRAVKKFRSKPQLARYLGGSMDLSTFDFRTLAMMLMSNHEQGGLRMRVTLQIPPNPGQRCNARPDTLALPCAARRLSIFKQPCVTEDYLDHPRAIQVSYERTLHKCVAVISLLPRSSLARYECLSGLEAPSTSAECGLVVGPMDLLAMVALHAVVGTFGFASGLSTAASQAIWRSSPVTLGIHALRLGICSRLAVDDYTPGRMAQLHAAPVPWPSWLTDEGVREQEDAVAEVSVAAGGGSYGGHASARVELAYGEAAVK

SEQ ID NO: 960794 - protein, 84 aa, Homo sapiens
PPTPDPGTDAAYQLVMKGPGWSLKRGAGGHPVRTILRGAGHQTLTRVSWISDEDVMEYHECGSVMLTLSLPSQPKCAQMGESDT

SEQ ID NO: 960795 - protein, 147 aa, Homo sapiens
MWDSDEPIPAKELERGVAVGPTGLLCLLSDHVDKSDPGCCSGPISQCHQHHVLCGIDHLALDEIKKRGDPEFGYTPDVLTDTTCRTRSLPATYHLPPGCREAIEEVKNGGWTSVGSPSWLCGYVTHAEHCRHHRGWGSIGQAIASCV

SEQ ID NO: 960796 - protein, 178 aa, Homo sapiens
MVEARGYRPRQSMTGMYDAGVAGAARAALSAPQLLTSWLRVRFGTWNWIWLAAAACAASACGPSAALCFTAPAMPPVQSGMWTCLSPPGTLLLGWSVPGSLHTTCDCCCAAAVTVSVPWRSCLCIWACVITEVDAGTQLLGHQRAYVVWCMAVGISYISVYDHQGIFKRNNSRLMDEI

SEQ ID NO: 960797 - protein, 136 aa, Homo sapiens
RNGFQRCRQREDPRTRPGSAWQIAEAAGRPGGHVAVTSGPGRCYGVDSCTLEGVAPHGRDTMLAVGLLGHQWIILPLVGVTASWVERPSGRHLALETRNVARVYQLARLVLWLFWDRYMTGPPAELEGRALYLLRV

SEQ ID NO: 960798 - protein, 309 aa, Homo sapiens
MYSLCGQSALRKGLSAPFAKLSHNNCHALESPAANSFFGRRLHHQLVAEARQAAVCGVLLVVCVLAVCAGYYCPLAVVSTCLPCLPDAALTVAVHELAVATFPTACVLCITLLIECMLSAWCSCVCWVVLWGVLVSLVAALCYCGPRPDRPVGYELLPLVLPVLCCCSNLWGAWPCSPGCMPPGVLLVSILPALSQPPVLWPDAGPRAKEAEPIDFADAPPTAGLRRKRRGGSAGVDEEGRHAFDLGAGRGASPPAPSREQQSLSRSKGSLWAFPKGENGGRNWRMAKSGRDNACPYMNDKPWAEKGQA

SEQ ID NO: 960799 - protein, 127 aa, Homo sapiens
MSDHTSQIGPVHGGPSAAPAVCVRASQLGMALQDGPSELSSVPCPEHVIQLRALCLILLKRVQEKGSHRKKDTPPSIDTSLSAKSGVPEENSSTRGYWFGTFIGVSHAGLCTKGACVPSLAIGDYSH

SEQ ID NO: 960800 - protein, 227 aa, Homo sapiens
MRPPNTPPPVMLEEIITPVYCTGGVSPMCMKQLWPCGAVSLCACHENAINVPECQDYEHAAVCAMPAEWLTLFLDDVPSPRVPQSLGLQGPECTQYHSKDLMSINVVNAVPLGTCLSNPQYIVGMELPAQTSSHVEHWWDCWLLAGHRLPHSQTTPSCTRSGSARHELSRIGYAGNLPFPAVATLGSGWTWSWMTAALQDGSYCRASARQESGRPLRGFQEWRKAVG

SEQ ID NO: 960801 - protein, 281 aa, Homo sapiens
SDEERAICSFANIHNNVMLWRAPRELFFGRLAHQLVAECEAGWRCVVAACGGCAVLCVLCYYLPTCCVSLPCLPCLPDLATTVCLHDACVCSFPTAWAVQCCRLMCSCLPVCMLCWRVVLWGVLCVPVCAGTVLLCALLLHYDSCCAYGLLAPGVLMPCAVQLAMQTLWVLVPCFPRCMPPVVLLGFESPCPALPPGSVPMLALEWMLEPSILPAAPHCLCFACKQAGVLDRATRRAHSVVPRAGGVSSSPAPFPEMQQSLAGRMIPWAIPQVETQQLAHG

SEQ ID NO: 960802 - protein, 80 aa, Homo sapiens
GDEICMAAGMRASLLTGVSLATVNGQPNVSSGLCGTAVSGLCLQDTMNATASLGTCDDNAHVKCNIGTPLTCPCVTAPVL

SEQ ID NO: 960803 - protein, 218 aa, Homo sapiens
DEGGSGRFWAPDAGARCTCPSPAAVAGAVDICRCERELELHLLSVTLLDGLLVMLSGAHAMLAAVRCLLAMDAVWPRELGSSLVLRAGPCGRMAVTCMVLCAVPESVLLRGGAIVVPMKLLCCPDGLKVVNDWSWPGDGPVLGWLPLLPCARAYVSPRAPFYLASVLLLSCVARQLELGCRALRCLLDCCWPGVLLVAGAGMDSWAMGPWMAEAGATG

SEQ ID NO: 960804 - protein, 243 aa, Homo sapiens
MAAVDLEKLRASGAGKAIGVLTSGWLTRKAMNAAVLGCDAHGHLCWCAKVFLIYEVLMSVPLWSVSVMNINACANCAELSPTYIHAVCWHYHLAALCCNGLYHQWRWLPWQRAYNLAKHGITNLCVMAGDVQPYMCANIFLQRCGAACWSELVAGRKDLRDYMPWTYSHLNILLGLVGSIDNDFCGTDMTHRCTDSALHRIMEVIDAIITTAQSHQRTFVLEVMGRLRYLRWICLAHGGGVIP

SEQ ID NO: 960805 - protein, 215 aa, Homo sapiens
MWPWNIGRGVPGWLSCRYPALVCLASPLTFQRTRTPQRTLQNVPGPAAVCLHATGDPGSPSSFPSVVEQTGSAASAAYDIYSRLLLGAHRVRQWARYDDSVSQPCYRTAPLPAIQSNKKPIHMYINSPGGVVTLGLAIYDTMQYIPQTDLATWCVVPGPTAMGSLHSLPDGTPGHAPTRSPNSRIMIHQPSGGARGQATDIAIQAEEIMRLRSAL

SEQ ID NO: 960806 - protein, 32 aa, Homo sapiens
MTAGTLVAEHQLSAQTTESLTHICLKSFNLTY

SEQ ID NO: 960807 - protein, 165 aa, Homo sapiens
MCLSDVARALCFAWDTVASRCLCLRGFLAVNLNACVPSDLVGCLVEPETGVPPAWWLILGLGHFGCCSWCLLACLFSMHSELTELWARLGNGRPGRPLQKKREERPCPTTKAGGGDGLGLGPVAWAWAAPTERPWGIGWKKIYREGEGNKKRKQGTGKDNLAEKV

SEQ ID NO: 960808 - protein, 172 aa, Homo sapiens
MWEAGLSPPTMIHQAGVEVHAVHATDGPVSSKCPCCQDGTYSKTIPSHTYYYIMRGTQGRGAPMHNDMTSHVNFRDPFLVHILPRQMDNIRLTLHKKHMGGPTLETPQFTGIHWQFPNESDAKRVIPLALFGNHHNDPCCGKPVAGNTTSDGLLPDKKGPPRINTPTAHQEP

SEQ ID NO: 960809 - protein, 97 aa, Homo sapiens
MPELGLTSEYLEGSFTCRILAVMDAGWSVTTDDLLPVPCSGDSVSPAARGRMCSGSPYWKGLRQGSMGSYEQLWAGRCGCLVDLTVLRKYGTRGRKD

SEQ ID NO: 960810 - protein, 120 aa, Homo sapiens
RALLRRFRPAAVSLFSVLVSGDSGDLMQRIQSVYPSSQCKLLLCAAMHVDWCQCSWVSSWTTRPSSRAVVGAGVSSCKELDCHCLTSSFPHMILCQNCLPQTPGMCACVLMPGTMWLCCG

SEQ ID NO: 960811 - protein, 133 aa, Homo sapiens
MDICGDRDVALHNRELVCWIQSSYESPMKLPCFSVDCVTDQYGQTESSGPDDFQCTSTCSGNKAENGQVSKEQGPSTKGMGAAPAETEMWSGNHRHEGLETQGREFDTAVQTDIETPNQLTERSELQPTNTNH

SEQ ID NO: 960812 - protein, 219 aa, Homo sapiens
AHACGRGACVCASARVSWSFCHHACTVHRQHTYTCPAPPLPDGFLSWSSPSSWQQATGKPPQYIADATLVPDQLMAFGGSSEPVRASCQCCTASGKIWRRAEPHPTASCLCGLLAERPAHRVRTRVYITLLRSLNAANVGWNQSPPSPKEPTRDPSSARALAPARVNRRAHACASRARSHPEASGVREIHKTGCTTTYHNHDLPSTEENNCDGGLKDDR

SEQ ID NO: 960813 - protein, 173 aa, Homo sapiens
GDLAPGVQMRSLLESDSAPCFQCPREPRLWGAGGPLLPIDYLHPELSCAVLVCSRRQCWHILRSRKCDRTSYVLAVGSWCMACLFVEFRYVLYVSTNPGPGMPLLLISCLLTSFECGSGPVRVRGLPLLLLGDLKSQESLATFSHKTLFTCGCETPGNYIGMGEAQAPVVTET

SEQ ID NO: 960814 - protein, 137 aa, Homo sapiens
QFLEAPSGTSGTAAATVAPAGWVEEDLGQAIYNCRFCYSAIFCPKRNTVHYDFLVCYFQYTKWLVGFYGYLDVGSQRIRVKLLTWVVALRASCGTWHVPDLAAAFNYTRTRGMSYTLAIRGLVPPLRVETPHTTSRT

SEQ ID NO: 960815 - protein, 236 aa, Homo sapiens
RSLQCLLLRRPPKLVGRDGAWRGPVKDAPILDAGAAASTMLHVLSCCACGFLPDLDVMLMLWCALDVCASVVLVPLPCSWCCVAVFSVLCACLDVSELGPCVAAGVRLWAGDFWGTVVLTFTKKAPQHVPTTLTTHSSWLLSPPQEHGVGLSRVPLRGVSEASFLTYQSSPLVSWVTLPVGPFRWFGAVCRGLERPGGARPQGPHIALQEATASTCGSRALNYDFAAYRSTVPRGD

SEQ ID NO: 960816 - protein, 46 aa, Homo sapiens
MRLYELGGPRCCSTQGYSGVPGGSFKIGIRRSTCGLGREPTFTTRV

SEQ ID NO: 960817 - protein, 110 aa, Homo sapiens
LQAPFPAVARDPCMASFPLMCDESHWHMCAVSFPMAWWPLWCAMCPGPGPTLNPSDRVLCQCPGPLSNPRLGWSPSDQVLCPTQGAGGLLGAGPDPRGGRSHGALDLDLT

SEQ ID NO: 960818 - protein, 178 aa, Homo sapiens
PGGPPFFFPTKKNPGLKPIFKKYPARGEDKKSCAPPPPPPPPPIFFVSSSLARREYHLLFVVAPPSLQKTSSEQVGCVLPPPCESKGVIKQSPARVRVRVPPEMVSTHTPPESWFSEKHTPLITPERERGRRARSPPHPLMMHVCGGSLYIHPPELVRVKERVTSNVTGGVLNKDRES

SEQ ID NO: 960819 - protein, 165 aa, Homo sapiens
QQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPI

SEQ ID NO: 960820 - protein, 194 aa, Homo sapiens
MNPEYDYLFKAAFDWRLRRGLVMPAPAVGWMTSYTDERTIERPIGVRLRTSPTAIAGSGMATETTRVESRGTTGAAQGDGFQRTIDYAMRYVTGEGPQWHIIYGGNGDCTISVNHGEVPSGTSDERQLELTGDDCTCILAMAGCTPVEVKAIRVRGAKHTYANRLTIADDTDELGPKHPTSLERNGYGYIVVLG

SEQ ID NO: 960821 - protein, 263 aa, Homo sapiens
IAERSAGAGPRERSAGEQPEADTASRPALPQSSRAPLARATAPLRATQDYSRLAPGAEKARWAPVAAAPAPPPPCCSCSLVASAQPLSPALRLPEPSPPAAPMRCGWVMGTAALAFLAPKECSVRHHAVRAVLCWLDGVSAGWVHDSCPCDHAAAPTGQFSVLCPLPMALSPGLACTNAFLCTACAPLLTPLRQANRLPIKVLKMLTARTGHILHPEYLQPLPSTPVSPIELDAKKSPLALLANMFAIGKAGPLALLDGHHFT

SEQ ID NO: 960822 - protein, 110 aa, Homo sapiens
LPQPSPQEPPQSQAPHPALPAWDHQWQPQQCARMPLPHQLPPNAPVVPSPVLQSPSEGLRDGGSAQGCPLTSHWHGAEAFHFTPDPEQGPRHCSGASASLGCLRGLASPY

SEQ ID NO: 960823 - protein, 305 aa, Homo sapiens
MKARCPRVGVDNPKGGSHTSSSEKKPVVVVTINPNTVLQTTCCHCCKTSSSILCCENQHPFLPRGGRSCLPYIKTEGNIVVGGPLSTKCCVGNIVWFLQGHFVGTPPPNFTNVLFVFPPNDYSPKEVPETPVGENIIFTPVSKEKVQLCGREIPPKSSVDKKATNGIHVFVALESRGPPYWEEHPFPGVSHCGRVHKDNLIVRRADKIRCVSLVEDQRWSKRVIFKGPQEELFIIPPAIGSREQNPGKTFVCTPSVVPSDGYGWSTILCDATCEHIHGRSDSTYVIIPIDDEDSTRRRSDRLHVP

SEQ ID NO: 960824 - protein, 139 aa, Homo sapiens
MPERGLWRADTATSPRLLVEYHVRGVAHCAREGVLEPPYTNRGRGGENRRSHGVSLLVNGVVHPEGAPDQDTPQVLGKVGNGVSLRGAHRHVKRAYNKRGARVYKAPERGRVYNPTADLENPTEKSYTLRNFVAKPHVT

SEQ ID NO: 960825 - protein, 131 aa, Homo sapiens
MPHIPRSIPQGQRPYNPVYPAVLSYNCGKPVQALLSSHQVSPVRVRLNRISISWQATVLMHLIRKRHPSSITIDLPSTTYQSSQFVIATDICLESRCRPNPSLRLHDCLVSLYLRDRLMTHQSHAYHIVNP

SEQ ID NO: 960826 - protein, 575 aa, Homo sapiens
IFNFRGAHSLLENFFFLWKGRGLLIMCSPRTIEGAGAIFSRGPALYRTIQPYKPPGPQAISSVPSALGEVTVGIITGVPRPHPRRVVSVPQYTFSISRASCSSVFQCGLFSSPYHKKSSILTLSLECGGLRSPCVTPSSLCVSRALCESVLCVCLSPAVIDTESVCARCVLSLTLFSVATSAILEGLSRLSYEPECFSLYIFYLRSRALLAPERERCGAWGQFSQCVPRVTPPPLYEAPEGVVREPLRCPPLGEFPPEESTLFSRRNLGGETLCLGGVCTKTPAGSPESLSFLRGVSSWPEYNTLGGGGGTTQNPRGGDKTPSLVGETVSDAVNRCVPPRVGAPPYNRRGGAHPGVSYNASCETKKTLVVHDTTCLAQPTDTFWGWLRHQTTTHNEGAPYIRLSPQGGRPRKSFLIEGKTPQSLFPPEEGNLPFNTSGRQPPKLGDGRHDWEAPLYTKEREKSPAGKGGGEPTITEERTSGKSRPRVYNTHLRGDHMSLTRGGPRNKSPPPKGEPLQKRAPGGTTSTTPGEGHSPTRGLYIDRDPAGYSEAHRKEHHGHILVDRRQHSGVILHTR

SEQ ID NO: 960827 - protein, 145 aa, Homo sapiens
GLGTKILLKGFFRKATSKSPKYRCQGKPVYVRGGTWGGDMWQGALCGFPPLLVFREMCGVWVGRYLSHSCGVLHQGASGCAQGEGDFFIGRHISLPRVGVSQGDKHVDFLTLVDAPQDNTLCVLEAQTRVWAHTRHVCLKASREV

SEQ ID NO: 960828 - protein, 125 aa, Homo sapiens
LPKKKTVGNRTPTRYSIPQQRPTLASVSGLSWGNGAARIHLDGGVAGFGGQNNRRWSSKWLRGSSIPGSGLTKSEGGVLRFLVFILAFILKGPGDLIKAMVVYLNREVGWGSGYHLHLKEEQIDF

SEQ ID NO: 960829 - protein, 103 aa, Homo sapiens
MSTYQSSLSYRHYKRERSNTAPSHNSNLFHTTFLILSLRNLLRAGPSRLLIRNHCRRARTNTRTKAGYIPAKPAIAKVVSTSSHIVGCYTNALIMPINLGHTH

SEQ ID NO: 960830 - protein, 233 aa, Homo sapiens
HPAPSAWRFSQRGSGWAPSSSQTCVRPAALGSRLRPDGPVWMGSGAVSALGVVLLLPCGSWPLTLLPSRPQPQGRRQPWLPSLEWHGLEAPLPQGLAAGCVATVVQPCRALYMILQTVMCPGNANGCCLHTPLPPLRRVPSWPICAAAPRFGTTLNGALPAAASAWMELRVCRHSQEGGPDHRHFCVILRRRNKSTESLQTNLCSWLKEYLLQTHPLPRKPSAPKKETVLLKN

SEQ ID NO: 960831 - protein, 89 aa, Homo sapiens
MSTLVAHTVLTPIHSHQRWLGALSFDPSNLAFGLMHLTPVQDTPSIGALDSLEPMSESRELLASLRGSLCIPCPLRKQQVSFPSTHPCM

SEQ ID NO: 960832 - protein, 72 aa, Homo sapiens
EECGLLDSLLMDPVLCWPVGEDAVPDVLCVLCWLCRVVRHVRDVSSDLRECGAEPLVVLCDVMPLLAVYPCV

SEQ ID NO: 960833 - protein, 211 aa, Homo sapiens
MARRPRNSSGLAFVLSACPAETQMPGACGSSSAPLTGVLQTHDWACTCDSGLRPLSTPAAAIHPHVLVPCDLAESFCDLCLVHELMASFCSSLHSGPPGQCDCLLCVSMKLSISDWVWDDLNKSSRHPADAVTTVRSCFHMDVHAAVHMLAILVAPSELVGWASTSVEIKMTSPVYVHRMMVGIGTSDVDLDKYLPQFCSLLCRDEDSWGL

SEQ ID NO: 960834 - protein, 199 aa, Homo sapiens
QPLPSSASSPADWASAEMWAAGQDGHSGSWHSNCMPMTHDIGVNANMGLDRPWRACRTVILRCGSCCRGSKDSACVVCLELIDRQMIAIGWTTECGWHEDLMHDLLPMQSRVAVCGTRIWTQLCIPGRHDWSAVHIVHEADYYQWYPKTNLAVYTSPYCNLTDRIMELDLPDGGHLTHGYMSDVKRISGTIHLLRVYAL

SEQ ID NO: 960835 - protein, 71 aa, Homo sapiens
RCGGDCATSLAGGCAAEPRPWPWPSLCLPVLLHPLIACCCGAVMPCFGLVTDVLNVYSLCAMMLCSCDVPV

SEQ ID NO: 960836 - protein, 112 aa, Homo sapiens
MCTSGNVCLKVVPEKVHALTDAAWCNKHAKIVPVCLIIVRSVGETTSPNMPLSCSYNSAPVMRAATIFCVLVAIAPLTRGEQPTLCLRYRLVRVYKHSGTRANSGCHTSALG

SEQ ID NO: 960837 - protein, 67 aa, Homo sapiens
ILTPKYVLKMEHVSTSLVWSQVAAALRHYCLAKQKPDCLLAMMALSSFLQMVTIHLSLGWVVVRGLA

SEQ ID NO: 960838 - protein, 121 aa, Homo sapiens
MALSLLLLAWARGPRWVRSCFTGRARPLSGSLCLVIERAASPAAAGSTVLLPLDLEAGYVGCPLIDPGPGLCALPCLESVSSRFYGLRGAGSTNVLWFLPCLHGLLSGALQAWAIAVHHLA

SEQ ID NO: 960839 - protein, 179 aa, Homo sapiens
FKMKLKHLLPSHWLAAMSSGRGAMNADRSYLSTEKRSGHMKLLLTLWVKNGRVMWSESWGGNDRNRGCPMNLRVSLIHGRVPHWLLRYRVGFLLTRPRRTGEGTQEISAVAALSFARHARSERSATLVIVTKEGREGYFLGTGLILQCLAERGPQKSYDRIRMTFQVSLEEDECPPDML

SEQ ID NO: 960840 - protein, 88 aa, Homo sapiens
GYRELKWKRFGGRGPNLGGGVSWPQESLTCIPSTPDSFRDSVAVCTLHDVSNHCWTQNPMVCPGTSVLVRMFRGLEWVDVPADMLGLL

SEQ ID NO: 960841 - protein, 227 aa, Homo sapiens
APGNFLPRSAPPALRLPSPRPGMAQMGGTPVLVACPVTDVQLCWTVACDVNGSDVMGTWLCSDVGALVCVDCVVPWMQMWVCGAQTLMHELPCDGPGHLSTLLACLENNFCLDLNGNDVLVWNELIALLHQRLRTVGMTLNSENMVSMSHPGFLALKGNQGEIHVQCLNVTMCFQMDNGFPDNGNHVLCPAHLRAFSAGQTWVPLVLMASELFQFCVWMDLGPPGNV

SEQ ID NO: 960842 - protein, 72 aa, Homo sapiens
LAGLPGRAELGLPVRMTWGAERSAAAFVAAELVCLSCALHPGPRPPVAPSGCQIRLRGPALRRSSLDGWWFS

SEQ ID NO: 960843 - protein, 95 aa, Homo sapiens
KNRSGALYSWTVGLPEEVTIAEAYQMLKKQGIVKSDPKLPDDTTFPFLLHGQPERIVIFEDEEKSSDAGPPAEKRAPIPKTSAQPISSFKEMVQE

SEQ ID NO: 960844 - protein, 158 aa, Homo sapiens
NLRWHPNAYRTKTTSAIYNYAKAPTYVGPYGLLQPFADAIYTRSPKSPYNPATSTITLYITCPVPIATHHLLFYYEPHTYPIPKPTVTTTEAKAYLYNIIDHLVALARTLIQVRNQNTRGVKRIEKLQKHTIANKHEDEGEHNDGKEQTHKQRNHTLV

SEQ ID NO: 960845 - protein, 233 aa, Homo sapiens
TLSRLGNQTRVLLEEQCSAPAELSSEHCHHGLLPVMSTVAVQRLCVMCPRHGPVQMLLNTHCQCSHSSLSVRVHHFPARPRTASDHLVLECCDDLMSSGEAAGHDPPCAPCVCCGDTYSMVSYSDTVFIHSACHVHLHHLSCSVPVNTLDLEWNLASAVHGQYQLPSQMCPVDDVMIHPPWVCVLRLPCLRAVATSDSRVPHRGGSSSLGLPRDVGGRRTSTPVCMPAALPCS

SEQ ID NO: 960846 - protein, 154 aa, Homo sapiens
MLSGRSGELTKLCRVDSCDLIDGHSRHGVSRRSSERACHDAWLRIEKAVCSSMLTEWARLLEAACVRNGPQYWDLEKAWMGFMSEAERVSELHLEVKASLMNDDFEEDQDTWQNEKPFTSKMMGGLQGDQGSLRTAPERHRKTWGKKRDRGRSS

SEQ ID NO: 960847 - protein, 248 aa, Homo sapiens
HRPVLIYNEHRGLRPESPFNPGGGGCMGAETAPLPSSLGKKSETPSHKKKKQGRNQEAARVAPGAPSSPGLCSGRFPFRGAPGSRKRRRGRDVPGPELRGPGGRSGSPAIARGGRFDLRAIPAKGPQRRRQAAALENPQKNAGRAETRSTPARERLPQRHAFPQPKATSLRVMQPQEVPGGEAQGLSNELFAPAVRTRGTAWREAAARTWFIWISLPLPSSAWGISAWVSPPSRRLSLRGFPFTFRTQ

SEQ ID NO: 960848 - protein, 249 aa, Homo sapiens
GVSFSVNSGKNERVPINKGHEPFLHDHVVPLTRGQGQEGAVDGELLVWGRPGTGETLGFKQGTKTEVGWAQGEKRALKGRPLTPLGGPQGWRGVTQGVRGERGTREACPRNSTLSRGVRWREKALTSRGVTLQAPTRVCPSQTNNRDSAGMCVALTVRARGHKKGECGNTCAPQRRRGGPHPNKRGEHLHLQGEVKAVWAQWDKSGATWENDQREVCSTQKISLYTVPEMYFPEAARQQPPQRDPYHQY

SEQ ID NO: 960849 - protein, 103 aa, Homo sapiens
KRDVHRSSLVVNAELRVTVAAVCATRRKLCECRAGELAVLLGNLKRGVGAKTLLLPDPFLFWPCLEVNKAKSTCSCPDLQPNGQDLGREQPGFALSSERMNLE

SEQ ID NO: 960850 - protein, 384 aa, Homo sapiens
MRRAVSARGGGWGGEKGGGRGLKRVKAGSPRRGEGLQLITPQETCGGVCRKLYKWDTSNREGVTRRKGVGVSERGEISERTLREESVVGSQRGISESALGPPTGGRGVYRGVGGHEGSSALVKKRGTVSPEEGRGGVSQPYINPENTLNEGLTREGANRGGELTRGGGGHKRVSTGGCTAPEKSPRGRVHTGTRGLRGHRGVQNEGGAGGGIPPPRKDAAHTPAVGVNKRRGGGELPHYAAGAKTLAPTRRVVRANTRRAPQERGGGAPQQRTSYKPLKGGGAATNRGGGEAPQRGGLPRTQTMLKQGLSPPTTKGGRKTRQERRRLPQQTRAGLHPSVTQAGGIPRGGGGESINTPPLCRGTGWATTAAGGEHTHKEGAFTTQ

SEQ ID NO: 960851 - protein, 216 aa, Homo sapiens
KDSGSVLTRPWLRLRPPALPLSHSVLPARAGRHLGQVFHFLRTSPRLRRGPRRWAWIFGGPWRLARGRRADGCAGGACAGADMAEWSWTYRMVELSPVGSEEPRCLSPGRRALARGPTAGRVAGSWYCEPRAEAQGGRLGQSVKWKEQARIGWKAGTDEARLHTVMNSERGGQRRVLQRELENVKARWPIGQVPRENGAMKKQSRKVIGHEKAFME

SEQ ID NO: 960852 - protein, 77 aa, Homo sapiens
MSVHHGSQKAGYENTGGTNERTHTTKETQTGAAKKERDDKKEEEPDAQTTVENERQKHHESPPKIQKTEKKGKPGKP

SEQ ID NO: 960853 - protein, 69 aa, Homo sapiens
RAILGSGGPPLGPPRGWLAGGRALWCHLALGQFPGGGLGAPYNLMSRRIYWGGFLQIWAKLLEQTKNMF

SEQ ID NO: 960854 - protein, 40 aa, Homo sapiens
PGAGSCGPVGTVGPFKSGAATGARPVSRGPSESLVFLARL

SEQ ID NO: 960855 - protein, 104 aa, Homo sapiens
NKERIRQVRGWVGATLALCTSAAPPSRILLARDRQNCGTGNAGIPARRSWVSFLEPNVGAYPGAIGLAKNGLVVFIGVRGGGNLETGPLPTPVEGPLGLVFFPF

SEQ ID NO: 960856 - protein, 216 aa, Homo sapiens
CGGCAAAKEAAAVAEEEEWRQRRRGPVRGWLEVPLGLQTPPTTSTSGPGGGRAPLSLPGGGRPRLLQQRTEEGQTKSTKAGGHAESPELGCESRETCGAGQVGIRCLLLPSACRVSSSSSTDLISPELRHLRDDDSHQEQGPERSRGGETTDNPEGGTQEESDEQKRMPGYTSTGEKTPTHHPLVVNAKEKCEDTQETAGKARREDKAESKKRAEK

SEQ ID NO: 960857 - protein, 127 aa, Homo sapiens
KKVCGPPNFNPRAPRGTPGVGPLGGPLSLCVFFFLSLEEPGGVGGRAPPLSYKKCGRNRPLPPPLVCGGHTHGGGAVCRPSLSLSHYSSLCVCVTPHTHSLSVWGCSLSSLAALSRDESLHNYISLS

SEQ ID NO: 960858 - protein, 54 aa, Homo sapiens
MWDRRSLAFYSDSFGGDGPGRTRGQGPQNRKLQKGGLGWVGGVGDGVGVCWCVR

SEQ ID NO: 960859 - protein, 150 aa, Homo sapiens
MYKVGSVIRECGFILLRCSLGFSISDEQTLRLFQDEELWTGEGSREWFELICKALFDTTNQLFTRFSDNNLLYCSQPIAPSSGLNVEFAGRLVGKCLYESSLGGAYKQLVRDSLQPLFPGQIIGLRMHYKYFETDDQNSTNLQLFILNND

SEQ ID NO: 960860 - protein, 239 aa, Homo sapiens
MGGSSFYPTIKWPPPVVGDLSHIKGTYSGGPQEGEYRSSLVSYIIRRRRLSPSIGGGGSLHERVCVCGLLKRGPPQIFSTLGGGEPPIFHERHHFKCRAAPYPLYRSCFPPPQWCGFRVSPPSGERRAVSHFRSALMVVETTHPRGVCRHNISNPPVNIEAIFPSVLRPTTFSCVFLPPPVSPRLLVVVSHQYQPWFLAARNKTLLPDKNRVRGLNFWGVAGEPSVVITYSCSGFNSCL

SEQ ID NO: 960861 - protein, 221 aa, Homo sapiens
ALREPALTSDSVALCLIEIATVAVDNTPSFPHARALDAHPKTPTHCRHTSEYHDTAQHIHAGAKQRRNKTQIAKEPEPILSHTHTPQTTHTPNTTNTITHSTLTPTAPSSLTPRTHTTTPPPKQTPPHTSQRTPDALRPRPPRHHNNNTRHDHTTRPHHRAPHTPPTSLCYTPTAASYTHATSHASTRIHKPTAPPHTHHRTTPDKTRQPPTPPNELQSSH

SEQ ID NO: 960862 - protein, 106 aa, Homo sapiens
MTQDTAAQGAFVKQENAEDDGKNGSGWRKTGMSSGQSQRPRRDKTAAKKNDKEAKQERAQTPDIERPPQGSRKNITHKMANSDTHQESDLENSGWSYEPWNKEGKA

SEQ ID NO: 960863 - protein, 275 aa, Homo sapiens
ARSRLVLIGRGERDSCIPELDAYRPVGLALDYEDVSELTASQREAAERAMRQRDLGELAGAWAACAVGSCMTVDEEDDGAALPAYAASLGGAGHWRTARRTMEMIESIENLEDLKRPLCARVVGALAGPRLDDPPTCFKNFLRTHVDKSLATTSSRSASATCAKMNRESLVVNYEDLAAREHCAGLLPALRHRRSCCEIFDEACPGGGTGHVPQYDRSQPHHVRSPPALVEELARWAVHLTSDRQWVCRCLGLPVSWRYWTGVAGLWANTGTFFR

SEQ ID NO: 960864 - protein, 103 aa, Homo sapiens
EHNKSGDGMRLAVDPSVASGGDLRRRAGGPGCLTLMCMPDPALLLLLLPFRLEPVCPHFCTGVLTTSAFVDRVLMRRSWWMCLVAWQLLFANFNQDNTVPSCW

SEQ ID NO: 960865 - protein, 104 aa, Homo sapiens
RLKNAFIFKMVGLTTCKVLEPVWESTRVFRVKTWTKGSVKFRASGLWSPPLQQPQFYRAFLQRVFVVTVVGESRLGIPSVVVTQNKAPNLWRKERGYPHVLSCI

SEQ ID NO: 960866 - protein, 167 aa, Homo sapiens
MSFMLIFGMEGECLPRGTGDVQHRRCPRNVVCLGLITKPGSNCSPAPVRVLYRIALVCQANGMEQELAVEADIDDGPLLPAAVCVGAMSAMKRLQTIQCPVYQACGACVVEIAKNIILEEVVKDCYHYMTKGMHKMGLNTYPPKLLAAYNDRIQKTHEDKRHHIHSI

SEQ ID NO: 960867 - protein, 231 aa, Homo sapiens
MPWALRGRLRLRGHQPIRPVIMTTNRTPSEVLKAAENKKKEAGGGGVWGPMGPKSAASGRGPDTTPTRQAKQLRKESQKDRKNPLTPSVGVVDKQQRRRSRPWRFRQKEEDAVEEDLINNFRVQGHTSMIRRQKGDHLVNEHSRSHIDRTRVQAANNNKIDRLWHRTSITATRQVWQQGRRGPEHVAKGPRTWHTNHEGNSGTCTALEALTHIPTTHRGLRHRHTSSAKTH

SEQ ID NO: 960868 - protein, 496 aa, Homo sapiens
SPPPFFPLGGPGTPFSRGGACLPSPLVMCSPLVGTPPHIRVCVAPLFPIFYKLRACSPRAGRGVCGKESPSSQKRDETSPLCVCRLCLSLSLSRERVSPCVGAPRDTPPALWWSLSLERERVSLSLSLIYLSLARERASLATRVALCASLMMGENTHSLSQARWRERYHSSRCVSLPLSLHDECAALSLSRESRSRDGVCEMFSLPRARARENTRAVSLYISARVVSPHPRAAVCLSLDKYVARRAHETREKHRLLWRRERSLSYRESACVERTHRGGLPPQRTGDNKKLSRGEPAVENTPCGSRNHNTRTLVQATQKRERRHPPWCFPPKRNIYNSRRGGKNKCQHTTRRGGERPLHNTTPQIKMCGPRTYEEEKSPHPSINEGEEEPTNFGSSKREERKTLCSSPFKKQTQQGAAHAGRSWLGTCGGASLRVWGAPPTTNIVGGPPRTVFTHTRALRRTIVWWLFACCPPSSCLCCWRHSCSKKRSRTLWGARP

SEQ ID NO: 960869 - protein, 280 aa, Homo sapiens
RLGRGRVLEDSCLLELQAPCAPWTTFSFAPSSAAVPATASAWTVACGAPSRKAPCHGAPHGLPAPIPALPLKLHPHWVPPQLPAAATGWRAGRPGWDPASPSCGGGSPGEGAASRSRRNAEPRHEQVSDSTGAHQAPPGAAAIHHHGIPNKQKQEDTGPDKQTQGINEHPEDNARHTGEANYQKSKTEKGKQKKNIQADTETLHMKTEALRNQNKTQDKTHTQNKRRQEIARTTQRKRRTSAQTRKNRTPARAMDMTKTEKQQEKAKRDRNKKQKQKHKQ

SEQ ID NO: 960870 - protein, 133 aa, Homo sapiens
MSRHSRLQSAGSEPVPRSCLLRRCAVGECLCAALMCVAGILAVCHGWFPCACHLPGAFGPVGLVVPWGNPWGFGPFWPWPKVSMWGQRGVYKPARCIVRFKAPSRETAIGTLRLVRALGVVAVAALLRSFCGT

SEQ ID NO: 960871 - protein, 280 aa, Homo sapiens
WGGEAVMLRGELGLHEGDVVEAEQAESVENWYEGMLDRPGRGFFPLSYVDGCVVPPALRGDSRACPRSRPRPSTLAVVLTSGVLAFHGCAHACEVLVSGRPAGATWAPALEVLPEQDPTLVVGGLIWVGGDACLHYARDSQRVTASHSATPWRQAVLPRIPQASRPQAWPTAGVQPHRGALRKHVMFLWGQDPNSVLTPTGGPGHCLTLESRRHITRIGIEGPPMRGGSEHRSLGIKITSQTGSRVNGAKDQKSRPKGTPAVKQALRTPSQTGQRAHRHP

SEQ ID NO: 960872 - protein, 247 aa, Homo sapiens
TPVQRGGPCVWPPFVCALVLGNRRVWAFIPPQGPRGGQKGGRTLIHPPVGFAPKPRGFVWDAGAPKDVFSTRPKVGGESGRTACGWEGNPHRTTCGPDAQGRAGAVGENISPRSGRPIWGGLCGVPQPPHRRRMLGAGEKTPCVCVWRPLCGRVVWPPCGTGVWGPDPQRAGEKLGRPPFSHPRGAPAVSRKTALRAPKKTEVGGPLRGENGGGATFITNGRGQPRTLGGGNLVAPPPRSFQNRQKK

SEQ ID NO: 960873 - protein, 139 aa, Homo sapiens
MPTQLIIPRNTGLCGTLQTSPINVPRENIDVKQSGFGDSHPCGCGWLGGKLEGFMRTKLEPLLLTRAPYIPKHVKLVVTPQNKEKHQYRGKPSQTHNILCTQTHCVSPELGRASQPVVWPQLWTERQKGGCSKSYTVAL

SEQ ID NO: 960874 - protein, 214 aa, Homo sapiens
MLLAWRPACACEYLYRKAREEAQRSAQESEGAAAALRWKKTCLIPTELRREALALQGSLEFDRLLEVKCVTSHVDDEYLMGRSLIDPNGYDHYLPETPVTRLKMFANVSWMLVFPVSRMRMNLRSTLNVGGTSCQSLAKANGLNRSCLVVSQSIGATPCGAHRQAPCPLVLLPTFTLCRVVLRLASQTGPHVGGQPTLPHGSLRLAGGLCSRPF

SEQ ID NO: 960875 - protein, 199 aa, Homo sapiens
PVDPAPEAAGGATCQSHALCPHSSALGWLMGLGAVEQGAALGEAQAAQEPTEFGEAQAWRAAGPEPCPVGRQLRPCEKLSTAAAGPGAKSPSLLRRWGQLAAPSAGSAEPTPTRNSHWPASTVRSPGSRPCLSLHTFSTPPRKLSVSPAPPWPAEKGAPTVQRRAEVAPQSAAKVEAQAEEVLRVSEGCEGCQCAVTSH

SEQ ID NO: 960876 - protein, 121 aa, Homo sapiens
VRKILPSILMNRCMQIFFTSVSCQDILKYAPSREQCLGVALSHRLRCAGCHGPSHGSPVHVIDRSPDERLADVLAQAVCFLHAILLWTAWCLLRLSGPSQRRQPAVTGLINACSAHSPINC

SEQ ID NO: 960877 - protein, 104 aa, Homo sapiens
MDTSLSVESGTEAMSSFGAGKTKEVSSVWLLGHHPDMVTIATGQVAGTTKEGKPLPPHVRIWDTSVTLKWPDHLSEDGCDVRFLIAGDQVENYHLILDGESRPG

SEQ ID NO: 960878 - protein, 186 aa, Homo sapiens
MLLILGLLCQHTNHIPMMDARVTERERHTKATTHHLVQKGLRIRDNPEFITVRQLSWSSTGVFLSLLYRLADRRPQYPTQASAGDNMATPNQGSSHTDYKITHRKIPNITYNAPNTDKHIAYGHVNGKLTPHLTPMEDVHATHRSAHHRHNNDKPDKPQHTYTFLTDNRAHLIITQLTTKLRGTPP

SEQ ID NO: 960879 - protein, 99 aa, Homo sapiens
ASSSLVLIGRGREVYCVPSRPGARYWALFPPSSAPRSQVRLLQGSPVAPAPGRAGPTRWRFMENFQKVEKIGEGTSGVCTSQKQVDGRGWRLEIAYPPG

SEQ ID NO: 960880 - protein, 125 aa, Homo sapiens
WPPYVQHLPSDIICHALLDPDNGNNGWKLCLDFPDDLASDNEEIQGSRVTSHNLLLLICVLVFVVLDMPGLHGMCCQSGCCVCPCGIGFVLLLQLIPSGVDCWLSNHIEHLCYHDLLTLQDKKPR

SEQ ID NO: 960881 - protein, 161 aa, Homo sapiens
NVNKQPLLLTQQPVKVVFYTDTRDTQEFETSLGSNTEGKKKPSFLGKVHGRPRSKAGPVMSPGCPANGWLRLACCMRSAAVTSLEEPRELCVLLCCEGDSEVTQWLGVSLAMDQAVLWGTWDRSNPWCETSRRTLSWDVAAAAYCGHAAYSTRRYLGKPGA

SEQ ID NO: 960882 - protein, 216 aa, Homo sapiens
WSRYEAGLIGRGCRRLVWAVGCGLRPRCLPALHGCVALRLPWCSATLRRGVHGITRPWCCRDRLRSDEGVVGPGGACWPVPLLAAYLHIPPPQLSPALSLMEVFSAMFITYKGLRIFYQDSVGVGWKSRDIIGFYTVYPTSSYDWYKIMGSVLTYEVLHRGRLPLIYYEGYGLTVEQSLRASSQLFPSKFLKTSGQAIRLESAIFAGISEAPGTGR

SEQ ID NO: 960883 - protein, 241 aa, Homo sapiens
KPCVASLTHRRDAHGRQVDLDTSNYFLKIIQTIWMIIRICLHGVEQTSVGSKQSAADSAVPFAGSAVVLMGKNTMMRKAQSEGSLEETNPVSGETAASYPGECGLSGSPKEDLTEIHGTCLLANEGASMLAGVLVPLPHVKSLCQHQEHWSRAREDLLFSRLEVITTKTRPGSTIEILSDVQLIETGDKVGASEARLLNMLKSPPSPWAVIQQVFNNGSFYTLEVVDITEATLVLAYGGVR

SEQ ID NO: 960884 - protein, 234 aa, Homo sapiens
AAWPFPVSPRGRQLPDDGCWRRTCPELSECLAASSAGLRAATQSYELRAAPLPMWMGMTSLKVDNLTYLHPPDTLRRVFEKYGRVGDVYIPRDRYTKESLRLRLLFAIHDNAATLSDCYGCHVTGCLCWTVPAMLRVQMCAATAAPPVNHTTCLPVWTCHTLQVRVGRLCYWTAWMPACASGWLSACEVESRHFAQPFPLSRSRSRYSRSKVSGPGTSFSISVDLHVQIRTTVQ

SEQ ID NO: 960885 - protein, 144 aa, Homo sapiens
MLVGARLPLNAEVDQVMRSHAVNKSKPLTCVSSSSRELSEENGLASHVSQNPAAPVQLNDYAVRIMYIDYASARMSSAVTADGASAKPVFTELIVRVQAVSLDLNNVCDKRDLEGSYSASGLVLHGRQQKCDCSPDMTLEITDV

SEQ ID NO: 960886 - protein, 67 aa, Homo sapiens
TFGYVRGPVVHDVDMPDIRLRHVCVLQQPVTRLTVQKIFSRQTLPENVRAAKAGEKTISVVLQLEKE

SEQ ID NO: 960887 - protein, 243 aa, Homo sapiens
TPVAEPPSTEPTQPDGPTTLGPLDLLPSEELLTDTSNSSSSTWGGRLGCPASRPLRPPPHHALSSMWALSGSSRLLFSDRRPFLQGFLQQCKCTDVTLSPWTWGLRVPPSAWLLTYSHPPSSNATVAPGSASWWCDDYSTLFRRVPQAWRRVWCDSEVLAQWHPLPGLLLQLPTVIGFLVSGPDHGAGRVSSEIRYRCCRGACEVAHWERLVRRLWDYVPLLEREFPRLGRGPGGGASSRAGS

SEQ ID NO: 960888 - protein, 253 aa, Homo sapiens
MSCWDRAQRNPLADVGRGGPGPGLLCAQTSGECCERLLVPAANEPWQCCTSGAMCLPLPPGVESCPSPPVAVGPGVLACFLPCPVLACSCISVRGELVWSMCVLCPACLDMPCSAVSLMPPDCVFTVPSPCSCWKADCWVQSCSGPSMEKFWDEFLVGVPDAKKDLLETIETQKKQLLQYQAQAKDVVRAYKSLLKEKEALEASIQGAVGIPRGQMWARRLSSFQDHLTDSVDDGCPLKRGLTGTHNWIWAVT

SEQ ID NO: 960889 - protein, 225 aa, Homo sapiens
KPNTQILFMHKYTSQPNNRSDLKPHNSRGQLVPVYFDSEGGKWCQGAGLTGLRHKKLPNKDASVAKETRGRDGLKRWKRMGREHFEGKAGGSLRERGAWPSNSVCAGVTMPECSPGPPVWFQTWAVPPEGRSLHRKEGVMWECTPGPGTLCMKRRPMFGSWLLHSTLHTMGPRVCPHRWGVLHRCPARTRLPDVRSETPYSSWASEVLACPLTIFGPMPLLQESP

SEQ ID NO: 960890 - protein, 83 aa, Homo sapiens
LSSRQHPRPDGRLFLVLCPGERSTPCLILPEDGALVADVYHVDPRCPSSFACLLSACGTHAVSVPPFMLAHLWCQAMLASEPL

SEQ ID NO: 960891 - protein, 156 aa, Homo sapiens
MQGWRVYHGGCSQLVYPELDSETAMYSCTTMDIGGEEVCLVTVPNILPDNHTKDQKAYKEGKATERLSAQNAFLGYWTAKMDPTASTLITRAWQQHWHGQNPNMDGHASIAPRTQRTPGLNSTAAGTQDGGWHRLHRRRQPDLLTTLQERPTGPNR

SEQ ID NO: 960892 - protein, 252 aa, Homo sapiens
VGTLIITSPEEVKYTCPIATQQARWPVQDVILVGLTAGAPTLTFQVCCDVGVMEQMVMDYWNAVMPHGTGMCVLGEIMWCAWCVPWTLNMGVSPVPCVPGRKCDAEIDMCCDVLQVCACFGCMLVMGCGVSCVEMCVSLMRCVLYTPWEPVVLLWGACSVCLLNALCMTKNICGVVHSEQVSQQRGTEVTMCVVSPKSQQGGQDAWISTHVCAPVYVSTGGRTPGLNVGLAMFGTMGQQHKMPGWVNQHRKL

SEQ ID NO: 960893 - protein, 74 aa, Homo sapiens
YKHKIRDPGASGQTSPSGEHVQERPEDLNLPNAEITRIIKEALPVTGVNISKGGPGAAISLLPPAVFVLYATSM

SEQ ID NO: 960894 - protein, 57 aa, Homo sapiens
MYGCDVWAGLWRLLRGHNQYAYDGKDYIALNEDLSSWTLADTAAQITQRKWEAAREA

SEQ ID NO: 960895 - protein, 272 aa, Homo sapiens
QQGDQEGVSTRKSVSELEKAMGGPLSYVFHLIFWEGRVVQAKLEEIPETYKGRSYKQQTLSHFYFTTETHFNTDGTRRDKRPTHTTKHTTKPTRQNRPDDTKTNQRQNTKPKEKPQERSNQAKASRQNKRQHRQRQYNEKQQGPRSQRPKDRAERAKSQAREEQQTKQQEQSKPNIRKKLKARDPQPRREEKQNRTKPRQKKRKARKKREEDARESEVQQEPEIGKMVKAGCQAEQWQGQGKKQSEPRGEGTKKQSPKKEQQGRAEEQTKVR

SEQ ID NO: 960896 - protein, 66 aa, Homo sapiens
MAEQIIRGDLQPDPGAKEKILDKPSTGGRTRGDIANIRMPQIWPSYYRGGQRASRKAYGQALAKLG

SEQ ID NO: 960897 - protein, 231 aa, Homo sapiens
YLSKVPLEAPGWVPASERPAGCHGCVKQHEEQVGPCAPASCTLCGPWLVAGAPGWAGWDAQEVRSDLTTTMLSKQVLVPGCELAKCWSASIWRTGQKCALKLLYDMPQWPWQDGRPSLAGFWLAPILSCILDVYENMHHGKLLLLIIMECMEGGELFSSDSGAVADQAFTEREAAEIMRGYWHCHPVSCTAITLPTEMSRPENLLYTSNGRKTQCLSSPILALLKENTQIA

SEQ ID NO: 960898 - protein, 33 aa, Homo sapiens
EQRNNTVNHLEQKPEVDDTQETTEAPNDSHETL

SEQ ID NO: 960899 - protein, 398 aa, Homo sapiens
MPYSYALVSWPTWVGTRKVDNLGYNCLFANALVVLIYPSSPIAISTRGVCRQSSVVIICFWGFPWGLAAKMQPAKLCYVFPESVILTPNGCNPCTSCYGRFCVVFMVMLSRGLLKPTRVDIANGNYPSRYLPFSVVSTGFGSPLLLNGPKTRPRRVRKRCFMCGYNAKLGASAGGCQPLGDMKAVSNPLALMNILGPLWGRFRPRKSTRHRNQRLTSRAWRNLCSRSESALRPLPWPPPCHAPVPIFHRASLHRAARATEEETVSAPVTFALRHLGGSGGTVWKGGTTATPAAEGGGFWNMKGDFGIHEYGTGVSMHSRGTLGVPEERDIQELRGTTGFLSTRGRGGQSNLREEMMTWRPSPYKGHGPDSEGAERGDRPNPRQSNLPRRLAIMPRYKS

SEQ ID NO: 960900 - protein, 330 aa, Homo sapiens
YQEFLPGARTPKTEEDGRGGSEEILVPAPRRWLCADAVVCEAGSVVLLCWGPGPARCSGTTAEACRDASADVLGALACGLLPASCNCCVYLLGAVLLCCALLSLLVLPHAMVLPICCDVLLACDVLSVGPYLACLAACATLATAESCSLPLQDGLLWLAVGRGRLRYCQPWGSALLGVLRLPFDGPGQPLPGAVCRLPAAPLDLTSPGLGPGLWASWVAGWVLGAWMRDCDINDDEFLHLPGHLRVVGPQQLHSETNERLFDEKYTCLSCSPTIRWDQALWEEQVLQKADEGRLARSHATLLVQAEALDETLSPPSPGTACWVVRTELPP

SEQ ID NO: 960901 - protein, 73 aa, Homo sapiens
LSRREQPPTEPGPQSASECGEDRSEIGVWCALSQGSLSDGGPSEVGAGHVTLCVVHVHALPAIPLCDASGVPD

SEQ ID NO: 960902 - protein, 104 aa, Homo sapiens
MANTLLMDRHLVGSELQRIYVSCTYDVSVMSLANNNARPGPLRVKKPGPAGRRISLEPLLCLCRPSVSPEVPSERLFNVPWPGVALLLRLVVPHSYRPAGAGGA

SEQ ID NO: 960903 - protein, 176 aa, Homo sapiens
VFFGDGEFGRVSFGVVCWCLGPGPAGSVLLVLWLAELRWCSAELACTRAVGTANAVLGRDALAMLCRVDLQANELACGDARHPCKLVGERPDSQGCTPGAVWSMYDNLRGLEEMEDTAAGPWRRSKPCPEGHLLRLFLLLLYLDDLAYEATLGPTSACHALTMHILGLKRYTQMAY

SEQ ID NO: 960904 - protein, 109 aa, Homo sapiens
WPQMLQPVVWTVPFNIMTVIKRMMWHETLIPTRIGLAAQEERVRKVCDLYPISSPKDSNFMLVTWSGSLEGSHTQHVSKELLDLSMQNVAGFVKSRFTGGRGKKLNIGV

SEQ ID NO: 960905 - protein, 107 aa, Homo sapiens
WEPRGGPITTVREKGARVRAAARNPIGSSSQHEVPERNREMSERENINGGECDQTRRDDPVTEKTNTSREQLQKSLAEPFYEKVRRSCLLNARSLDGSQVICRKCFG

SEQ ID NO: 960906 - protein, 65 aa, Homo sapiens
MLLEIDNSELRHMLESPESLRSKVDEAVSVLQAHQAKEAAQKQVNSATRCSILFIILTQGPWHDT

SEQ ID NO: 960907 - protein, 132 aa, Homo sapiens
MVKVGSCGVLCNCGLVRAIGACAYVVGCLLAMCVESMGPCVIVASWGFRVGCMSRLALLNGGCRYNGDGDHYGSMCVFDASYGTYGLDYLLDCKSSRTLRLRGSQSSSLLHLLEPSQISRLSQASLTLMGQD

SEQ ID NO: 960908 - protein, 140 aa, Homo sapiens
VFLCFFCLFIWAFLLSVSYFVFVLCLSFGVFDLPLFSCPSCICVFSIFSLLCPLSMLYADLRLLAVYWVPFPRLHFFMPWLCPSHQSVVVQQYRALTVPVLTQQVFDAKYLMAACDPRHGRYLSVAAVFRGRMSMKVGRM

SEQ ID NO: 960909 - protein, 127 aa, Homo sapiens
MQPKTLTPTQEDSNRTEHQTRHPLTHKRTNTQGNIQVKTRNMNIQNLKIIIKRQKRTKKHKQRQITEWTYTIKTKTGASQRIYGEEGIPKHIKQQHEIQRQSPHMHKTTRREKKVIIVRNRNIIHIE

SEQ ID NO: 960910 - protein, 146 aa, Homo sapiens
PLCDVCAVAQCPGSSTLLQQWAKPWAPVTPVELALLRPLVPQTTPCDRPVGVASDEFFLEQTNEEMWVKLCHARLHTKPVPVLPCRGGGACLSFLNPSFEDHQTLLSSGPRGGEQRQKECGEAERSWPCPPRSMRTRSPLRTVEGV

SEQ ID NO: 960911 - protein, 209 aa, Homo sapiens
MPPVEELDVMFSELVDELDLTDKHREAMFALPAEKKWQIYCSKKKDQEENNGSYNLCALQFYIDSAQFHGMPRHNSSDCALAARKKTAQTALQTTRAALKTRTRGQTPMRYIVTRFIDLDGLSCILNFLKTMDYETSELSNTYFSHWLYTHAFLNNSHRPRLTSWLILQSINCTLLSSLSTEQHLLRSVAVLDILGAAVPGSRGATRTV

SEQ ID NO: 960912 - protein, 192 aa, Homo sapiens
EEEGGSCCARTPFKQNSEREFLQQLTDQAPEKEVLPKMMLRTVQGVNAYLINTSKCTITHGNYNGTMLQELNIDMARIVHRKAGNFYVPAEPKFGVLSSESEVSTGCDAQRFERCCKLLLPSHKSSTGTFVEAQQWLRLTLLDGLVSSHIICMGVPQSEGQVYIELNLTSVALCANTQITGSRNLLRQRLTA

SEQ ID NO: 960913 - protein, 138 aa, Homo sapiens
MLPETLSWDVLRAFSGMRPEARLETSGKLGRRSCAMTAVLHTAPAFDMDNISEAKAQCTWVTFLAETMYVPGLGELRQNVAEKFPKQRGSGTLLDPAQRNLYRDVMLENSRNLGIHRLVQLHVKPKRQTLSGYISKRT

SEQ ID NO: 960914 - protein, 71 aa, Homo sapiens
MTTCPDWIIPRSSFGGLSGHPVGSPSGALGGSRGLKSEMGGVHKRHPRKIHIYDPEKKMVEINSCVVPKGG

SEQ ID NO: 960915 - protein, 200 aa, Homo sapiens
MCQWMMQLHVIYGELTCLSTSSEAMEWRAMNNILRARCDHLIKRTSSSSSVLDELSISTWNLAGQKLTVPLATTLTVARTTNQGLRPDENLNRMTPMEPPMGKVLGIVDPDNWTPACGNHAAGNKSHPSCQETLSWLEPGEAEGRYPWSGSLHKRPWMTTMNLRWNRYTSVPLGEIRTILSQVTLCEQGEQAEPTPGRYS

SEQ ID NO: 960916 - protein, 118 aa, Homo sapiens
LSAEPCMYPAVLGSEDVTPRPCARQSPGCLCCPVPMVLVSVQPSLAGSVLLLPVLPASVSPFGKAFDWCVCWTGFCWTEPCGSDCLRCVYLAMHPRPLNVDVACDLGSSGGSLKCAPK

SEQ ID NO: 960917 - protein, 203 aa, Homo sapiens
MNLFASRDGSMEIQKAIELFSVGQGPAKTMECWLASECYQFWDTQPVPKLGEVVNTHVPLEPDKDNIRQEPYTLPQGFTGDAWDLGDRGVLKELYTLLIETFMWKMMHTLSRLDYPPEFFGGLSGHPAGPPSGPVGSTWSQVGNGWRFISAYPRNIHFYAQRAHGESLPCCPRVASRGLPICPKSRGPGGSQRTAGVTAVPVV

SEQ ID NO: 960918 - protein, 100 aa, Homo sapiens
AAAAIMSGNRALAVPGQCRQPNLAPSFGDGDQLMSTGICPHVAPTTGTADLQLEQHQTVYYNECHLCCAMYCAPAACASVDSWSPGTSETPVLLCLGAHY

SEQ ID NO: 960919 - protein, 104 aa, Homo sapiens
MGQVHETGEGGAGPGLGRYSRTQSLSIVKNYCMYGPPQIAPTAMLGWLGIGPLPPQSDSCLRGKKKIAKRSKIKSLVKVYNYNHLMPTRYSWGLPPLGTKRGRQ

SEQ ID NO: 960920 - protein, 265 aa, Homo sapiens
LLGSEAGLLCRLRQPRRSLLLHCPGSEQLMATWACALPASARDAGFCALQMGSVALDCGSDAVAHVTGAVLACPVAARTNKFEQGSPVNPDGKIMVRRCLVTLDPFGFFVLGIGFFTLCFLMTSLCECQFSVPWLPGGTLPFTILHMNVMWGPLSPCWLSCAMMSDLLELMVNAHGLHLCHVLENMHVMLHLGLLADLHFPCRHVMPPGAVPHGSGSSAICPELSPDIAVKCGPDPCATVCSCTRRCQKCWWDQLLRHPVTQVPD

SEQ ID NO: 960921 - protein, 66 aa, Homo sapiens
MTARDKAALVENTLDTLERRSGDEKTRTLPIGGPDPDPVHQHKDRWGSPVENPVSVTGPLCAPQIG

SEQ ID NO: 960922 - protein, 113 aa, Homo sapiens
SKLLDLYPSVTTHAGLCPVNACCSCVPACMSVLCVVDVCMCMCAVSLHCLMGEPPAVSLCPDAWTMMPLLHETPCCPATVPMCMGHTPPGTGGEGVCRERIERQRGGKGATDL

SEQ ID NO: 960923 - protein, 287 aa, Homo sapiens
RSRYEAGWRGVGSAHQPPARPRPPLHQPRGPRQGPGRPDSDPAAAVTSAPPGAPHPPRKQRGPYHTPPQAGGPPLRRGKSRALGPGLSRAQCPGWCPKWLGKMPGRAEARWPARALKYAWQAYPEAACYRARLVEPRCGCRQHHPPLPPSEHHQGPPGPGGPGGRSEEKISDLGRGLRAHICLFLREAWHHAKVFTTDECSDCKGSGKLYLVWISRRDECQADVFATIMEKPRENVVDRPKGDREFASLVKGLRSTELLGWNMGPEGRDWVDTPIERYTSIRVRLSA

SEQ ID NO: 960924 - protein, 245 aa, Homo sapiens
PNSPRLLLLDALSIAPSFASFLPSFFLPPLCSLPSLSSVCPPGARLSLCAPAPWPCSPAHQISSPCSFHRYHALACQPVCRHLPAVDATDATEPQDALNATRPLDPSIHKHASKAQQGSTSTQTGDSPRDKHTGENTETREDRGVQQAGATQNQITRTERPAQRNSDTLVFFGRTVMKCHPRDTAVAHHDNGAGAQKDQEPKVESNGRPRTIRERPRTYRETGEGTEDTCEPLELEDRAGPKHNQ

SEQ ID NO: 960925 - protein, 63 aa, Homo sapiens
MGVSGTYWPQLCLWLDTNSLAVVRSQLIIAWSRKQAFGQGPLIVGILLVLMAVVYASLNIKGA

SEQ ID NO: 960926 - protein, 282 aa, Homo sapiens
LSRAPRGSLAGRRFLVTPACLCPVLAAQCFSAALPVLLDGKNGLVPVPVPVPIWNPNVCCLLTLLQWLMIDAAVTAAVPVWCCPLPLARACHVMKGPELCYWCFHLHCGRMGKFGARYILCWCEPCARLCRECAVACLAVGDLGLVDVVELAKTWRMDDPPAGGDACILRLHSTAVRLAWLVTPETDRASCMKARLSRSDEELLAAPSEELPGQAEPAGRLPDVHGWLGNGKMSLAEADKSHRSSASFGLALYHEEGPVGMVQLHRTVKPAVTGSDKTGEIG

SEQ ID NO: 960927 - protein, 84 aa, Homo sapiens
PPNWVEHDPVMDVAGGVLACDRVIHVFTILAPGMTPQFPSVMIGGDAGVPLCDDACSYHANACVAYCGLPTMLCLHACCCGNCA

SEQ ID NO: 960928 - protein, 108 aa, Homo sapiens
ASCHAPCADASPHDVPLAEEMRCSCPVEDWHVSWVALLCGTPSVNVFLSSTLFCWPCLIAVCFFVRYLCACMLMRALCVTVAADWARSLSGDQQVCDEKTLCSATIAN

SEQ ID NO: 960929 - protein, 134 aa, Homo sapiens
AGFDRPRLSLGWCAPLPVATLSGHAQCLHGSCPLRVHVLLRCVLCCLLCCCCCLPRALSPTLAPAPAVSLMLLASCPPDLLALPACLPGAACDCAAGGADVMVLGTSDVLACAAMQWRSCAENSNEDKCTPSRL

SEQ ID NO: 960930 - protein, 113 aa, Homo sapiens
EERAAKVPSTPPPKDSSTTPLPSLRTRRTWTAAARHLRSPIHARGGHCREARGPRMGRSEEDGGTKRRTEEAGSRTEEQPALAYHQRTTQHMHAAQTTQATAATKRAGSTTHG

SEQ ID NO: 960931 - protein, 70 aa, Homo sapiens
VLASSESWVLIRPMGVPPRPAGWLLRDRDAEFAWPVLPMCGHPETALRTVPVPAAARALAMAVPPCPSPR

SEQ ID NO: 960932 - protein, 151 aa, Homo sapiens
IGPVALVAQAGVQGCNLSSRHSVTSVCAQAILPPQPPKSLWDLQEHATMCPGIIFLYIFCVVEMWGFGACVCAQAVGSQVISSPAPSSLSQESVVWRQFTRVCVEPTETHRRVCASILLISLRHTSRAVWGTHSSVSLYPPFRVCAPQKEC

SEQ ID NO: 960933 - protein, 192 aa, Homo sapiens
MAERLAVGSLGCVSPVMEPGPTAAQRRCSLPAVAAAGAAAVVGAGPGRAPLLAAVLHMWSSTTSCLEHACLLDGWSDLSLSLLQLVDVAGASVCLPPVTLPGSWILSAWELLLDFCQQHAQMLDSGVLVAACARPVLPLSDLLTPSSNMVVSKMDNISLSRGEYFRESEFVARRSLNVQIELQIVCDSLRIF

SEQ ID NO: 960934 - protein, 70 aa, Homo sapiens
SMATQIYGEKDLAERGYQLVPEPPSRYYRLDQLQSRGRRGLGLLVKMWVVVAVCSGWLHNDMELYVAARG

SEQ ID NO: 960935 - protein, 161 aa, Homo sapiens
MPDLRFLVVPDLLALLLLAGDVPCAVLTSFCGGWFCVRDTLCTFVPGHCGDSSVGFRCLYSASARLPCGWLPGVLLTEETNRSPSEQAEGRATWTDRRSKHQLAEKPRPNLLRVHSEGELTHWPWEINGVSPRNSWEKLGLAHGRPNVRNSVGTKGPGHPS

SEQ ID NO: 960936 - protein, 220 aa, Homo sapiens
GSHPLTLGPKTEEKEPKNRKKKKAVRQISAQDSRRVEVDPLLPRREDSRKLQKAIELSLRGLRDLPKPVEEASRANAYQFWDYSSPSPSWAKLVNTHVAPLEPDKDNYPPGALHPAPGLSPWDACGLGDPWCANKKLYTLLIETYVEDDDNLSDWINPPEFLWGALRPPGWLPQWPCGVRVVSSRNMGGVHSAIPANIHIYDPEKTMVEINSCVVPQKLR

SEQ ID NO: 960937 - protein, 114 aa, Homo sapiens
GTRLRAWPYKPVRRQALWPSGSVTPPFPRPASVRRAWWAGASRPGMLPLGRCVTDAQIADHFWSCSCAAQQLRLPDGPHGGQLPGGWLAKCWGDDQQFPVSGPSLLGAIGAPER

SEQ ID NO: 960938 - protein, 191 aa, Homo sapiens
QGSSTPPPIAAHHPSLTPDSQPVDMSCKDPECLLPARWSALSECWWSEVGRRRRRSEEEEEERRRKMEDVSIHACYHHWPPALLQPAPSTAPSGGVHMAGDFVGLDDWASLPCVSQLPTLTRAHALEICQLDVDCTISGVLALIALLFKMEEANLESRANCHELIEATNQCHHRSHLKSGMSPLLSHTWYA

SEQ ID NO: 960939 - protein, 132 aa, Homo sapiens
EDMQLIWPLAQDIDDILVSLIAASGLLQPVSGPCPAGCPRSLCGMNSKTAGEVKASPGVAPRESATAIEKRSGGDTGKTREETYNFWKISEDWHWSGDGFLEEETSEQMPCNVDKLRIRAATFGEHTLVSGS

SEQ ID NO: 960940 - protein, 232 aa, Homo sapiens
WVLKKSETCEAKKRKAGAGGMGWGSGGPGSANLSSFVCKSGVCFVGGHFPVASGKFEFVEQRGERGVGWVPSRQVWVGGALLCGPFAVAQAVPVDKGNMWGFGPVRLWERPLEGDLSDAKRKKTCGCGGVRHSPGPCGKETGLWCVVEKYPLGPSLVGVNKTATTLFYHYYYHPENQKAVCVPQMFSHNLVFCGGRQVLLAGRGERNSLGTLGGGPQERQWPFTLYSLVEAA

SEQ ID NO: 960941 - protein, 153 aa, Homo sapiens
MALGCVSRICGMICYVHSQCVIWVHTWSSLSCCLLTAMSYGPPFQLGSSVGAQRLGVGDSYPMADNVCLPFTLVHLVKFYACVLPHLCPSQVVGIVVKPISCSCDFMSQTKFERLVSAMMVESDAFPCPLWCLPTLTGHWFLDPFPSSFLCAA

SEQ ID NO: 960942 - protein, 75 aa, Homo sapiens
MVVAEQPIVADSCGGRVGRRGHRGGPSPNSVCRGETHRVLCKRGVCGPPRKVSNSLSARGHFAPGRGLKNCPREG

SEQ ID NO: 960943 - protein, 239 aa, Homo sapiens
SRVGRGEECGLGTPAPLYCLVAAACGGDSVLLAEPSSGGPGVVAGQHRYSCMMRLLSLPDGAPLCMPVPCWHWSAYMMCGAANVVPACLLHTATGECHVTAVETLALVLEGDYRGLWLLATQMAYTHGCLIHQLEPVAAALSPFPPACHVTGAADVAFHLLPGPFLVSVGCTQRMCPASTHLACGLLKLHQESCMPNCELGSPDWRVQPCRLQRSSGVSYDSKPGVVDLDLHQGIMDAA

SEQ ID NO: 960944 - protein, 207 aa, Homo sapiens
LPFSWPTLARGTLDHSSMRALGCALEDSEGGSSGIRTLELRAALEACRKHYSRPVQWDWIAVACRGTAVSCSQTIIQGATPGLSVASGHHRSGCLSVFPGGLLVALLRGLHRSNYRLMITFAIFLSLIMLVEVAAVHLRGLCVQTKGDVRMFRYIITFRQQMENYPKNNQICFDLDRMQADFKCCGAANYSDGTNDPFHVNNRVPDS

SEQ ID NO: 960945 - protein, 116 aa, Homo sapiens
VLCRKRTGVLRLRCPAGVEVTMLRCRVEDAEFDSGPCGCYPCVLTLVLPGLVGAAKFPFNHVWCLHASKSPPPVPRAGYVVLETSPCLGLDDDPPPSTLLKDYQNCPCELRRLMMS

SEQ ID NO: 960946 - protein, 141 aa, Homo sapiens
MRGLLAASVGSFSETFFLRQYSGESQTNEYQWRGVPSGADITAVISQLFEASFLGPDVGDVSEELSGERDTANSSIEAYHITGRDRGQCTAGAEDDPLGGTPVVIGGYADGRELPRFMWNCCGVAYDAPSLGHGFLGHTWA

SEQ ID NO: 960947 - protein, 354 aa, Homo sapiens
VGTSLLACLCALCAVHGLQNDLIPNYQPKAMGPSPLQLAVPGYFPAGVDVQRLAWTARILHGGLIAQDPSDSVPESQWPTEQVLMSFLSGSSTAQYTDRRIGTVHAHIPTRVIIGIGTLSSAYMSREEALDRPRHNTDTLAVGSQRESPFPLTPWGINEPPRLEAQRLAPKPKADTFRWGHQCSTRGKCPTLYAFHRNGLAAMPLIGGGNRSLTYGRLERPRPLAKGSPEDPTKRRISISINHWSWLGRPFAEVHKPSLQKQARLNFVSRPPHEALYEHHSRSRRHAYCVTMFAPPPAIYDGGGAINPVGNPYLVTNGNYRWRKAFQSQILYGRPQLGPQSLGGGIEQHFWRET

SEQ ID NO: 960948 - protein, 306 aa, Homo sapiens
MRNRFSETWSLQARSYLNQDEEWWVQVGLLAVPLLAATCTSHPLSSPLPFTHGSLQAQFSLTRDCVSSTKTLCACGWNSRDSMCFYTVFQHPATTGTQIWEGLTLRFHRVMPLTPYRYAFSDKPRPHHYSILEQRQHSVISRFSAASGAPRNRQDTTFLSHDYGEIVAQEPTLQVQARHRSWSAYHKELSVCQMEVSFLRLTVHSFLPRAYFKHGRCASLPVLTRLFTSLWHSSRRSHPQSFGPVYLWPPEQLACWALYADRIRTTLLTFCFDALTSPPEPPPTPRVASPALPTSSLARLDPYPFA

SEQ ID NO: 960949 - protein, 204 aa, Homo sapiens
MTKAGKSPPQQTIYWRQESLSLPALSHEARDKAKRHVEPVGPATEHKRVYFQSPLSGSEPEGMLNAPCLLGEGAPPESVLSAGSADACMNVGGHMFSLGRSEGTEPKCLTSHQEARVPWSQGELQQLWLRPGDEIPQSLIEHRVVQQKLSRIPKAKGRQSIEVWKSKTNGDLDSLAVAQHKRAAAIMEAYKTQGTGEGARVRAD

SEQ ID NO: 960950 - protein, 47 aa, Homo sapiens
AGLAPEGVLSWLAAGTAAAHCYRSSARQRANVLAHFYGVKLDGQGAH

SEQ ID NO: 960951 - protein, 242 aa, Homo sapiens
PNSSFIIIKGAFLAKDTQIKESLWLRTQGREVARPVVPLSVGEKEASGQSVGKGAWEGLSGRGHKSSRVGNTCVGGVSVGVGPHVGTLACITLLVWVGGVSPIGACHRGRATLLGSRGRGPTQGDTRNQEKAQGCGLGATSRGCEGAQGRNRWGASVQVWPGYMAPRRLRGPEARFSRVYVCGERFSLLSVRLSVSQDATLLSVDLYGAPRGHVACDITSLSSQGALSHVGGLFCLPRQIRV

SEQ ID NO: 960952 - protein, 105 aa, Homo sapiens
MREPEGSAHRRDRVILGRLLACLPRAPALECRDPKVWREEEECRGRRKDAWSDDPSRVCMVGYSVITWGIAYVWILVDSNYIPLHCQYAPDTKRASKLLLEDVLG

SEQ ID NO: 960953 - protein, 315 aa, Homo sapiens
QDTMPSTCQEPLEYLQWMDDEGDLVAGYESLKKNEILHLKLPLRLSVKENKGLFPERDFKVAMEGFAGQGHILRSKACATYQIAGHQMAFQVVICKVWQVAEDSDVMERLSATMAVHEKEESLWPRVAVFSTLAPGVLHGAMAPQSAGRRSGRPGRPCTVSDVSESDELSSLQVLDADAFASAVLRAGWGFVRLPASVGTVGESQPGLGLVEREGVLTCWELGGRALVPMYGQAGSDGRLVFLTRGDLWHPVSSVQWPVSVPSPDRAAAVIGPSLRMGGPRVRRSARSCAPWVCRAQTGPNSTRGTLEEELVAVL

SEQ ID NO: 960954 - protein, 236 aa, Homo sapiens
CFHLSRERVFSEDRARFYGAEIVSALDYLDSDEERGCTGTSSWMNLMLDKDGHIKITDFGLCKEGIKDGATYEDLCGTELSTWPPRCVEDNDYGAVEWTGGGWAVVMYIDDVRSHCAFYNQDHEKLPELILCGRRIRFARALLWSRRGSEVLWRFQGLASRQDGPPDCHEALGWGLTRYRHWEIMRLRFFAWYRVARQRCTSKKLRPTLRSCQVTSRRTGQLGILIEGFTVPDDHH

SEQ ID NO: 960955 - protein, 283 aa, Homo sapiens
GVYTEKVLEATKLLSNTVMPRFTEQVEAAVEALSSDPAQPMDENEFIDASRLVYDGIRDIRKAVLMIRTPEELDDSATLRHEDSLMSASRTERPRSRDDDLADQLAIVPGRLMAHASPGAIEAKIADQVASFQEETSYAGLLNVSKWCTSSGYDIIVLAKQMCMIMHGRHDMTLPEAKWTTHYSTSDVISAAMKIAEAGSRMDKLGRTIAVPLPRTLACKRVTLSWPTLQAHRPLRCPRAVYFCLPGLGRCAESRRGSSCVSGVGLRLSLIRAARLYDAWCHR

SEQ ID NO: 960956 - protein, 147 aa, Homo sapiens
SQPRSPDPAAAKMWMPKKNRMAIIGNLLFKGGSLSGWPRKECLHMCLKHPGAWQNKKWCPTFSVFCKGQCELSLSESPERAQRVKRKRVCVPVERHIFLAWCHLITNVRGFLPRLLSRGEIITFYICCGTRGEKVCVSPWPTPIARA

SEQ ID NO: 960957 - protein, 130 aa, Homo sapiens
MVLFGIVVECLGTRWLGLMCLLSASLFWLAKAPVRLLGLHLSEATTCVDARFTKRLDTLQPQDTSWISGRLASTFSRVVVVVCLDISVLDPERRRRFAEEQSPGPRGWQQSAIAKAAVHSLISVKDYIPA

SEQ ID NO: 960958 - protein, 79 aa, Homo sapiens
CPRPSGTAGAEQVVRIASAVRVPPGVRRRGSRGRRAGISQTPRKRHRRCPDRGHEMQILGVIAQGDSFGDREKKKGKLD

SEQ ID NO: 960959 - protein, 178 aa, Homo sapiens
KGSCEADLGLWNYGELQNLAKKASKTIVCEKSTHWSGGRCLLASVMADKGYKKRGSTFQQSQKGTAWSMGPDVRLAVGQEQCYSILAANDDMVFMHVDEPGRRLGLASKSFHLRMIEGSVYSKSLDRDLYTTTGGETDFTKVTSLRRACYDKQACSHDSMILSRTMITFDRRRKVDGA

SEQ ID NO: 960960 - protein, 283 aa, Homo sapiens
ISCHRDIISIAEDEDLRIIFEESSKLEDHAAESAQPRRPGSEQLSRLKLKTQQRYSDSLWAYIIWSRRLSRPPPIKLYRETNEPVKTKTRTFNTSTGGSIHAINDTKRSQIYGSRSDNYMEKEETDRRYKGKNDPGKDSSMGYKRQRYSMKKTTNYTEETITMYRCIHMSEIQNWMNLGSSTRVQDALASIKVIIGTDREEEDNHMVTKIQTTRQTREQSRSINNKVGQWDDKREERRKDNDQGYNSGVKTTRGQKIGLNKQPCLEESREKRHNKETQMNNTN

SEQ ID NO: 960961 - protein, 31 aa, Homo sapiens
LPPQAVSGAAACLSGCGSVDCCSEISAELIR

SEQ ID NO: 960962 - protein, 238 aa, Homo sapiens
FPTTRCSLSTAAGSDWYCYYYSLVCGSERILARTEENNLRLGRRKRVNESEERELALVKRLKTSCFNKSFESTVGQWFRQHYTLIIFRAVPGKSGQSITFCGAASWLQIESIKYMGTETTCVAAVLNEYSHLQRTVIGNHADLSKGGDEYDNHCGEGSSVVPLVMISCIRHTLADNFNPVSEAAWRKSRIVSDLFETGYAAWPVHLRRSPTSVWVPLTCHVCIPGLLLTRVGGSYTSD

SEQ ID NO: 960963 - protein, 263 aa, Homo sapiens
MISVILCDNGGPLAPSVMGAIDAVRRSQKGSFLVRPFGGSCLRASLRNEGVRTWQSEDCVRALSVLTNASSNAASMHVLSPFQSAASSDGSCASPGGDAVEKEVEDGLMLQDLVSAKLISDYTVTEIPDTINDLQGSTKVLQAVQVAGFPLPPSLDLCCQTLIQYVEDGIGHEFSGRFFHDRRERRLGGLASQEPGAIIELCNSVLQFLASVVSSEQLCDLSWLSLSLLGGGPVVLTGWIAQAWLVNRGPVPFRWAPLGALCP

SEQ ID NO: 960964 - protein, 202 aa, Homo sapiens
QTIGFNGVIYFLGSCKIKTWGEANRKPREAQRRSPSEVQNLWCFCHVFPVGQGIPISPPVVLFLSVKRSSNRRASPGSEVCRGWDLREHSSGGLGQRQTAPPCVSPVQNGVGPKVLVEQTVGCGGSPRVCAEELSSRAHRSLCAGASNASQPWEEQPGLSHSLGCQHPAGATPMVPPNMLRGTGSGSKRVPPTGAGELVGRI

SEQ ID NO: 960965 - protein, 150 aa, Homo sapiens
VDCTCEARGGMWPWMAVLNELVSVEDLLNFEKKFHALRRQSGSVVHSSYANVWSYCLVPGRCEPSTMTDIRKGIVLLEELLPRVEQGGSAGLRLLPGPVRDTYLCSNGITQTGSYTVAAPDGALPSKSEHAPQTHSHGAKGTCDARSISY

SEQ ID NO: 960966 - protein, 75 aa, Homo sapiens
SRCLELYSSVLFLLVLLSSHYAQYLLARHCKQTYLASGVHRVLLDVLVLPGRNALSDARRNAVTACAPEFRTSDA

SEQ ID NO: 960967 - protein, 175 aa, Homo sapiens
MTRSSAANLQDAIADAEQRGEMALKDANEQSGMGWRMPCIKAKQDLARLLKEYQELMNVKLALDVEICHLTCKLLDVVRSAWLNGEGVGQVNISVVQSTCLHVAMAVCHVVSAAGLGLACEEAATPMCSGLGVGRCGFMFHADGRRHCAVASALLEAAVPTIKYTSSSSSSKEEL

SEQ ID NO: 960968 - protein, 203 aa, Homo sapiens
MSLLQLMSLCRGCAFPTFFVLCKSCVCSVWFGWACGHQQQCNTLCTVGTRHCLHWVVNAQTNSVANLNGVRSLQFRYLNVGHMVQGIATLVFNPKGTPIVVPPWVAKLQEFYLCTRQTGASPSVTLSSAKVQPLERQKIWKGKPESHEKRPPFYTNIPKRTLEPSQANSLREALLEPNESPHSKTRVGPNRLSLTFGWTALVV

SEQ ID NO: 960969 - protein, 173 aa, Homo sapiens
NKLYIRSLHEVLIQDEARWLVPGGRADANMQIFVMTLTGKTITLECRMPTVTPYENVKMPKFNDKEGIPPDQQLSDILPVQHMLGCDVPATLLMTSQPYPANAVPPMTAMCDYACHGDGCAIYFDAYLLLTRLAHEDTTCDKMICRKCYAAFTLVLSTCRKKKCGHTNNLRTQ

SEQ ID NO: 960970 - protein, 246 aa, Homo sapiens
TARYEAWWLVRRRVFEQCRDTIIARTKGLSILTHDVQSQLNMGRFGEAGDSLVELGDLVVSADLMCSCPLRPIWPLCATPWRPARAAWAWCDLLPAVTAMPATMVEQWLLPVLAAATAAGLTLTACSLLARSVSAVCLSAATSMFLTGLRAPCASDNVTGPLFCWEHVQAWASSDEHQLLSALLACVLRGEVWRPVSWLRSRCALFSGPLCAVQLSALVGFATEPQFLGRAAAVSPMGMGGDRILA

SEQ ID NO: 960971 - protein, 105 aa, Homo sapiens
MSMCVPRGISHEWPVLRGDTMSVDASSVWRVRCGTGRHFAVCNLKLSGAKMQSNKTFNFVRMQNHTPMKCIINITTSSSTTMQQHAAACHHRQYLQMGNMCQQPK

SEQ ID NO: 960972 - protein, 233 aa, Homo sapiens
IIGDGALRCHRGWSALGTCLGSLQPPPPGFKRFSCLSLPSSWDYRHVPPCPANIWYFYVGGEVSALLARLDPATPDLVILTTVWPPKDAGDHSALTPPTDRTCYKPSISGHIKTHASNNTLYPYQLLTLKFDTEPLIQTHTILASHKHTARSTNSNGQRHKHSDTSLPRQKKKASAPTKYHQSSPSLARTRARRYTPHGLRTPFTDHQGTTARNNSTRTPRAHLYIIKMTASN

SEQ ID NO: 960973 - protein, 291 aa, Homo sapiens
MRSFATACGSSRIGLPPRAIRVRLLNTNCTALGLVVRVCVAAEAHEGLLALDHPAPRNLSHALGRLPPFIIGYLILAVVITNVSVRSSNICWCSDNVCIRDVNTDKRDVYYRLAKENGWRARSAFKLLQLDKEFQLFQGVTRAVDLCAAPGSWSQVLSQKIGGQGSGHVVAVDLQAMAPLPGVVQIQVDITQLSTAKEIIQHFKGCPADLVVCDGAPDVTGLHDVDEYMQAQLLLAALNIATHVLKPGAACGPDIPRPGCDAPSSAACGLLLQGAGCQPGAADSSFEASCL

SEQ ID NO: 960974 - protein, 170 aa, Homo sapiens
MADSGACLLLSAAALPVLRWVAHQDEQCCPVELTRDLYRMLPCLLDSLGSSLSHSQSLSSHLLPGAEKRRAISDVRRYLLSLLLTFELLFISLLWIIELNTNTGIRKNLEQEIIQNNFKTSFFDIFVLAFFRFSGLLLVLCRACVFRHWWVIAVTTLVSSAFLIVTCHPL

SEQ ID NO: 960975 - protein, 259 aa, Homo sapiens
VAAGRWRQNVGYQWYLDLLGERAISTSVCVRAHESVVNELKTFRSQTIYGSCSDHPLPEVAHVKHLSASQKALKGELENGLLEQPLHGLRKSSCIALKFNGRCFAEIEQGLDRVADGCGRCLCFFYRVSPRSSSCGKKLYVYGPLPLSFDSRVGGHAETMRMLDMKVNPIHGLQSSKWDYEEERVEEVRDAGCRLHLRLGSVTVMDSMPIYWKPVCQQLYHCNNDRYLIKRRKKKEKRAYFAGKQEKRIANFRHIVREC

SEQ ID NO: 960976 - protein, 218 aa, Homo sapiens
VRGAVMQCPMEAGLPGVGCCQQPRNEKDGDGRDPVVSRGAGDTGPSSGHAWSETRVTPTLLLLATCVMHEWGARAAPSHISLQTLVVLQMACSYVLLVRSARVPSFPGDAKLFPRDDCLGMWMMPAVPPVRVTVDMPHDLPACCAPPLPMASDVPQWNCDSPPLRRRDPQAQISGRGPRVCKLSSGVQQQQQQEKPALAAAEESEEEIQSEGNRERTT

SEQ ID NO: 960977 - protein, 145 aa, Homo sapiens
IEWGLPECRQSGLVLGVCHCQLVCLELCVTSPGAGPASSLGVLDVLLSALEPFLGVPGEDPSCTRCVLDDEAACMPTMGHVLCSQFPLAGMEMCSTNVMFGDVHNLMCLLRDVPDVMDPNALDLPELWHLSACWLDCYCEWKEVL

SEQ ID NO: 960978 - protein, 172 aa, Homo sapiens
SAASWSMSAACDCMCNAGTGAPGLTLGNAWGPRLFACSLELLCRLAPPCEMRSREVLVDPRMPGCAAHVLCGLLFLWQWCVRFAKVASMISGLRTPMDGVLLGKICAKSLLLNACNHDVDEDVHGNIHFTCSLCPPALSVVIPLAFSDGQLTSVFVVLDALPAGGLSCDAAQ

SEQ ID NO: 960979 - protein, 227 aa, Homo sapiens
MTIPSSIGSEQRLAEWTALSWWPPVESQSGMLMMWITCALACVLVTPLPTPCSQHSVTSLPLSAGAHAMAMTSLALVLVCCPKLALRVPDGQWSTWLAFCCKNRLAGVLGCLTLASAAACLCPFDTSHATMIFVSWEMSGCGQDWRLVANAGWPGGACGAPLGPPGIHDHLWYFWPAKLQASSRVVMFVYEFWDCGESALKKFDHMLLACMEEHKMPSSSLFSFTDR

SEQ ID NO: 960980 - protein, 136 aa, Homo sapiens
MRRAISDVRLLPSVSSVTFDLLFISLLCDHRTEYQHMASCEELVSSEIIQYNFKTSFFDIFVLAFFLLLCDLLLGLCLCLHAPVHWWVICCVTELLVSSAFLICQWSSSLSCSANGAFGYLLPIVSFCPRLVGDLV

SEQ ID NO: 960981 - protein, 151 aa, Homo sapiens
MVRCDECGTVMLPCVWPGVIVGDSLCVLWVHWPVHFTALLATPDPPCLHFHMPPESCVLFPSCPPDVGLAILIVLSSVMCCIQVSLCLTLRTDMPCPPSPFTYAVSLVPLYELVGSFGVPWRALWLVFPLIVFGPSGWPISQGLLALLWGF

SEQ ID NO: 960982 - protein, 222 aa, Homo sapiens
PTPTVFRQMQTTFPHDQLTTLRSAVLVGAQTLSTPAHLMMSTITLTSGLCDGCCQPVCPDLRADRHLRTELMWPHTGSLFGPRIHPQDLAIKIHVSDQELQSANASDDDSRLEELKATLTPDHRQAPWNSRCTPYDFEKDDDSNIHMDSHRGCIQTSGQKTMTYLQQTGHKSKLIAGKIIPANANDHKQTVVDFVCLELYTVVQGHRQLDILPEWFPQLGPA

SEQ ID NO: 960983 - protein, 167 aa, Homo sapiens
MSAGVNRPRRRWRRPEAAEARNGVMAAGGVGGWVLVLGAAAELCAGGWWLRCTGPGWPVRSREPCAKLCRSLRLECALCVPVLCVLKLLLALLPDRVFSVCVLHAFSVCVRLVLLPILLLVAHASCVPCVPLLPVRPDLLPAVDPCPVPYRLDAWTKRLSSCCLLAM

SEQ ID NO: 960984 - protein, 148 aa, Homo sapiens
MGLSLPSCALAGGCVAPGALYSFVSASVGHECPPPCCLYAKFVSYQEMMLDKCGVVKWDNASPSVKWWRDVVLSLYESHEETTWCSVYPSDALEGALRRLFHHLLECPHIGTGFLNGSVRSPTCTTFGRWATQEVHIASEHLPNSLQE

SEQ ID NO: 960985 - protein, 229 aa, Homo sapiens
YKACVDSFLQQQHVLVVPGVWSCALTQRWSEHATTSPRCDPQNLCKTCHAPAQTEALSQLFCSVSDTDCQGGAICRPCCDPPDPPQCALSPRLLQGHDWGQLHTACAIKLMTNLALGRGVPSWPGDTGASRMSWHVGRGGMCWPMRDHTLKEVRFLQPHCTPVPSVFTHSRTTPRPLKMASIHRLMEAFSSVLQTQFPSTVSTVYWTSEKLVKGPRDCPAAGDSGPAAS

SEQ ID NO: 960986 - protein, 273 aa, Homo sapiens
ACLPALRSWSWLPCAEPDCLELPWAAGGDACRAGLPASLDEVHMCLSLGPWQVSLRLFPSALRWPKNGVSNLSKIPGMDMENGVGNLDMEKPYNKNEVKPGKRWRNATKMNVEPDDEGKSDEEEKPDCGGEDRMRGKEEDEGEPGDEGQLEDDGKPGKAGQVRKVEGKATMARAKPCSQGNAREPAAGREKRPAEDYVPRKAKMEKTDRVDGRITPKELSGGLTGNASEQLGDIKDCGDVSGLKGLGKTETVFHGSKDSGSFAEDRVRIREKA

SEQ ID NO: 960987 - protein, 163 aa, Homo sapiens
RDLHDRTNYGYDEDRGLIGRGTYRELNPVHPAGGGQPVAGVHACCTSALCTRLPALTVHVTQPKDVVAICVSVARMLVGLFGIATLEKTHSRICCSEKCSSATYKQCDRVRVQPCCRICEVGSSSVLKWSLPSAISLLGTECLGQLCAKHRTAAIAAVTCTHV

SEQ ID NO: 960988 - protein, 195 aa, Homo sapiens
MLVAGGNLPRDTRRRRDRRGAAAVSSGGPAARTRKPSGKERRDAGDKDKEQELSEEENKLQDELEMLLLERLGEKDTSCIAPVLEELARRLFLTFHDYLPKPLQILRHHYGQLKEIYENLAPGENKRFAADIISSLAMTMSGERRVPQVSWLVGSQEEEDYWGHEYVGHMEEKWEGVEELDEQQKVSRELCYSVK

SEQ ID NO: 960989 - protein, 77 aa, Homo sapiens
QQAYGLMLRFNRHDGVLTLCCPVLSACDAEVMPLHSSLVLDNEQNSVSKKKKKSNGMLEEIGVIINCYISSLLLAHN

SEQ ID NO: 960990 - protein, 94 aa, Homo sapiens
RAMYYGSVLNSDEAASYVSAADLEVRFRLRGGFLASPVRVPSSHTCEPWNVCRAQHAPLEELSEDVKMDASVHDASVPRTRSNPECGADVTCVQ

SEQ ID NO: 960991 - protein, 96 aa, Homo sapiens
MAEFICLEWKYKLGTEDRVWLLLGTSICAINITNRRGKWHVNARISEGQCIPSCCTESKALEDSSRVGFGIPQYRGIVRHHRLQCTTHGFSGTYLR

SEQ ID NO: 960992 - protein, 213 aa, Homo sapiens
GHEWDPHGGGCPQDDGHSGTFGSVLVGNRIQIPNDSRACEPRTTGAPSRVVGGVGPVAAGERRQRPVSSDAALRMRALWLSVKLGCAVLCMYDDRAVSQQDAHFHFHQILPAELPWATRGPVNVLLAPLSSEDFFLSGSKDRTCAASGLLYNYGDGTSETAPRLVYTQHRKSVFFVGQLSAPQHVVSCDGAVHVWDPFTGKTLRTVEPLTAGC

SEQ ID NO: 960993 - protein, 106 aa, Homo sapiens
MYTTTHECAYVMNVACTDDAVLTSTAEPPCGTQLMIVGWFHLPTCPFLFAYSNVTQTYGLVGPSLVFSWFMTFGFVEYGWMTCDLFDDANYSDGLLADMNKPCQCY

SEQ ID NO: 960994 - protein, 98 aa, Homo sapiens
MRLAVPYVRTLRDAATQCAEAIHMEENSSRPQMNKTNTEEDEQKGEQFIENELQMNDASEAVDMNKNRDKKTKNYTSPGKNIHLEHALQKDCYHHKTI

SEQ ID NO: 960995 - protein, 67 aa, Homo sapiens
GRTGPVVIRTRWFQERGLVGHGGLTSSDPSGGLEAGVLSWVSAPAVAILYACCWCCDVAVSVLGSGL

SEQ ID NO: 960996 - protein, 113 aa, Homo sapiens
MQANGVGAPRSDKVISSISKQGSSRIIGIEDTLLRPFGLAVAASGLNTKLDGYGPYRHLARPHEGVQNDPNGVEPTWAHKTLTNLGRNNWTPICNPGGLEPQRDSGGRETNEG

SEQ ID NO: 960997 - protein, 109 aa, Homo sapiens
MRAVCYSDEGILLESVPELLPNVWEVPFLYLCTTSWRPPLAAAPAGELIPLLTCSLPAGTAGVPALLGLPASPACVCSIYHDLLAQCVCQCCNAVLCMAVMMNCWPAVA

SEQ ID NO: 960998 - protein, 120 aa, Homo sapiens
RGRGPRGPVYVPDEKHDPVKAGVESVRPRAMSDLLMNVNAGSCTPAMLHAYLVDLDVPCCLAACHLLVDVLVHHDACVLAAAWLAVDLAPWMPMSPVAVIWLMAAGALVQPFLPAPGPTR

SEQ ID NO: 960999 - protein, 119 aa, Homo sapiens
MAMEKLLSEELKKLVETLVCPLSTICSDKTCELLTQNLDDMSAHIVCLTIKSMKLDTDMRIQMWLSLFDNDFMLPCALLLVHEFACVLCTHVACCLHVLHHVKILPILNAVCMFAERCL

SEQ ID NO: 961000 - protein, 151 aa, Homo sapiens
MSMNPKEEVPTLLVSLGVLVWHHPQYPRVAGSDPGTLTFASHSCGTCCVPDPGLELHLGPSDVPKFCKCGNLSLRDLVDFGLCESHVAASPECLNHVPVHLSCLVCCVPMPWDGPSMWCAQTSHPMANPPLGDETCVTLALKNVTLYKYAR

SEQ ID NO: 961001 - protein, 273 aa, Homo sapiens
GGWPDGDDSLYPIAVLIDEARGMRTLHASGSTSIKKLSTICLVPLGLKGPEVMLLPFLTDTIYDEDECPPGPGRTAGNLHYPGGSAQMYVHCLLPPVESAVPQWSETVVRDEGSGVLTWPSHTETASPSDLDGALCAASEAVAGRLSGSPPCTSACVPLLQSATPECPVLLKAGKFDQIRPEPVLQMTPPMVLVWPESVQAGGESVKGVGSWTTSGVTIMPHVLQSLALTSRIRGGVAVDGFVTRQFCPEDWTRVSIGHAMKKLRRNRGVTSQ

SEQ ID NO: 961002 - protein, 205 aa, Homo sapiens
MYEAGFSAHAAWVHAVRCGSMETRTLPPAFPETFWHLHRALQCALLMTVPVFLEHLLHALRLPAVAPCVAPVCLLLLLPDPLLWSCLSNLQLCPACLLSCCPHAACVPAYATALPLPASAWCHAAVLLHLPMHCCMLPLRTPAGAMLAYCVLCGRSPVLLALLLLTGCAVRLVPACAGILHMLTFLQQLRVDLALLPRRELPPTP

SEQ ID NO: 961003 - protein, 115 aa, Homo sapiens
MRIEHHTTEKQRHKKQQKGEQTKCRHEAEHKQQHTNKQEKTQPHNNHDNHKDESKANTTRAQNHQEQTHDQQKTTTKQNKPRKQNKRTRHRPHQTKQKQRKTKRQENKQPKQQNR

SEQ ID NO: 961004 - protein, 66 aa, Homo sapiens
WVLIGRGRQCTQLLGVAATLAPGSLWLPVALACPRAAVPGTPCVPDPEDLLTPAGVLLCDLLLRWC

SEQ ID NO: 961005 - protein, 102 aa, Homo sapiens
VSCFISAWTEPGRSFPTPDRTPIASPPSPLHLHPRDMPLRHPRPPQSSGRRSQPHAADRRRPYRSAAPCTEPDSFQTIARVAPQKNLAEHKCTSKQGRWHKF

SEQ ID NO: 961006 - protein, 71 aa, Homo sapiens
MPENITDSRLYTSLLATKCPCLVYGSGWHFCNPGVYRCLAFVKPPWPEVRTALGLPDIVAGLWSGERVRDW

SEQ ID NO: 961007 - protein, 176 aa, Homo sapiens
PLPPPPGGGEKTPPLKKGGKEGPQKKRGVAPSFLIIKKMLCDYVVYETPGSIVFHNNKNFVEQPPLPLGPREDTQNSPLCGAFQRASVVYTTSDLVATSTTEEEKKEWRLFKKKHTSAVTIHRKESVSRGRNKTGRPRTKHSPRGSGVFLLAREEHTECGSLPGRHQKRWTHNRDV

SEQ ID NO: 961008 - protein, 172 aa, Homo sapiens
AACLRPLLRVPVLEVVPGRKTNSVSSEDHSPVVPLVRNPACELASARTDVFMHADLAEDKEEPLSLDYQQAAEMLCRVPLPNMSSRPRQRSFRTLLPGPCTQKKRCLYWELISNASDALEKLLSQTWCLTAKALPEIGDSLCLTNADESDTITIQDTGIGMTQEELVSNLVD

SEQ ID NO: 961009 - protein, 191 aa, Homo sapiens
LSQGPLLKKHAQLPGPESPRGPIQEEATKNKPRAPPTARVRGLSSLWEWVWQQQLSLSATPCVYLIHLEVHHVLFKRPREKRGEWRLPAELCIEEGVCANNQASAVVNRGESVCIDSLAETSVRRRKLSEGRGSLSNERDSGRVRERVDNSLTPPPQQVDNQNNSHPTHNEGRRKRGESARASTRRGTINP

SEQ ID NO: 961010 - protein, 169 aa, Homo sapiens
HEDLKDPHVGVPAQELRKYFKMGDHVKVIAGPNFPVNCWPWNHMCPFHFVRVEENFVILFSDLTMHELKVLPRDLQLCSETASGADGLGGGAQGQLKWGASWVQLDPQTVGVIVRTRNGENLSRVGWTIVTGEKGWFDLVQELQAVTRKKDNRFGLCGLVGPFKKARKQ

SEQ ID NO: 961011 - protein, 86 aa, Homo sapiens
MLQEEMWTRRGDRGCGGEVANECRRSPVGEAKICWGCRLADELWVVGEEGTERRGERIEKEGRSKADRWGRKGWGVRDTGGHNALV

SEQ ID NO: 961012 - protein, 151 aa, Homo sapiens
MRTKVQKKSLLTTRNPFGYDLIPREPHPKTLPPQDVLAPLRSPTAKKLRQERSSYGSKLAKAVASMPREVRQCTTTRLLKPSATKGPTTRDPKNTRKKRPYLTNHLETTNNPLDTADWLGPDRVTLEQDKDEWIEADTRPGHPAAPDTARE

SEQ ID NO: 961013 - protein, 179 aa, Homo sapiens
MASSTIPELCFCLYGAWISSGLLDLRADIFDRIARGSHGYPQTLGLADGPQTRLVLQVCPAPVQGPPSPWKLQVDGAAIKKPEPQRNPGGREPPGPETATTTCAGQACHDKPDTADARRPWPHPHFQETCQARFRVKVVSARRDQHGSRDAYASSRGILPSEIIQATHLRASEWGNTTG

SEQ ID NO: 961014 - protein, 132 aa, Homo sapiens
RGTRLVNSGHLLLRQQQRWGLGRALPLLWRGYQTERGVLRLPAEEAREPLQPQGALERPPVDHGLAKVGDSILCSMVHKAANNQAPRLHRTSPALQNVALKIPSPGADTCRGPVPHGHGLFATLGKGKRASF

SEQ ID NO: 961015 - protein, 177 aa, Homo sapiens
MPSLRLPCLVSGQLDVLLGSPPCPCLTFSLCPMVMACWRRCSLLIDPSPPMPAPAFMLQRLVHLHVRCSCLSLLSWLVLVLGYRVPQVGSHLISWFCLTVTQYSRACNGVHCVGMTYKGMFRIGWDVIRYTIRTEDTPCTHVGLPLGLGGNLLNLSALVVCTSDAGGRSYGCKGGNS

SEQ ID NO: 961016 - protein, 102 aa, Homo sapiens
MLRIDRTHVNCDHHQVYQNVMQCGAYGNDVDRFLDIPGYGFSKTDNNYGKLMWRNQIGQKLVRDYGDYNVFGPHHRCGHNPSENTTWSEETQQKPIVVDRRD

SEQ ID NO: 961017 - protein, 124 aa, Homo sapiens
CSGGARGPCGPVMVNRGGFRGGFGSGIRSPGSRPWTGPGPEAAELAEARPSDKEWDALTKVVRRLAQRTLQRLNAPCGRRLYSSSSTAHSNAQLTSITLTLSFNERAPLFIHTALRRSLRQHFN

SEQ ID NO: 961018 - protein, 116 aa, Homo sapiens
DGDSDDGSDGWCAGGQPRGLPGAVSDPWSRVLALASRCKMRLRKLEVKWSAEMALFEQLNVLVGSSTWNPNCCACGAHCPHGPHMKKLMHGPSCAPVILPNYLLTNTYQHVSMQTL

SEQ ID NO: 961019 - protein, 81 aa, Homo sapiens
SRLGFKSADAVVLALVPETGPSGCSWNIMWPYVYCAVLWPGPELSSEPALHVPPCVSWGCEDDLRTVVVCAAEPATPVTVP

SEQ ID NO: 961020 - protein, 133 aa, Homo sapiens
MAVGAPRGPVPMLPMVEEPCAEAAAPLPPRHRTGPQGCHCCSGLLRPHQHHSHPVPHPAHPWPTLCQRGQRGVTRMSPQRQETSCVEHAGAYSDNWMGYLCDGGVTPPSSDLPTISSEYRPREYSMIGKPERG

SEQ ID NO: 961021 - protein, 85 aa, Homo sapiens
YVEAECYSAEGDGDHSSPVSMASKEWGVLQPVRAGVLCMCVCSWETNGNLTVAHDSINDVRTGADAHACQCLVCLPPHDCPDACM

SEQ ID NO: 961022 - protein, 72 aa, Homo sapiens
FSLASVLIGRLAFLALPVTVRSVPVALLPCVCALAPAVLCLCPDVLLQRECACTPMAALMCCNCELCLMLPV

SEQ ID NO: 961023 - protein, 72 aa, Homo sapiens
EASGGGGGCGEKEELDVSGSVLSGVSECWTREGGEECVNGECVNVCVCVTAVWCCCCCCTCVMLLLCDVLML

SEQ ID NO: 961024 - protein, 256 aa, Homo sapiens
MNLEAGRFHCQCPALACVWTKPVPMRMSPCQPNPCHGVRCALPCAARGWCSVLSAPWGVMGTFCQTCLVGSDVLLWPFLADFNGFSHLELEMACTPLHWDLGEKMRCCDGRVPWHEAPAVPPALQRAEDVTGKGVTSVVRWHCGTCRLEFRYDLVQGGQRSSGCREPVTLGAWTRVSLERNGARCPACWATEPRVLGEYPVTGTPFLNLKEPLYVGGRSRLQQRLAVLCRVYLARRCHTVDSFEAPNDARTVQDMQ

SEQ ID NO: 961025 - protein, 270 aa, Homo sapiens
GQVPQPPGKERQAEVPTATLQLGCTQWSSVPLVPGVMMLCVETAVKREAAPGPQCWCVNVVLCGVNGGVECTLMGWVCAVGLLGPSGPEVEWVSCHGTPCLVQNVVEMIHWCVQCGVVLPPAWGARMWLGKGQLYTCGALREGEPWLGAPPPPSFHGPLLASQMVADKRSCLGSDGRGQCMNPGGMSPGCLNCMGPFCPSGVGPLHSNVGSLFLSCGVGGPAYQTEWLFWSRGDRRTWYVVWPFPGSALASRSASYSTRTLARVCQIYLV

SEQ ID NO: 961026 - protein, 250 aa, Homo sapiens
TKMIEYHGSENVESYILTIMNMVTGLFHNPSIGNAIHIVVVRLILLEEEEQGLKIVHHAEKTLSSFCKWQKSINPKSDLNPVHHDVAVLLTRKDICAGFNRPCETLGLSHLSGMCQPHRSCNINEDSGLPLAFTIAHELGHSFGIQHDGKENDCEPVGRHPYIMSRQLQYDPTPLTWSKCSEEYITRFLDRRLGVLFDDIPKKKVEVQVIAPEYLWCHTGAVNLAMYFAGVNVQPGARRGALTGVLMTRG

SEQ ID NO: 961027 - protein, 101 aa, Homo sapiens
RCPACCGGTSQEAGVECGLWGGYGTELAVCCPETAQRGYILVWCVAWLVMSCCACCAGKTGCMLNGRCVAVVGCVVLHAFRQEPACSQWPQINGWEECQST

SEQ ID NO: 961028 - protein, 175 aa, Homo sapiens
RLLVDLLWWSWMRPHDARLPLCGLQQQRFQRMSPEDGMRTRPGDGEPTVRGPEPPSSGRDFQVPDSVSEACSRCTDGGCLEDDSTKHVGHGMRSLPPRARQLWPPTSMYHVSDVWKIEAKEEFLDLADVLLPHAQTYVPRLVRDEGGPRSGCPRGVVLAASHWILPFVQAAEKPV

SEQ ID NO: 961029 - protein, 83 aa, Homo sapiens
GLEPAHPLLLQPLESSTTTCCGPGNPSPYSARPHREPFMGAPPTACAPPPGPVPHLGALAPDYGLTGRGERGGSGQSLHLPFL

SEQ ID NO: 961030 - protein, 190 aa, Homo sapiens
PARQRCAGMLQTLYDYFWWERLWLPVNLTWADLEDRDGRVYPKPQIFYNHCLPPVPCFYPSSVSITIFRACTVATPLAALLNIKEKTRLRAPPNCHLGTFLPGPCGNACPMQVEVELLSRHEPGSLAAKVERRFLSACRNQWTLAQSPQEVPDESQLDDSHFYLIAFICLAMSCPLCIKPWFYDIEEQFW

SEQ ID NO: 961031 - protein, 67 aa, Homo sapiens
VSEEAPLRMIRLAEVDPTGEWGDHAGAQVPIILVGNKSDLRVGELHWQWSVASPIMSQFPEHLTTCT

SEQ ID NO: 961032 - protein, 96 aa, Homo sapiens
STRDVRMRLFPLLGPRAESDFCRFQDPLRSGLTRLAVQLHGELPKGGQDRRGHVRSQCTKAEKQVDGRGEWRLRKSAWTLRLQGVPSTAIRRDLSA

SEQ ID NO: 961033 - protein, 67 aa, Homo sapiens
GEKASLTFIALVGQGAQRALCGAGSASFFTITGFWLRRMALALSDGCHAQVGADNYVSMRIHVVLDS

SEQ ID NO: 961034 - protein, 236 aa, Homo sapiens
MDAEGLAAAAACPVTLAALVDSVAPRGLPSGSTTQPWSAGQAPPQCGALWGKIPWVYWQWQPFRSMPIFTQTQLAKVSLVPSPEGDRSLVAWLGQSWPECPVWPLPHLPCLAGGNGVGRVKHCLCPGCMLCICPCACLACLHVVSACPVWCLCCELVHVCAVATEGMTHCPRGFLACVGRNVLGRPVWAGARALHRLTDPGLRAACMREGDYTHVVLARLVALCDSAVLACANMAC

SEQ ID NO: 961035 - protein, 246 aa, Homo sapiens
DSGPYSGMAEPTSDFRDSYRGGMRLPRLTPTLGSPETTLPRRGTGGMLLGNAADTATTTYVLDFPQPGSKPSSESAAAPWMPRSLPGASDHHFDSPDTSRGRKHPIRSPVSPLDSQPINPAARLWNYHAIQHRWYWKTDILIEEHSDIKKSFNPCQYKNPLLSTNRYDCKNITELQDVTPSPREEKSKNEKEKNHKEKPERHESRTREAGSAEREKKASRDKRPASPTKRSRRNSRYTGETTSRGP

SEQ ID NO: 961036 - protein, 41 aa, Homo sapiens
MDLVDRREENSHGSAILVVSSDANKTVAVSSSLEDCTVQGQ

SEQ ID NO: 961037 - protein, 163 aa, Homo sapiens
MWHPWPGPPARCPLWLALLGADLPEQLYLPVVPGFVLDTNCLGQQLELPSWMSPTCAPGAGTAVLRLLHHPELQLGASGAAALTAGEDAIAACFLINCLYEQNFVLQVRASVGLHQLPHEGSVRSYAAAGQAWGSGSPGWQAYLKATRNLCGFDPLAMGPFGR

SEQ ID NO: 961038 - protein, 111 aa, Homo sapiens
MSSFLRHEGAETMPVPRGLRGMRRTSTEPQAACHLCRGQWGACRSGPPSSLVRSGDDGDAGAMVMYGPQGWGGATSWEALTPRTDVAMCESPNSQQLRLNLVPLAGQGHWR

SEQ ID NO: 961039 - protein, 269 aa, Homo sapiens
LSSPPPTVSQVPHGPALPPRGLPTVSLPPMGLPTGPYPTRGLPTVTHTPQGSIPTGAISNRAHTHTKTQIGTSNTRRNTTTRTQAPRPGNEKTTPRQGAVTQILASEEHNERPFHVASPNPEHLAPQGSIPNTSPYTYPRREADPTRCENIAYAVRDRHLSTPDQLMDRHTGWCARESQEPFCPRHNTVLGLEQTESQHHRLSYHNPSLFNQSTPTSRGVTYPPRMHHRWKPFVSPLAKPLDAHTHRQEDYAGGFPASVIAKAPPPTLP

SEQ ID NO: 961040 - protein, 74 aa, Homo sapiens
KLGRVTVMNQCCEHNWGEARLIDVHAGLCKYEDVEHNGDYTYLDNLLIYIYVNNELSILREKDTKMSLCTVKQV

SEQ ID NO: 961041 - protein, 208 aa, Homo sapiens
RVLRTPVPQSPGPGHRSPDSGHVAKMPVCTGGVPPRGTGSTVPKSWGEAGLRPGLHHHRHCPPPRPPQHSPVPKDAGGGLRPPCSAQSSFAWGLDHTCHVGKVPEGYLRGVVWAGLPPKTGPMVDWALRPQQVVDRVGALAVAKGNAKKAEVGGKSASNRGLPGASEGMREKNQKNSLRLDHLRGDNGRSRWHRRDRRTGSRGDEGKP

SEQ ID NO: 961042 - protein, 186 aa, Homo sapiens
MSLDIQSLDIQCDGAELTLDVADAPPSCSSMCQSGSVLGLTCVPSARRQLAGNGTSSCRSWQARMVQAPWQLGAELLEALLQLTELGRMSGCAIAVLRGACMTPLLRRSMNAEPPELLPDWGPGLRGSLSMHTYAALAHPCMERATLKLRTLLGRNAGPLQPCLVGEKGELPFVEPPAQGLVPGPL

SEQ ID NO: 961043 - protein, 95 aa, Homo sapiens
TGVSLSGLGWLLGPAGLCVLCVLGCLLGCVWDLGTVCPDDAVDEDGVWAAGVRCPGVCGWLLNLFCQLTGMLPCELVQCWKDWTGVMHAGMLCSE

SEQ ID NO: 961044 - protein, 159 aa, Homo sapiens
MLSRAVEAPDYEVLSVREAAYSTERSPRVYNIMHFVFATRVYILCHIVPGPASMKPAEFIHQWCDEDATVNEIALELCSFTLASALGAVLLLPLLHHQPMRVSCSRCARNYLSSSWLNGLPPFHCALGDLGLVFSNCPHRSSCPLGVFPSPGSKGCGPE

SEQ ID NO: 961045 - protein, 288 aa, Homo sapiens
YSSLNRLFLPTTKVGVGGPKTQPVRRVPGVEPAQTRVWSLAVPLKRRMVGRLSPRPHCGLLFMSVHTLIVRPLLLVDDGRTHRGWLSSRGLACRCLPAPSPLPPLRETLRGVPLVPGLDSPHERLGAHALCSATRHACAVFEKVCFFAAAGPDLLAQNVGCHVLGNRLRGSHRCILDERSPALEGAHKTMGLRGDHVLPPARICNLRGGERRLSDEYVRHLWKHQRPVALGDKIHPGKNWKTPGSVEQPENGWRLDHRYDVYPPTCNITRRLEKAKADPMKTRHKGAQ

SEQ ID NO: 961046 - protein, 241 aa, Homo sapiens
VSLALRDRRLEFLLRPGHGGMLVIMEHGMPVTLCEPVTMGLYWMLKLAAMGALRVWLTVPPVLGGVPWFLHTCPQPEWMPLYVVGRSLTSASWPCAAAVSSGFDWCHPCWSPSECRQLLTLEHVLLCMCGLSLSFALSPLHPGPQATPASIVGLLLSLREAAYVLPVSRGDSQDRTARRGWWRSQRGDVGYHWPFDRADLIVEYLNACDLESEKAPAEATTFELSLATEAPRAGALSGSPD

SEQ ID NO: 961047 - protein, 134 aa, Homo sapiens
LQLSGSAPGGALRRGAGALFHETCVACAATVAGLFPRFASATPQLLVVCHVLGSVCRLVAGMLLGPAAVPVRRFRGPVPLVACSACLSLSASVVLLLNAGPGQLDVCPETGCLMLGHFALAPEAVPAVHLGVQF

SEQ ID NO: 961048 - protein, 133 aa, Homo sapiens
MEVRYGLHGSWADVCLVASTVHLELWIWKTCNIALKRRSPNLPSLAVTLVWQRNGGGMFTIPKAEASIQAGAGDGEWEESDSRTAQSPRSKCPRCICPKAKGEGGAPAPPEASLLGPKGAVKAPRHPGPREEK

SEQ ID NO: 961049 - protein, 123 aa, Homo sapiens
ACNSVNWMMSSSAPAEPLCGEVAQSEMGRKGMLEGACSCDSSGSESFQTMCRWCMGDVPSGAHMPGRPCHPVPMICDVCCACGPLRMCTLPGCVLSHLTRTLPHQRTLKGAVLHKLSNPWCKF

SEQ ID NO: 961050 - protein, 83 aa, Homo sapiens
VAMGLCDPVDMMWMGAVVCVPAAALVSTVNVLLLRLRAVDFAERHGYINVCICQVTSSTDPVGLLCCGPSANGVSFLGSSIWY

SEQ ID NO: 961051 - protein, 207 aa, Homo sapiens
MRNAMTTEENARAERVSVPMSGRLSSALLPSGHCLLPGVLYFIPVGMTYLYTCVVMEQRVSSLTPREDLLYVGISPDIRSCVNLLFLDMSVCSSSNNPPGVLVAGAISPLPVGRFEMSIAIPHTHTRIRSLTLGCRRASVVCFKVRSVLFRGGNALGQSGYPRGFEAVYCWAAMGRSLATLLSVRSRVGNEKPAFWWKWVFSPWGRQ

SEQ ID NO: 961052 - protein, 180 aa, Homo sapiens
VGPRGRLTESGIVCLELFGLETRPGLQLVCVTVPTSCRSAKTPGPVDVQAGHDMVLVLTVRTEEARRLPEHLRLWGCGEKRVCSLLPSTESGTLMAALLGSHEPSNMKMVKAEGTKTLIMCHSIQETRIGISQRAGSKSKPGKQVLNLRSFMANPNAGRDWFDHLVLPRSSRESELLQRG

SEQ ID NO: 961053 - protein, 337 aa, Homo sapiens
MYMNMIQGCYTGLPLQDEVCVCYTSHINRCKSRRMVSLCMTSEISMGEKYIPTGYRIETSVLALYPDIYKHQDNDELNTLKCEIDIDAMDNQSNKKSSKISDKTNKKYKNNWIIQSKLKWDGNLIVYLNKRKLDQASAELKYSTLKEVNPSANQNRMIGQEVTTYKRNLSLDGLVENLTGTYKGTYCDTMRTQQNSRRSKTQNQQNTHVDNTHWTATATNSRNTQRRKQARERRERKQKTGNRKNTIHKIPKPKSTRGRRITTKQKKEHSEEEPNKRRDKATNRKATENSTETQEDTSKAAGRRKSHKEDKDPHMGEAKYNDYNNHTPQQAKKACSR

SEQ ID NO: 961054 - protein, 127 aa, Homo sapiens
GCNMCLLDDESSAPAEALCGGGATERNGAVRECLKWFASCDVGLWSSPDYGDGAWGDVPSVHTCLAAHVHPVPMIGCGWPVARAHVHCARCGALHTLTRNNPLIPVRDLSVRVSLPRNSPNPVWANI

SEQ ID NO: 961055 - protein, 309 aa, Homo sapiens
RVDNNQLLLLMIHVFLRKEEQLFKMILDEHLCAHGWATCSCCTVLLTDCYVYLLREMGATEKPYLVEEAYSYNELDYVSVGLDQQTVKLVCTNRRKQFLLDLADVALAGVTLFWHSLKSDMIKGCREASLPPDILTDATMEKLDTGTNLVAKNRSVRHLLVTDDASTDLVHLGGPPQTRSLGPTPCHCSTTEGTIQPREGMQNYKAASSLNCGKGNNGTEVLTSDASKKQGYHLPVTQDTNRKGNNIMNTRMNTEDIYTTYVDLTGNTDITGFDHNIIQEIIIIATGPFLKRIIITKTEEHKFTRVERQ

SEQ ID NO: 961056 - protein, 143 aa, Homo sapiens
CLQLSGSAPVRRPQESVRALYSMRPDVAWAGTVAGALSPFRLSYPSAPGSLPVLGSVCRLGAVELALAPACRPLSACFLVSSAPRGRLPAVIEAAGLRLLKLDLALLDVFALRTEPDWLVGIIAARHLSACPLLVAPWGGTVY

SEQ ID NO: 961057 - protein, 179 aa, Homo sapiens
PFLCPPGSISPYTPDGLASVMCDAGACHFSMLPLCVAPVTVLQSACSCVVEAGGVGCTCLDVCVPGAVLQPRMLPGQPPCRCRSLSNHDALTCVSVPVGASLASNSLCLHEHVAYPCPFPGGNPVTQWTLWGVLAAATPAHTVPGQPAHHSLDRAVEIGSGGLGKAKLPKLKYTSVPYQ

SEQ ID NO: 961058 - protein, 73 aa, Homo sapiens
RYEAQKLERMETNVEERGQSSSTVLKPEPNTVSYRPVQLDTTWWGLQTAPCTGLVHGGVTHEAHGMRVAGIVA

SEQ ID NO: 961059 - protein, 102 aa, Homo sapiens
MGEIVFPDTDVCVFLTLTRDRRRRGDHEEFLSVAKCYSSYASCCRIVPRCCRVNVDESTNVVSVLSPGVHYYYPLLHSSSQSRLPVTTHLFDIDSEICDKSS

SEQ ID NO: 961060 - protein, 287 aa, Homo sapiens
MVCRAATCRGTSAIARPPLAGPAVDASLAEYGNLRSVRSSSCLETAGEPAGQRACCGGLLSSPLSPHCTGGKCGFDVGSLLFETDEAIMGQATFLEHLAFKGEQKESGLGSALDELMRGRAWGPILIGLHAPVEHTVLTTINGCLSKGSAERLWTLLGDICAGTCKVVGRPHMFEKGSVDVESLRETCTDTLDASIAENVALTLTCIAPGITLVPTLLCHQCFLRCAQFRTVKAADIVADLTGIIFNTITRPSMLWQQWIDWAQSCYSPEDLWLVKFGTRPDIKRRR

SEQ ID NO: 961061 - protein, 256 aa, Homo sapiens
LPPEPREQRDVERAGGNQAASQLEELAGLEMLDHAVLLQVIKEQQVQQKRLLGPCSDECLLLLCDLSEHAQWMIHHADVHGVTEGWINPVHVCDVLHQEARVACVCPDVPVMAPEGNGQWMTVCDESCLPCLCDPGPQMLLCVCLPCSIPVTLTMRSLEHSEWACVAGYPAGPPELAALTHEPRGSPGQAERWPEGCRPQGSLALVKGAPQWPGAGARARPRQEAGGPEELPRRGIPGQSQDVTGGSQTGKLEDVQ

SEQ ID NO: 961062 - protein, 250 aa, Homo sapiens
RARSSCGLFAAECLDLLRTDVINSGGAYPNIPLSYSLTWSTQDLFMLHVDGHGKCLKPKKPHWIMGFCCGHLSNKFWTVFVQKEFLSIQDRDMKATYLSGICSTFLENFGIYVYCSDLTAKMKFCYTFGNCMGVSVTARHQETPPCMLCLAASKCACDTVVFALLVLMLVLQTRLTDEEVEIDADGCVQYEAWSEPEPAMTGPKRHSHRNDSLKRVYMENTVGLHRFCPQQNYKIIECADPTYDYYPTMI

SEQ ID NO: 961063 - protein, 240 aa, Homo sapiens
ASPLVRHPRLVVYPTLMDALSCCPIEAPRGRPGQSWPRCMTPGHAFLANAPSPAPVCWSPASSPSNGAREPRPLVPPVSVPLPPSALHPCEEPRTSPRQPGTLPGCHLPLCLGPSSLVKRLKVNPLPSSELELLFYWVTTAAATCPRMGLEPCQALLMLTQSRPTDKVWLPNAPGKCSTMMPPRWGVLAAQCSHGPRECFGGMCRPPPTSCGLLPESLSSVQPAAPDRPGVNGTSGLSLA

SEQ ID NO: 961064 - protein, 243 aa, Homo sapiens
VYEEAPTSGSMFMTSSIPSPNQRERTSSCFLRANECKTGFCHYDKVTCRYKITSGYCYGVSPSAPGEDEFKCPIKGESIAMTQLVELGCVIWLRLRLQDLGSMQETKLVYFQGTKDRRMEAHNYYVVSYEAAGCDQYASPRPGFSHSCSMSQNFDMYSTATYSSVSNARPACTVYKLSGPKTDTTAQAARFLGLDMMEAADEPPDNVPPEIFHYQSARMCGLRDDLKPKLETRREPRLLNGAH

SEQ ID NO: 961065 - protein, 51 aa, Homo sapiens
MVYAAAADAELRCGWDDADADAACGIDVLACDLMLCAARCCCCAVDVGMPA

SEQ ID NO: 961066 - protein, 308 aa, Homo sapiens
SPWPINFYWAGREKSRGVGVPSFPSLYPKNTLQGTEKRPRAVCCASGGPLGGRQSGWIVILLPVLPRSEAWGEGGNSSCAPGRDCECSSEPLWLPPGDSCRPHYQPFAHLAQAVGSSQIAGVDSGALWIIFAPGVGTSQTRRLSVFVAEVVFFSRGSLYQCTQPVVTCRPSISQEPLGEGVPAPTGVPVNHVGTPWLYRGDLPSRGVGQGNPPRGSQFPLSSGRGLTPRCYSAFLTGFLARANWPLIIGGSHLDPQGLLGEDSVRPGGGIHPSNIACGSPFGPLRRLGFPPQGSSQGEARLLNGVDLD

SEQ ID NO: 961067 - protein, 146 aa, Homo sapiens
SVPLMTPISLKGRCRQLGDGKRCSLEDLALMEGLAHMLEGPLPGKVLLEPGVRGFLLRVPGLQFLRHVVYCLVVHRANRGPQRKGKPPVASEDPDSRKWSCYVWVSKKDDTGEGYFFLSLVQSLEHSSDEMAAHEGLSEYFREAIL

SEQ ID NO: 961068 - protein, 240 aa, Homo sapiens
MSTVALLVPTWLCGWRKLSLTQCIPQCHHGGSVEGMCPALPSPSHVSCLHVDSMKTILGEPVDCGCAGAWVFWVAGFHVVACTACGRDILVPCDSHFPMNSHVCCAIPVCAHVYTCWGVVSGMPPCCSVSFTCCTVLLFPPFEHLQQTVLTTLLGVGISLVGQPCYNAFTETNIYRGCACIGRRPLANDRVFPNWHGVTMIDDAPLVEEVEPLCCRRPLKCVRAIACCPGSAKPPPWRLG

SEQ ID NO: 961069 - protein, 200 aa, Homo sapiens
AGGPCAPQHAAPWGAGGCLSVAHVPGALLFLSLRCDPRLVPHWGGLRCCSSMNVPQPVQADQIDMHLQIRVCSLFCLRMCGPVRVTCPMGFAVSELLQGAPRACCRSSSLPWEILHLQGTVYICCDMQEMVQTSHQVFMGILLAWAQRLLHGARIQVNSCHCNRTIPVKVLGARFNDIDLTWCKTCVLPQDPSFNWYNQT

SEQ ID NO: 961070 - protein, 232 aa, Homo sapiens
CAGSAAAHLSRPLTGAGCGGSTRSSLKVANEPVLGFLQDMPELRCPAKGLEDDLKGLDVNAIPCVVGVMRSVLDCRDVQYQVYAFVTMDISVAKFCYADKSLLNKAIEAALAARKEWDLKPIADLVPRIFLKAADMLSGPCMSEILGHDHGGTGKTCDPSGDMTLQLELIDFFRFNAKVMLVELVRSSEAHQRAPRHNSLCTGSDGIVEASALNLLQSGHLLRTGLWQRAYE

SEQ ID NO: 961071 - protein, 266 aa, Homo sapiens
MAHGCSSWHGFLSAYACDASDGAWMMLVNDMACALVLSLHACDCHHVSVLNAVPLCDVCVCPCVYICCMQVMCLHVVLCCLLWLPVVPLMATCCAHVVLCAVEMWPDSCDFVFELLVFAHQPDSGLLGCLGALCNEHCTMAVSRGECQWVTLCVLMTQNMADVRGCGAGGWNSSFSSDVDWIVLHVAVGVDASCTRGLCLNAVDGTLCLPRSPVAPKGQGHSAGRDDGRPGNRLPSGVSGLEDRVAVSPSCGFVTCPRMWPKGKTA

SEQ ID NO: 961072 - protein, 247 aa, Homo sapiens
MGGHVMMLCKCVTIFSCGVMPETCCNGIVCGGYLCALFHVQKDAMMWACGCVDATCGVGHAVVCPCNCGVLVPHVPWCHRHGTVRHVVTHVDIDVVSPMTCHRHTNTANINIKKHVAACGACSWDNWLSHVPIACDAFEKGACEMLRNEHVQLLCVEFASSELSPCDGAEAWANCVMLGGAPLWDHFCCHGPGMGLVWGLGPCLGRPCPQGSALCGHGSGAVMCPVWGLLRCMPHRHALGVVGYVQI

SEQ ID NO: 961073 - protein, 52 aa, Homo sapiens
MSDTPVCGIYKQVLEPTYTGQAFPNTNALVSQTCITKTQFRADLAGSELCEK

SEQ ID NO: 961074 - protein, 238 aa, Homo sapiens
VCLEATEYETPAGPVFLPQCPEEEHSSLPVLHQVPVVTSFQLTDKMVFLFLWLHTGMQVLLSSCKAAAEPSWDDKDDEIVSRSDRASNSEPCPSCAWVVNTHSTVREIRWRKEVWSTPVECDRYFPKAACAKVVPACMGRALVWTPYVAARRCRDAWSLRCVARLCRVAQPCPQWTDACPTSRGPAFRVAWTGEIQNGLLEDNDVTSYAILEVRPRLEHRYLYHSCLHIRSLTWNGSE

SEQ ID NO: 961075 - protein, 236 aa, Homo sapiens
MSVSGGFQNYVLMCAWVDVPLWHTCRAPSPPCAHDVSGCACVPLAQMCTCANGVWLSNNSHAPQLSRIPCERLSLCALVSPNNSPNTRVPTFDLLMAANIYTSLKEVCDGVCDTQRMLRVRRRPLRNLLSPKHTPRDKWPRDKRPHEHPHPDKTHRHSASEHTARHRQKTGDSACGMCAPPRRPSQLPPVRCGKRTQPSTTLPWGANRKSAAPRAPLARDAPQPRLPAPDPGGAVL

SEQ ID NO: 961076 - protein, 231 aa, Homo sapiens
IKEIGAKNVRKQTEEHGEAYFVEDEVEVIGRAFGFRRIPVISVLSSAELVVRCMTDRVQLRAQMWDFPSNASRNGLTSEQASLDTCDWAYRSTNARQAGWKEMCGADGQNSRRDPIDCLMGIEFDLHEYFTEVPKALKLSIGRRTTTGGLMVRSWQETGHQGSLHWTIVILALSANALGGGMQGCGLCRNNSHAVGTLSMHYQWVPTVATTGHGGWETELAQLVGGQPKEF

SEQ ID NO: 961077 - protein, 263 aa, Homo sapiens
ITPLLQSQAPYKSLWGLRGKNSSVSKNKKHRKKGSIVHPRGPRQRRGGRPSIKASLKRAAGGGGRRGCKEIRGTTGTGGGPPAHLRGAPGGGGTTTSIPRALVVPGGGTPEGRAKDAEVPGENTPWWGGAVNGALRGEAAGRDTPENGGLQGGGHGGFTLHRSRRKSIEAAINKGKDPRSKNATNKEEISRREIPEESAGATQRGPEAGGSNFLPLGTPPCTNGPTRGMNTRRDTKGQRRGAERPLRRDPGTQDGGNGHHHNL

SEQ ID NO: 961078 - protein, 265 aa, Homo sapiens
SQRRGVDRSGSTGSIRARCVGRAGRPQYEHRRVRAYVITSHGEATGTTGPILESTTSYLRSRRSGCERFLHMRHMQRIAEDVPECARHAGDSGVGLCATSIRKSAESREHSRSGIISCMTCEGQIAGVAGHSAVLRIVVQYSVPLYAGARKAIWSSSDKKTVTNFQVTETWGRYSRATTYITKGYKCGLTSQLREGQPEVRLSLSRVFSVCPLSSRTVTVREEEKLELEKLLEEVLSCKGELEEPGARSTVSAALIPSEWGLDVA

SEQ ID NO: 961079 - protein, 283 aa, Homo sapiens
ANPTAEEKPGPIKPRVNPTGVLQNMAVKREALGPGSPWSLVWQDKGSQKTARKFSVALEHWEEERDVVFKGVPGLSQEYIPGVIWWSGGVDSTHRHNGHLVWANVPYSYGEKNILEEMRKSIHPLKRHNRCPWAILCVPHVANIGCGTQNNKYGVPPCFFTSVAPVRKEAVDVWRVRMCANAMWWGCVGRHKGGEQRKGHCEQHIVWGEAPMGNALLGGVPGAYWGKEPNAKEKIPPYGARALGGGQTPGIKVWRPSGVLILKPNQRLQFPFLGSSQGKKEPP

SEQ ID NO: 961080 - protein, 162 aa, Homo sapiens
MDGEKGDPGPPGPPGLPGSCGASMGPLGITEDFAMGHSGPPGDLGVPLGFLRACWDPSELPGQMPGDLMARMGPGRGSAGPRVDLGRPGPKGTPGSGRACGEPGNAGKDGQNGCARDSMARMGEAGRKVLRRRRAQGLRAPWNNGDKSEKGDSAKCELVNAP

SEQ ID NO: 961081 - protein, 121 aa, Homo sapiens
MQVEAGGYSAEVTWRCLGADTTEDGDEKSLEKQKHSATTVFGANTAIVCLQFDRVYIYHLRCYVYQCQKPLGFEIRIALTDPYAHSRVTIHAGDKTDVSIIPFIPMNPTLGTKSNYSSDES

SEQ ID NO: 961082 - protein, 195 aa, Homo sapiens
MNDMMHQRWLMGTILQRSICCSDPDDAMSYDLGLQVWLPEGRSAMEQPQCWKPLRVREEEEKDGMCAGGMICEPQMLNGGDHKHALPSSMLHRPLPELLANLTAGPTADLACDGGLMRQPQHGSDRVCGDKASGFHTVYMHVRGGRGFFRRTIRMKLEYQKCERSCEIRRRTEQVQTAVQRLDGMSKGAVAVGAE

SEQ ID NO: 961083 - protein, 193 aa, Homo sapiens
MQQLSGLVVPVPQLFATSCALTIWTTAALDQVSEARGINWMAHSLHVPKWHSWPLRGAKTLSFAQIKAFMEKLLVPPPPADGPDSIPQSSPKSDCPCPNLSYPVTEPPIGYGSANLLQPPSLGPHQSQILEWAPLTPAISKDLPGPHMMSKNSLPRNLGELWSHSELARIGWDSPWSSELNMNGYHWQELRQV

SEQ ID NO: 961084 - protein, 270 aa, Homo sapiens
SPWPLIFFWAASGKNPGLGCPFSSLPLSTQKTPSHKDMTKPPEAWCCLKETLGWQRQYVWDVDLFFCVPPRQVWRNVWTNLLWLTARDLMAHRPAGIPSDCGPPPLIQPPPSFPHVGCLYNTRLYPPPWDIGPSVGSPKGAASPRYLGPWVFFQRPFPWSQLCYTVRALNIFKTPVKGGAPIGLEHSATVPLLGACPVWPATSGKQIFKPGRGNPGFKQLFPDITRQRTTYWPHVYHRNMRKPSPERIHPSAFLNVPKEDFPRAPQKHPH

SEQ ID NO: 961085 - protein, 108 aa, Homo sapiens
DPALNQGQHQRHVLDSEGYLLFYHKQILEYEEPYLAAGQKNKGNALARPHKVILPGRTIKQKKPNDNNRTRENTQHSQSNEQETTQTQGRQQQKQTRDYTKATGDKQT

SEQ ID NO: 961086 - protein, 84 aa, Homo sapiens
MPLEQMESALLQVLRGIGLDGPREEAHGPWWVRMCSCYLMDAGDGVAPRSSYSKVEGHPGGRCRAADVTRIPPLRSSWDASQTP

SEQ ID NO: 961087 - protein, 120 aa, Homo sapiens
MHLAAEDCYWDMLAYTDNDVVIGMDVAGLRVLQCLGMYDHGLSSLPDDPSRYISSLTMLADLYKSFINGLPRWCLSEDPFDHVMTWWSLAEVHSQLQESSVVGGDDLTCDQPKRVIANGL

SEQ ID NO: 961088 - protein, 250 aa, Homo sapiens
LQKQKDSMKDDKKKLFVIAKWDYTAQQDQELDIKKNCAAVVAGRLQDVVGVVSELLANMDWAMYLSNYVCCCEEHALNECGSLCELNLNGHTSASGKTRSEGPALLGCCPPLPSTGQPEYPANVHAVLPDLKSTTSTSLAFFKFCLCGLMREDELSLVNGARCVTCHGEVQQTVGGVGSYKLGRSSWFPSNYGLWSEVCLRRLLESPSFLSLWQGALAEQWPGLRVLHVVRRCTLRFRHGRAHSSRGDWG

SEQ ID NO: 961089 - protein, 226 aa, Homo sapiens
MGDTLVAVPYRPSFTAADPIQVSSHCVSASPSTVGQAGVQIGNCLTWELYCLEHGIQTRWPRCQVTMTMVGGDDSFNTFSQMKQGAGKHDATVSRKYVDLEPTVIDEVRNWQLNRTDYYTPMRHTSSTWPGMMLPINYARGTLHPFGNGRSYDLVLDRIRQSWHEPVHPRTSEDISMSKNRKTNVVGETVYAEGSTFDLLYENRSTHVDLMARKSHAGSFLQLYHE

SEQ ID NO: 961090 - protein, 157 aa, Homo sapiens
NGLVGLCLIGRGLTPDESLAAHRRAVLVTITPRGWSRMSVRFRPQSTHHRAIHEQAEADTQQLLVLTFLLLPEPSGVRPFPRFPRDMRGVRWRQRVRWARGPVRSRRCSFLVASRRTYDLDKVKMSQAPLSPFPKNNTISVHILGGEIDAPFAEGRE

SEQ ID NO: 961091 - protein, 207 aa, Homo sapiens
PLSTSEQALLRPPALPGGESMSSEDAIRQSNQILRDALLRSFCISKPARGRMKEFLSVQCSRMARKLVETDSAWRSSILNEAPKVSRALSGVWRHLNEMPASTMADGQRALHVKAQCDVLARGELAGEPESLVSASHSSECQGSGGSGPGDGQLSKATGARRRERGGRMKKRRNSVQVDQAAHAGTERWRTSPDGAPGASEEKGTGQ

SEQ ID NO: 961092 - protein, 73 aa, Homo sapiens
RLKPLYIKSFESTVGPGADTYIYIFRVCREAGQPHSLSAGLVAKSTKSNGKETVVGRLNETHILQREVIGYRC

SEQ ID NO: 961093 - protein, 225 aa, Homo sapiens
MGRVILWTEEGLPGLCTCAHVKTCKCALRACDACGFRMSVHGYINGASVKGHHPTDPVACWLLPHLPKDVSYQVIRYSDLMNAVTDDLYQYACLMGHSTLVAKLCSICCANEWHQLNHCAHVPPVWATNDLKGYTYVWLPWMEEALRGPVDTAGPWASWETYANRLIYPQHLQHQEDPDVNADPSGIQERIISLRPTGAVDTVCVPAGGPTSDKPILKAGQDVPP

SEQ ID NO: 961094 - protein, 220 aa, Homo sapiens
NSEPLSGWMVRAGSTRMLELMSMLPGNWFGRNWLQYRSHLEPSGNPLPGHPHYFCTQCTSSQLPGPLTLHPDLHPLQEEGQRPPGVTTENVRGGHGLDAIRMEEDGRTEGTGRQKEEGEMVETGRTRRQESEERRGSRTTRKWNAELCRPLVGVSPGWGLRAYGRTGMLSHGSLLAHLFEVDTPSSSTLERLELQSLEAAEIEPEVQARGRQAPGSDLSW

SEQ ID NO: 961095 - protein, 225 aa, Homo sapiens
GVRCEACEVMLEEGAPTGASPATQPPWMQLQSSFRSSDMPHADPLVRCMLVAWHQLELRYALYDVRSPDETTVELVLPGGSDVVTLDQSRSMRTGTRACCDWSSRASSRSATWRCLCPCRSDSPVSPPRALRPHWPAFYERVSLEFNTVCSVSVRGGSSVTDRGQPGPRALRYSLSRRPTHWIARGTNLESGMEDSLYYNSAKTTQSDDELPLPNSMDGQHPPPA

SEQ ID NO: 961096 - protein, 134 aa, Homo sapiens
MRLLPPCSAAVDPSGQREQSAAGARLCSQAGQVPWMSMAPLGCLCASERALCTGKCAGGPSGLSSSVLTEGPKALTCVGMLATQRRGSPVIARLLNQRRVARTQATDTGQGTPHRAQSPTQPTQGRKPDTGHRA

SEQ ID NO: 961097 - protein, 171 aa, Homo sapiens
MAECASWKAAGRFFRVRSLQITQNFIIPKKEIHHMYPDMGKWNAFSGIRLTTSDSSLPSTEGVKGKKLTFEYRVSEAHRETRSRLLDTLDRLDLIADSSMCDQPLSVMRNKCIQGPGYGKLCMRKQNKSGGHKWVATHLAGLVCLRVGEKLKGVIWGTHCALGYGTGLEAP

SEQ ID NO: 961098 - protein, 67 aa, Homo sapiens
HEGHYLTVEDSGSWLGNAARDNKKGRVTPRHILLAVANDEELNQLLKGVTICQWGCVTQHPPLMLLC

SEQ ID NO: 961099 - protein, 191 aa, Homo sapiens
DAAAPRCWRKRKMSHPELLQLPRDLEQPSQAAGINLEIIRSECQLQPEEASVMPELEGCLASCGLRSRSSTPSASSASISGLFLGTGRACFEAIEQKQLGAGRPTCVSDAQQHVPVSDTVQHHECAFHGDHFPPAALKENKDRNGALLAERHERKESSKLAGRIDGAEPDNRGEQETGTALHTTTGPGESN

SEQ ID NO: 961100 - protein, 109 aa, Homo sapiens
MEPVPCTLTGISSILWALPSPRPSSEKPQSGLCPPVVSDVLACAWSAVCDLWDLMCCVVACAFTSIIPCVPICMNALHSVPRCCWLVRQHACHSTRLALMVRDMGSAVI

SEQ ID NO: 961101 - protein, 243 aa, Homo sapiens
DAGAAGVVPWGALVALVMGEPLVCFLLECFWHVCILVAGCRCACVSVAWVPDGLLDALLECNGLMDNVSCDALSPSLVPACVKDMNDQCPCEEIYLFSLPINGIMRSFDFFLWVPLSRMRFLKIMPVQNADPCLASCTSVQWHLYAIWGLQCATSVWVVKCAPMECVHLPSCGAIHPCANALQSVPVLQMATVGEQRSGKAPHLSLCNGVTWAASGSCAGNAIIPAPRGHWASYSGLVPKKLS

SEQ ID NO: 961102 - protein, 247 aa, Homo sapiens
YPPPSVCPSVRRREWTDVPPYRPHTQPSEKVSSIDEEIRLSVPHCWMTMTNDMILSKPGVSSGYVPPPVATPFSSNVQIPMPACLVVHMHPMTILVKSPSSSTDSAPGSWLLAQSQDTVPCSAPAPAQCLRSNSMSSPRPRAVSLANTQTLMGPQPHLRLPAPKFSPVTPKFTTCGYQVQSMEPQVDLGSQTKSRNRGHTESYFLLAQGSALNSQLHYASKGEPECSKSTQSHTVEHTVRLARLSKR

SEQ ID NO: 961103 - protein, 150 aa, Homo sapiens
MCCVPPCMAVLLPFGAWVTCAGCAVLLRCGPWLMHVVNAWLCLLACGNLWLVMCLPGFCNLSAPPRLDSAVACEALVIWHLGPHPTLGDLLVRCDGLAGCWQCWGLKKGRKVTIVDKILLWASLRRRKAIGSTPGSTFSNPVHVYGPWED

SEQ ID NO: 961104 - protein, 170 aa, Homo sapiens
MVVHGTSHAIACLIIRFVDSKTRQQTLRTTCALSHWSNDCEAADHSSAQTLGRYPCHKLEYLCNPSGKISFCDGRSAVAHLALKHRQGKNHKMRIICLCGKPSWMDNENGSGETGYKRLKKDEKEMLTLSILGNEEVNTEKLTALCKHVECAKDGTGSHLVTVPPWAQYG

SEQ ID NO: 961105 - protein, 159 aa, Homo sapiens
VRCLAAAVAVGHGGLDMSLGPAWGCRVGGGGSELGRGYGARFGCLGSRQCVHGTMLMAMRSLLLGPGPASASCLLLLLGLQCCRCPPLLRGLVHVLCCYCAMVLPALPALATPLGAVDTCLLIAAFDACLLVLVDKCDPAGLELVVRGPGDLCLTWLHL

SEQ ID NO: 961106 - protein, 45 aa, Homo sapiens
MWILGAPAGWAPALVQTPVPPVNASYNSQSMVFHSDPKERRIHYR

SEQ ID NO: 961107 - protein, 227 aa, Homo sapiens
MSKSEVSVKSPVTAEEALALGGYEALKQLMRSLEVRRFGDKWAQRCIAYLCWLMKKHRKTTNSSILGCVGRFTHQCALLAGRLAVQNLWKCQRPTTRLRMARSCVGTQKSMRCRPRDKIRLEDRGVASHLNPWWEQEDDLGFGLGNLNMRRRLERKQFSAKQDEYTLVEARFIRAIDSLDRVDFDNFDERGARMAKMGPTGTNGGVGARYCNRYLVTGAHGTSLLVD

SEQ ID NO: 961108 - protein, 296 aa, Homo sapiens
MAMRELVECLNCVWCANPLMKLAGHFTQDKGPICAVRDLMAMCPLCPPGGPCDSECSPSQCLFGGAKRILSNDSSLCCDLKISLAVGPMIFASPLFVCSPDGAPSKDPYSTEFGLDRILGAFDDVARATGVMEASGPKEAVIPGPMVASPQMNGNGPRLLEFDWSPVEPFGETTIGYPMNETRLRAGPPNVGKAAPYLGREAFGHGTYRPFVLGEIWLQRQFPMVGILSLSHDRTAKRCNPLWISPPQMEKFSNICSLAERVYTRWKTPLFGVPGKGTPHDCPQRACGGPRRGKSS

SEQ ID NO: 961109 - protein, 104 aa, Homo sapiens
MCKYQEIWGKTLVTQDPMATEDGNHECVSRCSVLLLDSWRSVACTVCKQTDWKDDATMLVHTLFEMACSLILDKNLLYYGVVIDKPGPVETKTVSTSRGHSVGL

SEQ ID NO: 961110 - protein, 74 aa, Homo sapiens
CSLCLCLAVVACPVPAFVPPAYVTLPSLLSLSSSPEPAPRFLACQVALVVTWCWIDSLYWSSWSLSCKLTWCMC

SEQ ID NO: 961111 - protein, 198 aa, Homo sapiens
MGAQMMVLHCHVILILEPHCYATPSLDCDHEIICIGCPSPCHWATDACVDMWPLDKHACQPLTVGHVGVCNVHRNIACPMELGVETTRHIEHKKTIGTRTIAQMDREPQDDNIERATTTGPTKAKHMTPKDNNRTPHATTHRTSQHRRNKHRAHQETAAQRRSRSTPDQLADRSRQTHANNNAPEAEPRETTHNKTPT

SEQ ID NO: 961112 - protein, 236 aa, Homo sapiens
RGPVPEAPAGGPVHACDGGDCLLEKLASMLETLRGAGMGGLARRQGWPGMWSCAACIHDAGLVLLLMLHATDTHHANTFVLHACVANGWDGCCVALHCHSAGPRMLLLCCCLRQAHGGCMRAWMCQTTVCCLVGWLLVNARTVSCSYNGRDVGEGSLAHAAFHGRCIMMPLGALAGPSPGCLWAARSQRWEVPERLLQEELGELSGRLVEVQWWPHDGLAVVQPGICQNGYKQPSG

SEQ ID NO: 961113 - protein, 109 aa, Homo sapiens
MREICALAGRAVRQANRRQVLGGDHAMMHGIDPTGTYHGDMRPAAWNCINCVLQLMATWLASTVAPAAVLCGSWSPVHQWTPVLLCVALLGMIFLAWTTSFSVSDVVAW

SEQ ID NO: 961114 - protein, 115 aa, Homo sapiens
MDGRPEEKSPHCTASDTSSTMVGLFIQTRTDSLVCQKYTGWYTDSILGTECKGDITRVIATKCQKGQKKSEETKHSWTTRWYPGEERLDDVVNTLWRVDPFEEKFKVKIEVRRKY

SEQ ID NO: 961115 - protein, 89 aa, Homo sapiens
PSHVRRERGSRGSDGEDASSRASENRGSETTPSIPRPPKGPPPPHDLALPLLLLPSAHLCFWSATDNGESLQSRTRIAAPVTPCVPGPD

SEQ ID NO: 961116 - protein, 140 aa, Homo sapiens
MADVTARSLQYLSTRRTRILCSKTDLYSALTGPAVDEPTGEVLSLVGKLEGTRMGDKASRGPKRRCKRVERRMPKTNESVIEDRHEITHDEGLYYYCCRKRIEREWMGHTSTCPKNYHENSRQQRSEGATHHNITLLSLV

SEQ ID NO: 961117 - protein, 145 aa, Homo sapiens
MVCHCENPCVSARGVYTPSRKYVAKKGVVLKVGVRATGKPPPIGVAAFTPWEPFTYTENPGKPPGSQRLLGVHGPRGLTTSLSGEASYVNLPTMARCNPDSPLALCGLGIPCTTGRLLRGYRWGRGREVWLGCPSRTPGGLPLTL

SEQ ID NO: 961118 - protein, 245 aa, Homo sapiens
ETDLSSPGGPGWMCKGAILGSPKPPPPKVTRQFSGLKPPRDSLGRLTGALEPPLPGYKFVVFISKKTGVLLPCVKSAVSLKLLRTSMCRLRPCHQAIPNGACEIIHGCESTGVALVLLEGCNPYSHIMYIKERVSASNIYHQRCGAFRPRNLVPYLFRSHEAYGFGVRNNIFMCGDPWCIFSHRGHNTNSVYVETSFIEKIELASWVIILERPFIWDVSSGTKIRRARQNWCAIKETLSKKAIAR

SEQ ID NO: 961119 - protein, 170 aa, Homo sapiens
MSGLSMLRRPGPRTRHIAEGGVPPAQSGCMTVCDGPGKAGRPIWRACCDLLGGRSRANKVGSSDIFAHQSGVQGAFVPARPSGQTAYLPWGVQARLPIRARLSGPAVNPRGAAAGVARPGVGDVYKPIAPAQQQPPGSDPWAGSRSYRDGQSPWCCGGTFEKTLFDRLRY

SEQ ID NO: 961120 - protein, 133 aa, Homo sapiens
MCVRPHHILKHKENVLSPATSLRQPSQDQHVIRKENKCYPPQTCAGMWSAISDEGPEAPTPWRRGQKSPCVKWLKEEKRDPRPPNHRMPPVEAPVCRPQEGIIKGSSRGLSLKKNKHQTTNNKTHFVGGKYHK

SEQ ID NO: 961121 - protein, 204 aa, Homo sapiens
PNQKVPRLNLQCRHCSEMNSLHLGLSGTKPSFWSQGAQPQASQVISPTAPNPRKARWELEAAPWFAQVSQWQAGSSVTLNVKRTVTNKHYSGYLRDLGMRFRERHNRWVSVCCAHKNSKDIAGAHLRRQRLTRRCQVYGTRRGCKQRIRCSTRAHRKEARIVEVETLKRGIHTFKMDLQEVESITVAVNRNQRKMSTSTGLLGP

SEQ ID NO: 961122 - protein, 118 aa, Homo sapiens
AVTVFIDDESRLLLNPCVGRGTKRNGANGMLEVLLLRDVGSELSKLGNGQGRGPRGTTRRPPSHPAQIERAAWSPAQALAKGVGSPQTLHAHNLVNVKTLSKGRFFQKNLQNRGKIAL

SEQ ID NO: 961123 - protein, 164 aa, Homo sapiens
VGRMQMVDYYAVGPRLMVSDDEDELHPNIDYGQSLPLAASAPGVELRCYAKLPQIRVRNAWYLGQWCCLRLLAARCPECHDGTLKELEVALMAARQELDAPAGLMHMQSAQRRMRELVQQKLEEMRNEGEEVCPGTVDTLSKDGFSKSMVNTKARERRRRTQRR

SEQ ID NO: 961124 - protein, 255 aa, Homo sapiens
VYVFNYIFSIDNYIQVMKPGLYNSPPKAEEKQIHTQFTEEVTSETPGQTAAKDASWGQGRGPAAKAHHSSHVGAKSVGTRRRLWVEGRASPCIVSRETYNLSREGCPKLRESTRRRKHQRESAKRGPPVEDRMKRITVLRLNREEETTPLLPSLYRDTSVVQQSTDSYTTRDDYSLLAPGRAGEPQSTARNIYPTTRSSTYIESSSAQQQGAMSTTKIAYPRIHIPKAPLRDWSTPFPKEGYPPENDPLEHMERN

SEQ ID NO: 961125 - protein, 209 aa, Homo sapiens
MGSPGPFVSRPDLRGCCTGPQPALRMLVLPSPLPSAFWRFVLRGEPLEGPSPVGRCRSPEAGPSSSIVISPGFISSMGQPLSCLLDTQGVPYSSSSGGRGSHRGSQWAMWGSMAHQKVLQTAPVCSRGLRCTCPTFSRHRYHAHSECKARSSVTSVVKAFKRCQPLGTDTIPIHLAGGGRTHGLPASALARSGDAGDLAITVGCPLVHS

SEQ ID NO: 961126 - protein, 67 aa, Homo sapiens
RHVCTSSYLSSVRGYPESLMNLAYTCVPMCGYELFYQPARSMHTRLHGPGDFTDDHSRLTAVANAVL

SEQ ID NO: 961127 - protein, 81 aa, Homo sapiens
VVALRGGCVPRRWSCWMHCVRVQRAPATREGAPACVPSFATRALYVPCLVCPASPLPACQHALCGDCAVCAVLCADCAPVV

SEQ ID NO: 961128 - protein, 177 aa, Homo sapiens
MMLWCFICALASWLLPCAKVLHMQHVLSCAAHNDNVLAPQTWTCATCFLLSVNDGGEVDTPQQGDWCMHMRCALPVLVKPHIIPFILDEIGAYIEDRHICGVLARPGVTISSIEKKLSAFLAMPPVVILLLMTNTPCRCVLGRGVHLCMPPVHCTAQVEGPRDGSLAAACLMPAVPL

SEQ ID NO: 961129 - protein, 227 aa, Homo sapiens
MSLVIPEKFHAYFAEYSSTKLIDGRRKIAFAITAINVVWAEAYAHVVLRKADIDLTKRAVRTQLMDEVETVSHRVSAESIASDKSPRTGFLNRQKDVKDGKIQPGPSPMALDNYSSVKHLDATEEMIRAHRGSCVTSGAFVSEARHTKTTGRRGRTVGVSKQEISSVGLVCESNESYTLVQTKNPKPEGHKCGAARTGYDRGSGLNCARTERAWPGGENYRSPERGP

SEQ ID NO: 961130 - protein, 225 aa, Homo sapiens
STEPRLCRSCALSTPCRHAHHWMMISAALVCDNVLLCMCNGLASRCDDAPRAVFPSIVVCAPVHQWRDVCGMVSEDDSYVWLTEAQSKRVHPHPEVPHRALASVTNCGLTWRKSGTTPSTMSCCVAPEEHPCAADRCAPLNPKASREKMTQIMFDDLQPQPLYVAIQAVASLYASGRYNGIVMDSGDGDTHTCTIYEVYATPPCHPEIWTWHAVTELTTHEDLTT

SEQ ID NO: 961131 - protein, 129 aa, Homo sapiens
MLALTFGGLGIGRCHYLVAPSGNVWSLVYGKKPWNTRGLCHPLRRWWLRMEIIGILQYWGQPLWESLGHQTYGGVGDIRIALGANPGEPIGLRPGGPGMRSQGIWGPHHTRKPDGMCEKTVNIRGYGCT

SEQ ID NO: 961132 - protein, 72 aa, Homo sapiens
GKQGLGVAQAGSPAPGLKQPIHLGLPKCWITGVSYVAVATEAILNGAQTHSYTECKGPLHVDRSPSPLVFRY

SEQ ID NO: 961133 - protein, 258 aa, Homo sapiens
MMLVDLLRVGLQKGRCMSLHGALSKLIRSIRKRACILARCPPMALHTRHRLTADVTCPPSRACRHITCAASGINNWRCPIPGCPGPLRRLRPSCVPPGVESHFFVGYFPIVSLIRTLQRSLWDHTIPVPRGVYWLRLVPSVASRFSPPALLSTASAFSTFTLRLALSRAMSLSLPPISDARQHRHAPSSVLLHFTHYSCRVIIPRPPISSSRLFLDLSRVLSFLFLLCRPFRDRLQWMWTPVWRLSIDLLTQRWARRH

SEQ ID NO: 961134 - protein, 250 aa, Homo sapiens
HCAPTPHPHPARLPGPPQASPAPTASSSSVPFSTDCEDISTCVHYARQHASDTGYDDNDLTPQWHRGDQFSQHHAGLLKTPSPIQRTLIRAPQGRGQDALIYSAHLAHETYTDFLAAPRTACPSLLRRSSTLRPEPRLHLRYCAVALAGTCLPRLPWPLGISCLLLATPFRPTLAHTTTAPWLAPRARSGPSGALCIGPPPGYSLPDHLSPYPTLSSPQALASPGPRSLLPALCSLRLQPHTVHSPFVLP

SEQ ID NO: 961135 - protein, 225 aa, Homo sapiens
WNSELLMGLRAPQRVPGFCGLKASETWGSWVSKHHLAIHYAGRVWGLFGMVGMECAAVQGITKIKVLAIFQQAAVGWRLSASSCDLDVQQGLILRGPVARVPRARVRGASFVTQRVQQDSLFERASIVVGREGASTFPRGVFLQAGPSEFLRESRSISRDWDWYVSALVSVVSAVPTSARRCGAPGGALLNRAETSTVSSSSGFFRASSSYGARMFGMIWGGPEF

SEQ ID NO: 961136 - protein, 105 aa, Homo sapiens
MLLSSVCQWESGAGPGLVFPGDVISCVMCVVRKGALKWKGSLPLSCHGICGRLCSAVAEWDQCDGLSCSCDDHKFAMRYALNRITGVEEQVRQRTPSGSGFYLLT

SEQ ID NO: 961137 - protein, 261 aa, Homo sapiens
MDDTNQPNTQKQEHITRTEKKKTTKTKNTQKHDTEEHKAQNESKTKKQQDKNKDTHTEKKEHQKNKNNKRQRLKGTERGTTTQHKHTEQTKNNTKKSNKRHEQENKAQRKQQSTERTTHNTTHDSKQPTQTKKIQHKQQQKQNKNKKKKNKKEKQRTAINEETKQDKTEKQNNKKQQEDRKAKKHKQSTIKPQKTHQKKQQQTNRRNEEHKNKTHQNPNEKKSKQNRNTPTITEKALRKNKHRTHKEKTQTNKKKPNNTKN

SEQ ID NO: 961138 - protein, 32 aa, Homo sapiens
CAPGEKIAPFGSRAGANMWGRGFGPQNRVKEG

SEQ ID NO: 961139 - protein, 117 aa, Homo sapiens
VCCDHRLRSEPAAWPQQWLGDVGTTISCGAPKELGKCWREPGLSRFCLAAVVRLRPVPPSPRCVHIRSCLCPSGDWTHILPGGAMKLGPDEARWAPCSLPLSRGVLASPGFVLSIRI

SEQ ID NO: 961140 - protein, 67 aa, Homo sapiens
GLFPLTGVLRPGVRKQSTADSCALLSHPDGWSLCASCCDPVNLGAHRCDPAAPAPCLPPVGFHHDRT

SEQ ID NO: 961141 - protein, 215 aa, Homo sapiens
AARKAMPDSGFLGLRAHFVWTQTLMSVRAVRCAQRNKKLGACAVLLLAQGCLLVCVGWLTQYPVRTVLATCDAALTLLCACFVMMCPQSERTRYFCCDSCASKVRNMWLDKRNDETKRSETDKSPCIIVNGRTAFRGVGPSNSRSDGEPAQYPRKGSPVDDPQRKKSGNVSSAVPGPLRNSQSVVHRSESFDRKEGKEPFPIVGLVGNGGECQWP

SEQ ID NO: 961142 - protein, 159 aa, Homo sapiens
LTSLTRRWLPGPSRFHAGAAAAATWQRPRTGVGRFKTNYAVERKIEPFYNVAGKAQRGPDWPAPHSAVCGTRVNILEVASWGRCCWSLEQDGPWRTSTAFDHQPMTIEVHGDMPDRAIACWLSCGLARVAAITHACGKADTHWTPVANHGLSDHNLHFC

SEQ ID NO: 961143 - protein, 122 aa, Homo sapiens
GAVVRSQEGGVSICSLLSTVVVSLPTLPMEKLVALLSPKGLAGPGACEDVSSVPVMTKTFASFRSECEAEVGWNLTYSRAGVSVWVQGLWRWIGTLHKDQCAGWTGACDVASLRHSTTVPYK

SEQ ID NO: 961144 - protein, 235 aa, Homo sapiens
FCTLATREVFLEAMNVGPPEQAVQMLGEALPFIQRVYNVSQNALRLSTPCLDSAPRVLWNAMVACTVLSCLHDLWLLCGQGRESRGMSLLGRCGELEILCRPCELSWSEEPQTVTEKVWRPAQKRPTLSVRNKTPQPVVSPSAYYTRAAARASPVCWCRAEQAGVGCRARRARRVAPPSPVGCICGPMVEVPSVPGCGGSILSSFLASDLSSSKAVLDPFLPGGGLSPGTVPQGW

SEQ ID NO: 961145 - protein, 160 aa, Homo sapiens
MPKGKRARERRWSPAPVVVKKQEAKKGVESPVLEKGPKNLGMGQDIQPKRDLTRLGERAPQYKSCSGRRAILYKAGVKGAIRGIYPGFTQARDRQTDTQRGFKRVPQVTDQKNKARKRKPENVVGPGAEEKEGWRDKGGRPNEKEPPGPCETGGYTTRSH

SEQ ID NO: 961146 - protein, 213 aa, Homo sapiens
GVETYRLSHGYTVKAQPTAGRPKARIPQSLTSVSADETGPCGVRCRTQKKRWEPGSPPECAAGLAWWSPEMAACMTMPSDHPVCMHVVHVLVSHPNGHAMMPVLQLSPHAVSNDLHLDVASNDMPEYNVLNPHDVSLKPSDGWHQSVLSDQGVLGLGVVPRIQEELTPGLPPSISYRLCPSDHQSLTPVKQAPGPGALSATTGADTRAPGSPR

SEQ ID NO: 961147 - protein, 211 aa, Homo sapiens
PLQPQPKSRWIRDVTHGLTRIGAHSHILGTGVSWTDALEPRAGFQGSLVGSAGGTRGRLRVVLDDDPWKGRLPVVQSLLLASPGHGGKTAIAIGPWRSALEPLQRHITAICRSSESLSPLEIEQDRGRFDARAITGEGPIGPVRQFHREAKTRSIPSRNESPDYGCQTPPGIGIPDPGNPRANGASIGLAAKNGGAPYKGPNQNELRRPRS

SEQ ID NO: 961148 - protein, 300 aa, Homo sapiens
LTLFALVCRPGSGSWSRVRGLTADGPGLVSPGLVPVTPGAMNACDVARGWLPAVLLDNGCNLPARAGVRTRTPTCCRAPQGLLDDGNDVMCKLTGWQGQLWVMGMTGKNGVLSELRALRAHTQDGGCLENIDGHAFCEVTIQGDATVENHAKRKMRCFTWQMGCLKDLRVPCSVPLAGNCLAPIPDRFNWPCLQAHIVVTLAIKGGFGWQPRALLFDLFRTLYLAPLSEKNFFFGYAPFSVVSTNAHIGEPAGEGLIFSSASPVAPARWYKVAWRSDSRLPWPLNGLERRLLFQTSFGGS

SEQ ID NO: 961149 - protein, 40 aa, Homo sapiens
MSAAHEPFQSILPDRSPGRARWVTPVIPASCEATQAVPAV

SEQ ID NO: 961150 - protein, 229 aa, Homo sapiens
SCTQCGLHGLSPGPSMCSGLREDLQWTQSTLWQHDEDALADTDFPCNICGKIVHAARHHDGVTCGANLGLNALRLRMSVACAYTRQYRLMEHMRVHSGEKPLRVPDCAGGNVHPSSANLISHLLQLHISHSLEAKKHRGRPIMPTFASPGTHGREKRGDEQQAGGKHPGSKLEGSWVAPLGPKLHNTQELKWNSSRYQCKSREEGQPESKPCLATQIHPGPHARRGEPT

SEQ ID NO: 961151 - protein, 121 aa, Homo sapiens
DSSILVILDNPRSIPNTPKKGSLYSPALVGRREGRQATRRPGVLFGKVHTNPVAFPFVGSKRRKTPWITQYISGLINVNTGAQKERHTLECGFTTRAGCCGDNLSSLSTQNICHMMCTPSV

SEQ ID NO: 961152 - protein, 225 aa, Homo sapiens
VPTPACLALPVCAVRCFAGLVMFCCGLQESGCLLGLVTCGVPRRDCVTGGAGCCCGPRDSCRLHIPVPAHEMPPHVKSPGWTEVMAAAALTMPVHQPSPSGGPQLQPSAQSLAWALEVSALCAVPPVQLHACSMQQWRLGDGDLCHVTSPLRPCPVSPNCPPIAAHFLSGEPTLRTKEEPGPGHCSSVCGRSCGEVCLSTASGDSRGHNPPGLHLVRHGSSLDQK

SEQ ID NO: 961153 - protein, 104 aa, Homo sapiens
PLLAWLPLRRVDSSGVYFRGTLVQRGVGLGRIFPRPVVCDVCGSLAALMRTSQAVVTQGSLCFGTGIYRVTLGYRGRGHPNVYTCGATHSSTPVCTPAGWRLDR

SEQ ID NO: 961154 - protein, 109 aa, Homo sapiens
LLSLPCVIPFLFAWFLIAVLTPARVFRGPLSSVVADGRIFQAGVVSWGDVCAQRNKPRRVHKAPSVSGTGSKCTIWGIGAGAYPYVYTCGAYPIVLPQCARLQAGVLDR

SEQ ID NO: 961155 - protein, 241 aa, Homo sapiens
RRRMLVVECVRTAAPCVWGAEACAVPSVERLGVGGLHGSAALPRGPRQNSLPGASLLLLMPEEALALVPEILAAVTLVSCPASRLSCTTACALTSFKRQQEESFQCCRAALCMLSALGDPSSCEVLEKITEVPWLLMKQKQNSASGCQLNASEAWLEPVLPKRIETSDGQASGEQEEAGPSSSQAVTLKWGSPLAQICSPCPAGHCQASTGQGQALDWRVQSKDGPSGACQNWAKYYRELW

SEQ ID NO: 961156 - protein, 134 aa, Homo sapiens
SLWVRIPTFQPATCVRKKITIFIYDPAPKKGLKTQKNKPYGHRCGADRPHAICPRSNERQGQLYVKRKTKLNTFYTTKPPTNFWDIAGLGTQQSYTTGGAFGESRDKAQEHKLSAPSIIVDHTRSSHSLYGCAK

SEQ ID NO: 961157 - protein, 176 aa, Homo sapiens
RILVNFILVRITVHEMITSYGSLNLQIREIIYKILQKHSKKTRSSPISGSGSLFTPKLTYGWSSLGFKISGYYYWCLPSFWIFLLVPQCQNFQSLLRFQMAIFLVYAISEQSSMDRLVWKERMSWPGAQLFSPWCTLVFSKPGAPSFGKSLLSAGGTHQQVMGPVNSPIWVSRCRE

SEQ ID NO: 961158 - protein, 335 aa, Homo sapiens
ADALRWSNCFFGATYRPPGDEPSNSLGATLAAVMSQAAVTNPLRVSRVAVFTTSGCWTQASGRRHANGRPWETIPSGLGTGPVPAMGQGPRTTQPQGAAHVVCRRVRRGCSLASLQLHICNAFCDSHFSAEESSLGGRCSQSRGSQTLAFLLFLSVYQDTGPTCHVPEATLAQPAGRSLLPGCRLEFCARRIQCGDGPCRIGEPGPGGERFAVSVLIHLMGTSKGPSMSSLHWTALAVPCSPRWDSDPCAHQSSPAAEWGHQPAPTRVTGALLACTYCCHSPHWCKWEPPPGAWGHSPLPHIRQRPHPTPSVSCTCDSMVHCVLPKAKLKAVVPN

SEQ ID NO: 961159 - protein, 239 aa, Homo sapiens
QLRRKSLSRATSIRCPSAHGPGLSVGRGLTPSCSSPPPIHAHISLPPLLVLHVGLLCLLPALPASVSPCSLPPPSVTMCLLVSLQLLPSLQWLAPDTNSLFPLMRWEAVTHSSSFPSSPDSLGSVAPVGMWKMASYLLLCPSPLLASVPVRDNAPGGMAAGRCYLCFRSARRPLQLLEDPYISCFIVTFGDLQCEGMQGDGIGIPTYDPPLSLMPDVSPWQGVLEARGNDKHRKAEDPG

SEQ ID NO: 961160 - protein, 161 aa, Homo sapiens
LSVSFFCAVIVVLVPLTRVVCVSPPLVDVDSRSCTPLLFCGSCSSTYFFTDDVFPFVLFRLWRVLSFSRVVFTHCGFVWLAGFGVSPRVDLWVVLYLRVIGVILCSRSSVSRFVILSCRYVSLYGFRSKSLFSGDLLCGLSYAPMNCCLFKGCFVRGYVCW

SEQ ID NO: 961161 - protein, 89 aa, Homo sapiens
VSKNLLNKKCRNPGLVFGTLGWARRPRARSNPPGPWSGRRVGCGCAGSLGALPENAGYHLLLALCERPESRTVANSPIGELQGPCCLEM

SEQ ID NO: 961162 - protein, 210 aa, Homo sapiens
QYWSKPINILWEEKSGLPSTIFIFSEANRFYKYIFLVSLETRNSQSSPLWPAGEALGKGNLGRHLAPSLASSPGGNLHQSIVGISWGPPHTGSGHIALHYSSPVRHPPTSLHLCGLCSPTNPPRHAGVAPRALQGQCRPIISEITPDTLEGDIFSPPVAVVRGGENFSPNLLLLPLLCVPRRLSKSLEGAPQLRGVETEARRLSGNIRSG

SEQ ID NO: 961163 - protein, 216 aa, Homo sapiens
RSNASLRISRRRIHSRYSSIMPAATAAGLLSKPVRMLRDPAPLPGVGSAPPAYQLRSPPATTTNLRGPLPGYRARPDYRPRRLAVTYGPYPGSPHTHPAKQRGTLTTPTYRPEARRLPPAGSTQGPVYQRAYSSGPAYRVGTTKARKTSLGRGRTPGEAAPDGPKLKPRRTTPSLPHTQRERRKPRQEGPPSTTRPYPPPPPPTAPPPRRHRADRT

SEQ ID NO: 961164 - protein, 286 aa, Homo sapiens
GKPPRRENPGTITQGQPPRVLQLIAVNRPTPVGRVPFEPVGRTRSPKNSQKYFPLPSEAIGKKKRYWVYKGPSSLHRILYPEGYMLSRVVESSSSALIYAANLVWAYVPISIWGRRYTLRQLFRQIFTILKAYNRVSLGYLLCPLWCNMRWSPTTTIYVCPPHVLLISRALSPKNTVEVCVAGVFETNATVCGVLCAHTCCRKRTRDSRTYSVCGDRAPCVTPAMCGVSPEDMCGRQNPTAQEKIPPILACPVCGTKLSEIYKFETPVCCFTTSFIPPQEFNSPFP

SEQ ID NO: 961165 - protein, 142 aa, Homo sapiens
MAHNGLLSAERQGASFPSWFTPPKETCPHSMWTHGAQLSNSVRKQLVASPLGCEMGTFQRSSLGEGAGSARPWRLTAMAGPGSSSPPVWTPESPSETIPGQCQRSADGGVVPANVMSLPVGALSSGLCSASLDGLRSRCGVW

SEQ ID NO: 961166 - protein, 148 aa, Homo sapiens
MSCFTWSTSLACRAAARLAAMALRQWPMSLLVAAPASSSQWACVHRAAAEGPLLPERVGCLCCCQCTWLCSAGVPHLLRSWSWLGNAGPATTRMTLNHPPPLQLAILQLTEELNNAAGLAVTDSPRDGVLPNIQAVLLPKKTSATCGA

SEQ ID NO: 961167 - protein, 252 aa, Homo sapiens
AVSYAAMAAQPEWHGLEAPLPQGTCSWRVVDAWFNQPAPVMILQERIGPVKPRRAGDRSRAPLSGSHPAHSCVCPHGSCTTTKGARRVLLASSLEGARGWPSIPLEKRVWSSGTTRHFLVGSRGDGGTKSHRHVLVALPKRSQSGLTGSYRLHNSINLSFPEEMPLRTRPGRETVSVGRTENCDTQLSGPVMPGPERSIRRGKLGVITEEEKNFKARSLSLRMARCRRTALRHTGKKSKEAEKGFEGNKPRA

SEQ ID NO: 961168 - protein, 131 aa, Homo sapiens
MRKHRGKSRPATSRKGQCQGGWTRKNSCETGEEEEGILGQEILGRRRQVTHCQCRPAPSRGGGSFRHVTVQLVLPVPKGDTLAAMTPKKYIGTISYSQMAKGVKENKKDNPETSRRTSVASGPEMEVLPKT

SEQ ID NO: 961169 - protein, 177 aa, Homo sapiens
TPVQLGCVPWSALCGPCDGEPAVASCGVFRAVAFGAGVAAVDGGRGRGRGALLECNGLRIRSGCPVTKLGACLVKDMKIKYPGGDLSLLPCPLRNQRSLIFFLGASLKDEVKKIMPVQEADPCHGSAPGFKGNSSYIGDYNGHVGTGCKRCYQGRVATRHPVGAINPWPRISNQYPR

SEQ ID NO: 961170 - protein, 90 aa, Homo sapiens
LSVCGAVRWCECPVTLTLSPAFSEGPRAAPATTELPAGLKNIWPCNTLAMTTLSVELTDTCDACAMTVLLQRSKEIVAQTISQYAVCPSQ

SEQ ID NO: 961171 - protein, 76 aa, Homo sapiens
MRRRYFKLGKSHNPGDVSHVVSFNPSTDTGPLLGEEGPRACVGWWWVGSPLSLIEQKVVWGIEPGYMTWDVVLRAH

SEQ ID NO: 961172 - protein, 287 aa, Homo sapiens
MSSHLFMIGCSWTSPTIPHALLRICPPFGRLPLDVSRAPDPSRVSEPPSISWSVKLCWEVLRACAFRAVAVSATRNPMSLTPVVRVLSLPFEFESLHCVSCGSRQTYPPWVWGYPPRPGSPFAGHTELPRPFCVTFPQPDNVLAYTWAALPTHMYACAHYLCYRGHAFAAVCSFIDDPQFGVRVSCAFLASPFAKPLRSPGGGCTRPVAHLQRSVAFEGAVRTRRPITSRGPRVALSRQPEDFLGQGLMSGGRVLPRGRSHGKASLCLDRAAGMFLLGGPLGYAYLV

SEQ ID NO: 961173 - protein, 192 aa, Homo sapiens
AGAEGGAAGPDDGVGGLWPPRGSCPVLLHLLLASVVHCDVACVVRSIDCLAPPPCLGSLLRVPRAWDCLLDLPASLLDTCAVCQQSLQSLAVRLEPKLLALSINPSACCMPARAWSCQLSCAHPGGAATAEIQQVGVILVPRYACQECRQIDLVDNYFVKRHNLKLLAVLMKKSEQVCTSCEDNCKCSRVRV

SEQ ID NO: 961174 - protein, 193 aa, Homo sapiens
RARDCRRGDSMSDQQLDCALDLMRRLPPQQIEKNLSDLIDLVPSYVRISCLTVDQTTENCQRQGGVERITFMCDYNRDGDSYSVTMEYKYDPTLWRMGPCRHDSAEKAGGVTPTIAFEQLSRPVYMKSGRLICLTSGILESWVKLGVILITRRLCRWIKEDQSACLGYQYHVVKSAGEIHADAAHTYKLNSHG

SEQ ID NO: 961175 - protein, 122 aa, Homo sapiens
MRCLQIHSANVTLQKWGDMEACTSPWSCHNLNNNMDVESRTDGYHEDDTLASRGLLDADHYCYLMAQCGIMVYTRRKLQKLVLMDPITDYDILKVRNQTKAYQEDWKPMSTPSPWGDRELTP

SEQ ID NO: 961176 - protein, 100 aa, Homo sapiens
WNCINVYYNDVPPVLAKYVPRACARVIWSPAPWTPVLLCVCPSGHDLPVPVTDFCISVSSVCCLVNNLWPMCVHYTECAAELCVTLVLDVCEKCDVLRCL

SEQ ID NO: 961177 - protein, 210 aa, Homo sapiens
MWLDPSLLACLPLPPRLPCLALALGLLQAAPMCCWSWRPEGDHKQPPPPAAPGLFCCWASQAVLTRDLRPVQVASLCATLSAIVALACSMRRGECQPLHGARARAWAGGLLKKAERRDWRQSAAQRAGHGVPARRIYGRQHGLGCIAGTNIRLTRQYRHRAWSETTMEVPNPKTREPKAYDDPTWDIALSCIVGANDTWLENVKGLAQKA

SEQ ID NO: 961178 - protein, 301 aa, Homo sapiens
LAAWMIACIGCHVLVDVGLKMCPSALMWHWSWLCERKPVCLLENVLACRNVCESSLCLVSDCVTPCGLGNGVLPKWVCGGDLGMSCGPCCDAYLCGVTCVGLMPVVEPCPGMQVFPGTAELEIKRWLTLMCCLLATNVLFSRWGPPPTLGLASTSVVCPPIFWLEAHGPLALSPRSSFASSSGQPTAEQSLSSPRGMLLLDWGVGAWLELGGMPGPCSKSATRSDSSGLRASAHVEPFACGAVAVLATPVSGATGRGISREASRPANPGVKRGLGPYFPSWPGYVSRKAPSIRMCRHTERG

SEQ ID NO: 961179 - protein, 226 aa, Homo sapiens
GTRGNMAVREPGSLRSPTAAPGCAGAPSGTVPVLFCFSVFDATLVVCHTGAGYELLIQNVPHAMYVRPDQTCTCKIRGCSMIRLMEVGARIRWILPRRGFAGDAMQLQGVQPSVHAASSMHQLPLWDNLYHAYNAHDVIILPVSTARKRVHEPSHSTYNLACYALSCVEHETLSAKVAAEYSREVRVSLVEHVTTYRYNGLMETPVFKHNWMLTGCKHLGTFQEEP

SEQ ID NO: 961180 - protein, 273 aa, Homo sapiens
VLSHYKVLRSQTWVPRVSCHRNAQQQAYVEKVKSFPKDDPSKPVHLHSLILGYKAGMTHISAGKSTGRDTKVNKKEVVEAETICRDTTPWWFVRALVGYVEHPYEAYRNYTRLSYAETHTSDRMHRGVSIRNGTKSKKKAYYPHTAQKLDRMRMASKPAGERTTGSTEEVRDKVIQVIKDTAHQNNSLQPVSAKNARPTQDWEKHRVKREATCGPSKHGQGTANQAMHSKKYLRNQRRKDRNDMNDDNRGCQRAKSTRGTNRETQETARKQQA

SEQ ID NO: 961181 - protein, 260 aa, Homo sapiens
VHEAQLLSIQVAPSVLRLTMTSYMLLPVCLATSSFWSAWWLCCAPVRFVACVVSAFLRCPAFTVWCSCAVPACCILCPPARFVSSSSSGVCYCAVLCILCCAVTDLAVLTGLLAGQLMNANHAEPQLTCLASYLVTMCAAPWRLANWRARVLKDPRLGTMKHVGLGPPCDYSHYYTTILDLRDKILGATIENSSDLSCRSTTPCLAADDFLNQVGDGHRLCCIEQLNADINWTAAKVLDELTWQDRPGNADRGLKEELAT

SEQ ID NO: 961182 - protein, 78 aa, Homo sapiens
SPAALAAYKLVLILDTVDERMEPWRPRFSGWYDADLRPGGPRGGEALEGRRYEMLAMRFDICIHHQVQTESDPDPLDR

SEQ ID NO: 961183 - protein, 183 aa, Homo sapiens
MWHSRAGVAAVDGARGHRGLRELDGVQWPRIMAVDCPVTQSLGPALVKDMKIKSLDGDLISSPMPINGIRDHLISSWGPLIKDEVIKKIMPVQKQTRAWPAHQVQGIMYAIGDYNGHDRLMDVKVHPQEDGHRPSRGEPIIPWTKHLPLVPVTAGRLLGRKPRSAKHPHMSPAKGDMGRLQAS

SEQ ID NO: 961184 - protein, 161 aa, Homo sapiens
MACLLLLLVSLAVGLLAACTCCWADHAAMVPCPVLGAVCMQWCRWRWVAVCMAGVPHRATFLPGGCRWKMSQERPTFYRQELNKTIWEVPERYQNLSPVGSGAYGSVCAAFDTKTGLRVAVKKLSRPFQSIIHAKRTYRELRLLKHMKHEQCDLVCWTFYT

SEQ ID NO: 961185 - protein, 247 aa, Homo sapiens
MASAGVAAWADMCWSDVFACQRPTSRCLDTKPAACLLMPAAGPCASTCSSLPGATDSVTCPALREEENYSFLPLVHNIIKCMDNGQPWRSTSDLNCPQKQVPVMMLQCSSCTMPWHPPEPLNMQQQQLQSLREQVRTNEELLQKYKSLCMFEIPKEESDGYDFLRTDVGKPMACLPTTIPKLLLWGCWFPVDPQLSSVKLQWVRVAPVACARCIACCWSQRKGLVRRGFLVSLHMLECYNWSAVGKS

SEQ ID NO: 961186 - protein, 259 aa, Homo sapiens
EACHMKSGVCGLLPDLRHGNALYSSNLRDDTEVPFLDAMIMCPLARSTCAGPMPRAPCRPTTCARAYVPVHSLCLLCCPSAPRYCPDNGQGSSGHLPLWTRIMEEPSGRTEPALRDQHTTRRMQRIRLLQPALETQLRQRHDMRDVTARLRGSSCQQKRGMAKTRPIGGQRGEQGPRARGQDTRQPTGATNSTTGSRAQDNKVGPKRKPVGGQQDPDKPRENEQVRRSYTIAAHRAENDPRRPNRGEAPEQPTEKKHPR

SEQ ID NO: 961187 - protein, 269 aa, Homo sapiens
GWFVVLVLIVHVGFSCGLPSLSGCLVLSNILRRGATCISDSRRSSTQGRLEGGRSRVGGRRAVQAGGRLMGVKRVLVVLAGSCAAGRCLAWGMSMPDADACCSGGRGDELKQCQGDRWTAEKYSFMATVTKAPKKQIQFADDMREFTKFPTKTGRRSLSRSISQSSTDSYSFSCILHRYALMMRFLPERSSKTNSKGSSNFCVKNIKQAEFGRREIEIAEQDISALISLRRRAQGEKPLAGAKIVGLYTITGPDSGVIEHLCSLGVSPV

SEQ ID NO: 961188 - protein, 223 aa, Homo sapiens
MSYNYVVTGPEAHRRERLRDLDTELRPKTYTCGFAKNTRLEIYVCHRLSGLLALKEVGMYGKIAGHGAETVPNGGESNGPAVYLDSEVQEPDILEYKQSGESIDIITEPMAMYQDRIGRPSETGIIGIIDPEMPDDVACVYYDGLFKVITSRIAHNKEVTAFNILPGRDLHVHRMPSSYMVCQAPTILVMLPGPSGRRVKTYEVSTERRTPSGPWNRTFQSRL

SEQ ID NO: 961189 - protein, 101 aa, Homo sapiens
MDRRGGGTEEDISRPGAARPSPSGLPGSYRFKKRTELSCAGITRHVYAEGQLNMACAPCGTSLRYNRVLLEEKPETVAAAGIRNYPVIPQPETRRPGGGAG

SEQ ID NO: 961190 - protein, 107 aa, Homo sapiens
KKARTGCVGLQINLCHVPAIHDRHGQHWGCSARPGCLLHVLGMSSQSCWQGSLALKWTACGPVRSRSKLHSGRASGNACSDQLHAQRPNAPRVAPAANGPSQTSTPT

SEQ ID NO: 961191 - protein, 270 aa, Homo sapiens
LRLYGPVDGLLVTGMKGSWPGVTECRLCAATCSCGLCHMIPSDGTPDTGNAITKSVCLLSTWPPLLPTPVVPLCSDVRCWQILEYMCDLDAESATYVVLHILVLKTNCVPGDFCYVWWSSTCVAMVWLKSAVSKESAQPARLWCTRPAIEQLEKITFPHVSRLPVNQAPGMSSEAKPLYGTNWRTQNDAKLTARGRPHGGRRGFPSRKGSTLSDRRRGRFVGASQVLRSVQRGGVSKATGWPGFSGCEEGSWEPARWVLRRVIRRWTRPV

SEQ ID NO: 961192 - protein, 278 aa, Homo sapiens
TLGEEDWGGYAHPVKTIHAATQGTQVIEGTPITDIPTWGPSSTLMPGHILDSLRPPSQHTETAVVVNMPAQATVCQPSAPGRCPHCPVWWQVCPPQDPPACGQQCTWQVAPCMPSTCLPAQPVHDTSPQWCPCHQWAPHNLTRAHGLQMLLDHWRGEVMSYTDPGDTTREMEEGIRTSNAERKQFTDLKIVLEGREFEVHQNVLLPAALYYQGPLIQQVRAKTACTAGREEDESIGPCRNLKADVLGVACWKFDYTGVTWSSNSDNAKHCWWRQQFRS

SEQ ID NO: 961193 - protein, 143 aa, Homo sapiens
MVKYFLVPERAPDASWDLVVRRLLGMRVTRIPSMQTCLDVKTQYTVEVTPLHQQDCLFPADSLEQDQQDSHCWAERPISCQCCSLGVTSLAVISTCWTHQNQTMTTFTWNINHARLMVVAERCITVGTLTTVAGTEIRRESWS

SEQ ID NO: 961194 - protein, 124 aa, Homo sapiens
EYLDEYYRLDYEDIIDDLPCRFKYRTVGALLTLASATERDPLLTHKEPQPAGCSLNERLHVQRQQQAGKLRDKARTRHEGPELMAKSGRLFNVTLAEQEAETPAEATGKPQRDEAGPQRQLPAL

SEQ ID NO: 961195 - protein, 127 aa, Homo sapiens
RAARHDGPAGVLGLPALRSCLTLRALALTHVLHALHTLTVRLRYTLRTSALLALHNARRKRLTRTATALTRYLPRAEEASYFSSAHCDFKLAITTHYTQQPSSSSTRSRKKPLPLPNGPRTALTHAH

SEQ ID NO: 961196 - protein, 61 aa, Homo sapiens
MGKVKVGVNGFGRYWAPGHQGLGSKASWGNTGGTYLRLRPIQTGKPPLSTCDALQTLPVGY

SEQ ID NO: 961197 - protein, 181 aa, Homo sapiens
MLAACDVDFVPAKGLATSVLLSPVTSSVDCAFQLDAGDEAGLVCLSVYMHWPTTALVVLWCWVLPRWRLLLHPLVARGWLWCQCLPSGICPSVLGLPAVFTTCGVVLRKRAVTSMARFPQLDMHQLRQLPWTHPSEQHVLLAHGAGMGVDLVLNSLAEEKLQASCEVLGLRTVASWEIGKF

SEQ ID NO: 961198 - protein, 145 aa, Homo sapiens
MLPALSNRAQAAYSQPSRPSSVGCPSCRGGFAARPSGPGCSCRARSHVIGCYRPPRGHLGQRHQGHDRPQSLPAKFLALTYYWRATFWFPSLTRRQAAQSRVLPMSPLLVAHCVAPTGSLACAPFVTSCASLAIHAIRWGDQLKD

SEQ ID NO: 961199 - protein, 199 aa, Homo sapiens
GLMLIPRVSSCAVLQYFVPGYEDLLQKIALEARVRPEYGLGYVMAESKLSESTALDAQATEDQMELRGHKRWREAMNAWLFPVARIWVSEGSRERFRGFAVAPEAAGPRDGSVSRVLRCSADSGCMPDDAHAWLPVPGGCVVLGASSWRILPGILLELGAGIGIQMAGQEGAGARGMFVDEGSWVSRGSVLQVLTRATT

SEQ ID NO: 961200 - protein, 239 aa, Homo sapiens
MTILHKCPKTLGRYLVVPGQERGLRAIKQEKPVVTWVLCGEGLVVSLRRAQGCGGRGGQGRRGDLEGWWTAQLQGGLLFNPRGEVGHVGAILPLVKFHKREARLPRGEPSLSSGPPRGLGCGASRRIWGPVLQESIRGVGQRGGYTTSRCVHANDLFENVALDSRGKPSPMRASYPPKTNWDRGVPQSCQSYTRKPPGSHGTGPVGGQGHNPVWDEGKRAWPQTGGNNKICAMGALKKE

SEQ ID NO: 961201 - protein, 219 aa, Homo sapiens
CLDEDRQQGGMRKTIMLEAMIKKKEFQREAEPEGQKTGEVHDHEDVETAGNKRDAKSKSPMSTSSYTSYEKPGWLDCPLLVADVLALCVCFDTVWLPLQSRSRIMLTERKDDYRWRDPLGDGLFLLRDPLHCSVAHRTLLFLLRAPGSGDSALPNLILMTADAVTGARGEEGPRVQGGAPAEHFLALILSSPADELWAWVSCSRVLLFPGRPAMLALGH

SEQ ID NO: 961202 - protein, 231 aa, Homo sapiens
WGKKPGPGARAYPKKKGVYNVHGPFFGLKKCTFISKKKKVHKKCPLPCGPPFPSPLSCVPPLKPPEEIEPLWLWGVGVREKQTRPLRESERVSKTHTLCERGAIFSLSQEWREECVCVRKKSVLSQKCVSRKRKSPSLCVLYFSFGCCVAPRCVVLSFRRATQHLLFFNGDAPQNHPRSVPSRLCRRSRGERFLLWMVGTSIIMKLFMFHPRRCWYVGEMGGKKKGVAPND

SEQ ID NO: 961203 - protein, 54 aa, Homo sapiens
RAHCLPGQYRGVGASCARKLAPTEARPEVILTNFQASSTDARYAECGLRILGLP

SEQ ID NO: 961204 - protein, 233 aa, Homo sapiens
SGLVSLTLLKLSEVRNIWKSTGWAEASPFVEAPGDVLLGAWPSFSRLAWCRGRAASSKAGLGSGPVLGKPCDDMGAVSGTNSRITSPVLKFFVFFVEETGCLRFLVPSGSWGCCCRSGSQIFPLTWQGLVASRGCFTPNSSLALKPPLSTLGGRTCVAPSNQSPRGNDGRAKRKDVLGFSPNCFANEWSLELSFDRSGVLWDRRVWLTRVCAGGYRGGCRPHNANPVFFKMAK

SEQ ID NO: 961205 - protein, 139 aa, Homo sapiens
KNGGEWRHKGNPPPWGRPQRGGGRKEEGGGERERGAEGGGGPRRRRALWGEKTPPEGHTRGEGSSLSEKRERRTQTRKSTGEDPSSTTGGRGEEREWCVGRTRRGRRRPLEEGRDEKTQRERHRREGETQHESLRERGV

SEQ ID NO: 961206 - protein, 116 aa, Homo sapiens
MSQREGPVAQGDLLLGLPGGGGWQAGLWAMAPGLGWGPGVCHSSVLRACEHWPVLGTSPGALPPEYWGGVPLVALKRSPVCPGMVRGGQGPLWLGKGLPQGEPVCAWCLMMVTRVR

SEQ ID NO: 961207 - protein, 206 aa, Homo sapiens
AAAVPPSDGCVLGSPVPRALRPGPVPRTECVPGCAALGCAQAGRCAVRATPCKVWRRETPGRAARGFCPKPLRRMSAGSPALLYSPARTLDNAGHRWGNWETSTGGEVHPRLTTEERTCQGIFLSAPSKAVHECNFPGAGQFRGLKNGHESKTTGYQPEWRDTVLVPWKGELVKAQTPGFPSIQGAVGPLGTVGQFDRKARLSLIK

SEQ ID NO: 961208 - protein, 118 aa, Homo sapiens
MPGMCFLPRSHDDTGILDSIGRFFGGDRCAPKRGSGMVTHTIPVKNCSHTVSLPQNVTRPDPRRRPRSPLSSMNIVTPRQYQPPSQGTGERTVPDADFSWGAEGQRPGFGYGVRKRPI

SEQ ID NO: 961209 - protein, 205 aa, Homo sapiens
MPSKFTLPAAPRMRASVSRVSWSLRGLVMVTDRERLRTIYNREFKISFGTPVTLVFSSMLYVNEDCKSGLRHQDSGQVLQTRTLGLTCGSQKEENEAGGQIIRQRPQVTGSQDLSMTGLEYLHGKHGVEIVEVQGAPMKPEMGSVLFRLDLSRKEGADPEASEMAGTQSVTSVTSSTLPETQLVSYMKTGVACPCGPVMVEPLSL

SEQ ID NO: 961210 - protein, 172 aa, Homo sapiens
MVNSRDAVPDMVMVELALSPSIPSPVWVSQCALSEDVSWLKFGSACRLALLMQQEERAKAAWEIILLNENMSSWSSRMLGSLCYLEQELTCRRLPRWAPQSLGPHKTWARLVCCTPLGPRVASYHVRPSWAPTTNSFAHWEPLVPWLVCPRQSLADEHRGGCMILLCVPKSP

SEQ ID NO: 961211 - protein, 134 aa, Homo sapiens
MDTDSWALAVDEQECGCQVDDQFADHWKRKSNADTNGIIKTSTTADENMMKSEKDVTDADQLLTNKLIRSNLVDNHETKCEVLQLGSKAPLMYSVKSFDTSYRLKPHASPGKSMPWDFNRTSKIRENALPMIAC

SEQ ID NO: 961212 - protein, 50 aa, Homo sapiens
MVSPTHAQIPDGSGPHRIPFRAVKLSCPIRVPPVGSQGAYLGAEETIASV

SEQ ID NO: 961213 - protein, 140 aa, Homo sapiens
MLPSPQLRSSKKMYIRLGSGHTLCKERQDMIKNEVPSTEYDLSDQEHQPSGWRLSTDGEVTNDSCHAERLCGGNQEAGLTLRKSLLVQTKRRALEKTDLKFIDTTSKCGHGRFQTMEEKKHSWTTEARPNAKKTSYCQTT

SEQ ID NO: 961214 - protein, 43 aa, Homo sapiens
MNIDTKDLVCLGLSKHLLAVWYLLRRHWTCQQPFWPGFSLNGV

SEQ ID NO: 961215 - protein, 139 aa, Homo sapiens
MWPKPGSCARVAPGPLLSPGRGVRKVSLRGARAPARREGKGRGRCRGPESFRRALGAGLCAHPGHSARGRAAMTCEWPSPAKEGSPRSGVWCAWRAWRLVKKTGRGQRSGVCAARKGRPRFTTPRYEGEEDFHIREGTG

SEQ ID NO: 961216 - protein, 30 aa, Homo sapiens
MGLNGSWSGYPSWFLTPGCQYIPWDVLLPV

SEQ ID NO: 961217 - protein, 244 aa, Homo sapiens
LRPRPSYRSPLRNWTSCAWPCEHAAGCNCLLPTLCCMQSDPDDVCWCLLCALDTPMPSCGHTVKCPPALNRWTLASVLPSCVLVEACLLEHACCHWCWLSHGWACNLAKRGAPPGRGPCAYPGNPENVANGHTMPGWGPDCGDTDIIGSQCPERRLSLLLALGLGLNTLGRRGHQETPGMDYEIGARGQSKQMGPSRSESQRDRGHRKTNDNHMEGERPGQHPIMRPKLAPKPCAERPAASPPW

SEQ ID NO: 961218 - protein, 210 aa, Homo sapiens
HLDLPEDFQADGVCSAGVGRSFYQVQPPALKALHGARKWTLSKAREECQCITHTSREPALCKSASTFTCCAMAHPESSETVSSSDMEVFNANIIQLAILSSSLKHPLRLYSSSTASKWQVSRSITSHLQDPYHLTLDWVANVEGLLQQEEYTKQKLKRLWVVPDQQADQQLPGSSWNEVLKIALSDGFCIDSSHPHALDFMNNKIIRLIR

SEQ ID NO: 961219 - protein, 175 aa, Homo sapiens
CKSLDIFTVGGSGDGVVTNSAWETFAEIPMSREQQKRCENTDDKMFAETSSLAFLPVFDQTGLACECEPRGIRLSSVCDPNGGQCQVPGQSWLEEPATDVHLELFGYGAQVEWQTVGECHLQRNLIECLHAITGQLGQMHTCFQVSVCSDSVIGAYLGTWGFTNLPALTVQWTCR

SEQ ID NO: 961220 - protein, 120 aa, Homo sapiens
SVWVRGPIVRCYEDASPCPRAHPPLAVAMSWTNNCNTCSFLAPFGCISIRGHSQCVEAVEILLLTLSPLSKRRQRICRICAETMPKMDKHKNSLPFVMLVPSILIKCGNGDRGSALPGSH

SEQ ID NO: 961221 - protein, 121 aa, Homo sapiens
MSTPSQTFTKDLPFTITHFHAENACICRWERLPQWRPLHGRPWWDTKNPEPQSQAFSVNSRLRGDYQCYTLGKGSMKKRTIWSTDIPSIFGTKRDRNTVTIHTYCALLKRLTCRDAQPVMD

SEQ ID NO: 961222 - protein, 245 aa, Homo sapiens
TTGTTMESAGVVCPYRAIDVPVHVKHCTRTWVNAAADDPSDGLALAVSDVPCSRDTYVPIMGQTVYECNLCITSSNVVMCIDVPKCNVKQRYADGLLVAMCQTHTYASLTLPCVLRPQCDNANAPVILTHCAHCETITKLNRSGTNATCVTFAYAYNYAKVAIETFQSHYVWNHWRLHTLRGTFGLRRFGICGLNNSAPPNLYGPRKLLEEQLYTLLTATYEVNFGAQVGTLVDNRPQLGANGAA

SEQ ID NO: 961223 - protein, 39 aa, Homo sapiens
MHGRNNVHSICHPYRNEAHRADTHYEHTIRDKQQRRHCE

SEQ ID NO: 961224 - protein, 184 aa, Homo sapiens
APQICVVGSGPAGFYIGPNYLSKHPQAHVDIYEKQPVPFDLVRFMDVRRLITPRRMNVINTIYPDGPVLGRCAFWGNVEVEQGRDWCQELRRGHTTAVVTRATGQRTIGTTVNDLVTETARCVLRPLSSLGWIQWRFLTNQERGARPEAVTQPVILGQGNVGSGRLARILLTPAEHLRENGQHE

SEQ ID NO: 961225 - protein, 129 aa, Homo sapiens
MPCSDLMLPAVPFSLLRVAPAVTPSATGTLHSLPLLTMCLLGCPCAAWMDVGLHVVLCAVHACLAMCYCAAPLPPCLPSDDAPALCACCPALTCLLLLMPVQTHACCVVSVRSPVHSIAVTCLAAVVPL

SEQ ID NO: 961226 - protein, 144 aa, Homo sapiens
MGLDVQYSIPTTYVRMRKYLIRPQRSIYLTTQLTLDFAKREARESSEINEQASPAGLHICSIDALIRSVYDKAEKSKQPIAQVFSPGYRPQNPMYDPHHERHTTITAMEATLYNTKQTVHEGEPTAGALKAWKLKTIQRATKEG

SEQ ID NO: 961227 - protein, 196 aa, Homo sapiens
SIHVGYGRSSCALLLLSVHFSLDVAFYPVSSSVCASIVFIPVLCLWGLFCVSISSFMIVRFSVYDFFLCLVVLFVRVTSVYHVPLGYCVPQHATSSSQCPFLSLPSRTIFYEDVDFIKHVYVVYCASVTLGVRVSSWGLSIMELAVLIGIEPVTLLVSWLSLDRLYISIWKAISTMLCTCPSVTHLSYQAAIGRRV

SEQ ID NO: 961228 - protein, 255 aa, Homo sapiens
MGWAHAVPCAAWLPHNARLSCVPEMPCALQMLTGKKHVGRMCAQIAVLLCFECAWVGIAKIVLECAWVDVLWADRCLHVLLAGSQFAQEKELSVRLCVNDVIDLVCIMAAMLMCCVACLFGPPVKMHKGQLCLPSVRAEDKAGSAVHRAFVGIVCTLLSPAFVWIVGLCHCTITVHQQARSLAPGVPEVTPGNLQGDFPSVQEHYSGVALKKEAHFVGKYLSAWLKVVLLSLVYNGVVSAKQIREQVCRNGSCCR

SEQ ID NO: 961229 - protein, 107 aa, Homo sapiens
MLREKMEYSASCSACLCPASPTMPPPEYPWSNGRVCCNGALSAVTNATFLPAMCHEPGCLSACVPANGHQHVSGLTLPAVNWWCLSRAHPSLVNPDLTSVNVSWVKK

SEQ ID NO: 961230 - protein, 112 aa, Homo sapiens
MRDPQVAGDPVTSIKTSSPAEQKAIIPCNVPLPDVCSPLVPSKNLCTSPSSSSPPASAVALVLGNWREYRSGPQGGALLSLIPSPAVSTGSLCEVRYFVTAASVLCAIGTWA

SEQ ID NO: 961231 - protein, 215 aa, Homo sapiens
MRGMWAASASTLWSQRDLGRGARSRLRMRGPCCGDPCCKRAVHWLCTESWGLMYHCELCQLPLWLLTLPICEPPSCSPVAQPRPYPSFLVLEVVSSDPAHPCWEVQHHDGGAPVGGGVRQPRIAPRQLALGNSPSGLGQANDLGRPHRKLVTCQASGEPLWACSPHFLAEIDSWPPLKSLCGTRTGWCNWLPCVGPNGPPGKLQNTPISRQPGRQ

SEQ ID NO: 961232 - protein, 243 aa, Homo sapiens
GLDKTRWFEKHQSTCKQVWLQMPGLLPSTMQIYKKHLVLVPAGLLLPAPPGQKEASYDPVCTERLDEAAGQCVCWVCALWHFGGLQLHPPFPAVRTPTCPALAEPTVGLLHGSPWQRHHGCHVPMCMQEHAAEMAPTSPVESDWEPRLDSLLPCCSWHLTPSLPSVTQAPLMWSAGLSSWVDTGEDEYDPWWDVGPRDPWNQKACGKDFAFGGSCIIRRQSHRRLFIKALPTEVVQKLPCTGC

SEQ ID NO: 961233 - protein, 330 aa, Homo sapiens
MSNTFSFINPYWYSQGSSYCNFKIGLGHPVCVPRYYQYMFPDLAPSRQATSSYRLQITDWPDTFDWHSTLVVLSPLVVAQLQVWWACSPFVPHPNFHPTVQDLSPGAPIIGPFWTTFLSPHSRGMLCVQMLGEKQCPHVGSLGERMCVLWSPCQKIVGSVAALEFGRVGYADLLSGWLPPQCLFVLGQTEIASCLSRPIIANYYQSSLGQPQNAPQWAQIRPPKKRPHGLVIMHFEGQRWAPPLCGRLRPSWSIYVIWGQQARCAALLTRRTLVSFRPLSMLLGRTSPSYTALPLGREKRGVTYIVGHTPRLTPAALCVGAPPPTPPVTV

SEQ ID NO: 961234 - protein, 63 aa, Homo sapiens
LFWASLVLYPFFQFLVSMIRSGSSLTLASFILVFFVASVGVQMDRLVCRKDKLYGNSGQQAET

SEQ ID NO: 961235 - protein, 112 aa, Homo sapiens
MIATQGPPKDQRHPHPEAAALRNCQMLLGIRHLGITLCGSQPTKVVPDPQRGPPACVRHRPWHSIKQYYVLCSSRDEKSWPVSPLRGRPPAQSLISAYSRRSWWLRLSRCPR

SEQ ID NO: 961236 - protein, 79 aa, Homo sapiens
RRGYGRVWRPNPLLPVRAHKPQERRRKQAATLKAAPGWLNCGSWYVKPRPASARAQSRAYVQEAAQPLRGSTYRDTMEH

SEQ ID NO: 961237 - protein, 90 aa, Homo sapiens
LLAARVRLCQHLACGARMAFTPDWEMPEKFPLVTTIMCLCTLLTVWCCVFWVCVTPEQALGTYIANRVTRQADTYYTTCIYTCCRYRLSC

SEQ ID NO: 961238 - protein, 80 aa, Homo sapiens
EEYGRMLQADPNKVSARGEEKRTSSDGDPWEQLLIENLIHNLDLVPNSCTEAGLRRHAASSKTEPGVLGLQCFATMMSQL

SEQ ID NO: 961239 - protein, 104 aa, Homo sapiens
MRTLTKMAVMLRWPSLSSSKMQHGKWRICVQGRSRLDRAVRAADKGYERILFLSVKLEHEAPDQKGSSERDLGQQLNARSENYCNEESGSELNGMTILDRVLYD

SEQ ID NO: 961240 - protein, 91 aa, Homo sapiens
MATSRYEPVAEIGVWCLLDSVQWSLCFPTCGHFVALKSVRCPQLDVSDVLDVMCASQSCSSSVEGVALLEWRLGVLFEASQLFVLADVTVL

SEQ ID NO: 961241 - protein, 43 aa, Homo sapiens
MPVGSPDAVQNSSLGHSLAWLGVLGGKAMGNPRFVPARAPKPA

SEQ ID NO: 961242 - protein, 202 aa, Homo sapiens
PGNKCQALTDHLLTAGWPADFVFARKSGLCDEAPRPPKKAMDYSSVQQRSVEMAVSDLTDGVNGEWLGAKHDVCVCMRYPCGGLQRWVIHDMLSGNHVWSTDVEEIILVTQAPYGVRHHGWSSCTPEEELEPAALLDREWVHKPALTVVQPRHSPTENSKRPKAHPRRLGVVTNQFSWGWYKAPWTIARSRMFVDLGDLPDL

SEQ ID NO: 961243 - protein, 224 aa, Homo sapiens
TLPLPPLTGVSVYGALQEDPLVPPLQRCGQLCQDGHSWLSTARLQPSTRDWVKQTLGLDRPGKSLSDSDPEMWELLQTGEGQAVSVAWSSVASSRTFCDADAAGWMALWVLSDTSKYSEGYPGKRYYGGAEVVDEIELLCQRRALEAFDLDPAQWGSRMSSPSSGSPSQPGSSTQPFCCPHERIMGLDLPDGGHLTHGYMSDVQRISDTSIFFESMPYKLDGLA

SEQ ID NO: 961244 - protein, 250 aa, Homo sapiens
CSGDSAGPVRGEGPVSQWHSQSALASAQRELAAFRTNGTMTTCKAEDEWNVPSVCPGAGKQAERTRIASLSMLVRTEVSILNSPVSWRTEGDEQSELNAAGDGRRQRRCQICWTGDGCACLQCMRHASNLCHELLNAGSALRDGGAEPPGIGRLINRRGLHENLRQELTSQAGACGRILGHEFDVRWPRESSSRNEHGLSTLQLSNAMLSGPGELSCWQRKHLCQQLACRAGRARTPREALSEQLAVGPG

SEQ ID NO: 961245 - protein, 93 aa, Homo sapiens
VVEGLRRLSDYPEVHVVFSLYCEGTRFTETKHRCEAWRVGGACVFNKGGGLFLPLVPRPKWFNQPFGLPAWDQEGAFQPDPGRGPRGLPLPPV

SEQ ID NO: 961246 - protein, 241 aa, Homo sapiens
MDDEYRAALVVERTAPGMCKAGLRGRRCPPGPLFPSIAGAPQAPGLLMVGMGQKDSYVGDEAQSKRGIHHPEVAPSSTAIVTNWDDMAAKIWHQTFYNELRVVPEEHPVLLTGGPSVKALRPNRREDELMISVLRSSYTARHVRCGMQAVRSLCASGRGSGLVMDSGDGVCQTVPICGGVCPPPSVILLSWIWLGGTCAATHEDPHEAVTACATDERKRACLGTGRAWVGECRGRPGRSGR

SEQ ID NO: 961247 - protein, 90 aa, Homo sapiens
MERTTKDGRAKGKHSRQGEEVIEDDYSTEPNAERPIKQRPKRTVSAEFFTKKITSYGEIRGEKHIYTGEEGRIKKGAKTQPGGAKSVFAT

SEQ ID NO: 961248 - protein, 259 aa, Homo sapiens
KQKQSAAPSQAPERRERGLGTRGRVQRANGSSGDSPVGLGRHGGMAGAPVLRCGAPPVLPAASAPCLPLCLPHASLLPALLWCELMGAVTLALGWWPCGLNWLRDTLGGLSDAELPPPPCMDQCVTVELELEKCAAQVLGLLGQLCERGLEELIDYTGWSQARDPARATAKMLNYQGHFHLFCHSACNRIKDTVQKLGSDHKDIPQQLFLGLDKPFDTDSLLRDLELFPFGIASSIRDAIYPLRGKLLQLAEAVALDDV

SEQ ID NO: 961249 - protein, 107 aa, Homo sapiens
MRRMYEQLLFHRSPMPLLEAKRALLNTSCGSNETALDLTHRFGNLQITMVLVKFAVHASEFPEFKHMPYHTGPVALCALELDHMDIPVAFLAKRPYHSKHGESDTKS

SEQ ID NO: 961250 - protein, 127 aa, Homo sapiens
PGCPEPLAWSCLICVCVVLSAPPLPLYEFSCLAQPLPCISASIRPLTETTMSCVSLCGPLVCLTGHGVWDMPGTRGAHWLRHSDLAAEAWESPAWCTWTQPLTCADAPVLSYLTQCHTSRKQCLSLY

SEQ ID NO: 961251 - protein, 198 aa, Homo sapiens
HSGLPLVVDRRSLHTPAVLHREHESGAPACCPVCTRACCACLVALRAPSSTIVRWTAVRGGAWQPKAGRVPMLQSRNICFSYRKNDSLDELLSMACEKLAARHMMCAKRTSLKHAEPVACQLTVKENTLSTPGAPSLRDVEIASENPRTGKYPCLRREHQALKQRYQPNGTSEIVLLITRPRAEIHRRCKTYLTIDKY

SEQ ID NO: 961252 - protein, 300 aa, Homo sapiens
WERSGVPPAAPKLGSRAAGRPVPVSVVRCCPRLGPYVCAGPPEAARGLVPPPDALASARAIHMGASRMSCRRRPALHGQCKEIINSSTEMKKHFLKAAYYSKKKTHKLFMTCWCRELKEEVIQKAVMEFDLHPKARIEEGKSKCFSELFCVHNIIRLGKKPVEADHVAKEVLLGGQDPASLKSGLGSSQGTWCERKLSEETLFLSCAETSDLRRIMAASTVGVVTYSGCRHPPFALVTPSGCFVAHMWGLCVSPPYCSGDLAEVIRLCTTDAATSRVINPVLKVAITSLFNRPEKKHLDP

SEQ ID NO: 961253 - protein, 109 aa, Homo sapiens
MTQEHTGDPQQRDYAPTDRTPRAAHAPSERIEMTITISDFATTAGGTTHHHSSTRPASAAELEHVSTDHQRDISAHEHTRQPPSPRSATRHSHPRSERDRITAQPPPAT

SEQ ID NO: 961254 - protein, 44 aa, Homo sapiens
AETMHVTGTISRKQILAATPNPTVGHDDFEEVVCIGSVAELEAP

SEQ ID NO: 961255 - protein, 128 aa, Homo sapiens
HRHANFAEQIGCEELHQRAREYILPALMNRHCPEHNYNHTSSNATQLDTHYYNHNNTNNPNPPTPYTTNYINHLHTNYKYNTHNHSHTTHTPRQHLRQTIQVTTFLSLTIHSNPHDTITRHTPANINI

SEQ ID NO: 961256 - protein, 31 aa, Homo sapiens
MGYEIRKNSQGAQSGALTKPLGGNRTKGGST

SEQ ID NO: 961257 - protein, 99 aa, Homo sapiens
KLGEGWLNRPRWGGGWRLGAEVCGPEPTLDSVRSAMTAALAVVTTSGWKMGCLGPVAKGPGKWSWSGGPARLPHVRGDGGLGGEAELLRYEEEFLRKSN

SEQ ID NO: 961258 - protein, 39 aa, Homo sapiens
RTHGATERAALRTSAAWRPEMLSGKNGGSRGGGGCSVQA

SEQ ID NO: 961259 - protein, 126 aa, Homo sapiens
MIPKHVVKGKQVSVALSSSSIRVAMLGGPHGECCPSCVRGQLTRKESTLEQISSGKSPSPGARCRIMGCTPLERPWLGPKRTFGCARANTIGIGKKRWTQDLYPMDQRIPPQLRSLPPQCVAHPGR

SEQ ID NO: 961260 - protein, 175 aa, Homo sapiens
LCTDVCWMPVMPVYLDAWGLACVLLRCALSCACDAACCWMLLMPCAAQCLLRMLACLRSSLPWLPASPVAVSSCVCCVHCAVCFACAACACPFDVCMPALVAACCYLSPACVCMPRAVLWCCCPCPCAPVMLPCLRVPTSIGTAVQWCVCIDGLGMLALPCDVLLRACLPACHPH

SEQ ID NO: 961261 - protein, 192 aa, Homo sapiens
MLQERMSDCSFWENHSAGHMNVTGDVHHHAMLAPLMMCTLAVIRHDELWMDVTCAKPSLKTWVSQSCLSKKILLSIRAQDVIQLHLALIQHPNADQSCRQKGRCLLNRAPWVLSTYKRSEDPGADLANLGPGKNLTLTDHHCWFREPHNQPDTVQIWVTKKFSKESPGVTISWRKPSSGLAVIRSNRRMCQT

SEQ ID NO: 961262 - protein, 246 aa, Homo sapiens
KNKKNPVYIGQVPHYPCCGSSTALTGGQPTQYVSHPDKYCFYCRALLMPVAGLKLLRSALLLPPTAVPDVWPSPVLLYPHYDYPAASPSGFLAVTTSYMSLLMQQAVWTCCTSCVICCLTYICCPVQITWGSAFHAFAQPVLPVPHSAMLFVQCPALVGSSPLPLNPLLCSAVFIMSYARSLEFWERDYYTTLCWLTSSTRLVTSWTWPLALMTNNLNSIFYEHLTRTLRTQLCGDLVLAAGHLWP

SEQ ID NO: 961263 - protein, 144 aa, Homo sapiens
MRRGFIKCPWKYTVRRVDGRGVYALQGPVFNKHSTHQLTAKSTFDPSSLHRGYSIVSVGIEKCSPFLVTTSVGYTFDLTLFYEWDTVRYTWVRLHIRAWREQMAVYRLSNDAGSRLAPGSTQITATGPLLDGIWNAPHTDPYKH

SEQ ID NO: 961264 - protein, 84 aa, Homo sapiens
MTNIFICQRCDSDCQTRCERLTTVPQLTHTLKYLSLPVPDRARSLDYNCGTARLDWLHQHPGERWPRMAPALLTISRTCLRDAH

SEQ ID NO: 961265 - protein, 46 aa, Homo sapiens
MSHFATLGRAGLFGEGRPVGGPGSGAPGVPGHVMCACLKVNELREE

SEQ ID NO: 961266 - protein, 268 aa, Homo sapiens
MSRLVESGRGCFLRMSRGRSAAMAPSLEWHCLEAPLPQWTGSWLLCATWFNHAWPCNDSCMTVMCPGNANGCCLLLPLLPLLSCGPSPGPFCCCFASTVFLCTTTEVLLLPVPAGASSLGMERSSSVVPVAFDNECVVPWEAILSIFLCESWVMGCENIMSNCDGPPRPRALETDCHDSAIEKEGYPVITKKVQSLTISHPTCTNGSHSRGWPLPLAPGADETLDIPLTFEHTNLWTNICVLAPKELGHLRTPMWVHIRSPGFTGGES

SEQ ID NO: 961267 - protein, 127 aa, Homo sapiens
MTRRLTHTHGATLQHLDAGADLQRLTPGEPPCPATPPEPRPLPHFPPSRKLHGAAHTPLVDSLHRGAYLDTHQLHWELFSPLSLLGTTFKAVRRAGSLPGTAASRLAGLGQNPPPGAKFLNSGHAPP

SEQ ID NO: 961268 - protein, 119 aa, Homo sapiens
YVEAWVLLAEVRVLGLHTATVAGVCWLCCPVHITFLVLPPLVVHVTGLNDVLLDCDMCCDMHVAVTCSGCDMHVAVLHVVCCDCATVLLVVCCSLCSLLPCCPLTQCAVCPVPLPCVPD

SEQ ID NO: 961269 - protein, 125 aa, Homo sapiens
MLARLAVIAGKRGRRGRPRVQASPLGCDGTIACMLHLKCQLCDDKNACHAVTIAVPPDRTDTILSYLIKVTNEIFRHYDDFFERTILCNSLVWSCAVTGRPGLTYQEALESEKKARQNLQSFPEP

SEQ ID NO: 961270 - protein, 178 aa, Homo sapiens
MQTRASDPSMDTELAHERASQQLAALAMIRPRPSDLPAPQRTFSRRLSRLERVSLPPALPVLGSPYPSLLPAQLAPRSPPTHRWPTLPAYGLALLPRTPSLHCLRSTAPLPMLQPDCSPTQPTSPGAPSARARYHTHAPAHMHCCPPHAHYLRCATAARRLAGTSPSTATTGTALFLH

SEQ ID NO: 961271 - protein, 736 aa, Homo sapiens
LVVAAWAALSLSLAVCAVLRLVRLLFCLVSSPFVLLARGGSVVPCLALFFSSHLSLILPSSLFSLSLRSPSSLVLPLSVLVACSSLSGFLFSLVSASRCVLASPPSLFLPLPFSLLLCSLCSVLVLSLLLSPFLVLFSSCSLSPVASCALCSALLSPALFLVGFSLLLVSVRVCFVALAFACLRRHVVVVDCPVGCCASLLSASASLVVLASSRSSLSSVSRRSTLISPAACAPSSLCRFVSCFTRVRVARVCVVLWGLVCRRRMLLFVFVVFLCWFDVFVLWFVCGLFVWVCMLCPGVVCSWLGFVFFCFFVVGLFRCVLVVLCSSLSFLFFVFFFLSLCVRLTGVRALCAFLVVCVSVHVCGRVSVVRFLCFALGVVVVGLRFHVLGYGSVRLCVSLSSAVCSSCPLRVSRGLPALVALAWLLGCVWYAWVYHGRAGCAVGLHGCVVLLAGGCDRRCRWVPFAFVPVRFWASLKCGCVCFVLRMVVVSCPVRGLLVAFVCLPGPRCPSRAVVPCWSWVHGSLPSRLRRQLAELCSAGGALLPSGGPVGSAQAGPVLVVSLGFAMGVLALQSYAWDARGMALTCAGSLSAVAYLTILPLELASGVRLPDVHWPVAIGLFGTPSSKIWNLMARHLPSGPQGRRMGPVPYALSLHGQVLQGRVRKRQPRLPRVQRGFGSAASPTQVWFLPGPPTCGDKKGMEWGNEEEHGGPQSFCMTLWLGHHPFWRARRSGGGNP

SEQ ID NO: 961272 - protein, 69 aa, Homo sapiens
GTAEVNMRMMLRLGCIHVKPAAGTNCKVTFLAVTGPDWWPEVEVVCVAFDTPDRAKSPDARDRENQSIP

SEQ ID NO: 961273 - protein, 274 aa, Homo sapiens
MVRGWVLIGRGLSLLVPPARCCSSVLLLLGSLAGPWRRPRAPRAAHPVLRMEPAALFGELAVLQHFVLWKCLCLVTDDCGTLGPMWWMPYRVVIAAAVHCAACECASVWCLPVPCGALCSGQLARTSNQKCPNPWPVCACLLPCCLWTLAARPAPMDAQAGSGCSACQSWTCPSDVSCGTPVMHSARYSDRWVSQLLLSERALVVTAHTGLLFALLDRGRGRRRVARSPESRCCALASGFSISYRRAGPPNQDRLLRLYGGVLFEHLEPTQMAG

SEQ ID NO: 961274 - protein, 107 aa, Homo sapiens
MVRSCRLGAICNSHTLYTWPLNTSSSTSCFSRSSSRTNTVTATNSVSACLQTQDQHTTTNTNHSVITSAFSLHLFTLLYKQTSFIIQRTRTQHTTTIKPRTTQPQNT

SEQ ID NO: 961275 - protein, 314 aa, Homo sapiens
MHGLGFNSAEAGIRSLRGIPLLGSMMDNNEAPGLRHHPVSCMTMLRHGGASQILIAQESLECLPSMCLDDLLFVVVTGRMTCDLALPRDYCLEIILNAGLPTGAMEMPCNVTMMEPLLAEPSDLYLTEWTSSSMAELPLNQNVKRADESWTHTLNRYPVHYATAKPSELNLRTIADLISSKHEPASLTCKTLAIYACARCSVTCMSVAILAFCARAYKKRPYWQDCGLAASPRTVNTKDTGWKGPMWHIPNISNRALDSVGNPLTTPYDIQVSTPFNDLAGVMNVWVNVTPGLTAPALWPDFRTYTELRDNLAT

SEQ ID NO: 961276 - protein, 237 aa, Homo sapiens
GRRLGLTGAQARAAPLSCAASGAAPVPPPPVPLPRPGLADGRGLRRPKPDALVLPCCVLGAASTPAPHVTCRPSVPLDSGVPFPSRYLLCSPARPSSRSYTHAHTHNIKTHQLSHINPSSLHTYHKTTPNTTPHHATHTTNNPTHTTHNHTTHTIYTLISIATHTTQTTLAPTHTMTPTHKPTPPHATNTDQRKRPERNHPHAQSTQTTHTHHRAHPPQPDAPHPPPTTHPHTRNKP

SEQ ID NO: 961277 - protein, 122 aa, Homo sapiens
MVAYSACDAQHVDLVLATFSDPLRAFMQWPLAKPSVDVGCMRHRYTGMDLTNPISPYAASITANVQRGSSQPKGCALRIGRVHMEHEGRGRPKEVPQYDSGDWAFKKLAPPTGERDAPNNFR

SEQ ID NO: 961278 - protein, 53 aa, Homo sapiens
MPDNPCPAKYCIGRSHIGEEHSGLGPGIFPLGHKPTNFFPKGTKTTNTPQGAL

SEQ ID NO: 961279 - protein, 289 aa, Homo sapiens
SLPSVLARSIAFLPSLVSSFARCLVIVAARDRHGRLVCMRTLVMACLYTCGCAAGGLQPAVPDDSVRVCGGAVLCCVTLLCCPVCTGGGALPADVHACVLCVSVCAPRAACVLLVCHIPCGVCAATVRLWMCHDVPGADCQLACSCNMRTVKTPVSGMGQSWPLGSGHPEWSLVLTVDMNSLDRAQAAKNKGNKYFTRQGKYEQAIQCYTEAISFVPYMRRMLTFLHFIKTELLAFEHVAKIGKNVAQGLYKNLLNLIPICEALLRRAKPMKADIRGMLKSPGGGYRSV

SEQ ID NO: 961280 - protein, 252 aa, Homo sapiens
MVSGHPAITRTERFGAHMVAQEPEIIYLRLYGQVIHGYLCQKNQLHIHTRYVMFEGGIGLVMVSYQTWLCTTCPRLPLGLDPVRGMNGIPWSVDNIIDVAVRYDVETNEIVDLTCSCEISRDEYPQRPWNVYQLATLPAVEPMAPVCPCHGPAIPHVARGSATKSLIFSDQALATEYLAPSKRGGLGFVAEPCSLGFPFQGSSRYTGAQTEWMITWSLIWAIGPPVKPPGNRDNKPKTARNRVPGIPKGAPG

SEQ ID NO: 961281 - protein, 231 aa, Homo sapiens
ECELQKGVLLVSVLLRGGGGSMGVHLSTIPRLLVKHAVPGENPMGHKRSEMDSCTEGTRLTIDKLLLGQTNSGNTERRNDDDCNYITRMKAYSSKLPLKQQPMQRTLIEDGALGGAYGTRTVARHVSQAVERDSLVTILRVVYYEGAGLRGHPVVDDGLGSVAQALVIQKWTWGANYREPSEPRKGRRLARATPKKPSKGTIARGQPQNTQGGGYGKQEGPSGRKAPRSEN

SEQ ID NO: 961282 - protein, 197 aa, Homo sapiens
MATSRYEPVGVKLVSVPMWTVYKARDPTQMDHFCGPQECESPQVEDRGGDEAFPSCTVREVVLYLMATWRLFEHSQLFVLELMDVLCHNPRTDLGRSMVTLVLGALYDQGPKDISGQGHPTRLAMTKRSRICCSQCLKRPRFPSCQIASYTRRSEARDHSGDSGGTVILVTFGLAESTYQWHLHRGVTLVDSESLPI

SEQ ID NO: 961283 - protein, 41 aa, Homo sapiens
MDEDYYGSAADVGRRGCAAASRMDDSCENGERMNAGGFASK

SEQ ID NO: 961284 - protein, 236 aa, Homo sapiens
ARYDGWVLKEIQKDFLLLRYEVVIIDEAHERSVYTGHPHRPPVPHCDSPWLRVNLPLKLLIMSGHAAGGWTSPMNPRLFCQACRLVINGVNPCACSHVTSAFQQAGHLLEDYMWLMCFRKVCKIHLDACPQVCIPVCSCLVAVLSVHSACACQCSCECAFPPYQSPATRKGRLIRKTRCAGNAEVEEVTGARANQGAVLSVLPQINLDHSTRCNRQAKAMSDSEGKKWHDGTRGAL

SEQ ID NO: 961285 - protein, 257 aa, Homo sapiens
YWAAWSNISRFGARCTVPGVRKASECWAPGGKKRWPLTGYWVSAVWMQKVCLLQPPSYTGCGGGDAVGMGGDVDAEWWKTWLVDVGSGGLAPPKGLRRLVVTPPQVSGTGGAQAAWLVLGLTRLVLLSSEGRPRAKANRRVNAMLDGLGSVPEVARSETHIHLWAMNEEGRTPRKKTLAHQETRDHALREHLRGMGKCASPGAPRYLAARTCLLVIVTPCGAGRYPWVGPEATGEGDCRMLYCLPVRSGGTLAAVPT

SEQ ID NO: 961286 - protein, 160 aa, Homo sapiens
LSSGAFSGESPNEVSRIVTKDADYYNMLLKKLAPPLVTWLSGEPESAVCRPWRNIRLKLSQERGLEDRVKEEDQESVFGDSTDDSQSIVKTERELGQSLIAFGQSSSRTLAQGSWQKLKRKYASRGGRLTFVREGCGRIGTVCQSMVEQSAERLVYSTLA

SEQ ID NO: 961287 - protein, 233 aa, Homo sapiens
ETLQGQLEEKAQAARCTVRCALASAQRELAAFRTKVQDHSKADMMSWKAQCGPGAWQEADSEKYASSADLEEEVSILNRQVLEKDGGELMELKAVLVMCRCHENDARSSDGDGLRLLRGMDSQQQCHELQNACSALREEVHEPPVRRLMKHAVWLQENLREAADLDMAERAEDAGPRIEGVATEKFFLETSRPSPPCSSSTPSTQALVSELLPAKHLCQQLLAEQAAARNATV

SEQ ID NO: 961288 - protein, 216 aa, Homo sapiens
LVTAGLALHCDSSKPDCAIAAAVLRGRGAALPELVQWQVDNGSVTPSPPCAHPKAVWCDTCAAPMCCDLSLLPDDPHVRCSGLILCSSHKWCTHARECCHAQTVCTCGHAMWLLMCNVGASGNDHAQLPPALSLAKPASCGSSDLVPMACCRHALLSVEWARSRCVQPVRCCGVTLALHSWTGVASGQSSAQGAVVSLLRRDNGLAWLSNGREGES

SEQ ID NO: 961289 - protein, 267 aa, Homo sapiens
MIGTEADEKEARGIDEVVVDDSCCSTRWIPNDEAQTKKQKGQRVKECPRTIDIHTTKREDRGTSDTIDTKGERAYTRLSKGERKEYNHYKSKTVKQEQRKRSIESNNRESHTTKNNERSEKDTKAIEEQKTDELSKHRQEHQNHAPRTQYHRKTGTKARYEHDRTSGAQTHIDHSEVRRQATNSTHRDKTAHHAQSGATNASCETMPYQPHASTKARGRRRGPQADSNQNMRPVTTPQTLEQTRQTPPDDNTLQQDANDWGHKSIEA

SEQ ID NO: 961290 - protein, 134 aa, Homo sapiens
LPSPPFTIPLGGAFPGQGRAGLTPGTQPQRPTKSHNARKEKTQQTKKRETQRSDEDKQKRTMDDITTTRKTKEKRHKKATKKTATRKKQKNTQKEKRQEQKTRETTRKKTYNKQNKKNRKQKKEQEHKKTQQKT

SEQ ID NO: 961291 - protein, 141 aa, Homo sapiens
MTPFMASMHKKSRMNGQYHACPRTVSTNDKHKYSLEQLIANPSRGLGEVATTTNINPVHPKTTRYKVVTNANHHQADITDPKDSESELLLHSQTAPEIRVAKQQRQNNNPPHGTPHKDPQATTPLTNTHPPTRKTHTHQHH

SEQ ID NO: 961292 - protein, 164 aa, Homo sapiens
MCSNKPALFPPPVKKHYTTQPQTSTNIDHSRGLYNTGVARGVAWASWRGKCRPKGQAVPRVLSTSENPRESPRGERYSTGAPTKKGAPGGAHKEEAPRPQSLPDNYTPRGSHTRASPPFQRAFYERRRKGPMVVIPCGEGTYGKGHAHAISQKWAGPFNPSRGN

SEQ ID NO: 961293 - protein, 112 aa, Homo sapiens
MTTSASTHLNKGINAGCYMIHDLRDEKVQDHDYIWTRMVLEKDMRCKTRNPWTDEPKMVEEIDHDDGTYRLDSRYLIQLMRDYQQMNSEVIDDLHAHDISGPTTDKGHLNHS

SEQ ID NO: 961294 - protein, 159 aa, Homo sapiens
MSYPALSRLVLRLQQRSGVRTLTVLAAVMLVCSCLILSNAGAQQIASVLAEYCPQGGWTNVGRRTIPILQAAPRSKCPWLDTMELAVVYVCRGAQEMVVYAANVTVATQIVARAGGPATRGAVQSGVDKTKVRSCLAASNQSLGSRLGQMVLSGVDTVL

SEQ ID NO: 961295 - protein, 71 aa, Homo sapiens
YVAQGEAGQLRRRYLCAPVLAASVWLVMRAMAKLIIGRALTACSINACTLPAEMLVSCNRALSGDLGQGVV

SEQ ID NO: 961296 - protein, 167 aa, Homo sapiens
MAKTPVCSEIWNGMRHNACSIRSNDCVRTKPLGTSIEGPGTHWVKALARGKSPESHVNIRRKAVEVPRKTTVRRRGDLMKPKPSLRGGNPRGRGIIRCTRPRPCPLVTIVEALLSEGPTWFEIAGAVANQVWCNRESPSSFHVARGCLLMMHQSLPRASCSDRVDIG

SEQ ID NO: 961297 - protein, 250 aa, Homo sapiens
SEPDAPSFPLQSRLPCPLESRSVEQPRMHPQNMPLLVLLPGLPLGDLILTAPDPASWRLAAKCLPGLLPGCMPPVASLCTSLRRWVPWKPVFRLFRFRLGLWRPAGCSRYCLGLVLHLNMPLLRLPLSVPAALGLAKLLFLVDLCAQPLQPGELLPSAPALRGNLVPAAAFRLPCLAPPPPPPPPPSPPPPPPPHTPPPPPITHTPPSPPTSPTTNIIPYTNSHSQNPSPHTTHPKPHPPSPTPTPTPHT

SEQ ID NO: 961298 - protein, 102 aa, Homo sapiens
MPLVKKREFKAYRIWTMNYIWDLPMRPPGIELGRNDHQVQAEGSKDMSTLVVFESRRRWDNLTLLCTGGDNKDATVACLLGNPTNCNLNSTPPIRNAVQCAR

SEQ ID NO: 961299 - protein, 275 aa, Homo sapiens
VLGEKINILSGRDCTKLGDRDPLGELTVPEQDEAPPDAPVSAEVCLLRVCALMCPGASCASLTPVWPCGKCPCLQIPLVSWIPVLLCWVCCLCACPVLCTVAGNFVSTLTMTISNGHLTTKRVIDSDTMWTESCEPAGCRPVRSLPLHVGLRLVPACLYYLSPLKLGALGSYLLWRPVWLLFSSTGVLITSHLKARVAQHSCEPARCVKRPKKSCIDEIVYPKSLDSLRNGAWAHLRKGSEGEPISCFGVGGHWTLTIDAGPDQDTTHGSGDVVE

SEQ ID NO: 961300 - protein, 120 aa, Homo sapiens
MPWCVPCDALATLLMAVGPVPRHLADFHVALWALKDDLPECGDLIEILEGCMVPQTCPGAVGLSTADLVCLCVCVFWCGMQDLQSAIACGTPDDPDVCEHVAAFITPHCSDMTNGHFLHD

SEQ ID NO: 961301 - protein, 70 aa, Homo sapiens
AVLVVAAAGDPGPDACAVPACAHNGAFQLPPPKRTCPASFLLAACKCAVLALPYLLTAAPVMTAHCCVSL

SEQ ID NO: 961302 - protein, 245 aa, Homo sapiens
MPVHTLSPREPRSCTPPYHMPPCRDQGPWHTLHTGAGRWRSPETEQHVEQAWRPDKAKYSQEPARGQHHAQETMCSRLHVQDKPAHSDPERHLHRQQDASQPKPARAHAMAPCRRTQTRNWTILRQTSSTCVDRPTMIPMTKAKHATPWNVDRGDAGQDKHTAEQNNNQRNRTSTQTINITERSEPREWNVQTQRDKEQQTGTKELDPNEDGTMQTDIHSTKTQQRRNKGTRQRRTWTEQNTEKR

SEQ ID NO: 961303 - protein, 296 aa, Homo sapiens
MWYPGSQSRTQRVVSLGEFSQALQEPCNKSLGLRSRHSYHVEAGGRGPGQRGVPGVTDATRSEPSVFGTDACSGKGSSSLHSINVEANECSAGYPGSVASGAQVHVQRSRQCVTALCRGGKQKSALTGNSYTICAVAPGLTRQAPRYAWTAQLQCKWSLRCRVASGRGDPHVECGAPRKHLHYVRLQKPGAVDKTTVPLRNSHMKHEMQSTEDRDPGHTQTESISRFRAGSERIAEQAETSRKTTKWKTRSRKQRRAEQDWNKELDKHDRMGPKVAEMTHNKRTDDTDVHKVKHET

SEQ ID NO: 961304 - protein, 131 aa, Homo sapiens
GKALMDSTAMGWELRVEKVRVSLLTQADVEEEEMDSITEVPANCSVLRSSMRSLVSLPEAHAGGLGKMQPADADKNPPVDFSSRRLDRRSWCRKQATPQSLEVSSANAEEAQTPIQLVTRTGLTSLRVTFQ

SEQ ID NO: 961305 - protein, 145 aa, Homo sapiens
MWAVGRRWAVGLRCVLCCRSVCLTQCRLVLCAGYCMMLLSILLLNDDMLHVVLLAMYCCVLVTTDACAFISVLDLLDACGGAALHVPLLLALTDVMLAGWCCSVEIAVVGLDCVLPIVAILALPLLVLSIVACYFGAPAIVASLL

SEQ ID NO: 961306 - protein, 308 aa, Homo sapiens
APCCAAASWRAPRRGPRHWRESGRWVPTTRALQTSLRPGFLKGGLDCAAVLEWCPGSSGHGDLNVMGDVVMIKVAWWCKVEAANEHPCLSLECDAWGGRLVQMLPQLDVKEGSPVMPHGMVLVIGACGSGRRSPCCCPAALLAWGGPCGLALRLSRMAWGPCLQPSRHQHDPLAGLVPWAPVVRLWLRLEACLFCALSSPLLHAPTAHVSFRLPRLLCRLNPVWGCSLFLGLQPPVEPLGYSGGSGGAQQAAGLAPFIGGPYFHFAAFGANALGFPAHHWSTALGSYSVAVGRRSFGGAKDEPEGGVR

SEQ ID NO: 961307 - protein, 154 aa, Homo sapiens
VTAAWLLGPGNMMVAGAEGAEKGPRRRWVVLSQSGLKRRGQNQVSGCCTRMCCVWSVIPTPASSWKSCAWPVDAPCIHVTVFVSASVPVLWIHMCLCGPSLCDCCLPPLLHHRPWEYGCPHSLDLAVVLVKCYVKWINDHGLWSPREVRKLKAT

SEQ ID NO: 961308 - protein, 154 aa, Homo sapiens
MALTNTHWAQTNRNIWPIPQAPIIHILLPWDNHLSYKLWPWNYISPETHDNTVQRQEPPREFHMGGTQHRIDTTNNHPSHPNGGNIQAKHRDNPEKHTKQHTRGGDHTITINPCTKQLTKDRQEGPQKDPKKDGKNHATTKTKEKNGMRRPNTQ

SEQ ID NO: 961309 - protein, 243 aa, Homo sapiens
MRRPLHTNAVHAHRDGVRREPPESSPAALALCHPSRGKDIYLWLGLVRAARERTKTAVCPLVAASALVPPLYIAPASVLFPAGCAPSLASRAHSCELISVERRHSPPPRERVFLSRTTPPSVDLCCLCEEITHPGHHKDRLVPVFALGSCAAPPPNRSAPVEQEQHISSLLRYTNQRREAHEEASFTHQRRCRASKREERGATPNQRHKGARPAKGPTQREGRPRKKQGGATRLAAPPPKKSQ

SEQ ID NO: 961310 - protein, 284 aa, Homo sapiens
MLLVSVRSAGRLVSPALPSRSCALALAPAALQPCAAPCVAPAEVPACALCQLLLPLWNLVLLPDCWPPASCLWLLLLVALLGPDVSDCGHFPVPLMCCLTDLLACCCLWMPCACAPCFMPACPSWGCSDVRCCACWAALLLLTVPLCHAEWPAACDALPCCLLPDCPVPCILAACPEPVVVLRRVPPLTPAPDAGVNLLLARWRCAACAVQLCTKPKRRDLVGTTPFDQTREPLEFDLPWDPLHCAQLCQSHGNALHVLDTGTTVNWTRYGHRSDLGPELTKEC

SEQ ID NO: 961311 - protein, 209 aa, Homo sapiens
MGVLKLGGLDCIRTKDFQLQTDHTPVHLALLDEISTCHQLLHPQVLQLLVKLFETEHSQLDVMEQLELKKTLLAQDGSPVLSSQVMLLPCLLSLTSDTVLCAAQLAHCTLLTHFAIFVTCSAAGRSLAPPYTSDFVQLFLPILENDSIAGTIKTERRALTLDGSSIAHCKSNFIMVNNLEHPPELKQNIPEPVVEKPFQEAVPEARAAS

SEQ ID NO: 961312 - protein, 123 aa, Homo sapiens
MLPQAITVLSTYICGHPIDHLDLPATRRADGSSSSTMILTLVSVTSVAGLAPANTYTDLWTSCWLTPACRAVPFLRQRPRRMETTGKSQRETYSLSPPLATPTLELLHSRIIQTAQTTPVQTV

SEQ ID NO: 961313 - protein, 108 aa, Homo sapiens
MGAQPISLSFSSRAVREEVRHTHLVPPPSPPRWRPRPPRRGGNTPECARPRGGSPERTGVRARDTHRGDSRAGEWQTNELPSAVGRVPPLCGGWRGGASPSRRATSRS

SEQ ID NO: 961314 - protein, 35 aa, Homo sapiens
GGVLREVVKHPSVESVVQCEIDEDVIQVSKKFLPG

SEQ ID NO: 961315 - protein, 159 aa, Homo sapiens
MSPLLIRDVTYLHCVNINLKIPAGKTVALVGRSGSGKSTASPDLITRSLLILIDRRHTPAWMVHDLREYTLASLRNQVALVSQNVHLFNDYGLLSTVAYARHWYHATAREATIERSRPPLLRLSSMRIFTQVMMDYTVSRLQLDGENRTCLPLWSVQRS

SEQ ID NO: 961316 - protein, 238 aa, Homo sapiens
RIPRRSKELVTIIPNFSLDKIYLIGVVTWVPFNPVFTRGSAPAGWRLTCNTTAQTMLACSLQQLDWTARQHAWQNDERITRTHNGHRDTLYPHMAPSTLNLTTWKPLPKASPVSQHLMCLSKNNNTPQTAPRTASNSRATPCGQTGLLVEGPTLRSFTPTKPSRDSWFLGLGNQTHKGSRKHRPRVNVPPNLAPTRPTGNYTLLEPPMWTRGKASPSHPKPGRTLYTLQTTKGRPSHN

SEQ ID NO: 961317 - protein, 182 aa, Homo sapiens
MSELTRRQEAEQLKNQIETPGKHVQMLTLSQITNNIDPDGKNANMRTRRDHCGGTWPRSYSQCTGAQTPGYSSVPRRMVNLSSGTSYTNQTTVNAHPIMQLHPGHHAHVQYAHFWETYCCALTRGLQITTYAPLNTHDKPQERGHVARRSSDPGTDHPVTRPCRRNPANTTNRPTTDHPGAT

SEQ ID NO: 961318 - protein, 32 aa, Homo sapiens
MRTTDLLTEKQKLRVTEDPENETRLRQESIPV

SEQ ID NO: 961319 - protein, 123 aa, Homo sapiens
SRDPFPHPSLSSVHRIALLCPVAQPSPSVRAGGLEQPEARSRREKRQRTDPQLASPGRVASPPAWQWRQTPAHLLLATTRPVVDWAFSGHHALWVFLNQRLQEMVNLCYAREIQETGWEHFGS

SEQ ID NO: 961320 - protein, 111 aa, Homo sapiens
MSNSDVCDRKNTLGGQRSTERQGRWGNYPKNGVPSGHIVIAGHTVQSHQANESFHMLLKAAYIADHERGTEKIRVRVREGSERACNGNRDLNRHAVELFTCGRFNGLDGIR

SEQ ID NO: 961321 - protein, 227 aa, Homo sapiens
QAARRDAVGRVPAAGAWAALLLAVCIGADPGLSGSGVVYAPRLAYFHARKHASPAALARGHVRLRAGTTEAGRSLDLILWRAAGVLLPSAHGACPDRGSCYWVFVNAGGWMGAMCLLPRHLLVRRSVAALTAPGLGSRGHSGRYWLLTTLAHPITLWDLSSHWRRRAYHQEVRSSSLAGDGTYTGLVIATAVRVVGQDITVMVEYGRGVIPSTLALRCWSDTVFSHP

SEQ ID NO: 961322 - protein, 182 aa, Homo sapiens
MAIRAQHSNAAQTQTVGSKQGLCQCQESLIETDDPEMWEYAAEGEGQGSVSGLELIASENFCSLMLQLECPGGPDLNNKYIGGLSWTRDTMGETECGVMKEETASASSRDLEKTLEHGYLQQIGESNVTAPTTVDTPDKPESALQQTTTCKPIKRTREINREDMRHYDNRLEECTNIQHQQE

SEQ ID NO: 961323 - protein, 91 aa, Homo sapiens
LLHQRTSGDTSLSRTPETLLPFAEAEAFLKKAVVQSPQVTEDPLRGFALDPVHSCEGSSVITYQDVWRRKRQNKDGSGLGPLGGGVLSCVL

SEQ ID NO: 961324 - protein, 274 aa, Homo sapiens
GWWSQDLWKIIQHYKKNYKRVPEGFGNSSQAVGGGTGGWDRSGAKSPKSFSAISPYEVVGDSTSQIISSRDSRGVRTSREHKWVSPFSLSSSRAAWREEYLYRGPPRKFRLSTRSGGDNNRGHTRGCGGDLEGGGSRGGSPRTQTLGSGGGKSMGPGRGDSTYSLVSEPGPAYHFRGFVEWQTLPAPWWEVAPWEDGALASTESLTHSDPVHCGGGPKHRASQGVARERPHIYWVFVGKQARRGPNKIRGKKSQLKRPWGGCDKGQLGEQEESR

SEQ ID NO: 961325 - protein, 206 aa, Homo sapiens
SKHLRSMYCGHPGRAVPLRLWAQPVVIVMDSGDGVTHTVPIYEGYALHPRPSVRRGPGIRPGTVTGHTFYEDPRRERGYMLLPPRPSGRIGARTSKGGSGLLPSPLGLTEARHAWPTQRANRVPHSVRGEERRHTEACRDWSTVSRPVWATDADIRVSVRSLASRPFTSMGYGNLWRHHTKKPRLRTSNHARCGRWHTHAPAPGTA

SEQ ID NO: 961326 - protein, 92 aa, Homo sapiens
AGAAGWCRGALSGPGMGNRGGFLRSVSAVASWGRGRWPVDRGRGRWPLELAECNGLEDEVSGCPVTKLCAAWSMDMKIKSLCMEIYLFSHAY

SEQ ID NO: 961327 - protein, 46 aa, Homo sapiens
MTQTPKGWAKPQTQPSENTEKQVSAQAGRVSNIPYRSRDPDSDKCG

SEQ ID NO: 961328 - protein, 270 aa, Homo sapiens
RSVLVAWAALLQLLSRGVNLVVMPAHPSVPEIQRFVTLLYRHGDRSPVHITLIPMPHNQSKTGTGAPRGGVGQDKHYSAEEMRTCTGEACGHGPWLRSRLYARACPKRLSYSPRAICRALVGDGRPSEGSCLELGEASFLLYAVLQCPGSVPVSLFPRTQSGGLSCRFRDLAEEQLRPFESTSSKYPLCCRATLVCPLFAIICRLQTRVSVASRGLFPLMWWAPLVVRAPSLNGRGHCFSLERTDVAPGARYQLRRRLSKHIARGLLLGT

SEQ ID NO: 961329 - protein, 222 aa, Homo sapiens
DIYEDRHDGVPSHSSRLSQLGSVSQGPYSSAPPLSHTPSSDFQRCPYRSHAPVARPLPYSTRVKDLYLSGSMIPESLIPLWQAQSKHPMGANWHRGLECWRFGNAGASRPAPCSLLWLALWPRQCSSGALWIPPCECFERELTCGVHRLGPQRTALALALADFSRGPPNPTVGALCCHRDQPRATWGGGEHVGPSVPSLGPRRPFSRGPNFPLGYALGNRGT

SEQ ID NO: 961330 - protein, 220 aa, Homo sapiens
SVERCGQLVRMAIRAQHSNGAQTQTGEANEGLDSQESLSDSDPEMWELLLRGEKDSACVCGRVSVIASRELRAAELRLEARGVLSGRISTRRGYPWQEIRMGDAEVAGMTFELGCAYAPGALGSLLRLDPAQVGESNVQPLSPGSRSHTGRLDRPFLQDLANRDHGAGPCPDGGPVSPEGYIVLDVKSGYQAGPIFFRVYWPYKLNRQKLGSFDYNQVWA

SEQ ID NO: 961331 - protein, 103 aa, Homo sapiens
AAGCCWDLAVLQVCRSLPGGLCCGAQPRPVAWGSCHPAQLRCLPMCCPCASGACALSVGLPDMHAVCVWWPDVPDASMCQTPFTTEPAYLRDKNPIALLPGVK

SEQ ID NO: 961332 - protein, 216 aa, Homo sapiens
FGGVVARVAAAGECWCVRGSHASSPAPAPREWMSRAAPCSGATDYGRIALTTRRRAENEAGEQSDMRSRVKRLDMGQGSRKWDFCEIMQMRAGPFILALCAVVPVWCNSPGAKHSAVYWRVKDGTDDFYQLKILTLEERGDHGIKSQEERQGKMLLQHRDTHMLSLLHTQDGVVHHHVLFQDRPVKIVEDNMNLSRMVKKMKKRICLSTGPGYCAS

SEQ ID NO: 961333 - protein, 182 aa, Homo sapiens
AAAPLSRFYLFFPPFPFLFLFFFSLLPSRPFITITPRRRFTRKGEKPAHNKKERRRKQNKKENNTQENNKQKREQKKKKTTRDKEKAHRRNNKKQTHKKTKRKQEKEIEKKKEKDKNHEHTNRTTEKKQKKKQKTHIPQNNKKKNEKEKKKKEKKDTKEEKRKKKRKNRKKKTEKKKKTKTK

SEQ ID NO: 961334 - protein, 228 aa, Homo sapiens
AGLATCWCPGGSEPRVAALGPLRNDLGRDASHPSVLLLLGSLSRKKLVVSLDDKLRYLMLSLSMKLSSKWAPAQTAPLPVAPDAHLLLQICATAVCHLLPSWCPMSSWMPWVMGWAVCLPGPALPYMALDVYLQWCTPCPWNALAVLDPYVRGCPRTMHVARPTEVLGWYPAPLRLFHSDPWGHAQPWCEAATVSLILRLPCSSARWPLPFAPVPARSGLRDLELCRL

SEQ ID NO: 961335 - protein, 110 aa, Homo sapiens
APLSSARSQGVLSDGGIHNISTVAVPTQPGSASTSSDARTEPLDSSVPCLGVVRNPPAGGAECGLSGYVPWVPGCPCPEPMLSSEGESVNVPAMEPSPKPGTEVIPGSPQ

SEQ ID NO: 961336 - protein, 245 aa, Homo sapiens
RRAPEPGGRRARQQRRGRGRRLQCRPRVNQESVPQERAVCPGAQTELFQHQQQVSRGNEERHVHLMIEIIPVPDLWRLVIRRSIMVSLHVKAARAFSGEVSKSKADLLLSSLQKNCLIDRTRKKTVANTGRVTERCLAVGMSRRCCRHLAEVSKGAERRACMQRVQKRRSAAAVAASTSSSLERLSRMTRNYNDLGNGGEELRDDLRNYVTGTPWGEKADSPQEFSGAWACQTAGWIRNKRPLGC

SEQ ID NO: 961337 - protein, 126 aa, Homo sapiens
MRPSDDRARSLVLLLLDECEEGSLVPVPDESALIATCCSCLYSSMAVSSEVYPALWGPSVGMPPSSELQRRTIRDSATDGWADKVGEEASRRGPSFHKACTGTDGSGAQRPHKGRPTRGPTKTKAR

SEQ ID NO: 961338 - protein, 143 aa, Homo sapiens
MSSAKGAASSLPPVRLLALCCLWSLCRDNLRAVDRFLSAAVAACFSPELVILLCLPAESLLVPDPFSSLDPTANATLTTDDLTCLDAALAKCAVPSTVPLAPGHINVCDHMNERMTVYWTSLVCVVLSVPDTGHLLVTLSGLT

SEQ ID NO: 961339 - protein, 90 aa, Homo sapiens
RAPTTGAPCHVEDDMPPGPGMDNVCCHLWLADVIPCVTVLFPAVMLPGLSWVSCGSGLAPPSWSPFSRWAWFIWEEIVFQWLAIGLIDDV

SEQ ID NO: 961340 - protein, 247 aa, Homo sapiens
HAFGVSGKSRAFGCGGCGREPAGEVLLLPPLYSDPGSTGMSILQQLSASGVNSALFQMPPHLMSLPSKLVNFGGVAVLSDGLLLAWWPCNPRTLELLSCGLRCGPSVLDRGTASQGRVAHACRVGALAMYPVHAGYIGQGDADWGRSRGAVFSSPAVVQHPGEPSRGVAPGRTLEGRRSVIVKELQLGIWLNFGLDRVAGRADGIPVEMGVIGDDELQCRKSGRGAGARAINQGRSIDWWREPKYCQ

SEQ ID NO: 961341 - protein, 79 aa, Homo sapiens
SLSRGRGLAGTQKGPSVGHTDVGFPTIQPLTKSRLPRTPGNKNWCHLYTKEGWGTRTKIWLVVLVVAQGRLSEGVSVAG

SEQ ID NO: 961342 - protein, 130 aa, Homo sapiens
NVLLRATPTPVLAAAPASVPCCQRQHLAAVLLCSLLRAPASSSDPAVQQLCCNCWLLAMTPVPSCCNAPCCRPHAALLCLVLLFHVALPLAGLLWSCACTHVILCLHCWTATEMTQLRCACPDVIWDPDW

SEQ ID NO: 961343 - protein, 208 aa, Homo sapiens
MAPVHLLSPCAALNDMQCPGHSELGMVWLVGVPDGDCHPHRSAESLPTLSDSGSLCPLPPVLADSEKTQRAFGVPRHDPLPDPLKVPPHTDLTHPDICIGGPRDAAPQDSTGKRENVSQTPWKPLCPAPTHALLTTKATPDCCCRITKVACWFGTVSADTQCPGFEPSREGSRAPLQKVFNPKMQIEGDVVTSTAGVYAPTSPATGRA

SEQ ID NO: 961344 - protein, 109 aa, Homo sapiens
MAPGGHAVVALSSRHCTDVLVRLCDCVTLAVCAVQIRRAVTQAWRHSVWLNTGARMQLLVYTACSGVGAQTELAGPADLEEAKGWAAFVGGVIPSSGNIQSSVTPATKR

SEQ ID NO: 961345 - protein, 162 aa, Homo sapiens
MELACKLERRLRREEAEEMWPPAGSPRLPHAPGCPKPDALSSPCPVLPTGHAPDAGAAAPRLSLACLDINDGRCCWPRLLQVVFKPPTLEFPDVQACRLIKLTWMSMFKLYRTAGREWLQSDLMELKLMMEKLGGPPDLTLGLKEHDQQEVDEDFDGKLIFP

SEQ ID NO: 961346 - protein, 168 aa, Homo sapiens
CCVVRPGGARRVAQFWWRGMGTQERGDPVVTAVALPLPVLFPLPSHFFCGTSTPSSGCSVTLVHACAMGTCQHLDIGVAPWKTVNCCQDMQKVEKPGSHLVCGALCASGVSVTSMSCVRLQSCCVGPNIGHIDHIRPKWAFHKTLQGPDQIEIDTTKDKVGLESTQEQ

SEQ ID NO: 961347 - protein, 89 aa, Homo sapiens
MDERITPEKDTERHHGRQNPPEGRNKEWRNKRTSQKQDKDKTEEIVNTPAKREKKEMDETKTKTRMISDPRRTQKLEVKINNENTTRVT

SEQ ID NO: 961348 - protein, 279 aa, Homo sapiens
VKVVTAMIAVPAHDVLLDVLRNWSDMLLCLLLVGLWCSCLVAVLCLSCGLVAWVLSVHLDCAVPVLLPVSLAAGSWQECLRLECALWSSTGGAALLPCADRVFVWVLQLLGGAGAVPSFVVPSSVARAPAAWLPYRCRRIQPVPYRLELDQKISSSLLAGIWIHTCCPLRLRMLRKSGVMGLNKDSQLGFHMEPGKIKRGGYEYVYGDPHPYSLTSWTDLNETTGAARSPADELTTLVYDLTGKESSGIGKQFLWAMLEKVVRNEITVKVQESTGIRNS

SEQ ID NO: 961349 - protein, 146 aa, Homo sapiens
MERVHDRMFCEVIHLLPGVATTCSRDRPRGSVWPVAVRMSSAHLVDLFLSGRQIFQTATQADPPGASVLLQVSTAVERKLSHARNETEAPNAWLSLLRPAAVDVMRPAEGSWRPASDVPQLLKENLARGLLDLGHAGQIGHLLHQC

SEQ ID NO: 961350 - protein, 199 aa, Homo sapiens
MPSETPQAEVVAQQAAPTRSGTTLGEGDAWRRGPQRIMEAKEPLCDPGPMLLSSVHLAAGAGLPPSPHITTLDPVQNLQKSCHDILNENLGTPLWSESTRFGKKFGLKCELLANVSVLQLRAGAVKDRIKPADDLKMLSASDDEARDQRIEPEIGTTGMGGTEREGGERDKTEPKQSEGNAADTGKRRPPNKKTKTQRR

SEQ ID NO: 961351 - protein, 38 aa, Homo sapiens
MAHSAHMGLAWGTGGPMGNGGAGGPRKRTLGTKRHSSP

SEQ ID NO: 961352 - protein, 108 aa, Homo sapiens
RVTSLACVRSCVDQAMSVSVCHVFLSMCCPEGPHSTVPTISQQCHLCPVCAMWQPTPTPHNPSCASEMLHALACAVCPTLYADPALIQHDDPFLVRTCVPMQHCVCML

SEQ ID NO: 961353 - protein, 153 aa, Homo sapiens
MALCFKQGMPHTAVTMAHQTCERVYTKYTQQCMIRHQIVQQHKLNAASILAQRELTVCATCSHSAKPLYRSTEAVDSPCTIAAARQNSDSAHRQQIVQPPAGKGYLGFNLISQSSPCLTAQQPTQRPSLKQTQTGETRRPVACHAQTPLVTPP

SEQ ID NO: 961354 - protein, 79 aa, Homo sapiens
GAIILILTKVWQGSAHQVAEIPAHVPPVIAVTLESPDSVVSAHLYLWHRSLCHVQWTLMSSDGLWLEGRWTVLWKNLCQ

SEQ ID NO: 961355 - protein, 79 aa, Homo sapiens
ATGSGSSTWHQKQSIILPAEPVSGCTCSAMSFSQMISENAEWHESEGRVECPVKACTDAVCVSDGLDMVSWRAWRCMQC

SEQ ID NO: 961356 - protein, 124 aa, Homo sapiens
HSSGIRQATEDKDSMETGRLDVGSRHRDQRDGVCVLGLHLAKELCRGDEDGDSWLQVTRRLPITYPPYLTTLEVSLRYRSMNLALYTREPHKHLATSPWLALSREPQQWLGARTYTQSISYAPI

SEQ ID NO: 961357 - protein, 163 aa, Homo sapiens
LTIGGSGQRRTWPRPTTWQLTVTSWREELRMKLESIRQRSWGNCLCQGQGSRKWDFLEIMQRELDHSSLVPVWATHLVPMHSAVVRRVKRWHGMQLRNQCLKGILEPMRRDAGGGTQSALRRRPWKSTQCQGVKRICLAFAPPRKVTYNFDIVRTLTCAHIAM

SEQ ID NO: 961358 - protein, 300 aa, Homo sapiens
LACCHELALMLLCVCPLCAGLCLCLCCMSEVMCSAGCAPVCGSPAVTVCCCALCPVSAELCWCVCCCALLLASCTPGVPLLPPAMCSVPALVAHALLNVLLACFGARMVCLQVEDAWSGVDSCGDTWVVTDVADPIQLGDVLAIFGPPQHPTTRAGYFKARLKFPIDYPYSPPAFRVPDQDVGTLNIYETGDVCISILHPPVDEPQSWGSLPQRGGNPTQKRQDHSPECDLPPNERKPLSARNVTPRDFRTVAESREGSEFQTSSEGGLDQGARSVTGGPQLAGLLRQAGREANLREQRG

SEQ ID NO: 961359 - protein, 256 aa, Homo sapiens
RRSPGYPSAPDSRLGGGVAVAAVQKADLSLADSIKQNHLQTLDGRRLNAGLHLTTTETADGPLTDCRGMTHSVGHNTQTLPTILLPGLSDLTEHTRDTLTTVQHDTNTPMTSRHTVRPTHFDTHYHHMYLLYPTHTRNRTLRRQPGTGLQPRDTLNDNAGPPDLTPYPQRGSNIPTHAETPYPPLGHNATDTHHVGPPLHPDGGTNITPHTARYRPNGKTRWGPHRDHGNIPTPPPSARGTQPPTHHTRNTTHRPE

SEQ ID NO: 961360 - protein, 226 aa, Homo sapiens
MPKLELPLRWTWPRYMLNGRCEPEGVDDLRLCAAELLLAVSVFEKTKRLLFLVCAHGLPVTTVCVIECACACLYHLARCPQMPVPLHVVPLSVLHCGHDAVICDHDCACLIMDAFGMASEADPSGVERPLPVPHACEPWMGRRSCCVSCELSPVRAVVCCTCWGLAAPWPCTLCGLVDCSDMYEEMCLCTSLCHVLRPEAGLTPAAFTWEPRLCFAAFPWTERSVS

SEQ ID NO: 961361 - protein, 147 aa, Homo sapiens
MVSPARVDLSLLSRAGHERLPLTALSINKEDYKIGQGYLIKDGKRDQEQDASTDYDLSDKSINPLVWLRSTSGEGDQVSLCHAEKAVLVGTKKRVLTLRKSCAGADECGGLWRMIDLKFIDHLPPSLAMGRFQTSGRENDKHSVGTD

SEQ ID NO: 961362 - protein, 330 aa, Homo sapiens
RKALGSSPGLPRVPCVHVNGLRGCRNGLMPCVMHLMASMSRARNDLESLLVVPEMNGSLPMMCLHAAPCLCGRCDSATTSPMCWPVCGDVLMLPLPACLLRCDCGGGTHVLCAAAVACVSSWPVSPICLLQGRCLLVCVLCGLHGFHVAGAACACLPHGLPSAGLRIAVGLAWLSLGAACRKGPGCSWWATLVPIDTSKPACCPALPFPLKVLCVAVPGASSGCAAVCWRPREPAEARAENCLSVGDEGRGALRLGEVYSGAVHLGRWAACLGHLPIPEGLFGGRRIEGARAAKVRPVSGVLSPVRGRPPVAVRAGPQGWAPRSAAFRAV

SEQ ID NO: 961363 - protein, 233 aa, Homo sapiens
RDWSWVIGSPEILRKRLSAVVSRLHTESDSMPSNDSATPTAQAVPGCSLGSREGPERGQAGTLDVRQATGGYMGPDKPHLGRGWYLGPVTESLSGIELAIMLDEDTLVVSAHAVGSSPAMEIRGRGDLYSWLRDATAKAYQGPGCCVVARQRLLSGDSTEKRTGRPVNKVIKSVSATGLSVLFLRNTRPDSPFGPAPCPHILSRPTHHPGTLLQAGTSCQALGSMKAPIIITE

SEQ ID NO: 961364 - protein, 279 aa, Homo sapiens
MERGGRDKSKKAKTPAGNTTRFLCPTRKYKLARKGHLWGIIKIRGSRGEQWRTESLKGVRHPSQGGDSCGTQCETPRGGEKVSERGRVWREEGHVWRAAAGNISVVDTKGACGLPTRRISVRECAEREERRMQAPEGAPPTRRGVYKREGGCTPPRGGHTQRREGWGPPLRGSCGAPEREGSVTPAMQAGDQEGGGSKHAAVWWCSQTTGERGGSTHNLTRGPEERTNQRGDVAARGAKFCGGHQTHIVMSEEGDTPLIPATIYEHHMAMRDHQTLRGT

SEQ ID NO: 961365 - protein, 131 aa, Homo sapiens
SPSLVFWAQNPIITPPPLVNGGAGKKAKNPKTRSGKPPSVSGPPPFNRPCWGFGFFTSWPLGGWGVDVGGVGTPSRGASVAFGAPLWERMSRGGCGKKRHCAAGREFSGGERGGVVPPQKCPYRRPEGGGG

SEQ ID NO: 961366 - protein, 34 aa, Homo sapiens
MVTLDRGKCVSKLESGRWRKKLSKLKEHTERGRE

SEQ ID NO: 961367 - protein, 67 aa, Homo sapiens
ADVTQGSRKAVGGNVQLGSLRDCEKEMRLLLAQCLEGAYGPEPMRMRGMRAENRSKWLFYKVIFFES

SEQ ID NO: 961368 - protein, 100 aa, Homo sapiens
MLHTSFSPPIEGDTNGGTHSLSIPSSPKPYTASNLSRKNEKLNYEVSTCEVPGRIKQPKWFPVNDVKHVSPTLNFHPNANPLKSLRPSEKAWVGPNREKP

SEQ ID NO: 961369 - protein, 167 aa, Homo sapiens
MVRVHRDQWIGQGAHSGSISRMLGPSSIIMATQSWGSWLAENGPISACAWVWIIFRSLAGPPRERIFPIFSISEVGALEVVPTPRRLFRLLGRKSPRVRRFLPPWVAGVLGWAYKWVYKSLLATRRRSGSRQVSNYDDAEGGSLRADERAWGRCLPPGKRRQVISGT

SEQ ID NO: 961370 - protein, 91 aa, Homo sapiens
MSGALSDCGHCDFCRDMKNVLVVPQQGSCAEVPAAASASCVARESYKYFPSSALTSDCPQSPCQGPCLALPTQQQPHAITGMLGRIPVKIE

SEQ ID NO: 961371 - protein, 305 aa, Homo sapiens
KVEEHASQDPIEQGDETPKTPKDQTHTQDNQGEAYGGPKETPTQWKSFPMTHKGHIREWTHSIMNKSGILPLCPGIVGTAGQKIIKAKQWRCDITEETIMERTDGRLEPRNDRENIQQEYTAKDNQRQHSIGQLAEERNQRRNQDQTITCITTAGPATCTAAEPPAAAGYSRYRGKSHKREDRDKTGDIRNTTEQEEEDPNDDSDSLRPSHIMNPTMHANPAKKPPKRELVKTKLQHTKRTHIYGSNPQKPTTKGGPHTNKHTNAQPTPRTPEQSNKDNENKIDRTKPFNKPPTHTYDYQTQRHQ

SEQ ID NO: 961372 - protein, 220 aa, Homo sapiens
GLCLWLAVVASEAVVVFCVVADRGAPNTLLASGLKIAGRGAIRKLTKNGRAESEEEESIESLYDAHPDDISVVKCQKDRYATYQLEVTSYRVFQHPGITGQSSSGESKDNRECDEEEHTTKSSHGLAEEQKARQVQLPDRRQLRSVDVMCSAVFRGAWDERAWLTVLGTDFPRHGKDFIAVLVTLKWSRFEPDWHTMVPWRSGEVRNCSVRVWNLVSVYW

SEQ ID NO: 961373 - protein, 221 aa, Homo sapiens
MKYPQATRTSNNEPQNTHRVPQTDHSEQTHHTQTKDRRRNTTEATTHQTTPHRTTTNEEITQARDRTPVTNHTATEKHTQKTKNNNKEENQHRIRAQWKRNTQIKIERKKNKQEHHTNKEQTTETTKKSSKETMMNNPKNDPKDRNKSKEKTNKGKTEAEQDKRLLAPEDKARTQSQDKKQSDNKHRRTLANKRAQNETTNKTQRKRPETQDEHTRQTRST

SEQ ID NO: 961374 - protein, 210 aa, Homo sapiens
LLSWSLGRGFLRAAVACCVPGLSALPAPGGWQECPGPEVQVPAIPDVCCLHCAGAQCLLPAAGSARLVLECPAAGESELSEQHVEPDVWPACLSDCGLDEAEAEIIQLLKRAKLSIMKDEPEEAELILHDALRLAYQTDNKKAITYTYDLMANLAFIRGQLENAEQLFKATMSYLLGGGMKQEDNAIIEISLKLAVSMLAQNRQEFAVAG

SEQ ID NO: 961375 - protein, 67 aa, Homo sapiens
QAMLAGFLAFRSGQPESLSQPVSCAPACLLSPGPAGAVGCAWLPHGAPPPPDVLAGDPCPMPLTLQA

SEQ ID NO: 961376 - protein, 276 aa, Homo sapiens
WQTGGPGRCVLSTQEWSSSWWNPFQSTPSAAQCLDKGEQIGSLSEVRIRDVRLWMICDINSMNWRKGQMDGPSSSPEEAVIERGNRKLSEQVTAWCINSCCDAPVCERTWWSDRLSHHPLLGTNRALSLDKCSVVNNLVSPKQQALPSYCTWYTQCLVSDSRSWCLYALSIARPRSSPGRCCTWSCTELAHEDRWCLSFPCAVLGTALVSPSYHFRQAELSAGRWLRGCGPMRQVPMRCPRDKCRSLFRRPLRGPSSGRGPRSACYWAPSHSKGCR

SEQ ID NO: 961377 - protein, 274 aa, Homo sapiens
ILATSSLARLLKPLDQGEHPDFKRTPCIVRTAESVSAKQSSYEVTLVRHSTINITKKRGSFEILSDPYLAYHNNRASDYVLRIMDAYGHNYDLSATSSRDQSEAPFDLAEGESRIVSPAGFRISRKYSREAPFSPEVRSVAELHQNELVSTIKRALTTSNSSVGSNILTHSSRLNSYTDHYFVTQDSYFYPPCSYEFEQHSPEFRYTNSYTSYGNKFLPLTYLSFYDMSPYPLNLQHSPQAEKKNKPGHYGGPGKGRIGREGFLPVWNGTRPKA

SEQ ID NO: 961378 - protein, 351 aa, Homo sapiens
CLNKVEHVGAACLHGDPATHLPVGLLQLGRLCSTATYDLPTVHMPDVLVHDPCSVPHQLLCNNVPGAGLMCCSECSMCELLSCHGMPLNEEGSDSLWLLVMHAPLTDWWLCACCGAWCAFAATATLVPWLSLGSGCGQVGTWGQTVEPLLDCSLGWWLHRVFALNFALVYPSSSVVLARDRSCVWHWVMLASVPVIGLPLCALLTFSGVVAPGMWSPALVPLAFSGCHESCGCAPPARRDRVATAGCSFLRICQPLQVVTTSEHAGPPLVYGCLRLATLKLLPGLGTDRNVFRPWWGPCGTVGPLCVGSTLRLFTPLRPFQRDPQCAYRAVAWTWLDPPGLPWATGSGGAL

SEQ ID NO: 961379 - protein, 145 aa, Homo sapiens
LVQPHRQLLGPRRACRSKTVEGPLGYQGSLPMAIFPTSVLLVVGPIAHHPCLLLKCVRADAGTERADIWVKGQGSAQPGRLDCHWAPMTPPACVSRVQRWRVLRVWVYVPELDESAILDPGRKSSLSLDEDLTEEQDVSHRRINT

SEQ ID NO: 961380 - protein, 120 aa, Homo sapiens
MDHTTKKKGAKVVGRAPPTYMLAYPTTGREVDRDSISNRKAGHPAQDEKKATEQSKALAEEQPTPRRTFALEMERIRGGDENGTKKAATEQWRETKKRREHDHHQTRHTTAHYFGRYHRL

SEQ ID NO: 961381 - protein, 206 aa, Homo sapiens
MSTWKSNYFLKIIQLLDDYPDNVLIVGSMTMWAPEQMHADPLCPFVGNGLWLLMGKNTMMAQGHPRAPGKQPSSGETAASYPGECWAYVVHHRRTSLEIEGHVSLAKYTVPAVMPVSGCHMLPVNVTVASPEHWSRAREDLLIPGFEVSPLKSPGAPIEILSDVQLIKTGDKVGASEATLLNMLESPPSPLGLVIQHVFDNGRIYN

SEQ ID NO: 961382 - protein, 243 aa, Homo sapiens
MHKSYFLLAEDGGPGGWRSGAPHGWQLSPLAGRQLQPLWAPCPVLLFMVCWCLSLVDGAHGWDHAPPPQQVGSDLCVQGLMWCWHMWEWCDPGCARGHCTWATMHRLCLQMCEKNGIAPCMCHVLQVEDTLPVILGGSQCCTKMLSLEKDVFCLKDGVMRIGRPGDLFSVRGGRENSVNMTARGPPGWLLMEGLASPPVVSAGAGKKPLEDVLFWVTGPQSTFGYAQVSLLGILMLWPGAIRV

SEQ ID NO: 961383 - protein, 96 aa, Homo sapiens
PPSAPRHRLGSAWSPFLLAGAQSLELPLALAGLWLAVSRCPLSGGPVLSWEVLVAQLDPELQLQLPDVLPVIHDHLDSCLSFAFAPVVNLHQSCEC

SEQ ID NO: 961384 - protein, 66 aa, Homo sapiens
LRYRSQAYTPATMSNGTCSWYMILCTTYSCVVCFPARKSRDNMPMIRETNHSNAMSPLLDTERVDR

SEQ ID NO: 961385 - protein, 154 aa, Homo sapiens
MGCRQPLLPSRNGMVLNAPLPQWTGRLAAWPLWFNQPCPVRSCMTVMCPGNCQWLLPAICPCLPLLSVCPHPVPSLCCLPARVLRTSTELCCAAWACRLLALDGCYRWMAWNFHIRKVCVPVIPFRQLSCRDPEGVLEQSPTGSSPCKGPNPVA

SEQ ID NO: 961386 - protein, 242 aa, Homo sapiens
GSCALRTECGCPVAWIGGVPAVACGSRHWSWDAALVRGDRVMAAWDLDGSRVCPPDWYLMMVLCCPIRCMMPVPVPLLLCDLDFVLFAVSAGAPCELPLCVLLRCAPPGSAPFPGLSWLCGVVLVVLFDFRCPCLSHVRMEWLHLCSFCASSPVCACDADSVACASFASLALPGVFPVLAMELTCLRLPQDDAKAVVLAPSVGGQSRSWLVGPFLPLTLDMGPMALGACNGSTLRPGPVTGA

SEQ ID NO: 961387 - protein, 133 aa, Homo sapiens
SSGGLSDPVETLKNRPIHGRHELLQLVTTFSLYHILPFFTNCAHVMTECAQCGDACLPLELDPVFSQGLLFRVAAGWLCSIVHWWCSGCEIPCVPNCYTSPMGFAWHDCAIHPACGLLKWMLMKHLHFHGHRK

SEQ ID NO: 961388 - protein, 272 aa, Homo sapiens
LPLQAQKCLLQMRGFSRLPDVCSGTEQMFKCQVLVRFGNPAVVCVHSVVHALPCHAPMSLPLPPPDFVCANRCTVELNVLEMCGTCMCPHMCTVICHVAFASVTNLVKYALHVMCTICVTPGGCEYVGAGSPVMKDPNYLRQNMCDCIIDGALGGPLVCGSPRWDCPTCLSRRLKRTYFGCLYIHRHLCPNVPTPSVTKSSNISFTFPSRSPCMKVPRISMPKTSATGDELQVIEPSLCGLKKLSHFPGLLLLSLKIVANSFRDHCCLQNWD

SEQ ID NO: 961389 - protein, 76 aa, Homo sapiens
LTSAAICLTAKMLIKKTWNPKFTLRSHYERAYRIPGDLYHHSQSGSAHRLRGRHSSMLCEPARSAGHRDKEELLCC

SEQ ID NO: 961390 - protein, 179 aa, Homo sapiens
HFFSRFKVLNHKDTYQNYLTQNITYVKIIKSIHVRIHRTQKQNPETQNRKSHINRRRHTTRRERRDSTKTREARKSTDQKNEKKRSAATNTRKKREHRKSRGDNEKKTRKNETTTANNNKQNTKDETRKEQKKKQTGDNHQADESNKRKDRRTRKKKKEHKTHNRDRTNRDKERERAPT

SEQ ID NO: 961391 - protein, 220 aa, Homo sapiens
FNATSEFCRTLGEIPTYGLAGNLRGAVSELMDFERDEERSANGGSESDVWSENIWLCARVNLDEEKQQQDFSASSTTILDEDLICEYVVAVQLPCSCVRTNGLLDDHMCRMCGPGVNVPPTMSAALSLCTASMDEDVPSDDNVHACEWSEYLMCFTHGLQCDECDCATKPDVKIEYVDGDWAVKLTPKEAFLAAVHRFHGKGSGKMKTERRMKNAGRGRR

SEQ ID NO: 961392 - protein, 294 aa, Homo sapiens
LYSGVHEVQGQQTAGNASESGPWVHLCARMLNFTGSGDTDSIYAADDAGHMLLMMGHVRADDIMDPDNASLKPMWKTTSWCGQKRLSPEKCDCIYLASRPVQQLYTRELPCGAKCATPSTVYYLMDLYLAPGLDDLRNVKNGKVASCSVALNEITEIRTRIGRRGSFEDKTVPAVRRTAAPMNIACDDSMPQQGGNELPEHPILASVHVLKLDNNSHSTYQTRGLEEQLNSRNLDKTEGSLDAMMQVVADRTEIEWDKRGSGVATDKEQLRKEMGTTKRQDRRTKQSKNDRTRQ

SEQ ID NO: 961393 - protein, 254 aa, Homo sapiens
TRWPVGLGWNLRTPGTCAATLPACIEPACRVSCLRTYLKGRLLGNGGGFALLLRVPLTQRLAAPTLSKSSLQSRVAKPAQREKILNEIELHRDLKHRHIVRFSHHFEDADNIYIIYWSSDMTESPWPTSWKCPGTPCWSQKCATYLRQILSGLKYLNQRGIFHRDLKLGKFFSSLENMELTGGGLWAGRPVGGLREQQEEDHLVGTPNMWLQKLLLRPGPRPEAVYGHWALSVKAALGSLLGEVTEGVRASAVN

SEQ ID NO: 961394 - protein, 184 aa, Homo sapiens
MVVYLPFAGPRNLGFLGWEARQNRSPETSRLQNHIVGGFLTSGFPASPSRGGRLSPEHRRYCIVYTQTRKGKLSRNPRPLSSTAGPPYPLRAAQGSWVVALPAPPGPHFLCRSPECGAPLFVYLGGPQNPSPFPLPVSGLSCLKFCAPFEGFLRRILLDSKRKGEGKAWGLKGLAGKGPPDLEK

SEQ ID NO: 961395 - protein, 155 aa, Homo sapiens
TCPNGKRLDSGTCVPVPSRTPPPDAPRAWNLNLHVLQTVAACFLICTDGSRKVPRAKTSRLHGADEAAERVTMCMVELAGRKVVGYLVLSSRTSVHVPTVLVCPHGRSRVPQYAAASKDVCCGVSLVPHRACTLSSMFNRYGASTMHPMVARECA

SEQ ID NO: 961396 - protein, 241 aa, Homo sapiens
MARLIPSVAGGNQRTRSSLSRDVRRLATSFIHGRVQSSWEANDTRPTQGVAHTHTRVKSPTPGNMTLSPDGVLNPPPPFSPRGSLSRDRVASSLNGIDARPPNSGCIPSGSPTSRSGASFFAQAPPWRVPLPFWGHLVVPGVFPPQSCALLASADPGSSPRRGCPPLGLLQVCGPPSSWRSAVYPSSRAHTRPNAPPGGDDRPRLRSFSVGRLQEQVGWGLSKARHSNFFGARKNPKPNKH

SEQ ID NO: 961397 - protein, 118 aa, Homo sapiens
DGPSCLFKTLMVQKHGGCFTPFSLGMVAGGVNRASISYHFSSCNKMVEGPPSTSKSNKLVGGTGEGHGKGGRRENSLRANSQYKKEGDKKRSLQNISSISGAGCGGARASVPSRCPVR

SEQ ID NO: 961398 - protein, 96 aa, Homo sapiens
SLFPTEYQLPTALRAWPGLRRSGKLEEEKMKLSRIPAVRSNASSLWWPCLIYVGCEHNSHEQIEEECELYITNSGERSDIRVSLHVARVCILRMKR

SEQ ID NO: 961399 - protein, 224 aa, Homo sapiens
MRAGLLECCTRLGRWCGAWTFAARLRGRRPELWTPAMQLLNGALGTGSGPAAHAAYLVLSDATLHVPTKNGQLVLTSPCEICDLGPGTAASLGGRSPGRPPAVRVERVQICRAPREPEAACVDARIIKTKQWCDMLPCLGGGRLRLVKSTGQGCDSALHAGWEDKDHHGLLTNTAPEGPLGSGLGSLESPRLSTSSPLASDFTRSLTTDHPYPVVREDGSGLAS

SEQ ID NO: 961400 - protein, 195 aa, Homo sapiens
EQGRPGVSDPVEPLPERNSLSAIFNNVMTLCAMLPPECYSPTSTPSCIRGSPRSVRILGSLVAILLDVSDHCHPGEGADGCSALHLSSHMIKIVLINSFGAILTGTDLFGLAGPSALPEYTDTTIMMWPGPSKAFYLPSVAMICAIASMAQELIRQCLRLNHITDCCCLSFRPSSCNHGPAPPWQLYRYYQQLTP

SEQ ID NO: 961401 - protein, 76 aa, Homo sapiens
GQVRGWVVIGRGSARAVCVTLPRAGVAGRLELGVRRRRSQVMEEPGMCSWWEVQLVVPESCEKEMRLLLALLGVSC

SEQ ID NO: 961402 - protein, 116 aa, Homo sapiens
MYPTIQIEKARDSVASNPGPSGAPGTRRHYTAPVAVATTVRGDRLRRVRRSRSQSSLPARILDPNTTHMPVFTSCRWREYSRGTPGEPACTEETPTYGIGPPRRGAIKVADLPCCS

SEQ ID NO: 961403 - protein, 248 aa, Homo sapiens
TRPAGRAGCGEHGQGYRGYLAAAPASRRWLAACLGPWLPKRCSSTPHCTTVPVGASVNIHLLPPAGACVGYYLEAATGHSPKNIILLTRTGWCPLTDRRLPGPHTTSQGTQDNLTITMHRLQLVGHWHLHLPGHTRRSMYYGSGTLVLVTEEQYPRMAQIARTPHQGPLPYPAPPTGSSPTLTPADRPLPYPGPARQPLPSLRPWRVISFLLGAGPEGGVKYWRGPDKNWARGDKIGAFCYEPLTSVK

SEQ ID NO: 961404 - protein, 177 aa, Homo sapiens
SWTGSVLIGRGGRKIVAETLAVQFVSDCCFWDSCYPQCLTCAVSWSLNLDVSCCDDALCVIDDPACCLLMGVAEPIFCDVVIVSSKYKQTAMSVTCQLELYTSSVKGRRETPAYQGPGIPEYVEPNERCSLLAEDKVTGGHMNSVIGRHIQQYHMEDTEIKGEVLYLGYYQSDIDWR

SEQ ID NO: 961405 - protein, 183 aa, Homo sapiens
IRLSTRLGVNRTRPRAWCNSTLDVEGIPCIMPAILVCLGFHLCRWCATPPPHITLPGGGEHDQWPTSPCDCPMERPGLHGLPVRGLHVQQGWLPVDFPVPWCSELHQWLCQALHDDLWILPSAALCALPGCYYVPYDLMCVCVIVCVFIITKRDRPACMIVEVYLPWVQLHFPDFTNTHSPWT

SEQ ID NO: 961406 - protein, 271 aa, Homo sapiens
GPPWLGSRWWSAPNPVASARDKEKRIQQYQTPVDQLPSRTGYQLRYLAHSQLAEKIGLYDEEVGVLDSAELLPEAASIKLAVPAGHTGPPISVYTYGLLPTHLGPATDRVHQGQGYLTLQNPSTREPRYKNAKKTIRAAAMYNYARSTNPPAREHRGQPPPRGPGGRRSYEEYERELGAQHARPRTYRPEKPYRSSIHHRARPGGKGYASRDYPGAFGTRGTLKQKTRAGAKSRDPIRISPVTGCNTSSGVTQAADSAPMCRKALEGSSVR

SEQ ID NO: 961407 - protein, 141 aa, Homo sapiens
MPEETQTQEQPMEEEEVCDVSPNRQKLPSMMSYDTYNTFYSNKEIFLRELISNSSDAYGQQSGMKAGQIPVNYDSGKELHINLIPNKQDRTLTIVDTGIWNDQWSDLINNLVYYTHKSGTKAFMEAYAGWCRYLYDLDSTV

SEQ ID NO: 961408 - protein, 84 aa, Homo sapiens
MALNSRLVTRPENSCYMSHLQDNIISMQTRQCRILYNSTMVQLRICAFRKADKDATQSPVESSTSGDQRFWPGRCNTEEDRKKR

SEQ ID NO: 961409 - protein, 177 aa, Homo sapiens
MEGKRAKVLENAEGAENHPFSCRPITADGERLVGMAGKRQAVHQPKQYIFIATKRLIGRRYDDPDVQKDIKNVPFKIVRALPIGRCLGLRLMGSIVFYRSQIGAYCSRLQDATGDLQRHYLEAHQQQNACDSQSQANYNDSAETGHKAAADFWLTVLRVKLTKCSLAMLDNDSSLVT

SEQ ID NO: 961410 - protein, 278 aa, Homo sapiens
SVRASAVGTWPWEKAVSELPFRVWLLPAPGFPAPSCERHHKEECQDRANLMCKYKRIGCPWHGPFHELHGARGCVRPPDFKTGSERDGDPGWDVTSSLPHRMHARCTTASSPCSVSDKIGYTGDRAPPPACMPHEVWVGGLVKSRSSGGQQASGHMSTDQRQDMAGLWTKSPWWTWWTPRSDEDRPETEWNGGAEVDPQVHTLCGISQGAPFSLYSPPGSTTCKWHLHLCGSRVSDSPGNRKVGSLKGLGTRGCLGPGAERPARSLSWRSWPKAIGGS

SEQ ID NO: 961411 - protein, 267 aa, Homo sapiens
TKTFTLTSSGQREKLCGKDEENGEEDHLVFYGSQTVGTAEEFANRLYKDSPPATCDAEACQRTLSEYDLDLDLSRPCQRSDNSPGGYTCMCHLRVSGGPHTDKCHRTFYELVLHVMNDSGSLCVVNVRWMYMVLVGTMTYLRHFNAMVQCTWTHAGMADKARQPTSIFELGIRADRRLWNLEMSDFITWPESIHEPRRDVETPMEALEATGAGRYQTIQPERQLDGPPTTDRMQGQRRNMRGALGRRARHYERTREPPQKIAKKPDP

SEQ ID NO: 961412 - protein, 240 aa, Homo sapiens
VGNGQSAEDARWSHGTCPSARKDCRLCVANPEEQRCLLDASSSYDMETLRMCNLYLNARSAAVQDLVLTTENAVASTDLVQNNTSYRNNDVVCYFQYTMSKLNGTHWYVHTLSSGSTWHDVTDNYSHTTSTSAEHEVADTLAEYARLSVGNRDTTTAMHALEAMALTPSTALTDDFLRTFTPTTEGTCAGLAYILRPLGSPIVTLYKASHKQATYLTHFAIEQHTFLTLVLGDLETTEGT

SEQ ID NO: 961413 - protein, 219 aa, Homo sapiens
MDISVVVVSSLNAMVQWNLVSFNGCRACGLHPVDGVGVNYDSPQMGPCTGDVMLENYQNLLALVTSTCTSQMCSLIWERGRRSHWMHADGKSPEGPVQNVELDVLVPSPTAVAIMQMKNRPRSPSVERAIGRSSRAKGAPGSVDLPEGVKASDTRGGTHHAMACDVPGRGIPPQGSPIRQKGNRGCPCMGTDQKEPTMGQKGRETGREKTTTNTGPVAT

SEQ ID NO: 961414 - protein, 78 aa, Homo sapiens
KSNDDASVFQEEEDGAQHRVPGLVALFMVCLLTLTCVRFAASWARTLVLLDNLNVRGDSFAISIREPEVTCGFDAHIQ

SEQ ID NO: 961415 - protein, 203 aa, Homo sapiens
MCDSVGLAWRRGALGCSWLGIAAGFLSGRGRGLQKGAGDSSRHGTPHAFLSPSPPFSGKAELVMNSCTPKTRLGHSCAYEPPYDAWHFPSWDHHIILTFAIHYFFTMPGSRAGPLEQQLVLRKICHSSQSVCYNRSADGIMWQLTALCPMSLATSLKTWWNMCGVRNLCGQVWYLSVPPLEGLTKWKGHWGATENAGQMHILE

SEQ ID NO: 961416 - protein, 241 aa, Homo sapiens
YDRPGFNRPRLKPGALGSAADRCNPVEERAAEPPSCLGTYSEWLLAAVVTNRFDQLFDLTESVTHFRCVLECAMQMNNAKNECLAGGAVLFVGPCVANDAAAQCLLCPGPISNCWHGKHAAARMSHEDDRKNPLPPSVWRGLTEKRVRRRPPVALKEMKEEDELERRPDQQTSVVNVENNLIEDHEMADHLVKKIRKPLERKCGEWRRIFMLIDLIIDRPIRGRGGLGQRSRWPWTWNGPD

SEQ ID NO: 961417 - protein, 294 aa, Homo sapiens
LPLMISPRSAELLADEPGGAFLCELQFGAEPELAVISCLGRVNLIGGTQDYNQGLDAAYGSGAHDVLLVVQAPAMDVAECLVTHHTLRCARVSPMLRMQVYPHDPQTPAALAVSHCVTFLLDGAQSYGSTVRQSISSGTVTTMHDHTTLHTLGTYTRSGKEGGGSKGIPRIDPPMKSEGDVAIGSPMPYQSATSRYATNDEVTHRVYRTPLIQIRDEQGDIPWIHNENHYGGDNEKYTDLGSHLQDHPKRDGMDSQDTGEPWKTTKTYSDSGEFGTLEWTTYQLGPQDYKYVNK

SEQ ID NO: 961418 - protein, 224 aa, Homo sapiens
MAWLSASAGHLPGAAGWLTDGCVILMMEMLLAWLVLCTHMNDGSDDLNAWQHHVMNVGACSELSWTLLRTRSVMYGFCSVNGLPMLLCQNTVLINLGGLKMCLMPCKCACASHVAEVWQSSSSGVDVIVKPAAVEDIDAGAIWAACSLTGLAADSPALCCTDCRLREDENAEPVGTTYQKTDAAVEMKLDNREQVGDRHEGEELRKRRTGNAPVRGQVRHSGGQ

SEQ ID NO: 961419 - protein, 96 aa, Homo sapiens
RGAPPRTSFTVPLAPFAAQPRIGPALGEVMLSSKKETRAANNRKTKRFIYTSSSKQARAKSYNSRTAAIQSKYKTHIRDKVLHKIQHRITHNITLH

SEQ ID NO: 961420 - protein, 277 aa, Homo sapiens
LGARLGLNRPRPCFGLRMAAVDLENAAGVWALGKAIGVLTSGGDAQWHELLLSWAVTRMGIYVGAKCLPHLRGAMSGLVELECENINAVPTGLSCLQHHPAGACTIIVQLLAAMAFTTREGLPGQRPTTWSSTDHQPVRHLCVGWQPYRCQQSSAASGAACWSELVAGRKISETTARTYSHLNIAGLVWLHLITDFSGPDMTIGTDSASTCIMECHRCHHHNCPEPPEDFVLEVMGGPVGYLALDSAGPWAVGVHPGVHRGAWDFCLRVVDRAGPMH

SEQ ID NO: 961421 - protein, 221 aa, Homo sapiens
MLGAEPTEVCVTSLLDASMEHRVANASGAELQRCHKGDWPLPVTWYLQAPVWLCVPQPSKCSCLSIKTGSVKTGLLVPVGRQNVWTAMTSVASGMEERGGARMGCASGMWSSSAGSVSCVMAARPGTRLFIERACGWQRLMPPKRTGGEHVSHECESRRNSQSAWRKSCRCTRSGGLFAQEGLRAWSSSSSPSLDLGRLRSRSWKAYPQGNRWANQLCLRP

SEQ ID NO: 961422 - protein, 210 aa, Homo sapiens
MCWCSWLLRVNVERLGPPDQRDLLGLLVLIASLGAKVEQVRGWTEMAILVCPCVLSGPSVSTCGLRVLLDVDLVLKCCPDVLPNGPPCVSHVDSLELLAALDHPGSNGNPGPPVSPMVLLEKMVPKVLEETVAPLAELVNPCSKVLLDPLAEKGEPGDDGPSGAEGPPGPQGLAGQRGIVRLTGQRGERGFPGLLARRVSPARGCSGASG

SEQ ID NO: 961423 - protein, 182 aa, Homo sapiens
MACQHRRTKYYKAILMKDLDAFENETAEKVTLHEHLVPASKVCRITHIRLMVCEPETLLNVGTTTLTEASGKLHLLDEATSIPVFWGATRSFTVSPKVTQMLDILRDYLDYRGYSYERVDGSVRGAQRVALGQLRTFGQQPIFRCFSWVLGPVELALILNSSRYCDFVDSDFNPRNDLLAGA

SEQ ID NO: 961424 - protein, 105 aa, Homo sapiens
MITSALELFLFWMKMNHSLRNLHNTNLTCSCIIDFWAEIIRVLDKIEVLYEDEGFQEIEQLCSLSGIYSILSPGGYYEESLNYALWKQGTYFKCTMINSEYVETI

SEQ ID NO: 961425 - protein, 187 aa, Homo sapiens
MANGSPLSGDDIHPVGSSSIDPFVRTFLEERKVSNIQCAVIKLPDVYGVFQFKVDYNRLGYTHLYSSTSGIRCSAYSSDSADMSRFSPHRHLHHYILPDAFLHVCWRLFTLQTIVFLHMKRQETKSDSEGLRDHSSDTGDEMTGTGDGGLIRTLVVLCLLLSVSKPWEKWHNIYLCGTMQQLKTPKG

SEQ ID NO: 961426 - protein, 221 aa, Homo sapiens
MPWKSSSIERLTVPELTPAGLRCLVHDGCLGPPAIGRFLTVAAVFRGRMSMKVVDEQMLNVQYYVLAVYGCEKWIPDNVKSAVCDIPPRGLKMAVTFIGNSTAIQELFKRISEQFTAMFRRKAFLHWYTGEGMDEMEFTEAEVANMNDLVSEYLAVPGMPPQIEEEDFGEEAEEEGTKGQSHPSTIRLTQFPETVINYKHAHHCRSSTQEEVVRRPNMTCL

SEQ ID NO: 961427 - protein, 104 aa, Homo sapiens
VVLFLLVSSWICLHWVCGVRGISYFGAVWSFLIGDLFAGCLVTVVYMPILCTPVCGFGSRFLGFLSSWPFPHAHRLVLIVLCPAPVSGLFWSVCILCDVILSPV

SEQ ID NO: 961428 - protein, 161 aa, Homo sapiens
MVTSQIMGLIGTSSQPDAHGSHPACWGGGTSHKPPRQFVPPASGMPSGKGHQSGEESGGDACHPWQCGEVQVEGSLLPPGHGSLKPSRHHGIRASRPSRVRFPLLPAAYTGQAVAIVTCIIASETKEDPQLLALMRENGGGAQGQRNCATGLHLNTYGDSS

SEQ ID NO: 961429 - protein, 381 aa, Homo sapiens
VCILPLVVPFLCVFLCFLSPVLFCWLCFCFFVFLFFPLFLFVFLLVVLVIFCLRFWPFVLGTDASAVVPCSVVPLFASSSVSVCRHWSPVPLFLLGSPIGVARFLCFAPFWAFVFGALQFRAFPAPLFEYPCVVVFLVLYTLSSSFFGVPWLSTSVRPLQAVLILSASVGIVVDVLFFRKSVTLASPGRSFSVSTFAYSPDEGIVFVTPLVSRVFRDNLPLDTLWASSSNIDTWKQSIPAHCAWGTACPPACPLGVTCSPMESRWRSGMAKRHRLPDCSTHHKTPPTGAHTTHEMASNRKCSKTAQQVSSTQAPPSCSLLLDHRTFPSGSIPKISRFHRPPWGFSLTQSPCPALHQKSGYSPRPHSHRAEEASAASSNMYI

SEQ ID NO: 961430 - protein, 178 aa, Homo sapiens
AFCSCCVSFCALCLVSSLVFWCCLSALFLFCSVVLRFCCFCSAWALLRGLLVPRCLSLLSRSFYLFFSFRSSLVLRCLSFFFFVFLPSVFPVLVALLWSLFLRSAVVYLLLLSFVCFLVLAFLSFVPAPCLFVWGFVLCVVLSPFVFVLSVSSRGLLLFCPFFVFAWWLLSSCPLLCA

SEQ ID NO: 961431 - protein, 285 aa, Homo sapiens
ALVFLFSHAFVLFSCPLVGPLFVLCFGVLGSLFSSVIICVLCLSLVPFLFLFLLFTVFIGVFVFVFPLLCFGHLLSSIFRFCSIVLYLLAGMFFVLWFPLSRIIAVFRLGSCQVSCLICFLSVLSSFVGIIISGSWCSYCASGFIASCFVWVVVFGSVMAFFEVFVCPLLLCFFFVFFPFLVTSLVFHVCSVLVYASFGGSAPVKSVMALWFSVLLCSCVDVHWAHGVGLGAPQRDIVLSIFVLHAVILGFSVLCLRLQVSLASPTGRRRRPFRVHLSASSALLR

SEQ ID NO: 961432 - protein, 186 aa, Homo sapiens
MHMRNQTGIGHTCPHHWWESPNHCGYIQGSKPPDKATGRAHTKANKEGHNREQYTRTHIKNRPFVQNKGSGADTDPAPYQNLPTVIRHPKVHLKIHNMGHQIRNTAEESNRHQRGTPLIEQAHGGAPQGYRASPNTHQYETSPNTRPHAGHAPHYEYVANNTSAQRGECTTTCGHCGTEYDERERE

SEQ ID NO: 961433 - protein, 280 aa, Homo sapiens
MLLVPILQMDEASVKMLHLDVWMKTKLNQLTINTLMNDNASCVLVLPTGSGGPSWSVGLWNQTNDMWLPDHALPNHLCISQMVPCYPVTCERPNAIEGPVLCPHSAGWGRVDSIRIGYRYIITYPYPYASRSYTESEWYLVREGECTVPESGWHSEMTQRDGKRTRPIHTLQKNAHGRKGVAGEKTRERGPIDNMGPNHRMQQGRSNEQGFEPMVAPRVSQALNGVLWEQPEHIPRVECRGEGAVVAVCRNWKGDCAVKGGLYEMGSGGLCDPWCKGDVV

SEQ ID NO: 961434 - protein, 102 aa, Homo sapiens
MARLWAVPEVGPSCDRRSPTTRRFPYAGRGVSVKFGRHFEGSPPISVSKEGGEGKAWGYRGVAGKVPPVREKPKLRWGQTRQEHFRSIPEGGERGAARKKEA

SEQ ID NO: 961435 - protein, 102 aa, Homo sapiens
MSYVPEMNLNVLLLRQCASLSCASSCDKCAGSKAIVMGMNTSTWTLMACYAQSFHSFEVNMQCVNKMFDSFKVKSVYAMASMHVAQHIITYLIICVHAPQCA

SEQ ID NO: 961436 - protein, 274 aa, Homo sapiens
MAFLVGQQHVCCDCPRYHSEGDLSPDLLTFSDYPFGEEACGEIVGYSWSSLEEQRMWNLKHRCPSHDPMHCDVMHDGECASSPEPQSSYLGSLGIWDEEGGDAGAPPFWFLACGLELSYVPQMVTLSVACDDPFLGSSPLPSRGPPFAMQPRWTPAFGVPPPPEWSLGPGMKRAGWTADCLVPTVSELGERDLRLKGWKTLAGVCLPHAGAQLDLSKGGDMSGSHGVRQGKSLCSSFGDMISNYKASERQGGQNRENGKQRPREKQTEGEHTGT

SEQ ID NO: 961437 - protein, 289 aa, Homo sapiens
MELLSPPLRDVDLTATCMALSAPLPQRDDFYDDPCFDSPDLLLLRKDLDPAACCTVGAAAPETLNEHSALPRMCVCTLALVLHCDVTDACAAAAQLGTTMAVGRCLLCGLQGRCKAAMNTNCPTRLQWPAAMLLQAVSRHEQMEIDVPLRHSMLLHCLRQSKPIRLPKVDDLRNCHPHNIDGACSALLAATHVTPRPWLPHACLLCAVARAPGPAVAEHYSWQLRRVQRCAQCSDGMMDTVAPRVEPVVNCKRASKRWPGHAWKSVVKLMLPIEVPRSLATCGGMGREL

SEQ ID NO: 961438 - protein, 71 aa, Homo sapiens
LPHLPPPPTCRIVASVTLPASAFSLLVICTSSQMQRLVTDPCLLLHEPVSSGPVLCSMVTPPVLPTPRVLS

SEQ ID NO: 961439 - protein, 116 aa, Homo sapiens
IAIRAVYRGISYYHLRASIACPLPGGPNMTVLALLFDVCAVMFLYVGDCVCLRVIVVLFGAPYPGPIISYLLACPVDFIAAYSYRSLWPPIPVSNGWPQERVFVMGVTVIDGTLAA

SEQ ID NO: 961440 - protein, 127 aa, Homo sapiens
LFLRPADSRRVPVAPSCSLWTPLACWVICRGLHCALGLLDCWILCLCAAYLMWLPMQLPACACDVNILGTLCCDVDLLSLCCELPQVAVMWMDVPAYCTVCSKMTLPHPLLYTLLRCHVDATVTRCT

SEQ ID NO: 961441 - protein, 510 aa, Homo sapiens
MECCLELVGCVPWTPDPRGLLRAPQLVHLMAPACFTHGHVCLPPLLHPCAPASHCCCPDADAPVCSASVALAVAAWVSCWFSSEVLGDKCDAPHLFECATVLPLICCDKTLRGLAVASDDSVACLRTYLTHWCPCWEGTRGINKGLAIYTEGIKKGPYRTSLRRQGVIRQVIKDVAQRRNWPPNTITLQRSNIALSHHTTFNGSKTAKYPLIQTDVETGEQLLVRGHILSNAIPPEWACHSPLISTNVILAPQKLMKRTQDHPNRTPGEPRVPTADSHNGHEPIPLNLLACRTTWRMWHPVEEGERTETIHRHEVSSTRHSKRDFPTAHPHTTSLNEGPPNAGAGIYRSEDSPEIGESGVQGAQEPELVKRNAISFSNTEQPIRNAPIHQSQFPPHYFRHHYSQWPSDLYGDDLIPVATRQHLKSEATRTLNKRVWYYQLAPKQIIQTKIGDSILSHNRVVEIIYKLNSASRLHPIPNGAVNNGGAVRSSHNSPPILHSERKRYATYSDL

SEQ ID NO: 961442 - protein, 174 aa, Homo sapiens
VLPGVPCCCWCIVHVWPVLCVLHDAVMPASEPDACPVPMCSPCALCALPPLCLLPAAFCNWCPVLLHVHLCAQCGYTNVPVVPCVSCPCPCAVLPAVLCCSSVRVVTFRLVHSGVLVCNALLLLLMVSGGVAVMVCAFAVPCALCLCAQQLLCLYDRGWTCVVCVSICECLVLC

SEQ ID NO: 961443 - protein, 109 aa, Homo sapiens
MMEERKRQRKEERRITYYREKEEEEQRRAEEQMLKEREERERAERAKREGRATRVSRSGVKKIKKEVGKGEKTAKGSGNEEEKGREEREIEMSLLKDLWGDEIRRTGKD

SEQ ID NO: 961444 - protein, 177 aa, Homo sapiens
LGLETGAAYVSEVTSCPVVQRHMNRSSNESQSDRHFNNSINQCESLEKGSRTTEVKLKLYCCYISRPLKDRCNMPKTGVLDLIKKGQMVTHVNALGSLPKEAARAELCRIEESQIKEILSLGIHLVQSGDLATDREDTNMEIQKSSGWKTLRKTWHTQQIKITNTDTKPDKNAHKNT

SEQ ID NO: 961445 - protein, 353 aa, Homo sapiens
LFPFSFLVFFALCFLSLVFILSVLPFPFSVLSRLRSFFGCFFLVLYGVLLLLFVFCLSFPVSLFCVFSLLLAYFFDRCCVGFFCTFFVPFLHLPVVWATVAGLYPSSPMFGVSPWSRVRVDALVLWFLSPSTTCSISRLGGAHALGSSYSVDIAKVAPGRSPRLCEARCRFVTVVPFPLVRGLSPWCLSCPCLGDPFGTPSLWMTVSCLSISPLPLCSPEVVGSVGSDPSLPRTPCALPLRSLLFPPLTYPPPLGAYVSCPKVLTSFVYTQVPIPIAAYADKGGTAHVPFSVWPTHWGSIVASAQSELDGGSREAITVHPSPLMCSYPTPKIPCPTGGSPTTMRMAKHIGSEQ

SEQ ID NO: 961446 - protein, 331 aa, Homo sapiens
LLSFCLSFACYFLGVAASVCLFFCVMWSRLDLSPPCVVSFRMFHGSFQCFGLIPSVGPFVGWYQVRSLLSPYAYACCLPLSSFLYLMLFVCPCGLNCSLRMIGSHHVHCLCFSLSPSPDCAALSASWDIADFIYMMAWMAADSGLPGVPPYDTEPLIYDYEGDRLGGSGTLSSILSSQGDEVSRTYDYLKTVVPRFASAGRHVWAPVRVGVRGQMGPPGQGGSFTLGHCYPDTEAGQPDPGAQLDMPLPGLVAVMAPCRGSTEVTRARPHLGTGAASVPVGEGHKSGGRTLSVDGAAQEEATIPARGGKSFSQSAQCRSHSTSPTRCLTSQ

SEQ ID NO: 961447 - protein, 116 aa, Homo sapiens
MWVSGSMLGVSFSSSNLSERERAAAHRSPYNAQPSVIRPSIHSLIGRGPRTQHSSIIPTQGHVNITSSIPGMSSSTPHETQTQNISQSSPVMPINVNDSFREIISRIFIIINNNRT

SEQ ID NO: 961448 - protein, 222 aa, Homo sapiens
MAPVNGAVENGQPDRKPPALPRPIRNLEVKFTKVRRAAPPTLDGLVAPALVHAMTLVAVRGAEGCMLCACGCPAWCCLPDDPDAFPALGCGSPGNRTFRWDVSGRGSLVLCWGFCAACDASEGAGNLRPVQAALLRGPVACPAFPSSGPLTVSPCACPLLIGEWRCAPPFDSERAGFGELPPQKTPAMISRVDESGFERVGGSEERQERVREAGWRSCSWKT

SEQ ID NO: 961449 - protein, 173 aa, Homo sapiens
VPLLIIVSLCIVSIFSVLFSSLLCYVQFFVSIFRRVPAIFYFFNCPSLSRHASWSLLLSSFRRPVSVARVLFVWANTLCCYCGSFWIPVLGCSFPSVCAPRFLAFSLMELAFSLLLCCYFLSCPVPPLCPPVCFSCADCCVVFVTSAALPEAYFHSSLWVGLLVHCSWLLRSL

SEQ ID NO: 961450 - protein, 113 aa, Homo sapiens
LCRLVLLSFLCSFIVGVFFLLSPISCVTPFGPCVLSSVLAAPVVSVFCVFPCFHFLHVDCLAVHVPPGVIPWFLLLGLSWSVFSTCPVSVSLSSRSDAHAMYMMLLSVLLCLN

SEQ ID NO: 961451 - protein, 188 aa, Homo sapiens
SDASEDDVALHCCVVWLICPVVNTLICEHWSIARQSVFTWGMRTRPSHAVHFILYTNVSLGPGLVRVKLLALWDRQYFKLLYVHYLSNLHKVLTCLSGPLVSTIYWIYSGFLVVTDRAPECCGYLSKIWGRYNQQKYAEDGPPDTPWFSHGGHTAKISDFSWNPNDALGHLLKCLRIPNHAGIMANGC

SEQ ID NO: 961452 - protein, 94 aa, Homo sapiens
MFSLLLEPGALHLWAHEGVHSPCHAWDLWKGLPWHKGPLFQRTPRIWVSFFFSVIRVYSRGPALGCGGNAEGFAVVLSTALGLDVYYAQSCPPP

SEQ ID NO: 961453 - protein, 71 aa, Homo sapiens
VCCEVRLVLFCVCCSCVVFFHAVVVVSLLVIGSSFCLVFSSFLVYRGVSVVRLSVIFLIVVPVVPFGGSFS

SEQ ID NO: 961454 - protein, 30 aa, Homo sapiens
LVFPRGCDRSISLEVLSAHLPPALRRARPP

SEQ ID NO: 961455 - protein, 247 aa, Homo sapiens
MEEEIAALVIDNGSGMCKAGYCWGLTASPDACDFLSSLYVCCPMTTMWLSVCVAWCHECDSILCVLTDVPMMQMRGILTLNVPHLSMASVTNWDCHGRRSWHHTFYNELRVAPEEHPVLLTEAPLNPNGQQREDDYRECMKTYQHHRPCTWPSMAVLSLYASEDSTTGMRYMDSGDGVTHTVPIYEGYSPPHTQILRLDLAGRDLTNYLMKILTDARYDAFTTTDRAGTSVRDIQEQLCYVALYFEQ

SEQ ID NO: 961456 - protein, 309 aa, Homo sapiens
KASRGWARIGRGVCFIEVATPEGIFLRVPTASYDLDLFTMTWGPTMLLSLMFDKSLEETIIQKAISGFRKCAMISAHYGLSDVLTISSSLYANVTALSSESIENLAQVDLGAHPHSAYSRPTRSSSTSGPRSFMVTSCGRAGRISWEAMLAGSFRGPKLMAQGYDRGRRFRGSQCGKISLQREETPSNRGESTVLSFVSWLTLSGPEQSSVRGHPLKTKRPESGLRVYKANVTQTKMITGKQVSSQLEIHYRELMKALVFSDTRRRDFDEEDAASCLRDAGKRLGGDPDRVAGFGIVEHLTTWFRPDLS

SEQ ID NO: 961457 - protein, 220 aa, Homo sapiens
MTSIEEPGTTILKRTLEEPWKGLKVGVGHGKGKGDKEMIPQNEHWTKVEAKQEYLRTGDNMMSEAMEHYTTMSQTKDRAQIELGQINKIRDNAEGHQDEQEKETRADPKQHKGKWEQGHRNRTAQKDKYCNNDKKHQAKTEQGAQRKQTAQREQKRNEPNRRDKSHTKRQWAQRQNTNHTATRKHPKQRQQGKRHRPKTPENVKKKTKETETTKEKKQKI

SEQ ID NO: 961458 - protein, 74 aa, Homo sapiens
GLDRVLVLSGRGGTKLLPEVRLGVSLSDRDGSWAPPGLVAGVLGACWAESWIWGLSALMSCVDDVMCVCGCCVF

SEQ ID NO: 961459 - protein, 161 aa, Homo sapiens
MAIRAQHCNAAQTQTGEANRVLDSARRCLSGHVILMMWELLQREKDGSVCGLELIASEILCGEQSVLWMKLSCCASCLWPCEAFDLDPAQWVESMSSPTPWCPQPTWPVYTALLRPHDRDHGCWTCPDGGHLNPRHYMSDVKRISATSIFFESMPYKLNRL

SEQ ID NO: 961460 - protein, 164 aa, Homo sapiens
MWSAPLGHHTTLVALGRFPYTAPWEGSGYLGPTPSAGAGGALSIPAFVFAHIGDLNPWARFGTIVAQRPIVPPVWITLSPYGIFPALSGQVLPGAHDALDPPSAHVPGRPQHPTHCDGPSVHQLYGRGCTDFTHPSPRLLSLLHVAGPSDSRPCACVTCGCWNY

SEQ ID NO: 961461 - protein, 67 aa, Homo sapiens
PPKTGTLDLFPWFTSNTPMAPALPLDFANIFVIGEGNKPWISLPPGKGIRLPPTKKDKRLAAKKNSG

SEQ ID NO: 961462 - protein, 76 aa, Homo sapiens
MFLKSTPELQIAQVYTLACFTVCVDRCTSSEAASVYALMTVVALEGFIFVVPSVGLQIGELCEGFLTAWVCTFVWS

SEQ ID NO: 961463 - protein, 87 aa, Homo sapiens
PQGCTVALASDCSIHLQLQGLVNPARELGKLQAKRVKAQRQAQRLRERAASGYPVKVPLVQEADKAKLQQTAELPKMNAITKIKKML

SEQ ID NO: 961464 - protein, 97 aa, Homo sapiens
FLFIFHVAVGASRAAVEAGFVPNNRQVGQTGKIEAPELYMAVGKSGAIQHLAGMKDSKTIGQINKDIEAPIFQVADYGIVADLFKEDPEMTEKLKKK

SEQ ID NO: 961465 - protein, 145 aa, Homo sapiens
GVRRRRKGGEGEGTKKGKGKGDEGERPKKKEKEGRGKKKRGGESTAQKTKEKGRPKKKKKTPKNGENGRRTVPKGGQGAGTPKKGATPPKPGSQGESLGPGLAMPSSGGEGPACCIFSGAPTTASFPPLPYPILPNKAGVIDPKP

SEQ ID NO: 961466 - protein, 103 aa, Homo sapiens
MCFFVTVVVTPITNVGHQDLALKSSTNTVVNTTGFLLNFDISVRLMPDERLGPGFDDHGLREEPECGPDAKWEMAANCIGSAKEESSNPRCSKINCDHLTVLL

SEQ ID NO: 961467 - protein, 96 aa, Homo sapiens
KEEAARRKQEQEAAKLAKMKIPPSEMFLSETDKYSKFDENGLPTHDMEGKELSKGQAKKLKKLFEAQEKLYKEYLQMAQNGSFQGGTGLTFLTIVD

SEQ ID NO: 961468 - protein, 121 aa, Homo sapiens
SVASSLGERGPESMELFVRVLALELALALGPAATLEGPAKWTYQLELQHSRIRGSQRGPKEGAEEKDIGTNRQFFTNWELGDQRKISGKSTVISQEGGGGYEKVPGEKGCPEALPVSELYE

SEQ ID NO: 961469 - protein, 125 aa, Homo sapiens
KNAQTVATKPLRRASNSTPTKSYMRTSSKPRKPRQPPHNKHTGRTLCASNHVILIKDHSPTNRTQQLSHRRILPLQDHNTMGLTHPPPPTQKTLIHKKKHPHVHTPIPHSPPIPQPRHHYRVFLL

SEQ ID NO: 961470 - protein, 91 aa, Homo sapiens
MLAPEFAKRNVSLIALSLDSVEDHLAWSDINAYNCEEPTEFPFPLLADRNRELLLLGLLDPAEKDEKGMPVTARVVFVSGPGLKLLLSCLP

SEQ ID NO: 961471 - protein, 145 aa, Homo sapiens
VKNPPGTLTLEVEPSDTIENVKAEIQDKEGPPDQQRLVFAGEQLEDGRSLSDCNIQKESTLHLVLRLRGGIEPSLRRLAKCICDMICRKCCARLAPRAVDCRKKCGHTNNLRPVKKVKGGSFLEEAASCPGPVALEPPVSLSLTG

SEQ ID NO: 961472 - protein, 170 aa, Homo sapiens
REHRSELNLRRLFAASVDRFHFSLTLITHHGRILVGYSQNLVTEDVMRMLVVLAKSRGVVAARERLFTGVKIIFAEGRAVLLVALRIRSFAPILVVGVGVLPEVIVVLVLMKSFCPRVRRGAWMGFPGVTVADVFFLGLGGSALGPLWVLVPLCLLFGGPRVWSVSCFDG

SEQ ID NO: 961473 - protein, 144 aa, Homo sapiens
NFPESLLAILAEEELLEELCVSWSDPVFKSRAGIDPAEEMELLLENYYRLADDLSTAARELRVLLDSQSLIFLILDQPRNVLMRLNLQLTMGTFSLSLFGLMGVAFGLNLESSLDEDHGIFWLLPGIFMGSGLLWRRLLSFLGR

SEQ ID NO: 961474 - protein, 54 aa, Homo sapiens
QKPHMGPTSVTGNFDTVASRGEMFVFKERWFWRVRNNQVMDGYPMIGQFWGGLS

SEQ ID NO: 961475 - protein, 208 aa, Homo sapiens
MASSPAHGPGPQISALRKMGVKLTPHNKETVQHSDVLFLAVKTTIIPFILDEIGADIEDRHICGVLRGPASPSDSIEKKLQRFRPAPRVIRMHDQHIQIVVRRGGHRCMPQARTPRMEDGRLMETADWDRRGATDNGRMEEDLDWCRSRGLSEQERPVYGDCKYQWTDQEQVSTAAIKKTILDKVKLESPDRDRTRTHTGHTRQSPKT

SEQ ID NO: 961476 - protein, 94 aa, Homo sapiens
RDPEDGEQPGQLRTSSPSMSEPESGWAMEPNAAPVASASCPHLLQQGGSTVHPPGDACRHQAWGAQHCAGPAPLSIIAVRRHRDEQIGTQNYET

SEQ ID NO: 961477 - protein, 110 aa, Homo sapiens
MAILCSHSSQKWCVLKNVCCCVYEVTRNANNITHDVWVHLKEAYRLRGGGVRRFEPGGLYVNPYFEKSPNHGRLKKDQICYAVKAPLEGRSRGSERTCDWTNCMLLFSPG

SEQ ID NO: 961478 - protein, 39 aa, Homo sapiens
AWVKTDRKRRQKFEENEHETGTKITISSLQDLSIYNPER

SEQ ID NO: 961479 - protein, 221 aa, Homo sapiens
CGKKTPSFIKKMAPPPLPPKQPPRENRGPKGCGSGFVVYAHGMSGGRRLLVVGVGGCFAPPFVHGDVCVEQKRYWVWQQGLFSLFLRPYPPGGVTPPHRERKQRWSPQAAHHTKENRREWSLREVEEKKSGENEQRKPRGDANHTMEAPQETRHNGKTPKRGARRRLAHNTPRERKDEQQASTNHTTGLCHLLLGPLFFKRQPQGDQMREGINPYTPRNQI

SEQ ID NO: 961480 - protein, 68 aa, Homo sapiens
TPVSGSVPSGALDGPGIGEPRWLSAEVSAVASGAGGRGLWTGPGPRPRELRWSAMVLEDKWSRIALYT

SEQ ID NO: 961481 - protein, 107 aa, Homo sapiens
CVLQCVLECHAGAAVWWLALSACGMMEAGPEPCRLVSMSCCCLPAVLVLLRALCLPAVCLDCLTACLKHETYCLTVPCAGWLEPALLQPDCGNEAGAGQANGVCGCA

SEQ ID NO: 961482 - protein, 152 aa, Homo sapiens
MQFVPVVLLPHSAAGVVVFALWFPGLLMVLRLMSNVCPRDVLLHPPPQLFVAEVAAAVVALVVHPSMAEHFLTLLDVPAMQKDYGALEDSHSRCGEHHPCTGFNVLWVHAPMGFGASHPTCGPQGVPPSVACSSQPAYGPAGPGPTQLGGPA

SEQ ID NO: 961483 - protein, 232 aa, Homo sapiens
QLRSGVITLSFQLITVLAGSFEYSHAAPFMTTCRGNPRLAPTSNCSYRHTPAGPAPILSRLCPAYPPCMAILNRNWKDAGLNDMVYLVCWAVKLNDLIADWFACMCYQLSADSWHMLRRLWYGAVPSFSVVAIFLLWITYTHMHVLAEAPAAHHHVPCVTLWVCPWRLTGTYAAHERTLEQQKRICEMAAYFSHSNLSAVCTMIRGAAYSPQIVCFTLKELHRTGAPFVGAY

SEQ ID NO: 961484 - protein, 125 aa, Homo sapiens
TPYTHDPQRWGKLSAGTAVLPSQSLHSGMPEWKRQRRNLQNSSSSYCLTCTLRRTTERQRTKHTSGANCSRALTRAGTPWQLRANHAASCTRSGPTQLATLEHYTCAQEAFNRPSLGHNCFCFEQ

SEQ ID NO: 961485 - protein, 255 aa, Homo sapiens
CRAGCYSAEGELLVDAGSEKEEDALPECSRARPVAPVGLESDLSKVLCTMLRMFLQSAGPHCMSLRGEVATSNDQCVLAVLLLCLLLCELLRWSLGCHCFVQQFIRCRRCARDERLDLGLTGLLGVTVHCYQPGALKLFFRELPWAPLPLLRTSCQFIAAIKFAGPWPWRSRCVRDLGVRSLARSQPLTLCVMLFQHLCLGDRARAEQNRMSVQSLLAIVSGPRCCGPWWQRPCSAHDHGVPEQVVELILQQCAD

SEQ ID NO: 961486 - protein, 235 aa, Homo sapiens
GALRRHFFFPPSFPPLLLPSLPLSSPLSSFPPRSAGACWGERLVLQALALRGRPAGSWRGGGGRNRDGASESTAVGGGGELGGPAAGSWGRLASERLRQEVWRLCDGFGRQIQAGGSCGGGGSYSDLLLLLPRTGRCAGGCVMLPDERSRKWSTSRLTTRLYPPGLVRSQHRSIDIFELGSLIAPIFWHRTHYLHVSSETPEQTSKGQHLKLMILLLKSSRTLKESKNLIASQLI

SEQ ID NO: 961487 - protein, 71 aa, Homo sapiens
LRTCRVPYIMRRTFGGNKLYWAVFSEYVTTYGYGMDYAPVEFIPRRDKKPLCTRHETPKYGLLNTVMEPYI

SEQ ID NO: 961488 - protein, 212 aa, Homo sapiens
MGYDQAACYSAEEFIISLGSCLGGPCAEHGDGHHWGPGGNYYVDSFLLGADAADELMLLCRYAACVDPVCQPPLCMAVLTAVPDAPLTSALCSFLSNGDCVFCAASWNPVHCGWAANCCTLLRVYHHHHHHPYVHPQCARGWLAAPDGRYMRSCAVSPLPCVRSPSLGLPSSRPYGIKPEPLYRPEGVTVPRLTLTLCTLTDYAMWFSSRLI

SEQ ID NO: 961489 - protein, 253 aa, Homo sapiens
RSVELSCNGHEKVYRLLLKYGDAWVKKYDRSSLRTLGSVGEPINCECLGVASQGGGGQQVHAGETPGVQTEDMVASASHHGPRKKVAEILPAMADDGPSLASVPVLMDDEWAASWSGSNCLLSGPVHLPVPWPGAWPGPSMCDHQLIMWTAYFNVPTHVLLHSHGDWGLPELRADIYQITWAGWMMSSTSCGHLAGCPAEDLSDAIDRPTLQIPESAVIGYPHDIKGEAAFAFIVVNRCAGDSDVVVQELSHG

SEQ ID NO: 961490 - protein, 240 aa, Homo sapiens
LGRGWVLIGRGSYPTITISYLPHAPPFAGGHPAQLGLGRGASTFKEEPQTVPGGAQPGRHAAGVPHQHVKTKMLHQMCELQAGCVNLAGCATNVPGSGMLDAASALPVMDNGEDCSVPENCGAVEYRLASSCGAVWPSSNRRSLTHCHATGCQLLLGVNVTRLLNCPLPLYWTPPLLVTVLWHTASHWGPVEQAGGHPPWDLGAPANHTGLLALLPCAQSFHLDVYNAPPSTFFVCFSAG

SEQ ID NO: 961491 - protein, 244 aa, Homo sapiens
MLCVLHARHRGHAATKGKIGSAKKALTFISNVGNGVTRSPQTGPRTAFGTPVWMYRMGCPWDAPTLVCDANSGRRQDLWGQLLAGPRSAGNLGDTEGWVLEFPRARCPRGNARGMTRAVMRARRPLFFARRGANRFDGASTPGVTVGNKPLVICGAPIMCWWSPGCFPKELALMKQAPPLGTVWFPATIFVFPTRGMYPHWYRMFLRTPHKRGMVDTKGGGWLRRANSGLTYTWAPKLFVGKRP

SEQ ID NO: 961492 - protein, 237 aa, Homo sapiens
ACSCRAHPRGFGSVHGSRPAFLHLRPPATAAMGPTSPPHGEVPGDGVGAPLLPVPYGFSAMQWLAASPWRMLTTVFLELDSETSHVFLSTMDMEGRKLPCTVPNIFLISFKDSEGLQGDGKLQKGFSKIAFYGYLSQIDHLKNVIKELGTGYAAATHLRMKDETEKVADEDIVDHEEGCTAAGGCYHDYLKEAADTLRAELSKCPPTAIWGWQRGTRSRAQWGAGLGPLWVLPEMSR

SEQ ID NO: 961493 - protein, 84 aa, Homo sapiens
TDTRRSYPTPDGRPEPALRSPLHRTLGTAPDGPPSVRSSAALGLSRPTGRPSSSLRSCRPVTDRCPCSTWLFLPRISSHPRTFR

SEQ ID NO: 961494 - protein, 194 aa, Homo sapiens
YEVMGWWPACLHNPWVAGHPDGLLHLLLLLPGQAYHPVSTCGGDRTPSSLAGAYQAMETNAPPSIYRVGISYLLQPHSIAFNIMSKCMKVLAPTVSPHARVVPHDKANVINVKLVSPSPLRGVFKGREGLSSSCWRAMAGHQSNPRVVGQNDEGAPEPPNGPLTSVVPTMNPKARRVIASGGSHASLFQHGLMG

SEQ ID NO: 961495 - protein, 71 aa, Homo sapiens
LGDAINKYDVLLSICTMPQLACYELVTVRSKTTMRLFYADSGRFDPDVEPPDNSRLLASGLGSLLGPLVKR

SEQ ID NO: 961496 - protein, 198 aa, Homo sapiens
MARIGEGRSRRIWIVLGAWSPVPAFKLWLRVDIELPSDDPFIDLNYSGFTCSNTDSTHGHIPWHRQRLSNGKLVINWKSHSPSSSDAMIPPERLNVWRDVWQLSYVRSESTGRLHHPVVEGWGVILQWREPPTGHHLCAPLADCPRVFSSWVVDHVEVLTTCLEIVSDGSCVSDCFMDPLWPGASMTNFGIGEGVLLP

SEQ ID NO: 961497 - protein, 292 aa, Homo sapiens
FLCFVFSLLGVLLFGSRFLAPVGGGGLSAFVGIRFIVVPRVFFRVVVPLFRIFCAPFSVQFVIARRLSHMVPIYSLKRPNQRSSSAPERYRHRVGYTSEGQHIWRREDSAGHTRIELRMGWTEHKEAQRMSPCSQEEKWGRPRMHGSYRDENTGEHERRHPGAHLDLLYVQLSLTKDLFHGQATSYSLQGRSSGDRAAGNIITRYCHTHASNGGLEDYMSDRVQCVSTAQEWDPSFEEALDGLTPLWHSFVPDGYTLASERQEVTSLTKLYRGVPPGMKYVLYTHIHTDTIK

SEQ ID NO: 961498 - protein, 271 aa, Homo sapiens
MNSQEQGPCYAGEPYPAGMYNLFEEGTFRHYRERSTLNMLTPGGRDMQAGFCCTAPSGAIHPLHDLTPEQDLGPVSAPHKDFSVMETAPDPFVSQCPPSPSAAVGLCVTVQSSSATPSLFPLTGTGQFMCTRLVGSQPCSWELEERTWRYHKGPHHFRHLPPAHRGRGHREEAGPSVGINVPQVLWPFLNWEVPGWPPGERGKCLTGADTPGRLCLLSPVISRFHYLLTCHVTHQCESQGHSWSVCRSSATSLFVVGQPEAVARIIVQFLT

SEQ ID NO: 961499 - protein, 237 aa, Homo sapiens
SLVILSCPPVLSVYALLLVCSAILEANFQAVGGRSLDKFLFGSSLRSILDLRLTLRTLFPTLVGTPAAPAHSQRFCLQPRPLCHLGIQLLPLRVWGADMSKAQGLCRHIGWWPLGLGAQPQHDTVLRQLIAMGHHMAQSCCAVSQGQCTIAPLEHASALWSMMAQMSGFCSAFLDHWRISPHPRVGHEQGMESHAYAKPPAVTQYQQEVQGHLNPLFPTPSQQCMHACPSSHDGSGT

SEQ ID NO: 961500 - protein, 160 aa, Homo sapiens
MCLDPSTSARPELYGLMREWGHSSATPRGRTFKQLVEALDKVLLAVSEVVPRSSRLTVRTLFPLWWGRLQHLLLQRFCLLLTTPLPLGSSSFPFGSGVLDMSKGFKAVLATIGWWPWALGLSHSLTQCSTIDSMGPLAQSCCACVQGPCALPLELPLPVS

SEQ ID NO: 961501 - protein, 52 aa, Homo sapiens
MSLDIEPDIQCEELSDASMGRSSSLCSQCQVVRLTRPHGKPRLPQGTSQLLR

SEQ ID NO: 961502 - protein, 105 aa, Homo sapiens
MLEDNRALATRMIHAAFWFSTTSGIATATSAYPTQTFSHNEYFNMLALVRNTFLSSSSSGDDNYLYISLGGWKFDVVALTTNHDSYRHLVRTPRTIDTSMLLEFL

SEQ ID NO: 961503 - protein, 144 aa, Homo sapiens
MDDCSFQTKALDNPGPPVHSLTVELRWPGDVGAPIESVQRHLYRTTIIEDPRTGTGYDAPATEHNAPTLNPDRPCQAREIDLDPKLRAEARRVRNGAAASVRFLTTPALRPGEAPRHREARGGMPLSRPDGDLAGRYYGGSRAF

SEQ ID NO: 961504 - protein, 301 aa, Homo sapiens
MAPTRESACVLLSITTTDGYCVRGAVAHQWVLPRGPGALYRTRGGERYRAARKASGRSGIAPRPVIEVPFRSTRCRCPHGSNGYLAQSRFPPGESILSLSTDHHVELNSQYSNMKCAVSLGALSSLNRDWKSCMERTVNSTSRTKSFAPPEWPETDATTATCNEKGTCVRLTQVHPFPWARLFVSALIKVTTSAWLGTTVEYLLREPILSPGHPASIAPGSRATAPIEHSVGESSESLDEDANELVTFRQSAFRRGLFLVIAFLLCATPSVPFRPYGALGIPEAGPLVTLDGCGPMKCRPP

SEQ ID NO: 961505 - protein, 133 aa, Homo sapiens
VGGLHRGHELSAESETNETIQADVACRFRLVLRLDDADGGSHCVHGDVLLEAGMGPRCLGPYWSYSESALIVLLSSAVALCNGPSWQTLGQDRPNKQPLNFGKAWRNDRKDKRFDMWLEYNRDASDCTILISA

SEQ ID NO: 961506 - protein, 162 aa, Homo sapiens
RHLGASPGKPEHAPTTMPPGAQDMAPHRQEPKGQDILGQGHSHPHPFHTGWDAPTPGMSRDASLHTMALIGLGHPHAWTPRLWGPASRPDHAHWNALIPWTSLLNGHAPLRAAMPLESPRWVTQAPMRVRIGEDVDHPHSMKRPQMDSSMAAATDLHDAVKA

SEQ ID NO: 961507 - protein, 155 aa, Homo sapiens
MNKQKSNKQEAKEPAQCTEQATGGLRHSSAEWGLAPKETLRTRQQSLGGFSGKAVGPKRMFGCSSAKQTQYPSDQLANPSTQGSASYTMSSKRVACCQEVERIELKWRPLRDTHSTHTHARTHRTHTHTPPFQFPLPVLLDWYRPKVFIQKGSAP

SEQ ID NO: 961508 - protein, 141 aa, Homo sapiens
SPSPRNAERAPCEFVDLYVPGKCSGRQLGSSVPRTSALIQSELVAQEGGQGTQGQSSKIGARFQQRLLRIIGGGRYPVGMGVGSPALISHFYRNLCPKWSGSVAKWFFKRRTFIELGRTKFSNELVGENSLGPVRKYITKA

SEQ ID NO: 961509 - protein, 216 aa, Homo sapiens
LGSSPWTPDDSRCPKGSLRKFLEHLSVGRQRPSGVLDQLAVWIASRYELLPVRCLWLQHWVSTCGGQMVVLHLTDGATMGIVLCLEGSKHSGMSAWTWVKNVVSQDDSLPKGWSDGGKRESDFGQVCWRCCPMGPFRWQAGLGEMVPWPLKGGLSLWKEPLGHWQQTWAGANSKAKNPFGLFVRVQRARWYGNSGETCATYPKPAWVGETPNKRTG

SEQ ID NO: 961510 - protein, 73 aa, Homo sapiens
MVPLGDCLPPKGVTEEFGSCNTVNTFYVLAPKEMLQHCLVLKDTSKEDAEVLVELPQTGDLDQNTIETMRKPR

SEQ ID NO: 961511 - protein, 94 aa, Homo sapiens
FARCCGPAAVTAPMSQWTHHIAVHPPAASGRAMDPAAGSLLHCRRRRLAGPSGCAPGWPKHLCTLQVGGQLGKPVELRGRLVALSVLSPEFQTR

SEQ ID NO: 961512 - protein, 258 aa, Homo sapiens
AHLVRLACNVGTCGWVAHHLARRQEDAVSLFLGAVTTCSVPRAQSCPAPLSPPQPPTTCPAALSTLAPVRRAAAAASIYLHPPAMERPVTMSPLVSSSGQPTPAAARFNVPVREGARGLRRKKRRREEDGRWTEDLEELECAGEEARRRADPRSQCPPPLPPGVALMDFGNAFVPPGPRDSCRLLPPSSPERRRLGTRAPVSSTVPEPSRCSCCAVYAVKLPEEDSSGVAYRNPRQVNRSESLNFHADLGKHIHLDSS

SEQ ID NO: 961513 - protein, 70 aa, Homo sapiens
ERERERHRRRGGERLMIIIVIPERSSSYILDVLNTNIDGRRKIAFAISCHYKGCGPKYMLSVVYEEEADY

SEQ ID NO: 961514 - protein, 182 aa, Homo sapiens
MAWDHHHRGGEAQGSMGSAAAGQMMQSERADAASSEEVEGEMAWPWEQAEAECGLLEPVGSSWLNEELDRAQERLATALQKAGKNAEKMLADESEERYEGYLKHRGLKQMPKRLELHGNPNSKKLSTIAERGMIGKYDEVATLGGDHLKGDLERTEENELSLAEVPYAESMDEQISTDGPRT

SEQ ID NO: 961515 - protein, 185 aa, Homo sapiens
LNPFSAASQPRVCECQRGIRQQSLFPLVPVILRKVEPLWAGGGRGQGHIPNTCRARVPVRGTFRLCWEEETWAGKEPGPRAVRAASPLPPLAQLSSWVVSMPASFRKLFTKEKYIFPPEGLGQGQGRECYGNESPGKGAPGRDVNISGLPRDGIGLRTFETNRFQNPQNFAPGALVGQSEGRTGK

SEQ ID NO: 961516 - protein, 353 aa, Homo sapiens
LWNWLGSELGRIVVRAWQGRLAQAHGFQCFLRDALSVLSVLCSAARNIVLSHTGDASGHSSAADAAIKKLADFMKHHVTAKGELDPAVAPCDVLGLHKHVYLECAIIHCLTRFGENGKTPLRGGTMNESQTADCSEFLGPVFEDNREQQQFPARFVTELKLWIDEKMLTAQLTCPMTEALKNCILSGRRQPGIHGRAGCQLKTGWTKVDKEGRELHLEEKPMSLKALVSEEAEEDLAQCARDEAETTNQSQRARRTYIDCQPSMTCMAKSCCACEKIAWISLNAKLQWMIREGPNGVHPCKKRNPGRAMPNKTGVDADRTGKRDKDTGSAHTNTRPAKQACKQEVSDGMEQQE

SEQ ID NO: 961517 - protein, 239 aa, Homo sapiens
MWYTDKYGPIDVQLSPMYNAMPERMVAPLVDTTLADWRREQNEQHMGLLFNLTVVYTFRGNQGSRWCGPMRWKRTNGYGIVAQHTSGLGTTFNSVVALLVEKAPKRSAYQHNEITANTHWVHHTKKGLFEEAYHTPYRGGTNATTPDCSEGRNEPTERWNRGTHDSDGTYTLDTATRYGVAKVLNTGTQTHPQVRSCVSNASTRNTTCDQVKTTREGDTMRPQEQASRCEAAKFETVLR

SEQ ID NO: 961518 - protein, 102 aa, Homo sapiens
MHSDDSKKALKHVGCSATWTVLYPKRQNYTPTGNFFTNNWNWRTYNYSTFGKLSRRTELGPNLPVITRFWKNVPVWRKFGPRANGLVQRIKSFPLDSGVPKG

SEQ ID NO: 961519 - protein, 81 aa, Homo sapiens
MMLSLYGGEPVLSVQRYLSSRTENGCCATPCYAVFPYPAGVPHAWASLIWPGHVRCITSEYPMSIQQVLRQPQTSSVLVLM

SEQ ID NO: 961520 - protein, 48 aa, Homo sapiens
MRRVQSDHRSGTTVEVKPDPRKNNLVEIILDINVSQLTERLKGDVHPA

SEQ ID NO: 961521 - protein, 205 aa, Homo sapiens
SPGTTAPMDRSFQSSFRSSDNAQSVTPSPDALPLPGTSSSCKVLYDFEPDERRGAGASMEGDVDHAGPTRSYENWYEGLLDGQVGLLPAQLRGRCLCPCRYVTPPRCPRLSAPCRSDHFVAGRVSTKNGGLVPLPVSPRVFAPLASSPRRSRKLLGCHLDAGGDPNTWGDPPGSRIVGSGLHIRPVGRAQAETPQNKPLSVIAVG

SEQ ID NO: 961522 - protein, 261 aa, Homo sapiens
GGLVGPGGGPHSFPHPLPSLTGGHGGHPCMHNPNGPPPTCDAATEHHQMNQGTPDRSMWHHGPPSNGSSTWEVQPVGSGVYRLQSKEKGMIASTSSLLGAMSDTTRRPDWQPRGGTGTPEKEKRKQKTRTEEKGKQEKRRGGDREEKQERANARGSNSGPRSAQPKPTRPRRARNTRGRDTRPHRPSTQPRARSPEPDRDQAPDPTTPAADRSAPPPPSRPHQRTSKQLPRRKTARSRRCTPHAREAQRPAGAEPHPRPHA

SEQ ID NO: 961523 - protein, 112 aa, Homo sapiens
MKHVKGNKAIKKLDTKNIPKAHEKIWDLDKKIQKLLTNGRKREDSTKDRINGAHIGKVDSAAQEESDQDNPPGTYARRPEKNNPENTVVGRLRPGATKDKENQVNNDRRNTT

SEQ ID NO: 961524 - protein, 177 aa, Homo sapiens
IINEVVLGFNFGTVGWHPMNAVRLTLRFMLHALVLAMAGPRLVSRDLRFGLVLRLFTPRRRMFGPVVAPKPKCESLPGPGDERASPVHPVGPCCCTDWAWVGEIPPAPLEGLSPASSSSLLGMGDDCKRRCSWEGAFPPVPLPPESEESISPAFALVVSEEDTSAFPPCCRPFRDDE

SEQ ID NO: 961525 - protein, 488 aa, Homo sapiens
RQIEIVPKEKIVILLCGRNTMCTYYSDGRPLMERKAAFDIKLPETKGCQTHGHGHTQEELWHHAMYVAVKTADPFYEIQRTQANSTESSMRIVGSRHSDAEAMDECTGTGLNVMELPHSGIHDTVLKQYKERNGQTYINLDKIPSDPHRLAVTSHNRYYIDAPYRRTSGASKSEGKYLEYRYQKTMKNWIQKKPRKMHREEETSSDKEESMSEPERNTMENNKRYDAEPPNHHKSYTEKDTHDEKIIEKDRKEIIKAIFCAQSKWKHMNNDKKQHQATTDKTDIKGYTTLNHSVEQGGQHQIQTHSTIQNRERQYTIRERAKQTPKTTIRNANKLNQGENTEAKTQNRYDKENNQRREQSTAKKDNETKKKSTQTQGSDTQKERNKRNNEKEINQKEATAQRNNGTAERGKSRQGTSEETTDKMTAPPKWNCSKPRTQNYNHAGAANMEPERKENNEGTIETHSTPRADSQHTQQEKNEQQNTNHTNM

SEQ ID NO: 961526 - protein, 110 aa, Homo sapiens
IRLGTSLGGYSGRGSSRCRRNLQCPPCDGASPVPGQRNDDEDTWERAGWPGLVPAACVLGWRLCSSACCCLCGTGCQLLMCGFHAGHVDPRSPVLPCPPLPGDVAGMMPV

SEQ ID NO: 961527 - protein, 118 aa, Homo sapiens
VNTARGCLRPSIKEVFRFAYYKLLKKADEWVDIAGSEDGRSPISIQPDGLCNWSLLRVSSVVSSHVINIIWLMHSEAKDVRYRDDSNGEVHPSYITTDISGTFLNKTRQYNPCSNTLK

SEQ ID NO: 961528 - protein, 221 aa, Homo sapiens
MECPRRRRGGLVRPDAIHVTHVSVPARQGRNTLHVQGTDSLRSSVCVERQRREDVAKLICGNAALNTATYSNDTASVAGQRDDRAKTDRQHKGGSWEATGIPFTQGNVGDEDSTQGPLQTTHRNDSEQDQGRAHTSHTGNPDPHIPIKTTVRRTRAPPDELQNVTAWSKLSEAIPPVMPQMADLPKAIENGKRITDEIDVHTSPDTPRRNGLSNQRSHVCN

SEQ ID NO: 961529 - protein, 559 aa, Homo sapiens
LSHAPIGYLMCTLPGLSLCCFCCAELEHDCDVCVMPALYGLGYVLADALCYLVLTCVCELCCCVAVVLLAVLCLIAWPACLCGVLVFTTCMHVMLLCLRPECHAVTLRTAFYLLVCHLLCVPDVPCAICGVPDCAVVCFLWTADGDACCACGVRAISLCVCADVTCLPDVVAVAACGCAMWMLCAVLLGVCAWLCLWACSGVWHNGGPLWLQVKIWWTGHTSWAPKLEPRIPHPESLDWYITLGKPLGAGLTNSWPPIPNHLDEKPPWGYGFTPPVLPFSHFQKMDILSFWMGVLNEERFSTGQLRYMWVYGKAIRALGRTVWTRTVSRFSYWTPQGPSYTQLVSLWAKLTVIPLIQHEQELWNFETTVGEHCRKEVPREKLCYGGPMDGKEPPFVERLEQNIHYHRTSLVVERGYVGRQWNFPIGVNLAHVEALFLGWTSNRAFAEAHWIPGTSLRGNTQCNGKGSQINSRPNATKRIGAGGVGSAPGEVVEPPSEGSRWKEETYKCNSKRSPPGRTGANESQQTGPGGGRQTETGSDVAEHEGHDDSIESRTHKCRP

SEQ ID NO: 961530 - protein, 191 aa, Homo sapiens
MRLIERRLNREPMNKVVDPLYYEQIGDDVKAPAMSNIRHIGMTLVTRTQGDQRLHLMVLNGSVCCEVSLCCFRMNDEGCTLGTDSQLITGRCIKGKKTRLNYTSMALDLTRDQMCSMCRKQCADNDWNAHVMMFRGLPMRDYDYRSSTELGFYLKKYRQTNPEYWKTVLMLKYQSWSRLIVLERTMDWDHH

SEQ ID NO: 961531 - protein, 126 aa, Homo sapiens
CAWWFGLMPGPGRGAELEGVACDAAADGYCGLVFWLDWWSRACACRNHARPCWSLLLGPVPASASASFCCWVTVRRCPPLLRGLVQALALRARSACAPCSTTPLGAGDTAVDCCLLSLVYWLGRQR

SEQ ID NO: 961532 - protein, 45 aa, Homo sapiens
MSLGLGVVGSGLSLQQSLLTPEPTVIGLPDSTPSKIELRPPKTDG

SEQ ID NO: 961533 - protein, 72 aa, Homo sapiens
AAAVPVARPGLVHRVSWWVPVGPRLHGPWRRRGRGAGMPLPGLCSVNVQCRSPEPMKAPGAVSMGGPAPASV

SEQ ID NO: 961534 - protein, 72 aa, Homo sapiens
RYLHANGRLKYSLSASVLHIGRAAYSYGSFLYRQKPANIGYFILLTCIASMQHAFIWLLSSREAKYHSEGPQ

SEQ ID NO: 961535 - protein, 255 aa, Homo sapiens
CWAVAVCLVSVLRALHPGPGRPLEVADGATVADWSAARAQECHGVCMSAGAIPGVCLPGPDSPLRVRLFLSWWHADDMMSCAAPCACVDLWGRVFCWPGQFSGELLATHLHMSPPPEDLVSFVAPGKCSAVLVPLPVLAGIASLRRSMLGLPVLGAGAQWSGGALLERILGPKSFAQLSVTGALLLLLSASIARHEFGCQGFLNSAQPSLASETRPPRTCMYITIGHWPSFGSPVDLQQVPVPIGQFRYLPYDWL

SEQ ID NO: 961536 - protein, 125 aa, Homo sapiens
MSRQAKDDFLRHYTDVDPRTHPNGATPEYKVTAHVHLKEWTQRTVTMKCGCVMRTRVQATFRNAAMEDHGPTPTATSSAVLERVPRLSSRGPGVWPRLKAVSESRSGERGQRTCFAFTVHIPALN

SEQ ID NO: 961537 - protein, 142 aa, Homo sapiens
MYWLSDAVDLGLVYNHACSTYFPKDVSSCASQTSIQLHLLSSYPRACMELWDLLSWSRLDEPPVVDVPKQMDDWMVPCLTSSIFWDCKMLTPIAQCSRCALECLWVPSIHDPSNPFPSAPGEPAPCDPCWSLAIVGLAAIEP

SEQ ID NO: 961538 - protein, 292 aa, Homo sapiens
AGLLQALCSHPGPFQQTRKQDGPKKSSARDGTWHSSQNRTQISVSIPLLLLATCDVLSGHGGMLVDRGGRSGMLVQTPSSVGTPNGIFADSEEVTLVGGTVTSYASVTSDIVARTLGLLVIVARVQSLMYYVSRTDEGESRDGVGKMGLRGDIADDGLGGECPCTCPACVVLKPLVGTGDVVTGVEMKGSPLPLGSPSTPSMPSGSLPLLLEPVEDRFGTLFSVPGVCQEMRHVLQAFLQRDVAGHCLLGPLIQLLDRVPPSCSCRTGGSCQLVRATGGGAVWGAPGLGLPP

SEQ ID NO: 961539 - protein, 254 aa, Homo sapiens
YTYPENWRAFKALIAASVQRGSGPRALRTTATSIVGQTNRTPEYLRKFPAGKVPSIEGDDGFCAVMRATPELSYYVSNEELRGSTPEAARPGWLASACVGVCLIPDSRCPHDHDTLGCSATLGLSKCTHQTNQGQLKNVQRGRTAEAKILGRGGMHYVERQKDFFLVERSRVTVGDIDSSLHPVVALIKQVLRAFLSRQAYSHIPNRLVPHAAMNLAPSSGLLGGKCNWVRRWARLLLQVCETRAVRAPGDGRS

SEQ ID NO: 961540 - protein, 95 aa, Homo sapiens
NANRSLRAVLVLQALVLQRWVDLVIRLPTCGSSGPPSVCLTGVWPSALETGPLFHHPVRHELGQLMYNETGSTHVGMCRCSNYRTHCCGALTLTE

SEQ ID NO: 961541 - protein, 131 aa, Homo sapiens
MMLLVDAGCVDNWKNIAAQSSGAHSLHMSVIMTIWLLPNSRGLPQRGLPKGAKLHVIVARVCSLSGQWSLKLAVHFVPKAWYETTVMMDAAICAVLSRGTRWIVGTRRLSIGLDVEENIGMGRTIPLVHLP

SEQ ID NO: 961542 - protein, 258 aa, Homo sapiens
RGESCVSGSAHELLCDTQPLPVPHGPVAGREAVLSLYRALLRQGLDKLLHTLIETFYIWASYPVAEFLKNIQKLEDAECPGMRHAGRRRPWVFLNGKIGEDHLVHPPRGKRTEGAFCRHSCSLPSPSYRCIKKPQMSNGRRLAERKGKKDDNGIWHGHDFVLSNARLGAGGGWSGHAGHRTRVVFQRMYDRASQCPYQAPPALIPFGGHGAAKNPMDGLPVTADQDMKTACAVLADPSKTLHLAQSFSAASHAGGGDL

SEQ ID NO: 961543 - protein, 214 aa, Homo sapiens
MPTHHTAKKTGRERGIQEQTLVPEKAQEKKASKDAAHNTHELALTEDNPMQGTSTGTQRTKERVHNIPKDNGQDFHVHMKSMRHSPTTQPIIIRQTTWQKTNVDHTRPQPRKKPYNPNTTQLRITQQPTDTRSERTLPHELDTPKGTPHIERLTGHGTRNHGKKDGTGHNGPKRQVAGINDKEENPYNRAHNSAQTCQWMSHNQQERHPQEHGD

SEQ ID NO: 961544 - protein, 105 aa, Homo sapiens
MDMTTSPAGLPPSCPRPVCPLSLPRPFSLGVLAWDVDIYLSIGNVMLPHPFVNTAPISAVQSHFDLCPFIVQLISLSAAGVASLLALDVLRHHRPLYKSLPRKER

SEQ ID NO: 961545 - protein, 119 aa, Homo sapiens
MRAAPCVAVSDAFHDRLIVPSVTPTGVTLIIAPSRARYVYSPRPRSPLVLVPLAFLGRTPVQPLRLTCSCLVPEIRPYVASGLIRETESGGEQWRYPVGPGCPGLSAPCALPPDASQWE

SEQ ID NO: 961546 - protein, 234 aa, Homo sapiens
TRDMLLDAGVPAVPLGCGSARPGPSSSSAAGPAAGSGACAGAVGGAYWRRLLQAQAAGVELEGGSPPGVARGGGRKTQQPGPPARSLARPRPPNPEVRTRTRIRLDVATGPLLIPPVRPVAPGRALLLLPVAQGSDFKVEICRVICLYGQVQVIGVNQSAKGQPCPRHLSLCIPTSGLSIHDFTTHQPEKSEKDLTGDARNLLTSHLNLDDGRWPMPEFSPRVRWDARPFNCPL

SEQ ID NO: 961547 - protein, 290 aa, Homo sapiens
PHRLLPNVTNSNGAHHQTWTMEMDDVEMENYEAPPETMERDWMGDAKTTGDLTKADIEQTPVDTAYNPGTERLREMTPEEDSDEATQDRLTGENPDMKLWKPCEMGTREDGEGDETKDMTHIRSLAIAKSIRLRCQGIKTQAERRSHENKARNAVLNKASKRTQRPPKSCHGLTRHNTGNMQIVDTMNRGSSHHILQPIRDHHPLLLAVTEMQRVRLPPSGAREEHPWPQERRQTEKQTGTRRVHALNGVHSAPGGQGQSRHRRDKAILRPSGPPTDPHRTGSKMSREKS

SEQ ID NO: 961548 - protein, 190 aa, Homo sapiens
MRKGPWALLCCPVNAMGHGVHVVAMCHGAGVLPGEVWEAAKGFMYMPQSVKAHPPQSFLRAQPCAVFRASTHLPMGPSPGVDGISGICAGYLCMATSGELVPVRGALRLTVHLVPCCSASLQGQCVTAGSTHSESGVAVPVDGHMHLDPPSQRIVCTLGSGPEDTEMVVRFGAGSEWASLVSLLRLHLDS

SEQ ID NO: 961549 - protein, 179 aa, Homo sapiens
REKVLMQELVTLIEQRNAIINCLDECPAEGGRGRQDVVNAMIKKKEFQMGELNLRAMKKGKFKTMNVFETARKQTVMPMSNVPHETMMLTALMKPVVVTAPSWSSSCVLCSVLKWWRPAPLMISHGVKMTNGDGILCGDWPLPPQWTSDCSVAKESLVSSPEPQCSGDSALPNLILMTA

SEQ ID NO: 961550 - protein, 243 aa, Homo sapiens
MDCIFNTIAGVLVESAQNAVRPTAGIIPATTTREDRHVRGLYKLDREPVGHRKSFLFVCHNLHGGEDSPPSFVIGPLTRKIRSRGCQGAVLLIQAVRESPSSLNKSGTDSVRRSAGYLASVRIPLDRLSDASPLSRVKGTDGLAISEWCFHWADRVWGIAPFLMSATGCLLEGRRGRNPSVVSLLVFREAGRPASVSPGAPSVLRIVVGSCTASAGGPPINLLLGPLPRAAAPRPSVALAVPP

SEQ ID NO: 961551 - protein, 211 aa, Homo sapiens
PGPHLLAAQCQCNGPVCLTSAPSARCDLSACCVSDYLCSLVDLLWIPGPGLSPCELCISNLEPNPEVIKFDCITVAVQDPLSGPQRGAPISCVSVILVICCILPILYRCLINLAFYVLHPPCHQRSPNPDFSPRCKGILCPKEFQTQIRTWDLVESRVKDQRDNVSTIPTVLQRHTWLLCHHLAWRRLAAAGWLTARYLRVTVADTPARTS

SEQ ID NO: 961552 - protein, 35 aa, Homo sapiens
MSPARPHGGAPGGSGSLAAGPVCVSVVALTGLSRH

SEQ ID NO: 961553 - protein, 253 aa, Homo sapiens
GLDFPNASTGEPFHQPRPGLVPARRCAQSCLDIASFYWTLTNNDTHTQEPSAQSGGVRSSGQLQTLAPQCVRELSALAVSKPSWALSHQAGPVVALLQSWVPRSCMVAHAERLTHGVLHSRFWVVDQTHFYLGRAPHGLGVQLDPCVIGCWAVGRRQLLAAWLARPDRESLRPTGSWAKAAAPPINLGPGSIDTPATTYETPIEILLNGTPVSVPYLASAPPPLLSLWPHSRLEGVYLNVLDDAPEFHLRSLS

SEQ ID NO: 961554 - protein, 272 aa, Homo sapiens
CWLSLCSRACSPSLEPPVVPDVTSPRSGIKETILMLKEQNRLLTKEVTEKSERVTQLEQDKSGSVKQLFEARALIQQDGGPLDSTFIYSLWGRVGPQASLSGEPHWYSGGYFQVLLTRAVCSHAQPVPRFQLGEASSLSQWKDDKPPCVTGGGWGRSPWGVTLSGPWPGLHSRVVLEYVLVGVALGQPNLGGVRRCHQNQGGGHQASRWFLLARRAPDAGSVCVGRTGLRVRGQGVGGRRPPSCPGLWDTVPQAPVSGDVPGGFLDPSEPVA

SEQ ID NO: 961555 - protein, 507 aa, Homo sapiens
MSPGCARIRSTPTTLMPHGPCRWSPSGLLTDMDVRTIGCLLEPSWTRAPRSRMRACQRRERSECEVRPCACLRRAASAMPQPIVAAGTALEPFRGLDPYPNLRHSRGGVDATSLPLWARTPRVALGSLVSQFGLLGHSGTHFPSVSAIRNADPLYHPEQLTDRLYDLANRFGGIFKEKRGRPFKPRGLVPRCDFGLPHSDQGTGRTLKRAGLDRGEPPGHFARTSTQSASPELPIEMCNRAARDLAWLTLNFRPLNSNKALALVPPQALVLGAPRELKPPFFRFRPPEGRRSGEIFRNARGRRRPKCAHRGAASAQVKAPRMGLAHRAFLWKTREGKEPGAPPVFPARLCFCNAPHTLVLQGGPTSAFSGPERQDAAFRGLCRAVLTPHQWLLRSQPAWRTATRFAPHGFQPDCMFSGAPRHLAELVESVRRPLSLYRRRRPPFCKHVFADSKGPHGGVSPPLAAVWFVCLEGRSLFRESHKGGTRGAAQAFDRPQPVCVASAPTTD

SEQ ID NO: 961556 - protein, 240 aa, Homo sapiens
GRAKVGCYQQQQRCSMLSSSMHPQMLMIVPTTNVHSSGSEEDVRTNGPCQYGSSRELHASEVPAMSQPPAASFSCGEPGLESNRRGELPGVASRDGLVASKVRGGERLRSLWRRPRQDLKCLKNSELAPQTVLPVPKLPVPIKQRAVPQGSLDGLAMAAVLSHQGQAALIARSVLSRWGAISDLVLHVARVGAAAAARMGVSLRVLRDSYKNGEQGPPEETVIPVTHIRGVCDPAFLPRT

SEQ ID NO: 961557 - protein, 315 aa, Homo sapiens
MSQRVKERLRGLFNSPFSLSWCGGLLPVTGGRWYWVRLQAPPASCGLSVRDPRGARLPKRPRSLFQSVGVVATQEKERQRCSHVGVRGREILNFLFSTIFSGEGSAPLKAGLPRYLYRDRTPELFSVGIRLWGPVCPPGTPPLREGGPLLETLSYNAPLAALAPCGRFFTFSTLQITASLLNTIGAHNKTQQTIYNPIYFPTCGGGLRDVVNHGKKSRSIHPEGPPPQNHTISVCPHKKEGLSAKNTGEYKSLNFNLNSCRREFFIILSRGREFIPRESPFLYPTFPRPICPLIPPPQYFWEGCTCVPPHKEGAL

SEQ ID NO: 961558 - protein, 252 aa, Homo sapiens
RVAGLHAPAAGGWDVRAGGERSSLGNVLRAAHLRVLTGAEWLVEAIRETPRWRSSRRRCLKLLCSWELSKYPTEVYPIKINPSLPQRVVLTDARTILEENIQDHGCPIIDKKACSITALPKMAECLSRQKMTRTRPELLQITRPYCGATVEPALLQAWTVAAVQTNMTDFQDRTPEGYWCLSSRWRRPVAAEPGMRVDLLMQGECLAGDDEDSVCASCLGGHGDGFRDHARGLCDPFWPRPGGLTPTRISPL

SEQ ID NO: 961559 - protein, 66 aa, Homo sapiens
MVQWVPAMSVDFREHFSLDGVRGNRRGRDLLGGLIPCVPVPGAWTWLSRAASEVLILQAALCLENL

SEQ ID NO: 961560 - protein, 230 aa, Homo sapiens
MAIPAERHNPIGLHHYATSSTNAIARNSTYTAPNTATHGRSTPPSPSTQTQTTEPTNTTPHPLPPRPATSNDNGTTESPTTHTRQTTDKPTRQTQAAEDHTGRRTRAKQQAGATSQRHQKHNNTGTHTDKHPTPAQGPNQRHSPRKRPGGQTHHGLGDSTLGRVSDPRDTPATQTIPRAEKRKHEATERSRRDPHSIETTTHANPKKTQGNTTRDPAAQHNDDAQHAETE

SEQ ID NO: 961561 - protein, 128 aa, Homo sapiens
MTTRETTTNRCSDQHRPKVGNPRREPNRRPMDERGNTTKDRCQTTAEERDPIKRRPVLESTPLKRNRERETKKKTTKRDKEHNEEKNKTVGEKDRPRRNKSNQPKRQRKTKETAEDDENHQNRAKRNT

SEQ ID NO: 961562 - protein, 119 aa, Homo sapiens
MDTGSWGYARHVWRSGDDLAARMLLPRTTPNTHSLTLPGDLSTELRLNIQAAINQGEQKIGKTQREKHGQHSELHEANPTQKDWKDGNEARAQQLSTQRNTAEMSHVACQGPQHPGPMG

SEQ ID NO: 961563 - protein, 137 aa, Homo sapiens
MFFVFFFPRMPGTAGSNQFLELRVKEPMGFFPLGPASWGLFSNHTSIFIPNEKKLNSKGSHLSQNSPLKYPKAVLYHRVPQEFGGSHKFLTARQSLKSNVEIYNRCPDAPSSGVGQSCHEAVCLCGREMPEPGGQTV

SEQ ID NO: 961564 - protein, 151 aa, Homo sapiens
GRGWGKDFLPKFTASILHPKSAPGRKSHTICDGVWGRAFSCGLPQLSSVTHLGESPPARRKHPLSNVCDAACGEDHLCHRNSIRPKGLPAKKRSPERVEKTPLPICVAGPGADRGYKRGRCEISCEYVTLKRGLPLWGQKTTLDTLLRARG

SEQ ID NO: 961565 - protein, 74 aa, Homo sapiens
MVGVETWLPFDGPGLIRGPQSLERTPLGDPQLSHAGLSAEDPERPGQHLACPSMSLELRKFEGGWQRHAFLRVP

SEQ ID NO: 961566 - protein, 101 aa, Homo sapiens
NGVRGRCRSMDGPPELFYDETESLSNTFASEGSLNTAGRPGVGKRQVALYAGVARKGRRIWRVREGEVTRVGADYLVSGKSTLSCRPLCGLGTSAVELTDD

SEQ ID NO: 961567 - protein, 147 aa, Homo sapiens
AYPCVATVGHRGSPPSWRAVVAASPCVQLHPSCGYHTLCVSTVVPVTPCTGTKGPGSSQELKGAKKVQFGVKIYTEYSFMQAPGKTACLMLCYEWSCDVAVTTNTSYSSHVSLGNNHARTRVLTHTPGRETSYSGRQQRNEVGLATI

SEQ ID NO: 961568 - protein, 198 aa, Homo sapiens
SGDAEPPPQPPPPRRDAAPGEPGPGPRGPRYLPPLPASPETPERAAGPSEPLGEVAPRCRGADELPPSAPCPLAARPARNVAGGPGTPGKVRGRLPGGGSSEGRAPGESEGAGAVRQSAEAEGGGRKTSPRRARLLQQPQKARQLAGTETKRRLGHPAPRTNQPILARSGSKGRGAGIGWGPPCRCDGPDRYTLRFVL

SEQ ID NO: 961569 - protein, 144 aa, Homo sapiens
MVLGPEQKMSDDRCIWRSWGVCQSWISYQSAVACSNRLSLSRVARGDSEEYFATYSLSEKISIPEEEYSCVSFRKHLGFHRTRFFLCAVPTMGSEESVEVRFAVWRQWLDLSCVWIRSVGHPCGAAAPAGCAAQTGSGYWAASC

SEQ ID NO: 961570 - protein, 78 aa, Homo sapiens
NNSTLFLQNFKNDPGAGTPPCIPRILGGPKQGVSIEVPGVSTTILWALSKNVCVFSLTYGDSYSQEPPIPIIFLVPTQ

SEQ ID NO: 961571 - protein, 133 aa, Homo sapiens
LSFLPPSCSLSFSLSFFFSFYKSERLWGGGLGAGAARRGEVVSPPARRMGLSHPIGPSAEVIVSGSPPEAGVASLWGRSDLQVQLKNRQKGPPFQCRPAGKDFGSPLHSSPRDQTLFSPQRRPPIGFSLPGSL

SEQ ID NO: 961572 - protein, 111 aa, Homo sapiens
MVERLRLVRTPLRQGRRGSGRASASVEINHIYGPGSLMRGVIRGCPCVVIRVERLTGAPLFRYMFDLSESMARDDFILTLLWANCPNGPNKGKTRFDVPPYQGWVTASKRG

SEQ ID NO: 961573 - protein, 81 aa, Homo sapiens
MDYSESPSIINEDSQRPRPLKGREETKRGNTSEARNGSPVRNNSPLDQEGGSNKPPDAWTADNFGERGGPPKTGGNTNKPP

SEQ ID NO: 961574 - protein, 197 aa, Homo sapiens
STVFDAKRLIGRRSDDCCCPGLICNIGPLLVVNDAGRPKAPMKNYQGERNQKGFLIQGVQDVLLCDSELQTDRRIAEAYHREDCYHVLWSQCQLTFNDSQRQATKDAGTIAGSQCTYELLSGAKLLLLLLTGLDKKGWSMKETCSSLTWEVARSDVSILTIEEDIFEVEVYSWRTPTWVDDDFDKRMVKHFIAEFKR

SEQ ID NO: 961575 - protein, 317 aa, Homo sapiens
MWGLQNPGATLLGPGVSPLKNVLVLKTLNTLKSGPPQKKNPKGAPQTIFLLIPFVKRFTETASCFYSFSPQLFIHLTQHYRGVRHVVHTTHESRERHQISSPTQRVITERGGVGRVIYKKSEINSIILSKKPLFGETLISVEDENFVVRQLDAQRPPRNRHPSRVSPPTRAFVIMSTTPHTGRHVFRAPSIYIHRETGTKRQPPPQRVCATTLSEREASLTTRHTLWVLLCPREETPSYIHTQSGGRSMITHPRRTSARRKIIEGGPPFLIPPAMYLLTPPEQSGGGIQTDLFDSSYDDHPADKTLCGLSTSCVEHP

SEQ ID NO: 961576 - protein, 156 aa, Homo sapiens
MVGPLQDLSPPPDLARCMCDSTAMSGACCMTWTYLHGLSCAGLRADRAWKAILPWVLDTIGISFKRLAAKCSTPDLVSGVLLRLVTDILTVVCACSDLTWIVCTLVEQCRCTSLALCDLETLYLHRPPIGTPLVDAILRWSFRTILNPQPWIGGLT

SEQ ID NO: 961577 - protein, 90 aa, Homo sapiens
GSPVHMGQNRQGPEQGAFCPQSLQRAQFTKRTPFLDTGQRVLAHFEQAWFGGGGKEEEVCTGDETHRGGQISFQGQLLNTKGGRDLCGEQ

SEQ ID NO: 961578 - protein, 120 aa, Homo sapiens
RSRRESSHVLTRESVACWQLTVGMTPLRRLRKPMAAMLTPSIPAGLRQVACLPACLLLPATAAAALVLTWLLDVLLTMVKLHDAWPGMLPPVPLVALWPMLDPAWRSLQCGLAVCYNFPQ

SEQ ID NO: 961579 - protein, 102 aa, Homo sapiens
MGFAWYCGMAPLSWPLVDLYLMCACLLKFTTHSAASLSPHHLLELHYHHCAIVCIICAIKTSALLGYAASCGLFDVPYKLHRHPWHIYHIVTSTWSLLPCGP

SEQ ID NO: 961580 - protein, 127 aa, Homo sapiens
GQSLTAPRDAQCKTGLIWKYNYFHYRSSNYWMIILKCFICGEQTMWAPSRCMQILHVPSLVNVLCDARCGKNTMMLQCAILMGTWYNNPALEKLGWPPYIGGDSVGNVCTTGWCAYILHDSIEGDDV

SEQ ID NO: 961581 - protein, 206 aa, Homo sapiens
MCDVPVPCPVWPESLCSLACEPGLTVPSNGGGHVVASMDKWKCVPNEEPTIGMHNVVELAECGGAEPKDTPPPVCPILRTIKVPPVSSQKVSIVARRRKYNPTRNSNSSRKDITIGNPDLQPEQTVPSAPRDPAWTQYCQKQGGGTWPHSSHNLQLNIDPDWGAAEVLKPGEPITANWTVNMGCAHIPDKDNAVVLKPSDMAGEKK

SEQ ID NO: 961582 - protein, 233 aa, Homo sapiens
RVPIPPRPTRPHVSCLQPPRDEEETSQWPGPASPPRVPPAWMPLSPQWLDGHPAPWYHHGSIPCCHPVLSMLTWEDHAHHPEHLPHDPKYATTPKVIHGPCALLGWSLTILPICPGDVQECVSSTHWLLACPELTTYLDALPDGFHADDVPMSPRRQPYHPHCTRALLHSLPHQARSEEEQGATTEEREQRQGTRTGTERERTGEEKDERREEGSPRRKAQGQRARQESGKRD

SEQ ID NO: 961583 - protein, 122 aa, Homo sapiens
RRSAGGPGGPCVALGWGTACVLPLECFGVYRFKVGRYFTHLGGGRNSPPVWGSGIGLESFHGAHFGLWGHNPPIGWGALFCGPCVGKNMSTHIMSVRGGYVACVRYTKRPTIGWLTVLSVAG

SEQ ID NO: 961584 - protein, 148 aa, Homo sapiens
MVIGLIFLHGKMPCWLTVSSVNEAKLHPPRFLHRVWLAQSLLLVIALFGLVAVFDYHMDRTGYADLVHAYTVLVRGTPCPFVLVLCAVALVGLSASSLFPGASFSLLEAATCPQHILLEVLPSSSFPLGTALVGPEGRPLLFNLGGKV

SEQ ID NO: 961585 - protein, 79 aa, Homo sapiens
LFRRHGDRDPVSAPVAFCLLDPKPLCDECISYANVGPLLWCPAFGNCLLRRSSCLEQRQSKPDWPRCQVSNDHFGVTRE

SEQ ID NO: 961586 - protein, 198 aa, Homo sapiens
MPQEWPGPFSSNVVKCCNSCPPDNGQVTSFVSPVDGYECVGVLDGTLFGVRQSCRQTLGTFAGHPPWNARLQSSLCDIKHFRVCQMLAIVEHLPGMTSPMCRPGDDVDALFTQRWSSLAPTVVSTSLIMLHIHSGIQFGAPGDLVVDPKAWNKEVFSGPTQCSAVHVVSFGPCSAWACCPLCDIPISVCPGTHPSPFG

SEQ ID NO: 961587 - protein, 35 aa, Homo sapiens
MEYPGCVQIHCPWIDEPLRVGCLVSCFSPNSSNPI

SEQ ID NO: 961588 - protein, 152 aa, Homo sapiens
RSRTSCEIGCFAKLTNTYCLVSRSEAQRTSTVCSEGELSDTIPVVHASIAWLPASSGACVWRNRHGSPGTQQYHLTMELQHIRNSHPTTQLHDKSVVDRELCSQPWAMSPTCNDYVALCPPRLGQGDRRQFWQMLLKVERLHTDMCADHGAT

SEQ ID NO: 961589 - protein, 196 aa, Homo sapiens
MGGSGKGGGPSSSMVHGSYWAVTLLRETIIIPSALGELDVLDAPGGISVWALINLTRGRFHVPHQPSFIVVERQVGTLPAEDVSTCGPLRTDTCELSPFSKLSLFRGNLWRKLQGGGHKILTTSRAVVPKKRGLYTRASRQNILNPRGLVLVNMRAPLLRAPHSGGKRPLEVSHKMWSHVGIKGSGVPQRQGGLLR

SEQ ID NO: 961590 - protein, 35 aa, Homo sapiens
QVACTNWKRVMIVLSGSLLHGCAYRTVASGEPCQP

SEQ ID NO: 961591 - protein, 182 aa, Homo sapiens
KLKGGYLVAAGSVMAQPSGRPAGPFPALIDAYISRCQKARSYTGLEWKRTLCRHEVNVESGLSETQLSVRDRAWRKPIPCRLPSGVEMCKWIFSFLIHRPGAKQVLSTWCLFPRSVSSPSWFWPAQIWDSIHRWDPQILGHGRAMGLAADRQPPRLLLQGGPVSFSPEIYLLHSIYTISSLS

SEQ ID NO: 961592 - protein, 229 aa, Homo sapiens
GGKTPFFGLGGGGGGGGGGGLSPQKKGAPPRGVVVTCYPKREEGVFIKQPRATHEWVPIRQGGRPAGTTAQHRGAGDNEEVTARAREESNTEEHEGGAHCEKKVTRQTEPHTEGSSETNKVRGWWIVVQRGVATQTVIGPHIRAPANEKTGVTMILVNSHSPQASRAPHYLISTDGTQHQSRCHRQAARGARERERGRKVSETHTQENHARLKDSTYLEVTPEQQKRDE

SEQ ID NO: 961593 - protein, 64 aa, Homo sapiens
MRIPTFMDLIGLHPGGQADRRMPTGGQPGTQKRSATIPPIHEKNTRDRPGSLGQWKRTEPGEIG

SEQ ID NO: 961594 - protein, 111 aa, Homo sapiens
MTNPRTHRTTLYLTQTIHSGPWANMRPTRPRHTQGTTPDREHRNTDPHEPEDPDDQMHMEIYTGASDKWAHTTEEHSQAYDTQNKKEHITMRGNKEMTEREKITMVTARER

SEQ ID NO: 961595 - protein, 287 aa, Homo sapiens
MRPAWNGMVLKPHFHKDWQRRVATWFNQPARKIRRRKARQAKARPHRSAPRVGSHPGPSCAAPRFVYQHEGALPGRGFQAWKGAFRGGRAFHKKGGPVTIGHFRVESEEGGNKSTGVPCMAQRCRRAEWEYTASKLILFPRKALGPPKKCDDQFLAEELKLSPPSCPDPVMPRSGSGLYGRQKRARVHHLRDREEFSGRPYRHKSPVYWPRWPNGPGHLIRHNGGKKEPRNSPKKQGCLYTKKNKGPSCGTMGTTGRENTCLDSHRLWFFVWNQLGWSRRTSCRSPA

SEQ ID NO: 961596 - protein, 218 aa, Homo sapiens
MDTGSLETMCLPWRPCALHTAGIRLPLPLPPRLALGWLSVWAPDECSLPQAKLERHEPLESVAPTKDLAHAFPDPIYPGRQCPAVGSDLGLEPVANPSCSGMLPGGPQERQHLMQCPQVSIGQPMELRSGMVLTVPCGADECLSAPRSRPPQTTSPRKAINRGLDMAPDHMYHMVPFKRTPIHVTWFKPETGTPVMWATDAIPGKSGNVQAEMCWYTV

SEQ ID NO: 961597 - protein, 208 aa, Homo sapiens
PVVGMEKDVLLWAQTGRLTCAQMPQVRQELCTSAERVSSLGEGLAQWFCLNVLSCCSKTAGLPCCGAIAEHDWEAFCHNACATPPCSDPKAVNIWGARGSYIYEKPLAGGWPQVTGAPSEGPLLGPEQEERECASWTTSKVGPCMKPPCCHTAIPRGDAQDTVPQRADKQMNGCTYQLEEEVTIIMGKGYGTRNLTCAAKRKRKKHET

SEQ ID NO: 961598 - protein, 196 aa, Homo sapiens
MSPISIGHEAQMRKNIEKDNAGQVTLVPEEPEDMWTHITTIVQGGQTACAPPTIRKVQTESSTGSVGSNRVRNITLTHLRWRPSTYRNLKPASCKELRGPTSKRNEYVKMGGYYHTIELETKPQVQPWAKKAGDSVELGGASKQSLVTKLELLMWRADGHAEKASPNTAKAQPKLTPSRQVGNTLATTEDSIRHGR

SEQ ID NO: 961599 - protein, 261 aa, Homo sapiens
MHRLGWGINERSVSLCYQEIMAGSLVSDARASWEKHARLAPAHGPVGRADDLPGYAHKTLSFLSNLTHFPAPRFLDGAWWRSELSIYSLHRECRWTTSSMKATMARGAPGATLVAVTDLGSNQCSKWYLSGSLTCCLKKPEDRGLLYRMPTFINFSVMLNSQIASVWHVTLSKLLGEACMLLGIPKDSNGAAVRWTQEVRWRMRKDQCTSTWAFLAEVLCQPTHRSTTRRKLMDEMSKTGKAVDELRIHTLVAVLLRWHLF

SEQ ID NO: 961600 - protein, 202 aa, Homo sapiens
MGWNEPALTELWHISIPRLLTPLPSLTTPYNTQHNHKSQHIAYISTSTMHEPSPISVCLQLRHNKHKSSNTDSTDLRLPYQHPHIPHLITHTRPKTLSHDIVSPSSTRLGPNPVSLREPGLLARSRAITTHLHPNTYPPPLDSSSTPPHPCHHADHTCPQYHPNSHITICPRIHTSPINPHLPPSSHGTLNIYVTTLLVFHI

SEQ ID NO: 961601 - protein, 98 aa, Homo sapiens
GWYGPADDSAEALLLWGVPSEELTQCAGCSACYCSGVSHQICPYEAVLGSGMLELSCMDRQLRVFVPNQCAGEGAPHRPSCISTMSEEAEEEVAAAYA

SEQ ID NO: 961602 - protein, 145 aa, Homo sapiens
LGGSPVLIGRGTQLVWTIGGRECHASTACPKRSACPSTHLPMGKSGSLGQWATGLVCVLGLSHGWWHVMWVPMSCLFWWHPTLMPWSCALLPVTHAPHDHLPCAMPHNVSPLLDMCPMMIGQDVHHMCAPSLSLLSTCPVCAPLT

SEQ ID NO: 961603 - protein, 117 aa, Homo sapiens
VLGKAGVIRTRHGCQARMHASYREHVNVSVQQLHGKIRLFSEQLENGPNTQLALPACRMNSILRDALNHVPLSLVDDAMQNCMMLVPMLRACDAHAMVMQMMLVCDECHDVLVLCND

SEQ ID NO: 961604 - protein, 268 aa, Homo sapiens
MVSPGGREWSGGWHPLDEHGQKNIRMSNFFIWTVALGVPCAHGLPVATDAAAGSAHEHPLCVSVPPPWEAATRRSLGLLRLHRVNGREWHSLTPCGAKPGERPALTALSISHSPRTGRQLRNEYDLALCRWHWISTWSSKLIYQARPPYSLEAGHGCKLAWVQNLEAGGIRASGMSSCSTAGWQGAQLVGLTKIPLARGIGCLIPSARAMTSSANRERELGIRGLLRKKTGTCQLSGPTDRSPKLADLLQRREKGSRTRYQQPGKGPR

SEQ ID NO: 961605 - protein, 263 aa, Homo sapiens
MARVAWGLLWLLLGSAWGCSTRSTVFRGFPPEDLMPLAAVYGHALVAVRGEMMLCAMMRAATCDLSVLRLHLAPALTARVFCHRSICRLAPAALLCHGLDPDGVSGQTSGPVILRVFGRVLEASAAALRLRASVTLASAFQVPYPARGHLLSDFHEPSCPTSSLALLLLFTGYTELGEVRVGVGDYMLPPRGTRGTKLDLPCYLNLLSGGCWNVAEDSLTDLDAHAYEALSPGCEALQQRDSLEPVLGGLASPDLRCCVEGLG

SEQ ID NO: 961606 - protein, 172 aa, Homo sapiens
MYEAWVLIRPMGTSVPVMLRAPRAVAGVRGAVGLSLCDRGRRPMSVGRVRCRALGSSPVSVCWVNLFANDVQLPVMLVQCWNDVMDVDACWQLCMDVMPAPVVRMLTLTMSVPAACLAPCVILNDGMCAGPVAHTYASVCANCRCAGNKLALKTVNSMPMKHEDWSDECINK

SEQ ID NO: 961607 - protein, 118 aa, Homo sapiens
MWTVMDVSCRWLDTSSTHMAPEMLLPSHEDDGGRSGIVCEKPCGGNGTPTSPRSIVMKERSPYMHPHKNTDRGKMEDVRMGKDKGASHTTEENHDRKKEIGDKKDKRTESSPGQKETG

SEQ ID NO: 961608 - protein, 211 aa, Homo sapiens
MGYSTGEVSWLRHAFVETPSGEGGMGAEGPAFSPAGPSIPSLALVPDEWNGVELGPAAPSSAEMGPLKPIAWWPPGLDLGEGTCAPWCSGSHNEAGCLAPTHNFCPIMGPPHSWGGGGSFPSGQVAGGAKPGWQTSGRKCGCLRLVCGAPRCPIAREPCVVSWARLCHPSRPGGPPDHALSACQPRRGSLRSWPPCSGLPPRVPEGSAVCW

SEQ ID NO: 961609 - protein, 278 aa, Homo sapiens
MGIGLSVFISPFVAGCAWCACDLMLLCCVVPAVDLGVLTLLMPDDVMLLTNVIAVPAGGHMSPAVPTLCCCCAALLPPVCDALPCCCLRTHVLSCVLVMMCVPGDAVLQCVLLGPVISLTQVNGDPWMLPCDVLAVCCACVCSMWNLLLALLETPAAASCCDVGPSAAMPPMAAAGVLVGPCDVSPPSPCGCFPSWAKCGLLFLPPLSPPFPPPRSPFPSLYPSRAPPKGALIFLILPCSSFSHSSSSLWKWAREGMWGPSDVARIVCCAQLAVVRTT

SEQ ID NO: 961610 - protein, 86 aa, Homo sapiens
MRETLQEAKNRKSSLCDIKALSGYVNLLPLVRTPAVIDHAQEEKGRQMLEAFSAPVVSAEAPIIVTSLDQLHITQDSNGPLEITRN

SEQ ID NO: 961611 - protein, 74 aa, Homo sapiens
TTQPTARYRLGFKLVHDGFLFQVKQTGADFLADGVWKMVGIRCGSKKGVNLPGAAVDLPAVSEKDIQDLNVMWV

SEQ ID NO: 961612 - protein, 321 aa, Homo sapiens
MAPRDSLDTQTPACFSDNVAFVLCLDTVFRGSLPAPARVKPPREGTLQYAFLRELETVAAHQFPEVRFSMVRNADQPGGSDVLCLGKHERFAYPVERAAFYACPTWRATVTAAQARIMDVRSRVDSKTLIRNLRGILLGPVLESIYKLTVDRGHPQTMPVFNSSYMARYQLGSYLDSVHGRGSPTYAVGLRNACGRGQRASSARLSNHLSRYLKDVRAALRQCCNTRAARVCSSRPALSQVVAMAFRVQAGRPLGLAPWLMGLLAYLGMAKGGFSRTFSFLFKKPPKAVLVRPKKCSVPPREARVKLLAAHFLFPRGLKGA

SEQ ID NO: 961613 - protein, 332 aa, Homo sapiens
MLRDPADASEAHESSSEGRGRSPSVRMDILRPNKGRHREMEQREAGTDESDRMSPRWSLYPSDSQVSEEVKTRHSEKSQREDEEEERGRERYHKRGAEEEDSSEEKHLEDSQERHKTLTFTDKTAGFTLIKTEELVASRKHMLAGHSQGERHIAERRVARRVERRQGARRIHPQESKRPTPEARKESEEGEADAPLEVTNDARGQERPRRKQSPTEPSQERKSTIWRQRHPQEDTEQVNLAWPDKGKKAPISHKAKRRTGTYGEDKRGLQRTGPPRTERETQKRSRRATKEVQHPQEEDLERHITHPHSNRKRNRKLKGTMKETQEGDQRLE

SEQ ID NO: 961614 - protein, 152 aa, Homo sapiens
LGRRLGVNRPRIACCSLDLPGSCLSLPSSWDCMLVPPHSVNICRDGVLLCCPGWLQTPELKSLLFSLVFYHFFFFFGNGACGPHRCGLGVAGGSVSAHWQASGLSGSTRFSFLSLLSTLGITSGAPPPPRRASFLWCFSRDGVWLLWARAGS

SEQ ID NO: 961615 - protein, 111 aa, Homo sapiens
MGAPINCWGVATPPKKKEPSYHQGYYLGGGTSLRCARRRTYLSEGRHSIYHPTETGRTSRARQQPPQPNYPHKWYTTTTKVVITQDGPSCEDPPPMVVRDTNPQHSKETTA

SEQ ID NO: 961616 - protein, 219 aa, Homo sapiens
ALRWAARCISVAVLCSATLGSAACAFLQPPRTCVVSMLGERCGRGWYVLAWAATGGYDYSFGRVCALMCVCAWCTMCTACSVSACMCFDPCLSHFPVDAVDCFGQTSCCLCGPVRILLMAVAPSLLAKAILQALTWLHPKDVTKGRTIQTRCETRATTAQLVPKPKARRGPPGFALAGIGHGKLGDGPVGKTPRHGRDLKPAKQSQGGRLRRNRKEPAG

SEQ ID NO: 961617 - protein, 256 aa, Homo sapiens
MRQYSLSFKLQGRVYIDLSWPSSDEEPPGLYPYPNSISIDAGPRQAPKIAQIKRNLSYGDNSDPALSTRPRMPPPRPPELATSSRLPSRARHSPGAIAAETANWYPKRYCSAHNKSRPGTLMLPRLDTGDQTMNNLSEEVSRHAMSSVLCAQVPRLLSVPEIPAVPGPSGEAKLETLMPTHAPKPQDLDRAPEDLPTALSIDGYQHEVQMKLYQLKANSWQLGEDPRERGRKRRNQPYAPKKQQTKRQKPHKAKAA

SEQ ID NO: 961618 - protein, 294 aa, Homo sapiens
HSQVACPVSLTVSGVMKSFRRNSNYAERCKVKYFFMGISFMVIVGPVLCPDDLKANCAMKNRSHQAPVAFLTTVFIPRFREYVCCWRVVNRGTEHRFNPSDGLRNTVRFFNQCKANMRITIVAKSQSPADTKLRFVKELLGKFQADPMGRIWFRDLSPRHTSRAFGISTIQPDFMQAFNQYITAALVLFGNVAHALLIALQRRIAGTATAYRCRNRDSFYTMPGRWHAFVCQSLRAIRHVLHVGALRQLVKSSMCPSRGPGVLLLRAFRSVENSVGRFDPAPCGVLQAYFGTVF

SEQ ID NO: 961619 - protein, 266 aa, Homo sapiens
MEGVAHQSPPTQHTYGHLPFNSGCRAHIDAIFKESHAIREWYGIDQHGRTDSRINSIKGLRAYVIKSRMKGRTSPVRVNAVGHYEWIALVEARLGDLSVGETTCQDMASNTYERSYTVGFRGTSSNQKVGTTIDHGSEWVSVSHEISAGGIGNSPGMTSILASGNDFLGWQRECSRPERAVLTQVPPPWSMPLQEIGRSASGGVPHGFQEKPRRKEERSTERHDSRLKSFDTVDEGPSIHVGHSHVGIFRGGRHQKKVLQRTKTRE

SEQ ID NO: 961620 - protein, 94 aa, Homo sapiens
ARGRKRYNKVEDRRLARAVSLGSHVAAEGTPGTVDSPLVRTDSLPTMTKDMFPGPYPRTPEERAAAARSIICVVEDYEPYPDDGMGYRRLPEAP

SEQ ID NO: 961621 - protein, 149 aa, Homo sapiens
MTWLRGIVAVPRLALPGRADLQFNCCTPSAWSECLIFLHVEMPCWFTCVFSELKLKLHHQWSCTGCLHIYCLVIALVGLCGWCSDYHMDCTCYADLYSLQQLVRDPCIKSCTSVHVAGGLQHSILYPGGFITTLLEAATCHKHIFFGAT

SEQ ID NO: 961622 - protein, 266 aa, Homo sapiens
ARVVIAYDTPLEAKGRFYTDSTGREILLRRRDYRSLLETDTQTEPVAMEYYYPVNIRVIYIDGCDYTMHLTVLTDRSQGGQPSSERWARCELMVHLKAVKDDGRGVSEPLMEQRDREAWSARSSHHVVLRGHSPGCSRRTTGSWRSRRSWPLRMVLAPGGGAAILSLGGSSVARTLSQGLPQGSLAGPSVHLLHAEPCWGPRKWCLLALGATEYCRIGEDSGRTLSAPVTLNFGDLYSSFTITRLQETTLVDNKLREETSSSSGHN

SEQ ID NO: 961623 - protein, 246 aa, Homo sapiens
MQVGPVLSSVARVSGRFSRCYVYTHGWDYGNIHVTFKPEQELLVIDWWSSNMHEMNEQENAALVRCGHETCKLRLKSFHIPLLLGQNHCTLNWRISTRPDDTMKQKFTGPLLPTVKVFLLILALILKRWHLPSRNHLPVELSSVSSLQALPPGTMVTGAPQLYQTTSVVMLTPNPDGPPSEAAAPMANTRLPVLEGHPPKRTISSHLLRLVPGPPFCISSLSTRARVQQAWRPRSSKPEGRLEGRL

SEQ ID NO: 961624 - protein, 267 aa, Homo sapiens
VVEAWVLTPATGIRMGGWVGDAAAGGHLRGAHGGLKGICQCAPARMATCSSMRGDNPKLMRHPVEDVSFPPRNHERWKGTHWVTLKWNNNVQEKGDQTLGGDFGEDMRTDALEVTARPKDGENSGGGPEATRRHGTYTSAVKPMDAPLEKSTQHRKYNVRQEAKTGTGAKGEYGAKALWWVYTLQWGILKDGMMEPLVEREHYGFTLALPWTFLADPTLYLPKLAGQTFNPGNNCIPPNGWGPPPLGVDGVGPSFHEYPRLIFGYPQ

SEQ ID NO: 961625 - protein, 41 aa, Homo sapiens
MGQAPTGDIIKKQQAPLALGTTQQHEPEARPTMTATGPGPI

SEQ ID NO: 961626 - protein, 72 aa, Homo sapiens
RHEEAAVAVAVYGGGDFLDCDFLNNPGRSERLFSLGGGLNETLRGPSGSTPAPALTLTSLPHVSHACLGSDA

SEQ ID NO: 961627 - protein, 187 aa, Homo sapiens
MHLPVTTNFDNNCYRDALLTSSINMYHQLQIILWYAIILHPMCYMAHEHKVNIEDVATEGAGTSVHPVSRGHFYPVLDLHSRAMYCVITVHAPGAGALTAQLGVHGELSSQCLADDFQCPEATPGNSYTYRKSTLQTHFLLDPVLHNQRVGIYVFDPPGQLLLAMDTIQYFIWLSIMGKPIPEDTCD

SEQ ID NO: 961628 - protein, 110 aa, Homo sapiens
YTRLGSEAGVAHIIPVGITFFKDETTALWIVFNVVSDTFFLVDPGVNFRTCINESAASADEGGRRKERRRDLADHTEQEGREAKKQMMSQHDAHVSTAQRKSLYTTHNKT

SEQ ID NO: 961629 - protein, 283 aa, Homo sapiens
MSFFPRMATTDVAPQDLDGAPGDEVQGGEQVPSMHQCVPCAVHVWSGTFMARARMAALVMAPSEGFCSAAAVSGSVCRQMSSPAGTQWKPFSTAFMSDADWCRTRACWKYYLRGLLAARVIGGSWCEAEMNSRTRKHLVCGSWAVPEYSRWMMADTVAEDASHTLREPHEHDAEWRTDLTTELVSERRRWPEAHTLVKGCLARCKYRGRHNTESLELAGGRPRRSRRYGTGQQDATTRHPTGNRDPVSTDHSRRDTCTAPQQRPQSIPQTADTLTNTHTHDTA

SEQ ID NO: 961630 - protein, 173 aa, Homo sapiens
MLCKCECHTQWLAQVDVPGPATDASAHAMHLVNCDSSDEIVTCATMVGMWQVKGQMHEMLSCHMIARLMKSCQLPPFEMVGALTRIKRCGHILWIDLYAPIDTGGVQIYRHHFILYSILPPMQHPGERASCHPESPIDRKEAERKMLEPKLQWEQPGPRKGPCQSLPRSSVTG

SEQ ID NO: 961631 - protein, 189 aa, Homo sapiens
MTLTVDGGGYDSITRCQLEECLAWLNTNQQTCCARVIDPRFKGPASYPLGPCCIGGLIARLNAYPSYPIPQKLWSNVLPVRALQGASRIRARAYRGLILCLPLWPTAYSYVRCHRTWTTPFLVDKPFVALVAYFAVPVRELIHRPGRAFVPTVPVTANELRGSWTSFTDTWCPTKALVIRAGCRMRGRL

SEQ ID NO: 961632 - protein, 249 aa, Homo sapiens
MAFLMLTSTKNSSAIYNYAKRPNVVVPLRGYYNPFDLTPYTLFTTRAPKTRHIIPSPYYINDPHLTLSHIDIISTMNPTIHQYTQPHWSHPHTYGPYLLYLHRPPHHRTIHRYTHLNYTPELHVGLKAITNYKTNDTMNSMPATLRHPASAPQHILTIDDHPYHIILAIKHLLINVDIPIQTHRPTPLSATQEHLLTHSMPLNDPLANKHDSIRHTSKEQTEPPPDTAEERAEQGTRLQHRISRRHHAH

SEQ ID NO: 961633 - protein, 145 aa, Homo sapiens
METIGRVWQWPPQLVAVYLVLPKTCTDGSGTPGTGQGHQSGDIDNLTRRVSQAERDRRVEEQNPRDTTRPKKGAGVPHNRRSGKGNYQRALGTRVGPPRRGGTRKQAPNGRREGGPPIANPRGGARGCRRQRIEKYKAKTRERRA

SEQ ID NO: 961634 - protein, 245 aa, Homo sapiens
NARSSRDFEYYKQYLCILASRTIKEWLSVLRDGETSPAVLIPSKPLARRCFPAIHAYKVCPDAVCAMRRPMSDGHGSRKNITDLVEGCQESQWSPRVRGTRHDRQLTFMKRNIITKHKLPSPRYWIIIGLVIAMAMSLLFIILLRFLAGIMVWVMIIMVILVLGYGIFHCYMEYSRLRGEGGSDVSLVDSAFRRISVCTALTADLVGFMIILSSLSHIILVASSRKRSLAIASRARLWNSVLCLH

SEQ ID NO: 961635 - protein, 351 aa, Homo sapiens
MGWGIPSKLLFFCPMIFLWSVGVLDWQWADYSPGAKLSEPEAERLRTDSLILFIFFHSLARLDLLSLSLFLCDNGCLRPCPPALGSCRGTDLRSHLAKFSSSPVFKPHSSLPYYTPPRSKRLARYTTAHLFPPHPPKTTLSVVLFTALRRSAGLHPVYVPHEHCASLRTFLLMNPSTRTLYATAYVTTTQERFMQDECYTHASLVRPPYLTPHRTPQWSSTKHPFSACTKQPWHASNHNEGDATHTHATTTRALPDPAHPLYDDTSTSEHYFNHHADNCGVTPTHLPPPDHCRTHHYSDRLARQRKPLQTPVPTYHQHTRATQKPLPTDTRPPPLRQRGQNNDPLGVTTGA

SEQ ID NO: 961636 - protein, 129 aa, Homo sapiens
MRTPQIRKPHPVANTATLKICSWNVDGLRVLALRRNRITSRYIDTKPQIELCLQETKMSREQTTRLKLPRAALALSHHTGHLLRHIGSGSVPWPCLPASLPLNRSFRAYARRTCPRRRLSVPASTACVR

SEQ ID NO: 961637 - protein, 81 aa, Homo sapiens
MRVAHATTEPAQPDTYCSDDPSAPSNNELASCRKGLSQFELFPESAKLEKGHVQGRRHRSSNASNDTPLDNIFLANAKQPL

SEQ ID NO: 961638 - protein, 76 aa, Homo sapiens
KHHHNSDDVTTLVDSEDGPKSTTQSVLISGEATVCSVSAVNYCLVVDAVDVGILARKLKFIYYYSGAAVYTRSDVY

SEQ ID NO: 961639 - protein, 172 aa, Homo sapiens
MPLSSISFPQGSADCQTGPYERRHHFTDCARFFRTNILQYPIYKSSSAPKRRRSPRPELLSYRSQEKQHPHSPSRQPVSSQTLRPTGPRLSCPSPTHSPSWPVCALLALPARSLTPALSTHRPGPGLGAPPLPPPPLYSLYSSARSCSPLPFAFPPITSPLGISFSTAAAAP

SEQ ID NO: 961640 - protein, 134 aa, Homo sapiens
WVNFGTILNSLNGFYGQIKTCFNNGGGWGSQHSTQLSGARASLCVGLVHFEQCGMWNSSMELTGSHVERHALTPCGDPHCAPFNEMLEKSVAHFFTTPREIEPTPREFSSVPRGFSRAERDTQSLWGESLEDTA

SEQ ID NO: 961641 - protein, 41 aa, Homo sapiens
MTPPGFAEHQTFGRLPMADWVLTLCSNQASCTASSGFHTSL

SEQ ID NO: 961642 - protein, 111 aa, Homo sapiens
MVGGGGVGGVPPVKNANPLIYQRSGVSGLCLAVLRSDEHVFPDSIDAREIFDLDICSINDPEQSTMTAMSEYCTVVEQVRVQVQLTPDEYSGCVLSHQPFRTASMATPYMV

SEQ ID NO: 961643 - protein, 193 aa, Homo sapiens
FPTYTDVPFIYSCWSDCDCYYYILACGSEKNPGTTEEKTMRLGSEKRVKSQRNELALLKRLKPLFTKSFESTVGQDSDTYIIIVQRLCREAGRTTLLGAGLRRKLNQYTVHGATDDHVRSGRLNETHIFKEVIGIMLIYKGGDEYDNHCGEEQLSVHVVMISCNRHTLADNFNPVSEAAWRSPTIVSTSWQLA

SEQ ID NO: 961644 - protein, 209 aa, Homo sapiens
MLPRTSSLSCLRTQWVDVKCDMEVSCPDGYTCCRLHVWGACGLLPFYPVLCAVSDHIHCCPCGVYCVTLQKCVPVNSGAPPGALCWMNGPQLTSACHDPQCLEDDDVPCDNLSCMLVPPPIPACQLTYWGVGCLLVQSQRLVCLLRTTSTAAPQGYTCVAEEAVSAEEAEICVLDWLNDACPAGFPYPIPGDIGCDQHTSWPVGQDLLP

SEQ ID NO: 961645 - protein, 103 aa, Homo sapiens
EEEEDDDEDEDEEDDVSEGSEVPESDRPAGAQHHQLNGERGTSECQWMMWSMDVDPLLDLHHGPVTEVACGAKPLVHAVLPCQMCSSNVHATDTSERGVTQTY

SEQ ID NO: 961646 - protein, 239 aa, Homo sapiens
WMYKRTCFGGGGGEGGWGRDGSVLPFRPPKHVGLWHASVRAPADTLVGLSRLLIFVPSFPRSFAPGVELSPCGWCAPCVVPSSLCHSLLSPERGVSLSSPRTREQSCALVVPPPEARVAHTLPPLPSPDAPSNACGSLCDPRCSSPPRRAFSKCVCLQSCPHSLVAPIRGRPRVFLTSYPRWVAPPVVGRPTWRRPDERPPCCRDGYLFARELRPLCGAVLSPPLAPRRVLRHLRWGPP

SEQ ID NO: 961647 - protein, 118 aa, Homo sapiens
HLTKKALEVLCCCFFFLSQSLALSPRLECSGMISAYCNLRLLGSSGSAVSASQVAGIAGTCHRVRLIFVIFFFFGEWSSGLRVGNCRWCDSQSHVQPSTLRGFNAILRGLSPSRVSWN

SEQ ID NO: 961648 - protein, 103 aa, Homo sapiens
MSFEVYLRRVTGGVYALQGPVQLSTYLSVYWRKLHLSTLKFHKGLSVVFWGKENGTPISWPPQGATTFDLNVSFTVGVTWLRFTLVTPSTQGFGVEHMGGYII

SEQ ID NO: 961649 - protein, 207 aa, Homo sapiens
WDKILPPRFTPPPRERGPLFWWAPPRKLIPPPSLMCEILSVWVSPEETRLSFSSVWSLLGRPERAHHNTPHTQCEKNPYYLSREERENKRRERDVFLYHQYTRCGGGEPHKKTREVCVRGGGRGVWAELSTHSSEGAPRCVGALSCRSPLSPLIKHLSPAGEEFVCARPTPAREREAPRKARSPPPRARERASAPATRVYERRGRAV

SEQ ID NO: 961650 - protein, 192 aa, Homo sapiens
DFSVSLKRQGRTNTSRCSSWTMSTALGSGASHTMDDGWMEHYKKAAHLHQRARGEALPRLGALRCDVRPGSHHLASRRSPRCVRCPARPLVGRGLLPRGTAPRASLRVSLYGSGRCGRFVSHLPSRPHTPHSSPTRLPDFRGGRVSRATFTISSLSIGEVAARCIHSSFPVRLAPLFKQRTLVAPCERWMRA

SEQ ID NO: 961651 - protein, 156 aa, Homo sapiens
SLEKSYELPDGHGAITYCAMSRFRCPEALFQPSFLGMELLMDIHDNYLHTPSLKVTVDIRKDLYANTVLSGGTTMYPGIADRHCRKEDHLALDHPVTMKYQDHCFLLERQVTPLVEIASAPILDLRLSSLSTSDCWISNAGSYDRAPDSRPFGPSA

SEQ ID NO: 961652 - protein, 239 aa, Homo sapiens
MAPLSHPQKGIRWVILRLWLLQFPTTRCSLSTGLLVGLGLLLLLLAAGQVRAILARTSIEENWRLGRRTKGNEESEKELALVRKAEHHCVQSTSFREHVLGQGFSTTYIYIFRVCREAGRPTLLGQAVVHESTIESMAQGDQLVGRLNESHIFNGSNWIMLIYRGGDEYDNHCGKEQRRAVGDDLLSIERQPSGQFCPVSERAWQSPDCVYSWDGLRLAGPDFPPGGFPPAVGQGGGGG

SEQ ID NO: 961653 - protein, 252 aa, Homo sapiens
MREKQKLRYFRCPIHYLDGRARKSYTFNHDEEIVHIHAGSVLGNQIGAKFWEVISDETMASTPPAPTTVGRAIRAAWHSHLCVLQSECLCVGPIMFLVPSCAGSRTWDPATLFAQVLLAQIFENQTNFVFASVWCAGIQICGPKAYYYSRAPHAVFDSGPGMLVPQSERLRSCRSRAAGSSMRGPIVTGRGCAELWYMGTSPYQQDPRKNTLESLSLNTFSRGAFSHSVLTPGSSPKMHPLRPVSGQDLLAL

SEQ ID NO: 961654 - protein, 160 aa, Homo sapiens
MRFHHPCCCSQILGVLIPGKCESLTKVARVRAMCQPQRQGVEEVGARVWKLRGDPLLGASGVTPGMPLRGPSDACFTTFCDVIILGRFPENGRSGPPLTRWRGVRRKALPVELPYSSGLTFPTALDAPLKGRYIFWNPAPSATPGGPSFGGDADGKPPDL

SEQ ID NO: 961655 - protein, 134 aa, Homo sapiens
MPMNMMAACDPRHGRYLTCGCCLTCGLDVHEVRSMSRCYNCAEQEQQLLLWNGSPTMSRQPSVTSTPRGLKMAVHLHWQYAQPSSDLLQAASREQFTAMFLPGMAIPPLVHSARAWTYMEFTEADEQNMNDLDL

SEQ ID NO: 961656 - protein, 229 aa, Homo sapiens
NKARSSLWCNQAEASVWLQCWSTGSIHYITLDGRVYDLHGSCSICLGPSLPPQSLGTRTFPSVLDERMHAGHLQQPPRITVGWPGCEPSSGSSTVTVGRQRLVGPACWLVGRVRVTRLMGRNMVLLDDQGAAASLMMAAAHLLMSIPSPFRGRLCGLCGELYNVQLEMTDFVPAQWPQPASNVRALFRGCNERGATSSFQGAVTEGLTNPNSLPKVACAAGQLYPNESN

SEQ ID NO: 961657 - protein, 73 aa, Homo sapiens
LGRPVYRPMANPALVYRRARSAKHARHKPGSVPVGVLWLAEEGFGDRVVVESEGALAGVRGRVLDGFRCVCCD

SEQ ID NO: 961658 - protein, 220 aa, Homo sapiens
MTPRYWRCTVAICRNLILKLAILWDTVLTTGWAAVVGCPACGQCWDVILLWPCELVPVFLRDWTSVLIVAWTLRFLVCNCVVDVISLLMNERLNDVMAVNACDGYGHIALRICPWMLEFIGAGLLTLAWGVLYLAPTSPACCRVIQMLLALSSIVTEGPALLGQTCLVLLLPGPWLGLHHIKHLSSLHACLASPAFLVCRCLPLLRPSWQCTPSRQLLPF

SEQ ID NO: 961659 - protein, 34 aa, Homo sapiens
CKKNTMNRVKDTLSYNIIVYVSISNSGLLDRERP

SEQ ID NO: 961660 - protein, 34 aa, Homo sapiens
MLVVVQARWGIHKLRASQTLEETVLLEHPTAGDR

SEQ ID NO: 961661 - protein, 81 aa, Homo sapiens
LVCSVCAVVVDAPCVVCGLRWRVAQVSSVCIAQWEVGVLSARRGCWCAVPDLSRIRVSNGGQVSMAVRVAELVYAVFLSAV

SEQ ID NO: 961662 - protein, 172 aa, Homo sapiens
MADVNRRKQKRVRVATGLGSYGVEVGTKDEGEAVAMVAAKKSGAKEECHGRMRTKGVVKGGRCKKEEWRVCGGKRKGTVRWKVVSGGASREMGVGVEGREVCVWPAARVVHETPSQEKEVGGRGREAGRRGEARRGRGRERRRVDERGRGSRRRSVRAAQRSRAQENVQESE

SEQ ID NO: 961663 - protein, 66 aa, Homo sapiens
HLSTDPLRVSRWQTVRSFSSHEAIFQTITWGETLDNTPLSRAEVPAAFRNALCPWFIETENGDDFY

SEQ ID NO: 961664 - protein, 204 aa, Homo sapiens
GPPSLWGVCLVLWGAVGAGLRWLRRVLCLRVFSFFPAELWFDLVGRLALSVVCRAAGARLVDVPGCTFFIVSLLCAPRSFVFLPRAGAAGDSSGSCWGCCWALGPRDRGVVTSGGLLGVFGALYCRSLWLLGFGLRGFGQSSRVSVSAVAWSFVVVAVVLGVVGCVCVRWLLVRSGVFLRLGLLGPVVSYVGECGGVGVSVRDG

SEQ ID NO: 961665 - protein, 73 aa, Homo sapiens
IKQEMTMEYKQELKKLHEELCILKRSYEKLQKKQMREFRGNTKNHREDRSEIERLTAKIEEFRQKSLDWEKQR

SEQ ID NO: 961666 - protein, 181 aa, Homo sapiens
MLFLGAGFRACGSVGIVCPLFWSVESSCLWAVSGVFCLVMVLVRSSSAWYYCIVVDLVYLLALWCVVLACIVFLFVLFNVVKDVLLDPLFDCARIDGVSSVDGWLMIACWGSGDVPGSIFGMFWVPLPGELAFVFLSHLVFPWAWSCVVVPHVYYVIVCLFGRGVCTRFLNCPGMKSGLLF

SEQ ID NO: 961667 - protein, 105 aa, Homo sapiens
MSRPRRPEDSNLATTMNYIEADYDHMRAVLHERSRAQGALSRVTRVDPSGKPSAPLPDKIGVHSQETVQPEPKKLPAAQQSSSTEVSIDRWTKSTDRSALQKALE

SEQ ID NO: 961668 - protein, 154 aa, Homo sapiens
NSRPRRHRRFYGKDSPACPQGEEMLTVLSGAVADANDELADLVAWDSSLEGMGTTFCGAMFSGPLGVHIGDSRGFLLRQGRMKRTRDHSWVQSLLVDGRFTPEEAAVLLRSLLLQVLIGQPQLIPGTQIVVLRLGGRFLFCSVGLCGLVVVDSV

SEQ ID NO: 961669 - protein, 104 aa, Homo sapiens
MLLGCGLVPIVIMSIWICVTTYFISPCHLKLVEVFTWSYYVKAQLLEIFTSCNCVIYFFSQGIKDPDLHMEMAPIRSGQPFENVSSTEAVKLNTYIYVKKMYIA

SEQ ID NO: 961670 - protein, 108 aa, Homo sapiens
MRGRVDIECMRALAGFIMRGRMQAMLVVAGSAALPLLFWLSAAAGCLVLLRRGSDALGVIGLGVLSVLLFWHFNIQKDPTALLVLLGSCSLALVLRAGYSWNRVLLVD

SEQ ID NO: 961671 - protein, 89 aa, Homo sapiens
QVVHVDGYRTKAPAFGLFRRGHTFRTLHGPGVNNLSLSSCPECKSTRSCKPKFTKIEFALKYQCVKCTVLTHRYYRSPIQTWTTPVHKH

SEQ ID NO: 961672 - protein, 107 aa, Homo sapiens
VFFFLFSLARFCGLCGSLFVDVSIFVGSFCLSLYYFPCFLLFSRDRAFWCVSLFVSPISVMPFVGVLFRVCLFCCSPILSCGVLLVLLSVCPSRLALDLYGIVATTL

SEQ ID NO: 961673 - protein, 60 aa, Homo sapiens
KFAAASTQRTAASVDLEKLPSDVEATQSVTQLTLTEGAIGYRSLEVISGQKAMAILRRRG

SEQ ID NO: 961674 - protein, 262 aa, Homo sapiens
VLILSVVRFLLAFASAVFARSVRSRLFLPALPALRLFSGPGASPGFARCVVCCVVVCVPPMLLFCLLLSLFASLSSFLFAGLSSSRFTVSLVVLRLSSPPVCFVAPFAPMFLPCGFPPEFSVDFSGFFPPCIGGVLYLFSGPRLIPGLYPSVYLFEGALYGFCPSCLCYGSRCRLRKSSCIRLYIGRRINFPVVSDNMYFRYVIHVLIGYLGTLMSPGGNSGHYRSGGISVGGPSAARPDLRSLSRCALCFAFSSAHALSCS

SEQ ID NO: 961675 - protein, 92 aa, Homo sapiens
IMPSKPDELTRKLRGHVSPRPRAHMQGLRKAPQVPGAELICWLDLACTSRILNFERNYHPGYMRDNVVSLECNYHYREELGASGPLVEPLYK

SEQ ID NO: 961676 - protein, 36 aa, Homo sapiens
NTPPPDHHHTTHPHHRCKRLPCLFTERAGARVTELR

SEQ ID NO: 961677 - protein, 376 aa, Homo sapiens
REHSDATFTTRSTRAGHRAAASTRFPATRYHRTGLLSALTPNAGTTHLANTGYRTCLTANMDTDRAPLALLAFLTRSTPLSRTQAFPRTTLASAMACAFYPTTHRRSAPAPQHPKALETISNSFCPRRALNAYAHPLRLELLNANCTLTAMVVTFWERTHLLHTTDNFSDHLRARRNRRPCPHLMGATGHCTLTSKQATAHTYSNNRVRSRFWTTSRFPFPAYPNLVPCLRTVHTSPTTHTQRIRTPRFCPHPNLGLGAHRIPNVEHNDNPLSNPQRPCTTGNRTPPHPRSIPHHCWPANHPQKQAAISRAARANICLYKPVKHKRGETPHRTAWPKLHPTEPAAPVYTRGAQTRVPNSGRATLHGQNTHAAPHST

SEQ ID NO: 961678 - protein, 418 aa, Homo sapiens
VIVWDGDTTRQVQSNIMLPRSTVQVFNCFFRDLDALAYLGAELTCCCCGTDTTSRLSMLERLDQPIPDYSANLADSLQHLKPTPNAHCCLPASASSAHKETCTTLLSALSRYGNPHTQQDSTYAHCGTNYMCTGSQRTPSIWTPPQGTTLLSSIRLLHLYTSYNTSSISRTPPHGYQPQRHIPPTRLRATHAPRTSDIPLRATRPPHCATPWRNPKMAHGDPSRCQNRANTHPPSLQQHQELPTRNNNPEGPPNTTKSPHAHNTFTTHTPSAGPRKPTTLPQHISKPLYYIPTLTPKLPQLLPHTKLALNNMCNTRERRDTVCPFHQPHGTDQSSKKHATQAQTKRMAQRILTSQHTHDVGHSNPYTAAPDQQRNTERQWTPAARPSTSRKTSGSPAHHRMPKANKANLVGRHHTVCK

SEQ ID NO: 961679 - protein, 77 aa, Homo sapiens
MANYQRKKGPPGQGVLYCAKLKALELEPRSVLFPKKNSPEGFPNGKKGPQNPPKKRRAEKFGFLKTKKFKTPPQGGP

SEQ ID NO: 961680 - protein, 119 aa, Homo sapiens
MSSVPILLILRFDSIYHTVTMRIQLRPYVILQCEMGIYEVHLSAEAPKKTLILSQRVDRTYMGRNEKINHFCSVVLNSKAQHCMTTLTVIAYFTVTQCATSSSGDSRCRDGMQFVAFVR

SEQ ID NO: 961681 - protein, 111 aa, Homo sapiens
MSEPNPILAEIEKFDKSILMNTYDARENSTCSSYRRIAIEQVERSRRRIVMRGARRSICTVHSTGYSLLILFSFMLYNFCKYAKRSVSGSMFELTVLSPFTIQMKLPVITS

SEQ ID NO: 961682 - protein, 137 aa, Homo sapiens
MQRCLTFSEYRRLASYYIVRSPHQEQSRRAPRNKVSPYTWYTQRATTNIAERMSDIYACPPANARTPRRHSSSPTHSELGLTWHCTTSYNAPPGQNHSTNHTDSITELITQNGQQKHMAYHTTLAKQAQHPTAFSMP

SEQ ID NO: 961683 - protein, 278 aa, Homo sapiens
TTENSRFNPTNSKTPSIYTGTIHCVANPITLASAASRLLSGVVSGNSFFLELCSNYSSHPTTFVPIFEHASTIEGGHLQVEEDEFAMVQFQNFTSATFEASVCASCVYGGTNHSCDKRPVTLWSPRGPLLWVSKHAPTSWNGKPRVAKKRALLGLPLSPRRKNAASLPALRERGAKLSERGGEHLRSRAGIRVGPSLFCRKGHLVWRGTPSVFLRQGSRGRRAGFRLESVGPLTHQLAAPYVGAAVDGQHFTLRRALPGTPGSRQGPPDEGAPGLEPD

SEQ ID NO: 961684 - protein, 56 aa, Homo sapiens
MPLNPNTSTCGDSRRHDPPTDGPLIEGGQVLPPIRGRCYPHRPHTAHPPKNHSPPN

SEQ ID NO: 961685 - protein, 111 aa, Homo sapiens
SNNNTRPVITNETRNNNTQDETRNNNTQDETSNNNDETSNNNTQDETSNNNTQDETSNNKTQDETSNNNTQDETSNNNTQDETSNNNTQDETSNNNTQDETSNNVDAAANL

SEQ ID NO: 961686 - protein, 204 aa, Homo sapiens
RRHVRHDSAGVINYPGDHQPLSGWARGVGQRASLTTSVRGDPAAAEPGKGAVPSLLEDLHFEGPVRDRPQVKPHPKKAKLEGAPGFSWRRSRYKELRSAGRGWVRPRVALTWSPKSGRTHRGVKKWGVEKDGDYQAGGQDGRGCEVLEGQGRLLGQARSLQKPAARRKWSPGRGRASGEKRTEPRRRARGRTPPAAKLKVVRPR

SEQ ID NO: 961687 - protein, 58 aa, Homo sapiens
MLSDGTAVELFESLRAHAKPSQPPEREKGRSRLLHNCVRVYHFKSFVIVDTEVDAAAN

SEQ ID NO: 961688 - protein, 153 aa, Homo sapiens
MRQPRGAALRRRHRRRAVNIFRLDSGDLVPPRRPSYILLLKILEDALLRRVLALYTQAECRDSRPQLHYSLSLLESRNPPTSTSHVAGTTGIFWEKPAICYALVLHNSYTWIFLLHLFHYYNTYYRRLSTYACSYATVYLIYLTFKATYDGNT

SEQ ID NO: 961689 - protein, 248 aa, Homo sapiens
SLPSVTNVTSIIEEVEEKRKRKKNAPPEPVPTKRNKKKRKNEKNRNKKHTKQQKTTKHNIHNEQKKTEQHKKQRQNSNDKTDRHNKHPARADTNNEQQSNTQEKRKDKKHKKQNNRNQRKKDRKKTTSKTKQTTTKKKKTNTKTQTNKRKNNTEKEKPDKHTKRKKKKRKITQKETNKKPDKRTEESQNKQQTQEKKKTHKREAKTRRERKGNNNSRQTKQQTTHNNKKKRETNKTNQKPRNHNPKPK

SEQ ID NO: 961690 - protein, 272 aa, Homo sapiens
STSEATVGDLKQNFGYSPRQKESNDPEHLRSPEGDLESRTSPVTRRRSRSRDLTHVTRVRSTVPDILHAYSGASMHSRRRQRVIHPADIVLERRLTTLRESCRRFLDPVLHGSCFGVNWSLTRSTPCHPQVLFVNLEVVRDRSSICYSSSNQEISSGSRYTSSSTQADSRMSCFSRPSMSPTPLDRCRSPGMLEPLGSSRTPMSCPACKPAAPVMDGPGPRDPDHQRTSVPDKSCSVHDCTCLGAITLARSALRHVVVGLLRMSRSPGASEF

SEQ ID NO: 961691 - protein, 219 aa, Homo sapiens
MSILDTSILSAVDDPGLTGAYSWTPPENLADFCGCRLSPINLHISLYMVMLVCTTGDTTKTRKLSRAFAIAPILCPVSSLESLTILCLSESFRACSTAASPQRHAEPAQAEMSLDTPGGLHAWASRSWVLGVVLVLFQLLCPVGSLGTFLGLLLRDPQGGESDPCSPSTSWTTPCTGEAQQLPGLGPSCTPAHGPALTVLVASPHNGLLLEEPYGEITA

SEQ ID NO: 961692 - protein, 299 aa, Homo sapiens
GGGRPGRERAPMDAPSTGRLRTPTSRAQSRSGAPRRGISGQDKTPKLLPQHTARDPQTQLKKERHKERREGKRTNRREKGRKGGREKKTQKEEEAKAERGEREKKKKKEERGERQEEEKTEQKETSGSRSNQTDKEQTPPAHHRQKAEREKDENTKKEEKTTTKPKPDTREKPAAKGSSNKEERRTGDGKRRNGEEETTTREKTQDQQKQKEPHQAKEAGQGSARDSKTGREHERDEKKSRRRAGREKKKKRPRKEARDEKHNRKRHRRNTNDETPPRHSQHKDKEKKNKTKQDRGGRQ

SEQ ID NO: 961693 - protein, 260 aa, Homo sapiens
RRCTRGGPGALVVPGYVLNRWWSSAEVSARGIRGRWSRPCDGAAWPECRGCSRSARPGAIMEWMPRHRSCGRLVQGHEDLSPWSGDLSLLPAHSMDIIASLISSWGPHVKDGGFEDYSQSSSKLTRSQVQLATYGCNGHLLAIRRHYNGTAVRYWVLKCSKEVATVILGAIILAKLSIVPVRMRLLGEQRSCNAPTSVPCEVTEAACGSVLVRLIPVTRCTGIVSSTVSKKLLMMAGSDDCYTQPGLDCTWTCKDLVPLD

SEQ ID NO: 961694 - protein, 111 aa, Homo sapiens
VSADQAEGLCKQWLQRAWQERRLLLREPRYTLARWPPAYCLAEVGITFWVIHRVAYTEIDWKAYMAEVEGVINGTYDYTQLQGDTGPLVYPDMVIVYIFIGVKYYATQPRH

SEQ ID NO: 961695 - protein, 229 aa, Homo sapiens
MEYHIYRCRLNQYFYIRNNQPRHQINSSTAYYNFTGVSTLYPSYTSLIQYLHSSLLHHFRTVIYELIIFSSHRLPRDFTSLLAHNFSYTICFIRQLIFHVYHPNITLSFDVRRTDTGILYMWLLTTFCYVSTLLADGSEHTEISKSIMMKHQQPTPRPPSCGGAETGSYPPPITTATRAHTDSFPAGTHPSNPKRTEINAPPAYPPPTPPPPPRRPPRAPRPHTPPHIP

SEQ ID NO: 961696 - protein, 95 aa, Homo sapiens
SRASVNRTRLDTLQILLEFQADVNIEDNEGNLPLHLAAKEGHLRVVEFLVKHTASNVGHRNHKGDTACDLARLYGRNEVVSLMQANGAGGATNLQ

SEQ ID NO: 961697 - protein, 175 aa, Homo sapiens
MNWHKSKKKAFTMYCEESGRMSDGKKQLEKDFSRHEKYCQCHSVSIAPSPMDAPDFLCATKKAHLMEYPGELEVTVAVEAGLGPREAVQHVECTCGTNGVLGSDEMSLTVYLVVTNGLHMATKGSPVVGSPMKLPRVDPSRMACAKVACIGACAILLVEPSLWHALGQKGYHHRN

SEQ ID NO: 961698 - protein, 84 aa, Homo sapiens
QFDLTNQIQFDLTNQIQFDMANQIQFDLTNQIQFDLTNQIQFDLTNQIQFDLTNQIQFVLTNQIQFDMANQIQFDLAYKNNNNV

SEQ ID NO: 961699 - protein, 133 aa, Homo sapiens
RRHESARMIIIPIWLQHGDDKTSLAMVSEIVEHPGQQYRDAEQREPNDNRPSPHVSRVPSRPRGRKNRINTIISNGSSAPIRATGTVRISPSRSSLRGTMPIGRNKSAIDASITTENVTTIPIMTEGRRGREF

SEQ ID NO: 961700 - protein, 63 aa, Homo sapiens
STSDLGRLGLMMMMMSDLGPLDLMMMMMMPYLGPLGLMMIIMMPDVGPFGLMMMMMRRRGREF

SEQ ID NO: 961701 - protein, 140 aa, Homo sapiens
MGDTYSRGLEGRRVVTQTEDNRDSVCGDTQKCARETPAGRRREEESPGRSGSRGVHSGRKILQKRHTTKQTGKRRVSKGGKKPIVGTPPRDISRLLFIFIEPNYSAGLKTGPSFFSSLPKVRRNLGKSAWTDLENAERGE

SEQ ID NO: 961702 - protein, 247 aa, Homo sapiens
PGWGPARGGCLSHPRTHAAQGPVASVRVFEPKKTATALCGRTCKRGNVVFSHSGFERAAPVEIDLTRRTSYRYTACCGPSFCFLSDKRAIVLGVNTSPVSPLIKRGGWAHVCAPRYFVLNSAQVSISLTNTPCGVRLYFSPRETSFVGDMKGFLTKKGKDLQKENLPYISQVYCSTGRTPCACGISCGPFQFRFAGGLHKVFCESGRCVVPRLLLFTQENSLIPGLSAHSGDLKNLPVGFIYPPLFG

SEQ ID NO: 961703 - protein, 136 aa, Homo sapiens
MASYDEQPCDTLPLRTLNEQTTHITELLFYPGRSVDPGAVLNATAAGCTDNNTQHPGDSSLKDRMMTDFTTLHGAWPRSCCLKQHNLAVSATDPCNPTQPNRHQLLHPSKGPTHRTAFSTQRTHFLHNPQHIWMPH

SEQ ID NO: 961704 - protein, 126 aa, Homo sapiens
FFIILAGQRLFLNNKGKQNEHLSMLLQSMGAHPTVSGERNRGGGARKQGKDTYTGRGTAKHHHAASLREGQTHVDTRTRETTSTETATGRDVVKLGTRHSSSYVPTAALFCHEVPYGEGSHCSVFH

SEQ ID NO: 961705 - protein, 179 aa, Homo sapiens
MDAAWKPEASTSRMAPPAIRAPLDESCTQARHQSLSHQQRHPHLQLASSAACCPGMPGLMALDGNHMQLAWLWASACGAHNWVTAILAGFSERKEELSLRGLTSLSQVASGNPASTASSSLAFYEIKQFLECAQNQGDIKLCEGFTEAAEDSADLQTDWPNLKKFNLDDDGTISSHNVS

SEQ ID NO: 961706 - protein, 102 aa, Homo sapiens
MTRGPARVSPAYQTGLHLTFLLRVLGVENGLPISEDPDGPRKSEPGPGKQVACERYCVQDTIRRCCNIYNRHKLVPTLGEKTYYLCPSVVGYAGYKRKDRMS

SEQ ID NO: 961707 - protein, 125 aa, Homo sapiens
MVAGQGSGVPITWPYYTRALRPTDLEAHYMCRYVKRLAGRRLVYTYPTPRPSGLLSPSAHPRSVQCCEGGTIAQYFRNLCSDDTPIGAVGRRLRSWGVSKVLGAGHVTVAHPSLTRLYSHTSVRR

SEQ ID NO: 961708 - protein, 49 aa, Homo sapiens
GPRRRKGQGTCIPTLLQLQVKDTAQRKGQGTCTRTLLQLQVKGRRGREF

SEQ ID NO: 961709 - protein, 294 aa, Homo sapiens
KRTKPETTDSASVRAWVFNRTEAGGRRLRRSQCPCHLPCPALLARSALPAPRCTDLPACCLRVGLPLLAACCLPACLLLPAAACCCCCYLVLLRWLAELCVGCCAECAVPACPPCTPLSCLCRLLGPRLVAPALPRWPAVGRTCAPACHAPWRLCPGMPVASCACCSVCCARAWMCAMLLLLVRLNNPLRCWTSGAAAAIPTRAPSLPLQALVIGAICTCENAPGRRSNGASPEQVADTWLMTTQKECLVAEPRWTAPMNVLGGGVQCWPDAPQVGYDELPCSGAGPDSTAMAR

SEQ ID NO: 961710 - protein, 141 aa, Homo sapiens
ASTRTNRGNRLSQYVLQRGRTMETGLVNTCFNADDTVETGTVNTCFNEDETMETGVVNTCFNADEPWKQAWSIRASVRTNHGNRRVQYVLQCGRTMETGVVNTCFSADEPWKQARSSTQMNRGNRLSQYLLNADGRRGREF

SEQ ID NO: 961711 - protein, 111 aa, Homo sapiens
LRVWEMLARAARGTGAHFDEWALYWLLAALRAAPPLDCPEHTVVLFVPQHGGLSGGADWADSTGILEPGFEHPHPCCSHRIRILCRRLTDNMSYNAACSSRLVTLRKIVNY

SEQ ID NO: 961712 - protein, 82 aa, Homo sapiens
MMGDVAGSRTFSTVSPDTMSHAQCEPAFICEEYRVPVANLPILVFSGKCQTSSTVFGYKHNPHLWTSGPHTTLMESSTRPRI

SEQ ID NO: 961713 - protein, 225 aa, Homo sapiens
NFCVQSSQAELKEAVEEPSYKDVMENKKEEEEEEEATNTHPPDSLPSQKYQAHSAEGDSEGLSQGSGCDREKGLSCTARDGRQTQRRGRSERGRRRLRLERRLIPEEEGPTVAARTPTRALATRRSGTGESRSESSGCGLELGSLGLRRLRNPKGRENRSTSQQKRARRRRWQWIPQGPSSRGWEERRAGDRRRKRLSKELRGLQKLEQDGTSCQGLTAESGGGQ

SEQ ID NO: 961714 - protein, 116 aa, Homo sapiens
GGVHSSGVGILCGHREVKVEDYFVVKQGRVLGVDVTLRDCRYRLVGVNGPQAAADRREMVDCLTPLCATNRQLVIGGDFNIDLGIGGDSSAGAITGLMACHGLGRRGREFSSSRRP

SEQ ID NO: 961715 - protein, 188 aa, Homo sapiens
LYRSRYQPQQQTGSPERTAGQQRQPLAAPEQSGSGRKLLGSALYRGALCRSADVFLSAWEEEEEAEEEEEEEEEEEEEEEREREDVCKHQIGRNGASGQQTDTNDDTDTTRTKNDRSEDGRDDEEDGRERRTEVERETTRKKNQTKHKKTDKADTTKKHNKYEQKEMKSRDQQDNPDRYATQNNPNSN

SEQ ID NO: 961716 - protein, 244 aa, Homo sapiens
GGTGALRAGRGGGGGDGACLLPDGPGRAEPRGRCGDAWILPPPGRTALVPRGGCMSPMAMVPSAETWNLGATPIAAAACGEMGQGPRETRAGDGSTPKPESTQGQDHGHATRHHSVHTDIPAPTRGTRYEDNMDVNEEHKKSPHQNNARDAPARGSITQRNEPTGKRNAPQPSAPRYVSTHFTQSTIATPHSTSPSNTSLGQPYGMYTCEHPTGRKKTTHPNSSRPFPYQQLQPPMNPTRHKQH

SEQ ID NO: 961717 - protein, 103 aa, Homo sapiens
HSRVSSASVNWTLQPPVVSQETLEMFSDDIEKRKRSDQKKARGENAAESSRIEIAENKKQGQGYPEVHNSPSRNLQTISMPSYYYIPCIHHAFMTIDDPTRHT

SEQ ID NO: 961718 - protein, 81 aa, Homo sapiens
VIPNSNRNGIPNAYQTPKILGYIRTYAKGPNVVEPLRATTTHSTDAIKLFTKEPHKTRHIITITLYITDPDLRLITIALLL

SEQ ID NO: 961719 - protein, 115 aa, Homo sapiens
RAVRNRRGRSHLELEPGRAGALQPRGSASTLLAVQIRGAPAGDSPIQPCKKKVLLIGEETGLGKTRHVESENTSATLHLRRRHPRDLWWPPLVACETLSTVSHSIEETLDACNLV

SEQ ID NO: 961720 - protein, 168 aa, Homo sapiens
MHDDGSLNNFQEPGLKSWQVHPPAPGESTIQDTKGQTCPEQSDSSAWTCPEDTCPLPKAGVSSNGSKTERSSNVSQQDDLRCSCGTQHKIDKSHEFALDGGEDDNGLAGLACTSEPHDETRVAASYDLETDIHVANFQIWKAFSGLIQQKLSSGHRERAENPPQCGRH

SEQ ID NO: 961721 - protein, 106 aa, Homo sapiens
MDEEMVLGLEVVAVDTITIATSESLIEQVAMMALAISEGTVFAVRAGTSGIEQVTVTMVSLEDIEILEHAGELVIALPEGQLEVQMVIVQHEVCGVLAGQGQGRGL

SEQ ID NO: 961722 - protein, 119 aa, Homo sapiens
MPAKILTADNQTYMSCPGQNCLPSVQGLRSACDPMLQWLDEDGTTVLQDEQHLPPMPMKTLGYYETSRTKDTGRRTTAWADQMSKTQVTIMDNLKVKRCKLRSHQGPRKATNREERFPG

SEQ ID NO: 961723 - protein, 169 aa, Homo sapiens
MGSSRMMEPWRLTHDYHHCGTNQQHYDILWYTNPSRDLGPQFMAQTMILRTAHELWAMDLSSIILHDSFQSASRPPWCHAHIPRAYHASDQTSMQHELRDSVVSHGTVKSRNLQSWPHTTGKWTQRYSKGGQPMGTGCPEVHLPDGDKHAQYSSLGLMKARNTTKEPQE

SEQ ID NO: 961724 - protein, 74 aa, Homo sapiens
YDVIKATHATDDKDSYHPLSLIGHVDSGKSTTTGHLIYKCEWHSTNRTIEKFEKEAAEHGKGLLTRYAMGSWIN

SEQ ID NO: 961725 - protein, 145 aa, Homo sapiens
ALPVTKKNDDITSLASTGERVQCMQVPPLGLKKFETLSYFPPLTTEQLLAEVNYLLVKGWIPCLEFEVKDGFVYREHNKSPGYYDGRYWTMWKLPMFGCTDPAQVVNEVEEVKKAYPDAFVRIIGFDNKRQVQCISFIAYKPSGY

SEQ ID NO: 961726 - protein, 288 aa, Homo sapiens
MFILSTATYAETVRWQDTMPRAVICRHWNPQIIDEVRTWHLPPDIIPPSSIITGKEEMLPITMPEGTTPIGKEIIRPFVLRTEFASWHDQMHQDHSEDFIEFSTDLWMEGTGSGVHHPCSWNVSQIDYGKKYKTESSPIYHRHHQVFHSCRYETHTTSILTNHTNLEDTLISAFMVDNEAIYEHLSVRKLAYRDAQTTPNLNRLYYASIESSITWIPLNDMDGALNVGPEQTYQSKLSAIHTIHYPPGQFALSISVQKATKNSAEDKSTKVVEQPNKGIDSLETGGLT

SEQ ID NO: 961727 - protein, 113 aa, Homo sapiens
IYVVDNGQSVHFQTIFARCSNDTVGMTLKKLEYFHAGLGVVLGEDKKQHNNTYRDETVRLIAYYLGKRTKTSMDKLKDKETQTRSYLQRNMNAATDNPLHMAASNMLTIPITG

SEQ ID NO: 961728 - protein, 226 aa, Homo sapiens
MAPIKVGDAIPKTDVQVFDRGAREQGRTWQTSCSRAKKGDASLEIPGAFTPGMFQDTPCQGLLLAAEHESSEQDQREDPRDEMDLIMDDEVNALCDMAEMEDETPQGQRTATDSGILELNPNMEEHIGESDEPEDFITQIDYDWVSTLQGEIERSSGAFSQGGYHAWNIVQGPKMWKQDGTELHLAGTRTPDYYSNNLGPGTNIKFFNHTFSLTTVLRPGDEVGQF

SEQ ID NO: 961729 - protein, 277 aa, Homo sapiens
MVRKERIQGGREKMVKPQTEPGPRPIPEPMQESKAEGNNQAPGEEEEEEEEATNTHPHRPDLPSQKIPRPTEPRGTVMVCLSQGLVDREKGLRCRARGGSAKREEERGGGGGELKTAEEAVTRRKEGPTCEMLNQPPETLSIQGRSRQRREIGRRLMAVGMELGSTGGLRRLRDPRQGRENKGALPAERGGGQEMADGPQKGPFLPGAGNEAPEPGTLGEQEADSTQGNGRTDPNSWITEWTMMGPQEAACAEKRCKGRRDGGTTDEHKAYIGQSKA

SEQ ID NO: 961730 - protein, 273 aa, Homo sapiens
LRAIEKLLASVEERNGTSQGLAVGRRPPQECCSPELGRRLAELERRLDVSGRLSDSAEWAARHRAGRSQRGREATPPELHQIGPPACLAWRDQHSTPPWALREEQEESWPGAPEGELKPLACTADRGRLEQLKEELLANVSGEHREGRLDLLEEQVAGAMQSMQGSLSALGPLGSRNSSSQRDPQMPWSAEVLDSEGQLVGWWGSGLSHGAKQRGRPGKAHAAVAFPAGWWGRLQDPCGLPTLRRCESTLPDDLLAPVGHWGRDAWDRMGWRQ

SEQ ID NO: 961731 - protein, 282 aa, Homo sapiens
ASQLDCRSVDVATGWLGQGTGELHVEWHIWQVLRQDQHTGVFCHHEMMASPSEGSVWEAMAFASYYRSGQSCGKSLMLNRSGTQMVHCPPRHCIHIYQRTHAKHFGWNTYVDGRTRTWRHCDQVFWTETFSRMKHKPTAVVAKTFKGRGTHKYVRMQTSWTCKANAEQKEQMHIIKLIAETKYKTRQESGAQEPRIEDSPESQTIQRTVKGYPFSHLGFHRRLVHKNRILRNNMRSWIQGSAEIREHNRSRETDMVTRELYTMKYPEEYPAPTQGLGHNVTF

SEQ ID NO: 961732 - protein, 63 aa, Homo sapiens
MDREQRPGLYWRVTPSRLIPQTVRKRRRKGPQPSNHRGRPLYWVRDKNAKPNNWHPYVAAHPY

SEQ ID NO: 961733 - protein, 217 aa, Homo sapiens
LPRCFRIDRRALRQPTDTAARTDGLPADRTHSMTIEDVQISHPFYGKPRGSGHDSHMAALKNGTPLEKLDLGGHHRGELTKPDSGRDSSYHRSCIARLKSAPDLQIFLPSSWRRSREISIMVGVQGTQTVPPTDHCEVSWGWHSCLTSTDLITISSGYCSSPGYRSNGERSGSQMRATGQPPSTDGRDGQPFLTMVAYMRAPEDLYNGTGCRHAAHN

SEQ ID NO: 961734 - protein, 250 aa, Homo sapiens
EKKKRLGRGPGYSARVHAGINGLWLHNKLRATDELWAPTSIADPDYTDAVIDNIRLLTFHGPLVGSEAQVATRDAAPPATARMDEMKGALMEIIQLASLDSRPLGAHGRRHLEVLSGTQARFNLAAGEQQNPNVPGYFGRTLAAQQVGECASVCHAATGSARYLQQKTALTNPRRDTLTPPVKHFQLKRKPKSATHAGGDCCRSPQETDQQLKRSSRGDLPRQGPGDAAENGHHNPLKGIRRRRLTSPGA

SEQ ID NO: 961735 - protein, 108 aa, Homo sapiens
MGAFVLDRSGLDAHGRRLLPPAEGLTRGKGQADDAGLPWAPALSGLLLAKTYECAPGELVVPKGFWIESSADLSGDSELRDKAATAFSLTAVTTIPGSDTVWTTSIPD

SEQ ID NO: 961736 - protein, 106 aa, Homo sapiens
VCISVHEGWILHIIDYGLIELSPNSYLPADDVVSIIEEVEEKRKRKKNAPPEPVPHKMKEKEKKRKKKEKKAKTTEQKKRDSTDEKEKNLNKKDRRTAKQQNNITT

SEQ ID NO: 961737 - protein, 163 aa, Homo sapiens
MTRSRGVVQLKPELTIGLLDRATERPNNSSTLHITIILGLYCDPRYKPSAATSSLPFTIVQTALYGLQHSEVATGCTRNFTYISWLNFPHYPAVTRLNYYFTDPSNASTLRPKAPTEYCHFVHVDTTYDCMSPTMCGLKALTPPEYQNQRGAKHAKHRTHTKD

SEQ ID NO: 961738 - protein, 163 aa, Homo sapiens
MAPPLPPALLSDLWLWSPCPCLHTPSTPPSRPPHKGEERAVCSSMHISHHNARDGASRRMGSEKAPGAHQTESPAFQLPKACTQRRMPARHTRASEHAPVGHWRRLPHGTWEKPWPWTRCLRHRTQTSLRVLILPPHTPPLTDIKAKSTLASRSSHYSNTHIT

SEQ ID NO: 961739 - protein, 72 aa, Homo sapiens
GSEFLKRLGGFGGLFSEFRKAAQGTNKKKKDPWKSSAKKEQRPEVTQISRGPEAQKKKRWLQEAKFAGQTLK

SEQ ID NO: 961740 - protein, 219 aa, Homo sapiens
NPLFKRQAPRKVENQFLLNLPQERDVIYVLNVAKPLANSSNLTKHRRTHTGEKPYVCTKCGKAFSHSSNLTLHYRTHLAGPGPMTANVSKTLLAHARSAPFLNTHARNCTHASSAPLLSCTRLAGTRPFSRRRKRHALTPLTYRDPQLGEKPYSAVTNCWEELLSSRMRASAPTRDSTPERSHYNAAQELVATAFNHSSNFNKTPQNPHRGNKPYWLSL

SEQ ID NO: 961741 - protein, 223 aa, Homo sapiens
RPGLAVLGADERIFSTDAQLAHGEELRFGAIHVRCLLTPGHTAGHMSYFLMGGLIARTHPDPCSRADAAVRWPGLRLVPGRAAHQQMYQSLARDMGTADPRDRCTCGPRDTRISNLELCPESGAQCNDHVRAKHVTGLREEPVRKFTGKAVPADVLEALCKERATLEQAGEAAEAQRREDLTCADSEGLLKCRHHTTEPPKPHRLGTASSSWTRQLDHMRATL

SEQ ID NO: 961742 - protein, 74 aa, Homo sapiens
PLSDSRRCGCCKGSSLRHTAVAMVKLSKEAKQKLQQLFKGSQFAIRWGFTPFCCDYTWDLRGVQTSRKCLNQLF

SEQ ID NO: 961743 - protein, 120 aa, Homo sapiens
MHPKAPCLPRPRDLSKPPPPALPHFSIKIGQPIDRTSRSNHRTACSPRTVSTTREPQTRDHDPLNPAHDSKPLETSYRHNPDTEFITQCIPLHPFNLPFSNPHALHFCAFSNPNISDPTL

SEQ ID NO: 961744 - protein, 280 aa, Homo sapiens
LQECSSFGGNWKMNGRKHSLGELIGTLNAAEVPADTEVVCCSPYLPIIELRRRSEPLRSQAIACEAAAKILLLKCDYTGCLLHGGSIMSLRHASNASAGSPRGVRPRASLSSRTALFFIAGSLEVRHVFVARNMWVPMRPCARRDLETLTLHLTLRGDECLRLKTGNAWTITCMKGFVSYGAKTNGHRMTEREMDLVAYGSIAGPIAVLLCGQLVHGKTATAQQAQEVTEKLRVMAEVQRLCCWWLMSTVSFIGGSVNWGNLEELARQTDVGWFPVVGAT

SEQ ID NO: 961745 - protein, 237 aa, Homo sapiens
AVTVFFDDDSRPLLNPWWGGAQSEMGRQWNVLKVCPVMSVGVSRLGEGRVEAFGHTAGAQFTRPRWRAAGPCAGTLPRLASHSRTLAPRPQGRSSTTSTQVQIDLGANLNFRRDGGNRARWRLLNSSQKKRKDRKASETKRQKDGKKKKGRWWERRSFPLEEPQLRGMMWWLVDQPIRRRGWPVKWIPRCGVGAAGAVSRWCPRCRADRSGSPSLTFKRQILTQVGVVVVGSSHGSL

SEQ ID NO: 961746 - protein, 237 aa, Homo sapiens
MPSKGPLQSVQVFGRKKTATACDRTAIRGNGLIKVNGRPLGDDSSRARYSTICCERQFCFSARSDLLGVMTSVSVLKGGGPRGPYLCYPSVHLPKPWWTITRNSVDEASKKEINSTSSSSYDRTLVGSLTLVAASPKSLEALCARSSLPEILPISPSCTHNLTCHNKQSWRGIVTSFNLMRYQRGDAGIITWERRDDKRASRCPWVQGLPKPPVVSTWANRRATEVTGNTHALCSVN

SEQ ID NO: 961747 - protein, 129 aa, Homo sapiens
MSGLVCTSSPYFNVYAKSTEMAYYQLELIGITLWLDLYLELQCLEKTLIRGISIPMSKRTRVIRGMYCAMLMHMYMICPCKPYAHSILRNCPGAFNHAFIYQDTLNGMMKVAQFHEKCRYPVGHSEGTL

SEQ ID NO: 961748 - protein, 233 aa, Homo sapiens
MYYYSSLLQFTHLSYILVQDVVDRLDRLLPPDCIYIIRKRIKVSEGHTHRAYEEEDKLKWGAISCHARRSAPMRSVSLVSRVGLTFFLGSSLVYQRSVCDVSRIYKAQVVPLTLEVSREGKRKSQDTTTGKERTQAHEAYGNQAEKKRGRRNLTNTQRSSQTHGLHGLSPNKDWLFLMRCLPFSIVALECTRTQGQQQARCHRTPGHRRWTQEGLVIPPECEAQRIGRFIFTQ

SEQ ID NO: 961749 - protein, 116 aa, Homo sapiens
ERADRGGGTTLTPSSAAKHVAPYVRLHHPQGNKSEVAQKLKEVDDVLGGASCLGECGLYCKVCVPNANILLASFMQLQTRLCPMSLMTTFYKCCNAQVWTPTLAGIKGSMDGASLP

SEQ ID NO: 961750 - protein, 247 aa, Homo sapiens
RRPGTGYSGEYNRGGDEWSALQQELSCPWISVPIHGTHITCKRTWDPLHLLDSSVLTLHQIFAALSTGAGERLHLTDPCPCIMFVLVSCRNENCHVISSARRHSKLVPMVSGVMHPILLPESTTWDELTSGPWLGATVLGVATECHGHYHTSWTSSLTMYILTPNGHHTVADRPQSKFTVSKTLSVRRTVSKRYECANFGEQGITVGCWDLYRHDIDCQWIDITECEAKEIYILQVVINPNFEVAET

SEQ ID NO: 961751 - protein, 85 aa, Homo sapiens
DEDDDLDTKKQKTDEDDKHSKKGKVNTNKKKGRRDLFTLHFPSQNLNVVTFELKRPALPTVGSATQQNDTRISTTLTQTHENCAN

SEQ ID NO: 961752 - protein, 312 aa, Homo sapiens
FWCPGSPERRIAEGAPGAGLQRSASSSCAGKGPPSQCQRSLRLARIIPDPLPESAEIPLILILRSPSPPPWLGELPQPPSEDSRSTESSTPNPKRPHSLHGVPHADSRGPDRRSYQMPVLRIDVSSGIPEKRLAPVLMRQSTEVHHYGVVDVLTRTLNGWQNKACHRKGPRRQEKPSAEPVDPSPKGPCLSLGTGELCTCALHSMRLMARPTGTGPGPTGGQGATAGSERTWSGACREGERGRSRRDRYVRSPGTPAGRPIGARRAPVAAGTSSQTLAESESRARLRTRFDLGREHTGSEDRPNTCRDATGR

SEQ ID NO: 961753 - protein, 138 aa, Homo sapiens
MTPAQQIAKGLCGYIEVTETIYKRLLDYSLHKEEDRQPIDLAKAMSETFEHITQTWYTKGVKVGDGHSSMKLRNETICSRWYTFKNSVDVPGGTELDEGTRRHGYRNHQEEHLADFTWTTSYYWNRPIAVRTLVWDKM

SEQ ID NO: 961754 - protein, 150 aa, Homo sapiens
WLGGGKGRLQTGGLRYVAGGAVGAALEEGATLLEKKENVVGLEIGEAPKEPLLWEGRLAFHIVVVELWRLGLDRPVHFSLCCLSPVGVFFSLFSFSEEKGPRKGPLPGPRRLGLPHFGKAARKPGLLGKAGRVAFPPPLRFGPVGGPGVC

SEQ ID NO: 961755 - protein, 91 aa, Homo sapiens
MLIKAKSSNDTFPTAMHIAAAIEVHEVLLPGLQKLHDALDAKSKEFAQIITDWDVLILKGCCSTYSWAEFSGYVQQVKFAMTRIKAAMPKS

SEQ ID NO: 961756 - protein, 73 aa, Homo sapiens
VEPRAKGVLLETLCPPGRGALMRAPHSSETTLCKPRGPKGTSVLQRPSLHEMRKIHSHSTKGTSAATSMVGSL

SEQ ID NO: 961757 - protein, 67 aa, Homo sapiens
VWGCQLAIQIGGKPGNLRGHVTHGHGRLGKHRKHPGRPGKCVGGSCIHHRIQFRQITTQATLGKVVV

SEQ ID NO: 961758 - protein, 132 aa, Homo sapiens
MPARESTRYMVAALGWATAELIMSRCITPIGSEPGAYEFDWKYIQMSIDSNISLVHYIVASAQVWIDKHCYDLYHSFRQPVLLLMFLSVYQAFVMETFVHLCSLGTWPLYWPAQCNGAVASALAFFPCHASS

SEQ ID NO: 961759 - protein, 41 aa, Homo sapiens
MGHMPSDTVVTEIEVCTLLPNTDSVALSQSQQLCQGPSDQS

SEQ ID NO: 961760 - protein, 275 aa, Homo sapiens
QERGYMHAVSCLRNQLTCGDPMAGSGGAPVLRVGHDHGCHQPALTATRPSLDPGPYRVKFLLMDTRGLTQGLRPSGYRPAYTTPPREDPRIPSDTWPGTAKWTDDRHIPTILLLLWPASYSWPILAALYHALLQTCGGPEGGPGDRLTDRLLHGTSDYMTHPHPTQTRTDHTDRMGAAKTLEHDTPHHTGLRTHRHETIICTGARRKTDSNREDKQPWRISPKTEPTKGTAARDAATHGPTGHDARTKTETDKEQDNQQKHRHPKTARRQASTSN

SEQ ID NO: 961761 - protein, 183 aa, Homo sapiens
NISAKYQAGVNQAEAMAAGNCTRILNTGGPYKALIAAQYSEGSESACSPQHPTYHIENNTNADPVQFHPQNFLPGQVPAFEGDDGFCVFESNAIAYYVSNEELREKYSRGSKPSVVQWVSYADYRYSSPQPVPGCYPTLGIMHHNKQATENAKEEVEANSGAAGCYTMKTEDYNLGGRTSDIG

SEQ ID NO: 961762 - protein, 383 aa, Homo sapiens
MVILPDSVRNYMTKFLRRQVDAAEGLSEGGGPHGEEALDGGTIRCTGAGPVSTTTETVTPQTITCGTHHRDPPGEGHSEQDAQMDGLRRGDNSWRMVTDIEEHDHRSPGHCTGKDARRIRPKIGKKINLQSRYQTEIQHITGQQTGARDIIDNIHMETGTTIRQHEMRCNRQPGITRYPNKTNTVERIHRLQTETTELENDIRESLETNQEQIRNNLDIDNVSNGPDNTKGKTEGEHQNNKVANSPPGEGQASKGYKRQTGKKRKETQEQNNHRHPQISPITYYEIYADGSTTIKARATPHALELEDSNDGNIGGNNRRANTHGQNTHTIEQATHEHEAKERDQFPRRYYTTHIPEMKNHTIGRFTHTTIGGHNDDQRREPHI

SEQ ID NO: 961763 - protein, 77 aa, Homo sapiens
KRDGAACARDAKVLAKHKHKNGFQKSSVSSWLKDAEEMEMVIPVDVMRRAGIKVTVAGLGCEKTSVQVVACDVGHLS

SEQ ID NO: 961764 - protein, 490 aa, Homo sapiens
GRLAATANTYGTRSRVDTRSMGHPDPALPPSGGELLGLRGQRLHCQDAGVPRTTCPERSSSDTEEADGGLARTVCQQLHGMLSHHRRAHTPAGEPRAGTWSWMRRTRLTDGTENPHLDDSTVDGHMHGTLTLNDPDMNTYFDTDELCVDHTKQDMTRETGKHTVELHMNTQGHAPWTYRTGRPDRRCRPCGDGPVPGDRGIRAGPHGPHKGPTEDHRFKGRSPQGTGAESRIRTETGPSNKWIKGTVCGLTHACQQTRASWEDGKKFDSSWPVQEASLGRIPVEDQFLLRMGQPPERTGSKFPRSSFTRTAPLRGPESTWQLTRGSRMAIGNREHPDSYHLGTRYYNLNPSWNSFLLVANQDPYRLGSTPGPSQSTARNRQLRPRAYRTHLLQAAHGHQSSVRVPTQGKGTAGSGEEAQTPAELGRHREEDSTRGMKRTTERCTGTTNGKHNHNEKTGDDGTQGFTRRDVVQQGTDHTTGYQQQGRRGTP

SEQ ID NO: 961765 - protein, 134 aa, Homo sapiens
MTVGKSSKMLQHTDLPGLTVHPAGPDRTLPWTPFNGFDEQRTLNFDPLMTCDLTFRTDSQNHNDTYHKATARHRGHDDTRTILRDPWMTEVNERGDEHSWIHQRDPIRKGTTQLAKRLTWDNRPSEIRIFDVEA

SEQ ID NO: 961766 - protein, 131 aa, Homo sapiens
MGCGRGRQPAYESCWGRYVAGAARVKSGWVDPRSRSRWAPRAPPPGVAAAGLSKRRGPVGSYASQGERLRGSRGNTVRIHDYGRTGSFQEKVVEDEVADRARCGVLVNVAGKRGMRGRVGVGCCKGCCATM

SEQ ID NO: 961767 - protein, 214 aa, Homo sapiens
TNKHERVRKNEYGCVYFSYEAGGCPHTGWISRHDDSASCLVSSPSSSPSSLLFPDHLLLSRPCASFPLPICPPSLPIMPIINITPYTSHTQPKYTHHKPTTSQTTHTHPHTQKHNTDIHTLKKQKKQPEKKTTKHTTQILPDYIQLPIPPPPHAIPYKTNCKQTRPYTIHITSNTQTNMTNNHSRSQQTITYRSKTTDNNNNNHNKPSQHNAMK

SEQ ID NO: 961768 - protein, 289 aa, Homo sapiens
MKQCVSEHPDVPLLREPLRRTTLMQGASGPGSVTCGPTSTRAVSRQGLLQTFHLALSGSSDSMSVQPWRNILGPSDTVVFREKKPNVSVTGTAFQDAAPNSSTPPSCFTMEYVDVVLKSEIHDAMHAGLESTVLMITLWLYAPPAVHASGMALVILLSRTCSWLSMASSGSLWQEIPVVRNSTVLVSMTHEDQNACKRVKFELIVSEASYLRSLNIACGSFPTFNFAPGAHVSTRSTSGSSLGYRLCETVSAQVPFRNLGRGLCCTNIFSFRVCDVVLVRGPGFRGATA

SEQ ID NO: 961769 - protein, 32 aa, Homo sapiens
MRTTGFGSSGEPPTFNVALPKPLGGKTRNQER

SEQ ID NO: 961770 - protein, 179 aa, Homo sapiens
EQSLAQSHPSETSRTLGRGLSYRHWKELRHGRRCGKSHTPRELEDIERRPANGSGPTHTGIQRILIESSRQAQSRYRGSKRRHVSPIIVQLPERDPFRLGRHDISSDWRREHTRTLRKSYSAEQPSNYSRYVPRGSAPTGKTGGHRSPGKTLKRSTAQQTLPQEPAKETTSTKAHKGRT

SEQ ID NO: 961771 - protein, 107 aa, Homo sapiens
MCVVSSRAVGRPVCLTRRRGTEMFCDPPEVQSVERSVLPCARERTPPPWCLCVVPTHYVCDDTARVRAPQKCVARLPVSTSLSLTRGKTPAYIQTHQIVGVAISPMW

SEQ ID NO: 961772 - protein, 107 aa, Homo sapiens
MGTRARERKLVASTCSSFLHIYFPFFNLFLSLVHSLTHFSLALGLRSSLPWSGLSCPHQKATRKRPSLADAVPAFSLILLPIRAFIRHSFPFLALHLFFSKDIYSSY

SEQ ID NO: 961773 - protein, 195 aa, Homo sapiens
MPCVFAILGQRCTSDPEWRTWTAGRTPFNTPHLQLVHDGLGDLRQQTPQRTPRDQPRAHLASHGQNAAEEEYKYRRILAPDARYYSNIVDELLGSGSYYSFVVIDNNNIACGYPPWNLGRNSRYAKVRPPKTDTTGAIMYNSEYHRDCTTFEEDRALRSSRSGFSAYTGTESIRTFITSETYITNDNAAPHDKDI

SEQ ID NO: 961774 - protein, 229 aa, Homo sapiens
IPPAWFQVCAVRWVTASARWMSIPRELMLGGTNTQDACTTRCEDSHAGRTQSCMDRNARLTQRLVTSSDETYYALTWNPETDSTLPHTDVKSLATEYTLLQGRPHKMTDPGKTGRIKYDDYMNRADRQTDNEDNSHIRALQMEDIHGHKRENTTNDQTLAENNTGHEQADPEDPQKHQRRRYETPVDMTTHTHIVDVKQETTDPDTTHAHTTEHATRMHCPMGNPANEG

SEQ ID NO: 961775 - protein, 115 aa, Homo sapiens
MPRHTDQNVYIPGSNATHDHTQTWTSGDGKAHRQSGQWQQEEVGQEGEEVTWRPGQEPQGGPLPNQPSFSLPAPRTSEFQGLNPQEILGRGTKGQCIPHLGKPRQAKLPQVPENT

SEQ ID NO: 961776 - protein, 82 aa, Homo sapiens
RLVRAGVIGRGPILGEASGSKDQSASRDPVDWKRVRLHTGVADYRSQVIWASRHGHDPSVGSSGCGCWLQDTQGGERMGDKC

SEQ ID NO: 961777 - protein, 443 aa, Homo sapiens
LIAGTGSSLPYQGTRPKPDCHCPYLGPTAPQKAACCDSLGNIFAKPSQEPALAKNGALRIPALRWALDCRQRNRPPLPTTEPANLGRARLDQPTHSPYPSGASHAVRPGCAPYYTQPLHALLQDCCGTARALAPPKRHPHATLGTPPSLRTNQRNPSPANNPTAALHSLSCCAPAPGPHLKLRAHARARSHPLHGGPRGATRHALATSAPNTCPLPPRATLAPRKRPFPRRRNTCTPLALSTHYPPLHGHYPLLMSPHHNTPNKNTPRLANLPLVAHPYKTLVTPTNLARKLAAHWTPVGARRKLYRTADRQPPPQSPPWADRHPPAFCPPDTTFTPPTPPYTITRAHLPQQPHEAHPNTTPDMVRHIKTQSITTPTTRRRPPPKTHPHSRHFAPPTTPTRPPPTTHRHNPCRRAPPLALRPTPNHTSGHPHSPPPTPGTAPL

SEQ ID NO: 961778 - protein, 166 aa, Homo sapiens
SCMTKRKFTSTIVLLVDPEQDRKKSIEERHYAPTDLEADIEWVSRPVTRQGTRETVTEKLGSINQGLDRLRRVSHRGTDEHWSAEFEWSPRVIDHVRDLGASAGQNSTGTKGSLGGAFRGRELKIIVRSRESPRKCSYHVTEKAVVGELATRKKAERHAESRWATA

SEQ ID NO: 961779 - protein, 78 aa, Homo sapiens
GLPDHPGDDCASYLASTYTAYDQLKAFLLCVNPDSDSYAPMVAGALAAWAPRPVISPLELMRTNLELTILDPDRSPVQ

SEQ ID NO: 961780 - protein, 488 aa, Homo sapiens
TLVAGGCGDPAAAGYIALEWARAAQCSGVVGRMADAAKLSCPRLCVFPDLLRVPERCCHLRPGVSLTAQPNITLSSCTASFHKHLPHLAKTKIITQSITRRASQHASPANETHTKPYHSRYANEAITPAHQTKDDSQTPRQKFSPAATTPYSGSPTLIDRLHPPQATLPDATTPLFTRLRLPGGHAAHPSHSAYLRPRAAPHLLPPPEGKPCFDRPPLSPGGRFLHSPPIHSLATTPPRNPMPPAPPAPFLRTFLSHLRPLRTIPNLPHTVATTARALQPPSGKLSNPAANHLNCATNGLLHAALAIRVHRAAQPGEPTGPYPTLVSSRIWPTLTLVLHRRLSERHNVAPKTRIINVNGEPPIKLDSTQTATPNAVVLVETTSMCPSNTAEPTALKPPIICATVHGGHSARARRREHNPQNPRNKVRQPTQTPRVIQSKDAPSNRVGTYPDRQITPHYEKDSKQKTDNNAEKKTNTNTQQKKRHSEKN

SEQ ID NO: 961781 - protein, 69 aa, Homo sapiens
SRASGSMLEVTIIYQYFEIFVEEQSEVGSMEGPALTRDPSPGQVGGSCSRSASEGELSSWRVLLRHMDF

SEQ ID NO: 961782 - protein, 236 aa, Homo sapiens
LRWPAVACLVPFLLFRLCCSLWSSGASERQVLRRGGLLGADRGSRRIELRGFQGWQQLLLRCCAVQEGFRFQHNMNEYKRQLGTLRLANPGEQTAGACEPLTLANRPAKKQQGQQETDKKGREGGKQRARNDKERTDHTTTNGGERAANPKQRTTRTRQNKRSNGRRERGKARHKEREQINEQIQRTEKDDQTVVRKSTKQQQQARNTRPGRTKRERNTRKKGKGQKGTDNENTKR

SEQ ID NO: 961783 - protein, 113 aa, Homo sapiens
VEKRGKAEVGLGGVCEGEEEESGGDRESAMSGGVPVRGTVLPHVRWLFLEGKARGGLGCWLSMGSVVVVFGAVRWVAGGTARRALRVQGPGVVGGRRFARVVTARYWTTLGSV

SEQ ID NO: 961784 - protein, 116 aa, Homo sapiens
MICACASCDVHELCADVVVPWPALREELKKVATLPCPQNLPSPLQSCALFPAMTELCVCDVCSLCLPCPGLRGKMAVTWPEVQHQSDSCLLQTSQLSLECEPAVLTMYIARVYRDE

SEQ ID NO: 961785 - protein, 212 aa, Homo sapiens
GWRSQVSALETDGELRRKTRGGDLAAVEGSLEPPLWEGISSGSARASALVAEPQGCPSPQTPPSKADPYELYSLNSINPATLMAHRAPWLPLPHFAPADSVHCWHAATRVQHTTLQPYSPRSRLYTPQGRKGSAYTHAAPTPMATCVSLLHHTRTLRYEHHPSPFSWITLHKLTVSPVRAECPLPCWLPCPYCCRAVAGCRSAVGVGHSSCP

SEQ ID NO: 961786 - protein, 272 aa, Homo sapiens
MGNTNYIGEKDSGEKEVYQLVPKPPSRLYGVWPSLQSPGQEEARGHCAVVKQWAVVGRMCLGVRAECEGKFSVTRPGCLGPWAPCLGRGSGFLTGSRGPWVEICLHSRDPVLAHNVARGLVQQYSVPRLGGHNRSLLYVALSPYRLYNNTWAQQPGAVSMWISQLCGTRDISLCAWQHSGGSLCVHSNGAAVGVNPWGTHLLTGTVWISPRCVMRGPYVGVYLYTTLCCSPQSRRVAHNLLTFILPTWVVYHLRPMCPSAPVGHTTPNFTKP

SEQ ID NO: 961787 - protein, 137 aa, Homo sapiens
ALPPARIAGLVWTARLQAEGRSGGGWARVSPGIVPGGTVSARPTWAASEGVTVYKPSASHPSSLLIFSAASSIDPKAPSPESSTFDRRVGSYNVHDQTVGRRIVREMHVHAPFRHVCFLAIHASHVGTKPRETYLFA

SEQ ID NO: 961788 - protein, 149 aa, Homo sapiens
MSIDLKDRIPRTLELNLFKYVANNTNEEAGDGTTTATVAGTLYAKEGFEKISTRCYFQWKFRRGVMLAVDAVHCCSLKSSLKPVTTPEEMVTRLLTIVCHIRRTTEHSAMIISDVNEPSSDERVSSTVKDGHNLDDELEIIEGMKLIEA

SEQ ID NO: 961789 - protein, 183 aa, Homo sapiens
MVMVLLVIMPLSSCSSPLYRISISCRCHRIQNGAEAQKLVSSVSLISTEVAPESSFGTCQLQFVPLLHVHYPREGNDPISEWRALGILMLFSGLDETQLLTFSEDYGNSCLSDVLTDSYGAIKYSDFTSTKLVPEQMRNSVCLWLPSGYTILARGCYKSDLLGERQEPFIANMPYNRVCDLGS

SEQ ID NO: 961790 - protein, 109 aa, Homo sapiens
RYLNYLLTNKAYKLISSWTHPRCGHGGQGSWCAGLGHERPQKVTQPSYGPESFFSRSQVFTELVCPDHGSRTSAVISHPLLSSSCLCVLKNPRLVGSLVDTWRVDSRAL

SEQ ID NO: 961791 - protein, 122 aa, Homo sapiens
MADKQFSPLLPRYVEPETAVTGTESQRQEYIIQERMLELNRGKVIQGNTKSGEGGGEAASSGWVRLGIQEVTISPNIKGRGEYGVGARPYEGSVEVIIVHTQIDGGKTWEIVRNKRHKYKRD

SEQ ID NO: 961792 - protein, 241 aa, Homo sapiens
MRTRSKTLRRACKRSVQWVNCSRSASLSSAVSSLVQLAHVGMTSNLHAPCPRLRLPLCACCPAEPGVRTELHLTVPVQAALFISTPEARAGSERAGCGRVPLSSRGTGATGWIPGERGDERLEPWVWGARGTVGGVLGGRGDPCQSPGRREDGGGRGTWNPGDAETSAWFLTIRRSRLAPARSVGGELLLEVRGFAGISRLHSGGSGDERWWCLVGTEADLLTVTIPGSPPGAVLGVYPVE

SEQ ID NO: 961793 - protein, 203 aa, Homo sapiens
MQLSEPHGVSDANKLQEECADASEWFTLVNKKNALILECRTSCMLLMSVMQDYGAEVFDAAEPLSCRAMLAIEDWQKTSCSAAPESSSYWSELVSLGEPAADELVLGPGPQVAVIALEDVTSCLELLAGTVSADKLSRVVEPGGSAACLADGRGPGVPITSLRPGDTSSTPVAMLHAVRILCRPGGTNAAFFAMGPAGSLSPK

SEQ ID NO: 961794 - protein, 31 aa, Homo sapiens
APAAAMPDMLGHRMCTREPPRPHAWCSPPNL

SEQ ID NO: 961795 - protein, 120 aa, Homo sapiens
VPVFTEEFLDQDKAREAELGRVCGRVNGGLRGAERGTAEAHAERVSSAARAVWSRSWRWRSGGRVAAESKAASQCRMRPRAARPCTRISAYLAWPGCRGARGADKRRAACGGSSHVGPCR

SEQ ID NO: 961796 - protein, 110 aa, Homo sapiens
TARYEAGFALPLSHSVLSPLRRRVSSGRLCMWPEDIAALVIANGSGMCNAGFAADDAPRARVSFHRSWRPETTRASWWVCGQQGTSYVGRRGLQNQAGCVDPDPSNATST

SEQ ID NO: 961797 - protein, 216 aa, Homo sapiens
GPGNWFIKTQSKGQGKTIRIWYFWGGGGGDWEGVGLRVETAQKRKASFYPPLTSFSRGPTEGSKPTQLLFSAWCRVSQAVVGGVVCAKGRCGCGAPPQRRERGSWETLEAVEELTEGLREHLESAFFSLRVHVGSRGHRTQPRAPTVVARGVWPWGFSRETRGRGVQTQLYSGGVEREGLCRVGLSEKGGAGRGLPGAGGENVGERGTPGAQGGAG

SEQ ID NO: 961798 - protein, 286 aa, Homo sapiens
MQGPGFSCINYWAVVDNYKLESQISRTPRRAEVLERSFQEYKLKAKRDLGRARGAENRVEDTLDTTELAQTESSGQNVEQEVEHTKKKTLEEEAKTHEAQIQEIEAEALTGRGGAGGAAGGRRRRVKANHREGKADSEENERGELANEAETVLMQGKGDSEHKRKKVEAHAAGAARSSTTEGERDAHRAGRQGHQSCRWSWTHVTGGTTAQLRPAKSQPSSTKGLLPARESQLQDTQEAADREEKQEDAGHDEPSSAVEAKNTTKQREKESQHTSQRQERPPSTET

SEQ ID NO: 961799 - protein, 198 aa, Homo sapiens
MDAPAQLPSAVRAFLERVRSTDTVDIGLLCQATVQLRASILVRPGARGLASVELMLPEGAIDFAEPMATAHCGMGRIYINTPVHQCSCVPVECIRSIKTRFAVFRQCVTFVHTLTIVTVEPTGRHPDVAVMRTLSLSLDLGVGASQRMRENSLAVLRALQISGYLGERCPENSCYPSWNINGAGSCRSVFQGMFKATT

SEQ ID NO: 961800 - protein, 156 aa, Homo sapiens
MRLNQLLHPSPHDVDSAFSYVPALHYSQNSHARFCGLKPSACLSLVAGDQNMACHSENTPPPWPLRSLPPSRLRSSQQQLAGDEGRVLLDTCYVIKPGNTKEKVAFFVAHQCGGGSRAQLHEGQGALGSDSSKAKRRGAVLTHQGPPDPGPEGPFC

SEQ ID NO: 961801 - protein, 203 aa, Homo sapiens
MASPAIGQRPYPLLLDPEPPRYLQSLSGPELPAACPPDLVLAASVSLAPLSTAPGAALRVRSALEGFPGEPGAPAPGLPTRSARSGPGLQQKTSGGGLELPQPPQTMRSIYRSSRMDPRVHGRSDGRGALLRRSWCCRADLGMVGPVTDEQVLRARLHALHITCKIHPVTQNACRPDPVDMQSARKGIYPGTDPLQKDTSTVS

SEQ ID NO: 961802 - protein, 113 aa, Homo sapiens
MVGRLSPVFCRDKEAPIKEFLAHFGNRRTISSAPNKEELLHPRLLCAKCAPRFIIPGLLPRREEKAHFASIIGRAVKERVPFRAEFYRGVYPPGALGTAPKRGFTSTLAYKAG

SEQ ID NO: 961803 - protein, 266 aa, Homo sapiens
EQKWRGPVVTATDGHAQLASVLAATTITARTPSRPWSRDQAASWPAWRVYSGRDGWPEQADGCDVSSDALLPAAVHAVSCTSSTQTPCTLPSTPCPGAWVAPYDAGRRNADLQSPRALTSLCSALPRALLEAPCPQLAVGPCSLLPTCAALPRTPRSPSSHVIEDATESQALLEGDEDESRICRDVCWPPCLGVRFILRHRSTFQRRIVAPPVMREESLWLLDSLLPDRWSREPPAWNSTSPIQLELLDICCPAPGCGWDPVTDTC

SEQ ID NO: 961804 - protein, 171 aa, Homo sapiens
QTVLVELQEEAQEADACQEDAGTEGGQSLKAEPGVVFKGLMMELNLFGAGHQKIQEKAMNGGYGHLPPSIASITAKLCDVAQQRNCEDMIQMFQKLVPSMGGRKRERKAAVEEDTSLRKGEGPRQPDGDEEEEHSPSGSSEEMHARCSTSCRDDMICEDDCDSLTWEGDLT

SEQ ID NO: 961805 - protein, 203 aa, Homo sapiens
TCSASCGATKQEEEALLSEMDVTGQAFEDMQEQNRGGCVQQIAGNRMMPNFKLMSERIKANQIHKLLREEKDELGEHGPWPQVPGVMPMLLDCAERWRRRSEPCLGSPLGVVEKDADRCLQLKALVAQQSWNGCSKAAQLADGPEVCSCDARAMTRAAGRIQALPWQRAGLLVRKRASSLNEGSRRTSHGCGAGWKKQQEGGG

SEQ ID NO: 961806 - protein, 224 aa, Homo sapiens
MSRPGVTTISTQAQSGGWPQALSSHRYSACSRSGVVCRSQVLQLASLYIPFVPQVHHLPLRTRTGSSSTIATSLEEQHKHVPPELSQYLGVTIDLINSCTYRFDPNCSSRLQLMRTLLDRRRFRPPPAPRRLPARRDGGALRLRPDRVHSPLQFHRHCASPTEHSLRSASGASVTPHALPRPAPSHRRPCPIQPLPRLRGCPHLISRITATPSPRWRSLLSSQI

SEQ ID NO: 961807 - protein, 289 aa, Homo sapiens
RHEVETELATMGRGESPGLQEASWVKAEANMGFGATLAVGLTIFVLSVVTVSVICFTMSPAAAFTMTVPSDHARGCHHHHSPLTAVLHAPYPQASKVLPVQLPWTKLPGLPQPMPSQTSVCQRVSGATPMRVPSILTRPVPWVPGWSIQRELWTGSDAARASIPVRVHALSLATRLISMDAPQGGSLGIPWFSLDCLVGLVSVVCAMTWMFLVAGSPYASPLLLPVVLFMAWGVPLGPQCVLWCFPACILWVPSVSDMVGATSLPEMFWPRFCTRTGIWCSIRASKRGG

SEQ ID NO: 961808 - protein, 197 aa, Homo sapiens
MYERARSLQRDQEMARVYLTPIAASSFVSKCAMDAMRVLHDASFISSNDCEINAARIWCKLHQREHVKAVKREVAGKAHASYKFEFHVQGAPFEVRDSVVPPCWQSQASRGERPQCEPIGCSYYAQRWPNVLSPVQFAPWRCTPCPLAGLTHNPAGFDLSNYASEPPDDGRGHGIRAGLNSAFNLGAIEPAVRGPDV

SEQ ID NO: 961809 - protein, 103 aa, Homo sapiens
MLAAQSRRSVALACGPSTYHWMQKPFYSDERCATLDVAYAYGKLSLHQTQVSQGLATELSYTYMPRLTSGEVAHCASPSLIKWSAALVEALPERLTERRITCH

SEQ ID NO: 961810 - protein, 93 aa, Homo sapiens
VRPQLSHTILTEKNWFHYAARICDGVRKSSALAEYSRLLALRPGRGTCHAGDLPWVRSCLRVSTDVHSPAGVESRQLALMDEGSWLPVSQYDH

SEQ ID NO: 961811 - protein, 84 aa, Homo sapiens
MHKELKKESTTKRDSKRQYNKPQSATNTTTNIHTSSNRKTRGNNQRRQERNAQNNSDLTAEKQRTRQEDSHEKDDKQDRPNTTK

SEQ ID NO: 961812 - protein, 111 aa, Homo sapiens
MVACAYSPSCYRRLRHENRLKPKEVEVAFNLRSYHFISSLGDRARPLASKTQHHTNTPGETTPNRDGAPNNGDPSTAHGPTRLSDPSILTHQGTRRTPKERRQYRNPGNQP

SEQ ID NO: 961813 - protein, 265 aa, Homo sapiens
MVFLQSSAARGQHLGLPCCNGAGLQCAPLHFPAHSWGQSGAGRSARGLTWVLTQSHVRECGVALTQHRSSRNKDPGLLGKRSQPWALQQGPKAGFKKQTAEDTSSLRTAWFPRIAKHSQRAEREKQQEGLGVPTGRVDRGPVRRSPFPAFLLRNLQAGATRVSIAKDPGLEGKQILEAKFQGGPLNTGPHTGYRLTTKGVAPVPLGAFGWDPLCRFVAPDSLAKSPRVTSKHGGHDGSLDPGPNSHRPGTRPQRRSGRAVTSNLL

SEQ ID NO: 961814 - protein, 88 aa, Homo sapiens
NSVHGRGFNSIHYMVPRSYNFTPSRRRPLSVRADMGVQVETSPQETGAPYPKRGQTCVVHYTEMLEDSERNLDMPSQRQKQALFKLYS

SEQ ID NO: 961815 - protein, 119 aa, Homo sapiens
MWKRLELPRDLLNGFAQNADSNMDNKIQAEVASGRDVELFWNWRKGDSCFVLAKRLMAFCPCPRDLWNFELERDDLGYLVKEMSKQQSIQEVTWVTVYRDSVFKGKQTLRVQKICSLTM

SEQ ID NO: 961816 - protein, 228 aa, Homo sapiens
EDVEFGCHYIFIGSHFCDILLRLLAAWVPALLGDMVARAASLHSCAHPDHTKEADEAEYRDGPRRAWRKATDSLVNASRDLVTRVPTAQKVFSTAVIGTSPRHLTCKRHTSSSVHTNGPTEQRQVTLHITWPTSVDGKKAMAARRSTAERQAAAAACQLFTELGSAKVPRYMSCFDAAKYPSCCCIALASLPTAGGVGTQHDTYFLAAAESESIDQGDLGAYPLFGRT

SEQ ID NO: 961817 - protein, 115 aa, Homo sapiens
MVFFIFYRNGFCRQNTGVVKTTPKSQNGKGKDSYQHCRHGHTLNFGQAPPLRGHRDSITCGWHSTKEPLEKFDKGGCMKVEKGLLSRYAVGLANTTENLSVNGGYHHVISPLVEI

SEQ ID NO: 961818 - protein, 283 aa, Homo sapiens
QVQSDGRENASGMNAAMAAQVEPQVQFNTCIWLVMVVLGKTTFVRRHLTGEFEKTYVATLGCRGSSPSVPQQQEDLLMFTCMGHTTAIEKFGGAERWLIISNAQCAIIMYDVTSTRLRYKDLCLQLAYEIWYEVCDKPLPIDVDDGKQTWTNLRDRETVSGEKSSLIIPNRNKDGHITMRVAERTSYEPVGQRIGRYSKPRAFVGTPQAPVCSVLGSLCVDEVERCANSVVGRETAMTEDLGIADLGELPKVDATTIYRADPTRENEGSTPQYQRPGPFIGST

SEQ ID NO: 961819 - protein, 138 aa, Homo sapiens
MLHSSSSFNSFLGLVLRLTYCAWFDTYRNLCTMQAGSAATKSAPSIREVISDEHGIDPTGTYHGDSDLAARNAYNVVTTIEATGGKYVAPRRARRILGARHHRTTVRYGALRADLSGRTTIRISVRVGSWEQLGSKGH

SEQ ID NO: 961820 - protein, 293 aa, Homo sapiens
IKHKEKHRGVYYGRGEALRSGASGGRGDEELEQREGTMAAVGFEEFFSAARLRVGVAFPYLVATSWQSSARRRKWQYSVRWSRAGFKGSGRQKMKRKEAARGSAGGGPGGGIKSPAQVTRHIGIARLTEDDRRQGETKAESMNAGHPFRVTEAHTLEKGHAGRDPGGDSFMRRCWDILRENMNYHRGDHRHNVFKPNNVARRRISRRKTQGATGKLTHQNPPKGKTRRAADYEADTSQHRQQGRKQLVTSGPKEAANFHWTPPARNTQGQAPRTPPAAREANKMRARNKAERR

SEQ ID NO: 961821 - protein, 252 aa, Homo sapiens
ISIPGRRSLYYWPSSYNYNPDMYQLEGLNWLRFSWAQVDDTILADEMGLGKTIQTIVFLYSLYKEGHTKGPFLAEAPHLYLHSTELAHPPPPPPPPPPPPPPPPPPPPPPPPRSAPGTARSDAQATGYAPPAASVEADAPPRAPAAATPARADRAQGHQLGEPAPGPPSAQPHSQATHQPRRHPACATRRDARADTPCTPAPQHHRPTTHHPHHRPTRSTAHPRTTHPHTRHAPTAHAAPAAPPRHSTHSTT

SEQ ID NO: 961822 - protein, 69 aa, Homo sapiens
DPSSKLVLKSEQEQNREDSDLGRSLSQMQDAARAIGYWAFECLTVRDYNDMICVHSVCVAPKVEMAQKE

SEQ ID NO: 961823 - protein, 129 aa, Homo sapiens
FECEGRGFRLIITGRSSVQLNTLSPPNDLRPSHVITLPLHNAPHTRPTNQHTNHIPMMARCNTRKHIPRPPHTTCPKRPSIRDNPYYITSEVYYTFAGFILSLITNSSLAPYPHNKGGHMEPHKRASAR

SEQ ID NO: 961824 - protein, 108 aa, Homo sapiens
PPPQHQDYYDVPYRLLIQCRGLNLLVKVWSPRQNCLMERPCSTERIWYPAHLREPKEVHEGKAEAVSCWEAMQGASPSGLLRQVVEASLYPNEHCGNYREALIMETMS

SEQ ID NO: 961825 - protein, 163 aa, Homo sapiens
MFPGLGRGKTASRWLVPPRPRLPLRWLAPQMGCGLYPVGAVRTADGVENVRSAAGVCVVLCSIAPSVPGNKCLLKMYRKPTLLLYAICRRALLPGFGSSSGWLGNQEPTSHVLIPRSDCPRGQCAHSVSKRRGKFTPPKILSRLKGKPRVRFSGRLGKMWLNS

SEQ ID NO: 961826 - protein, 261 aa, Homo sapiens
MTGLDVFDSLVVFGSYAINLATAHSLGPRCVDELYTLTAKICSFTPEPSKTMSPLGGTNNFQTCCLKSCNTHHEGLQLHVLSQRDHEPTRRKKLRTHQNIRRDRLQMRHLKSCNTHQKVCSFTPEPARPRTHQKEETPNTSEHQKGQTPDAATLRAVTLTTRVCGFILEVSETKNPPIPDTFGDHEEDFRISPSGETNSRAVRPFPIAKQIEASSYRWSYKMEPQKKFNNNFYGGTWDQPTGLPGLKSPSEGPTGALFASE

SEQ ID NO: 961827 - protein, 88 aa, Homo sapiens
MVQRPPYVTPLYSFGWSLGSESAAAVLYGKHTEAPERQAHMWDRPRCHRGAPGAPGGPGMGTRVVTRKFRHSILGRSRLKGRAKTEPR

SEQ ID NO: 961828 - protein, 256 aa, Homo sapiens
GHEGCVSGDTSLCRYLVQLPLTAWLSCLRQLHRTQSAAPAGGAAAAAVNSSSSSSSSQAALQLAASSQQQQQQFQAQQSAIAAASSNAVVQHARSSSSSSSSSSSIYIKSCIIKISNWYSSSNSSLQTNRHSCSSNNSNSSQQTAAVSSSSRLMQAQPQFSRPPVQQPQPPASHCFMPQTAAADALTHSMRPAAVTNSPSQPPIAQNQSSQLPPQSADPAFGVTRRKSRWTCCSQHTEFVDSWWCQPSEPVTQQTQ

SEQ ID NO: 961829 - protein, 130 aa, Homo sapiens
MTGRGFDLGSYLVRSLLQLTMQHMLGSPIPVTGADKGLVSQHLGPGALRQAELEGPVESSSTTYVCTACPPAPSSSPALVIMVHRILSVEFLHPMDCSRHARTQTSTRLPPEMPQTRATPGQVGNGLIVD

SEQ ID NO: 961830 - protein, 124 aa, Homo sapiens
KKEIRPKSRVIGQAGRMYARSMPPAWQTFLKDHRIYYIQEAGPILEGCACTPERMDEAGYASTAPLRTSQTMAQCFFCFKELEGWEPDDDPIEEHKKHSSGCAFLSVKKQFAQNITLWCNYYAN

SEQ ID NO: 961831 - protein, 282 aa, Homo sapiens
MGYAVAVPACHMCCFVCLLCVCCCVCVLLLNVDLCCVCCVAGERMLLPGDLALDTGACCVCDPHLALLMCPADAASGCAATEVMPVCILLVPLSSGGALPRLPWAGREILVWAHLWGAGDPALGCISGVSVCAQLPWVTSWMALALASCLGSMWYPPVDCACSLLPPLPVALPCGAAWAKAVLEVQPWGFACVPPGPLADHWLTLLLCLPCGSGCDTPCERRFGSRLLSAYCACLLLACPLCSTLACSSSIVLILYYAFLMEVHRPQRWASSSCPRDLTKAL

SEQ ID NO: 961832 - protein, 217 aa, Homo sapiens
EEVGRRTRPFVARFGFDVVTCCGYLPQVNDWREDWCRVLCPAAHSAPDGHGVEGVWGQWRPSSLWSALQLKIPDLFRDLEIIPVAYVPGDLWGGNCSRGFLWAGDIMTPVFFLAVATLEYELAIAGMFGGFEAAPFTPPTTGKIPKDPGFEKRLQTVSDSLHYLNHLESFRIGVQRILPEHHEESGSVSGALLWKGGLRRFLHSPLLGKFLCLHMPD

SEQ ID NO: 961833 - protein, 111 aa, Homo sapiens
MLSSGTSRRGKGGYSTPGGPTPKVFSISSQGLLYEDNPSIEGAIYGTRPGQSSRERVENDREHLTGEGPGIGQNCGPTRDNLGVSRLSYVSSAKGRPLGPQRQESSFLVPS

SEQ ID NO: 961834 - protein, 260 aa, Homo sapiens
NCCSGGLEASDGGLDSAELAGWAGHGAPVRVVGAVKSLHALWLVSSRLNFWSTKHWGAYCGVARRFALVRAAMSALCVSKHSPRVCLCPERAYATAQWQSGLQQVPCPTMWILVCDNDVAVLTVAPWCYRVVDRHGWMMCAAGCAPAVSGCGTCADEAGGEGEERAEEEGSCMAGKLTLEDTTGVSNVQLPYDTTISEGRDKADAPEMIVLVALGWTGLSAYNFFGPLCLPDRAPSPVSGPVPVRRSLERGSRVRLYSWS

SEQ ID NO: 961835 - protein, 379 aa, Homo sapiens
MATICIRRYFGLISSQGLGFHSTIDGRWCHQFTQTSLRALGRPTTAAPRTGPRGSLPRTGPAPGPPLRRYALLSLLRPAYQYYGYGRYPDTHEDTEDTTTIYQKLKKQETKKEAQQKKRKTKTEKRNTRKEKNRHLQKTEDKKRAAHTQDKTQEDGSKITNRRERSEGYSQPRQQKCRERRDITGKDREEEQEPDTNNREDTSDKSPHTPRNKIKHKQRIKTATNAEEKRQGHAEGQPPPMRAMRGQRRTTTRRIETGQPRNNTEADEREERANKSTDENKEPRRERKGRDSRAADRTTDETVGADETKKRKERQKHKNSHHNTKKSSEDRGSNRTNNKTTRAGRGKKTDMEQTSGVQQESLPGPTQRENEASEQTRRI

SEQ ID NO: 961836 - protein, 187 aa, Homo sapiens
MLWWQQPQGSCESTKADGSAKKALTLFSKWEGSNPSPQTRPGLVCHPLMIEWGTRCNSWVANLQTDTGNHCGHPPGSENADVPSVISSTYRVVDAAIVETTCWIDQPKGRSGEMLSFVQQRGPAGSHFVSVLIKLRIHSGFNGAPGDFVVIPKPGKGGLLGRDRVRAASDFPWARAQHGRLALMAHC

SEQ ID NO: 961837 - protein, 190 aa, Homo sapiens
MLCLCLYVPVHRGKPKHDIPDTYEVERGLPAEADMSNNTMHQVSYNPTPRNSPPTSQLRTHRKLCHTGLEDKGPYEMAKPKTYEKKFCPYNPHKRIMRGKRRHRSAGGCYKQCLVTQHKKLNGDRILEQPQARDSIASSPVERGPRGPSTRLLHRPRQGKKNKISSKESTVDYTKTGNHSETSRKWGNTP

SEQ ID NO: 961838 - protein, 67 aa, Homo sapiens
VTVYSSRARFIVHLAVSYINTTGPHTSPTYDSGWPFEKVGYIAIGNRQQEKKNVGQVLLVPGPEKEN

SEQ ID NO: 961839 - protein, 241 aa, Homo sapiens
MLDYWSLVLQFNTRLFDRTAAGQPSAVENIDKNTADAITAEGFTDIDLDTLGRLYLERDTLGIREVAAVSIAVSPLVRGRVSAAAAAGDAREQAEGIQGKALGPTYTLTRYKTIEEYTASRYPHSTGIPRWTREVGTAYLPEHYTPYNPKPRVGVTYDRPRYLPSVGEGVQHQPLPAGGESLGLTAGPVTASGSQYNKRIFEVGFGLYGSIHGPTDSKVNIQIIHTDSNTVLGQNDPGYSC

SEQ ID NO: 961840 - protein, 207 aa, Homo sapiens
RGRIERARRRERMSLSDWHLAVKLASQPGHLLHQSILRSARDRTGSRYSLGGYSTFIFLKQVICWPQAPGGLVRRHLQSEYDSDLRVVGSKKMTETLDFVWPFNTGSTVHVLRNVLVLEDLKYMQIAEPCGITMCACSLYESSRVVAHLDSCSRQTSCLHGMAVFKMLQSTKESLDQIIVATPSALSRVTLSLLGFSSDKGPLLCLR

SEQ ID NO: 961841 - protein, 200 aa, Homo sapiens
MATWRDKVRGLKAGVLSQADYLNLVQSETLEDLKLASSRAQIIGNFLANEASPLTVVSHTIDRLKEKIGGGVPPHRGTIAYEPLRQLYLDLHYYNSYIDRQRRYLATYTGTLHQRSIARARAQDATHIGSFEQMEAVNIAQTPELELYNAILVDTPLCGFFPGLHIQRQDLDEMNIEIIRNTLYKAYLESSTSSAPTGRD

SEQ ID NO: 961842 - protein, 266 aa, Homo sapiens
RGLSGRYRRGTLCYCRARRSPALLRDATPCWSIVQPFVSWLLQSLCRVDWQVEPAVENWPACCVPPEPLVLSRPYFATWWCKCRVFDCSAMPVFAALDERHNWGHALTFYVSQSGLYPVGRQRIFAHLCQIALGKHSAGWQEALGAPYFFTFASASNPCERITTVTYEFTGRLSQKGSLRRDSLCERPWVDWLMRRTCYVLGEGLPPRVGGHGSRWSGCIPAVEQCEDELSACLVLRLVGPLTRTLALSDSPSHGSTLLGPGCGGA

SEQ ID NO: 961843 - protein, 217 aa, Homo sapiens
MTFWHPDLHAIERLMTLGLRRGRDRLVVGDWRAPLHRGSDIRRYYRTMLESAGILRGPEPWGIVPTCVGTLPHVWSVLVACSTSVALNAHLGGIAVCSFWEQPLPQAAVALWVIRIDFSKAQEESTGLLSVPPGSWSTSTVVLPVRAPGPHPLTPFSARTSALTFWVGGKAWSDDTSQLCPDQAARDVPSLEQYAEERWEVVLTSWWAPRGVSARLV

SEQ ID NO: 961844 - protein, 147 aa, Homo sapiens
RSTAARFIIIGRVIILTGPGPPSMVSSRTSQSSRGIEELLTDRNGGVSKVEDGRRAPKPVPTQPRPVSPQLTTNHRTTCIPPIFQSGKQKGVSQNLTGLVETSRGDIGQDVLLPSSLPAQATTITSTIEPRTYQSLGHPVVEELERR

SEQ ID NO: 961845 - protein, 257 aa, Homo sapiens
MSESKSGPEMLRYALHGRHGPTMVPYQQTPGQLTYGHSQEQVTVHCESCTDHDGTEQIMKSIHPRRDHRTRHHQPSTAMKGDGRIPSDRHTHHEVSRQSDHHNKAAYPHKMRQHQSPMKPDEAMKQAQSKPGKQPNQKNLKGEEQHESSEVGHTGTKGKATRDTIPMRAVESHRSSVSSPLLTREGEDRAIHNGVLQIRIRPHPVLIHNKDRPLSPEPEQKAQTIINVEDNTDHPYKKRTRQEKLRHRGRKPTRKWA

SEQ ID NO: 961846 - protein, 241 aa, Homo sapiens
PDAAHGWLILWKRGDKFRGVGEGMALFSQTGLPGTQELEMAVVGQPPVPPYRAFLRTPVDFESSGSSEPPAQEADFLAIQTAGGGVGRGPAGSQQLPPAMSEVASIRLPMRDWASRSLQRDSAPWKTVGNYVSPMDGKTQTLEAGLEVRGGGWAWGLDAWACLPGQGLRYLAHLCLVLVADGQGSCQLYLQLRIQRSPGDPGEEESIRAPLASRYTPQAIGGSGQGSCMQKTQEQGGYPSG

SEQ ID NO: 961847 - protein, 163 aa, Homo sapiens
MVLACSWVSDVAYAGLHELLAGLTDHSTACQLLFVPMQEGSVVLTDVARLSDSKKSGYTSARCFAQVHVHPLVPRSYVHPSSTSLAWHTSGRHVSLARATLAIEADVGHVEPIVCTCLMGPLLQLALRCQEVNLLASDLKEDGLASVFMLVDPDSLADPCVTP

SEQ ID NO: 961848 - protein, 205 aa, Homo sapiens
LRRAGLAAGFSDVEPSRDMAIYSGAGGSAPEMELAPEMGMRSEKYIQVGGSDCAFVHGRNYGLITSGSSFEEYGMMLHQRLRDVKNVRRCSRLYCMLLLIEEDEELPGRLNGHPTWTTWSPVSGLCMIRIVGRACATQRQRLITRVPYQALISAQANSDIHRVPDSFDCGCLHQRCSRRELSMGSPLHPYQGMCSRIPPKENCEG

SEQ ID NO: 961849 - protein, 284 aa, Homo sapiens
KGDIWIYPIIKDEWYYQIETSEIGNCEAKALIWTAESITQTIAIAGQWHHAAAPAPEGVLMRLVEAVARASLIPEFSDGILDWRPNWRCWNEYRKHLGILLSLNISIYLRRTQNSSQAHLRYHSILPHSFYTSDPLMERDRALHHSMNCNRIRGISPSTPCAGASAATRSMRRALYAHLRTRAQNHGWRTAAQPLCQKSQTARHCLDITGALPHTEDDEPSHMLSPISLSSETHTGIASHSAQKRKEANSIGLTTRAMQKEQDATDLSPKQPPTNTEIIPRTKT

SEQ ID NO: 961850 - protein, 125 aa, Homo sapiens
CGTARFERSQTCPPCFVAPILCVLLPSPTRECGDVWRLRRGDSRVCDADDELLLPACLPLTCCDVLPACHLVCHHDLEPALPSLMPWPILCPCSPDLYPFGTMLLEEGFGDLWTGIVTCGVIWRQ

SEQ ID NO: 961851 - protein, 199 aa, Homo sapiens
LGARRSAVFCGVRPSGPRSPCRSFDIQSPSRIPVDVNPFQDPSVTQLTNAPAGSVWLELQQPFLRDMQADILVPVIANIPGVLTASGFSSHQWNQSSRPPRPWCLQTQATACSVLDREETGSRNSCPYDWKRNGAGAAEAPAMHKLALLRQNQAGLPVCSSWCPCCRPCLLVKDFSTEIPGDYQRICKMLYYSVDVAFE

SEQ ID NO: 961852 - protein, 220 aa, Homo sapiens
MLWASPMSSKELQSVEQEVRWRMQDSSSTSTWPSWQSPVPPSHRSSTRQELLAESARHTWKGVVTEDLNDSHTLVDRHELKVGHLSESIVMRSACEDKWCLDVGWSTLVPFELREGAGVVLAALEPAAVPLLRAISYQPGAREALLSDEEMCSWTWTYAYGQTRAFTRAQVSQRLGSDLLSLMAQSDFWCGGPLCQSFAYSSGSTALFEAFDQHVLNERR

SEQ ID NO: 961853 - protein, 215 aa, Homo sapiens
QRRSELCSQDDRVARQQAPAGRTRPQTSSSLGSGAPMDVQDQMTFPCMDYIACEGEVCQVPALTVQGGYAAKCFRKAQCPIVGSASPNSMMMHGPVTSGKKLMTVRIVYRAFEIIHLLTGEEPSAGPGERHHLPVVPVEDLLRRIGRAGTVRRAGCGCVPPAAVCSLAIGSGVAQALVEVCLPGDFWTIAEVCLADELSRVLAMGSSYSYANLEE

SEQ ID NO: 961854 - protein, 160 aa, Homo sapiens
MVEELGYNQYESKTKEFLYVLVSQKSAESWKGVKRRCLENGNLQQKKIYLFCPIDLTDMVPMKRLPKLVLQEFGRIDILVNNGGMSQRSLCMDTSLDVYRKLIELNYLADGVLDQNVYLPHMIEEEARKDLLLRIAIVCIISVPLSIGYLCYKALSPGLS

SEQ ID NO: 961855 - protein, 233 aa, Homo sapiens
MEAAGATIPCSTTICCVAGYVRAAREVKEHERPEVFPGSARNPSRTSIHTGNKTSELGRKRKAEEDAVTASLSKTRVSDPYQHLGELGKRRNECMKPKTAKVHPKTSDLANYLKFLGVRALAIKDDRSIAKARDSRKLARLVNSMPQTCPLGKARWPKPSITGEGLPRYVQPEPSANLLRWSQETLQAGGPASRPYGAAAKPWDGVSGTRTDSYSEGHLRFSDEPDCRGTLSK

SEQ ID NO: 961856 - protein, 216 aa, Homo sapiens
MAGVSILSPKSKGQGLISQAPFLAHLQPLNLRGPQAISSVPSAWGVSVGYTSCPPPRLGSANYFSTQLVLSVYVVFSPSHYEESLFSFSPGGAQVLQCAPFRGFTRLESLVGCSPREKGVPRGLLHLFVATRLSRSPRLSYKTSVSSPYFYLQLQRAPQGAVRVGHFHCAPRQPSSFQPPKDKKASGAPVGEFPRDQLPGERGESLALGGSTAPGG

SEQ ID NO: 961857 - protein, 79 aa, Homo sapiens
AVGRLALSEMLRVTHRSFASMRPVFQCYWLLHLTRAYAIRCNIFGAGCRCRLNAFIRLIDRLYDLMPVSSLTIGGRERR

SEQ ID NO: 961858 - protein, 83 aa, Homo sapiens
EDGTRPQRDDICRQSSAGGVLFSVSLHLYPEAHPLTDVPMLICYNFMDLVIHTLNSFYKRFVDDYHGKFGPSIIIEFSVSDFL

SEQ ID NO: 961859 - protein, 89 aa, Homo sapiens
MMFRQIGEGPFALALPSKNSPSVGTPTVGADRRKGLPGREDASVRNKRHQIQGPLKTNEDRVKRKVSTNRNSNRSIKEPRREENKPGRD

SEQ ID NO: 961860 - protein, 203 aa, Homo sapiens
LRQMATVGGRRHGRACRTPAALVIPGLTAMRAQRLSSCRVRVEVKRSGSRCRPLAPIRSVTLQRCSCSLGEGPARQTIYVLPPVDCLLSSFSSILQSLLRTLAPLLGFMAYRPTGFTADFVTLVFKRIPYPWNTGEGLFVGNFLLPFWAFSLGQAPLFPCILPYKPRVWGKTCFLSMTHCFPDSRGFPAILGFDPGFCVHLNG

SEQ ID NO: 961861 - protein, 100 aa, Homo sapiens
MTKMGLLTCTQLWVRQSLARQTRGNICGTPSPGSEKLQSSPSGDITALQGLEDAAIVEHLLDDQPKGERGQHVDACSAAWLRWPPFVSPSSSAAITPDSN

SEQ ID NO: 961862 - protein, 107 aa, Homo sapiens
MSCNITVNVCSFTPEAIETTNPLGGKNNSRHTALRTVTLTTKVCSFTPEPARPQSHQKEESPNTSEHQKEQTPDTLPLRTVTLTARVSGFILEVSETKNPPIPDAVG

SEQ ID NO: 961863 - protein, 287 aa, Homo sapiens
RALSSPTRQRSAIVTITPREEPLLPQPVPVTITATMSSEVETQLAARRPSAVSLLLEARRTTNALATTGSGARQLVDRAGFNIGVRLPGGSQGGSSQAEGFTGAGSKDWVPRCFAGAALLALHSVQGNLHHQGQTTGSVGTAESLAPINGRGILTPVAEVNLFGGWFATTGAYDPGGTGLDWASLGTRTTAAVAGGKAEICFRGLLAGYYPGFRGAAFKLVDGRTGRPFTTDRISTGSEGGPSSADINPRDTFSGHCCDVGAQRTGGSADLVPKAMPRYAAHRAGKG

SEQ ID NO: 961864 - protein, 251 aa, Homo sapiens
MPRWVARRKVAPRHAGAAGRLTLLLGAGLGAVVEGYACGVLGVTALGWRCGLACGLAARLLALLASSQPNLAPLVARGGTPCGRGVNLGRTDNGWFSPGGALGWQGFQVDAREKCSVKWLLSWLRNPLVANPRGARARYCGVTVASEVMRTPGSVFFTGGARAGGDTPGEAEMFTRTLSRGEGGTEPYRDCRTGGYPTLCVARHKNGARKNRGGGTCGITRRRGGRQPLVGRRPGTGQKPAIDVLKPTKKI

SEQ ID NO: 961865 - protein, 228 aa, Homo sapiens
GNSYSFFEKKTTKTPKRGVGAPARGKGAPPRVLSWSGGAVGVVWPARLCVASMGAAADAPAGNGPQSTPHSAVRAPCPCTEGGRQTHKVLLGGRHPAPAEEGNTWAKMVGTEDVVAPPQAPPQRKILVTGNIHSGPEGVPTQRQGQKKIAPESTTPKEETNGRNTPPGGVAKKVPRTQIPPCGATGTTTGGLLQRPTSGYSKMETPCCSDPEGSREESRGGEGENMAH

SEQ ID NO: 961866 - protein, 208 aa, Homo sapiens
MVLSGVTAFCCFFISLLLLPCKKCLSPPAMILRPPQPGGTISPIKPLLVPSLRSCLDQHAMKCGLISTSTSGALLANVYPSNVDSDVVELGCLNIIWRASVSKIGKCRKVWYLPRDCEWRDCDTACDMYNFVVRLTVVSDGDVDLVGPEYEVTLVCLRQETAGFHSWPRALWPLRLTALLSGLRGKSQGQLSGPGGDLSLGGRIRNPR

SEQ ID NO: 961867 - protein, 253 aa, Homo sapiens
MRLAVLYLVWALTECYWQSEHCNNQPLDYQEPQKPPLTGQPPQVRPTQSIVHPTSATHNPLSPPERMDRLSLVLSNKPIALPRSLVDASTCSTRHDPAIHLVYWNMPRFSRNKQQHCAPARVSSPSSAHPRYQLHPLRVLARSLQGDHWATTRVPMVPSPVSTSVPRFRFESCHYPGWRMRPGCTLCTESHKYATGPGKAVRGGHRQLGSLIPLWTASGFGFMAGLHRKLLPEPLGAGPRVFPGSRGFRAKVL

SEQ ID NO: 961868 - protein, 124 aa, Homo sapiens
MKDLFKKNYKPLLNEIKEDTNKWKNIPCSWIGRINIVKMAILPKVIYRFNAIPIKLPMTFFTELEKTTLKFIWNQKKSPHAKTILSKKNKAGGITLPDFKLYYKGYGNQKQHGDWYQTDILPID

SEQ ID NO: 961869 - protein, 80 aa, Homo sapiens
DTVTSPSLVKFMIEPTTSVGNKWSLDVRSPRRRRQVRYRTAYFREKASLKLYKTTPECHLSMLDSELIWAGGNDNWLGMI

SEQ ID NO: 961870 - protein, 196 aa, Homo sapiens
GLSPQPRSGWRTAVCTHCEGSHADAATWMAPVPLPRCPDRHAATSMRPMNAFMVWAKDERRKILLKAFPDMHNSSISKILGSRWKSIDQPGEACPTIDGTGGGLSRGADLEKYPELQVHSRGPKRSLRSWRGRCGLRVGESHGSLLMDPWVGMPVGATVIPPQAGQVQMSSSDVLSPRAAGYACGGATGVCTMSLG

SEQ ID NO: 961871 - protein, 180 aa, Homo sapiens
MSDAAVDTSSEITTKDLKEKKEVVEEAENGRDAPANGNANEENGEQEADNDGRPKNDGQNGGDGTRTDGTTRHGDGDGHEDWTMNDWRNAGVSYRGKRAAEDDEDDDVDTKKQKTDEDDYDSKKGKVKLKKKGGGTYSPSIPSQNLNVVTFEYKRPPANGGSATADDSASTPTNMELHGG

SEQ ID NO: 961872 - protein, 269 aa, Homo sapiens
RRCSGGAGGLVALGWGTAVGSAEVSAGGIRGPWVACVDVGRGRGRGSSRRQGRGIREWMPVNQCWAGFGPRTIEDQGPVERESNLFSHAQLRESRRSLIHFHGEPLYKGMRVSKDYRHVAEAHDPVPGQATPGSRHYVGYRGTNNVATVREQGVSKVAPKGRVGQTGTITVGANHSMEQKDPPNRSPLRKRPNCGGNQRSGKSTKTCHLCKGVAKGGLGHTYEHENAHNPLHPGRTGQLYSEPCADKKMANEAGKQQKGTKARGDATWE

SEQ ID NO: 961873 - protein, 219 aa, Homo sapiens
RGGPSTAHASIFSHHTSPDSAPAHHFRAPNTHNATSSSYYSVSAVPVMPRPPSGICGPACPRGSVIAPDAARSSDAPENQRGAHASLGPPIMAPRTARQDGANSQLCLLQLVARCRQLPDCKADHVHPARSPWQDEPTSKKTEDQRTASCTEEEFLRRNKGPGSIKVQVPNMQDKTEWTRNGQVLVFTLPVTDQGSVIKVQIHEAQAAEGKQKLQHEAL

SEQ ID NO: 961874 - protein, 76 aa, Homo sapiens
YFWGGGGGCGGQGKEGTRGPPSPPHPLYQFPPSPGSREKIVAGRGGAQVFAEPEGRRPALGPDPKSGLLGQLCQAH

SEQ ID NO: 961875 - protein, 41 aa, Homo sapiens
MSRVHVSGAALWKLLLLNFPPTWQKEAMLLARLGAAAQGLL

SEQ ID NO: 961876 - protein, 68 aa, Homo sapiens
EVPGSDMPPWRRKRKRRKPKIHYLVRKKQLMRLRKQAEKNVEKKTSPYTRIVLNDPPDSWFWAQLNHC

SEQ ID NO: 961877 - protein, 242 aa, Homo sapiens
EKNRIIIRRICMEDTQQAHEDGHESKQHAIILNHHTVPDSKADIHQTTLTRAMVSGHDSDLFNDSRPMMVHGGEHGMPYMPSHKKLDAMDNTDWHSLKRLHKEIRLKRNESKGEHVPEITRLPEEGSDLHTFQSCREGVLTGQTLAEGGGRPKTYRLGNPPDLELTPLRTLRWLSHHMAHLILILWGTRFSWTVTGGSARRHSDSCRLRWDCPESPSCPSLQTLSPKPEEYTGWCAEGALLW

SEQ ID NO: 961878 - protein, 104 aa, Homo sapiens
MTETEPSTVADGQATSMMIWTLTTQYIIHNYRHRRHPRTCYPYCSEERPPIVKRIGRQEIPAWTGPGGTGHVMPQSTEDIPDVPPMTLVGECDVGRTVSLTNTS

SEQ ID NO: 961879 - protein, 220 aa, Homo sapiens
GAAAASVEERADETNIMAWALTEKASSCVVTNRFDQLFDDESDPIQRCMKADREQEKRSRLVEAALGALRAKERRLMAADQTNIQQRTGKQHAQGVPERPQEPACPPALAVVDKKEETAAARGRLRKKESDELEEDLIKQTIRDEGKNTLIEDQKGDTSMKKIRKSHLKNRVKEANKTVRYRRLLTDLFKVDGGSWKRYEGAVDVEETEEMDKINEAKVI

SEQ ID NO: 961880 - protein, 84 aa, Homo sapiens
MVCSNWGKSLPCWDFEERFYKVLCSLVSRKWAEPKLWQDEALGTRPWVHFRRAASWLRAGEFKGVNFAHAFRGGEQRRGRRNPG

SEQ ID NO: 961881 - protein, 204 aa, Homo sapiens
GAAETRLQTPGGRRHTTALSSSLPRSAQPASFRGACSWQRLLCPTVTRSARRSAGSWHTGSAAWRTHRTERAHATRLARLPRAHRFGGARPSPRAGPPFSARHSPPLPCGCTHDRASSPPCPADRSPSNSPCCASRPSPHLPELPTTQCSPSPAHSPTRTPPPPPAPAPPLQHSTPALHNLPPYRCTPPSLTLNPLHPHQRSLH

SEQ ID NO: 961882 - protein, 227 aa, Homo sapiens
TGRLTLQVPLVSRNVSACRRQCVLLHLPAHHRPPSLQRSLPCRPLEILHGYASPPVFPACAASNDAANVARRPVVGPQSARRTQQHANSSSSSNSSNSSSMQQQQQQHAVSMQFARPLPSTAQTDPVLQPNPGYLTSVVVLLTLQAPVTHALRAPRFRIMPVPILLPMWIIDRESHRISQMLRGSFAAGRGRSSLLAAVVREFTRACYRGAGGCRVPYGPPVGGGGG

SEQ ID NO: 961883 - protein, 215 aa, Homo sapiens
MQFPLWGLDRGAPIVSIVLLCFSFFFLDQCVRSSFSLVDEWGRFLVRAVALCAGSPLSRRFAVRVLQRLVCVVCVVPLRRRFSVEMVTPIVGTYMRVSLMSSLCVHAELYSSMYGQCLYHVERHNRGVSLPPSVSFRGHTDMLRFIGSLISVYPLLLVVPTRTLLSWGRYSRQIGLRRSGGDISQVEVVSSGRKSLALPRVALGRPCVCCLFLVP

SEQ ID NO: 961884 - protein, 251 aa, Homo sapiens
PRVRLASAPDSSASRRPCPDAEAVRPRPRASLLRSPSALSPRPRCGLLLDSFGHRRACKHAALVERSEDSSSSVMTQRVSGNAPRTEVNSSPEESGEQVRIAQTKILPAPSPTQRIYQHAMVTTNIDSFPGASPVRLSTVFDTLKHAEPKGDTPRTTKIARRTVNAQTPPEFHNEPHLPSADNDTITFRILTQARNLHGNSRPNSNVTPLSPQFTPNLWVSNWATHHIGAYPVHTERINIAEGHQRERLHC

SEQ ID NO: 961885 - protein, 188 aa, Homo sapiens
CAMGHPSFVMSNSFTNQVGWLQIELCDPSMTKYPVGVQFPDPRKLCMSAVGVKPRPWASVNVKLTKLTGESKARDTVRLCPCDGTHSSRISYRILESQVCVSPIQACVSYDASAHIISSRKRLHWTSKRLLEYGYVVEIVRLIDIVMRGRESAVSILDLMLTARSILYPKCCDTRGNMRYPSCKHPCR

SEQ ID NO: 961886 - protein, 182 aa, Homo sapiens
VRTFLIPEAMTFEEAAALLVNYITAYMVLFDFGNHTAMATADHWYTWHAGGVGYGMPCSMCRYRWRNVTVFGTASASKHAGNMHRQHMWVHNHHPSALITHAHALTDDALRHRKQALSPINRAVAPYDQCDTNHGMRIKTTLTKEHNKHIRRNTQWDNKIRSTIMDTGPSRDMHGTHKNRKP

SEQ ID NO: 961887 - protein, 114 aa, Homo sapiens
MESQDTNGSLLRNGETVYHFRGVEFQKANSGVMLVTNNVYGSYWLNKNLGISETYKPRKEQTARWCLAVIPVLQRTLHLCSCIVLVNTCSDHQWVGYCVEFPAGLIDDGETPRS

SEQ ID NO: 961888 - protein, 147 aa, Homo sapiens
MMERNCRREKKVVIEQPQEMTKNFRFSLLEVRGKQYLWYLNEVNMFTNQGTVIHCDNPKVQAISGMRTLSPLQAMLRHSSCEKCYPVMLNQLGADSLTSYKGDCACELLHKKDLWDGKAPVATGEDDDDAVPDLVENFDEASKNEAN

SEQ ID NO: 961889 - protein, 240 aa, Homo sapiens
RDHVRVRDDWRCARSMHELAAKDIDGHMVNLDKYRGLRVHRHTTMDIPDEAKTEVNYTQLVDHEQPDTLRCGIADPGLPDVTSTGKQEPGSNEEDQRVSAAGSQRQQFDMFSKICSELGTDDPPDCGSRMKIPPKDKGILGNAIKWNFNQDYLIDKKRLDVVTDATRHHRRSHTGRIADRTHDTNIELGIQTGSEETPAQAATQAPKAHQADDQTRTHERDRQKEDRKGDNQENQEHPPG

SEQ ID NO: 961890 - protein, 285 aa, Homo sapiens
PCAPLRRASLPAPRLGSLRARPSRPQSSADRSSPAPAFLRLRLSLLPPPPAVRDIAVRMCLGSGTAAGESRDCALCHALSSPLVLRESARAPSSVAPPYSLPSHCRPSRRLIPSPPLLIPSALGVQTRNDPGRVDEYERSSNLDVDNLALTSASLQGAVITRIWCKDIGVVLHIPKGLTLVSRTYSLIGNPKVISTGGHTPTFAKFVLFLGCADNAQVAYSSVDAHSLTGGQTLPSFLRDTGMGSSDEEVPCKGLKSPLLVTSPVPPTGVARICVVRSRHELVDL

SEQ ID NO: 961891 - protein, 286 aa, Homo sapiens
LPGPFPYRVHPKAGHSENGVEEDTEGQNVGPQKCYPLEPIGDPSVPGPARTYQGSEANREPIGDLRVPRAVRDHAWGRSHYYEAQSYETHRCPTRLGTYKGYDPGLRIAIQVGPQESPSDPGGHTLQIVGPKADASRTTQVLETTNGTRQARGKSYLALGGAQHKCRTKPQWCLKHSYDAQAPRCYPLLTMVEWQVLYSWRTQQKVYRPRDPRLPYFQVVRWHLAPGFAAVRLVNWALVGFARSGMPSLGASSVDQHYFVLASWRSLRELLHRLSFTHAAFLIGGG

SEQ ID NO: 961892 - protein, 144 aa, Homo sapiens
RRDGCAARAPGPVQHLYSVGDGGTGKTTFVKRHLTGWTLRRSMYATLGVEAHSPSCSTPTAGPIKLQCYWDTAGQDEHFGWNCRALAYYTPSPSCCHSLTALIVTLEQLLTTNCAYTGTRRSGYELVLNTHPHLCSCWQPNVRS

SEQ ID NO: 961893 - protein, 116 aa, Homo sapiens
LLRLPEGQERIGEEAVKLLEETPQAERGRNVTFHAVVSRSRGGSSALMSKLWGLFKRGQASWRVTDVAEAGVPAGMLQPGAPCGPQELCGTLALDFTHTPQASTVTVLQELGSKGA

SEQ ID NO: 961894 - protein, 245 aa, Homo sapiens
RCQCSPAGGCLPVRLLRGQRSGVRDPLEEAVCPFSDLQLRAGRTTALFKAVRQGHFSLQRFLLSFCLSVPCPQRWSLQRQAGLLELWWAPPSSSFPAALFTKQAWAMAGAPPPASLPPCSLISDCCASNQRDSVGVGPSNPGAGYYLVVRRFLSPLEKRSIQVGVTLFSRCRLSPLSLTRKGNSLTPCASQVRAMPRLFGRARCAHPLTVPLSGLPREMTRSPMEWGIPVWAPRGGARGVLWHWP

SEQ ID NO: 961895 - protein, 175 aa, Homo sapiens
MRELPKGGNRSGEGTDTELCTKPANKLTGEVVAAEDNTACDTRDVRVCPVRAIREISSDLRRLNQILSIVKLTGVSFTAEEIRTLTCVFELYCSQDSRRNSVDCRMLLTWPFRLARSIKSIVWFQTWVQGLRLSCHSHRDPSERELKTQKSCLINIMRGAIKLADFGLARAFGVP

SEQ ID NO: 961896 - protein, 122 aa, Homo sapiens
RVHQPGTSSAVGPEALTAGGGQDAIRLGLGETTTTARNPGIEDSKPLVLRLLRRGKYSSRVLAAPPELALRDTVTATIGTWVTPTVGTHSLHRVGMLLTTREFHDPDRARLHSTEPRARPGL

SEQ ID NO: 961897 - protein, 194 aa, Homo sapiens
MGASHALRGASLHRVHHPPGDAMNAESRTSMVGATAVPPSRHARGLYPLNRLAVAIGPIRSDARSALEYYSCFLPTVSHLHVVAGRSELFPVAARCPRTKDAVLLDGPVALNAPEKLSEKELQHEACACSSVQRTASLDPSSMASRLSLVNALFTELVVDLQDTFVCAMKTLYLADAFATEALGTLQGHEADHD

SEQ ID NO: 961898 - protein, 239 aa, Homo sapiens
RRVQRGGPEALCGPVDVGTACGFRVRFRQWHSGPGGRGPWTGAGAEAAWARGSATADVIRSGLPVTKLGRFGKDMKIKSLEEIYLFSLPYSEESADHMISLLGEPLSGMRFLIRIMPSCRKQNPVAGQCTSVSTVICCYRWYYNGHDRVWVVKSLQGTCRPPPSRGASHPWPMLSIVPVAQRLLGAEQDPASPTLSLAIVTGLLCGSCACYASSLRPRVHWHLSPAPVPMKLLMMAGIR

SEQ ID NO: 961899 - protein, 209 aa, Homo sapiens
VVQELIVLPAVCSCRSVVAIPGPGMAALALTPARQRRRAAAALGPGLTISLGMCVQWCFSLHARTWLLPPCATGTRVRRPHLLLADVACNGLLCRHSNLGDAPSASITGCEETLAPVSYLLPSRFSEMLWRSLQHHAHCTPGDATLTPCGDLLARRFSCLLPTLLRHRRTHSGERPYVLRGLVASASDTRCRFRRHERQLHGACRSRGP

SEQ ID NO: 961900 - protein, 156 aa, Homo sapiens
TFFASVHGAPRQIGGPPLSSPHPVLPPPGVGLGGWMWTNWEPARVNASPAHPCRWDEVSDSHRGVGGDTAPALSPTPDAQPRRRKATGSKYTGNWAVAAPSPNHPKSRIHHNFKGDSTKIHDPTERVHMPCAPPAAIESRPNARADCRGTPPANAP

SEQ ID NO: 961901 - protein, 74 aa, Homo sapiens
YSRIPVGSSGEDAVESIVLTTQEPEETWYIISVEGDQGDGYETDFPLLVEGDMVMVRQFEKGRNQSSEKKVHSS

SEQ ID NO: 961902 - protein, 133 aa, Homo sapiens
RGSAVEGCYTWDAVRWWGLAAIMPWELTVELWIMLLQVCTENVEVSSEGFIDHPACLHHCPSWLAADLGWHECLGFTVLSQFLQWDICIASPSANKHEMAYLGRRKELHGGYSIARENVVDAWMSKHVQGQYR

SEQ ID NO: 961903 - protein, 177 aa, Homo sapiens
GLLPCEIYSIAYPIFSSHFFTSFALNLQEPMRDFGSDEATAPRTLRVQRRRIDSSGDGEHPVQGELNLSTHYDSAGICTEFLGGPVALGVVGPIVWAPCHSVSALSSWDAPYPLAYSTLGVSAESLVVWSSALVPAGLLINYKCGQQEGIPAIRAQGSEKYMGSLERAVLGILGDYH

SEQ ID NO: 961904 - protein, 122 aa, Homo sapiens
MCRSRPVPASAPVFKAFVAIWGLHSGLLSCRVVLMCSKRGGTRDYRCGGHYLWPKSLLSVPCAAECYVGEQRSASPTRVPCKGRHVPRAVLCAWVRLYPLHPRGHVGICLPAIVVAVRMRAL

SEQ ID NO: 961905 - protein, 203 aa, Homo sapiens
QSLTGGPAAGAAGIGMPPRGPGQSLGGMGSLVCHGTATCHLSGQHAIHGILGEWAAHSHGVSSSGNSSRPSLQLQEVALQTAGEKQQAVRSTQQQAGAYSKQRSRQEQQQQFQAQTECHAAGSPSSSAACSKRGSSRQQARQQSSILNWSWHSSKSDKEEYEAGKRTQQAGGGNSHKGAAPKQQKQQQQQEQQAAAAALEDPA

SEQ ID NO: 961906 - protein, 247 aa, Homo sapiens
GTRRCRYEEAGSMAALLLLPLLLLLPAAAAEATPLAAVALASWRTCAFAGAMLCAAKWALLMLCCPVPAGCLPDPGMVPEWVAACHCLGASLELAQHALPRHTFLIHWLAAALATHEAGARDVTGASTAPSYCALVLVTVDPDGGNSGQGEALEKCEAGSCQVAVDACWPEAARTFAGRGRCRQSVGWSRPAPLVTVDATVELILPCWPEFLVGLVRGWPMPAAHCLCAIGPGRCPFVHASAIGAQR

SEQ ID NO: 961907 - protein, 118 aa, Homo sapiens
MDDDICLRSSSTTGSVHVQWPCFAGRLMPPCGLSSPPSVGAPQCTMGVMCGALGQNVIPSGATMAQSNEMASSPMKYPIDALASVTEHGTDMDENLAPAPSTMSLLCGSLRSTPLLLT

SEQ ID NO: 961908 - protein, 259 aa, Homo sapiens
NCARCADCGRGAPMALWLHACGCLVFFVVGWRVVCCAVQRRSSSVPLVAVVEYDRDLLGSCGRHSMKATYTSCLAGYYYLTIDPALGAGVPGMCCCSCSDKLSIEDFTGIMAVVFGNKQDSAFFYPRRMPWTLAPSYTGCFLAVDLVCSHAPLDHLYLQEKLRGQPLALWTLATLRELECSSASLPALVLIRLPYKATLMVLNGTQGKFLTMATNRVGAVTLEQLKSEEFPETGGLQRGYALPVVRLNIPVVGEGYSTR

SEQ ID NO: 961909 - protein, 223 aa, Homo sapiens
MVDFFLGDNLYYMDSLLLIITRGWYGKCVYYAGEKVSRNSRRGETQGSCRSVPSSCVAGGIPRWALVAGEFLQCFVPRAPCVRITFLVVSGDIAIEHPCAKGESRSQINVGNTGVLPERIALRGVIRVTPLPRGHRRGAWRASRSGLTRRPPLWGAACQTSTQLAHRRGPSPRAYPPREARQSFWEKPQIFNSFSFAGCSQSVRHLSFKNNLGKNSPGPKAVE

SEQ ID NO: 961910 - protein, 56 aa, Homo sapiens
EEVSRCWRSFKAELNEFLSLVEAWTEDGYSDEFEVRVTSNQDSKSLSYAHQNTECS

SEQ ID NO: 961911 - protein, 32 aa, Homo sapiens
MGLVHRDLKGETLCLGRRCPYRVTGRARPPYG

SEQ ID NO: 961912 - protein, 122 aa, Homo sapiens
TTVCWRPAGGAVARRAVHRAALAFRLPQANVSAVGSWGRHGRRWKTERKTLLPWPSHLRESQAPVRGGRTEDVLPRGSGPRWASCCQSGTGVGAGYVAPICQGPGLMELPVILRIVPMRDRA

SEQ ID NO: 961913 - protein, 242 aa, Homo sapiens
VSGLQVPTLSPSLMMIATSIASVRSVDCCASEQKAVHQKWFAPLKKNFNIHGTNKHWLIRQCQDSDDYTSSHTSSIDDAYYGTNVWQTLLSVDDLVEKLVKRLEFLVELNNTYIFYTSDNGYHTGQFSLPIDKRQLYEFDIQSSTVGSRTWDQPNQTSKMLVANIDLGPTILAFLATTKLDTDCGMSLFALLRGGRTCLGIRVLGGGTPGKAGEVSCTSVAPVVGGSSVPQVCVGSYTPLPL

SEQ ID NO: 961914 - protein, 88 aa, Homo sapiens
VEEDQTENPLILIDEVDKIGRGYQVDPSSALLELLDPSRMPSFPCGPNLNLGPVPPLALFPQGACFTILATVRTSTCVPTPSPPRKPP

SEQ ID NO: 961915 - protein, 94 aa, Homo sapiens
AEVPPPPWSATGNPPASAALAGVACVGPRAPEARLGRHRAAGHGVPVRAAPGGYADVAPEVGPGSVAVWVPCGKGGKPFSARIRSHNPVKEPRT

SEQ ID NO: 961916 - protein, 198 aa, Homo sapiens
MSGIVHLQAGQCGYQIGAEVWGGDQQMSTASDPTGDLPRWTSGPARLERINVYYNEATGGKYVPRRRARGSGARATDGLRALGALRADLPGRDNYRFSVRVSAGNYWAKGHYTEGAEGGGHRCQECCEKWRLMSCDVPCRGFQLTHIRWVGGLGLEMGYPPHQSRSGRSTPERIMNTFRVVPSPGVSDTGVEPYKASL

SEQ ID NO: 961917 - protein, 137 aa, Homo sapiens
SCALQLSVELRGARGTLARPGRREGARAAAWGAVRRGFGSPGTGPGLRAGEAPQVLCYCPPGAVGGVAAIWGPGQSPLIIEGAWRSGNGWQHLTRPTHVPWGGHGPPSAEPRGLRRASHLRSALRLLRPQEVRPPSG

SEQ ID NO: 961918 - protein, 193 aa, Homo sapiens
VVTALVFGANGGWLALCKTPELPTCRVLAVAGSREMVPRLLLRALAPWAPAVGPGEPPCQAPFMLPRSLWPRSDVPCMRKYRCPLDALAMDCLPQACSIPNFEDTHLGEYLMCTEALIFEVIGPGSGATTNQFPQTEFVHKTRDWEIHELALEQDLVCSWTTAGIRHYQGILFLENPWPMSMYLFCLGDSVGS

SEQ ID NO: 961919 - protein, 149 aa, Homo sapiens
KEESPEPCVLERRAEPMLRGSRSVVPPPPRASVVPGRWAGLASCGVLAPLVMCVRGARGVRPARGSGNPGEAEGGACSCVGPDRATDEADFPVRVFPPSLPSRPVCRPLFSFPFHLAFPGFLRARYAAIAFHKPAACLSLQGTFIGRVG

SEQ ID NO: 961920 - protein, 206 aa, Homo sapiens
AGSRSHRRQPVRPTARTRRRLPYPAAGQVRATVARTVYRCGYRAMATKNDKEASRAAYNLVRDDGSADILGSTIEHIARSTIVPGEQGAEYQHSYQQCTDRRTGCMPYRPLTPTGNAMSQGGSNVGPQYTCIRLKPVRRVCKRAKTGDGHKTPGDRQVVHELRIRQCVTQCIGTGAGQEDSSQSELNTAGGTPINDSSDRRNAQAP

SEQ ID NO: 961921 - protein, 224 aa, Homo sapiens
NHSSEFTVTRNYLDWLTSIPWGTVQQLRTLTCARAQAVLEEDHYGLEDVWKRILAVRLRVMPDSAAPPRATILCFYGPPGWVQTSIARSIARALEPRATFRFSVGGGMTDVAEYHRGLQADRTWAPCPGRSLQCLKKTKTENPLDPSSSEVVQDRPRLPGGPVRRRLLELLGPRAGMPTSWTCYLDVPRGTCPRCCSSARPTSGHHPRALRDRMAMINVSGVVA

SEQ ID NO: 961922 - protein, 220 aa, Homo sapiens
MLFPSVSVPLGPVCGTLWRPCGSSHGCGPRARLGGHPRCASLAPCAGALCLCARAELALLPRAQNPREKGFLLRGGDAIEVPPFVQQELLGKNTRQKRRNDNCSLLSRQQRPPEGGGGAQWGATRKKGRPEKPWRVYRDPTRNKHTARGKKTPATEKGQESKRPFFSTRGDKPHLLVGRQLSDHHATHQGGNTQHIRKKTTETYTSGASEHINKITSIIA

SEQ ID NO: 961923 - protein, 113 aa, Homo sapiens
MLPRLVLERLGSRDPLRAVELTGVTSPRLAYAFLLAVSSLQNSFFTVLLLFLFFFGLHNENEIVLKLSSSEWKFGICYSSLITQVNYYGSTLAGQFEIRRMIAQHLNRLEGSV

SEQ ID NO: 961924 - protein, 111 aa, Homo sapiens
MRYVASYLLVCPGGNFSFPQRQGLQEDSLDSVGSRGGRRPASTGLLSELNVEKPLKTLFRPGYGQALPVFPAVGGGLIPALSCLPQGFLKAPVLAWFSRPCACTQMEERKD

SEQ ID NO: 961925 - protein, 159 aa, Homo sapiens
RKYRLLPSDAPQVTLHRSSRRRPCLGQAIKRACRRRWCSGPPEKKLSREEQDHHDSYEPIRLGGISSTAGDGPGRYYSFHEQVNWLERLDNGSACEDELLRTNGEVGEAAVPLDDATLLIVNRYWAQLDDNLWNALSPTAMRCHGGCLSSAAMGHLVTQ

SEQ ID NO: 961926 - protein, 291 aa, Homo sapiens
MSLRPDSAPRVSTCRSPFLSGGQSEEEASINLNVAFNNVPPVEPLGPVPFVLRPDARVSRHVTLNAHESAGTAQGGTVYRCCRSEDVVVNLEGPWYREKVREWSSQWALVSGARDRFTFGGDKTLPFSTSHAASSPWRYRALERGPFGRSFNTEKVPPSGMAGSRRRGGALALSRMAGRSRNPFSGSYLDSQTGPFRFKGAVSRGCVAPPRRVLGPSAARCEASHGGAPWCADMRHTSFAINRRRPDSPVGGAFHRAMVRLSLRHRFSFSLCVPIGALSGVACSSVLVGVA

SEQ ID NO: 961927 - protein, 127 aa, Homo sapiens
VDQDSEFAEGSLAMRNCAAGMLETGSSKHEDGGLEIHRAWWCMKEEQSLEARLVRFWLQSCVAKSEFDSIQACENDQSRDHLRYYCACSWALQQKELLINGIPSLGWIISFIWNRIAISRSMKADAY

SEQ ID NO: 961928 - protein, 183 aa, Homo sapiens
MTRGGSLGPPPLQGVYWATVRRGNPGWGGTECGRDSPAVRVSLPSGGSCAGGGGLQWVYTPGDGHVGHGGPPPLCAVAKFVVIPGNELDKVGSVEGNGQPQRQRWEEGVVRCRSQEETTGGSGVAQDALEGALRAGFTTFWMSSYWAGFLKEVRSTIDTWACGDTGMARPGSSPVSSGMTLAH

SEQ ID NO: 961929 - protein, 146 aa, Homo sapiens
TLLGTTAGGWERVMERKAKLRSQKVEEGWLVPLDLTAELLQSRGLWPLPRGVTLSACWGVRGVAPPVEVTAWLWGPVRELVLLRAPLSEPAPWDQRVSTSRRSPMRWAGPGWSPPPSFQWVTVPLTSDGFVGHSLGTGALNFHNRQ

SEQ ID NO: 961930 - protein, 202 aa, Homo sapiens
MRSAQILASGPCRDACASTVDPSHRCALTEETNGVDECWPRCGVPDQFGVRVKANLRLASEALRPHREEVEQPPSDHLASMNYTEKFGAGTTRLECVLRSGLPAVWEQSATPLVFQDVCPMMDILAACDLSVSADIIGTLMPLAFHLRHARPFDWHLVGFWPTPISLGPGLGRDTILMPDEPWTSPGLTGWNNFSWWRADLA

SEQ ID NO: 961931 - protein, 254 aa, Homo sapiens
MSNVCVRCLPPRRVPKRPQHGHGQGLRERPPLRARGHGNMELFLPCPLTSAGAHVSPVHVLVVVLHCCCAPTLPSTAVRPPALSLPPVPGKFLAGRMLVACGPERICCGSGLRVAPCVRVLLVPAEGSWSFGERMPMARARRWRPLEWGPWTETLGAGSTGNRGARQAYNAPGDKSPDAAQESSRDAQGQNQVMVPVAPPKSTPGKDRAGMHTELRSEFTREPRLGGRVLTPKRGLVAHLKMQEQKKDWKRLPG

SEQ ID NO: 961932 - protein, 282 aa, Homo sapiens
IIDGPRAAQIFANTVDNARIVRRALDNARLAVLDDFRVKYETESGLAPVCVRIDYAMVLRKGQLMISRISHRTVRLDDQTILGLSRGSCSALNEVNLAKRKLTHVSYGPRLPARGVDRCEARCPQISGPRPRIHGKHPWPKYDAWLCSDMNQKELDLELLVSCRVEETHHQLVCHHGPAECCDAAEDALPLSELESVQSSSLRDQILDSDENDLEGQPWADSALRTVGVRVIAYMMGAWQPGPAEPESKVGRPREGAGGPRLGPQVGPGGAPPPGGGGLRAA

SEQ ID NO: 961933 - protein, 175 aa, Homo sapiens
QTAAPGPEEKARHPEGSLPKPLGTAEDWGDQQETPQAREELFGCLPCLTCPRQAGGPPAAFKWEAEEEAGGGWHHGPGRVPLHARGMTDTAAMDSPVPSLQPPKSGSPSSYQGLRFQEALWGRPLRPWPVATDGEWEEFTLPLFPLASPLPYTLVPSEVAKVKGPRPGAVGDPPE

SEQ ID NO: 961934 - protein, 215 aa, Homo sapiens
WLPGLKWKRFGGRGPDLGRGVRPQESLTGISGHTPDSFSGIRAFVNFTGGPIHGGPRNPMCGDRDLTDPSGVKFSRAEVVMCRQKNVCGISQSGASLVDYRFRGNTFFFRHYMWPMSHNTTGYQVVWGVPLRGGRIIARVNFFPRIIVKGQRFLSSAEKVGVNCGVKRRLLVGELCAPPSVCCLPKKALFHLPSEVLAPEGAPCYTRRGAPCGSY

SEQ ID NO: 961935 - protein, 240 aa, Homo sapiens
CEGRSGGAQMEGGRHWGHPRPPVQHHELSRTPGGEELWGPGGLQRLLSCFLGQDYWVGAGIPEKTSWGSLNSNPHSHPPAGAWLPTRQEPGALEVVHPLDGGSFPQPLGPWRAWWENRAWLVGPTNRPKTRETLHSPHGTVLILALPWPFVRDLAWVTREATRWLGRPGRSFLPLLEGPGCHFGVAPVVCRCACNQRLGTRALFDVLYSLCEASLCVVQPFVLPGGAIAVDHLHSPSSYQ

SEQ ID NO: 961936 - protein, 167 aa, Homo sapiens
MSKNLESLYFSNNKLESLPVAVFSLQKLRCLDVSYNNISMIPIEIGLLQNLQHLRITGNKVDIAAKTSCLNAIKLRTLNLGQKLHHLTPRDTVGQLSQLTQLELRGERALEAGCQLQLGQVSGVRHCNKRALSWNDHHYSIPLPSSNVKSRHVNQDINIPFCKWDLN

SEQ ID NO: 961937 - protein, 154 aa, Homo sapiens
MLVNWMSVHPYDRRQPELYVKCREMLRSGEVETGFFCGCDDLVQSSVLEGELRRPQREITDRKLASQASRVGSNSYTFACVPGGRWLAVTISRGKFPSVARFCSVPEAPTEHAGWRGLYETTPLMNPWRAPAGFFNKWSSIGDPFRELALHTTL

SEQ ID NO: 961938 - protein, 120 aa, Homo sapiens
MERIMNSPRHFGTTPPVGYVSGRRCDLVDQTLTDPICGDCVRQNELRSDENDEGMLRTVVVLLFETALLSSGFSLEDPQIHSKAVIYRMIKRGLGDEDASGSRGTQVLQFLYEIPASRGR

SEQ ID NO: 961939 - protein, 230 aa, Homo sapiens
GAGAAPRRHPSICLPAGWPRWSLARFLRRPSPPLPATRSAHRRPSAELRASQPSTLPPCSLVEGTMSESSSMSSQPLASKLGQGTALSNAWAGGMAWASEPPKEPSEVPTSYYTSGPTKGEATNIGCCQYPENHHNSRKETQRVQYPKKLGRKEAKRRASRRSPSEEEPVTLVVPICSLTWREQPSILGTEDSFSSGPKRPQDPECKSQQSTFRINANTHEMAGFNVKTR

SEQ ID NO: 961940 - protein, 47 aa, Homo sapiens
MGKVKVGVNGFGRIGRLVTRAAFNLLVKWIIVGPPNPPLENPPFFQI

SEQ ID NO: 961941 - protein, 92 aa, Homo sapiens
FSAACNPRGCFLGKVVSPAELSPVPPTRAVPCARGSSRCRLDLLVSRSARPFSLDELASFLFSAYGILLRAFSPSVSQRNPKDNEIAPIRRR

SEQ ID NO: 961942 - protein, 72 aa, Homo sapiens
GCVHLCGKCVAAVFAGAWSLHGFQCCRYGMPGPLARVRSRVEGVTRHCHVFIALWHYLALVLRPSGLHVRNT

SEQ ID NO: 961943 - protein, 241 aa, Homo sapiens
RLRGTSAIAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIMQQQTAAAANSTAAAPTTATAAAAAAAAAASEALQAQPPIQQPPDAAATASGPPRFCPKASCSMMHHTTAPPAATTAPAASSLLRTNHTQLPPQSQTQPLVSRGASLLDNCCIHEHIVFCRPLWWSSPPLSPGSQQKR

SEQ ID NO: 961944 - protein, 162 aa, Homo sapiens
MAGPCPKTFILRMAVPHGKRTMEELDLRDIDDDVPSSALSCTRHTLIHAGEVFHMRTRPGRRCDCSLDAPMAKHVVVLLMFHCVGSHGLLSVTHRRVLETMLERDPKTMPLHHMMTMAHRPLDLSTVAPCTTESPLAEGGDDEDDTSMCLRVLGSRRDMKNH

SEQ ID NO: 961945 - protein, 54 aa, Homo sapiens
MPQELSRLTDPNYLCLLDCPFQTGQYDESHVITALRGEEEKVVHISSPGVCGPG

SEQ ID NO: 961946 - protein, 277 aa, Homo sapiens
ETLKPPKNCFIIQVSLESRVGYIGRIPGSERGHQGLQTFEVTRGDEGGHVYQRGPWSYWDRGIVYEISFWERLIHIFLGNEATQGLGEDRDWTGYELNFLGAHGDHRPFIHEDHGFVLPRSKFALLCRKNAKICASKHAFDPWYAVRRASINSSYGGPDRVVHLLWMAEPMVTGRFVRVVAPTSVVAAVSHLRRREEDLCQDVQLAPLWTRAVWSRSLVGTEDDLNAREEFISLGTPESRNLVGALHPSGLFYSPLRGQGPPGKHLLTPWGCHLFEQ

SEQ ID NO: 961947 - protein, 59 aa, Homo sapiens
MREKEEQRGLRKYNYSLAFAGGFAPLPDGCLLQGTFYARERLGAVYGFVREGPCRSGLG

SEQ ID NO: 961948 - protein, 290 aa, Homo sapiens
GTRPPPPGERHVCGPSPPFPSLHSHPPAPGDPRTPNPDGRNGLPVLTDFVCLPRPPPLCAAAPGRPVPRATRPTVGPQPHDPGIMHRTTRIKITELNPHLMCALLARGTSSRPPLSCSAALPSAKPALVRLPVRSNKYCPCVTCRSIKPGLQLEQSGLTKHVQDIVYKIVPELLTDSDETVEGLPMQTYPTERRFPKGFNWSAPEGRFMRASRKGALSDECRLLSHLPFEIPTKVSRNRDNYEAAPVSTCDLRTQGQHGGTDLSRSHNRVSALTLPDSPEVFSHIKVVRD

SEQ ID NO: 961949 - protein, 282 aa, Homo sapiens
RRKLRLGTRLGFKFGRAGCCGPPRDPDPAPCPAPASPDGATAGSDAGLCGCSWLCAPCSVAWKVLAGAPPSDPVAAQMCWLNNERGLPWNVGSIHALPSSAVRVLPPPVPLAVHASVCVHPSDGYDGRSTSLDREATPILIYAPWKGDATVPLERQLCVGAEMLSLNLRRARIPSPKLPPAWARSCPMAKVHASPIDRPNFRLPPRRRAGLKKLPVCRKHQGAQSQFASHQGLRGLVNPCLPPVWRALPPCGSEGMPVPRDFVRAECARFVGTCTSLEGVVP

SEQ ID NO: 961950 - protein, 161 aa, Homo sapiens
ELSNRCETGFYFRHGPWVWLSKASGAVILKLTKGKFPFHFVGVVACAGGCLNGRGKPRLQTDMRIRPCLRKMEGIYADIPCAASGVQLHTCSELYQEWLEGINSPKAREVLHTTYQSQELWHTTAWTSSGEVRARAFQLALGGHEPNEPLSRGRGLPELEY

SEQ ID NO: 961951 - protein, 133 aa, Homo sapiens
MHDQLVWLARGRVVFAVLVFCIMPIHRNTNVPAPPCRRVLSELTQQLRRHRQPPQYIACRVPDQLMAFGGSSELRAPEPADRKIGGAQNRSYSKLLCVPAWPERLRISPDSVYHQTIRHEARPIVGWKNSTFG

SEQ ID NO: 961952 - protein, 72 aa, Homo sapiens
YRRSRTQPSERRCPSPLASAPGRSNSLRRETQDQALQQQADEAEDRAQGFSEELNGSASGARNAEGDVSALY

SEQ ID NO: 961953 - protein, 195 aa, Homo sapiens
MSVGSCSTDRETGCVSIHSVHSNVIIRRLLDDKASVRSVSNDAWMTWPAVPVGLSLAWARGLSTDFESRGRILACGALAHWLIGQRSSRSPSINGGGSELSYNSISLRDGNGGRPTRAPFVSHLRVPVMFSLGFGGHGLSVLSWARRGMELAWSGVLPEVQPTLAELEVLEKCRVPLRHGRTFGPSYQRCRLEEN

SEQ ID NO: 961954 - protein, 83 aa, Homo sapiens
RTEPDVNQDEAFPPPRLRSTATMAYEWACSACGSIGLCMRRAASTRLCMWNPQRLKPWLLLTGIQQQRCCNLTNDTFELSTFL

SEQ ID NO: 961955 - protein, 227 aa, Homo sapiens
MRRVPVFISGTGLEDERLSYCGRGRTTTPRGYPCTRAIRPGAPDESMRGRARGVVFPRTPGGLPRPVLCTSSPTKGETEAPRGVGRAGWTSGPAAGAVVRPLCRGGPLGLRVVLGTRDWRCDAAPLRPFAGLSRTSMQTVKPPKGRHSLSAGRLSAPLERNGLGNGCARGLCNSGLKGGKETSQSYYFPRPRSPTPDFGNAPKLLIREPYKVSVIVPRSWNRGLIFS

SEQ ID NO: 961956 - protein, 208 aa, Homo sapiens
MARYEAGLRKSGLRLRTQRNPFPASTGQCQRPGPFTGSSVPTLHRFFLSPGVGWADQGGGRATVRHIPLSLRPRVGRPKPVTDAAVACSPTLSAVCQTTSSSICEARERTGRSFCRIIALAPVRCFTRPCVGPQPARVVRSVRRTLGGQSTEPGGASGPRGDPFGQTPSGHPLPVRGKLVGEGAGQSSEVTARTIPPRRVLTRAQKNH

SEQ ID NO: 961957 - protein, 102 aa, Homo sapiens
NSAAGGPSMIIEGRWRTSYEEIGLEGGHRWLISITAHFFHLVEPEQCTDMSTLKVHYPRENAGTQQRSDREHQKWGRRRRGSLSETGFALGIRSEFPIIGKR

SEQ ID NO: 961958 - protein, 214 aa, Homo sapiens
MCLGAWLGVESAEGSLVLLWRGHRISFTMASSPAPASREAPDSSSPPALAESSRRTDALTSYALAVTFPPFDDESEGLLGTAGAPGGRSRYGEVARLAAWHGERDYRAIPELDALMMARGTGSGLHEDVRVSVMASSEGRLARRWVHCRVSVTREAAPGPLGLQCCPCDSVILTTRLHARTEGSAPDPAIRLSRCCRACRRDWRGAGPIESESE

SEQ ID NO: 961959 - protein, 217 aa, Homo sapiens
MPGPVPRWPRGECTALLLPCRRPWERSWCCLLLVPRLARCTDLMTCHWAGPLACWGPLSDAGWHLRVWLLGPGPRRLDAQCPVKRLRTLAALCLPAMVMSHGHLHCSSRASPCFWLIWGLIVLLLLASCSFLAAACLKRRQEERLREHNLARPRTWSPSNSRGSLGREPPRALTAAEHQHTVTRLEGRLMRTRNQPDHSLLTAAKTLVARPETGQGS

SEQ ID NO: 961960 - protein, 118 aa, Homo sapiens
MARSRLVVNRPRLAAMKQRRVPTSSRAAAPGLPDRAASWPAAPPAPPGLIRARLRTSGSEAHTQATTAPGTRTGQAHRHKKETCRAVQVEQGYPEHSYHIDDTQEHSRRQCTHTSKSK

SEQ ID NO: 961961 - protein, 62 aa, Homo sapiens
MLMMNLESTAVIFEDVGRPCWHSLQKACGRAVDAHTRREAEEDVKRVASKMVRGKPGVGGLG

SEQ ID NO: 961962 - protein, 137 aa, Homo sapiens
VYPLIIDSPPDPRLRSAVTHFGVTAWGLPDPPDHASVTIPSHALLSQKRLKPALFNEVRADESPLTNCKHLSGVPSSCYLHANGASIVLYLPLRYTLGRGLYSSESVLLYSRKPETVGLILRAYRLSQAAFIGYVLP

SEQ ID NO: 961963 - protein, 116 aa, Homo sapiens
FFFPGVQNVKARTWGALVVQNPGFPVGLPVGAVINGADNTGPKNRVYHSSVEGDLKGRLEQTSPACVVWVTVVSGHSSKKATPEPQKKGTLQQVAHLDNERVSSPLEKEVACVSPL

SEQ ID NO: 961964 - protein, 112 aa, Homo sapiens
MSPVFHLPQAPLCGDFAQDVRGWPPSERRPAKFSRRHPRLWPVHPLRENISHLPPDLLTQVSPTTRHSTAWRPGVWAPVLLCLPPPEFTSGEGPWGPVKATPLCTPQWGAAG

SEQ ID NO: 961965 - protein, 283 aa, Homo sapiens
CKRKDGRDTLPHFMPAFCPSSSRTSAPALGPKGSFASHTPIPGTQIWGLNSSCPMISGGPSFSFGRVPGVPSHAHFQSGSRYVMVEYETLGGLAQRGCQTCTVLRGLPRGLGAVQYSSFPSGPVSSGTGSFSAKCRLRPRFEKPPFVTSMRGELQRISFMSFPSVLPERDDQPPGGGREKRLAPVPFLLSRPFVLPMSPLVAFQGHRLLPRTVHGACGGLNLSSGRSASIAVGTLVLLREGLREAVLVLSCPSSSLSDRGVINVGIFGSVCGPTDWSNALCAV

SEQ ID NO: 961966 - protein, 163 aa, Homo sapiens
MPVPRGSRCSRVQVIGRNEDSDSCGALLNRGKWSHQGGTGGPVVDEEPRSATRYKPVWKPDSAFVGKERFARCRTIRVRCKGWLGHVLSRIYAIRRVRSSIEPWWHYYQKYVDEASKKEIKDILITDDRTRLELTLVGCESNRVVEALVPALANREILPISPS

SEQ ID NO: 961967 - protein, 120 aa, Homo sapiens
CFTSAWTEPGARFPIPGQAVPYATPSCSSLFTATLGILSPMAPAAVPAPRMHTKKRCTARLSLGSAATDRRLRSTVSRVAPITLLILGPHESLLINPAKDTTLGSLLPASLRYKPCSHAL

SEQ ID NO: 961968 - protein, 117 aa, Homo sapiens
MACPLDQAIGLLVAIFHKYSRQCRVTKHTLSNDRHLKELIRCKELTDCGVWKSCRDELEDIANGLDGMTLGPGTTDQEVNFPGGMSPSLRGLASLIYEFDSPSNGARIAKILRESIV

SEQ ID NO: 961969 - protein, 65 aa, Homo sapiens
MTMRVVALVVHKALVFLDPLVIPLTLPKCVNETRARNTTLNTVSAKIIFRVHTKRNPVLIDYLIR

SEQ ID NO: 961970 - protein, 48 aa, Homo sapiens
FPDVDWSSLSQSPAPCSTSGPGSGGRRGLREEEHAVGDLALIPDVGFD

SEQ ID NO: 961971 - protein, 249 aa, Homo sapiens
PWFWPTVAGLDTSCILVWLKEPGYDVIAYLAHHWPEGRLRGTRPGKQGTVSLWAPTTGVHSEVMSMQWGSLCRPVHVHYSVAGPTHRVHSSHLVTEGFRLALLLWANPYVRVPLRAPWATPVTLRHIDMVVHILPLRAERRCGRPKFTVVPHAAGHEAEVGELPSMCVPLVYGRASKPIVVIVPTLVPPSRPRNQDGYEIGRPPSAEWAFCALHSVLSENPGISRGVPLLEWNPCNGDVTDENGQNQLG

SEQ ID NO: 961972 - protein, 192 aa, Homo sapiens
YSIALSLDPNDQKSLEGMHEDGEGGESHGVPLRRRMWTDYWNGSGEEGDLCRGSAQLRLARRWWLTSEASCVSRMRRVCGWRGSSYGLPVACPALSYFRGLTGNRRSLLSSKGRSDSSMVDMLGKGSSAPPCSIHKFLQLGRVLYLVTHDEPLTEPSYVSYPITSRCVRARVGLRECPEYPRIMSGRIWANE

SEQ ID NO: 961973 - protein, 90 aa, Homo sapiens
MEHRRSGSVGYPCTVLEYKREAMLTPPVHPRSSCRHDDSSRQERQWCKGEGLDEELVKTHAGLDARTSLTLGIYMQMKLGQAPMPGTHSG

SEQ ID NO: 961974 - protein, 186 aa, Homo sapiens
KPYRLGRAGVIGEVTRRCALYLVIGCLAREGSRSQSENLPVVRIQLLYRALDSGEQAGTSEAVLVDRTCWFGAAAELTSRRASTVPLGARAVASQGWKSRRARRDHFSIERAQQEAPAVRKLSSKGSFAELGLEPRVAARNYRRLRLKSFRPTTVQSSTIPSLLRRPPCRLAAAENGQWQDSQLPP

SEQ ID NO: 961975 - protein, 195 aa, Homo sapiens
HQLLLGRSPGCYFVTGLGVFDSRFRGASFVPIHTAAYAPGPWPLSGMACGATLKRPMEFEAALLQPLAPLKRLALRPFCPGPTPGPSGPQDAEHAAAVFRTPDHHLQKSSSEPSPCPVRRVGAFRNSESRIFQEHKTRNIGRISRGWRHFRKWYLTQSEALCFRKVKPHSFSNFTGTIATPGFPHWIDRSDRAHN

SEQ ID NO: 961976 - protein, 84 aa, Homo sapiens
METSNAKQEHHPPDTTRQRITEHRIPRNDNTGTGKNRTSQDKTEQTKRTGDHVATPEKKTADQQQIQTEKKPKAERKENKNQTK

SEQ ID NO: 961977 - protein, 169 aa, Homo sapiens
MRYYSRPWFISLPLLALRCTEVCRRFHFPAVTLLAAAASLRPPTPRAAETSAPAPVAAAPPSAAAPLGYQRAACRYLGWTGTIESGISPIFLFGLCDACLPSAPTSIHLSLEELGSNTGIQVFNHDCEGRGLMTTFVISPHGNCVGPGDASAGGGLCRTKKQLRPLVMR

SEQ ID NO: 961978 - protein, 37 aa, Homo sapiens
MTNRLLQRKQMVIDVLHPGKATVPKTEIRRKNLAPNM

SEQ ID NO: 961979 - protein, 161 aa, Homo sapiens
TLKEVYRSKMDGEATRPPSPDRRALPSSSGLLLLLPAQVVPGGSPPQRGLSPRSGTGSFSGRTEAHAGHRDKRQLALQQKGHQVMKSSGGDWRELKQKAAAEAQCQWDAHFTGQHPSQLGPSGFPPLMHPIYPRTTCLRGRERGVEGEHAYDTLSLESSDH

SEQ ID NO: 961980 - protein, 249 aa, Homo sapiens
VLTKHLAGCRAGRLPPPAPRRSLRCTPRPEQRGHRAARSQLRSDAASARRGFVARTRRELGPGRCVRPRPRLLAPTSLNNDHRQPRWEDNGQKMPGHPETLSAFCPGHRLLHSLLPDDVLWEAPILSPAAVGGEFVALSILVAHMMVGGGRPELAASVLRKMSDLLELMVKRMDALARLENSSELHRAGGDLHFPADRMPPVGRPHGADPGYFAQNVSDIAVKVDQILRHSLLLHSKVSKAGGTRVRPQ

SEQ ID NO: 961981 - protein, 76 aa, Homo sapiens
LMYEDGPGVYFITGWGVAILCLVVPQIPGLKQSSCLSLEPPCLAPEGTVLKISKKRGAVAHTCNSSTLGGRAGQIT

SEQ ID NO: 961982 - protein, 71 aa, Homo sapiens
VVRITAVDISVITVDELIGFTESCVMYVFDRPGRVTEHVGQLSTLPREVMVCEWCGRKLVNCVVGPVIVVA

SEQ ID NO: 961983 - protein, 163 aa, Homo sapiens
GEIKFGRSGWCDFGTEGESRSEPCRQGPLQSVQVFGRRRQRQLWRTERGMVSEVTAALEILSRARYQYKLLSQFCFSAKSELLCNIRVRVRVVVTCQIMYRQSISKALWPITRNMWIGFQEGDQRHLIQYDRTLLVADPRRCESKKLEAWCPRSLPEILPSPS

SEQ ID NO: 961984 - protein, 128 aa, Homo sapiens
QYASFNAVFVNCASVRSQESCVESVCLSAVVGCCTCVARKPGRSTLTCQHKCWKVTQPHMEWRCEDLLPPRCGRPCAYPFPWGNLKYNAYIHLCGVIWLGVVCQERDHVRLRQAGCRGHRTPLWMHIG

SEQ ID NO: 961985 - protein, 101 aa, Homo sapiens
WKGSLTLSPRRECSSAISATLQPPPPEVQAIPPCLGPPQVSVGFTGILCHHVPGQILWVFLDRDRVLASVGARRGSSNLRELLRVITPAFSLLQEVAWELI

SEQ ID NO: 961986 - protein, 126 aa, Homo sapiens
APAALARWASPETPGSRPASGNPSCLPGLFARALRPSRPLPVSPGPSPAASLQSFLLSPEPERPSETLAFPRPLSRRQRGAKDEVIRKRLLIDGDGAGDDRRINLLVKQFHSNVCNVLGPSATQGI

SEQ ID NO: 961987 - protein, 140 aa, Homo sapiens
MYSRPGYFVTGLVMYLVTQGPGPFNFPAKASAYMQNVYRYLWNAEKGATFLSDAEIIQLVNCYSISQPTSWKRLMDNSVSVVYRIRRQLLSKKLTEPSSLQVPSLTGIIITSLRACAQLVVQQCYWILCPSLLEWQDPFA

SEQ ID NO: 961988 - protein, 226 aa, Homo sapiens
WDPRLFKTLRDPGGGPPLSTFFPPQFVTSEMAQSVSLFLGGPPEAIGRAVRPVNAPGKAHRLAAHWPEHLEGRQTPPPGAPSAGELTWRIFTLLTASLKQTLWTVHNHYHFDSTHVDATPFQRSELNTFSCAPTSAELCVLNQRQVRPSLTLTDPHNPEQTKCVTPSSLSYTITLFAAPQCVHRVKKLAIEGTMHLNTPGQASYALQCRERIAGAQKGHPLASPVH

SEQ ID NO: 961989 - protein, 103 aa, Homo sapiens
MVRYSLDPENPTNTHANHRGSTLFVFTLKNTRETAQAIKGMHYTKRATKLSARVCHSYTKHVCTIPTVTMVELAVCAQAKQWGWTPGRWPKNDVLKLYCWHMS

SEQ ID NO: 961990 - protein, 215 aa, Homo sapiens
DWLLHIRGLCNTFSSDALKVTCLITRLTGTRPVRWVIPYIKKVEPPPLTDYRRLSGLTMNAEFLDGAGRDEDFQARAMTLGPGAARSLMREGSACVTRPPSLASPSLAPVHIPVPSSSPALTPACIIPLRSLFPSRVGACLCSQELALHGSLLPPLGLTLERAAALSFQPASPSHVHLDAVLRSSCKLGSCYTLDRPPTAAAAKPSPPHQTARRL

SEQ ID NO: 961991 - protein, 233 aa, Homo sapiens
LAAPPACRRPSYHHTPGWMPACCRSLAPVTITATIACEAETQHAARLPLPGCPALSAAEHQSPGTYVAAGRLGKRVAPVLGLHNSVRLPFPGGGNKERVHRQRKGVQGRNKVEDLPSNLLAGTRRICVFNSTASEFDHPSVKRVVFWIPPQGLCAYTPAAYYSHAGNDYPFPRVGLVTANCARRGNFGGGRDFGNGYVHSGTTGQADTERDLTLSEDAEREKKSGLTRTGFAV

SEQ ID NO: 961992 - protein, 300 aa, Homo sapiens
SRQLQRTLAEEQHKNQLLQEELEALQLQLRALEQETRDWGVHVEYVVTGRVLLHLSLTCGPSAGGGLAAAREELEALEGGQKGLPGEGRRVLLLQQRLLACPGFETRNEPGLQCTQGHRSNTRLVETCRIDPQSVRQEVPSQACKAGTTQRQDQAQGRRPRAGAADALSLSLPVDHKASPEGACRQRTPGPIGPVGVAGFHPVGGRVASPGLRVQGILWARPAGSGEVLQAEFFAPARDIALTDALAQGSAAEAQHGQQRTAAWSRGRYLRLWTRRTTRPTVCGSRGPAVREHRSGRPPG

SEQ ID NO: 961993 - protein, 196 aa, Homo sapiens
QNQLIPPDGEFELMRYRTTKDIILPFRGDYPRELLRNVETHRNLVGQRWSSNVQQYYNPYTGMGSRKDSQSARDRPIAPPETANRRWVDHGSTPCHSRRAGHGAKLPNVASPETVANPVLRNESKAAMVSASVNATLGRTPGAQRANLSRSMPRYPNRTRGTGTHSSGGRKPLPQFSSRSENRFSHCVRRHSPDRL

SEQ ID NO: 961994 - protein, 70 aa, Homo sapiens
IISDITDAGSCQPLASPGGSIDESPHGRQGHTDTVGPASHPTPDTTITPREKCLSSSLPGQFGSANPTDV

SEQ ID NO: 961995 - protein, 234 aa, Homo sapiens
GFWLALRGPGASLEVFGTATAPALYLRQRLAGAPAPKAYVLGSPALAAGAGVPVGCRHALGGWGPEANCEGGGLPGELVLHRLPVGNPERCAAGWMVGLLTPGNFQAENLKGFTSGPLAAYLLQASAPGLPFASGGATQPFGPPGAYPPLDEAWPCFHPAGDNPGDVTDSREALVVKLGRPKVSGARHSFGEAPAGIQFIEVGCPQGNYRVIHPRKTHPSLGGENPSLDNRTSS

SEQ ID NO: 961996 - protein, 103 aa, Homo sapiens
MDPAPGAGAVPVSEWTPIHDPSSSAGWEPPGHLTLQMPAPGSDPVEKHATCTDAGGLPGKAKAAPQVSACQLCHLDDFVMPMRSWSLRLGVRRTCQEQLGSLV

SEQ ID NO: 961997 - protein, 274 aa, Homo sapiens
GQVSAECAEYTLLCRRHQSPTPRQPALSPASRRESVSAWPGLAVGFCCNTPLASPFPAHAVLPLPVAPALDLPWSPRASVCPSVFGPLSLPVALNNAPMFTARISSFRYGFWTICPNARWENRWAEKCVRRLEMGRRIAWYCPACPEPPLPGAPFVSGRIDVPWGAPPGLCRALGISAAFPEHLWGQPVIRARLRPRKSVLHPPAEEIIGNSLATDARYEKIGPFPHPTPKKRLTSRVARELQNHAWTTFSPVKPRTFGKRHNKAKSPAAGERY

SEQ ID NO: 961998 - protein, 223 aa, Homo sapiens
MNAEELYNYMVPRLNYLQTALEAEAKQMICRRRREPEPPPGARGGAQVQRVLHGQQAGGLLLRSVHEEFLKRPAAAPLPHPPLHHLVAASLGDSWAPVAVPGPHLFPAARHRPTDRGLPQLMSVRVPICSSAPRAGHEACDSGRGDGDWAVAPAAPDLPNLVPSKSVASHLPENGNLAFSHSAEGRMTGIRRETYGTGTTKAVVRGEKTLSISLKLTLITIDN

SEQ ID NO: 961999 - protein, 319 aa, Homo sapiens
ASAQKQPAGKVQIVSKKSELQPYSVQDVVPRTILSMSLEVVMFRLRTKNSGHSHKVSSNVCAIYELTTQRHKPGWTDDVKIRKRSEDMNLHRTNETHGHNRMRRLHIEHKNDARSHHINNDKRTDDKKEQNHEETTETRKHSREHTPEATQEHTQTMNTGTKRKDTETQIINRAKRQNQRKDKRQTKTRQTKETKTGDTVKNETQRRSKHKEKKNRNRKKNKKGKTKHKAQKGGRETRETNEKTTKGKNRAKEQKQKTRDTEEEKQEKNRQRKITKTKKRHSKRRSKTSNTKKKKRDSRQQEQHTRKKNESKTKYKKPH

SEQ ID NO: 962000 - protein, 38 aa, Homo sapiens
QSRVDGSGGGVLARARACGVLSEWLAADGGVGSFPNAR

SEQ ID NO: 962001 - protein, 75 aa, Homo sapiens
FTRTNTGSMVVTQPGEEPSVGLDVSPKHVLSERSVLQCGLTVARMTWKFLHENEYVHGNVTAENILSGSRGTEYR

SEQ ID NO: 962002 - protein, 135 aa, Homo sapiens
RGRAPHSPRANPALRYLPTTLHIPFFSQSHPADIEGGRCKYTNNTLSGVSVKDNAVILELSDGVVAMLAASMTLPGLEGLLEGPCLHVAIEGPGPATGGQGSSSPFPGLGWLELPATAAIPLPESRGTGCGGSRL

SEQ ID NO: 962003 - protein, 204 aa, Homo sapiens
SLENPLSPFSSDINNMPLEELSNALMVGWALQWSTGYTALLHVYLSGAWHAQRLANSPSPLAVASNNQDSGLLVHRERWAQSCGRSVPLCLVGMPRSGLGWTVRSASALGHSDECRYVIALPGQGRSIIVIPVPGRNESSRPTAGCEAWFGHGRISRIRKRRSSSLRQGWPGPVVWHPRPLQAHRSALELTFPDVLSTLSELVQ

SEQ ID NO: 962004 - protein, 257 aa, Homo sapiens
CWALELLEQCCRGALPRTRCSVSAAAWRSSELLCCAAVECELMLPPQGAALLVATCDVMLLLLHACMLNGVSLDLTCVDATPCAHNLLTLLAAAVPVRPECVCSEHAEQLPSCLGERLELLCTMLGVHMQDHMLQRLPHGPATREAARQALAEGLQNSAWLRELSCWGQCLGCARSTEHRTVSPEWADSLAAVRPQGTLKDPAEAAQTARGAPREAGQCRFSRGGVLARSFRTRNELKAKVFLLKEKLGYFQRELSQ

SEQ ID NO: 962005 - protein, 232 aa, Homo sapiens
AARPPMSVSVAHSGALASAVSVSFRQSPCCPLSRMAGMDGRAVFWCGGQGCGPSGSWRGARYRGVQWLTTGQPCVLTRNRRVYGLGRTPSSCCTGSAPSSWGMCGRPGTRRFGGPRPSERCMARGLSSEEGPRTTERDQLGGRLTPVGALEQEKKRLDEAIQGSLSRDRVPCPGPHVGKACQQMKSRPGYVTQVTVLRPRGHVILCLVLLPFLVLGTVEPSGRWVCGGVGGG

SEQ ID NO: 962006 - protein, 98 aa, Homo sapiens
MHCVELAVHRLKGMGEGAWGTQSLIIRIAIAIAFRAKILSSTHYATFNGEKSCEHTNGGKKELLSALRKALGGWLGTSGSMVGSDEDGRGPGVWADHV

SEQ ID NO: 962007 - protein, 203 aa, Homo sapiens
MAPPRIGTHNGTFHCDEGLACAVLRLLPEYRGCRGLCGPGIPRIDSLPVNIVVGRGRGGATYASAGRPDDDSIIAEVISQSTMSSLVPCGSRGSTKLDAVRDSSSLYIAGHKTAWAQIAGAQMKQDSHGWAPLYDKMYENFGDGGGMLLDYDGISQWQRGSLDMHWSNMLSARVARSYSYLEPARAKTVRPGFKLCNGSLVQE

SEQ ID NO: 962008 - protein, 230 aa, Homo sapiens
SSYRSAIDYSDSAMLQSRHGSCSCGLGSFLEDARAYTEGAAGLRLRSGKDAVGEALHAPRRAVKGGLGKYDFVHHARDGWMLIHGALANTNGEWTSVNGRRREGNAVKGLMKSVACVGVPSQIIVYVWELGCCVKRGMVITSWPNLTSWAKLSCVTKRTEMTSESPRPITKCPTQRLLATSVLSFQDDLSSICASKSQCHIRFRETGSRGRTLHGGGADELVRYRARKGS

SEQ ID NO: 962009 - protein, 239 aa, Homo sapiens
RISTERTVTKRLSLPADILAVPEGYLEKLTLNSPIFDEAPQPPSSARVRPIWMIGFVEQLEHLTFIAGHNTGAEALPMPPVYKSARTLQLTDNLVALMEHPTGDIVHEGAPVHSPVPGARCPCSRDLHITPTFVNATLTYLSITGRKSLTLALLTYLARGPEAVPWMTVGTSSTCTNVKLFPVPAASGGLRLLPPAGKAATPMYPQAPRICSIQAQGQSSKLADFGLSRVTYPTGTCSM

SEQ ID NO: 962010 - protein, 106 aa, Homo sapiens
MGKVKVGVNGLWYVLERLVTRDCIYNYWYRWILVAINRPLTLTINIQWIYTCTTYRFHTIGKLPVDTRTRAAERGSIDTYNEANTTYTYLTRAARIPYHKYKLAAD

SEQ ID NO: 962011 - protein, 273 aa, Homo sapiens
PGQLERKVLLEKKVPKGLQEEMEFNGPVGLPVDQLVLPAPLGECRAGPTWVRIGRAWVRKKALRRCDYREQNGPPGPPRSFRGPVGCPCELLEVMVIPRSYGGHAGVCEGIEKVMRVPVGFPGPPWSNRSSGSARPYLVNKGDHWGCWSHGATMVLQAQRGPRGPPVELMAPHGTPRSVAFSCGGVGRIWVNLAEAVKPRVLLGGTRRVGGDPEEPMRERTGEARSALVRVDLRCAEGHPCDGGLGFPVRGASWRTWAPGGLARGKCVGDQGR

SEQ ID NO: 962012 - protein, 85 aa, Homo sapiens
GNFKTPQKLFIIQVSLESRWAYTEGFLVASAGPRPPNFWDSQRRGSATSRSGHTWMRMSWISFWEASSTYSWVIGHQGLGDGLDG

SEQ ID NO: 962013 - protein, 118 aa, Homo sapiens
MSTSLCPQFPPALSPLLALLTRVERVLSKGRQCSRSSEGRFLSSWRTPLLPGRRAQHPFFIQTLSWAQALCCAPLRERDSPSEGTSRGCCVAAWDLGVGLCMGGRWGWDQVSLVPPPV

SEQ ID NO: 962014 - protein, 110 aa, Homo sapiens
MTGEKPRTRRAPVAGPWGSWRNSSYRTQGQSHSKAQAQPGSLSGLPCLLSSPLWLPESSSVQSESCKRVAAVAQAAVQGLGMDIRGSVEPPWSPASPPRLQGGPGGPEPN

SEQ ID NO: 962015 - protein, 133 aa, Homo sapiens
MTHSKFRAVRADCREFDRGRGPCGPSCPFSDGKLPHCQGPARGRLIVGPDDGLQVTRLRRASAGAVVALQGTAGTTLNWPPSPRAPSGPRLADRAAIPQHLTRNQGTRCGTHSIVRRPLDRGPGQSQQFLYTG

SEQ ID NO: 962016 - protein, 296 aa, Homo sapiens
RSDTMGKVNGREVHGFGRIGRLDHQGCFESLVKWILLPSMTPSLYLNDTGSYMFPSYEYPDLNVQIPMGDAVITAGERVTAESFNGIDPITHLSSMPMDPTNISKLACASCVGSIEGTRSSCDVQRSAVVSPTRVGNDMLLRASDFAIVEGACPEGVARFVLRPRLGVDSPRLFQIDRCVETDCQKVIERYESLAYGIRCYANLSLPWATYLEIVAYKDSPRGPEGCSPMTRALGIREKSDLNVDQQVLIAQSTSATANGMNLFAWLAPPPREDSLGVDRPARAFALEEISLRLAS

SEQ ID NO: 962017 - protein, 95 aa, Homo sapiens
MHPTSLCPRYWGRQVAGNPTGHMSRTAQGVSSMYEPLCSTQEAKTGPDGRRGDTINTQVSGPSEHGWRVPAHIVGTEGQHPSSGVGPPVEGLVVS

SEQ ID NO: 962018 - protein, 101 aa, Homo sapiens
TERCGAACDAASASFPERLAACGAEAAVYRQVRAVPPRPRVAALSNGLSVRVGSSEALSELLRLRAATVRRLEWMAVLRDLLEAFSEPCLAANVLHEAHSP

SEQ ID NO: 962019 - protein, 276 aa, Homo sapiens
VQRGGRGPWWPWDGEPAVASAEVFGSGILGPGSRELMDGGRGPEAAEARREATAEDNGVDSTVTKLGAQLGQRHMNASSHHRRHILSVLPPLALHLQGSSARAPLTPSLSMRARLVLPGPAPAHRARALLPQVCPLHAPVPRLALLPLSSLSPGGRTVVSAPRPRPSPPRARSSPTLVAAPPSRLRCPAALLRASRPSLVPSFSGPSLRPPSFAARPVPLLTRPSTRGPAPPALPPALPPAHPPSRVSVCAARTVRAFVLVAFVVLTASSAPSLGC

SEQ ID NO: 962020 - protein, 105 aa, Homo sapiens
PAPPAPALPPALRTAAALRVYAPDPPPADPCCCSAASSQSAHLARDVSAEQAADRRTYVKINASKIPGQTIHTNRTIKGPILYRTLKPREMQTQGQNTEKTNKRK

SEQ ID NO: 962021 - protein, 151 aa, Homo sapiens
SAETKRRRVSNPPTGRSPTEEDPPGPSPDRQARVDAGSVACGVTVYCQPGSWADRTVPRRVHVPRKMAPRPLELGSGPRRCQPAIGLTEEAPHALGARRSVFSARVCEPTMLWVAMHVPRSCCTQNAGRCMSQLPLWPFQPPFMSSYFKLH

SEQ ID NO: 962022 - protein, 259 aa, Homo sapiens
LPAHSMMLHQLAPTFSTNYRSLGSVQSAQLRRPAGQPRAGQPLYVKSCWGVSAFPGISAARRSTELTEDGDVGPGAPLAHPEISPRVLWPCASGTRIQNLQKGEHNSTHALEKRPRPWALLIPRDHACDVTSQEDQRHRVGLGETTHSGKHLAQEWDPRSETGRHYFKIIRGTLRASKSSANTGGTMPASFCGLDNCPSCMLITKTSEYDNRSCACPRSCARTESMGLPKRALWLPHYSTDCSFGQRSGPQGERALKGP

SEQ ID NO: 962023 - protein, 77 aa, Homo sapiens
MQVLSPLAPYRNLLPHSRKYPFQHEKWTIHHVGPLARSELQDESKDSAVEGFPSFSPSALVCLSGRHEHYPIRLTCS

SEQ ID NO: 962024 - protein, 78 aa, Homo sapiens
IQEPKTLPVAQCASPHYRKPLSTSPKAVANIADPCALSQMGAGPQALGDTAWGRVGVGFLPVSALTVQMTGQKQLSLQ

SEQ ID NO: 962025 - protein, 173 aa, Homo sapiens
MWCSRTSDGPGFVLALRVPSLGDGEAPFGGPLGECVLARRVDPISIVRSEFSCGRLLQGDRCWTLVCPCSSFCSRSGQDVSSGICVASNSRCIADGYLPLVCVAKLTSSGMLSHFDESGVFVVAHSSPRACVLSPIIVSLLAGTIAGQGFGTWLAAAADLSFMGPAGYLEPGA

SEQ ID NO: 962026 - protein, 201 aa, Homo sapiens
MYVAIQAVLSLYAFWTHNLASCMDIWSMVSTHYCPSSYEGYAVPQCQSLRSGSGMVRRISLDYLMKILTETWHISILSYCLSVRIVRDIREKLCNVLLDFDSEMASCRILILPLRRVTELPDGLVIAMEGERFRCPEYPASRQSFIGDGVCWRSSETTYNSIMKCDIDLRKDLYANNVLSGGTLMYPGIADECEEITGLHQ

SEQ ID NO: 962027 - protein, 176 aa, Homo sapiens
ALQSNHFELMPAALSATQGLVLCEWQWPLERADYVALAIVDGHLQLSYNLVLPARGACVPPVPVNTNLLVAWSVAHMWMHDGKVPCRWAMMCPCDLAPPRWAATQSGHCWSPVAWGACLELALWAQHLANGLRHRAFVGCLRGRGGWGGHPLHLLEDAVSKPRACGPAQPHELGNQ

SEQ ID NO: 962028 - protein, 113 aa, Homo sapiens
NDPLLPNYLNGFECFVCDYELARLDAEKAHAASPGDSPVFEPHIAQPSHMDCPVPTPGLAMWKRFLRMTEKNKREDRPSGWVQWLMPVIPALWEAKVGGSLEPRDSRPAWVTW

SEQ ID NO: 962029 - protein, 268 aa, Homo sapiens
VHVPGAGEPGNDAESRVRIHGVSQLRRRRGFWPTRRDWRAAARVSSDGCASCERCSARSLGPVSSVPFSAPHGCTRKTVLAGGFRDGYTVPSGGLRGPGHSWNIGDFPRFRVVTRKPKERKAAKELRLHSLLEAMCGGKTHTMHQVIMDLALDGAYATFIVPITGDELLSCDPDCPVVAAASLICVLRLGLQYVGLTARLREPLPHSVTAAGRLVRAALLTRRRGGCGLLPGPLRSPTRSGAPPFEPSSLFSRAARRTFVSPGPPCKS

SEQ ID NO: 962030 - protein, 170 aa, Homo sapiens
WTSRLSVKWTNQQDMGGAREENKSRLPDNAVATRSGPLPHCGNFVLSLFAINLATAHSLGPHCLYEFVTLTAKVCSFTPEAIETTNPLGGTNNSRGSALRAVTLTAKACSFTPDPGDHKPTEKEETPNTSEHQKEQTPDTPPLRTITLTSRVRGFILAVSETKNPPIPDT

SEQ ID NO: 962031 - protein, 104 aa, Homo sapiens
MGGMGGIGATTSMNWHQLGLRRHRRTSKQILLTNRKWHERILQAPPRDDGELWRELRSTLFQNAHYSSRWRLVCVPPFFGELESRLEGGDAGLCGGGGLPAGGP

SEQ ID NO: 962032 - protein, 235 aa, Homo sapiens
RCSGFPSIDLEGNCHKCPEPLNVLQMKERVMSLSSLSVRNPTLGVACKYCRRSQSGDKYYLVRHGNSDRAILLVHRSRQGVSRGRTRSAWQLVQLLALKTLLTRSSVISSRQVRAPVRRVMLEGLLLPRGSHLQIVCARFTPGTFIVTMIHGTPSGEPRSWLWLAGPPSGLTSTVLSLEASLMFTYLPLRCVTQIAPLRYVDLAIPCTTGELTQWVYMWVDAGLREVLRPAVGPF

SEQ ID NO: 962033 - protein, 150 aa, Homo sapiens
MFTSPMPLELGAELENPGVLMGGCYTPARHAPPAQTVAVSSSPFRHRGTRTCGYWLHISTPPSYEAGKTGCSYRRHYVINASMVRTPFNAVAKSMLTVWASIGGSVKERCQPTDMHSSYSEMWPWIPSGMTADSIARVRRDTERRTAFCT

SEQ ID NO: 962034 - protein, 74 aa, Homo sapiens
LRLRGAGVGWAAALETGGCRGDRSGPSLLRSPAPGLPHRDAPGTWGELQPVTRREGGAAPKMSQTAMSETYDYG

SEQ ID NO: 962035 - protein, 244 aa, Homo sapiens
SCDCLQGFQLTQLTVAGAHGSGMWHSPYQHSIREEYPVVGTHAIPSGGGAFIPTEVVLAHRWVRVPDYECPSALFRCPSRLGEQTYCNGGPVTLAICTKRSAPSYRYFMALRRYVMQSLTHDPSAYRGMLETQPFVLQGQPSRSWLSTNRLPSPCFPLCPSVHTALEPSRRELLGEYETDWVPPVSPRLGCSQAISIYKCPVGRFVSPLCSTQGAPGESAHASLFAGPRVTRCPGETSLPGTGA

SEQ ID NO: 962036 - protein, 67 aa, Homo sapiens
SKSKGHYEVTGSDDETGKLQESGVYLALRSPRHDLLVLSNDSGNKVGITATRGGDDQLTTKKEEQDI

SEQ ID NO: 962037 - protein, 190 aa, Homo sapiens
MAAFYDSAVQDALSSSVASMLRMYCLEQVSADIVTVGRFLMSLVNHSYLTNSSLMSFATYAQQLRHSYDPFDGDPYLAKTSHTVTRLALDMIEHLETPVEWSPNAVHLAGLGINPQDSEVKAKWVYAGGLLESLLTHQSVRVVTATLNRSLPCGKLNHETEIQKRECSKVTRNGQQADSLLGSLRLGVSG

SEQ ID NO: 962038 - protein, 172 aa, Homo sapiens
MSSDALCWYQNKADVAMKPRASFILFLSKPFSHTFQKHGCPVSEMCMTLSGQMYVHSDLYVQAYYSGMPSSKRALSRGSIESRGVSSQLLFSSDCTRRAVSVVFRGGLSLPSSWELIAGRVYNLSQSFRGVRCGIPMKRLFLQELGPCSLQHGGYGPGHPFRGPSWSPVGPL

SEQ ID NO: 962039 - protein, 63 aa, Homo sapiens
MAGVKDHVAVRALGWASSLRYRGTPSLRSELEALLAGGCPFLCNLGFGAFNFSLQIGGPACFR

SEQ ID NO: 962040 - protein, 251 aa, Homo sapiens
PSTSEATITMRMRKGNYLDDIMKLLEQSELAANKRGLERGTVCQMERVESRPSRHAAYGRSVLDVVHGREPGRLDEAPGWGVLGAGARTVLITQESLERETVEIGHSLALAHMAFALHRSPCFARCRSPFTTSQGPECSRCVERCLGDAVAPCVALAYHFAHLYARIRQVDRLVAESQLVGWASKYGLVDGWIGRGELSWVGHRAFDSQPLEGVLEPPQTVRDEVWGALAGGRSSFTLGGLQLGHFFPGGA

SEQ ID NO: 962041 - protein, 89 aa, Homo sapiens
QKKNLRVSGTKAGVCEIQSHGGDDDDDDDDDDDDDDDDDDDDDDDDDDDDDDDDHWGSRRTHSLSSTILLLINSPPYYFLSFLPYLPTT

SEQ ID NO: 962042 - protein, 188 aa, Homo sapiens
RWRRKALHRPFGRSLVPLPQPRRRRPRGAAPRRWSCWSTAAVCRERLLTLRGSPACCPVLHSACSACLGPAAPRRANSSGDGVGGGATAPVFGLVPLFNANSASPKTIGGEITFMLLIVGSKAATEAQDCEPVAALSLLRIIAPSHQAYCVGSAREALLCENLVLEAANSGVKLHQGTITVALYVGPC

SEQ ID NO: 962043 - protein, 228 aa, Homo sapiens
IPPSSCQKGTDGDIVAQRAFQCLKQDCCYDYRENPISSVEREEGSETFHLTTGADGVYPGFQPSSCNPIMRPSKEVLIGVNFRVGPRVLLVALQSLCRFQCSLVVRGQFLQCSMAVSLVLILWDSSAHTHLVYLCGDHPLRDPGSSCEEFLMVGATPMPFIPRSCFILGLNAAVFKTSRVLSLNAAAVWIFQVPSRCGTGWVWGSLAFQTVTVSISSEKTGRLCVAGS

SEQ ID NO: 962044 - protein, 258 aa, Homo sapiens
DWSRSRLVGIGRGLGPPARAHTNGPVADQGGAAHPPWARPYPRRSAACSPGRGHPTVRASPRGPPRAAAIAPPCPRLYAGRFGTRPPSPPFPFPVPPQNQSRWRQSDPCSALNLLCPAAPQESAVTALLRAAPLGSGDALAQVAFSSPLWRPGGSRFQQGPVGRFYPCHKASYKVPKQTGSKKHSSETLRRARATKAGGSQVKPLAKHTPGVFRTGAPPLGEGSFLGEKLSLRNQGLEELKQAAELAGQRALERTRTL

SEQ ID NO: 962045 - protein, 239 aa, Homo sapiens
MLLPLLLLLPHCCWAVEGQGGPGGVSLTTSSSSSDESNAFHRCLERSRAYHSALVSPGHTSAPSCALRQGSALDCSQCDRSCRGPHIGRASYCYLTTLALTKPPVYPPPNPGPNCIGRPVTSLAMRTKQRKIFSTQTAPVHFIGADKTTHCQNKQNKKRARQAAQTTSKIPHLDAMPSMRTRERIPPQAQKTGGTSPTSPVTAQRNNTSDFEGDPGQQKSQTNAEHKPHHNTTTPATKH

SEQ ID NO: 962046 - protein, 212 aa, Homo sapiens
MILAQWKRLCFLTELHVNGRTQLLESASRLSQTAKKRRSYRFRSAEQRTKERNRRRSACRKHGWSNRADPTVATGPVGCAARSSTVWRLPPGIKSSKKISDNYAAGIVCNAGLPSLHKRASWLQATAKNVITRVIGEQQISELGMHSYLAVGHGSQKRIADVGDRRTKANASRRCTAQIAAGALKRSPSTPANLDPASTTLRLNDADMSRRP

SEQ ID NO: 962047 - protein, 231 aa, Homo sapiens
RLKEFLQQCDREDLVELALPQLAQVVTVYEFLLMKLEKDHLAKPFFPSYYITEFEELHNNGLRTHAANDYLTSSGSRVPTETLDNNTTDNGCLSSLYANSHELSYATRNAQYSPRHTLAPKHPQPEHTGMGTQTRTGSYAAEQEGNAECRTDGTWPPAAHRPQQENGPVPTIPTALSWLPNSRRPGAEAPAPCLAFCGRWVQLAVFTDEAPLLPVTDCPAACPARWAPLNG

SEQ ID NO: 962048 - protein, 254 aa, Homo sapiens
MMPVWGVVQLGDTVSCFGALGVSTPVITQFVEAIICQPRFCVDRNCAREVLRYRRAHRSTAWRSFCQPVVCTLSGNLRITIRAGGVVDRNRFVFFVLRLCFASRQISVGLSWISRIGYAHAGVCATEYKCVMSVGEEAVSFQGVDEHVGPGRVFAAGPFVADIAHSNKVKDVACQTTDEARDDRRRGDAIARLSLVPSQVYSLIRFRGSRINGLSQFRTPKELAPKGALMLMTRKGQTKQKLTGGKPGKYFRKG

SEQ ID NO: 962049 - protein, 32 aa, Homo sapiens
YGLKRKWPALGGEKIHSMVKETKNQDWSQAIL

SEQ ID NO: 962050 - protein, 210 aa, Homo sapiens
KLGPRCEAGGAGPESPEHATAARLVTITPREEPQLPAAGPSHHHLQTMSMRGRDPAAAAPRARSRAADTKPWTHKGAAEQRMLVGPALTIKSQYVLTCHFCVYKQRSLNNRKVYGKHVNIDYKVKRTDNNESPNTTRNMHTPKGNDQIVRKHHRTRPKKQNTTIHNPAQDHHYHTVQIAHNWKKHERQDREDVRDREKRSIKKRVEDEEQ

SEQ ID NO: 962051 - protein, 176 aa, Homo sapiens
MEDVLKCLAVGTHLWWTTKSLSVATMGTSSQYYYNTCNNDDAQSSITTDLKRTWEKLLLAASCRLLPLKTLADVRCYSPPGDTGQRAVLKFAAATGATPYCWPLSRPWNSSANQHPRQPSAEPRRSLLRSLSPRADHQPLIGGLLLLSLRYHVRCVTRDSPLRYVDVAIPCNNPGA

SEQ ID NO: 962052 - protein, 230 aa, Homo sapiens
LRLPGRAWGLWEVARPGPAAGRRRRRSERPAAAGSGVDWERAPVSLTLSLSLMPDACCLELVLCECAWRCADAATIVRLFWESLFWGLGRGCIVPGIGAVPLDPAMVRCHSILVLRDTVKEDCLDARNQEFPCEKKIRVRSLDVPAKKSRLPKNRARRALPGTEALRKRFDECSLAAYSSGHFYQATRVFPAGRPLGDLPITNTEGAQGTWAYSRPRAIKGGPLPTFDLR

SEQ ID NO: 962053 - protein, 92 aa, Homo sapiens
SKKTIKGPEGLAEGALGLGEISGHRGGSGGNISRIREPSRGRWGAACTITGSRSHRPGQYSSLLGARFGGYHWQMQQYGAEASGNSPPTEAS

SEQ ID NO: 962054 - protein, 85 aa, Homo sapiens
VVLVSTNASTRCPSYDRCSDSTLLGGVMTEQIDPSVGILDGATNWPRGNARSAYVRACRDSPGTIKSVIAALLLDDNKDPFIHCA

SEQ ID NO: 962055 - protein, 203 aa, Homo sapiens
MNTFKRRALYPKVSETRVVIALQRHRCPSTRLVENTDETYCIDNECCSTYNLRSAIPQAGHASTLRGPRSHLVSADHELESPGSLRFPGQLNADLRKLAVNMVPFPCLHFFMPGFAPLTVPGQPAVIGGLSVPELTQQMFDAKIMYGRLLIRATDCYLTVAAVFRGRMSINDEVDRQMLGIQEAEQSYFVEWDPPKVKVALFN

SEQ ID NO: 962056 - protein, 325 aa, Homo sapiens
DYNMTPDRHLELPGFDKCRPNLLITESTYATTIRDSKRCREIEYFLMEGPRDLWIVVRTVLIPVFALGRAQELCILHGDLLGAHCILKVPILLSPRGLTDEGQSTIYNAVRSLWNHTQEGIPRRSISGAAGTVVVSFNAPSNGLRTGAFCKTTSSDLHEFVFCQRLEKCSLRCGMSPARSSWHYGARETETSIHWSSLPRPDCGARATVWPRSIRLAVCKLACIGRCDGGGMAAAKVMTAGGVRVIHAHIADCHRASMQLSGPGRSRDSVLLVHWRGPRRLAYLEQKDEPEVRVNGYLPGHGDDGDAGPSPHPRRLSWAVNGMRQ

SEQ ID NO: 962057 - protein, 173 aa, Homo sapiens
NANAHLTSETGSAPQTSHSKLDGQAGPEESSSQASSLVLVPKGRDNVQVFLGLSLGQGVLAWTEERGREAAVSLDDHSAELEPTWFLTGQTQALRTDVNSWKADSEVSAVWCTPPQHIRVPGVPSATIGSCNDFPRRHAPVEACGLTLYNRQTITEPRPVLVRRTCVDQDLVA

SEQ ID NO: 962058 - protein, 128 aa, Homo sapiens
MPRMRLLALVAPIGAICAVAAIGYIGAAGILLEARSATPRDSVDPVNMLPPLLALSFPSCWTKYTAAFAPRKPDPPVVPCPLVAITKHAKTRVVGPQPMLVRGDPNGYSREIPSAWPPVPLDVVWIRP

SEQ ID NO: 962059 - protein, 320 aa, Homo sapiens
RGSASVSLFLIFPPFPLSYILYFLILFSPSPPYKISPYGRRLSRGTGAEAGLTQRRKIKREQRKTRREKEKKQKRKREEEKREEKEEKKNQKTHTKQSNTRENKEKRTQKRKTERNKKEKQRSKKNTSKTKKTDHEKTNKTKPQHDNKTETEREKKRQHRKRTTDKTRKQKKEKTKKETNKEKHTAREKQSRKTTKRKKEKRKKTQAKKKRKNYDRKHTKKQKTQKQEGQEQQKKQKEKRRQKANKRTKNSRETPNKKRQETKKKESKKKNDKEKRGKKKRKKQKEREKKQKQNNTHQRRTKTARQNKAENKQRQSNKQE

SEQ ID NO: 962060 - protein, 118 aa, Homo sapiens
QRQHAQVVLVGELCWFRYSAPDASTWVCPIAWASMHHNETGHCRNAKEEVRVGIRGVCWMLYVDRTRTFLVGRTSDIRLTIERLSAPCGGVYKRGFQSASFRQDLSRNTANRWFLSCC

SEQ ID NO: 962061 - protein, 271 aa, Homo sapiens
RETLVEDALTSRVESKDSGVPCAYVGRLIGEVISLNGMKEERDQAAVCRLRQRLTRRASLKFTKDGKLAAKLGFDGVQESEEEAQKAQKHFSKSFIDTSRITVEFCKSFGDPAKPEPGANVPRNQARPKQAPKDSTTPEIRKDENEEKGGRSTGEAEGGYRVPGVVCQFIRGGRQASHLGEVMAVDAEPSKGKSKPGSDYLKFDSRYWAESEEGAGGGLEEEASLEASSVKRGGDMTETTGRRRPPGKRRETAGKAGPKRPTLENGGTSAE

SEQ ID NO: 962062 - protein, 135 aa, Homo sapiens
MDKSYYSIACVNGTVVCTRMLVGTRITLVLIKSHDCRRIGHSRVGEIDTQGLAGRGPGGPRIGKAAKGLIKMGMNEHEVCNLPSNYNSGILEESPFAETKPNTSGRQGGIAEWGLPMSPEAATGNGQIGVNLHSD

SEQ ID NO: 962063 - protein, 81 aa, Homo sapiens
HISSPRCPEREDDWQMRMDVESHRLRRSGYADVHMPVKPVRCKAAVWLDKVRTRVAVTRSESKWRTRWGPGWNVVLSQMEP

SEQ ID NO: 962064 - protein, 107 aa, Homo sapiens
GGRLARTPVEMRPSPGDGRAMGGLGHPVGMCLCIWSPCRHPGSFPTCVLLLRPLVKSTATSLSFLATCRASLASEDNATDLCNTNYFNLQQSTMLLMWCRSRPDAFR

SEQ ID NO: 962065 - protein, 102 aa, Homo sapiens
PSHAATRRLLSGCVKLFIDNRSPGGYRARMIRSLFEHAHGKVLECDITYIYYGFCAHIHDKTAAVRMPLRNRVTTYKLHGVQQSTWKPARIRAKLQPSYTLG

SEQ ID NO: 962066 - protein, 136 aa, Homo sapiens
ASETRSRRRMTEQMTLRGSPQGPQRLGNPDRYYPSSARTVILSASRDRDPSSMLVKTDHGYRCTQLIVNSTACSAGVTPNFVSDVVIFHQMAQCALSGSWDGTLRPLGLSQTVAATARAMYVGHTQGCAEMWPYSL

SEQ ID NO: 962067 - protein, 262 aa, Homo sapiens
HQVVSSALQQRHPHPPPLTLGLACPQRPLSSSSLSWYDNVIGLQRDLGVVDLSGATSGLRQEVTTPWTTRPPRGEEAAKRRKEKRPITLLGESAVRHSSPHTTLEVSRSLQVADVRPPLNRGDGVAREACTLVNVAIQLEGTLVLLTKIHEKKIGSMASGVGSRGVGRRSSSLALDGHVTWSLPYARVFRRSTRGVRLCAGVSPLMSEACHHVLGVSRLLPRGIVARGKLWPWGPVEGFEPAGFLLTQVLGTLNSLRYRGDK

SEQ ID NO: 962068 - protein, 284 aa, Homo sapiens
MSIAARAPSPSNPSDVPHVAANSDAGVCEALAPSPGGPAAGEVWAHPPSLLVNYELVMETGLPTPFQPTEDSRAAVCLLGPQVSALNVREMVCVDPPLTGRVDSSPGAPTRRWPTGGYATRADETRNSFGLHFFASNVALMRTIPCVYNPVQIVLISRYVCRGKSWCYSPVNVALGFFGVPYRWVHALNLPDPALPTPRIRTGAGWFRDVYTAAGNPAGENDLHGLDDRVCVAMNDDPGQPAHQNNPAESPRQTARPRPNCKENPSKGDTRTTTQTHTGTRLLQ

SEQ ID NO: 962069 - protein, 170 aa, Homo sapiens
MLSSCDPSDKVPRHICEYSTPTIDGRGKIALPSLPVKGVGRSILRRWWVVGGKGESEWDLTRRAGELTEDEVERVITYYAVIHVQYQMIPGLVAGRDEKDVKDGRYSQVLANWSGANKLRERPGATDRRFGPMRGLRHFWGLTCPRPSYDQVPLAAVAAAVGVSMNEVGL

SEQ ID NO: 962070 - protein, 229 aa, Homo sapiens
RPSPVRQRISYVHGPNARGWCWLTLCEVVWSPTGEEWRAAAAAVCAATRMGAWCMPDADAWPLLVQEMGWMAACLRPEVLPWYAPLAAPGDHVGQLRLPSGAGDGCRLRMWWPPDGPCRSQGAWRWELPAGRGGAGRPWAGCPRVTSETVTCCLFSERDAAGCAPGRQRPPGRGGPGAGGRAEAESRSALACAAAGAGTQTVTYSLLKLVKERSLDTLLEAVSPRRRAG

SEQ ID NO: 962071 - protein, 215 aa, Homo sapiens
MVSVPSPARSCALAWSRRPQPWQLPAWPRRGLPAPCASAAPREPGALPDCGHRFCRACVVRFWAEEDGPFPVPLQCCLTDCWQRAVLSPAGPLLSRAFWRSRRRPVAARALTARPAMACCCSCVCLRRRLARVCAACRMAAGPRCRPMWEPALEDGAGGNGEQGVLCEIIENRTWMTPGTCMARAESAAAVCKGHDDGHVGKKALTGLQGSCGPS

SEQ ID NO: 962072 - protein, 251 aa, Homo sapiens
PTGEAPQRPPLPPVTADYQYGRNNQSSADHFQYSRQSYPNSYSLNRYDVESSKGHGPDCFGDILPRSPHQQVSETSDNHVNVATQLGVTVHKLSIMISPWGSWFPREPPEDALPAVHDGRELWAIPKQMTSCLIALSFLDVCRSEWPCSLRRSWPRCTFPCANLFPMPCVSQSTCVCIPDNIQDLCEKLGSLCAVDHELSSGGVHRRLLENVRLAESNALAQIAEDHRVTSQRKPEIFNSPHNDPSGTPSP

SEQ ID NO: 962073 - protein, 220 aa, Homo sapiens
CYRDYKWKRFGGRGPNSGRGVPAPGQFYRFPSTPDLLHGSGVLALLQRLQFTRTQNPSGDRDLSPRRLSFEGGVVIAADLLGSYGLLGSFPQHLSHLCEFNNEYQCVGLPLGDYADFSSIFEASFSAKVVIVMRSFVGNGHSYSPKAIQFMADQGHVQPALEDEPFVDTPWSSEDYADGESFLGYVDMLGVPMKPFRGHWLWAYLVHLCAKIWKSAVLAD

SEQ ID NO: 962074 - protein, 56 aa, Homo sapiens
ISCAHWHGRETFYVSEMKETEWNGGAVEGIAPVVARADHWCPQFVLGLPGRNSARS

SEQ ID NO: 962075 - protein, 246 aa, Homo sapiens
MWPAWSQHDENTQMYTHMHVDTSDGHSTTKCATKEWTEHMQMPQHCKGPIYRGKKERDTAWPDHGKEWRFQPSFPTLDMTPRPFHWNNHQTKSDKSDHTDQSPNRTIQRTLEDKAQTPRGKRQIPTRQKRNITHRTQMHSHTTEKREKQASVKSMLDGDLQSQSDQNKVMNEAKEPYNHINPYYGQRYQTNTRGTAHLKTHHEEMMEHRKNITPKQDPQIIRNPKTFKGDPTDLHRKNKENSHKEI

SEQ ID NO: 962076 - protein, 38 aa, Homo sapiens
NYGLRYRGLGCRAWAWFGSSGSQEEEEEPGLVEGDPGD

SEQ ID NO: 962077 - protein, 114 aa, Homo sapiens
FPDPRVEAWSKGEDLKKYFRRRMKEEVAERVEPTPVETSPTWTLAPRLQSAIHHPSSYLGAQARRTKVTGTWADGRTGQWEKRSCRKSARGFVSVQGTKSSTITAHQILGVTGR

SEQ ID NO: 962078 - protein, 224 aa, Homo sapiens
DNGPAQMVTVVPSLLHQDLAALGNSDAPVTGMVSASELAVREQERIPSLQAIAAQVGWLFTNSFLQTGICWILLSASASVRCPSEIMVSQKECPQGIATRLLSPLQVGPGSAGPFGLLPHLQQKYSSGLKVFVPLESVMPSSPAASHCCMTGMDSEFCSTSPRREPLGHPGGTGAALDHDEQRLPSTVWDIMFQVAVPNVNESEAAAEIQLLLPVIQSFDGSSV

SEQ ID NO: 962079 - protein, 181 aa, Homo sapiens
MIKLSERYTNHAEEGRRRAVFRKRASRPPLPTYSAVPCYFCSCALLPVDLTEQQRTLTESIGARKGGSELGVDQCALRDALGDDLLEHDKRSTIPGVRRDNWSLRSSRDAGRPPVAGVPPCLARTVSFTPDQASRLSRGLCRVPDLDRNYLSGLAAVQTEFMLTDDLLTRFFSDACSTCGE

SEQ ID NO: 962080 - protein, 280 aa, Homo sapiens
SLLCASHPRGSRSFSRLRPRQRGRTAEAGHGLSCVWEPDLSKDRCELQNVIILDDPTKLAKVEENDRPLTSSNRAAITITLLSFTIDSASMYFAFDLGYVLCSRKTTSGEASSLLFCFVSYRSSVLAFPIWSVQLDRHPVLHGESRFWTHVCSSFLFLVFLLFLNFEQVKSLYCIVLDPTSSYATREADVMEYAVNCHVITWGEDYPATFDILAFGHSWGWGHEGFGESEVKGSAGANQDYLGTARALFWVSSHFAASRGHKHLGTVCKRAGDSGRTPRQ

SEQ ID NO: 962081 - protein, 195 aa, Homo sapiens
PPPPPPPTIASIEASLNSLTETLPGNLAVRLSTQSDCLIFNATSPSGSNDCSYCETEFSHTCGASSSRCTCWRHVTCIPAFLSSAHPRALQPARPVAVCLACARVVHMPGCHSAWPDLQCPLPLPCHSAGVQLSCLSMPHSGMQHDLTDTAGTYCLVASVLGVLASTLSTVQTPCVPGAWCVGVGHQPGFLTLVK

SEQ ID NO: 962082 - protein, 225 aa, Homo sapiens
MCGKSGGGRGRRPCGQGHEDALLLGTRPGPQGPPVIAGWLQVLGGHAIGPGGDATVLLGVGGPSDLSSWGVCGSSLLAVAPVSCPSRPEYGKAFLWVFGTPLSNQGSLSLDLLGQARDIVYTLQLSRELISRSILPVLGILLFRAVVKARELLQDPLLKVEGASQKLLAGNTVRETFPLGPHGASLSARPGPSLGPGGYNVQLVLAHIAARGRAESRPSVFFVSE

SEQ ID NO: 962083 - protein, 138 aa, Homo sapiens
MLTPCSDSDLSADLDPSVAHTWHMVGEDAESALFTCSRTMSAENMELRWVSSSLRQVVNVYADGKEVKTGRVHRHRGRTSILRDGITAGKAALRIHNVTASDSGKYLCHFQSMVTIYEKALVELNRCRIAVLDLSHPM

SEQ ID NO: 962084 - protein, 98 aa, Homo sapiens
VFQSQRQATRRTFIQKYHTPPWSRAQRDRKATHRWMRQRDVPGVYHRRKADHSVDQTRHSECQHKREIGAQLGYRDSNGRSYIQSLHVIRAIIQKYFE

SEQ ID NO: 962085 - protein, 209 aa, Homo sapiens
MRDSEVGSGTVEVGSGERGPADGDMRGGERLARSGERSALCSCRRTLNHGRPRPRVDDRRARARKAAAQRWKTMITHAGIRDQVRSVDVSPTFDTMGLREDLHAGASMLYELLNEPFAIPSKVAINVRVINRGDDCHSATDRQIRAHGNNRATLQISSSPSKMFWIIQGFVDILQGLDLELPSRELGWCRFQKGLISSSSDYRELFRCQ

SEQ ID NO: 962086 - protein, 246 aa, Homo sapiens
MAARSMPGSRHRTATQTPPEDHPDEEMGFTYRHTRVTYKPGEKTYTTEAADYYQLGNLPTDITEGGTYKRALYRHRLWRAPAARLSSNTGHAAHNRHTSSIGQSRTTDWNSEKAEASDAHHSSQKSRNLLPGYSTIRLTHRNAALEHVQATLNYQDSSTQQKPDQQPTQFNLNHRDTQDATNQPARYRSGKSTTSEHNAYTGNNAAATTTPPHTATPCHHTHGLRKHNTAQNGRTMTLDYTNAHNR

SEQ ID NO: 962087 - protein, 124 aa, Homo sapiens
SAPSFKCCLCSENTLIYKYPILNPLQIVVHKGRLYTSCRSTIGLLLCTPDSFTVAFIQVVIDYLPIKSIGWSVAGSCNLQHYWRSHRWAGSLEDQEFETSTGQHDETPSLLKIQKLAGCGGSLL

SEQ ID NO: 962088 - protein, 137 aa, Homo sapiens
MGLLLQLRRVGRRGEPPGSIKGVGVLHATSMNVKQRVRAGVRNCMRYSARAEMSWCSDSSSTCAIRDSVRKKLRPHPDANGCVQLVVELICMRRRLAFPTAGEVVPECRQCSCMRARARMCRMGSEVLSWLGSRFSR

SEQ ID NO: 962089 - protein, 163 aa, Homo sapiens
MANGFGLSVLYFLFLVFLLFLNFEQVKSLMYWEIQIFDTPKGKADVMEYAVNWHVITWGKDYAATLIFLRLDISGAGAMEALSESEYRSLLAISITWELTEPFFIGFSPQFASAWGHPVLLASCVPCGAVGGWRCRLDQGSLGGHDFSPGRQNFRPCPRFCCP

SEQ ID NO: 962090 - protein, 173 aa, Homo sapiens
MALARCRGSLAHARAPRARPGGTTRTREMGFTSRTVGGVCSRRARTGRTAQRLPPLRGDVCPRDVAEGDFLRLFERYGEPSECLHQTGTVAFGFIRLDIQNLAEIAKAELDGTILKSRPLRIRFATHGAALTVKNLSPVVSNELLEQAFSQLVPVEKSCVVWMIAVELRETGL

SEQ ID NO: 962091 - protein, 186 aa, Homo sapiens
MLAPGDPNIGSKNLGPNECSLCHLEARTLMHLVETPPNRWTIEHGASTTTHSAGSDGERVGRATTPAPAHAASTRRSHSITGSPLRRACSTRSHGHVASLRSFVTAFVPADDGRRTSGPLPRTCSLGSQTSTPPAGGETGRGEETRGKGAAPWHPIGSKPLFLHAVDIGGLPKGERKNKTGMGVGE

SEQ ID NO: 962092 - protein, 94 aa, Homo sapiens
EKFGLGRRLGVDLSVTLTVSERWSLVTALPPFALGSAMPIYQVKSPITGAARLSVCMLPTLHVPGSPTCTRRNYAPRRRALAYCAGMSLILSLQ

SEQ ID NO: 962093 - protein, 115 aa, Homo sapiens
CCFSCYITWALADHYTRSARRRARHMRRWIDTRFEARRELCWLTASQCHQPAENKTFRFVGTHSQRQIKEVITFREKNQRQQVCLITCQLSATVSRPWARVGYRLPSLALYVNRQ

SEQ ID NO: 962094 - protein, 121 aa, Homo sapiens
MPSMTPFIDLNIHGLYMIPISFHTMDKFTWHQYKAENEELDHQMEIHITSHIQEQRLPSKNQDGSRMHGRLTIRSMRRSNMDVINTPNERTAWRDINIDTEERQTKKKSIQIESYMTHTIQ

SEQ ID NO: 962095 - protein, 72 aa, Homo sapiens
WTCRDESVAQRNAYDMSMLSSETSRLCHKVTYTDRSGAESGLRLDDLFVTGRYVRYVPLSQNDVKHHASSAL

SEQ ID NO: 962096 - protein, 146 aa, Homo sapiens
SRGPCMEAGTEMGVVRDQDLSSLSLLSDIVFKPCVAIPDAPPLMPRIDRSILRSSNYFLKIINYWMIIRNVSLWEQTNVGSKLDAKHIRMFLFDGKAVVLMGKEHHECAKAIRGHLENITQLWEQTVCLIIRGVMSGFVFTKDGPH

SEQ ID NO: 962097 - protein, 194 aa, Homo sapiens
ARYEAWVLTLCPCCDDPDRPSAVPATVCCCCWTSPRRRCRRPLCKRSRLLWAHGPPVIATRQAIYTCGGPLRSPMHRLVYVDPLTMKHCAVARRILPDPGSSSLTWLLVYGVSSYCLRWLPIRIHAAWNNTVSDGQSACMLQRLPSSVECSECKFNKVEACVLDELDMELAFLTIVCLDSSFERHGEQVCQYAC

SEQ ID NO: 962098 - protein, 311 aa, Homo sapiens
KKNNGRSRPGWYRERTRQRLCIAFSYFSPLSPFFFNYFFSFLPCTKKSSKGHGRGKGKKEQHPEQRTTKRNKEKKRSKTNRQHETDSRKQTKHKTSKQETQKTKENKNKKEQRKNNKTKTKEKRAEEQESNRGRTKDHTHEKKKHKTSKQKDKHNETNKRDTRQSQETDHQRKKRPQQNEDKKKIHREIQKKGQKEDKELRRNRERKGKKKEKNRIVNITILLGETKTRNHRTMKKHNNSGKREQKKRRKNREQSNTGKTATTGRKKRENSDKERRKKRNKNKRKEKTTDNQRQTTTRKKKEPKGHNKKQK

SEQ ID NO: 962099 - protein, 128 aa, Homo sapiens
YRLLPRYQTEGSQKLSYHCKNVIATASDYDMPEQSPISDLPSDCVTGWWPASSGPLCCAGAVLSVTALCSGSLLTPSKRTRRSTENPPYKFIHMLKGISIYPETLSNQEENHHSAEKTKMVLGGEGET

SEQ ID NO: 962100 - protein, 218 aa, Homo sapiens
GSCTWYVLCGGDNLSKDPNGPIPFLDSVREGRLELHVFYVLASPAKRRLSTLILHGGAPMCRVQEPGAVLLAQPGEALAEASGDFISTAVHPGLAWSATSRLELGRAYRALGPRRSSGWTTGIRKQSPGALGRGAPRKPGSRHRATAGAEIRLLPREFAATRTVKAEFFDGYGLQGDTLPRLLTPGFRCPTRVTPAFGVDKGEWDRPDSFAFSGQATP

SEQ ID NO: 962101 - protein, 84 aa, Homo sapiens
ARGSCRNRLVMKGGKKKQASSEVHSLYCTHPVEDGIMDAAYFEQFLQERIKVNGKAGNLGGGVGDHRIGASSKITVHIPRCLSP

SEQ ID NO: 962102 - protein, 130 aa, Homo sapiens
MARVVYNLQGSRGASALPGAGDERVAYPLASVSYMYVVGWSMARTGPPRPPRATSPTAWGPQSTGNGTKELGDFSLSPGPGCVTDPPVPRAPSVRPGCSSQVEMVDTVRIPPLGSFESEKLNELHYAEAA

SEQ ID NO: 962103 - protein, 167 aa, Homo sapiens
MSALPHHCPTPEPGWPPACIKLEAERGTRREGGTNGPRAVPFHARGMKTLLPWTDPCQPQPLSQALPQLPGSIVQSPWKPEPWPGRMGVESYPALSPCIPYYHLSRSAYEGLGRELRPPEPQPLYHCQHSSGRFTAARMTDELRPMRVKALSDVTKGATMPARRTAE

SEQ ID NO: 962104 - protein, 217 aa, Homo sapiens
GKFLWRSGPESAMSHGPMQPGAAAAPCGRQGSGSRHGGFVVTVKQERGEGPRAVREGVPRWRSRLKKLAAGPRGQSSGRTILPKWARRHRSRCYCALPERIGAELDPHCAYPDLPFPEITKMLGAEWSKLLANGKSSRYLDEAEDAEKQAATSEGAAGVPGSLKPIRCARRRSRRRRSRTEDSMLWAHEHSPEWTQGGDCDGFPTSMSIFTEEFWTT

SEQ ID NO: 962105 - protein, 119 aa, Homo sapiens
SEQRAGWIAERRVREPSRPPPQPCPSRFEDERGSARRPTDRGRDQRRERSGQAGRSGTATRGRPERVDGSSEPKPAVARGGGTEPVCGLPRAVLAVEGGSRLWPLSYVGRTKRTKESKV

SEQ ID NO: 962106 - protein, 123 aa, Homo sapiens
NGVVVQGPTPHGISLIASTAVLKSNLQGGTKVWGRGARHLPRLCFRLNKAAGKLERGVEPTTAQGGRAVPLVGLHLRGGRAQTNKKTSSITLCVRTLSVSPVFVTAFVKKKRGGSPPRGSASV

SEQ ID NO: 962107 - protein, 119 aa, Homo sapiens
CNRKPTACSILQSEQFSYSLTLDRGFSVAKIQNKSDKIKADFHIGRRRVNSPTGKLGPCGSMPFLLVVWGQCRWTCVGCEPRASNLATLATCKAILAILDLQWLAPEPLLFPPIFPTWV

SEQ ID NO: 962108 - protein, 267 aa, Homo sapiens
DHSPLARNSEERLQQGLQAPRRSHPPVAPLAYPQNHLAGHESTDKRTDARTRKNRQDEKKREKAHYTPHRQAKHKKANKRTAHPHPRPHERNTRREDSASDPPAQRRDEREDRAGQGTTHRRQNGGTRRAQRQKAEAASTTNRARALPTHERDREETAPPATRRERPATDPPPRPPGGETAQSDNKRARTGRDATTETQHTTTQQEQTRREEEDGHHPRRESADTRGGTEHPRPTTQTQNEKANAREAEQTRNMRTTPPRSDEQKDT

SEQ ID NO: 962109 - protein, 78 aa, Homo sapiens
KLRYSYLKYGGSDRNRTSDTRCFKPLLYLLSYRAIMAVQTGIEPAIFSVTGRRINHFTTEPYWLLETGFEPMTDKASR

SEQ ID NO: 962110 - protein, 315 aa, Homo sapiens
SFELMRSNADLFQLGSRPRGCCWIVCTTSEACRWRRGRTRSPHCLTRTGHVPADIHHDRPVIPACGCTAMQGAAHDATLKASIVTRRRGPCGTARRSGAFTREGSRKVLREASKGRSGAIPVHRYPMRNCEHNHITEPVNKKVSKNVPRHNILFPIRHIRGISKADYTPHGPMNFYQPHMRMKTERGVRTRMRYQSVPWQPTALRETVWSGTPLARKCPGHFTLAKVRNKRTFRGEEATPATPRNPPKETGGRTLTIPFFGDTSGITLERHGTTGHTGASLEKRPKLSDGALSGELFLPGSDSTSTGSLALGTCC

SEQ ID NO: 962111 - protein, 43 aa, Homo sapiens
GQDTKGTSYNEKPGPGQDLILCKTCFFLFGEVTRDPKVVITAP

SEQ ID NO: 962112 - protein, 95 aa, Homo sapiens
KRLLVSGGRLRAPPRLSVAVAALKFICLRHSGRFWFPYNLVRRYLGVSLQHVADIVTTKNSLLNFDSRIVDCIVEKVKKRGTRWLKKQNLKARSA

SEQ ID NO: 962113 - protein, 66 aa, Homo sapiens
MTSPSPASVATQPGEVGQGGHRIFCDKGSTAIRTSLKETWSSSEGNVTEKKLGELRDGGKNTTRVQ

SEQ ID NO: 962114 - protein, 193 aa, Homo sapiens
GCNSVYWIMSPGFLVEALVGEGHRAKGGVKGMFEGCSVMSVGASKLGEGRVEASGTQPDAQSPGPKWRAAGPVRRHLPRVAHTHAHSHRELQRPLFHNLHPGANVTLGANLNSQKGRGKQSSVNNRTVHSFLFKSGCLSFQQNCHIKGLAIVITPVGNIFCKFPLTHSAFGITSGVMRGGFRRPVISTGKSHT

SEQ ID NO: 962115 - protein, 229 aa, Homo sapiens
SSGVTEAFYLEHKTTGDLPGGHPGNNTRLTGSLNTGGKGEGEEKQWTGANYTTGKARAGQRGPGELGLLVGSPKGSGTELQGGGALTAGPPASVVGSGGLELPELDTEGEGCLVYAKGDQRGLAWPTGLTGARGVPECSWPANLALRAEVQAPGCYEGIEAISVGRLGGHSWLNGSRRGRKVGARYAVEGITISGNFYRNTLKYRAYLRKGMNTTLPRPYHFRAPSRFR

SEQ ID NO: 962116 - protein, 178 aa, Homo sapiens
QDRHRPGLPCSAARCWSSRCTWGPSSRAKMRLRKKAVANPEDALRHGGPQYCRSDPDVERCLRAHRNDMERHLHPSFSWASSTPFWVLTLLSPWMHFHGSSSMRPMMAHTVAYTGEAERHPVRLRGTTTMDPASPCAIHGSADPLGSGTPPDDQTADASLDTRPWDKEPTRAYTLGDL

SEQ ID NO: 962117 - protein, 228 aa, Homo sapiens
TGGGLVHRAAGAVHSGCVEPGGVDGVDPGWSRSPADVWVLECGVVPVRVPAMNDLSGDGPGWRWRAWPLGVSASSAGRAAGCCWAVTDHHEKPLLMEKLCLNKNISCRSCDRNRSPCGKIIIISELREEVSFTQVHLHEEAAASGAKCVLTHSPTWIIDPIDGTCNFVHRFPTVAVSIGFAVDKSLNSGGDLPLAQKERLYTGPGGVRGAFCKWTAAPGLRGAQISQR

SEQ ID NO: 962118 - protein, 231 aa, Homo sapiens
VPPESPGVGVEPQGENPGDICGRRPCRLPRLAVGGGCCLRPTPNPNTCERAQQPLLSKQQREITQRSRSPVVEPRGTSPLNALQSTSSPRTTAQGVLLMLQTHIIGPKMCSNSDLFSFRRHKTKENLSISTKNVRYYSHIFVVSTQNILENNLQPPRPKKKIISKTSVPKNPRVCETLWNSTLELCVRTERRQLCFVTPEVCVWTQTLFEDFSRRNSEDTTCATTPCSYPW

SEQ ID NO: 962119 - protein, 261 aa, Homo sapiens
METRRTGLSHPLKPRAPCAPGHLARVFHGHRGPTLITNIDDSHSALLFRTVKKELSQHQRYTRHAHWNWSRRNCSHTYHQEENKTTLHDSDMRVGRDSVKPTEGGFQKMSRSHLGLPESQNKTEQRQETQDMKTERTYEPANTNELGQERRNHQTKRAHNRQRSTKTTHATHRKRVMRQRWRNIEGSSQEETVRAIKEETIENRRPKGRTGETQETEGNDHDQGKFDDVHAIRYIQDNMTPEKEKDKRHRRKKKRKQREKE

SEQ ID NO: 962120 - protein, 210 aa, Homo sapiens
GGGPPPQKGVFLKKKLYKGAVLLLFLLLSFSSGEEREKNRVYRETTFYIKKKLFFSLTNILLIRKEGVVVPRGTRAGLYYCVCRHPTALGPLSARVCVSSLSCLWEGFSLSLSLSLSLSLSLSLARAGCGVPPGAPGGGGRWLYIVGGRRKNRLSLRRKNNTKKRERGEKTTRRQASPPARGGDSSLSPKPGGGATKPPGGGRVDYPERN

SEQ ID NO: 962121 - protein, 191 aa, Homo sapiens
MSSRQSGGVRLQKGMLLVSVLLRAEEEVGVHLSHYPKTAGNSEFLGKTPGTTLRNWIPARRTRRDDKLRSKQLRTTKQNDMMHSSGKYEAVLNKLTPEKFDQLLPCAPPCGCRVINLHPLPGSYCLIVDKDPRRSHSIAHCLLSYVCDWQKDCKLTRLSGPTARGVNTDQQATQHIQKPPYFQIRDAFDTT

SEQ ID NO: 962122 - protein, 259 aa, Homo sapiens
MRQDLAEAQARPSLTRSSLMARPRPTVRGIPSCWCPATPYSDEWFCMQGYAQSQRGVGDAVRAEQASDDPGSYTQTRGPGLQPPRDPTRREWRQQRPPWTGARTRGPILVGHRRAPGARERAHAMRGRLAGEGDGPGKDVTLQWMGDPQEHIGSQSGKHMRACPPGAGILAWYSHRHSAIPGRPDTLHPTGMGAGASPLRPGPRGSKAVRPTPGPRRDQAPTSAWGWRDGSGHRGGAGEVDDTRRQIAPHAETAPDARN

SEQ ID NO: 962123 - protein, 106 aa, Homo sapiens
MATLKEKLIVTSSGKIEATVPNNKITVVGVGQGGMAVCYQHSGTKSLADELALVDDCWKISLKGDNDGICSMGSVIIFEHHLNIVAVVIRYICCDRRRFYRSVVVN

SEQ ID NO: 962124 - protein, 243 aa, Homo sapiens
MKEHGDVPPTMLDGTLNNGAGGISNDEACGGDVECMAQSPRLLKDTWDSDKDDNYSIKNSLDTLYQAQEIVKPPSFNSCDHSIQDTPHAEPPSPPCKGLFSHFTKHDRPGVVTTPPYKRTAMLTGSSALTGSSRPQDKNYGPLPERSHVEVAGAAIHSDLKQDMTRSMRAEDTNITTERGTTRAGTNIQLVGDKHPSTRATRDRWDPQSQESAKQNTILDARRRPKNPGPTPNTVHHGTAPRA

SEQ ID NO: 962125 - protein, 475 aa, Homo sapiens
SAHKDGYIGSKEQHAGKIKNPNIKSVECGVERLKTVRPAVDFGFDLVKGCGEGRISHRKSACSPAPNHHPCGQGFSPLSQGGHGAQCLPQGGLRQEALCVSSPCARIFSPVYVHAFCGNLRRGEGSLSRCESVTTCGGSSPVREHPFCVAAVRPTPSVAPIACGCGVCQPVSVSETQRAPSLSLSLCRVRTHLCDHECVRRVSLCARTCRPGARGRRHTRVASPGGDRPTRGVSTHKHKAGPVVGEHESVWRAPHILQTPSSEGKHLVALISLSRREGRPLCGCYHPLYQQRDTFHHPLSVDPCCATRAQKMRRGLSPPVVARLIRKHHILLDKKVVRPQGGTTKTAGLSRGGNVGAVSSGIPPSLSVVSLLLAPTPRVPYYLVCNPYYVEGPSSGRAATYFMPKRPTLSTFLVVNHTLVGDRPPKSGLSVSRTTLFPTTDLPYTSPFEGASLRARGVALFNPPLWWVFCGGGSP

SEQ ID NO: 962126 - protein, 317 aa, Homo sapiens
MYMPADGVCIICVCEKLCISRVCVCMCSTNTHTHAHLISARWRARAGSVFYPRCVSVRSMCARARVCPRVGSTTRVVALYMCISPESRLSHSPGSRESVGHFVLWLFRERPRAQILSHTQSRASPPHFLLSGVFPPEGSLPSQSAPHKREEGGRPCCVPPVRIKGRRQRIASCGLRGPIVESATQTRAPPEREIFPEEIYKAPPRGRPPGAILCLYSRGRGPPPCRREIPKEGQAPGRVSPPQKQQTNPEAAGGGSTKEERPDNPLLHHRKWGSRSIEHSDEKVDIPWVLFFDTPRIRGPRVFSQPQKTVLKKRGGP

SEQ ID NO: 962127 - protein, 439 aa, Homo sapiens
MSPRRKRESLYTRGSTPAQTTHILDTETHVCSRDTWERLLHTVCADTHCATRQRDRGAVSTTAYSADRCDTHVVASLREYHPPLLRPHMMRSRHPPHHLPTHLCPHDETYCAVYITAEQRPDILLSPMIISSAGTLGTAQSSRLDATRFPPPLPLVRHPARHPPRALSSHHPAGAPAATHNPPTLRAPTHHPSGRALAPLPPRRPFFLPPFLLIFLLATPASSSWGRHPLLVAPLLISSPPPLLQTHVGVGRPSFSHRCAQRAAHNSIRKPHTPAGAAAHPPLLRAGRPPARAPISRWPHQHTAPPCTTHLLLIPHPPLATNARPTPPADQQTAVPLPPPNQQGPHPPRRPPLTQTTSLVTPTNSSIYPPSLPTTTSTTHRHLLPPLLHAPPSNSTRQLSSHAPARTTSSRPTHATTPLHDRSSPTRAADTTPPTIRHD

SEQ ID NO: 962128 - protein, 142 aa, Homo sapiens
PEVIPAPDVTHLLPMMSTDEETEAWRGERDPFRDPTVADWSSEELCPLQQGSFRCTGGTWKLRSMLVPTPMASVLLRGCRLMDFTQWRSWEQLDLAQRTLYLRGEPWRPGSIIVSLAGAIKRDLLQGIAGGPPETGSYLEGD

SEQ ID NO: 962129 - protein, 30 aa, Homo sapiens
MAERYRISQYTGTESHEQATDTTERPQQIA

SEQ ID NO: 962130 - protein, 178 aa, Homo sapiens
MREIVHYSMAGSRCGTSMDRAVQASWRRGWIDACMNLNLTPTRDSHIHKCAHTPDTVELGTDILLVLSTRLRASMMDKIVFHRDSFLLVWILENHGNAHGASCFCLIVHICALRNSFRHPRIKLLVFSWFQFWWAKCNYNVGPKSDLSYLAKRGTGLQAWLALLVLVDAVYGHTDGKT

SEQ ID NO: 962131 - protein, 146 aa, Homo sapiens
MPSHSASCALGPCWTLGDPVVSSHGLGPRARLGVPPCASSAPCAGALCLCEGGAAFLLSTDPESICQGGRLSFLLLCTDFRKLQRSGAVFPPSAQTRAGGPGAPRGRTCVSAQHTPGRHRKGKSSLLSTDLVGTASLGDYSEPHQW

SEQ ID NO: 962132 - protein, 76 aa, Homo sapiens
GLTTSRNCGPRESAIKTRWQAGSYKVHLAQSYRRTVVEHKVESSAGVYHEAHGRMLILNSQSSIVTQSLVQVFFHH

SEQ ID NO: 962133 - protein, 81 aa, Homo sapiens
YHGHALFKRTLVLMSLPRRPGVPGAGTAAVGLLLASCRLALAMDWPPGERAEAVEPTAPVPTPTPTPHYPLLLLDVYPPIV

SEQ ID NO: 962134 - protein, 245 aa, Homo sapiens
SEGKIKYDAMLDKDSQEDKVIYSKYTDLVPQEVMNADDPELQRADEEAIKEITRKDKSQTLEKYCITEGRRSHSQFEQLTNRVLRHNIPIHTILSKEWRMSTLGAETREGISASVRNSTKDPIGASQQCQRFNKKIPQGEAPYSIPAPVNAYYLKPEQKDTVNRETNEDGRRITLPRYIYTWQKMQKGDYKSTSDNTSGVLMERRTTHRTHQHEEYLHKGRSLYIADRKIAKLRKACPVREKGPQ

SEQ ID NO: 962135 - protein, 233 aa, Homo sapiens
CWGDSHEYRLCQLPDCPPGLCPSETYSVPCAMAALCLGTQKTYQWCALSMGRPTYVRSFNVPGLRGIAFLSTSVRTAVPWTGYRLSAPWCPGGSAWLAAALAPCCDGVVRALGCPRRYRLWSVCRRLLNDSCLFVRRVFRDAGAFAGYWKLTLIPEGARHIRVERQEPQSTWALMGGDGRYVSSSGHWVVSPPGPTRSAARMWSTPETQGPGDVASSRATPMTCSYRSPAEPT

SEQ ID NO: 962136 - protein, 223 aa, Homo sapiens
MGFYSSKNKGRGFSYSFHSFLYFFTKGIQIPNWVETETSSYMIQLGINSTHKLQQLIWQQETGRVQVWPQRTPNVHARGRIKEEEPPKQPGEQRQSGVKWGQGVRQESTTRQKTWPLAIKLGGQRENKALSFIRNKPLRHRVRHIQSLVLNEYGVGQMRVPQRLSSGYRELNKADTRGDGQGRIIRGEEAQFVDLCLGNRKESDLLRASAGGDIKPRIPRGAL

SEQ ID NO: 962137 - protein, 33 aa, Homo sapiens
DTTLMNIRTKYGLSKEENPYARFDNTKALHTSV

SEQ ID NO: 962138 - protein, 60 aa, Homo sapiens
QPSSRVCALISGLCCNGAWVGFRPDSVDPFRFSISGHGWAPAALMSRASGRAYRQSAARD

SEQ ID NO: 962139 - protein, 195 aa, Homo sapiens
FSSVVTQDGELVLGAPGGYYFFRSPGPGSSCGYFLELPPRHPFVARVLPEPLHLTPATQKYFDGYWGYSDGRGAKFRRGIFNNKRRNSVVVCPTLGAGPWERWKFWIPTTRGCIGCAESRWRRILGIQWLSLTSTGMGGMICWWALHCIWRAGQTENWPKWGVCICSCRREAPALGAPSLLLTGTQLYGRFGSAI

SEQ ID NO: 962140 - protein, 206 aa, Homo sapiens
MGPPHHHPGHRMPHPGINEHPPWAGPQHPDFGTSHPSGFTGQTPHMRRQGPPTHTKHDDPRLVPKCALRSISLTGHEWTHPIVKLEDHEIQRPLDHIKTSALPHPHDRPAERLTGLQDGGHPNTNAPIHTDQAPGKQLNGMRDTSRGHHSEGFHIQKTQHMTGPREGSEQGQSTHAGHRQDPSEAHRNTDPNRNQGAVIPTTAELK

SEQ ID NO: 962141 - protein, 102 aa, Homo sapiens
VASPRCRVPVRACARLGCPARRGEGPGRSVCMETGVFGWAPSPRESFNGVEIPAGCVSAQIVSTQRKCCSSAARILLDGVLSLPRCGNSLPHSAYEFVLTVP

SEQ ID NO: 962142 - protein, 88 aa, Homo sapiens
MPGPQRPSKALGCQALRERKWSKLTWTRKNQGGHDPELHVRDGTPLQFMMGIRSLVKKVSGTPGKGDALGRGHLGQELALPCEKWGFN

SEQ ID NO: 962143 - protein, 201 aa, Homo sapiens
AAPPSRFSVGARLEEEIAALVIDNGSGMCKAGFAWGLSAPRSRVSFHRRGAPDIRASCWRHVAKQDSYCGRSSAQSKRGTSDPECTPLTHGIVTKLGLTLDDSIWSPLTLLATSLRVAPEEHPVLLTEDPSLNRQGPNREKMTQIMFETFNTPALYVAIQAVLSLYALGRIIGLVYGLCSSGVTHTECPSSRATHLSPGPS

SEQ ID NO: 962144 - protein, 143 aa, Homo sapiens
PSGSCTRAAGGATCQSHALCPHSSALGWLMGLGAVEQGAALGEAQAAQEPTEFGEAQAWRAAGPEPCPVGRQLRPCEKLSTAAAGPGAKSPSLLRRWGQLAAPSAGSAEPTPTRNSHWPASTVRSPGSRPCLSLHTSPHLPAS

SEQ ID NO: 962145 - protein, 32 aa, Homo sapiens
KERGLFRGIEDNPMVVPLCNRSKDVVEPLLRP

SEQ ID NO: 962146 - protein, 127 aa, Homo sapiens
MVLHPGSLLPSLVLQTCLRLGMPSSIPRQQCEGAGTKMSSWPGVEWPRPLSPVMTTFWCSGSAWKRQSLERKRWWTDQGGLQAGPVRVGPRTQAHHSQGPFRSFNSEIYHYVICVNNELGNKRDLKQ

SEQ ID NO: 962147 - protein, 90 aa, Homo sapiens
PRSPPVLGRPPRSPRDGEGRHARPLYGEGRHARPLMGKAATLAPCRGKAATLAPCTGKAATLAPRWGRPPRSPPVWGRPPRSPPDGEGRH

SEQ ID NO: 962148 - protein, 202 aa, Homo sapiens
CWFLPSGSCHHELQVELTCQSHALCPHSSALGWLMGLGAVEQGAALGEAQAAQEPTEFGEAQAWRAAGPEPCPVGRQLRPCEKLSTAAAGPGAKSPSLLRRWGQLAAPSAGSAEPTPTRNSHWPASTVRSPGSRPCLSLHTSPHLPASSGSRLRLGQPRKGLPQCSGGLKGSSSAAKVEAQAEEVLRVSEGCEGCQCAVTSH

SEQ ID NO: 962149 - protein, 122 aa, Homo sapiens
MRGETEWAVPPHTGNLNGRPPGGPPLSRPRLTFSSPGGHLEDQLYHAAQRQAGCPRRSAPRPIWCPVHPKTTAREPDEHGGERAVQFLPVRGGTVPYLEGVGFRVPVCSSPRVALQYEMHSP

SEQ ID NO: 962150 - protein, 132 aa, Homo sapiens
MWVHHCRRMHSAIEDKQEENYKKINREITLIRKKLNKAPSLFGPANPDDIHPRRSMENSKKSLTTLLAKTNLASQTHLYCRKRHVGHSSDMSNTFLDRGTPILNLFREPTKEQRTTDRILMYAVSSSWHRCE

SEQ ID NO: 962151 - protein, 256 aa, Homo sapiens
TDEDAQPDVMLLSLSPDRMSFTTRSTFSTNYRSLELCPGAQHNETTRTVSDSAASVHMQALGAHGSRISDDPDSTRLSGAAWGPGAWPRDSRGIWQRMGGIQNEKETMQRLNDRLDHLYPGQERGALETENRRLGEQNPGSTGGARRDPRSEHWRHNFKIIEDLRAQLYRINTVANARIVLPAVTNARLLLMTYSVQSLQTELAMRQSVENDIHGAPDRSLLTTQYHTHCSWETEIDALQGRTCSSEHEPQRTYTP

SEQ ID NO: 962152 - protein, 123 aa, Homo sapiens
AAAYYYKIRGRVDLVSTLETILQGYTNKNSMALVTWHIDKNRHTDQWNRRESPEIKPHIYSHLIFDKVDKNKWRKDSLFNKWCWNNWLAIHRRLKLDPFVVPKSTHDRLKTYMRNLKLCRRGR

SEQ ID NO: 962153 - protein, 268 aa, Homo sapiens
DGQFDVAEQRTPEEHMKEKICPDGISIAQLLPTLPPVALTRVIMPLETEEISTASLTEGLEARGEALGLVECAELHATERAGGMTSVLFITLVEDHPGGGDLHARVTQILPSRSIREPSSLPTTMNYHSLAANSYEDSRQPRRGGATAPSLTWRSEFHSSTQEDGGHVGSFICSSKYRSRGARITQGRNDGECHRKLPKSFFPCEYFNHKISDSLCNCTKTKELTGSGPPTANLYTLRHLLQLSTLAAGDHPIMPLRLLNILAYRIST

SEQ ID NO: 962154 - protein, 218 aa, Homo sapiens
QAGVLASPLGGTLDGVYPTLMEPVIAAQGGPPGARPERTRADTGHAFLAKPPDPLRDWSPPPPPARSSEPRSPELPSMISGTRHHLSSNTLQKEPSHHHHASPDPAGSTPEPRAYETRTGNKTQSKPFSIQELELRSLGYHGKQLHAPNGVGARQTCELTQSGPTTRGIPKHLEELDQSQLEGELRPKQPGPVKAWRGGQHTSTQHAGASLRASPRPH

SEQ ID NO: 962155 - protein, 74 aa, Homo sapiens
MTIQIGEASYGVNNNHSLRIRGDPKGLGGRWVRILGTQKDKRKKGEHDPAEAKGREASQRGPGRITHQTTTRDR

SEQ ID NO: 962156 - protein, 387 aa, Homo sapiens
MSFTTRSTLLHQLPVPVAAVQAPSYGARPFSQRRPASMQCARGLWFPGISVSRSTSFRGGLGSGGLATGNSRWSGRNGRHPERARRPCKVLNDPAWPSYLGQSEEPGVTENRSAVRRTNPVEHLEKKGPQVRTHVGAYYFNIIDGPVGSDLRPILWIGCPRSFLRALTMPVLLLMHFESQYDDCFWLMRPMSVADRLSTGLRWALCCTPDITLTAAVRPEIEAHQRNELIVSLMEETTEVVKLKGPTKPENCQLLRLTVEEMPPNLRYSPMLLGRTVRAQYYLGWLGENSSRRYPKCVSRQHWGGKPPKCAFATTVLTRGLQHGLYQKAPERSVTSVRSIPVKDYARATFERQTLIGDAGGQSFVIEIQTKSQPREEHYESSAKRRR

SEQ ID NO: 962157 - protein, 127 aa, Homo sapiens
MQVISSDKMPSEATIASSSRLTLYRLTTVGNTPLIFNPPHRATIKRLNPLYIMTFSYLKIAISRYDDSFLPDLPNTMNAAEITDKLGLHSLRIQNTGRHSGYLCHYWTVESYTKACHWLANQFQNQN

SEQ ID NO: 962158 - protein, 397 aa, Homo sapiens
MTPPRALLVCGCWVAVNPRGVEAMVTCGCACTGWLPPEPGPSWRLFYSRPRGALCVRTCGHAELSASVGLPGRLALRRTPAQASGQERAFVARDLGLHQCSVRSSSPSGSVGDASGRHMWPDHANSRWGHGRRYAGEAWQRNVDADGWIVGVRQIDDHGASHSSWDLFQGGLSGGPVGRDFLGPARPGLASLSRHAVTCAWGRHGTPRGLLLATLVSPCTWQSLEARGPVAGSGACSGPHAVWLLVVVAPWSGDPSYSVVTTSPNGVDIKLLNYSAAASQSWHMPNGPGHSTTIGQAFTDGSLHQDPGPEARAPVRPCARDKRTPGSETTADTTGAGNMGEDKEDRPGSTDSNEQTPTTEGHQDHNDKLTMRKEPTRGSERKENDGRNEQTKREKHK

SEQ ID NO: 962159 - protein, 71 aa, Homo sapiens
MSGPWRKQEDGEELHWRWPWNRDYRAIPELDAYEAEGLAPDDAGRKAVDDTRHGSQKNNHSAFDRKGTKTC

SEQ ID NO: 962160 - protein, 395 aa, Homo sapiens
KPLFWVCDRCERLRRQQTTSRGAVVLAQTFRCSNGNVPLKSQQCNGKDDCVGLWSDEASCPNGELSVTCTKHTYRCLNGLCLSNGATLSVTGECEDCSDGSDEKDCDCGLLCHSQRQCSCCMGGTVMRIEELSGPVQVSLHALVPWATSAVLPSSLPTWLVSACTLDTSMTEDSVYSDPTQWTDFLGLARPETSAAPLGMQELQQLKRINTPNPFFNDFTFDYDIEHAGAEKNRQEYSSMVRPNLTWRNAYTMTFPMQARPSGITRCGDTTTELKGLKSMIMQKVRTRDIKPEHMKNISPRRNNRPENRVAPQRRNHAGNTGDPPRKQRGEHTAQKRREQAHPEQSEKAHRTTTTGRSHTSRNRNKNTTYNTIDTTTRREHAAQKKQPHKPTTPP

SEQ ID NO: 962161 - protein, 81 aa, Homo sapiens
TSRLYFCAGGLPAVMKRRPGYLQHRQRLRGPGSPLMWHRLEELYTKKLWHQLRLTGCYEYVSAGSSSIFARKDDGSSFKAL

SEQ ID NO: 962162 - protein, 116 aa, Homo sapiens
RSLCACSPSASRGAASRPLPEAHTGHVAADHLPGRRGLGGQGCRLQSTLQPAVCCAANGRLVSLACHWCTRACLPGAAGIHIFLTCIPTMHSSIPAQAARIQTGIGDQALRKQFQV

SEQ ID NO: 962163 - protein, 209 aa, Homo sapiens
CGCPTQNISAWAYPYAYPPMPAMDATPLAFDGHGSHESAYHMSHRKRESVRREADEHDQDLRHSNQYTPSNKPIESHHTAPRRAETAESRTSARKAAGEQRTTEPERKPRTRGRAPRQHPGDTTPTAPATHADARATSDTVHTPTVQIRCASETSSQCTAEHHTINDDPALLDTPALSSQCQCALALGPTLQRPPPTMIVVIVSAPTPA

SEQ ID NO: 962164 - protein, 315 aa, Homo sapiens
LHNQSVFLPFLSEPTTSHDPPQALNPFMDRSPTAWGRKRRRGRQKWRQQQPQQPKRGQRKTKKPRRRGLAKPGLSRKSCVPVFTARSPWSELSQAIAPALKAQGAEVWWGTSRTRALPPPKLLHRLQTSHTTSGVSGTRTGGATTKRTTINQPKITHAIRCADQNPDSASSNHLYQESPPKRRTPLWTHNPPRNWAQPAPTHSTHRERAMRATRHPAYDRPTPHPYPTNDKYMKLICSVPHTRPHTNFHYTLSTTSALPLSTTRLTVTRDGLAASHTPTTQVEPIPPTNPSDGTPDKTGPPPQLQVRTPFRQRQP

SEQ ID NO: 962165 - protein, 69 aa, Homo sapiens
YNGTYRPEDVKRRAMADPEVQQIMSERRLRLILEQMQKDPQALSEHLKNPVIAQKIQKLMDVGSDCTFG

SEQ ID NO: 962166 - protein, 201 aa, Homo sapiens
MREEPLDTDYGVTQRRAEALVPLIGHAPRTSRLWAAPYTLSAQATPVGEHSVHTSTERKALGPTVIPRIGRGALTFPLGLPAGPVGHFRDTGGIPFNPIHQSHDWIRDKPIPPSSIFGGLGPPYSFPTTATSGSPPGNHSRNTTTDTQPTAAAPHNMRGVATPDHKTATEPAHTQLTPTIYQADNTRAPMGELQNGTTPQR

SEQ ID NO: 962167 - protein, 429 aa, Homo sapiens
MTADALMPGVNDGGWLCSIQSWCPDFSVGIVRILVTLRPKRCPGPFACALPVHTHSRVACAEPGTLLTQAEPASMIDQPKGTDERPREVRTRAQEGNSRPTHASEPTTRPSETRPQHSKRKSKQKRSRDNTEPNNGRESRTRRAEDTQDEKREKKKEDRPQNERRGQQEPHTTADPEKRRRRRGSTPAAPNPEGGTQKQDRHETRGRTRSTGAPNSLPRQETHQTANEMTNRGDEKAHTPDRETPARASHRRKPPKEQGRAQRHTRGHTKPTRPHAANHTQPHTHTPPTREPDQHATTQPTHRPRATRRARHRTGRGGRAPHPQAREARDSRSGPHHEPQNRQDQRRAETEGKPEDTTADSQQTHTTHRKSRAAAAPARPHQSERHTGVTPSKTTEARHTSDTARGPHAEQTHREAPTQTAARHRAAAQ

SEQ ID NO: 962168 - protein, 202 aa, Homo sapiens
MANLPPKRPRKLLPSLKTKKPRELVLVIGTGISASSTKPQVPALKSWKGLISGLTWMLPLILILIEDEESKKFQKCLHEDKNLVHVAHDTYPETLLLVPVMFDPHSQGLLYEVYDDLESHDGRFWKTANIRSVLPPDGKMEPYVIKYKFCYVSWELYAADQGKQLESLELTDENQVSMAQNSVSGRVDIQEINSYGKLKRRQ

SEQ ID NO: 962169 - protein, 121 aa, Homo sapiens
RLRVFLSLMATGWYDNLTPGQDKADAIVKMLDAAVIQMDGGHWRMIFAILEQAEEAEQAENAGEPARKQKDGLEQARDGDASNDHPYHNTQRPPNATATHPTPGPPTAAHTGRPRERPQRP

SEQ ID NO: 962170 - protein, 274 aa, Homo sapiens
KKEKKKKQKKTTHLASVRCWWLLISICDCTNCTGKSYWDTSPGVTQDRICNGDVQRDSGTGARSSQPMNGHVLDGYKDHYQDPVPGITPSSSSRTRTPCHLSIANTSTTSTLQIYTGCRMPLPQNMTSQMFSAIAAVQANGQNPNATPDPVGLQTSTAMADRWRRQTVLTNVFHNASPDSQWPHHIMTPYDIIPTRPKAKPITTPIRNTKLQASTNPQSARPSPSHLPAPGTAQQQSPQTCARWDKGERVRKERRGKTGETGTSQKSPAGQTKE

SEQ ID NO: 962171 - protein, 263 aa, Homo sapiens
MTCDVAVTKLMCHVVTYYQHVIAWAWEMDLTCSTLLDYTCVLDGFSTVHLWRLHRTPNVAPAPCLPLLIALSPYSEGFTMQENAKANMPMECRRSPQLERIPNPMVKVLDLKLGRPWKSVEPHGIMTIPLCKRQLERLESKDNTPLGTRVGPPPRLASKHDWRRHLANGKTQPSGTGIPRLPDGFHDPTNGWKEETPMNSDFGLGIGPTPPMDQRGICAAEMIKDAQQDIVVSSRQRRKRCRSVPAKCTSPQRHKLRKHAFGP

SEQ ID NO: 962172 - protein, 115 aa, Homo sapiens
MTHDTAHDLCPSTGTSIIVQMIDHGDLKQNMQTTEQYKREQWRQLANTTIENTGKNENNTRPTTQYNTEIINDNTNYTMTHNTCHRQEPRHNINTQQPQHNNDKTNESQNLKEPK

SEQ ID NO: 962173 - protein, 173 aa, Homo sapiens
MTTRSAPPSPPTPTQHRGPDRDALADDEQLTSDPTRPEPGRRPRPGGTRPQPRAPAHHSYPRPATPPPPPEVPPDQTRQPGAPPPAPSQSPAGYPPATPHHRHPPPPPGATQASHQPAGTGPPRPAKGATPRARHTPAPAHQPHHRHRERRTRQSTPQEANTQTPRAPQPIPP

SEQ ID NO: 962174 - protein, 122 aa, Homo sapiens
MAYNLRAIRVYMGDSDSLHRAPYRCGTWRIGGPASEAGLRQQVTFITHVQWRNLVHCLAHTEVVATDPDERTKGATYTNSLGNTSLTEATRSDLQADARDERTRSIANHRTLSKSQIFTPLF

SEQ ID NO: 962175 - protein, 113 aa, Homo sapiens
MGDDPPTTPTLLSSPHRTNKPDLTPPPRHLRRHPLAPTEHSTGRQNTTVSARLCSTHAKPGPGATTYLRHSPQHPTVTLHHVIDAPPPKPTAYINATNAPLSSCQCHGTIPPT

SEQ ID NO: 962176 - protein, 139 aa, Homo sapiens
GLWSNARLSTSEPTIRDRSMWLDILLIYQMLGLLPYYWFISRDKEETLPLDRWVVGGHGTRSAARKDDSIRPIQGGNVRRVRYHDLHQRIDKLPYITPPLGGQLLPLWLTTTNYLKKVHTPTGGMNSDWKKQVGDIYNR

SEQ ID NO: 962177 - protein, 84 aa, Homo sapiens
QSTLRMRQLTDFSTRLDESTQDHEPLVWSLRPKCQTQWLEPYNATLSSTSSYKTQTDLTALITKLYYDICFRTLKLTTPTYKST

SEQ ID NO: 962178 - protein, 244 aa, Homo sapiens
GQGCWCVRDQWPARALWAYLQTTVLIQCTSDLLASQDLLWVMALLLPWGDNLSSMATWDDLWRITDASMLHGILTVINALNSLVKVILDKYYFLCWCMPLQLHPEEGSCVTGGAVHCPLGGAGRRSTVVKSFPEGPAVAVRLSKDRSTLQSAGLGHRELDSLPVVDKLHRSSRLRQACRQTGLQLRNPLSAACGALVPMTRICDEVEITDKQPGASHAELKLGPDSQAPWYTLNFYACGKSLND

SEQ ID NO: 962179 - protein, 80 aa, Homo sapiens
HTHHPTTAPAIGYVHGGVNTDEEHICRRYINRSIVGTSIPRIYTFQMMMANFIHVLLYVTHKGEIRGASTPFQYSSFFSS

SEQ ID NO: 962180 - protein, 431 aa, Homo sapiens
DPESRRTAGSRVDGFTMTLDGRQYNPVKAAAECCYATSCYSVLVLRLASGAAILRLWDRRSARGAPVMSPYPPGSGPRFPRGPWYSKCMTECVSILAVALSGRTPYETCAASNSAHEGLLCLQLSADAFHVSPWMQGFGELADVSTDKCILLERRKCLTPSARPASQTLYSRKPVDCENNLDGETIPWGRSNSNGPSHWTFLLTWFKFAAQLAWNPTLVGGPRPWAILEAPHYALLTVLPWGGLRSRTGRNPYLRLGWCEFVCPFQNSRTFQLGPFASQSVNTFRDRGKPLVAFYGKATEKFPQGPSAFDTKWEPLPRTNYPGGRDNLPSANGNQRTLPRRFTITNDFSPAHAGKISTGRRKPMAFPVRVPTYCKVRPEVTPRDQGPVVVVTFGGLEPVEIQEWHRGLQETHTIRHYNAPVNVHPEGDPIG

SEQ ID NO: 962181 - protein, 172 aa, Homo sapiens
FICKHESSVTMYQALWGPERRARAPWCSSPEAVAFRASSDLLGLEVKYGGPWMLLHGAHPPLTALVPILCADAGQELTMKAQLPDQKALSLVSCFSGEASYLATCLLDLLNYYLDCHEMRPMADLARDAPDTHMQEFILAMGFFLDPGMMEQITLAYKEQTGPYNSWRKQGL

SEQ ID NO: 962182 - protein, 349 aa, Homo sapiens
AKATIEVIQQYSRDRLIYTGSTASNMPSSSKTKPVLQLSKSATEYIGVVRPHTTYSSKLDPPTVQGHVLKAAGEEYGEGSAPGYPLTRKERDRQKQKSMSLLSQQPFYIAGATMSERAGYNNARDSLPPSTARCNQIVNNWRDDQYLDDSKPKQHMHEALKLRLNLGEGACKTRSRRSTQQTTESETNAPSWEIIKQKAHVDNADPANELISNKVIGTCEETEPIQKETIEPADHDQDTTQREAMEGTQAGHNIDPMSKEEAEEDEGRRQPDETGHGQKDTAKHEDTNDPTTKNPKDAHHRGVNPHREIPEERKPKGTHKKERTQKNKPENKGGTTGTPQNKKNAPRDH

SEQ ID NO: 962183 - protein, 214 aa, Homo sapiens
RPGSVTLCNCLYPSSSSSTTRHCGLDCSRMVLRYLVQLDDSEFRERPCRKLHADQEDIWTIDLAYLMHHYWREAPHSVPRPWVSHKGYKNQSFYRTHYVTQQETRVNQSVCTSKGLAQVAEVGSKCTVSVKDIQAHLAQGHVAIVLVNYGGAALVTCAPAHVKYCCYTTQMATTCFCRTPDYQGHFIVLRGYKRATGCIFYNNPAYADPGNVPA

SEQ ID NO: 962184 - protein, 169 aa, Homo sapiens
SLLRTPGGLALVLACPRPRRVHALPEVPVPALLSCWPWLPSGCACGCACLLQSACTAYTCLAACRILLSALLILCHLLCLPIFSIGLECCLLGGVLGSPKAGRMPAGAFRCACQPISRSVPLTSWVGCVVVAPKQRKEPWEGHLGVLHKAIRINAQTCGISMRFPNPLY

SEQ ID NO: 962185 - protein, 34 aa, Homo sapiens
HLHTPQQGEVPPWVESLPLGIESDSQTEFPLLPD

SEQ ID NO: 962186 - protein, 343 aa, Homo sapiens
MVMTPAFQAPSGLLMVDCGLTWWSWEVPAGPQGRPGYLHVFLTGLPWGEMVELGPMLAWSGPKWRCLGMSEGGGLVPQNVHPMGSPTGSHAGVQGVGPLVPRRVLLVPCMWLSLGVRWQIDGERLGCSGGTECQLMHARSGGACVGGMISRTKFGTVSLLHLMEAFGTLGPLVRAGPAVPPWGPPGPPGSNRSPWSSRDPPDTAVPRGSWETRARGNQGDRGDEGAAGAGEEGPDGDQGPKDPTACREHKDRHDGVRETVPSGNLDPEPWGPGDSRGKRQKRHAAKEPVRKGRGDTRPRAVNTTEDEVTRHPKRGEDTEEVSQERQTGNMHTDEGSGVREPEV

SEQ ID NO: 962187 - protein, 125 aa, Homo sapiens
MQGLRFDWLFAGALLAVRYYQLQLHCIMPHVNTEITEQLKGADKVAELVHILKHRDRAKGLVPQELSGVTVIASSTENWAEIKYWMTTKSNTLRLQGQKPALNEGRNLPDPSRRAHETYFSDTEQ

SEQ ID NO: 962188 - protein, 322 aa, Homo sapiens
MAGVRVVVEFQRAQSLLRHLTWEASIDILHSICECCDIHVKTMKMACAMSNDADASWNLGSLLCKCLDNAAELGGLLKYVLTLLEFHQQMAKAARLVRSLLDLFLDMEAATCGSECRAVFRCASECGQVREKNFLTPSFGGKTGVLCTFDTKRYQEAFAYGFSAAAGVEQDGRQSSFGGSTALRKQKIPCPEQAAESPSCITSARTTANAIYWPPKLQATLEHAVGYNPCSRREGLEKRRYSYFIMRPFDGYDSSEKTTKVPHIICRTMWQCKISAKTPERMTKALVNCDSFGTTVNAVGEKIERIYNRPGPRDKRASSLAS

SEQ ID NO: 962189 - protein, 275 aa, Homo sapiens
EEAAALPPTHTQRDPRYASSPGASAAATADRPGPSPPSAAMYHQVRLVLVLLPQDEFQAARDHRETGRDSSRSYVTTYHPHTTDHRAAALTPQTPAAASTSLRTPGGSSMPRAPLPCACGDRRARGADTCRTRMDFSLADSQSTTEIQETTRHQQRRWRLQELNDRFDQLHRQGALYPRQQAAHKYTCMGTTTTKQTTRAQGQKIAAMGGPSSRRSEDAGASPGQVAPVNQPRKPASRVERDNHGRRTIMAPRENARPSILRHQQRNPEAKTDVP

SEQ ID NO: 962190 - protein, 225 aa, Homo sapiens
WSRPSPVCLSWLAIVAKHVYCWAGIVVVCTAVNVHQHFLCNYLHETMLNVPWLSSCKLDEHQPFPEAPTTSWAPSLHLLGCDLCDGIACPTKPMLMCHVPLCDLSQCVFGLALPPAPTDQVKTADWLCSMPALNGSVLLLKRYNAKLCLFLVCCLCLTCRLGCARYQCMLTSHDPWAAPHMTDTHDDTGHEQSTYRDTNDHQAINDAASGTPRARAQDTMDERQF

SEQ ID NO: 962191 - protein, 246 aa, Homo sapiens
GIGLLPARQHGASTGTYGAHAHDSSHKMSALTELLPAATLRPSPILLTIFTDRGSDPANDRRPEHKTDVRPKPDGLHSHDTGPSEYSVKPFSFFSDSNLLTKQIGRLDQAGARRQGRHGSMQLRRGTVATHLGRQHPLAPQQNSHRRTANGEHNEARDKPYQAQPGPGLTAAPPTGARHERQHTITTDPDGLPTPKRTTHTQPTREHTTSERPGRLHPARHTTQSHSATHGAIKPEHSRSTAYDDP

SEQ ID NO: 962192 - protein, 34 aa, Homo sapiens
YRNYYRTTEPEKTVLTESKGLNSKLGTQKPRSTP

SEQ ID NO: 962193 - protein, 99 aa, Homo sapiens
MDLQRHPVWQENHPWLRNEAPCLLSMYPMKTKNLQEVISRADCGQKASYMRSLSIAGIISNFSTFLRPTFHQGTMVFLFQGFEVGQSFHLGDLGLSRVW

SEQ ID NO: 962194 - protein, 255 aa, Homo sapiens
MYTKLVLDLKVAHEPLALVPWTRCRRLQFPQECDLLLVVPKLTFPPCLLERTVRRGPNWLGCEGPLTTSTEVGWLFPQFVDQHTTPFFQLTFYPNVQIPYAYPLVPKRCHTDKEEHKHSCARHTQRSCRIINHRGGKKTRSEFENKETTAPPKEVTRDPPMAQNTPPTRNTQDAQDHDRNNMAQDTHQRAAPRGHNDAPSLQRNRPTKGNGCVKDERTDSVEIDPTCEIVSQRGRTPTRDDPQHARKASAQRGTT

SEQ ID NO: 962195 - protein, 458 aa, Homo sapiens
MSTASTPRGTYHVGTADLQLEAAVNVYYNECHRLAMYCAPAACALWILDALCTSVTPVAALCGPFWCMIIPVPVIILLLFVSMMVVLLVCNQSLCATMCVRHNNNVYVLPVHALCCETSVVGIGDLFCLHDNIAHVAQRRKAISLRTIARIATMMAFATPNDFCHYTDIHTISCGLGEGGVRTLKRAGYPFMVSRKFAGELNHHRIPPFPIASRVVHDKSKASTDRTAAHSGRHICFTATPAHKSGKPPNLVEKISTHLLAQVTAPTKRVTTLAHATTEQIWVTLVHGHLGAHTTDEDTHGHRQLDHKHTLRRSTVVILPLKRGAKTHNMLHEIGDSSVIGKHQWCSLQQTGTPTPDRRIITRRSDEQQRRWVDVATERQARHTYYPNDSPSKARSTYHRRKRQPPPRTTVERHDLSPRRRRDKNAGRQTRTNVTATNATHKAAVHARSTTPRCAKNV

SEQ ID NO: 962196 - protein, 33 aa, Homo sapiens
MGVDGSLKKRALQGQVEASGPNPGPLKGGVQQG

SEQ ID NO: 962197 - protein, 74 aa, Homo sapiens
AWTEPCARTPPRPDDHSQPSVHLLSPAPSVTSPNGPTAAQIQTACCSRPVLHCLTALPTIKYCLHMTDLLYTLC

SEQ ID NO: 962198 - protein, 407 aa, Homo sapiens
LAGLIHAHGQAARPLCLGTEVGAVGQLQDDPPGTLLTNNGGPGNWPPPDGIGFAIARRLAQDRAHVVVSSRKQQNVDQAVATLQGEGLSVTGTVCHVGQGGRTGSGWWPLAVKLHGRYRYPSLQCCCQPLLWKPNGCHRGGVGQDSGPPLAAGPSPDDPRPGARPWPHAGRRLTLVTRCLPQQPSVHLLASVLTMSVTQPCLRLNNTLDIELAPRNIRVNCLHLDLSDQLPPDAPAFASAQLDTLQATLRISRLRRPRGLSLPSRPSCARRSRFLSARTRWPAWLRNPEPAHKTAHTTHKHQQIGPQPQRTPPALTAVSLPDHLNNHEAYPHTRHAHEKDPPLATRAPHANTETPPIRPPTKYAVHTASTTHSGPDDERTTNRTTTESSPISQPEPTHATPHNHHHP

SEQ ID NO: 962199 - protein, 171 aa, Homo sapiens
KAPLRMGNEAPLTGSSPAGRHAAVTLMEPCGLGACRSCPWVPCHCPTAYGYRLCGLLAGCGGGPATRLHLAGGRLSPMPESAAPAPPHELAPRVPAPAVIIFYFLFNLLLFDMIFLPECWPDGTAGPGLPSVLGSRAADRPSAEGWTGEVASVEGSAWMAASGHTPLLSRC

SEQ ID NO: 962200 - protein, 85 aa, Homo sapiens
MQLQRTHRDAQHNNTDAHPLTAHEHDTTETTSFGRHEHAPHWRLKNPKATLRTLTSTYLGKQADNPHVTLYQARIPEHELTFDPQ

SEQ ID NO: 962201 - protein, 409 aa, Homo sapiens
MTSHSIETSENCSCDHMRTERYKATPGLYHRMTGPRPQWQGTFTEELYIKEKGFFRSPTTGPMAAVQLDPELAKRLFLGEGATVGTYLEHGPRRSRVMGYRLINYLGAYGSQDAGSVKHDTLPEQYHCPSDYRLLLDDRLDTCQEVRPISHRVNYRFSLAPSGRAGQWLQAREAPLQGKEVRPCTPRHPRVLEGRRATRGHKRYQRRWTELPRQHDNRNIAHALDTEGGICNIQPKLPVNGKGQTGQGAKAKKDPTYIGQESWERIETGVCLPWGQTAHGQGNSHENRRRACTQSNPPEEGQQEGEQALTQAGDMGPGVTNRKDAQETRTRNYQTKQKDRHSEIRSPKGRAQPGQRTTSTTGGARDKPWKTVSTRKKPQTPQESTSTQRTRRPKRKRGKRRKDKTDTDT

SEQ ID NO: 962202 - protein, 282 aa, Homo sapiens
RHEELLVSSCRSVNLSPLTHSGGFIINGLPYGTFPRNRAKGGRPEGSRTLQLLPLGQKGGCLGSSRAAVGQAEAPSNMAQGQAAAGGARRGRAPVSSSEAARHHIEAVENRALHARAWTLAEPKHELQEHLVEWRDHRRYKLLGRSPLNDAMMLRPPWEPNVAQTAALKHAFSNAAQQSPGPLWLEKPLTPHEERVPGQGSFQGGPLEKSRRGLTPNSASVAKGCRYILLEGPRRGTRAPVGRQVMGNSEPGACPSEVEGPADEIASTILDLGKRALYEWKT

SEQ ID NO: 962203 - protein, 259 aa, Homo sapiens
MESDCGRGAQRDNEEYSHLMTPGPNGASFLGSIANTLDCFIIGNSNTLKPEDEALIDVGKIQSSSRGRSPKMPDVTDSRAPRDIGAPLSIAVFQPVRSYVDAGGRDLAIHDCGFALGTSALCDQPLLFSPALTGTRKRTMESTANGLSTPVPYLGTHVTSPRCETILVPIKGGFPPTRRRDTPRGYKAHARVVACRHYGALTTLSIRCHTPHNLRSLRIQCLPKSHYDTSTTSRIIVTKQTSGSLAIATRCTVRVSCRP

SEQ ID NO: 962204 - protein, 168 aa, Homo sapiens
MSSRMGAVCVTVGAFRPGPSETGVSVVLFEPADQPAFPGMDSCGPLGLQRVGKIHCRTLRRRPLSSHSALGHTARRCILRAVITLLRYARSSICLPTEPPRMRSRCELPRAPSLRVGFVVRHGGSSRRASWDAIDGPSLIAGLRGSAFFASTWGCPCVSAVFSPCILG

SEQ ID NO: 962205 - protein, 92 aa, Homo sapiens
MCSMILYHAHEGVTNTFAHLYSSFALLAIDIREDTPFTVNGEPLTPPALACSELDKYHSNVLTTICKCGLAQPDPNLRRHHTCKTGINWAHW

SEQ ID NO: 962206 - protein, 356 aa, Homo sapiens
RYRPQPKSREILCCNKDMSESGAHSHIRGTGGWTDALEPRAGFSKAWWVSWRHWQGVLAVVLEMILGMWKIAWSWQSLFAGQPGHWWNDCAICHVLHVMQCPWALTTANSHAICLEVKSSPWMMSNDLRLLTAGLPVLVHQAVLHQGGDSEIIECVEDGGDPGFDLTMPTVDGSKVGKRDPSRPQRWRPIYDLGTKMIESLTQGRRDVITIEQRETGQDLQRWSRSLHTDARELRAMGLTKNKSDARCQMGKPKKSKEVGHTVIPATRIDGQSNIIEPRGIRAPHQVTQGRQVKVRNRQRQVTEEHERRETTGRSTEAIAKYESNVTSRANVDGLQDSAHKRTDECRKSLRTKQDK

SEQ ID NO: 962207 - protein, 270 aa, Homo sapiens
MMHGPSRRDVSHDGRIVDRWQTIVIDRLAYMATGTGTVLALGRPDPLYRVEIRSVNNLTDKSSPFSDLELWTSGVLTTPCEVYRAKSARNTPFHGEPYTTKQSPPEGHRELTINPSSMQKSIEKQYQPTNKDGPQGRSHRHCRDTTWSTLPASIQLDQSNTFPRGPRRRQRGRNTAQHHPKPNLPGTLTTHGSTATPSLDQSKRRNPKREDHTPSGEQQQGAKPEHHARNEHDTTQIPHSQTTTTQHATNSIKRQEETTQAPTTTEHMST

SEQ ID NO: 962208 - protein, 529 aa, Homo sapiens
MRKRRKKRRRRNEEPQQRGQGREVSHALTEDFWTRNTWESQLSRCMVLPRRILQTVVQAFLVLSHLPGVSCLSLQGPGDSDVCIDSSHDDKMLEHREEKRCAATERFTERGRSILRDCRGTNSPRLVKRDWQGLHGSGEVRKLQHGKCDETALISKTSRQLTIRDFIESNTFRVYTKGVASRWHSTEGGFMSFHRTVDTRSKGFRKGATRWDARIALVSWGARSVTWRRGLEKLRINVVVCATSKWDPSICIPLEKGPCIAQHPRVDCWLRGMVNRVGTAIMARRNHVGLTWVNCPGLPPIRDRGCNDDSLPGQATGEDEPNVVAFTETSKKAPFIPSHFSTFGAPMGNPHCWKALWGARVGPSGGLENSFEGGGTRHVTARFLPFGGHSVEPSSGGPNKGAEARRGSFHWVGFPPAWTRSPPGSQEGHTANGGETTSRLDREDKQGTAALFAKRAHRMDHTHGDQGESTRGAETNTVDKPRTRSPRRSPGQPGVSREEERIGGPPRRSETNGGTLKHEDQTTVYTSTT

SEQ ID NO: 962209 - protein, 202 aa, Homo sapiens
MRAAGVALGHLLAAAGCRSCPAGPCAALPWLLPSQLAGLPQREPPCQHCAPACRPACDAREQIARRWALPALPVGQPWLCCGCCCWGFYAWPVCLGPVWCAFAGIPRCCVRDCGCAVPCLGGPLKRDRCPWVCAELGLSASGRAAPQARRMLATVCHGPQKTFLLRPKEPISPPYDQVQYSGKPSQTPGVLVTFVMVFKEPS

SEQ ID NO: 962210 - protein, 236 aa, Homo sapiens
MNSRGDFYDLYGGEKFATLTELVEYYTQQQLVSCMTADWNHHATYKYPLNCSDPTSERWYHGHMSGGQAETLLPANGEPWTFLVRESLRAACITSVLTECSLTKPMLAQCYPDQGQPDQGHVEGGRYTVGGMDNVGQPSRTIDEAIPENRCIAVVLRRHWTTVNKRTNATGLTCRVTFEDPAYVGTVYHKRVRSRELRHCLCTASGSEIFSTAGVTALALRRGAGLLNRRYPTEPP

SEQ ID NO: 962211 - protein, 98 aa, Homo sapiens
CDLSLETLAPLACGRDWRHGNLTAPSLPSKANSTHAHVRSSERGVSSSMARVSACVWCGPLSESWVFRPEMGLIPPGGVGWTLETLIVMWPACPKALY

SEQ ID NO: 962212 - protein, 125 aa, Homo sapiens
MADRRAHGEYYDGVRYGRRGSSRGARPSREGGHRSAGQQTQDSSDYYQPSERQKAGITMEPCDQSESPKIKWWIGYEGRMTACEQYCPIRVLEPRERISGEACIMPISHQDLREQGDPRIGTQDA

SEQ ID NO: 962213 - protein, 368 aa, Homo sapiens
MLERPCYRTRAPTELTESVGGDHAACAGHSSLCLPLPAHTWIGCVLMHPNLTKGFGSDMAPRTSSHFWTLPICRTDSLTPSLQEQLCQLYPRLKMLAFGAKPDSTSAYLTSLLAFQSHALAVPHEMKKELLSKTAECLTVDPLSASCRGGQLYPKHLSQSSLLLEQIAQLLGGRLPETVRGLCRRPFTSLKLTNHGAAAEGLRSTQDVVPVTWPASACRSRCRVLGCLDAAPPVLLLFAVASCAWSRSTARSSPAYCPIASISGFSPASNKRVASYLKLESHAGGGTRRPKNQQITAAPTYRLGPKPEYIGQGLTQVGTTHTHKQTHPRITQQSTDQGADSPATKNGPTSPLLSASLSVPPHTTTTTT

SEQ ID NO: 962214 - protein, 88 aa, Homo sapiens
MAPITTRTPWANRSQGYEDFYAGPNMQQCTSIMVTSPDERYSIALKPKTRTTPLQNIPRITAVIEGQSCEITARGADLNSLVRVQVAH

SEQ ID NO: 962215 - protein, 367 aa, Homo sapiens
MSVSLVADENPFSPVWTCQSEDCFILDHGKDGKIFMSRKGKHGKHVRRGMAAFKTASDFITKMDYPKQTQVSVLPECAGETPHVSSSSSRTVLCDPDQTDGLGLYLPFQPYRQRGAGALRRRHPAHLHMPWPPSTAWMTMAQARNRYWRIEGTNKVPVDPATYGTVLWRRQLHHTVTTNRHGGRQVQIIYNWQGAQVYPGMRSLHLTILTAQLDEELVEVPPVPRDQSEAKAREPRTNYMKPDRVGQHMNHSTKDGTHPTRAGTRKTQSTHHGLNTKDKRPTRAETNPGNRHGHGLKGEVHWTHKRTSRGAVKSPVKQHNRCEGHQTHTKSTKHGGTGEDTGCNAAHPLCVEKAEHTNQWEHRKKNA

SEQ ID NO: 962216 - protein, 242 aa, Homo sapiens
MVEKTSYTRCPCPMPNFHSHFICVIIKYSTFQKKKKKTRNYFSLSLGAAPIELLLQAFRKRRLLSVSPSGLLARKKVSGLDPQCEAQVKFANVPTSRSADLRKLHSKIGLDSSPQRLVTGSILPGLSIRRKHLWARRKGQGTLGIRYRGRVQPIARIAREGSHVDEEKGGFGARSAQKEYRESLRRFDRHMCFHSLYLRVTGELCSKTRRILMEPLPQAEEADKARKKLLDQAEARRSKPKE

SEQ ID NO: 962217 - protein, 151 aa, Homo sapiens
MAETGASIKQGVTLPITVLQPEGPLAVLRDLSPADLIVPSIPSVPMLGGPRGQGGPALTLGLAGGSNQRVQTPQGPSRWTTGWLDAGGPAMVLGSQGIRQEDLRQHDQETMYSQNQMAAGLEHEKSGETLMKRRPHDLSLKRTRRSSSRPD

SEQ ID NO: 962218 - protein, 151 aa, Homo sapiens
LARGPAVSVEGPRRSPAARAPSARPLVDAVACEAPTPAGRWQAVPGGPGANGTRRVGSGSAGGWRGGMACDRGDGDEAFARGTCVRGGGSSSSDRPCAGREAEPGERRCALPRPPLWPRQTPSRCQTRPRAQHPRDLRQDYSTYSIRESRE

SEQ ID NO: 962219 - protein, 135 aa, Homo sapiens
MGCPESIGFQYSYVGMKRTRGAPFYNTPSVARVVPSTGACGRARIGTTTWPRPAELGLAPRHLINSGARCRASNTHQYYSGVPRQLSHDKPTEQPRSAPPLLLRDKQQTAPLHSIPSKRGRATGNTREIPPQQLF

SEQ ID NO: 962220 - protein, 329 aa, Homo sapiens
RGAYKDSTSLLSTAGLRYSVLSEPTHFHLGQTNRTPEFLRQISCLARSQHLRVMMDSVMFESNAIAYYVSNEELRGSTPEASAQVVQWVSFADSDIVPHSQYLGDIPTYGHHDTTTNRPHENAKEDVRRILGAAGLHYYEDEDLIWMGERDDIGLTSQYSLEPCEDGLYKQVTRDLYLIPTRPYIHTTTQHGVRYHQHDNENKSTKYPGGMVSGGKVKNMAHEKRLATREGIASTQGSGQKNPNPYKTRQQTTGHEYDKGGFNRETKHGNDQTKAPPQVAYERPQTRRQGTDQPKRLGTLAPPWQYPMRTQDRGKTNVAMATEWSTTQR

SEQ ID NO: 962221 - protein, 179 aa, Homo sapiens
MPCFCLNTALCLFKIQIPNPSHAHKAFLLTAFFFPLPVPFTPPHFSFLPGGLQLPLVGLSLLLVAESSKKQPTPSRPVGNLRVSFPPDISFPQYYSGWVSLLSSSLRGLLSPDVVTRMDNLLPETVYLALTLILLRQLFILPATLPDAFYMYLSSVPPIECKSPDGRGLILAHCRIPFV

SEQ ID NO: 962222 - protein, 261 aa, Homo sapiens
MAGSRQGGNRTRMHHGLGRRGGNLPAMAMRPFFGIVPVLMDEKGSVVEGSNVSGALCISQAWPGMARTIYELTTSDLWTPTYKAYPGYYFTGDCGLTRTEGGYYQITVAVDDVINISWPTVLGNREDLERPLSGRTLLEQQESCCRVGYPQLNQEEKLPSPSVVVKRSGGDLTMWWCTDTSSPWMATKIAKMAVPDEILGGETVFQKTRSGKVMRPAPEEDHHLVRPRSLGDNYHLGGTPAIIAGDLSVYQKVQDKQAVLS

SEQ ID NO: 962223 - protein, 69 aa, Homo sapiens
MGSPYSPELLHQVLLAPLTPAEETKDGQTVSPCPLLPIPDTHGLPRLPQEKVTAVEEVHIDGAIRATYQ

SEQ ID NO: 962224 - protein, 314 aa, Homo sapiens
MTHICAGTVDSAWCSNGETKNGGGGVLVTICMMTPPMCGYVEHYVGATVEIPLMASVTFNDCHFAGAHHVMNARVRFYKNWPYTLTQNGRITKLLHTPHGRMRHGQDRSWSKALQHAHEECTAKSYRVIAHTQDAPASSWRKNQRAHLMEIQCERMHLWPHAAWPGPRLRQCLQHSGPCDPRVLAPAALLRRPRGAPGPGLHTVYTGDWHTKTADHARRHECLRTVPVLGACNQQIVASCATHGPKGYLSPPCDSHDTYTDCTVEANHGTDVTENLTTDICNNRQSANPWLYDPSVRPKNLYSDVFGQNVYHNT

SEQ ID NO: 962225 - protein, 104 aa, Homo sapiens
MSSSRLQVETLYLDSPAVIHLLSPTFLPPSSLPPFLQIVDSSSSACTLDSFFPFLAPWDSPQDCGFKDHQPLTLQALTVESGRCSDPPVFSLAMYHGFSFWSCS

SEQ ID NO: 962226 - protein, 252 aa, Homo sapiens
EAPWVGSDSLGQRNGHNDDEQYAWRVSCWRYLHCCVLTMVSPLAGEYQKMILHLKEDQKEYLEERRVIRSSELKHSRWFIGYPISPLLWRRNEEEWKVSDDEAEEEQWVRKKREDKDDEEIARTVIEDVGSDEEDDCGKDRRRRKTNEDQEMKYHLSGHELNYSKPIGTRKTLMTITRKRSMDEFYKMPHYMTGDRSDLDSSNGTFAVSKGPVGNVTGQQRIYFLVGLPVDRLRGTELSKNDIKLYVRRVSS

SEQ ID NO: 962227 - protein, 304 aa, Homo sapiens
MVLVSWPHVVRPWWASCSWLAGKIVEMEDVGLLFARLGKYILCCLLGHADPWRSWYCPSSTSSCTRNRNPYRFLWGIVTPLATAFGTSFHVSAHAAADLMMCVEENIGVGKRIRRFILPIGANVTWTGSQRSSICWWSAVFIALAHVQQILCDFLKIITILVYGHERPSVRGEPRASLLGRCPHSGPSSSKQSNLPVDHISLILAVDWLIDGPVTVLKCRKVTLCGQGVLQNPVDRRMSRSPILIDPVKSELPWIRALPWGRNPFCPLVAGDASGTRGNPVPGIHLGVWPVRNRDTLVLPGRPR

SEQ ID NO: 962228 - protein, 109 aa, Homo sapiens
MRVYEYPDLQTLGIRYTSYRATAAVLPEVDDASRGHGGVEGWRAGHTIEGCIFFKTAIISHFKGGMYLCSVHVHVFERVCVVCKWVLGYVYCEHVVHSVKPVHVHVVGA

SEQ ID NO: 962229 - protein, 290 aa, Homo sapiens
MTSHSTITAVTMNYHLPTMAYQHMEATHFLLSHYPPATPGTPSSVTFAFADPLCPVTLLCRRTCPTTSAYLFTVSARGIPLPNTRSMPSLLSWAPHPVSLALAWTPSTPLLPFGNPLCFQTNRLHILHAHHLASAACCTVTGPAIAHLWHLAHLSPPTRLGGPPTGTIPPFGIPPLALHYTLNALAYPEATFAAASSRTCPLLPPPPSPWSVPSYPYATGALLNTCVPLMAPPLPCPRSCTFIRRSPSLRPLPQFSTPAHPRESSSTGSPPIACVVSPPLISATCPSRHI

SEQ ID NO: 962230 - protein, 77 aa, Homo sapiens
MLYGQKKFGVIEERGSGNLHTGSQYLWSFEGCWGPLLSETCLVWTREQKEMSSLLLHSVLSPRAALDQMKTTRVRRG

SEQ ID NO: 962231 - protein, 128 aa, Homo sapiens
GHKVVDEGPLERDFLKYGQRGIPRLLALPRGLWHAGDGHHCCPRGYSTAVQTGRSCFQRSWCNNSVGAIHGALIVMFECPGLLPLLLVLLCLMCSCVVCLPRCPPVLPCCWKTLGCTSLSCNCGCLLA

SEQ ID NO: 962232 - protein, 196 aa, Homo sapiens
KLIKGPIKGYEAGFESERAASCCSNRSWSPDPELHPRHGLVPSAILHNGSAGGRRAHQQHYAACLPLPRGHRCCAYGQASMRHRLHALPSSHYSPPTTGFFYPGRTCPAAPDTGFAALRAKGSCFMDNCLETNPAKAGGCRRRAFPHVEFLAKAFAHHVFWSGFLTRRFLSNKIKFQFPVGKVHRFKTLRVLVPDG

SEQ ID NO: 962233 - protein, 221 aa, Homo sapiens
MLSGTRGRPRWRSCIECGSRYKQSNMLSSHHDKRAAAVTCPKSCQTAPAQLHPVVKTVEGLWQPRRMGSRRYVMQCFKPKDGQAAVNSSADSCHPEPLQVTGRCASSAHEGSSQEDLLYSTVECIRDLLVDHDIGAACEPWLTSYKKALRNWINSCPDQGNADEAPSLGQLLGVAEKTLAPSISRRSVSEMVATCYKVPAAFGYWTRRVTRLYGTEMCAWA

SEQ ID NO: 962234 - protein, 172 aa, Homo sapiens
MCWGRVLVSRVSISHSVVSPVGISLCGGRGVVAFLLLSVAFFFSLLSRNRGSCGDSLVLIAQSVGGQRNVGGSGCGRGKPEAPHVCSPPRGNRGRAPPAGPSQCYLCSQEVAKNPQCGSRTREYLPELAARPFFFRGGHIFISDFHSFPDPCLLHFYSEGVNRKFEPGQSDG

SEQ ID NO: 962235 - protein, 165 aa, Homo sapiens
MAGGAGEKKREKKKRQREGTRGHAAQARENRERTTEGAHHTKRGRTKNIQAPTNRDIPPRILCPPARDQQEQKKKTKKEQKRRKTRKTTKQGPKKRERTKRARKKAPPAESEGREQARRQEGEQKQRATRTRTKDTRKPKTRKGKGKPKKTEHTEKREQGETKNK

SEQ ID NO: 962236 - protein, 133 aa, Homo sapiens
MTLCPCDMCRGVEAVPSLTTCVCVTLDATALVCISKSACSFLPPPLSVGEMCEIVRNTTTSHLRDVLWPGMCLIDPTCAHSVISSHLYVCVRGRGVGVGIRASPLLFSSVAIFLLISLSTEATLFCVSLSYTI

SEQ ID NO: 962237 - protein, 235 aa, Homo sapiens
WKGSLALSPGGRAGAQSRHTSAFGVQAILRPQPPELRGTMGACATMCPANFCVFLVESGVFTSVGQEWSRSPDLSDSTHLRPSQRCVGSQGVSHCGPGQPVCVSFQRTSAPGEVADLTSHVVSLEITPPSPGDSLFPCSLVLGGVRGSTVQVTRAPMTWARQDDLQSPYGGESSGDQPSPIRSQVGAGANFAGLSQDHQSASSPLGVGLASGTHQALVSSLGRGVWSRLLVFRGA

SEQ ID NO: 962238 - protein, 148 aa, Homo sapiens
MRIQGGNGIYKGFCLDVIRNNYECELQGAKQHLESEKLLLYYTLQGELQERIQRLEEDRRAVDLSSEWWDDTTAATRVRAPESWDSLPPARSEEGTLWFLAHNIVVLLQEIEILGGLASIKEVCHLCPLREKLFGLDLLYQPGDLKDT

SEQ ID NO: 962239 - protein, 410 aa, Homo sapiens
GSRLHGVAICGGRTVQMKASFNTICENATVVRRYQGKADAPEALVVHMAPDICDYVDSRYQQWMERFEDLTPSTLDPGMRTVPQYHNLRSHKIQTTAQTSSTPDIFPHDSPGIPADKKEGPTISDAHGFRVNASITVPESDPRREMAEEDAIYYYADPEEFIVEAAADFPTFQQTRAGVQEECAGRHQTPAEKSKSEPEIIYHWKQDLTSRCTTRMSDAHTCHTEAPERLLHNMNMMNEGHIYGTNCARQKREDQVEKGTMKKPGMQVQGGPNMTRTISPHGDRQRNHAAKDDSGTRRLQGKTVTTIARQDAHNPVKHGPTDHTQRPEAEPHYTIGHNASRTWPQPQTSRKKANKEHDTEQRQPKEAHTQTMKYQPEEKAQQANYEDQQRDTEQHERILTASRITQNNSR

SEQ ID NO: 962240 - protein, 140 aa, Homo sapiens
MRTTFAAQDSFEVPASVLPGISYSASLKEEGLTVASYEVCQGERSSNGRNENDPVTVFAEGRVIDVQVKEMAKVRYVVSEPHQIPSVDSTPVSVLSMSEEEHERVRKKYHYSVVEGDWYPHHPVKSFKEMRFPCSHPDEA

SEQ ID NO: 962241 - protein, 260 aa, Homo sapiens
MIRAGRIPDGRKHCSETQMEYLENCIGGKHSDFCRHITVDVPLTGYFSWCLQDLQANMCGDPGGTGEQESLLQAPLKDCCLGKGWERTGALGEEECTLPWRVVGEQEPGNLNELQALSCCCGETLVPVYEEMTAEDCLLLVAFGYTLVVCRQQKQAATNAKSFFADQEPWTVSCLVDDEMKPRADRKVKYQSHQRWDQGVLHEDWGEQRRGSQKAFLLPGADGRNGTVQALGGPEKCAPEGFGPENVLFVERPPFGSFHT

SEQ ID NO: 962242 - protein, 108 aa, Homo sapiens
GYPEKERDLPRDTQPPPSRGHQKPDRQIRIPGSVTERLLDLGGVTKCEPWSCYPEKRPVERPPLGVVKVKLGRRAPGPGWVGPGRPREAAAHVRSLAGQNLARHASDY

SEQ ID NO: 962243 - protein, 36 aa, Homo sapiens
AVWGRVRSRLRAFPERLAACGAEAAAEDRCVQASTA

SEQ ID NO: 962244 - protein, 94 aa, Homo sapiens
PPPISTLRTLAPSNSSILTASARESSARLLESSSAALPQDCKNKPTMKRSGLCAVHSLPTTAGAVKHCAHEFLWVGFSTVSVVVPSLEIQLGSS

SEQ ID NO: 962245 - protein, 45 aa, Homo sapiens
GGKLTGGGTDCLGDNYLEGALTDSGRSDLGGTGRLGAGSERRAAA

SEQ ID NO: 962246 - protein, 58 aa, Homo sapiens
DINLLCVPAQPTLIIMSQAIYSLMGNNTTNGPECTALLGFGVCFRGNTTKTCPVRLVL

SEQ ID NO: 962247 - protein, 139 aa, Homo sapiens
DYAGAGEKENLERHCVNQVEKFMELWNKNDEFRKEYLRCNMKSTLRRFRTLDGRALGPDEEPPYVGNFSDNRVNASAKVNSVDTTSALESDFPLIAKKAEESSKKVIELKNKTALVQNQKQSEITSKSSLAEPSGRIET

SEQ ID NO: 962248 - protein, 108 aa, Homo sapiens
GPLCFRLAACELEGQSPRPGGLGGSGCAVGCASLLQVGTQRGWGHEAEVGLKQEWAVGTSCFSCIRAVAGMPGDYRRHLSRLRFRERCGVSRRSPQCARRFRLAFQSP

SEQ ID NO: 962249 - protein, 53 aa, Homo sapiens
PAGSASLGALMAAQCEDFRAPSLWLSFTPQFMVAPVFAGSTSADSTIKITIQQ

SEQ ID NO: 962250 - protein, 99 aa, Homo sapiens
QLQFRKNKRPSNSSHATGEADNGPCWEPLNRPLRDFDCCFAETAPPVSRKQLRSVFVLILILILMAVRCISLEGAMRQPGGKGSPEKLQPAHWEECALG

SEQ ID NO: 962251 - protein, 102 aa, Homo sapiens
MSQRQSGFLGQKDQLTVVQQVSLKDATDLGDTKEILSFSHLRSEADDRGYLHFTFPFRGGHSGDVRLQNPPPEPPKVVNDKPPQIPRSLLSRSPSAVMSVPG

SEQ ID NO: 962252 - protein, 78 aa, Homo sapiens
LTELGRTVFMGKKLDAAGDCTTSCMELKVQHPVYSCRVRPVLPGEPTPPLCSSCFPLALVWASDPPTRLASPGLTSGV

SEQ ID NO: 962253 - protein, 241 aa, Homo sapiens
SGTVGECREKDPNARDSLSVHKNVTGERVMCNDAGTAVMPRVMMCVDVCCNECLSLNPCRCMLPCACGHVDMGVWVPCLLGWLCFCPRNPLRSPWLCHTHASITMHACMHGRSNLVMHRHVVVEVVMACTCALMDFVVTCDILYEDIELECSGGPLTRIRHESAGLRQCQLRAREQYKYFPSSALTSDCPSDVPCQGPCLAHLPANSRATMPSQKLGRIREDEGAVAGHQQSTEPPESYKA

SEQ ID NO: 962254 - protein, 64 aa, Homo sapiens
MTPPTNEGETDTRTNEGTRTTNTGAHTQLSTASDTPHPHETATNQKSTRANGTNPHNRTPPVPT

SEQ ID NO: 962255 - protein, 131 aa, Homo sapiens
MGQQHHSRLSLYHLKSITSRRRTGKAAYYRVATLNKSGGHEGPQRETTQTREGGESKGGNQIVGPHEVFNDSNGGHSVETTTTQKSPLPEDPIRRDTCQRQYWLGGGGNPGTLVYNTVRQGSRGSGRGLEK

SEQ ID NO: 962256 - protein, 151 aa, Homo sapiens
MCETKKHSVLCADPQLTASKVDLTPKVCRAGHRALDMLLPCAVPSLLLAVCPCSHLPAPQVAELLSAVQCVVERSVYGVPALLVSSPKSFPFKETNMFRGPVFCPHLSGDSIRCMMWMPSLLSSSLFGPPCGERQKGRAPDAPLFHALGAQ

SEQ ID NO: 962257 - protein, 105 aa, Homo sapiens
MRWCDELRRARCKFQGGTTVLVEADSLTSISCGICKQQFNNLGYAFCSYTSKVACQLTWHIRSSPQQLVQFVIGGNMCLQPDSDQHQKHHLGDPDNHSSAPEFVL

SEQ ID NO: 962258 - protein, 237 aa, Homo sapiens
HRHPLVCPALPVTAAVAIQLPVGAVVCVAPAVCLVPRVILPCRFPWGCLLLQMPVLGAPGALASCPLVQQECACLLYILSSPASQSWENVHGWGVWKNKMENVLAPCRSASPTLASLACAWWTSQSACHEREHAEVRELRWARVQIPGWHNVCWWMLDSRHPYLACIFKQQFNNLDAFVAHKQSGYPADRHILQQAPARSSLYRRKHVPATQTQTTPEPSPRRARQSQFQLQNLSLG

SEQ ID NO: 962259 - protein, 96 aa, Homo sapiens
MMCPKPLVHWAQGPQFLHYCGRRTHWPYLTCLSQIPSEDQQDQGAYKGTITGSLTESTRGLNRGTVGTTGGPISRELTQELGQTVQNPEVTHRPAM

SEQ ID NO: 962260 - protein, 333 aa, Homo sapiens
PPFFFLCASSLLFFPLPGGGGPGGPLGGGPQGCPPFFKEKPHPRVPSKKRGGVAQKSTGKKRLPTTLRHSPHPLSYRETGKTEQKRRTYERVDQGQREKKTGSPTTQPENTNTQCTAKQKNAHEHHTNRVGGPHHEWRRRDVTRPHKRNNRQASKITYKTNISPQKENITNVTHTRKYTTYQRERPTTPLYVRDPRKNPAESEETLTPPQRGAFCGTHITYTQNSPLTSKDKRGDKKHPTRGATSTQTTFTHENDNDGTDWGDKYDAGQTGTIHKTTPYDDEQGPRPVSTPFGSDSTKNKTERHSTYQNTFDSAAAGSELTPADNTRDIELKK

SEQ ID NO: 962261 - protein, 278 aa, Homo sapiens
NCCAPPQEYRLEILEVDVYPGLALMQDRFMLTDKGSQAEVKIQLNVRTLGHCNAVCCAAPSMIHGAPSDGAVSRAAAGMLKLLAVMCDPVARIPLREPALIWVLLVCIGAVSGGTVGVTAPVVEVTEAVAWVWEPLRLAPVCAAVIVVLEVAQEVRIACAPLVPMLAPFLEAKQSVDWAVGQCLCQGPKGRRMKLAGALPRQRARRVLPKLARAYDTEYFAQACSTGLLLGAADISSLRPEAAVWALPVSTSLSWRLQVYDDELGDCARPGLLNRGPF

SEQ ID NO: 962262 - protein, 33 aa, Homo sapiens
MPYKVIGIMTPRLRFDFTGAVRFSKSEPGLSVP

SEQ ID NO: 962263 - protein, 175 aa, Homo sapiens
MLVTASELSSMLAANCKEQQLLACVQRAAPASPLAEAPLRAWLSAGGLPRAAAAHSEAASRDRHEGHLTRVSHPRTASDACERRFCFYQRVSKVTSEAMAWHPPGLVGPMPQLAPTDWRTPPVLHTVAFRQAHSPSPWLVSSSCWWSHEAFRVPPFWTGTPEGGRTALTAPSRVV

SEQ ID NO: 962264 - protein, 118 aa, Homo sapiens
MAVTYSQYSPRGQYVTAQIEGSYRGASGAYSTPQPCPDRSGSYYNGTADITLRLHLGTIQRDLAKGGTVEYSQREAHAGPGPNSTSTGQLASYSGHSDRQRSSQFFPKYIVPQGPKHP

SEQ ID NO: 962265 - protein, 102 aa, Homo sapiens
ALPPPPPPPPPPPPPPPPPPPPLNFGRSRPGFCAPSLGSALSLLVCDKASVRHCGENCGLLCLSVPMCVLVHLHCWSGVAHFPAAGVPVRNLGILCVLDTLP

SEQ ID NO: 962266 - protein, 211 aa, Homo sapiens
MRLQRSFVEHSAAVTAVQAGTGTGRPLESRGPRSCSSRELRAGCAPPVQKDDPVSVLVGPTQPVRRYVAGPAFLGNGAGFANVLRDLRTRTPRRCSRARLVPKSLLLKPHQREKMSIGKSIHRSLAHQHVVGFHGFFEDNDYRVSWVEELCRRRSLLELHKRRKALTEALRPDTTYVQIVLGCQYLHRNRVIHRDLKLGNLFLNEDLAGDT

SEQ ID NO: 962267 - protein, 257 aa, Homo sapiens
MGKVKVGVNGLMVDIGRLVEPVSAFNSGKVDMLPSMTPIIDLNYMVIHVSNMIPPMANSMDTVKAENGKLVIKGNTHHHTSRSEIPPKSSGAMHGAEYVAGRSTGRLQPPLEKAGGSISTGQEPKRDNHSYMTPICLECPHCTTWRVDTSEKYRQTAIKITQQMPPDTTQHDDRHPVANGTSHEQTIDEIRKNASSMTNSTMPQHIAPRKDLVDRTPPRKTEDRCTSGAHPEHHHDTLRKTPKAYETKPTTKETREH

SEQ ID NO: 962268 - protein, 213 aa, Homo sapiens
MHAGHSSPGDCHLRHAEFSGEACMARAMVAVQAVQGHEAVSVCGTWTLRGCAEHSMAMRSGAHLADSLVHAAFICSVLGMAVVLAGSRHATCNHRGRRPGASRLCLLVPCALTWMMQQGSPACLECVSSFRSTSPGTYAYRPPKRAMEALLKGGSRIAQTDLAPEACVSRSRHRRGHIRTRAAGLSQSPWLAIRQSVPLGSMWSGGNCCPVVG

SEQ ID NO: 962269 - protein, 33 aa, Homo sapiens
MAPITRTQTLDLGKVNKHRYRESRGPQVNNDGA

SEQ ID NO: 962270 - protein, 103 aa, Homo sapiens
MVHIHQTRNQRVSQVGRVCGVKERGGIKPTQWAQCARGDTPLGGIYKRGWGGSVCLQMKARNICDDEWVTTHQRRGGNIISERSERKKHSCLSERKPHNVCFV

SEQ ID NO: 962271 - protein, 151 aa, Homo sapiens
SILSIYGRNQSGVKKKGNEVWGQRGGGCERSPSPVRGWWVGGEGEGVTGKTHGSGSSFWMTVWYGFLEVLGQDNGSGFLTGQPTFHSPDRWEVNISSGKSYLGRGHIVFQVNLLREVHLARDRGENQSTIWAGGARKGEIQFNGRQHVQGL

SEQ ID NO: 962272 - protein, 211 aa, Homo sapiens
MTWRSPVPGLEDVMPELRPEENLSPVLNVDAGAACLACVALVCCPAAMAVPECDMLVCREAGGCCAVLPVPNDVLACSLSARDTTPKRLCAPRRCRCDADAPEPTNGCREYLGWGLAAELQPEELRVYPVCGGLSNLLFLLLCSRTTCPAFGEEPREVLLAAVRSHLAVLLDSLVLESVMFAILAERSLGPQLYGVFPGGPAGTVHPSRAL

SEQ ID NO: 962273 - protein, 86 aa, Homo sapiens
AFHVPTPTVSEIWLAACECWSPENDEYDAVALELLLANGCWSSAPTCPVVFIECLVNAWMLCVAMTYTHVACPTDLVLSDVPCWHY

SEQ ID NO: 962274 - protein, 228 aa, Homo sapiens
QCKYPMKRKFVAAWHLQSLKLYSEFLTRELAEDGYSGVEVQSYTNQAQKSLSLAHQNYNCFLRAEGPGGIRAHCTCCCSVTVRFGFPEGQLLEPLYACNKGGHLRGLVCHSAQCSRSLRLNSTSLGRALAVAARAVLVDVRARSISGRSWGQKAARLVAGSVEDSDGQHGLDSMTGLVGWPDASTSGGPWLLYSRLTLAVRHVLAQTGCAGAHGGLIMLPWDPAGTIG

SEQ ID NO: 962275 - protein, 124 aa, Homo sapiens
RKLFAAGNLDLQQKSIAWPTQTVSLEAVTGWCTGFSLFQQGSGQAWLQQLLARVDFFSFSLANHTGYIKGGLDNELEKDMNETPSQQLKIRYTSNQIPTEVRSNAEEVCPSVKNKCLVTGDTRP

SEQ ID NO: 962276 - protein, 99 aa, Homo sapiens
GGSGTVVLQCCWSLPGACAAGAQPVPLWPGCSVSPCCSCASSQLLPLCSVCLCPDGGVLPDCACCVCLCGLMCLMLQANPYLLTCYLLTMIHACLLHVS

SEQ ID NO: 962277 - protein, 257 aa, Homo sapiens
GYPTISLDILLQVRSHLFPPSGQISLSLDGFPSNGRRCHTTQVPSSGYPVSWRLPMRPWEVIQPLEAIHGCTHRPGASTIHIPEIIQRQGIRRSHTGWRAELNHGVIHQTHFTGHYGQVDQQQSYQLPWRLYLEDRCHNSDILEDTTLLHHSQPCHRDIRVTQRNISRTSVPNIQQTTKRSHENFLTTKATTNGSQRDQTATHATGTCRQANPDPTDHDRQTHIHASHHKPTQCPGSYQTLNHSHAELDHLHPPIRP

SEQ ID NO: 962278 - protein, 116 aa, Homo sapiens
SKRQNRLGGGPLVNAGRGFPMGVVAVIAIYSGKDVLVLWRTWQRAEPLQHATSAAGARWSRVDLRSSSPVAHVARPLPDLATLDSLPPVERVTVCEYLRYLRSIIALVLAICVVVS

SEQ ID NO: 962279 - protein, 299 aa, Homo sapiens
KTQATIRLRDENGRRQEEASAASLKHGCVCMPALVGQPRAWLPIMWPQPIHGDEGGLLDWRPLEPDGKRVTAFHFTVCTLSSNFRQKWMPRGLPTLAWRSMNTDSNELEGPLGALEACRSIESLTLALALTCYRLDYSRSSSRYSTLFPSPPLSLSCRQTLHPSTFHFPPAYCRTSRPACYRAYLYVNTDPAAARPPHNHEQQPNHQPADNTPHTQDPPPNKRKGRRANHHKPPKYAKPTRNTQNDEDTPPDKHSCQRRNRRTPTAQKNNRKNSHKTGHERPQRHPNIATMQYRTKRDR

SEQ ID NO: 962280 - protein, 106 aa, Homo sapiens
MLLQNTSPGLCLHASTGSDEKLRNPEIACKIQHRPEQNIHNADARKPSDRTMEREPGSGSKVSLKTTKQQGTQAKKGEVQTRKQEKRRAGLTRRDETVKRRQLTGT

SEQ ID NO: 962281 - protein, 131 aa, Homo sapiens
MATPVSHDTSVPCSSRLLEDWSCYYYSWAVAGEENPGGQKEKTCEVGEERKGKESEKELALVKRVKPLFNKSFESTVGQGSDTIHLHLQGVPGELANRHYRGAGRGAKSTISNGKETVEGDSNETHIFDGS

SEQ ID NO: 962282 - protein, 124 aa, Homo sapiens
MRKGPIIIEGETIIMSRPGLRKKEDEHAHQHKEVISWSGGVVETMVVVVAMSWCITSIVVEDRSSFVVRESRQLQLLMGEVVVCEERMNKKHEERGRRDRVSEYVGTRQDGGQLNICISKKAST

SEQ ID NO: 962283 - protein, 137 aa, Homo sapiens
MVANAILAACPIAVCKAGAALTKGVPLYRHIADLAGNFCKSSCQSRRFNAHQLAVLTAGNKLATAGASRSSQSVQQTSGKPCALGAEVYHNLTRMSSNGRNYWDKMPTNVGDEGGFAPNILAELRRPGAAEDCLWES

SEQ ID NO: 962284 - protein, 306 aa, Homo sapiens
ATVLKTPHGTARNADFAHLHALDPRPRPRTAAMWASTPRDHRAATYSGLLPEAEEDLLRWLAPEITQRAMTTKISILGDSPCLLIDIMMLYYSKANIYLVIFEITRQKPLMKRRHLYHDPKIKPEEATPRDAPPNGANACGERNDILRQRPRSTSKLTSSLGRPYGQSTRQNRAHGNKHHHNAPKDHTPHHPNDTARRRAPHREPVDRKQNHQTAQYTNKKHYYTRHHVTRTMARTQQNQLPHQTKEKPNAMAQLQLRPIPSINHKKRTHTTAPTTPPGKDERTNITPPTSRKQETTNEGNQAPTH

SEQ ID NO: 962285 - protein, 135 aa, Homo sapiens
MGRTIWVLQLRNFLYGGLVVERYYINAGETIGDIRESPLAVISSLQLWWKILIYTHGVKPLYRFSKCGRLYSKGGINTGCYWKGIFATIAWGAPKGCCWGGEKARMQGSWVWCRLSWLFTHKTGYLGKVWGNSNR

SEQ ID NO: 962286 - protein, 169 aa, Homo sapiens
PLYTTLLGYFSLVGLLRLHSLLSEHYYQAINGCWTNIELNNEELCTSRCCQKCQVTTLLLCFGLCTILTDCRSLTQDSHSRVFCHTSSIYTPRCDQLTHCFPAGPQYKYDDDFNTRRTEHDCTCRCLAIKPLTDKYPQCRYSTEEHFTIRACREHQHYLGDHMQCFAAT

SEQ ID NO: 962287 - protein, 168 aa, Homo sapiens
MQEITNCPTPGQEGMAGWLLESSELGQSKRCDTSQRRALTLIPTRSLDSHPLQPPRPWYRTQATQEHNTQPKDQAPTQANTAKGRNKTNNTHDTGHELYRQDSNQTETPPHRNTAAPHHTNHERGPTRAHNHTNTPTYNTHPRNQREETPTKQKHTDKQHKTPDWPPT

SEQ ID NO: 962288 - protein, 51 aa, Homo sapiens
NSVLRGGTGNNQGCRDHRKRSTPTTEASLKTGQTEPEPRTPGRHPGKQEDT

SEQ ID NO: 962289 - protein, 191 aa, Homo sapiens
LGRLVSSARDARGKTCLLAMVTPPCLRLAVDCEPLGRVSFELFADMVPKTAEKFSCSEHWHEANQDLVHEGSCSSQNYSRFMCQGGDFHTPEWHMVAIPSMAEKFAPDVELLSYTCNAVLAILSYVLNAGPNTEWFPVFHPALPSTEWLDGKHVVFGNVIEIGHEVIVRRPWLRFARPGLRETIYDISPFA

SEQ ID NO: 962290 - protein, 332 aa, Homo sapiens
MGVGEQQEGNYVGRAAGPPEHTIQPYTPTGHMKAPKTNLDRTETPQNRTNTTIRRTRQRKSHNDKRRREQQPDPRQKHQTQHTKGDNKQQAAGQPPPHKQPSKPRDRRARHQANAAPDAHGAAHRQDKGNKATQQQPTTRTPRAHRAQQKPTRTPARTEKKTEQQEQRTRTRRRRSETRTHNNTTPTPKTKTTHKQQQGTTRPTDARRKTGRTKERKKETQGNKARKGQTRKRQKGEERTEGTRRKRQRGKQRKNRKQEEARGKDKRRDQRRQPGSEKGAGNERAKRATTSATGGEQHATENRDPNTPRRQQAKLLTAHPNGKRRPRSDRSQ

SEQ ID NO: 962291 - protein, 604 aa, Homo sapiens
STRKEPPSVMHSLGQVLAFLNFRDSYLEGGEQGCSLPQPAFPTPTPTVIQGPIMPAIHRLEATGPEDVGARDAISDHLWIFRPSTSDPQDSGVRMADIHHHDPSVEKTALKSHTHRHSPIHTAPNAKMGHREDIAQRSDRRPHKVITKTMEDAGVQMEANGSDTGKRLIHGTTCHKIDIRKMIEDGYTDGIERDREEDKIDHVKQDDHHGRHIVRCSEVERRFSWIDAGLFEQAGRGIVSRRSRDTDRSIDHIQQKQHTNRTEGNWTGGGTEEPSPVTRGQSKSNKIDPPYHKRNTTTIHQDDKWKQHSNQSPVVHTTPPKIQYLMTALGQRKSETQRTRKSEAPSKETKSGEAEWAWATEGQPQRATVRQEWEELERRHKNPIRRRYQQKTTGTTQEDIKGQKRHHDTSTPGPTYPRTTEPIHTPNTAWTAGGNNSKTNTREGTEKIEETQGEHSNNYELEEKIPPKKHDSTNTTHKNTRKQQQKKRDQANEDMKQQQSKNNGKTKRSELTPEMNTTHRESSERTDDYKCLRRTINDHEAEPIAQCTSAQHTKSEYTNTDDKHGLPTTESKHKESRADHDRLLLSLAASIDQTRPSHSKQQRN

SEQ ID NO: 962292 - protein, 231 aa, Homo sapiens
DEYVANLTELVRQHQGCPGRHRRKRRERNKKKAEDAEKDTTPAIGPDGEPLDETSQMSDLPSEGGIHVESGIDPHRLADAPKAGQLEAWLEYEPVGMNVSVRGLIADRKWLRRRGRGGGGKSSRLASDECSHPARGREKKKIPTIRDQQMTSSEVDARDIIENAKQDVMMNMAVSRGPWHVAVQSYYAVAHAVTERVDKQSALMVNGVLEQYQIDRLGAGWVSLYNKDLNG

SEQ ID NO: 962293 - protein, 186 aa, Homo sapiens
MPPKDNKKKKDAGNVGQKRQRPSEQFRGQRPKKKESVVSKKAKFREQASITLVSWFGQQSFTLVNNTSCRGKSPTYKHFIHPERGGSSGEDTWKNLGGLRVAPRGQPLLEESPPYSIRGLYLKAVVSQEPNEKPSEYNLYTQKYSPEGVEEVASQGVRGCDRYCQMCIIEVSNTEGVGYLLCANKV

SEQ ID NO: 962294 - protein, 135 aa, Homo sapiens
LHLGFRFPPFPFPGSEGDIAPAPRGVAWCTPRRTPQLCRPPICRVWFVPPPCFPPDQPLRVRMRVALPGVQLSVCVGPALRAFLDHCGWGPASALSSCVAVAFSLAGLPAPWTLWSGSSLVLVTDRSDARLQYGS

SEQ ID NO: 962295 - protein, 107 aa, Homo sapiens
GRRRVCPGSTPALHQPPSEPSGPSPITRPASIPGPGPSRVSGLPRPAFPERRPAETSPEDQANYYILETHISIKQDNNNKSASTTLKDTIDQHITSHTIEWNYNRST

SEQ ID NO: 962296 - protein, 109 aa, Homo sapiens
MGSCYVAWAGIELRASSKSILCASASQRAGITGRATHTQTEVQRRLGETSLVLQSLGGGLETESGSVAQAGVQWHDLGSLQPLPLGFKQFWCLSLLSSWDSRVLATLPG

SEQ ID NO: 962297 - protein, 144 aa, Homo sapiens
MPDPKHLNLNTVQDTHTEVWPDNLIPISALLHGAPSTCCLDLAYTTPGRLAHCHMDVVAINPLCGNTTPLVTSTSHHWGDLGTNTGPADQELTPPISVTFPFGRPTFTLEMQARLERPIQQTLGWTHVGPHFGGKEAEDARNSG

SEQ ID NO: 962298 - protein, 82 aa, Homo sapiens
SGMEVLMRLLYEHWTALSGRRGHGTFPSNMAATASPQTTRHSGCRSENSSFYYYEYLDEVAFMLCQEDAVVSFGKVFLPVIL

SEQ ID NO: 962299 - protein, 237 aa, Homo sapiens
LRQRRERAEEYAAALELSVGLRLVEVEEVIEESRAERIKRSGLRRVDDFKKAFSKEKMEKTKVRTRENLEKTRLKTKENLEKTLAHLLEKLQNKLVHCCLCALPSWREKLKTVAGTMLRKSFTPDHSGVRRCSKTAVYKCATLHLPLSRRSSRGASVEVLKATEMVEVGADRQTRAARMREGGPADRACAVDAGPQNGGNSRQCIGKESARRKVRGTAGALGVEQKKRTSRDWRHDT

SEQ ID NO: 962300 - protein, 186 aa, Homo sapiens
MPPSQAAGTTPGPDPKAYQLLSVPQCLPAGPVGRTQRADQWRAACPCSSFFRAYPTGVWPTTWLCVLGQVLPIPLACFPGPWLCCAGPWPRAGGARLCWAVCGGYLMALAVLRPLPALVCTSGGVGLGVLSVGCCDLGVFSLREGGSSPAAWGGPAGIAGQPGGLQGGSWRRLWFFPPTGLFTCSQ

SEQ ID NO: 962301 - protein, 186 aa, Homo sapiens
KQRREGGDGEELERGRCRPVCCSVVLHVSEKPRSSVQSVVSPEVRECAGPYIVGAVGAEAMDLQAGNALKRFLSSQTKLHEDLCEKRTVATLATHELRAVKGPLLYCARAPHGPQDCPLVCRKEAKAKERGCGQACQLWGGPEGKHEGNAMKERGEKLCSGLRQHTFTCWLDNENYPGLVDCRRCM

SEQ ID NO: 962302 - protein, 108 aa, Homo sapiens
RYSGSYVELKAPDDDTSQLKILSYKRDQIELCKCLVTIRGVTTKQPFENVYDELEAKIDAREGYSVADAREDDLKSAKADAKVMKDAKTTKVVESRERKAVQRLVWNS

SEQ ID NO: 962303 - protein, 32 aa, Homo sapiens
MGGCAARGALFGFEGEETSRSPGSLCWTISAP

SEQ ID NO: 962304 - protein, 221 aa, Homo sapiens
MSGGADSGPGLLDNAVMLSVGVPDGRRVSAWKAFVADLSVKWRLLVPFVAGAAPGRPPQRGCGFLFTTPGAGKWGLATATPFCEARWQRLALLGWAPQLVATRLRPVGEPPCGPEVVVFTTAGRSHPQIPTFPCWCFTTRPQERMRQRTTILSPPVWGVGRPSGYKEDTPSGGTRRVELTKLTQLERRAATESGPLNDCLGENPLYNRPGGNNYRPNEKCI

SEQ ID NO: 962305 - protein, 80 aa, Homo sapiens
RWEPESRRGGLEVEGPGEAWMKPMREDQAALCWASPWDECFQAAVQLSAAGRTRIIRKALTEEQNVSQTKNISLQIFVTR

SEQ ID NO: 962306 - protein, 204 aa, Homo sapiens
DEYLTGPFGLIAQYSLLKEHEVEKMFTLKGNRLPAADVKNISGKDVHTVKEIRMPAADVKQPIIYLIQTQARVDGYNRVKTCSGERIDEAQRESFHMSVLCHAVTCCANSGCKDSGCLGILVFTGRSTAYDLIPFDGDLLIHGNQRVRSTECYLEGDQTSLYHAGQGLMTLPALCGTMPPDIFGKRRMRSATWPIMIDQDGRES

SEQ ID NO: 962307 - protein, 70 aa, Homo sapiens
KSAQGGLRLPDCTHIYSNKGFYSIYNWDGGKGRCRRGRKKEGKNIPPTPPPQKRGKKKNPTTGRLYVAKA

SEQ ID NO: 962308 - protein, 411 aa, Homo sapiens
CAAVGGAREALVGPGDGGTCWWLPAGGFLASGIRGPGVAGPLDGGLGPDVPREASPDVAMGLRHKGVDSPGHQWLGRLVFNGTMWMYQGPLARRTLYSYFPCRIYSELMTIDLAVLLSVAGPSSSKCIEAFRATHFMPSCHDMHDPCLPGPSGPPRRFQRGHLMTAALPRESDLTRSGDPPLPRPQRLAHNRLGFPTTARARAPTAGTPPPMWRAQYQSRGAQTAFFTNSCMPPMADKHAANLASGQPQTSEPNSPTTTWVASFVHIASRTCWPRPVRAITCWPLAVYRRHHILPLCRPHGGGPLVPDSGPSAHPLCCPLIYNALPHKAERAPRTKTPQRNTVSVNKPPSSDTPDERRPTHGRHPPTLGAQTHYRAHTMQPPTHYSECAHHLPNNDRPKRYNLYEAPAAEH

SEQ ID NO: 962309 - protein, 106 aa, Homo sapiens
MGLVASVQSPLLTPAPPTVLSCGTVASPSSPVTQPTQGTGNIPSPVESLPMWSSHTPLARHLASGLIAFFANQIPRQSEESTGLQWIVIQFVQERLHRPHGWKADI

SEQ ID NO: 962310 - protein, 186 aa, Homo sapiens
RRVRPFWTSPDSDGLCLKLTQLHWDYEETRSKTQEPLQSSRPSPSKRPYGASPARELEVEKSALGGGKLPGGARRSSPGRIPNLKKRKGLELKVVAKTLLDPFQFVRNSLAQLREEVHELQARWFPSRTTLSIAIFVANSTWVTFSKLFENDRHFSHLSSLEREMTFRTKMGLYYSYFKTIIEAPS

SEQ ID NO: 962311 - protein, 277 aa, Homo sapiens
AHRVTTHEAYDREGGEAMTYCIRFVPLKMVTHDSQRAVLSGSATLPWEPLPMLQPMRAPRVERGMPRRSDARRALACRELKSGCASRIQYLAREAGAGGLAIAVEGPSKVEISFEDRKDGSCGVAFYVVQEPGDYGSLSQTFNEEHDSRQPLSVVPVAFFRLADGPAWPQLFLSLQGVPGLEGQPASLFEAVSLKGAKVGDRMPKGATAPSGALGGSAMSRTLAHDSIACALHALGKLGGLPGLTSSSSGPTFPWKPLRDPGWGAWALGGPRLRGSV

SEQ ID NO: 962312 - protein, 265 aa, Homo sapiens
MTGSGPIDSNALHTSQQLGDQHFNEDAYGGGHETAPTTIVDYCFFLPAGLAPTLQSFTFCLAPHSRPRCGGSCDGAGCLLCPVGEHETERSNVVVPRVCLLLDTLSWAIDLPQAVISQRPYTFLDAQCVRLASSVLCTLYRGSLRNVLWLSCRLTDTSPLCLSVPSPLSLFPPIHLLSLDCVPDFPSFSSPPLHLLWGGALSTVATLVAPPEQQNFSGRLRIHPRWAPPIPAPGCVLHLSASLFSHPNCRFPGLGTACAFTKNPC

SEQ ID NO: 962313 - protein, 195 aa, Homo sapiens
SLTRLLHAVRQMNPHIRVTSHQNRVGPDDCTRSECMTIFSKKLAWRGHMLRGQTLGVPRHVTMDRLGVSYFTREGHCLESRHTWGTERGNCASVVIPFLTKSCTDSSQDPPEKSIPICTLKNFPYMPSMHNLHVGLGECRLNGLFKQPAENVNQYLTDPKFVERTLRLAGTQPLEGAGGLCMAQAWCWRDHSTLC

SEQ ID NO: 962314 - protein, 262 aa, Homo sapiens
MHPQIAPRAMHLVAGMDRYPRKVTAAHWPMKKIAKRSKINIFGESCIPYNHLIAHKVLLWISPCGQKLSFNKDVSQKILAPETVRRPRTGKCPRSKVSEAAYKDQVIETKLVPSRNPWRFLSNALGPPSTFNKLSPPQKTILQHLMDDIPPVAISQTCAKTTYVISQHALNITYTQRQGRASPRKPMNIRCPTLLDNGLSYSHASSEDTTAEPQHCSTNTGGLASPILNRDPRLLLSNDATAPPEAVPMLIPHNSGTSYVAK

SEQ ID NO: 962315 - protein, 162 aa, Homo sapiens
MIQTPDADLDVTNIIQADEPTILVHSNALGLDIPGALGRITGALERTVVIKAKAPDSPSPLPVVVVAPGLALVMPLRGVLSTVCTTRILFGTKERCLEKTYLQGALGKKKELNKNKATAKNISAGNSTLKLGKNGAEGLQIEVSIPEDVPHRRAQGTFDVPV

SEQ ID NO: 962316 - protein, 300 aa, Homo sapiens
RASAFLNTLGWCGLRQESGSVSLLPPRSSAHYALPSGLPESTSMQRNGAYPSSSLGLRIRTQNPLAWQSEVCCTLQPLHYLTQDIGSGKAERYEEPDLISPTSKTPSATAAPAATHPSTVRLPSSCASPLRPERMTIQSRTSSSVAELLPAGDDRRSPSTFPSYLPVVHPFCSTYAYLSLCLSLSLVLPERLRERVHDFLLFPPGPLSEILSFAPKAQFATWLAKFWRDERAFDASSGYRRLLPLHVVEAKPWALKLALGAGDPGPGPFRSLGPAVALWSRPALLLPEGSFALCPSAIVC

SEQ ID NO: 962317 - protein, 324 aa, Homo sapiens
AGGKTRSYTKDYTEGWVEFRDKRIAKRVAGSLHNTPMGCPQASAPSVMIFGTSSTCTGFTWFPPQRATSPLSGQVRRQRLKSGGCSKPSVMTDFYLQSGGPGGTSAFFAADGDPCSAPDGVLWTILAQASYLTQETPEWPRYKASIGPSGGTGETGASPWSKLARATKGPGSQAKGAPWAQGLVWDAPVHPFKNVALDRGPYTLVFQRNSLDGGPGVGPLFPFSPGALASVGFPGRTLHYLGNGLPVTYPGGKDHFHLGGRLEEPTGGLYVDWAQTHSRAQVGGFQVVRAFRNSRGVVALGWRHPYFIRGAYLAIHSLAFLRIC

SEQ ID NO: 962318 - protein, 246 aa, Homo sapiens
LKVLSSLKPAVPHTRAISDHNSERQPPRQLSLGPLSSASRDSITAGAHPADSLWKEEIIRPVRHESLPVSTRRVSPRSPKMHSRGRGAGHLPLYEIRSSSSSVSSQRDKALEDEEDDRAQERPVEDGVLSRKRAFDHFSLVGKPEGRRRREGWNRALLESMLQPERATRVSAVVTSEDWKTHSYTDKTGARGDRWSNEPVAPKQGIGGEPERLAGRGDNSRLAKNGPFPGCTVFPWVALGNTPIPL

SEQ ID NO: 962319 - protein, 158 aa, Homo sapiens
IQMFMPKEKQDFVQHFSQIVGVLTADEMGHPELGDAIAGSRTVLEYNAIGGKYNRWFDGGSSIPGAGVRQGNRMLIVSRRDLDCGLVCGTACTAFFLVADDIMDSFPYPPRTRILLIIRKPGAWRFGEPSMMLNLLESNVSKRVLETLYLPGEHALLA

SEQ ID NO: 962320 - protein, 67 aa, Homo sapiens
HIVESLIKHLNRLNMFRHSQDEELDMSKKKDRQHQKLNSVPSILRSNQISAEHAENALEEDDDMWFN

SEQ ID NO: 962321 - protein, 129 aa, Homo sapiens
MPTTTKLSNEAEETCVKPQLLEREFYSEILDKKFTVTVDHAGPWTYIDEAYGLDFNDPSRLPKEDLVAPSFGMDACQAQGMAACRHKPRPGPPQAATAEGTPEPAGQPVYDQVQRNWPSLEARGRVGGP

SEQ ID NO: 962322 - protein, 95 aa, Homo sapiens
LPLLLPLPPESLPAQLRPPGSPYYSPIFGVRYNMAPTIDNLPSGSSTDECNASQRNRARLRVCTRVEAKFYERTVHDLATGQYGVLYQPLFDKRI

SEQ ID NO: 962323 - protein, 120 aa, Homo sapiens
MDSVEKGAATSVSNPWGWLSRGRRRSCRRKFAAASGRGVDEAPRTWTALILARWQCSVGIPPEEHEAHWRGSRVIGWVLRAARGFRAAFQSVWVSTDPLMNIEECGQNNFGCTRFIERTC

SEQ ID NO: 962324 - protein, 251 aa, Homo sapiens
GAAQGGVTCRSQVRAQAATAVSELRTLKVAEQLSPGPAVDSGVQLSVFRISLGGSMGLLDARKRSGLATQRRRSKAAAVADERGLQLVGIDPGTNEAGEADKSKWIQTEPVTAGNTEGRGLTGGPWTQAERGARRETPEPRGDPRAVGVHRSSHPRVTGQEPHARGWWGTPKRKGDSIRGGKAGDKGHLSPYLGTPVGETTTAAGEHNGERAAPVIGDERRKTGAQKQSQVLGGTRPDADAHPRRTEQKRA

SEQ ID NO: 962325 - protein, 98 aa, Homo sapiens
RRWSAVAGAVAALVDLTEAAMAVGGGYGGSSFYKKIQNAWELALGVALSTSPSGVNSKPHPLTHYRLPCIALGGATSKAAYPCGVSSILPATSRCLSL

SEQ ID NO: 962326 - protein, 189 aa, Homo sapiens
MQFFVAKQVIATYSSTEGLGQMANRRTNEQRSEPNKEANSINKQSPHEVITQATIKSQWRITKANSHRTHYDRGADNTNEDKTHIGHRTVTNPPAGDINTYYHRVRGLIIVLYPTSINGKRKHEEGVFQIIPTCLGLVIINRQPHCRNIYRPQLGGKIQFGMLDSRSLIDDMKRSHQTDTVRPCSGVSA

SEQ ID NO: 962327 - protein, 109 aa, Homo sapiens
MAQGLYVWLAQSPGSLGSSFQIQPQGPKCNFLHTFVKLWTYTCFTRTTPLCLKFSLVETDSLCAQVLRLRGSDGPPCLSFQMQQAKLYLGPLPYMPNKRFYTFIMNGLS

SEQ ID NO: 962328 - protein, 114 aa, Homo sapiens
RLEQGRRRSVRLLPSGPRCEPTPGPGALPCEPCHVDTVIMAQRTGPHVDSMDRGTLPLAVALLLAMLQPHAPQVLQKQSIVTFSLWAPRGAEVTYTTEPGLEGLRGSGPPIAIR

SEQ ID NO: 962329 - protein, 266 aa, Homo sapiens
RASPLPIRRRPHRAVSSPLDDDIAALVVETAPACARPGSRATMPPGRLPLHRWGAPGDHGVSVWAWRQKDSVCGRRGPEQERHPHPEVPHRARIVTNWDDMAENLDQPSTMSCVWLRGAPRAVDRGPLNPRATREDDPDHVWTFNTPACTLLIQAVLSLYASWPYHWHRDGTPVTGSPTMCHLRGVCPPPNAIRAVGGPGLGRDLDYDYFIEESSRSAGSQVSAPKAERKSVRAYRGHLGYRLPGFEQEWARGVRPPWEETNRPRR

SEQ ID NO: 962330 - protein, 136 aa, Homo sapiens
MWKYWQNVSMCVPIDDTVEGIHWYISSRYTLMPYFLEAYRPIRKGDILLVRGWDAAVEYKVVETDPSPYCIVAPDTVIHCEGEPIKREDEERVLELKKGMMTFGGCRKQLAQIKDAGGTAPEDMLPSLKGHIGWLK

SEQ ID NO: 962331 - protein, 95 aa, Homo sapiens
KWESACSESYANAVIAGCKCAHRSVDPSRLSDVTRSKAAECRISPQAVELCPGGYRMSGVALLCAAMEVSCRWFRDTTRACHGVVCPHTGAYVVH

SEQ ID NO: 962332 - protein, 263 aa, Homo sapiens
MEVTIAALRRPTEGPVLAEVAPACELRRAGCSEHFSSVYAVVSVLHVQPQSTGFGQPGGEATRDSLMSLFHGSARFSPQEDSYSQSRELLVQEVKAAVSSGAISPRKAPRSGSRGGGVVPIPWHLPEGPCDAGWASKDEVGEWLQSVLTTRAGREFAVLSELRRSTNECRAIISADHWYQRCYRGSARGRGQKPGYPVRGGPGSGVLLPRVFGDIGLSGASLARGRNRFVFRAMGVGGDPPLWWPLYAFSTSLEPSAVLSPTL

SEQ ID NO: 962333 - protein, 114 aa, Homo sapiens
VTAWARWLTSVIPALREAERVDHKVRSSRPVGQDGETLSVLKIQKISRVWWRASVIPATQEAEAENGVNPGGRGCREPRCATALQSWATERDSISKKKNYKSDIDWCAKGQGIQ

SEQ ID NO: 962334 - protein, 196 aa, Homo sapiens
MLHRRLWNNFDWELGYNLTLNDTSVRPPSALASAGASWSLTTALRESSALALWAQARVLSETSLETAPKAPRDPSTQEAVTLPPNLQLADPEHPWLALQFQPDGAISESPEGPSRGSPSADLRRVLLRSTTCNEVGEDPSPVSCHVPVNLEAVACQAAWGPWCRVEERFGHRAPGIWRHAAPLVLGGRGLVGTEGD

SEQ ID NO: 962335 - protein, 81 aa, Homo sapiens
CEAGWPRSVPWAAEQLPHQYSYPLMAVQRALGDSELSRPWLITRGYGAHVSQHRALGMPLGSPLPVFDDTKRVVYSRPARG

SEQ ID NO: 962336 - protein, 270 aa, Homo sapiens
APREQAWRETGEQCQGLCKSMVDPAGEGKEVLCEFCLDDTRRVKASEVLYYTCMVNYCEGALAARSGRRSNCKATADRASEGPQRGDTALAPPQPTCPAFVAALIEQCIYQDLCQEHSGHTIVSLDAARRPRRLELQCSQLDLDAETQRCLDKCHLQAPGVNQQVCSASPVSEVKAVAEIGSYGGNHCGCEEGQAKCDAPAYEGERARLRSSQAKGPKATWENRQCRDAHEPAELETKGGTSKWPPLAGAKLDRRHTSQGTPAPNPAPTS

SEQ ID NO: 962337 - protein, 272 aa, Homo sapiens
ACAVLRAPACAPRAVCMGLFQDAHVRTETPDRGSSCLDSACGSRGAISVGSWGGMTSTCEPCAAGCLDQEAPLGSPWMRRRDALVSPVAASRSVSFSPYRTPDLGDAIKRTDSLQRSVPIQALSPWGENGLAADDWNGGLEVPTRAPTSVGRPKYLRVQGPRREIGGSEAGDLRVKGAGAGPQKRAKETARGFRASVPFLTSAESSPQGGSPRPCPSRGFTGFSSPVRVVPGDSDPQYVWLMGQERLDDKGCLGLGEFQVTALHGRERRFTS

SEQ ID NO: 962338 - protein, 297 aa, Homo sapiens
SREVGIHALPAERSLKQHAVPCGSRQQTPDPSSPSRGFPGCIQPGSPPLRASFTDLVTMTPWSSWTQKLQSKVEFLLLEGATVPALRLITTIHEDEVAKTQKAEGGGRRAGSGSPVWHPKVHDRPYPHVPLSPSPLAPACSPLMVDPRPWWVMAVPHFLWQSKTRVAEVPRLVDLELWNHGATEGSRLGAAQDRREMQRGQAENQGQGGALKRGRVSKGAGIGRTSVARTTRGVDRGMEQPRGPHTGRALEQDHTDNGATPSTKGPDYFARHNRANTTTEHPGLERPTTTNTRGTHK

SEQ ID NO: 962339 - protein, 123 aa, Homo sapiens
MWAYVGLPGVSTPGAQWPGRLRDRSHRRGHQGSRLCPMLPWEECRYRGHCGVSPRHPCALCGRESGIPGGARDAGIQWCLAPLKAVPFAAAADFFGLWGVFEPRLVVLPGATVCSGGSVAHSS

SEQ ID NO: 962340 - protein, 273 aa, Homo sapiens
IRRCPRTAPRFVRAATAAPAAMERAVPCAGSRFRCVFGGLRCGGRSGRGMSSWRPAVRDGTRRMATHQKDCSLPYATESKECRMVQEQCCHSQLEELHCATGYQPGKQQGPACAKRPHGDKASLEATICEEVLPLRVCVGRAAQAKGQSVRVQASWLATSVDRSPGMLCQEPGDRRLAVGGLQGNRIAILGVEADQEDPYLNDRCRGRGALPGQAVPRHGVTRVVCSCFGGYSVVLGVSPVTDALSGSGRPSCRFGDLLTRGSFAPPDMRLVR

SEQ ID NO: 962341 - protein, 268 aa, Homo sapiens
MGRVKPGLVQHDGQWDTGARVDHVSVLTVLYPWDTPGEGRNRLFGSVVVWSPQAWLGDRGVLGHTRLIRYQAGWAPFKLTYGYQRVPYKRARRLPGPMTGPQGEEALSLRFSGGLRKWSGLLRPVKEGKKHKLSRGCAPRKRENKHKAPNFKTSSSTRGVREPRRKGVLEGNPVGTFLQQKSEKKPYILWALEGVSPFNNKSTRTTTVWSQKDMPGGQLLGESTGDLKGGKVCAHARGETFRKSGGFEACVTGNKLHIEGEFTTVMNW

SEQ ID NO: 962342 - protein, 278 aa, Homo sapiens
VHGFRPHLYLIYTVRRSLMPAKYQMSLMVLSILRQSRDRGPCPQDAYSGGSSSATSTLKSNQKTEVDFLKKRTQMHKKPTENPPSATETTQEPDDMEPCPPSGENLASETKTESGQDWKVLAPAYRMETPLDARCGAQSCLPSGLRECRRGCPPGFLRWHGVHELTPCRAGKRCLLPLARRQREVTPSDSGRSLRTLQARGFSVKVVASMDYSGVTKSKLGTTSVEKTPPSYQKRWHQVCCQNGPLEGQMKKTPVQMCVIPCTPESCVTIVPLPRVSP

SEQ ID NO: 962343 - protein, 164 aa, Homo sapiens
MSCIQHPGSCTLLPCEAQEGEWDYLDSVSLRVASRVKVQVTDSIWRDSVSVSPVSSICCRSTKEAFTILLFRLDHHPWRSCHAKSTCSAPLRPSRICGLQHQSSISGGSCCLFSACDAVADLHLSHWTLGRRTLTGLIGWIPETPGGHRLRVLHLPGPSKLYAS

SEQ ID NO: 962344 - protein, 272 aa, Homo sapiens
GDSELRQSLAATPRLECKGAISAHVQPPLPGIQAILLPQPPEEVGLQDQRSESSKNHTQQQCQRHVERLEQGVDLSSEHTRTSGAPRTRRTTSENWLDLSELLKAQGPQERTRPGPEEHPVWLKALSLHTATLYTTRQRRQTLATHGHLHCHTTSAPRSDAPPGRPHPTAPIPPTFAPLSHLSPSGRPATGPAQRALPHGPPWHALPSRPDHPGRSRRTGCQMSPKGAASGKPTARNPPLHLPLSAQKPKPRKLPWVGAPHFPLHHPRPYTM

SEQ ID NO: 962345 - protein, 172 aa, Homo sapiens
YPVKLKNPKEKPFVKRAGFKTVGDHPTPTLGRQPPANTRQRNTGRNTPFGGTHAHRSALLNEQRATTAGDTHTRAETTVFLHLAAPKPICGGPQKAQAPLVGEGAISDTQKPLQPNNRRVPTATQRFSPRADNSPMGPAHPHRHNPPRAQIPRPPGCRTPNTPRAPGGHHTT

SEQ ID NO: 962346 - protein, 222 aa, Homo sapiens
MVQPQGGTNFLNSPKNQGQLSFPRAPRPQRSWDPKRTFKSIGLKDPPDTTWVTVYTTQRPFPGGKQTKTGHGYHRDMEATTQLGCDTKRIPQPPRGGKETKPPFGVGRVYLSRRAVEMIWASSNTRISPQSPQGGHRKDTQRGQTDSHSPIDPHWDSLENTQGVKTPPQETFGGPKGPPGGETHSWVVGKHHKIHTQSTTQKWARERRSTVPTAGGQTHRNQ

SEQ ID NO: 962347 - protein, 492 aa, Homo sapiens
TLQWGQCGNQIGYGVSGNELCAERWYQPLRASWRSTPPECTDRTAQSKIYQADDGALRKPRGGAARTVETRGGSITIPQVAPNAKGLSNPENILTIDGNHWHVNGRWGRANIGAHVRISSHRGTDNDDSTFERTITRGAYIRTRGKRQDLGQRRTQVDRTAPYLVASLVQTFPKGAQGAGHQGPSLEPGGIPRNHSYNEKPGCLEAVPWRIIPLKTRAVDGQEHLSFKKGLNPPKPHVSREAIARRKLSWLLDPQGAYSAQDSHPSHFQRNYSNMTGGSNRQIKICGRSHVSGQQQALCAYGQTKVNQRDPAVESRGTLGAPKEILLVTLCTHIPLGSPTVPHITIARGKIQKHPDNMEYRILNPQSTGVSKAAGTARQDEKTQWSERDHPREDNHNGETPHYGTRTHKLREGRLHNRRRQTTYQHKHQRQPKGASHTVRRTTTEEHARLYKGPRTCNVTRGIQYTKEEDTHSTEQQSEGHNRRHSRMDQTD

SEQ ID NO: 962348 - protein, 214 aa, Homo sapiens
MHHDQTHTRHRRTIVTALSLASLSAQISLDQLLSTQSVTKWYLSLHAWHISPSYNTTKQGRDRRWIIDLWLTTPPHPYLHIRHPMNRFYIQTAISPLTIENPCHTVHSPCTASGKHECISTRVSPIMASIGSSQQALGRDERNHSELVTPQQTAVGSMLAIRIASIHAMTQKTRCITKYQAIQSPHEGSASNCNLQTWPIERIEPAQHHARHTQ

SEQ ID NO: 962349 - protein, 203 aa, Homo sapiens
MGAVFAGAQMTKVPSCFPVYLVFAPWGAQRGALMETSTSGAQHHQVHLQATGLAALQPREKVSETGVYECGVCVHGSVGQLGVVTPSPAKRGRTLHNPQWRDKSLGPTCQWFVAKTKISKEHEWASAKGPRAMVACGRRPSMVTCGAAGVRGGRVGQAGIRQPVKIGFHFSFLLVTRTLCTHFGAVSIQAPGPSKCAFVAKGA

SEQ ID NO: 962350 - protein, 97 aa, Homo sapiens
MCVDIRSAASDLLVEVCTSLVVSLVTAPRVGFLGGNPLRNFLAIDKKSCLVNPAVISQSITATFLVGYEGGGQTPPVCSTWLTSLLSKLVITCQSVL

SEQ ID NO: 962351 - protein, 210 aa, Homo sapiens
MVTSEVTRLLGELPASVRDPHRRGPVKRYPWSMKATGVQSRVEAPTRAHSLQRATRSSLHVPVLVPQRGTGMLADSGALSRRDQKCCSVKAMLCAVFRCLFACLVLLVRPLPLLYPTFSATFIRFRVSSPCVSSSFVCLFLSPMQSHVDCRCRVFSYRSLSVRGVALLAPQTPGGLEVLCCIYSILPYGPGPGSSLCGVLGTRVTVLWSW

SEQ ID NO: 962352 - protein, 86 aa, Homo sapiens
MTPVQRGGPEAWWPWDGEPRWFRGGFGSGFGAGSRRGRGRARPWTRGGRPRIGVMPVNHSWAACQDMKDHVPWRRSISSPLPIKES

SEQ ID NO: 962353 - protein, 69 aa, Homo sapiens
ALLPEMKLAPFVDIGSYTVRAGYAGEDVPKVEFSYSYWYGGKKEMTEVTLMVIDVDKANKAVPPYSIGY

SEQ ID NO: 962354 - protein, 244 aa, Homo sapiens
IRRTWTPPEWKPKQECVAEGLPEPPRASGQTPERGGRYATWHDDPVPCQEPDSFLAPSLPPRDPYSIRMRTACVETADYEKQPAINPYCAHLRRYIAEFVRTPRDAPSSNLVLENPRGQRMEQETTGNRLQRRQQEVETELKNCGTLTMIPMLRGDAFRDSLRGESEIMTTTESKLRREFEVYGPIKRIHMVYSKRCRKAPVVMPFIEYEHEASTCTPLTNTHDGRKHCWPEGSVGGTWEVGEP

SEQ ID NO: 962355 - protein, 105 aa, Homo sapiens
MQQVTLRASSRNRLYYNQSGRAKTTRVGGNTVWHTFAKGGARHQENIAGEGPPGETVWTNPGGGYPTWGTQTRGGNPLGVHELSLRREEAPICNQGGGAPTAPRN

SEQ ID NO: 962356 - protein, 293 aa, Homo sapiens
SAQSACQLAYQAWVINAQAVLRRWQKEREQAREEQARYMLPTGGGPSQEVEPGEGPEGRQRAGREPCVCRGVLSTAQFLWMLGQGALVDELTRWLQEFTRHQEDMSDRAAGQERYLLTQELLQGWRCAAGGRAWISCTTKPGRGHRLPWPPTRGPQGAPSTRVQWAGREREPLSRHYETDVGLGPLKPRVTTRVACGSDGRALQPDPWGSRCRDVLPLSCYPGGRDCGPGQGELVLDQGGLGNPTWLRQPEAVGGRGARAERLWGCFAHVFHCVCGGPIGAVPCSSHRSSTGC

SEQ ID NO: 962357 - protein, 139 aa, Homo sapiens
AGGAVPAEPFETARAARVPWGSEVGGRHERRMELTWIPLRSQYDIDDSVTWLSSGVPIRTVGWEFLKEMESKGEDKIPRWFLTWRHSQPRVAIRKPLVLCCWDLPRVWASGPSVLGGARFLPVFIMFFASPWELLRIYS

SEQ ID NO: 962358 - protein, 149 aa, Homo sapiens
RGGSRWVGKVEGFCGPRSPASFLLPFTLPVEHSYGSQDEEAAEAVGAWYCNRDFDDEKILIQHQKSNSISKCHILSPRNRIQDLGLRLFIALQVHKMKPIDCRTKMHYPWKNRHTSLEHTSGHGRYSRKRDIGWKDDDFLNKKNTKERF

SEQ ID NO: 962359 - protein, 138 aa, Homo sapiens
MGLRWGAHEGLRWFPRRGTLESRPIFVGCCSPYCLSVRFAFRLGVPPAFFGPTFSGPPPFFTLGQSEVPSAWEASAWRSFTRGSVGLYIGHFPWVGSQLVVDLLLAGGRTEGLWISLFSRLVGWTVVLLSQSKRFGID

SEQ ID NO: 962360 - protein, 69 aa, Homo sapiens
AGSVMATRSPGVVMSDDEPGFSDLDVLIAYRNHYAEDSERVLIPHGLIMDRTERLARNVMKEMGGHHNL

SEQ ID NO: 962361 - protein, 68 aa, Homo sapiens
ILWSSSRVAAEIDHRFLQVVPYFNYTVQDLRSTVIEEVLRWATVARKHVSEVIVLDMSWPAGCWAESC

SEQ ID NO: 962362 - protein, 82 aa, Homo sapiens
HAAADAGLRCPHVVLEQGHQHARGTERLRGSFWAQPLRTRTTDGSSRAEAQVPLQRHPEPPPEWSAVRQLKSSSSEARLAKV

SEQ ID NO: 962363 - protein, 70 aa, Homo sapiens
KTCVRLWLSMAYGDYVQDGKVASGTMSDVCTPYSSICFYPFLQALISNPSENPDDATSRTNLLVPLTQPV

SEQ ID NO: 962364 - protein, 189 aa, Homo sapiens
SATFGPGSAGGRGYRITADVRTTWGRCRSGLLGGAPFLSGVGLAVSHLLDVRTQLTRSATINPFCGGRNDHVKHVEIPRMSGSITAPLDRRAKSAHVADLRLGQKFRSRAIASSCHLVTCQVTRSSSYVLLVPQGVVMASIARKVCTAPSSWQKKQDAKRELRANDKTGEAAREVVRQEEDGNIVKKCL

SEQ ID NO: 962365 - protein, 125 aa, Homo sapiens
EKKDGDNEEEEEDYGKMYIDQEELNENKAHLDQEITDDITNEESRQNSIRALTMTGKIILAVKHIIMFEGTVWQFMSPSICPTTCSFEICFENRKKREQHQICMYARVYIMDNCEELIPEYLELH

SEQ ID NO: 962366 - protein, 205 aa, Homo sapiens
STGCSGLGPWRESHVMSRSRGAQSADLYRDTWVRYLGYANEGARGFRSLVPAAVVWGAMGVASSYVLAGCIDNGQDGLEKGRWISSVTPACAISTQQVGGSPAPLDHSSWYLACAIRPPCYMSSSYFLQSDCGTPGSVCCPKDPCAPCVGVSWTEAKRPTCSRTQVAAGSHRGQDLSAVCSLEFQDADVKGDPLCGPGPCLSGKM

SEQ ID NO: 962367 - protein, 302 aa, Homo sapiens
DHSNMGNKMLQAMELCGKALAWDEMCQGITGSRLRLNVSAKWELDYGAKGSAYGFVGRRFLQQMLSGIAMFARFTDAGSEREQRERDDNGAQLNVAISRIRCNRPVSLTGMPCCLSTRSKGEPLHSAGYLPPHLTEVPLMWSSLVNGLPSRQRAREQTGEDSGLRSTPVYTRVHVRVCPCVAYVEVPQPLTYPRGYGDCLYTWYLLTPQATSDQSDAECPILRTPAMGTNRQSYPIRVPVHLREHLSQPQGRPQNTIGTLYAPGTKPCTTHHQHHAAGATPHRKHPTGAGPKRNTANPTHPA

SEQ ID NO: 962368 - protein, 301 aa, Homo sapiens
MEGYGTKKYVKGPVLSGTAPHKKFFFFDDDEGEWDCGVAWARSELNVFGKFRRSMPSGRDGQLCSLSPSFMKASRMAEVHVRCHWCPITHRSVCLRSIATVGADRVCFLITQQAVLQWGAGGLILVPMQRVHGCLSSRAGPGMVSLACSGVSHRCRAAPLPLSLFAYSLSSGLVQTLVWGHCGEMRCLELCKLLVLGSLLFASVDLFPQLIPYRENVLSSRVDRCMPTGLIDGHHGGMHRAPNVSRTKGCPCREGRKNQLNQGQDIGFYLSWAGLERTPWKEKQNLGGGTSAVVAQDRWKA

SEQ ID NO: 962369 - protein, 299 aa, Homo sapiens
TRVARCGAASVWELHSVAANLLTYLLACSAGPLWSCALLNGCVSAWLAQMGKNYISCLVGACSWKAQLHACNDHVPRGLVTLSELHHANGLLRVLAGSCQKCIHLVLMGLHLGKPSWSILDVEQSYPGRSPCRSGSTCGDLVMPTFNPSWVRRGTLPLVARFLGCLLHAVACCGLIPSHGFRAAPGQAGLGLTQNCIHHSLVDPCNIAGFSGVAPLSWVCRTFLHVEPRRVRAHADVVFPPGAVLLYRSSFAVSIPCAGEPVDPSCAHIVCGGGCGPHLPGRTSFLAGALGAFLQSVSG

SEQ ID NO: 962370 - protein, 394 aa, Homo sapiens
SHPSSLEAAEQPDPLSATTQEKDEDHCSSRGGTTCQLTSPTAPDHAWVPEADQFSQAFSVKLYSLETSIISRHLLHGERDSFWLYKHMTMVHRYRPVAHFLDTQLGIECISPHLLECNLSAVWEHALVYREALAFRLRPVTLLKPYRLTHYHFEHRTYIKADTLRSHHLTNALTSMLHLASGGFAHHYSAKHTLSERPNSVLQTCASSPSSYTRFICRPLNYALPHTFRQTRRAITATASWCQRAEPLLLGFRRKLAKRMVPYICDNMERLLPPGPLHNNSTTNTGKAITQIWRTTADNTIWRRRRHRLIAPVDYSPNMRRNSARSPSEAPEHFTAREGYTSYYPVHNTVRYPRATWPSLYSPVSPYYGYHNGWAHNTLRRQATNTPIEASFLN

SEQ ID NO: 962371 - protein, 84 aa, Homo sapiens
EPPAGLVAATVRSAVESAFPTGYQCKLEEEKTHSSSLSHGYQRLYEKYYVGEPVLQESLDELIQSQSRSAPNLPFKFYFSLIRL

SEQ ID NO: 962372 - protein, 215 aa, Homo sapiens
RRVLKKIVVTLEGSGLRHVPCISIMQDNGIITALETSWILLYECTQRMKHRERLPKVDSRGNRFPAISDSTVAFPERHDCNCTAHSCRKRHASLQRSLLPILPHSHNNNFEITTHPQEEYLETAQTDSQHHATCSTHTHVASCVSISERQHSSPNSYANHETSINYYFTRIGKPTKRPTQLIIIYGTHNNTPIFRAMDHTTTFTIHHTRDVASSP

SEQ ID NO: 962373 - protein, 104 aa, Homo sapiens
MPRPLRAATEESGLSPELSRGLRTLLVSQAQTHLEEHEWWIWLLSKSTVYVSNLPFSRDKQVILYPDYFSKVMAKLVHTVTISDTIHGYQGQSKGVALSLILSD

SEQ ID NO: 962374 - protein, 254 aa, Homo sapiens
MYDSTRHALARRKHSTTHICDCPQNYQSYLSPDKAEILTYLNQLRLRTTLHTTTLLYRDSHVMNFPTRPHCRKAPHSTGVNLGNIDRQDTSYTNLELCIMAHQYSPLATYAFLKHTAWNKEAKVRHYSTHYHMVHIHRNAGQVDLIRQRHHHPVAYRNKNRNLKQSSASIWQLPSCQSQRRHITHRRVRITPSRKCRSKPPESPPHFGLMAVYPNTRGSMDETDSQMFRSESKTIRVPAEAGGGPCFIPKIPIS

SEQ ID NO: 962375 - protein, 99 aa, Homo sapiens
CGAMEGGFGSDFGGSGSGKLDPGLIMEQVKVQIAWQRAGAAAEDDWTSVSVKCIGKPGGSLDNSEQKCIAMCMDRYMDAWNNRVSRPNNSRLQRERANM

SEQ ID NO: 962376 - protein, 316 aa, Homo sapiens
AVPSHPPNMVLILAETPAVCARASQLPRCTPVVPARPVPQALCWVHPSPPGFLSPLHGPAGALPADAVKASVHCMKLRQAVEWTLGPDWATTLCGSPRPEPFQAPLSSVDPFPSTKEQVPSTSYPGFVKTMPCLLHRSSLRQGPLQAISRIPIDALESGMPPSLCMQKGIFCGKKTGLLAPISTKMGANYARATQHCWKPTWEDMAGPPEEERHEMGPIPLGDPPQFENGAWCFEGNPCAPVWDEQGQETMDGLLKQKVIEQVPAVHKDYGFPRVVTLIVAWDQVGTIKWHNRGVDHWAQCGLGKQLPYPRIFKIT

SEQ ID NO: 962377 - protein, 221 aa, Homo sapiens
EDLIISELRERYPSDRFIAEEAAVLAAKCVLTHRPDVDHLSPICRGYLHFCAQIPDLWAEFSDCADSAVTDTELDFGVILPLLPEGRRAVVNNGGQAGGSGRAAFPCNLCASVGIRGGLSGAEEPMGHSFHFLVQPHVSWDVCGLCDTIMWGVHPLARHVINNTHKGYSRRPHFLSLWPFRSSSYPWKIKAIGRPFTYVAILVFPEPKESPVGLTYLSEVT

SEQ ID NO: 962378 - protein, 180 aa, Homo sapiens
MAEDNGVDARHQGVGRLVKDLTDQVAWREIKSLSTLALLRESRDHLISYLGASLKDRGLGTINSQLQESKTLCRASATRFKGNRCTRSGDYKWATYGLGCKQLLQRDGWPPRHILEGPINPWNKAYSDTGPLMQHEGFTCGGTKITGKGPKISLVQMVTHGPACGTTSSMGSALTVPWAT

SEQ ID NO: 962379 - protein, 80 aa, Homo sapiens
SALRGSWRSPGACARNVKLSNNAQNWGMPESNQVSTYQWPIMSARNKRGQCVVWTRLVGFLWFAQFWVTVLVLEREKTTC

SEQ ID NO: 962380 - protein, 71 aa, Homo sapiens
TKLARKPGCPEATACFNRLDLPPYKSYEAGGEKLLYAIEETEGLDTEYDRGLPSHAPQRYIVVLSPPVPER

SEQ ID NO: 962381 - protein, 262 aa, Homo sapiens
MNSTASTPRLLLASKEQVLHRVVLEEKVAHRGEQRGRGEHTPESAILRAAIQELKTREEALSGLAGSRREVTGVVAALEQLVLDGSLGEGVCLFNPGRVCWRYLSAFDEETTEVGSLDTPVLDLLLSRLENEEEAVSEPEPEGLPEACDDLELADDNLKEGTICTESSQQEPITKSGFTRLSRSPCDYFVTKRKMDSICSWDLVNCALASCGESGSLADVAPDGSQRPVFGHWRGNPCLRVFRTAFPDILSTCALPLVVSTL

SEQ ID NO: 962382 - protein, 131 aa, Homo sapiens
MPLNVADGRECTGMPLIGLFVKAGSDGEQHGNCPFSQRLSHDSLAQRSVFSVTTVEPVTGKQQDLLELWFPVSQPSHFITFNHVKRQHRLLQLRIGRNFSEGKSYALPSTLNAFTQIITQNQITCWKWDDL

SEQ ID NO: 962383 - protein, 204 aa, Homo sapiens
MPPNMVQHVVGQPVVAKPLGPEPGHRIREPLSFPSWSVPSAPVIDLCESLVARYLCDPGVAHARMRTRRCDRYVLEYRRDQASRARPAVMGDQPGMVTRGHPADQRYTLDRSQGLTLKYIELPCEGACSTSGHVLWQPRKKRFPFLGNAPRVVLSVARAPSPTDALSDGFSPALLRIWRGPTIFAQPEENPWRGGWGMASSSRV

SEQ ID NO: 962384 - protein, 191 aa, Homo sapiens
AGVSSILGAINIHHNTYHYITPWHNPIPNAPSSAESVLNHSECLHSSLYSRQILDCVAIYLTDYTEPRNLNKQHLLREPRREVGKKPHCYITEHRISWILYRGLHPVKSLLIFSSLYTRGSRGIKSCRTILERLRNPGEKKRDPIVEYPLWVTSMLESLFDVLTMSGVSLARIHPEDGKTRHTTLRQSVNQ

SEQ ID NO: 962385 - protein, 134 aa, Homo sapiens
QLLESSLQPPGFTHQPPESATSPWGSPSQPQGSIRPAIHAGVQPLRAPGWCTQASPKPFTPRGPQGVHLIQPAGGMHPFRCPLGGASAVKPSPGGSQSGSGLPWRSSNPIKAFRGRFQPPSNFLGGASPAKVPH

SEQ ID NO: 962386 - protein, 119 aa, Homo sapiens
MGWAGVVLAGIAWAGSDEVGSFALLTGGGLVWGLNVKRRVAGSWSRASPAALKGCFMAICPQFRAASNSPQGQRGWGGGGPTAGFHLKSLRASEHGEAGYGWHLSRPALCSQLKNLLEY

SEQ ID NO: 962387 - protein, 163 aa, Homo sapiens
MVPSRPTHHSSPTNVYNFSQQSWKFRSAYLGAWPTLGFGAPPLTAYTLGLPRAHTHPPDTTLNGEIRPHFEWEGERGLCARARKAIHQTRSRALVKNYIPGAAYSGKTLSHTVKPRTAAFNSSGLNAILSYPSKEHGRLQHRVPPACDATFRHTSPTFVEASR

SEQ ID NO: 962388 - protein, 183 aa, Homo sapiens
MQRRHGFIIPALLGGQSPGGQLVDELSSGGRLRGRWMFPHSPEIEETSCLGLSLFEERACRASLKGLIQVASREQLLYLYCRGYKRVTRWTLVLLLKPSFFDFEGTCTQLGSFGNAWVIQCPRPSYCRNNIAVVYKNSIQVGILRIPEKNGNEANRVLGASKVSIYENPCEHAPYFDTADNHL

SEQ ID NO: 962389 - protein, 441 aa, Homo sapiens
LESSMALESGKTGSSSRGRLQAGHHQEGEGEPRGGGPRDICAALEAARGFGLLCVAVSPPEGTLRAQGFLRCRMMWPHKWDLGCPPDIAPSSGSAPLGRLGFWARASIRAFQGGGQGGNWAADGPRNSGADGQSARVARDVGSRRILPGGNGASSTGLPSGKARRLEGQARSRAVTHCGQESRRSKGEHWGPLSQKRPPDGTPKRRPVVHPFRDRRLGRLETGGPPPAAISERLGPYKRAGFSEGGPLGGRQPASVPRGGIHSPKTIGSETGATVLRPPKRSDGLFGPQGLGWPEMNACPKGGLPGNWGPGCELTEHEGELTFGALCGLPGEYVMNQQPTRNPREGERRAGPGRPLFCPLEYHPLFKRELRGCTPHWRANRTCAGSPLAAHINRFPFQGGTVPRATLRGDWAPIIGVSCRGHPVDKSFANGSIAAPKPPKI

SEQ ID NO: 962390 - protein, 319 aa, Homo sapiens
MHALMHMLLAAEEEIRSFVSRFREWSKGDHFSNGKAKREIRTGILTSWRDFHESNLENNGGAKQADSWGEQEDKNSTQQKQRHTGDRTESRRNHSSLEAQRDGRKDMGASTNLAEHGESRGTNSQGGYRYNWAHSQGGQTIGTLCGTSGASRRPTLQEHSTGDTPTDGAMSTTQGADKFDQHLKDILWRNYDALTLTKHLATKASTTRATVTHRIRRARQQTENPPDNAAHKSPQQGRKYHSHPRNMIHTQPRGADTRDHVVPDTPRQRRWEFNVRDSHSCCTRGRQKNTEGDEGQTATMQPTGAQGVATRRLEKHEHT

SEQ ID NO: 962391 - protein, 127 aa, Homo sapiens
MTRIMNLLWHTRVPVIPTNLLTTIRQCSDRVMHMQCPNLSGWTVCAQYFVFLISRWLDSDMRPLPCELVPHAMRLTRKKSLKNTKIGGLSGVTSGGSLAMRMHAGELRMITGRDPIRVILSNYGDRV

SEQ ID NO: 962392 - protein, 210 aa, Homo sapiens
MLAAEYWSQEPAMRFENSSAVLELAAASQPKRRLYSQRMSVPRTSSCHQLDSENYLASTLGVETCLPYVSEDMLSRSKRYIGNFFQKRHMGIIHYIFEFFGFDIYFFGNSLAVWPRWEGGGPNHSHGSSITRGLKNPSHLGSWDYRLTAPPGLENFFWVDARILYVAQGVSGSWAQMGPSGLSSKRTGHLYFVSFAIIANKRSIPLMIAS

SEQ ID NO: 962393 - protein, 172 aa, Homo sapiens
MKYHQDSEAAINRQINLELYASYVYCPMSYYLDRDDVALKNLLPNTFFTNLMRRGTMLRKLMTLRNQRGARNLPSGISRNQTVMTWGERADCNGRVHYILEQQCESVTYVELHKRATDKNDPMGVDFIETHNLNERVTAINEWGAHVTNCARWERRIWLGGISLDEHTLGDQ

SEQ ID NO: 962394 - protein, 74 aa, Homo sapiens
MLGLWKLIGCAGKHVMLLVRVGLGSRVVCERLTLFWLGALSQARFRPCPLGLPPPLWSKAPRDLRLFQPFVLPV

SEQ ID NO: 962395 - protein, 129 aa, Homo sapiens
MHTECGKGFTCRYQLTMHSRECIQGRNTMNVPQHGEAPSSGHQLTAPRYILTVLRKLISVTNVGKPLVAHGRLTRPQGIHSGTDTPMECTNMCHSPTALNFIPFKIAVQDYSYRCQHLTMSRARAAQAS

SEQ ID NO: 962396 - protein, 353 aa, Homo sapiens
MLRCPIKEDIALTSDEWEVSARQRFQDLGQCRRPSWCTSSDTKDTPLEHHLYVVSYEADGEIVRHHQRPAYSHSCSMSQNFDMFSSATYSSVSTADTACTVYKLSGLDDRPPCTSRPAYWTSMTEGTQHAPRIMYPPRRIFQYPQRSIGMCEIIPGMIYKAQNAFSKPRERTQPNSPYLVHNHQDPKDADCMDYTSLSKGIHKKLARITTEMRLHWGHTPEEKQKDVPKTTSKYEDTTRTHKEAHEETQEGAQRRAQISDTNVVQDPRHNAEPQQDKDPTDTTLNTRQHNKRDATKEKTTTNTKLARPKDRTPPQYQDGRTTVAPANNHRMQQHNQITYVNTEITTQKIHNET

SEQ ID NO: 962397 - protein, 182 aa, Homo sapiens
SLADSPPSQRIMDAPRQVVNYGPGPAKLPHVQVLVSEITKGDSLDLAKEMAHLDGSWPNCSSQRHSRYERKHLLHHVAEKSLCAELGYADSQTNYTGDRFCKEVGAASSVLPLKPHWLESTARCADYVVTRQLGQLRPQKKPRSMGLINIVHPKLGQLYKKFQIQAPGTSNTDASYVYYMRK

SEQ ID NO: 962398 - protein, 147 aa, Homo sapiens
QKGFYSKNAKYKKKNKISLIPRVNSISPQNKDQRGYRRVKINAPEEGIWKAHQSRTGCGIIILYTHGRECPSRSTHESRGPTWISSVDGAPQNATGAAALCPCLIPCDPRKRSNAVWRPPPKGPQGQRRRGGNEKLRARQRIGTLWQ

SEQ ID NO: 962399 - protein, 212 aa, Homo sapiens
VRIPDTPSMAVPRMSCNLFVLNVTHYKKMQKFLGLPRVHGDSCSKKKPLDDQCEKLSAAGKTQECCVQANKLSFASLKPKWDKNQITYRIIGYTADLDPETVDDAYCSVPSQVWSDVTPLRFSRIHDGEADIMINFGLLVSMAMDTPFCRGKANGTSLVSCLSPTGTDVGGDSQFDDDELWTLGEEQVVRVKYGNADGEYCNVPLLVNGKEY

SEQ ID NO: 962400 - protein, 256 aa, Homo sapiens
MRFWRQVKDEDMSESLEKIKIQLDKGNNELVTKLKQQQDATLTTTTFQNEDEREERSIYDSTQGCKSKPSIKVYSAKDINRGQRKVTETAEDEQEGQTAEAELLESDHEVQKQNQKMKIGDYQDEPKPQHLDKNVQLNLMHNILTEDLSLGKTMEVESFKIMYQLYAFNKEEVTLVTNKQTTHGAGTAQRGTPLVGGPQGIHAVPQSKSGTHTWAPHNDEIVIKKDKPQGTHVIKKDEARATQAASVGPPGGRRTP

SEQ ID NO: 962401 - protein, 209 aa, Homo sapiens
FHTSSRPPPTVGGIARQRQRRSVGPDIAAQGSRVSVGVVGFCGGCGGVIFKLPAAVKLVRSLMLRATRVVAECACVVPGRRERALTVRARGRVVVAEEKGVGARAVESSSSSGLAGPRCFGSRGASRGRTFGREEGGFVACEDLGPWTEAGGLLRATRGHGGVKGARVQAGGVRPPDPPRYPRLHGIRGGNDRDGGRRMEPFLVPAPPP

SEQ ID NO: 962402 - protein, 261 aa, Homo sapiens
RLCRSAAVHTRRQLTMDDDIAALVVDKRVRHVRAGFAGDDAPRGVFPSIVEAAPGDQAVMVGMGQKDSVCVADEAQAKRGILTLKYPIEHGIVTNCDDMEKIWHQTFYNGAACGSRGSNPVLLTEAPLNPKATRDDDPRSVLRPSTPRAMYVAIQAVLSLYASGGHWHRDGLRLTGAPTLVPLYRGGIAPAPECNPCVLDPRLGPGTWTLTTFIEGFLKRAAANSFEQPRADAGTSCVPLGGPCAKLPRTSSQRCHGGTAL

SEQ ID NO: 962403 - protein, 69 aa, Homo sapiens
DPGTWKAFSLSGAMGCYMGKKSKRELKTSSEDEEEYVVVKVLDRRVTEGQVAYLLKWRGLFCGAQYLGT

SEQ ID NO: 962404 - protein, 63 aa, Homo sapiens
PTVKSLNPGRGDIWDFRILLRGLPGLAVPQGASWLYDSRGLPTPPVVPAVACTSGAAVSLLQS

SEQ ID NO: 962405 - protein, 102 aa, Homo sapiens
MYHYRVVGIALYVIRKFMAMVVAGIIVRVTQRSVCEGRRWTVDPRVMRRGRVRDPAGLGSSSGGSNPHSVIYVTPQKIGNNVVPARVAGNHWLCTLPRAALG

SEQ ID NO: 962406 - protein, 133 aa, Homo sapiens
CVVLRLLVQSYAKLHVPGRGQAITNVRYHGTCRMRLRTRQMTSHKGFSICNILSSGESLPQDSCTLLAAGMPHIHVMREYILTFKQVSSAGNVWEREDCGVPCMSDTHGCSYVGSESLVVKARYLLAHIQTLR

SEQ ID NO: 962407 - protein, 422 aa, Homo sapiens
SSGSEQYQVSVQLERSSSGSSNAARGVKQWHPGSFRQASSRVRKLQHLPQLQRLAALRGSSKSFSAQTAMNEEALPLQIQTTLKEMTQGEEQGGAHLLSPPKCTCGRLTRNCDERITSWRYFPPMGKIKHDGHARGTDASPSCPKGYAYVELENPDEAEKALKHMGWRPNLDGQEITASGELAALGLGQPPRKIPAFPGRMVCTQRLWWAAGLPRGMMRRSRIPRGTQVSPPVQPEKSRGAPGAVWQQEGKRTQESKRSSRIETGAHERDFIAHGNIFIPPPQEQVRGDTSPSTAGENHQERGRTLGRPRAADRNALNGEGEPTTYVTTEEATRRAEKTNDGRAQHKQMMALTTPIKPPEQLGWTDKPTHNACLTTTKNRGVNRKKSNTLMLLPTNNERRMTHYRQNTPQADRRVVGQTATT

SEQ ID NO: 962408 - protein, 180 aa, Homo sapiens
PSWVARNPVHWDAWSASHEQKDAWVRDYTSYRSPGPCVVPWAFVPYAVTHNAVICCLMDQEAEWPVADCWLHDTCGASLIAELVLLQMTYDEHHGGRNKWYDMFQEHDVQKTILKDKSCDGQLYEYAEHCVWQSGVWGGTEPEVGGPIHLYVLWIGASRRSVFRFLVVFPFGPRGIVSPG

SEQ ID NO: 962409 - protein, 113 aa, Homo sapiens
RAEVLVSAGFRAWSHRGGTAEEGRGLDARVPPRGVCHLRAFISSSKHGTINCLGNASLIEDHLTKKALGFWLAQNWERDHFIGFLRKAIVINFANLGATIRSVERIHWWGKKN

SEQ ID NO: 962410 - protein, 291 aa, Homo sapiens
MAPSRNGMVLKPHFHKDGSGACHVVNQPARKIRRRKARQAKGADRPAPRVWVPSGPIVRCPTVRYHTKVRAAGDFSPGGAQVGLAFTSKVGPGPIRPFLVDSSREAETKSTGVPAGPNGCRRLRKYRSKLIPLPRGKPSAPKKGRQSWWKELESGPPQVEPGPVHAPVGKRSIQKGKTRSEVIHWAKEKNFKRLPDNPSGMGPVAKRARGFFAALCGAKRTPGERRQNQDWFEKGKTYMALRGGLWDPNKTRKDREYNQTKEQKQQKGATRTKDLPEAPKYTAPSLKGGPN

SEQ ID NO: 962411 - protein, 173 aa, Homo sapiens
PEDVVQAEAGGMRTVESKQKWPGLFLRHASDEVCPVAQGITSSEHAATAVNASSVGKCGDACNDDMVVYTRCRAGEIMSHEAVPFNRVIGRCTYLVGCYRFSWRAIQTGCEFGTLCVQRQFVRNEATGGALWVAKVIATAYVKLVGRWGFKKRLWALRVKLNPNRFCVGNFGL

SEQ ID NO: 962412 - protein, 123 aa, Homo sapiens
NHQSSAFSSKRAPMQGSIPHVRIRVCLLLLKTDMQQRARATHVPYLGPEFGDGMLCLLHVALHMAAVTVPLRLNVAFSHSASFSLRSRVRPLWHDRCGWAIVGSLSPASRGSSQSGWLTRTTR

SEQ ID NO: 962413 - protein, 153 aa, Homo sapiens
MFKMYLVSKSFLKPSHLCRMLDVSGWERIMPEGIDIGEPLTDRVKDVTWIPPFNRMLHGRFDLWQAVRLGCSEHSKVLWWMPVPYLKSLVSSRLPRANPSPSENPSGPSLGTIPQAHFLLVMLSDATLQLQGKQLDLLLKFRHAGPRSDGTAA

SEQ ID NO: 962414 - protein, 104 aa, Homo sapiens
MLTRITLGEGISLGPHRVSAGATITGPRATFHSSGGVSLEDLAAQVCNCHKAPGGCWNPQGGAPKGGGSSQQKSSFFPKKKTHTYTTQNGGRPEGAPTGLRGRA

SEQ ID NO: 962415 - protein, 311 aa, Homo sapiens
MLLMKTGNVRPLLGPMVSHCSPLVQITVMQFQYDSKLPERSPEVYLHHQNKLEQHQVYGARSEPPASMGLRYNTYVAPGRNASGQHSKPCSRVEYVSSYELLCQEYLLPRRHSTVPYHPESAVSPCSAVFHDSLCSHFTDRSSPQMMSQPSAQELCEQYKPYQSSQAAQIIRSLSFSLTLRMAGVTTGNSHSPVLLSYYSADGGLSDVECEWKAQVEPQYRHPQSQHWELQHKPISRGTETVMVTEHAEMEATDTAGPRGPGEVLAHRHKSCVRNSPEKKEITTNTHKENRGSETEAQEPDREETRRQQEI

SEQ ID NO: 962416 - protein, 77 aa, Homo sapiens
KSLRQKPGDSTMTYLNKGQFYPISLKEVSSSERNPSSHQQSFDDVSHWLGYYSMKTKAEKISSKAVGSTGTPGEHTA

SEQ ID NO: 962417 - protein, 300 aa, Homo sapiens
RHSTSEPRGPALMVTPLVRKAMAPARTMARARLAPAASLPSACGFCARSAPGHPGRATGRAPMGCPRVADCLNSFTCRGAWLRAGHQAPSVSETELPSWESPTVRRGWDCVLRLVATTQNGANLALVGALQTDARGRDAIRRLLPHQIASTSRTSCASSRPGRGFINYLNEGKCTVPTRSCGPKGLGGSGIPRLGKAIELEGKTPRNPGWLEDVGDHKIGRLLGVTLAVSGRAGKAQTGGLCGAHGRPYLVQLDRWLVRPPEGGTSVTVRHQAQGYARSMVGLRAFPLFSPADSSPSGLP

SEQ ID NO: 962418 - protein, 102 aa, Homo sapiens
EEEAGSGRCVGCGLGTKWGVPVPDELDPDGPSADYGARPMACAARRRHSKFMCYAAGLLCAGAGSMPWRDRHAVQLRVPCSKPRELAAAHSFSMIIEQRQRN

SEQ ID NO: 962419 - protein, 139 aa, Homo sapiens
MSLRWSGFDLSGPYSPGLSVLVHMGAGGVGIAAGPIVAISWRMCISDIGTRASRGRQSRTEEHLKDNWGHTIPWTITRLTRVYEYQCNNCSLNSDVLMVMGSSASSSDYLAFGDYQISVRNSNGVLTESIRSGNGQILG

SEQ ID NO: 962420 - protein, 188 aa, Homo sapiens
MCESQSEDEWTPFDMSIQCSKGVYISKIISSDRDLWLWCSMVPRKTKNSVNFKEYLRLTGAGYIQVQNRILELDQFLGGSRDQENVFQDMMGHGSDYVTSEVLWVCAKLFSDVQFTDEVTKRIMLVTANERQSPMGIDSAKGQPGQDQKPVISGDTGIFLDLIAPEEMLGGFDNILVPTRRISISIDR

SEQ ID NO: 962421 - protein, 184 aa, Homo sapiens
RWRSAADPWRNAPPSPPSCLGSYRKGFGCGGHADRLRTSIFDDEIRTPFEVLKAADGTQKRERSSDGGDGRFGGAPWVASSTSARVRGQAGTELEFATTAGANRLRQIGRPQDRDPLRNTPAVLPHALGAVGWTTDKGGRSCQTGPGGRAFRVTNAREHKERSLGKERDRGVEASLSGGLKRGQ

SEQ ID NO: 962422 - protein, 104 aa, Homo sapiens
QRSTGPDGMAGPRVPSLRMTQSMRSEDCRQACDDMNLSEFPFSGGIYALWFLGKPCCRSQTGEPILTVVIKAFSDCELLKPNSGTGKDGHIWHIDSAARIDIRS

SEQ ID NO: 962423 - protein, 278 aa, Homo sapiens
MAAGGGGRMPDTNGTGGSSGMEVDAAVSPQRDGLQEMTGRCNRRFSIPLSYLKRSSDHLESEMQLHRKGADLLRGELESSDWASQEVPNISTVNETPFEAWHSPNNQMERTKINHLNNGHINYTPKAGSKYKTRVSNSELRRFWRDMGITNKRGANLVPPRGTIHNFQLKHALMLKESIERGPHKSYILQRSENAINETKGNNRQSIPCYKQIHYGTHSWLQFGIDYIRTRRNKGPRKLAWMTGHDGLETITTFHVAPHKKRDKQASEQAAPNWGTRY

SEQ ID NO: 962424 - protein, 386 aa, Homo sapiens
KSKRAGREHSGVASVVVQHCVGVYPMCLGQTWDMAWVTHVTEWVPSCHLTHLQIHLVAWHMGACSCALAFPHVPYAWTPLMGLEMLGMTVHVASGESYAAVTVTMDGANAGPRETGGPLWTIAAGKGGAGSGLRALLRPAGSQQMRTCWAQGIKDSREQGPDKCATFGDDLLVLPLSAGIRPPWGACALGQEPGNQGIPRGQVQQGALGGRRPRTKSRRPGHERRENVCNLTALFKGNGGHAEMGCHRPMWRHEAARTAHAVRHVPVTTGDRSPLWAHYPGSPPWLSHKRGRGGTIPLQRTRRQTQRGRHPEKQHQEGPHTKRRQVRSEAQWAHAREEEPEGSTPKKHEDRLGRHAVPHHRNMRTAEGAQGTSAHGAPPEESTHSA

SEQ ID NO: 962425 - protein, 185 aa, Homo sapiens
GSMPEFFHTYDKKVYQAREWDNNQRALTDEWTQLDMSYYELGHLTESFIKAIWSRTRICIARGLNFDLSPCTTLEQSLTFNRRDTPHNTGRISHHPQTPFYTQRKTTSSIVPFPTVGNLGGTANGGHHGQSPHTGNHLSPRGAATPFHPSPRGQRSHNGLIDHLNEHCGATTLVLPNTRHTFTLG

SEQ ID NO: 962426 - protein, 275 aa, Homo sapiens
MRCGKGQPLWLRCHQTPKFNFNSPASNHSGIRPEVKMEAPFSNKRELPWRVFNRGDCGQFTATAMSKAPQVRTRYLATLSQSRMAHIRRQPNGAHSKNQGAAHTSLADLFVNATKRLPPRGKQHHGSYDARRISPIPPPRVYRHKPLMRAATSMGSTLSKSRPTHLDYEKQREVDPPGPPQSNTTFAGRNMTQRQLLATSPPNIFGSALTPWTNVWKNSHAIDNSTSRHEVTVCIMTQPYRNHRDYAAHPIQVVFVAQTNSCRLDGKRQCRPDDT

SEQ ID NO: 962427 - protein, 176 aa, Homo sapiens
MVPAQRGAMPRRQRAGGLPQWRASDEALTHLSPRKEKALRRNLKEQSSSSDCQRSKGRPRSELAGHSTVGRFRKKENQKLLLENQLFTAEKPHGLVVENQELRQRLGLDALVFAEEEAEATGIECEASWPGLLVRSTQDYVHLCTQVLAQLSPLHEANFPSGIRGGEYGLFKIQEV

SEQ ID NO: 962428 - protein, 206 aa, Homo sapiens
MSLSALLAGGKPEETGSILVQSGRGSRRPGLAGPVEYRSGACGACGHVSGRGAREMRLGSLYCSLKAAGPKNWVGAQGPSKRPWPFNNPQFQGRGRDPVTTKEGPESLRQTVRTMCALSHCPLPAGGHNHRDDHAVWQSVEAQGETDVPGAGGKLPPPIRPRGDSEGRPRFCPWAWKAWFGQERGLAMRALFAEGPLIFHGCARPW

SEQ ID NO: 962429 - protein, 114 aa, Homo sapiens
MSKGGTPPTPQKGLVEFIPTSELTRTVWYPRHYLVTLVDDKRSGEKRNRNDQSQTAPQPPTEQQEGMHCATDEPVHTAASPPNTGSTRSTESQPAISREIASSQHKRVIAQLKD

SEQ ID NO: 962430 - protein, 211 aa, Homo sapiens
CADGSDQISDYCSWNIQEVTGSVGSFYKLNECSSLPLVGVRYTELDVSHDETEIQHQSDLLSLIGYTLLCDLLDSASLSDQTVSKYVFFVSISMLQLLNAKPQECIDWGTVGTLLLENPLGQKWPHPSKVFLYEAAKVVGRFGAGSYKLLLNETHNAGPLTDASIPGEDSVNYEDCVLFQCDHTNSRLSSTVLLNVVRSGPLPLNIHTIAP

SEQ ID NO: 962431 - protein, 280 aa, Homo sapiens
SSSASLLAAAASAARLLRRRGLRQLHRTESLNSRFLFNPLHRITGCPTMSDAAVDTSSEITTKDLQEKKEVVEEAENGRDAPANGNATEAHMGSTEADNAGRRRRRKPGGRGRARHARTNGDGRGQRMADEDEETLSSATGKRAAEDDEDDDVDTKKQKTDEDDYTAKNKQHNTTTKPPARRHKYLPPGGTTPTSPASPAEISGNTTRRVPTIPEPGDTKSQTAASAKPLDHRHRDAESPRRPAINRRTATSPLRGEPQAATHLPGTLTTRAKTQMTGHR

SEQ ID NO: 962432 - protein, 89 aa, Homo sapiens
EPGAPVVPGLPPVTSLLNICVVVVTQMYQVPTTRLASRDGDPWLYVGFRIHHWVGPGSRVCLVPPWSAFPVFWQSFWVPLLLSTFQGST

SEQ ID NO: 962433 - protein, 252 aa, Homo sapiens
VYGVERCIRLCESGRERTLTHFSRQHVPSVSILLAEDRFQNRAVSTHCFRGHIAVTAQGSFRSAQGSQRRWRPTRERNSLARNIRHARCVRHVSGVDDDRDLTTQFLKNCPEERANGQGRPKTVRILEAVAPDILHVSSNTSSDYAPMECVHAHGYDVTKAQKCTFGYLAWPNANISKTKKLFRPIVALHETFPPYGHTNPYPLAHTTRKLPHWKTLVPLSAKETPLLSDSEPEGSPIRNTKPNFAFPFMAE

SEQ ID NO: 962434 - protein, 200 aa, Homo sapiens
KKTKTEYLAELKNKEIVKKHSQFIGYPITLFEWQKERDKEVSDDEADEKEDKKKQPDSRRATAVGRLNLKLQDVGSDAGKHSTRNGLVHPSTVTATHTQRIYQVNRRYESAVPQAQNASNLNRPKHSLSNSWGTSNAKQFAPATGIHFDTCNTGSGTVTGAGTLSSLQRTALHSKWTWEDHVWPVKAILLKFERTQFGHS

SEQ ID NO: 962435 - protein, 362 aa, Homo sapiens
NILLLPQWKVSPTRRPGYQNTISCALGDGNSEDPMESTHVAAEDTCQEVSHVNALEIKRFHDGQIRTGESNQRYESSADDVPRTIPRASQGSKVSPGPTCKEHSLALPRAEGGSGHWDVVKAIPKPMRAWSHMRAPTVRHRQPGPPNIEPPTKSKTVMPGDPPRTIVAIHFRGLHGPSSGYRALSLATESWLSSSLQRPCLDTWALNAGTPLRCVTPLHFASSNSCVVPLPPASGPTAPLPLGGYYRSSNTRPFKLAPRGSINVAVLYSASQSLVAPRASSAQHGNTKDILIRIGIGPQRPLASTGIRGIKPPRRMTVYPPGGGAHSRHTAKQRFVYHIGPQRRLNMVHGEVHRTTRDIPIH

SEQ ID NO: 962436 - protein, 108 aa, Homo sapiens
AGVGWVLHALLCLHRRSPPGSAFGSAPGTGSGWRCCLRRLCRGPSAARLHGSASPRALSVQGTAVTTCAPAAGCVVRACAALHTTCDALAAAGLCRSLEKLPVHIGAW

SEQ ID NO: 962437 - protein, 153 aa, Homo sapiens
VRAVSMCVSVAAVPWGGWGVRTVGLVVKMSLRWCCGAGGRSQCTADRNTHRAHGGITTLLTKPRNSRTSPHLWDLPGRVRQKTNKGQRVLSGCPGDNQISISGSIQTSAKKVSLRTRLAIMTAPVGSGHSFPIWLLFLSLKFKVHSKLWKTKI

SEQ ID NO: 962438 - protein, 199 aa, Homo sapiens
MVLFRAKPKRTKYEERDRDDAYTEKEIHTTEGGARKEDHAPVLREQPPVRRRRVAPQHVGGGRRGDPPDVWGQAESNTVRQPHPEGRREMPHLLKYAHAPDRGRTRPVWVLPCEATPPYCGDPRRFLEAPSLHARLVVATKYIVSVVRLPTLGGLTLERRPLLIYCGVSLRRPPEFFHGGGVSVGCGPPSWVFARDECD

SEQ ID NO: 962439 - protein, 76 aa, Homo sapiens
DKAPVQPSSLQSGPRGTDEKPSGKERREAGDRDKEQELSEEDKAASKMNVEMRRGTTRGRRIHPVYRPALEELRRQ

SEQ ID NO: 962440 - protein, 136 aa, Homo sapiens
MAWFIQTLMIQMANMAKIHDHLQLSAEVVEGSRYQEVIRQYSIEWKTERQRHTLVFHHQFPHLTVTYRDEFEELDSVPLVKSSAGILSLVHQNSQEIQRSSQDEMVSTKQQHINTSQEMTDQNIQLKMQPVLQGIL

SEQ ID NO: 962441 - protein, 199 aa, Homo sapiens
MLCPGNVFPSLDGGLLWPILPDPGHTTDSPPAQSYLHLAIYSTVPILPKGAPRSPHIDTVRALRPNNCSVLGAFVDAGAQNRDPGFPKYPIWGRPTQPDLVSFPLCATKDTDMSARNENQPTQQRTARTLAPSAIKRAGLALELTSAYCDSKNCSLTPIDRTPLANPLSHHQNTRRRPRHPSNVHMTIPQLPSIGVYTQ

SEQ ID NO: 962442 - protein, 107 aa, Homo sapiens
MPPRFPTVRSPPALLLPRPPGLADCASGSAGICHRRCREGIGSQYGPVDPKNLAVRFRTPFLLDCKGEDGVNDPLLFRAGQTVTAILYISRYYTEIFRPRRTRGQGK

SEQ ID NO: 962443 - protein, 185 aa, Homo sapiens
MELENIVAEHGATQWPGKVAVEIAKGKSNEMAADAPVPSHQPVLKSCGSASSVTITACAERQPIGRLLFREFCATRPELSRASPSWMGVAEYEVTPDDKLEGMWAGSYAEFSEPHWVLTSSLRSPVKLVTKLHQRVDGRVPAKTFPGTHPGDQMSTERWPFLANYLDSIYFTVSLRWNVAGNAAK

SEQ ID NO: 962444 - protein, 113 aa, Homo sapiens
SILAHEETQELSNIFSMSVCQRSPVLSSYVWDWVSREAQVTDFPWYLIELDCTLGKTLPGEVMNRLWGSSMEGRSHPVVLARDPRKLTCRIARGTCLLAFPRLMCCRGIVSWQ

SEQ ID NO: 962445 - protein, 307 aa, Homo sapiens
GLERMGPVMDAALPPGLELHVCANNLERMGLDAHGAPTASSAWAWMLHVVPTCLELHGAPVMGPVPGLLALSCMGLAMGGWWLVPAFDLCHRDGAWQLRRKLLQVPIWWSLDCHAPGVASEVLPDISVRNLSFDFTWQDANGQIPTMCGHVLYADITMDNGNSKAVLAAGIRFDVARRWPTQQPARDEGHGMKAELAEETRRSAIDQTPPSAGCRNIQTIDYENLLTLGLATLVKPLSNFRSGCALLYTHFVNTNVHALAHPRRHTRHFHTSTQLCAYRRHTTMSTDTTHYDTSAHVCEQHITTRRF

SEQ ID NO: 962446 - protein, 580 aa, Homo sapiens
MSPEQPPPPPPALVTITPLGWMPQLPAAWSLVTITCNHDACDGRDPCMPDLHVEPWMLMNPHKDMSETLYEQDDSLQHTRYIEQLECTILHRHEQKTTYPLEPNNSRHRARKIPTTHAHPPANANSTPRTDTPTTYTSPNHHHSTTTPAPPATPNLHPQNTRAHHHTQPTAIITKQQQINTIEPPNFNLQKIIYNTPNIHYHSPLTHKHILKHHPSSQHPPTLLSILHTDHILIPTTILHRIQTTHNPPPPLLHFHFSLSLYTNSPLPIPPPHQLDDTLPQDYQTQSTTTTKHHPLTYTTPPNSTSPYHKQSIYINNHTLPPTPITQRTITTLTLLHLIIYPLTQHISPLPFKLTNHSPPHSTLQLSHSITPQQTNSTINHPTSTTPTQATIRTQQYSNTTPTHTIHLTSPTLNTPTIYLKLKPTPDITGKDVQTHRLRAPRQSELPYIIRSMPARSHKPGATHRVGWSRIDIRHTRKQQLHHLINSLLSTPHIHPSLIHIPTYPHNKTNKMNNLNYPHHHSLITPETSTNQYYITIITSISTSHHSHSIPTYKSLKYTTSHTQTHPLNTQPPHTPQTSH

SEQ ID NO: 962447 - protein, 77 aa, Homo sapiens
MRSNGIGFARTKLVLTMQGVTVTHCQQGDLSSLRLTKCFVRNTRCLRYQIPWNWIYKNWETINCQHLMRNAIIGGSM

SEQ ID NO: 962448 - protein, 423 aa, Homo sapiens
SRATSLRHHGEGEGTGVNVIMCRIRAAWSPVADFITLCTCGYKYAINDPYAFELNIHGLNVTNYDSIHVQIDHGNLSMADELGQLVIHMEIPSPSSSERRSLQNQVAAMLAAARTVAGSPLRAHYKPTHGMKARGPQYATARDATKRYIITTAPNSLNAPQSTKFGGETHERNGIRTPQTHNEQHSQLASLPHTPHMTTNNPPYGNTGTSPMHNTTCNSDGPRHSIEPRNCPCIAPTQTDPSPRTNSSSHVAPHPWNTLCAGYSALPVVPYSLPSIKSSNKDRCKLNIYQDPTLNRTEQDDGKGLRGPQQAHTKKRALTRPQTNRRKMKPTQPHKLHRPQVHSAPNTMKNKNRTNNLPSHVPTAQQDHTKETNTTTQHKPREQTYERTTGEKKQKEEKTKRLIKNRRSNQHQNEGPQNNPRHG

SEQ ID NO: 962449 - protein, 206 aa, Homo sapiens
HLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFWHCMDPGAGRPSTPVGWFPCFSFPSSNGRPLSGRPGQGPGVVKLRLFPAQRQRCIEKNILRGLRWGLPPQNHMLLEHKMERPGPSLRRVGPVLPPPE

SEQ ID NO: 962450 - protein, 152 aa, Homo sapiens
MMPPCPCPIASTLMLPPCSPLMKCSAPHEPNELCAHTCISCAIMLACMPHADAAEETGGAQPGMARCEFGPECVMLRACSMLPWVCAQIHRQNNWTPLPSFLSQFSPAFSRTSPWRSPKNFRRLYPPCTRLWMCSTLALLLNFLACLASYLC

SEQ ID NO: 962451 - protein, 353 aa, Homo sapiens
RGRTTQRKPVGEECDGGAASGYEVSSSYCPQEHGRDATWVTEVTLVPWGIRYGWRRRESRILVKGDDTTFGVTGRLSNRRILLRRLMRSMRNAWCWWLRPGSNIKNLGGLKGSSCRVVGRCASGLHTVSSAICRPDQSLWSPGLGPKFVVARSEASSRLTLVDRVTLIELLWPKNEGPNMHSLCIRMLRTPNNKLAAWLIRNGGHVIYCCMWPEPDREPGFVALNALQRSCVNGRTFRGFPFKGNVAIDSTGLRRRPVVGSESAPRCNWSNMKAAGSQVGPFEAHIAKENHGQGSLGQWYKGGQTPPKWAVARNRGQRSHRGMDHTEIRGKSNAWRVGGTLALHRAERSADNL

SEQ ID NO: 962452 - protein, 489 aa, Homo sapiens
SLAFADPPPVHTRRQLTMDDDICRSSSVDKCSEHVQGQASAGADRCTPCGPYFPHPLVVCCPQCLPEDCDWCEHVVQQVITSCEADSRTLDAMTTALPTLLERTTILMHWTFVQHKLADLHIGTENILRQPHITTNKWKPAAAWPPLTAQTTPQIDHCIVNLKRHPHMNNHPNGPNRRLTRQIDTNDSMFLQAPLLTSNPHRPHGHTVYKYSSHRDVLDLFSPDSPALLGPENPTLATTDAECTLHELNCADIAHTNLCNVPTHIPNPTGCSYKHTDTPTPCPYTLDRLLEYPAASGTSRTCATCRKYHFNTYSYLTNGTRRTITGLAPPPHQPRISSHTSAGSASHTAENPREPRVSPQSHIPRLTQGPRTLLHTAHKPCNPITPIPHSTSPSAPTLTPPPRHSPHHSPRRTPPTHIIPQPTSTYDPHLQHTLTPTLTLYHLLTLTPHPPPPHPYSHHNPTPHHSTPRHTPNATRPHPTPHEQPTIPT

SEQ ID NO: 962453 - protein, 291 aa, Homo sapiens
ACGYSMRSSLTLTEIISEDRFLAAGEDQDHTDSTYMACHTGLNDSTYDKVGNDPHTRHWPDFAMTADGPDEVHTMTHSLQQLPDEDTGSTIGPVDRPGVIGARQASVRHLGDNTVNQWTSTHWTSTCCDTPTDIHGSTTTTCTKSAWLTNNDTQTGVPASRGATQVTRGQQGTRLDWSLSYHSKCERAYSSISTVRTEKGLMCSPRATNETSKKCTIREGDMPTHQDGIAREGLLAVASYPKMNIHYPHDTEAHANMTLITLAHTPRARQPIAHHSSAPCLGRGHSTYSPK

SEQ ID NO: 962454 - protein, 185 aa, Homo sapiens
PSPLARFPPSPQDDVRGALRPGKPVDRRDLSTSHDQGEVAQAVNEEEKTTGQCPVFKAAVISGSQVVVGGANMYFTQGARSDDERASYTVRDVPMRTPCMRNEAPGPYLIVPEPIKRKHDELTYFCSVTLDKGPFSQNDVTARQSSVYQSVQLVIPPVSFSLRAVPLACRNGARDSAAAFCIFSS

SEQ ID NO: 962455 - protein, 249 aa, Homo sapiens
MSRFFTTGSDSESDVVLVRGGVSSSKPGRMPTMAEQSICLPEQMDEGMIPESMLFRSANGQRGFEELTNLILDHPYMLMKIRDVDPSAWNQLDAAVGNASGKAEEAVVDRMIGVPRVSILRGPVPDLEDYLNELWERKRNGTPKKMNKNQCSRSLRLLASEYPNCTTRDFESLIVTCRTSQSPEQSVVGCWGCLRGVRRSSLRMTLPPESVLCFLGGEPSAAPLRRVAVPQDGCSAGGQESGMWPLWPR

SEQ ID NO: 962456 - protein, 137 aa, Homo sapiens
MLDFFTIYSKGGLVLWCYQGRERSCTGPVNALIRSVLLQERGGNNSFTHEARTLKYKLDTPVGAGVGWLVFTKILTLTYVDKLIDDVHRLLRDKYRTEYPTAKCFKFIKWHFGFPKGASCGSFVKQRRAVRSVLPLP

SEQ ID NO: 962457 - protein, 300 aa, Homo sapiens
RRVQLGWARECPGGPGMGNRWWLPLEVSGSGILVAWGLRACGLCGRGRGRGALLEARPRIRSGLPVTKLGRLVERTLKIKSHGGDLIVFSIAHEGNREINCISSWGPSLKDGGYWTDYAMCKKADPVPASCTMVQCAYCLLSRDYKCATVGSGVYNVLHTDALATRGQFRVRPIILVPKLFHSYPSCCMRAYWRRKQRSGKCPLTCPFATVDMRLSADSWCLGTPFIPLHPWGATVHSVFRNLLPLSNSLGSTCSRWVIPTEPGYYLQAPGRLALGRPLGRQTFGPLGPSYLHCPFSKGP

SEQ ID NO: 962458 - protein, 175 aa, Homo sapiens
MVDHGEGRGPSPGGPRDPLIQQCPPEAGRAYSRNHGLPAQSAHPGGRLVIVLPAFRAWADILGFGVPLGRRGGLSTRVYLLGLWTDAFDCHVGLVRSCGISPCDSTGSTFGPTGGLAAPTEPQCARARGSDTLCVSPGSFSRRNGGSITPLSSRNRALPGEVLLRHAMGQNMPPR

SEQ ID NO: 962459 - protein, 330 aa, Homo sapiens
AKQILELYMLYNAGDREEEAWMEIINKKIWREISKGLNLPSIITSADFTLRTQYMNVSSMPMSVRRKALSSPARCSRHAIDGNRREGPVAQLGAPPSLATHLLRATAACRMPGPLSLLLPHPRSAFPILGCCGFRVSGYQVPTLALVHTPPRHTTSQERWNGSPLVDNHVACAEIVRGLCPLTLGHSPGRVVYSEMRALVMPVFRELVGGQEVTSLLQKQGIDGCLRRSSGWLRQAFLRNLFQNGSAVRMRSPVDWARHEDLSGGPRLALGLDTEEPCGLHIWGPLAPMQCGRCPHPSAPVDETQSLAFLLKPTVHLHLSGGFAHYRFRG

SEQ ID NO: 962460 - protein, 87 aa, Homo sapiens
MYRTNLFLTNVTLRGGDCSLGEQRLFGTLVCAHDVDNHFYKQLINNIGGEDNQHTGGEHVSSHNSRTTLAVDHNKDTSALIATTSFA

SEQ ID NO: 962461 - protein, 283 aa, Homo sapiens
VLLRGALSLVSSHEAFGHRNQLAAYTGTGACGLRRTPRPRRAMLWLLVGVAGPGAAVFALLDVWYLVRLPCACAARAPAAAGVRDLLAEQRFPGRCVPSDLDLLLHMNKARYLRDGQILRASPPDPLRCARAAEGRLRGAHGAGGPRARRHRQSVACGALRGAHPACLGLGRPGVLPGGAALSACGNGFVCALLALSGRGTSRGHLTTERVVQAPCCQVQCWSPRELAPLDLAATGSPTKEAAASFSDWRVGLSGVPQDPLAGTLTVAWAHLGLWACPSGGSP

SEQ ID NO: 962462 - protein, 159 aa, Homo sapiens
GVTDKDITVPTSDADPGEPADDPQTNAVGSDAVIDEASEKSIASEHENTEYQCVTVLPDSPAEAPQDDRSVVMQALHQQQLGLRRPVEQWSLEASDALRSECVGQPILSRSDDGDDRLSVLAPSVAAAAWCSVIERGTGPDLTVAASWSGSGLPRGAHR

SEQ ID NO: 962463 - protein, 225 aa, Homo sapiens
FPAALDEAEPDSAAQAGPGALAGRDGVGPAPIPAGSPSAHRADSDGTMSVSRAQGRAEVLASICRKTPGAFRYSSVERCDESCTAMFLVAGEGAARTSGRTGILQGLQVGKQFERELPYSNSFLTTGNNGSGGDSEKRPQNFVDPYKVSGNSVLGKKYLKEDKPMWDLARQTKKEMVDSHRTAQQAPRDRKKRTMGFCKRICETRPLAHSNKWKNCHGDRQQEDP

SEQ ID NO: 962464 - protein, 78 aa, Homo sapiens
ISSLVAHTKPVGGLFTATRMKFGAITRIRGPPLGDQSPVLLLLLHEKDPPTISAPQTNQPKEHLTNFKSDLLSLAAED

SEQ ID NO: 962465 - protein, 70 aa, Homo sapiens
CVSNLSGLRTVAYERVKLEKLEGVVFWPTEIPGLARTDQDSKNCTGTGHAQLDIQKIVEFDVCNLECHVN

SEQ ID NO: 962466 - protein, 102 aa, Homo sapiens
MYRPCVSQEEQVPRSCPVVPSAEFPVLLCLLTRTWGWAVTLRILSELRGSSRASGPPLAASSGRWTSSIFHSLVIRAESDGAAASRKVIWSADVIKLLPLCR

SEQ ID NO: 962467 - protein, 80 aa, Homo sapiens
RVNGRLQVVKLTAELIEQAAQYTNAVRDGSWTSGGIKFPSLKSLGAALDQLGMASDFVVTNEIRKLDGSPLLRRLENIVR

SEQ ID NO: 962468 - protein, 287 aa, Homo sapiens
MVLMKHLKRVAAPNYWMLNLSTVVSAPRASTGPRWWRTVSPPHQLYLSAQSLGAALTGYAVGEYFAVLRSRYKIEWPGPDIAVHLPCWVHGMSSGIEQDGGQMSVLLYAVTKGRLSCTVVVTALEGGQTYRVVQDVMKTDSYVRDTNTEIPSILVDCNDALRRESGEARIPLIYGEGVAIHELLLEILEELLLSLKYARLVNLCVVTWGLLPQERIGVDHQAEQRPLDLRRAHVRGCPMATALALEVSDICVYWAAVNPGISLPRGKGVRRALVGGNKHLAGPQHGV

SEQ ID NO: 962469 - protein, 335 aa, Homo sapiens
SSLPACRSSSVYVAPRRESRASGFFASAPRVAISRKLECRRGVHWCAAGRHSAPSVSESLGPGRCCVSSASAVGAVSRGTRAVSRAYWDEGREMGSGELYTDSVNRAYRQADLFKEITASAVRVWFGRGRARRMRSQAAVSDIWAQGGNCEETWQFAYRMFEPPPGSVENRGKNVVKKPAWGRKSVSCLAQIRLVVTEEVSLSPKIGTMVLNEPRTPGIAIRAIVMCQCSFGLCVDVSRERYAWCLINSEDRPRKGMMWLNPGYGITCRTAVSRKRSLGPLGEVGHCTLGLRRGERLTLPVTGPRTKPQTFCSRARKAPPRFSGGMLTEEINTAC

SEQ ID NO: 962470 - protein, 116 aa, Homo sapiens
MSSSPLSKKRRVSGPDPKPGSNVLPKPVRVVLKCPRLPTNENGQELAVKQTYDEGLYSRQLYVLGHEAMKRLQTSSVLVSGLRGPGRGDPLTNIILGWGSRACYPYMTMGNLPSGA

SEQ ID NO: 962471 - protein, 273 aa, Homo sapiens
MLPAVADWLPPARSGVLIQVILVADVLRKKHRVDETRPVRLSMNCVMYRMCLVLNQRYRHKEHSAIMHASCICKQLEREDTRLDGDCLALPVLQRPVRRRMASWGRGFVNRAIGLTAASSCRACIIAMDRSVRGPGGPNRAGEMSLVTCVAWHLGDGDLSYVGETPTLGGLQSPEMRGVPGVGSGEAGGVRSLDLAGGCPGEVAFPGEAGRITQKRARASTDERRSEGDSGDRMHDVAQRPRVVGGSRVTFKERAFTGPRPGRGQKLANKRTL

SEQ ID NO: 962472 - protein, 120 aa, Homo sapiens
TIACEHAVAGTITKRISCAYLPTVLGIAFDRCAPRWHVGEIGCESVLPVCNCARSLDRLIVFITRALHLIDMSRPNILSFQRGQVALHVVLYLEHELIRYTSLSVLNCYELEGSFLWYGQ

SEQ ID NO: 962473 - protein, 122 aa, Homo sapiens
MCWRNTRCLRGCNERGQCLTRLKRLGVGSTLSDSCPSCVHDTGRSRSRLPGSVSRPFLELAYFWFFATGMVQNGGAVVGRPHWWGVPALTFWVLHPGLHVLQGCGYPGRLLIVFGAPPGRAL

SEQ ID NO: 962474 - protein, 114 aa, Homo sapiens
MVRLGGTYEMSPEELLASDGQTCIGKTRAGKRINNLEVLTSRIPKAYFHLLNQIATKEDNPGRRTTDRSLTCQVSNETDDSKRAESMLQQADKLRLQTVVTPADVVSGKPKLKR

SEQ ID NO: 962475 - protein, 142 aa, Homo sapiens
DCTARPARPARNGARLPPVAAAPRLGPRAGMAVPGAEPSGCDRDSRREQTEGKTRKAGAGSVAKEFRVLSGILQRMEQGGGDKPGELLLAPIWQGVVGSPTGFLTQFRPQGGGPDRGPSFLLPTRGFDLARKDFALLWERVP

SEQ ID NO: 962476 - protein, 135 aa, Homo sapiens
MEYKRTDAPQPDVKEEEQRDRKRNKDTGSMRRRTEQETLEEQTEEVMLNEDGGTVYSRCEEGHENLKREVEMQILNQISNESRQARNESETILRAGSVISSPSSPAMSGPSAEDLERLRSDIQKNFKTITSAGSS

SEQ ID NO: 962477 - protein, 114 aa, Homo sapiens
FDLSQLHRGLDARAEVTRNDVAPSLMSVPRYLPRPASPDEDGNLSDENLKAVDTDPTAPPYDSLLVLDYEEKRFRSCGSLSSLNSSESDKDQDDDYLNEWGNRFKKLADMYGGG

SEQ ID NO: 962478 - protein, 444 aa, Homo sapiens
DESERGMKVIENRALLTMRNTMELQEHSNSKKLSTLQKRHDRKYEEVARKLADHLRGELGSAAAAYTSLRLASRSRSAEQTGLTQTYDLTGPRNLHSCSELLPARKRYIINHTARLTVCTEEKSKHFFNLTKQPPKRKRQQPPRMPCRLPAEQGRTQAEARKDRRHHDNPPTHLTLHRHGITHLHTLTNWPANTRKRSHTINAKQHTRNWLEHPRSPNAYSTPWRTCHASLPQDRPPPRLPQPPLALPWPPLPPSWHPVGNSRPFGRAPLPLAGAPTLCNPVSVRAWDTRARHCFIDEPWGYGDLACYSLPLSSRSQPARTYAFPAWVLRICNTAPTHSLGTSYGPVLFTPGTQPSHAPRRASYPQAALGSASPFLAPRRGAFSHRRPPCRSAHPCALYTAAPLLVTSVPSLSAPLAIPPRSVARALYPALSFAPDDPRYRGTP

SEQ ID NO: 962479 - protein, 243 aa, Homo sapiens
MTSLKVDKLTYRNLARHAEARLREVRAASATCTSRGPVTKESRGFAFVRFHESATLKGPLWMPLDGGQVLGTEQQSLRGAKWGAANGRPPWSSKPLAAGGTAHARRYGGRLIRDGQRAEAPRQRKPEGPNPRSRSQFTRSRQTVSRCAGPSRKVLGPRDLVLESSGRNLQGPDSDGGSTSRSSSGLQNSSSAVTGPGLGPGSPPPCVQRDPVHVGLRVPRSSEEDEGALQNVFGHVVGAWKGL

SEQ ID NO: 962480 - protein, 68 aa, Homo sapiens
LPDLMCHCLAGMAMQLAVLGDGMLGDLMELYRVMDDQPQTSNENFGELATCDFGASQKACLWKGKAAN

SEQ ID NO: 962481 - protein, 140 aa, Homo sapiens
MYVKGASMNGVIDRCTHIRVGSTKVPMTSGVKQKIMSVIREWGSGSDTLRCLALATHDNATEKRTKCTLRTLPNYYFDSETNLTFVGCVSIAGSSRTRGWLLRDAVPARRHSGHPDSLGNTQGTLVTISEPKSTIIAATQ

SEQ ID NO: 962482 - protein, 71 aa, Homo sapiens
GCYRPHRLSMQGNQSAWFTVVASNILPVHITSLDRGQIASGSQVSMCMWSVPLAVHDFQLRVWNTRCDSGT

SEQ ID NO: 962483 - protein, 75 aa, Homo sapiens
MRNPVGGLVGTNCPDPMAVGEGGQACLGRGTFGPFCRLEGRCLAGPGKQSGDHRGPDHPGVGMEGFREGPLVPRC

SEQ ID NO: 962484 - protein, 219 aa, Homo sapiens
MMLKRRLKADEDSSEREEAKQKELSEKQISQALLVTPSHYQLIMVCGPEEESVDPRSILQRVRSQAIHQLKVNGEDPYPHKFHVDISLTDFIQKYSHLQPGDHLTDITLKVAGRIHAKRASGGKLIFYDLRGEGVKLQVMAKFPEDYKSQIEDIYSVLNRQTAVGETEFGVQGESCVKAQKGELEHQFRDADHTCCLPCLHYVTVIFTSETQRHRKQGI

SEQ ID NO: 962485 - protein, 84 aa, Homo sapiens
KLIENPYVEDVYGYQKNSNIQAKGVRSSGQKITHVVSSTMMAGLLRSLLTDRLMPGAWVRKKEKLQFHSDTIVCYKVPASKVTL

SEQ ID NO: 962486 - protein, 168 aa, Homo sapiens
MVLSLEKFTKRSGRREQETVVGILNANPMKPKDGSEEVCLLYDHPQKVLIMGEALDLGTCKAKKKNGEPCTQTVNYAVTVSTVSTMSRLRYNDSSVQCCAGSAVQAISGSNEFHKTVGPQKAARHQRTGCAKHGFTLRDGRIHYMHYGIAEYKLASRHDVFLNQRYGI

SEQ ID NO: 962487 - protein, 102 aa, Homo sapiens
MKNLQNLRHTVALEPAQRLRAERTGPGKPMSEELLGMLDSPMLGVRDEVTAVFKENLNSDRGPMLVNTLVDYYLEIQLTAGYCTILTHLAMSHMTKQPLGTG

SEQ ID NO: 962488 - protein, 148 aa, Homo sapiens
RCRVLALAAAAVRCLRLLRCPRRAPLHQPLGGASAGRPGRGGTCVAGRRTGYLNYGQIGTPAKITTILITAKPLKDQPLSSRGPQRPFLRMDPQVEMAPSNKEVKRRVQADQVLKGPEGPITINDPIVVQHVRTCNCGDKNSRCRFWN

SEQ ID NO: 962489 - protein, 279 aa, Homo sapiens
GRGGLSCRPEEDQCRRTPAERHAMRVRSGRPSIGGAMNLLTVLTPHGQRASSTAGLQPVTTGCYGDVALDNCDPESITRDSTKTKHRETTNFLRQERVGQCVNTVTFGCQRILRFSYAWVAQKSRKYPSQHKYIDLEIDREDRQTCNLPIDKANRSSAEVNAAAEIRNSARYMGRPLIQGVHISRGQSRISWHSVRNLAITRKGLSVLGPNSNNYPTGLFRDTHTGHVQLVDLAKNGEATGEHSCTTRVYRSWHGTQPGREQDCNWIRHTGPYKNMETQ

SEQ ID NO: 962490 - protein, 109 aa, Homo sapiens
MTRGPIKTKQFAPIHAEAPEFMEMRVAQETSGDCITVGTILIAPLCQGLATLGACGGAGSLAKTGLAHGVHSPLVAKPMAADLCLPGCATDRARPPFSLMAKRGSHLTM

SEQ ID NO: 962491 - protein, 127 aa, Homo sapiens
CDVLPTSRPESEMSDDLGERLYGENQCDWSRSVSRRRHQMVKGEGDTKVMQHGDKFHVPVPSVGTTTERPKTKCLVGYNQEERQENTTRDLKDTMNDNEDILLMFLHNIRTKTRLPEDLQKLDEGLL

SEQ ID NO: 962492 - protein, 147 aa, Homo sapiens
MAPGVVLGTNRFLRGGFPGTAGAHLAACRSDGFDGKNVPPAGAAGPGMEGIRGGSPLVRAERSVVLGRGQRGPKERGFHGGTTPEKRHKKMLGIRGYSFHKRGSGDFKSGIELDLWGQGELTLLESTNRWKGAHVTCAIIRCGTIGS

SEQ ID NO: 962493 - protein, 317 aa, Homo sapiens
SFQVSGSPARGRRGGAGAGHGIGGLECAAGSRPPMEPGSVQNLSIVYRSRDSWWSNGGSWERSHLTSEGVAGRLLDLVREGTLRVPGFPRGWPTLDTVLYRVQGSCQPGVDFSTQVGRLCGGPYNEGARRLGRGVRGGFSGAGAVTQRLYPWRFAAGGPPSQGKKPWSKPIKPLPIVKGTTQLGGGPGPHRPIVASEGLRQGLLVNPKKAKASTKNLGWVPWHPRAWYRKAILSSIGRWLKPVHGGGDTPCCAVHLECPGPPGGVGDLPKGKHSGWEAGRRMSDGSNGVPGAGCWGRPGPLALVCGPHLYCPLTLAQ

SEQ ID NO: 962494 - protein, 130 aa, Homo sapiens
MARWCPMKHLKLGGSSLKHWMLDKLSGVLAPSSIHAVADKLREFSRLIIFLRNRLKYALTGDEVQKIGMQRCIKIDGKVRTRYKRTLLDFMDVISFDEAREQNFRLIYDTKGRYAVHRITPEEAKYKCAK

SEQ ID NO: 962495 - protein, 54 aa, Homo sapiens
MDIAHAQERLLGLRGCHAVRDPFWPQGIHEHALEDGASGSSGTNVFDPCGAFGE

SEQ ID NO: 962496 - protein, 47 aa, Homo sapiens
GPGGTAVRKRNRSVGRGSVAWEVSPLLGSGMDTKKRRGSTPSSEFRA

SEQ ID NO: 962497 - protein, 90 aa, Homo sapiens
IGDVLRHTYEGNEGRELRDLKEVLPLTGCVEKCYSGYTRRRCDGRQSAPIYAPGYMFSGRRIDMCNSLRLSELTPDFEEDGAMLETGIPR

SEQ ID NO: 962498 - protein, 72 aa, Homo sapiens
PTCEARSCTRCQELIFEEFARFILVENTCEEVVLQTVMIGHPCRTVEGEAADAERSTYHLPVTALGHCPDIA

SEQ ID NO: 962499 - protein, 150 aa, Homo sapiens
MRALLCPLAQTSALLYSAPSAGLPTPRTERYSLSGPPHYGTYSGPYNLKNRGPSTHPFEDIYTIQIFPPYTDYNPFLCPKITRRTLFPLQPLTRLGVGDTVLTWCGAYSHDKPALLLYGESIPNTFVWGHTSIYNTRVYYRRIPAIHNSR

SEQ ID NO: 962500 - protein, 176 aa, Homo sapiens
WRDKTSYRWQLLHRPQVGYIRGEALMGPHAWWRIGVIIDTIHAEGGVCGVFVLSPNENSNLVQVSKYRMQMTTVPGQFEPIPDGRLLPGKGRDGGGHHDSELQTFVDLFALGSSWRRLRSKYSPLRPNQQTRSSAPKEEVPSPRGVGRPRALQGHETVFNGVLRQALTPKDDSTLP

SEQ ID NO: 962501 - protein, 106 aa, Homo sapiens
MQVLYIKDLLTCTIQEMKEQLKHDQDVKGKGYSPEWDKFIVQTSGDNLGFVDSRNTLQIFLERLKNEIDQVNYSKGIDYWIAWVTFEDRFRGLFWETGVPNPCFIS

SEQ ID NO: 962502 - protein, 283 aa, Homo sapiens
MRTSADAGGDTLLAYRAPSGTSPWQVPIARGASSGQKKYQIHLKRVSGPMRFCGEQGGMELSLCGVPVPTEDLLQSPSAVSTPPPLPEACPSPVPGSLTSKYVLSSLPLVSLAVRKSRNGWPAGGDHREWGPGTDSKARVSSVHVPRGPKERLDTRHCSLLPVDKKQQQQREQRGEAPVKAAVRSGTNLTSSFEAIRETPQVFVELPMELSEIFDPPREWLSSEPAGALVSQKCLPSVGFPPGDLGIFNWGNDGFGPIVGLSSREGGGAVWWAKVSGVGLSHY

SEQ ID NO: 962503 - protein, 150 aa, Homo sapiens
MPRRYSDLPRCIQHMKHPIICRLIHFSNSSNINNFMMEKPSLRGEKVLIVEEPSETGVTIWCASYTIRERIHNIQTERTDRPAKVVKQPMAHDFQNTKRGGKDRAARKASLRAKGGNKGDAAERKTGARDGHRAEIGARVKYDAMLALLQ

SEQ ID NO: 962504 - protein, 352 aa, Homo sapiens
SVISEIREEYPDRMMNTFNVDACQLQSCLSTVVEARDKCQPLSVHQLEENTDESLLQLYRRRALVMILWRITHLMRAGPQPNAIGDSEAMLVVSQLSGVTILRSVIPGQLNADLRRVGSQHGPLPTSPFLYAVALPLSPAVEASSIELSLVPELSQEVFDAKNMMAACEPRHVRYLTVAAVFRGRMSMKEVDEQMLNVQNKSSSYFVEWIPKQCQGQRPVTIPARGLIDGSHLSLGIGQGIQEGLQGDVWKQVIGHVPGQEALSFTCVPKGEEAWDEKGVNQRGVTRHVKDPVLQIYREPEEGAPRKTEERHIRGGHTKRLRETPTNRKEAERHNSGTETGRLIPHKEVGRR

SEQ ID NO: 962505 - protein, 102 aa, Homo sapiens
METGEAKAGLQERGREGLGERKSVRLGRRLMPVDPKDPGKPKGQEESFWSPGSVEPAVPGVTIDENFVVYYMRERSTGYKHGLGREWLRGGAIAQTGHPVTE

SEQ ID NO: 962506 - protein, 323 aa, Homo sapiens
DADSTSWDGALAMMTKLKEIVATETYDIERVVERSCKPVDGLISTTRNSDEALSVSAEELPLREYHRRRGSTSMSCYISTSPEGFRGVVLAGEGRGVVWHAHEWSHGRGMHEHKFARRLQALGEVDDNHRVKMNGFTGIRRKHEAPGMHVREMVGQDKMAAGPCVLEERKIELNVEQGLAGEPYSTNVDPFSSTCPEGVTLVVGIEFKVAVGLQMRTQLSVAGPYSRGDAPLIRWLGACGAPEYRLADGARLMTFVELESDHVVVFRELGQREERIAFGRRSPFLEPDKGVPFAGAGATGQEACFSGKPDGRGPGLNGGDRFS

SEQ ID NO: 962507 - protein, 119 aa, Homo sapiens
MSVQGLYLSYICMRQGLCSCPPGWECSGVIIAHCRPLYSVGSRQSSWPAFRSQLGTYGARQPCLVTFHLVRRDGVSWVAKGGSQMCGSSNSTVCGFPSAEIADVSPRAWADCLEHPALP

SEQ ID NO: 962508 - protein, 303 aa, Homo sapiens
PGTGLGGLGGRHGVRYTHSQRQDALVLAVLAERASCRSTLRHSVFISKRPGVWVLSMPSLGSVLVVVHLLFALVLAPNSPSQIGAPCSSLGVGDPGKEGFERSRRPGELGSASPWSSSTQWLLGRREDTVSPVDWGVVCPSSSCSVTLRMNTCVANLMQAVARRSLGPGAGWVSEPCAACGCLRLLVNAGVGKGNIGAGYSERVACGGRLVGRSALEAVAEDLDHTGVGAQLVNFDPQALVANLTKVEPSVVWAWVQGLFGPRTRGLVYGLRNIPYPPGVTHILGVVDPGSGLTEKLPPLVNP

SEQ ID NO: 962509 - protein, 103 aa, Homo sapiens
GFLRYGSQAYIPKQSCSKGPCSGYRSRRQLLLCGCFQHGKVEIVAMIRETEATPSYVAFRGALHGLIGDAAKNQVAMKPTNTVFECQTSDWTQHLMMLCPVVI

SEQ ID NO: 962510 - protein, 303 aa, Homo sapiens
MWPVLDHLLDCPADPDYLATTCLDSQNCSGLTNVLFLDLVLPDNSPVLAEDRCTAVPLRATCEKWSFGRLATSMDELFVDCEVMTSLFAGYQKQLSILLRHLPRGPQAERELQKIRIKLMCEVTEISVESKHQSLQGLDLPAEGLRPGDFSSYKQKHGQIPPDDVDQERENTLKVVCNTEAHGLLAQVVLPGLPELGGGNPGLPLESQPQKGTPLRLRKVHITLPGAKWPNRIATTNQRQKSTNTQVGSVPIGESTSILVLTNQSNRGGTTAHICQSTLRLTNPVASRDESAHTDFSPFSSVV

SEQ ID NO: 962511 - protein, 342 aa, Homo sapiens
MDAACVCEVHPGTLPRAWACDPAAAGWTSVSCMSLLLPVMDAALYPCASYFHVAVHAWMIKPAHAVNDAVAYLECLDGNVECSMLLVSDGTSSPCAMNYLDRYLSAVPTRKAQLQLLGAVCMLLASKLRETTPLTIEKLCIYTTTLSLPASCGTVEVLVLGKLKWDLAAVIAHDFLAFILHRLLSARDDRPWSKRMPDLFGLCATDYTFGMYPAFMIRTCCIGAECLAWVLVLVGMSSRSCWHGSSAWIGSLGGLRKQNESCPQGKPQGIRSKKIKSVVHSPGSSQLGSMKETLKVIANQCRASPLVTQQGGRRPIIEQHYRWRTHKRHNRPAAIDASLQVG

SEQ ID NO: 962512 - protein, 636 aa, Homo sapiens
RGELFWCPDVVHGRWLSSTILDRQKLLLSVSRDSCEASIEASDILDGGVVNGGWSLNEVQMPEEGMPELNCECRGVACVHSSSLVPWMTCTTGHCVLALDTSQNGSCVEETERAVMARVTPSPSVQGFELGGHLGSSWRRGAGICPFGYCDCGQGVEVRPPADPWGMIIRPIPSGLRRRSNAWPVGHCTSHLRSGHSCCSLPPSCRRTCPIFVGCGAWTPGCGAVSKLTRFRAGSWKESGDLGVDDINVILTGTRHLTPRRLCTHGTTSTRCVVAYPSVRKYALPTVSITFVWRFCRGQENPLSLEGTPLCPEGGATTKRTEASPRMGQKTPVETLVKRLTLQTGREGQHYLTHTSLPRACQTSIHSSEKCARLQHAGVHRPRHDTLRGRLPKNHSEHDKGNKLHSQNRGQTENMSSSRALHNDTSLVDHCSSSPHDHYRSHAPEKHITRSAVPPKGGERQVLAPDHDAPNTCWCPATQERRTTKQKPGPRTIHTEHQQTRWETPYRGHGPTTNPSGRGRRQTHPPRRGAPTTNTTTRRGLDEQPDEERRRHPPPDAVEMRASYPRCDATATRTTDTPTHSRALSRDDQLDPYRSQQNTTKTPITETSDTHPPAHDRRRSRPTQHIQSTRAATEHS

SEQ ID NO: 962513 - protein, 88 aa, Homo sapiens
TASIAGGQALYEDIANRIRAEADEPCTISGMMEPADPGCDARAMTCGRTKDLRISEMNPEYIKPGRPGVIMEGLQKCLTGVLPCEGGL

SEQ ID NO: 962514 - protein, 228 aa, Homo sapiens
MACWEHRRECNGLTVYMCSVYALSSQRLAPGSGSNGTIRRLNCPLVTDESYVVFVHVPLIKVNSLKTRLHVSSRGERSSLEATDAFVTDFSAHVPREQEPVARAKRHQGSRDIVFAYRGGLTSVPASRHGVLQWLQWTCGPPGNRVRAHQSVAQGSSNRSPVLQKRYWAGNKDSGKAHTAGPFANGDKGRLLARVPGTAFNPLQLRWHWGIVLRTLCLKKLLMMAWYR

SEQ ID NO: 962515 - protein, 305 aa, Homo sapiens
MRKDTNKSDCRDGGYKCELISTSLSYLNTSLSPMHQMRRAPTAKPKEKNTHQQQGTKTRDTTRTTTTKTRQLARRGVDEGANKPRRKNERRTKGKTERRRTNEQPQRERGNQERQDREQQLRTIVRRESNKKAHKSDGYNQQREGDERRTQEMQKDRGTRRDQLRYEKHNLTQEDKRRIIDTAKHQEKKRNDKKKRDTPQTDQREDPNTAKKDKERKKRAEVEAQEKKRDSTRPTRKKKEAEQERKPTKQEERKNPQKNHNAETRKKKKEKNTTKGKTAKRHKQHNDQRTPQNNKTDNNDKTTTA

SEQ ID NO: 962516 - protein, 330 aa, Homo sapiens
MASCSGQLHAVTSPWRANAATRTGGGPVDIAAAQGGCRGAQACGAARSHEGTWRPKGSGCWESGPTVWTMGGLLVMPFNLLKAPWGLGLLAQTRYSNPMVDSKVQLECKGPKNIGANGGDRVPGGEVTLFREREGLRGRARDVTPKRKARAARSRAEGHLGAFTRKPQVGTKGAEAISQDAGKRGSPGGIRESPNKARYTGACGEARKRSEESYPKLGEEWRPALAPKPNSSRPQEEGHQREQANGSPREWATSFELKRHEEHIGTLGDPGGMIGHGPESAPRRADRAHEVSSELFPREYTRTRYNEVHCGLCGGPMCGVDRTEREEEYV

SEQ ID NO: 962517 - protein, 137 aa, Homo sapiens
SSVEIQAALSKMQDDNQVMGAEGIYYLPTSEEASISELGLCRESSSVFPTLSPDPSLMPLLPEQCKNINWKARNVGDEADYRTRRILGNGLMNSCRWGEEERRHVGEDNDYCIFHGKGYWASSDRIYPPSPKQRTQW

SEQ ID NO: 962518 - protein, 68 aa, Homo sapiens
TRIGMPVCDDPPYQETSKARDVQISQGQDSPKIRTPIDGRAYAHMCSFARMLAISYEVSQCSTVTIVC

SEQ ID NO: 962519 - protein, 31 aa, Homo sapiens
MHKDAKKGFIRLDMSEFQERHEVAKFIGSPP

SEQ ID NO: 962520 - protein, 286 aa, Homo sapiens
GVPSRATSPTVNSFSTHVHRGSSGTAFSVPIRSLDGLEAAGRHGSARGSAAGHHQEGEAATGGVAPVGHLQQALDGLQVALWPLAVCRRVSPRGALGGAQGVWVAETKGAPTRVGTFCVGRACYLPPCDRGLLGPPLGCGLGALGRNGIGGYEGYLPMGANGPSMGAIGSCPYGPRWNLKGPQRLVVSECCYRALVGQLSTGRTFQSGTEGNGRTLGWATEAMGRSYAKCESRTTHCGAAEAEKPWRQQSHNEWLPLSPKENDPTGWGHQIECAGEAHPPRSEEHP

SEQ ID NO: 962521 - protein, 230 aa, Homo sapiens
MGGLLYVQGGNSIGERDLIFHKGLHNYETTSSDWESSRKRCLNVAEAAESLSIQRRSALNVRLFLRDFCSEFLENCYDRLMGSVTRITCFVEKAQSVMRPIICGALVSLMASTSCSFRAGLFLRTSGVRTFHFIEQKAQHLLWDDCWLTAMELLPWDADALGSEGYSGAAGPGAMSLAIIQMRWREAAVNPEQYFSSVGSGTHPAFGLLDSPPLFLAGGPPLSEWAPLAG

SEQ ID NO: 962522 - protein, 254 aa, Homo sapiens
MARELRALLLWVPPPAAFAAGAGRWGRAGEENQFCVLGVTTAQLGPQGNQPGACRRTMFSRQTGEDKGVNPCTRLSSSTESVQGPTSKHEFQAETKKLCGHCCPVPCTQKKRCYTGADSPMPAMPWKKLRSQTCCLTGHATAMKLPDSFADQLPTKGPITHPGYVGIGIDPGSSLVSNRGTDCQDPGSKGFRGCSCRNRLNGHARRIIGQFALVATSASLVVATWKNPRSETPREPASRWLPNVLTVKTRALWS

SEQ ID NO: 962523 - protein, 168 aa, Homo sapiens
MSNCDMADKIEDDYKTYPPRSGNVQRRESETNKKLEHPKRSTTHASQYNQQNFAKTPLVATHYSTTATRQKPTATQSTPTTQPRQLSSTQPPKMQQLPAENYTKREQPKKPDQLPQPKTLPRHQITHTRTLKKASTQLRDKDKTKFTGNTITTEQAHTHKIQPSEAPP

SEQ ID NO: 962524 - protein, 241 aa, Homo sapiens
LRKGRWRTCETGELHGSRVRRLRMFLRCPVHRSTLPRAGSPLGYAKGGSDAASMRPDGGLMCVVPREAQIWVPRGVLMRMDISPGITCVKQSGPELPLTPYTLVLLGPRAERRPEQRTVMMLSDAQSGLGQSPDPSEWHVDAQNEEDGQMKEDDRRAEDPQLARWPLVAHIDGWLQPEVRGVMAGVQDALWLARVGQRKGPGGRWCALEAGLLQRGWMEPPRAWGGLASGIDAWPQIGAPC

SEQ ID NO: 962525 - protein, 309 aa, Homo sapiens
MVSGFGKSPVSEVVGSAPGGDGAEFTSRRGSSRRPGADVLGAALRGSERAPGVDGPCAGCQYAVPVLRPRVVRAFRSTPAFGLLIAAGRRRLPPKTGIKENGVHFLQLELISGRWMCLLWLLSLHTGDSGATIDTWQVFVDILCLHGQVTAQHVVSSVRFPGTFKQAVVKPVGMRRCRCSKDAGGSTKGREAGPSRKKKHVGGRKPQYEGARTQAEKTSACGADRPFASDPLPTQLCASSTDNYPACQWGDQIVNVRGLRGPLEKVLAFQPRRRRESTCLARALVRGGLWPCWASTVHVRAQVPFGYRG

SEQ ID NO: 962526 - protein, 242 aa, Homo sapiens
VIYQASQALNCCVDDEHGTGSLEEAEAERVLLTGNWEENTLIDELHKLKNEGPQRKNKASSPEVNLCHPKDQLLVRNPLASKSRLSSAVRFRKPDAADYYVLKSYKKQELKDMVATRISKYFKTLLTADCSDTSLLHLLCKDVSNDFRNSYRSLTAVAASRKIPQALLTTDPISHVTRLITSNVLTPSHSIVPHSAPASLLPAHGSAPARSQLSAATASQPPAPCVGPPCTLFLALPAGTTI

SEQ ID NO: 962527 - protein, 255 aa, Homo sapiens
MAKVKVGVNGCGRMGAWSLRAAFKLLVEWILLPSMTPYIDRSNYEWFTCSNMIPPMANSDGDLSRAENGKLVIGMEIPSPIFHGAEIPPKVNVVADAGAEYVVESTGVFRQQLEKGWGLICRGEPKGSSSLHPSADAPMFVHGCEPLRKYDNSLKIISNASWSTTVRTPGKVIHDNFGIVEGLMTTVHAITCHPEDCGWALRETCGRDWAGGVSQNIISASMGLPGWGTSSFDWTGAHWIGFRSPLPRVFWPGLA

SEQ ID NO: 962528 - protein, 125 aa, Homo sapiens
MGGAGPGPGVRARGRAPGFPAQFDRGSLEDGPALAHIMPNYGRKGPLARPKEVGPPCGRGAPTDIHRVGGKRRTGSRVGERTHKPREGATPQESGQAGGETTTKIGQDPGRLLLRGEGTASKSHH

SEQ ID NO: 962529 - protein, 229 aa, Homo sapiens
MDDDIAALVVDNGSGMCKAGFAGEMPPGRLPPPSWRLPQATRAVMRGHVVRRIPYVGDEAQSKERLSSPWKYPIEHGIVTNWDDMAKIWHHTFYNELRVAPEEHPVLLTEAPLNTKATGENDEPDHVETLQHPSHVRCYPGCAIPCNASGRTTGLVMDSGDRVHPRMCPSTRGNAHPQCQSLESGPGLAGTLDLTTSWKILHRSRGYKLSAATGDGEIVRDIHGNAVYV

SEQ ID NO: 962530 - protein, 99 aa, Homo sapiens
MVGTGALEQEGCCTAHGSMINLQCIAAEWSGGRCRGRFGLPLEGFGLRVGEPWFPELEDSPLVLAQRLPGPLAWVGTASAGPRGTLGPAPVPAFGGNIF

SEQ ID NO: 962531 - protein, 257 aa, Homo sapiens
GFSFHLEQPAESRSMEDFARGAVSHRPLPAWAWFPSASSGLRMRIRRSELETRTQNGAMKSQFREPGAGEAVPRPPHGPPCQSTWPVQFEPRTPAFAVVHADSAGLSVGPKEAKKAFLDFYARASWRETRGSPGAGSLPDVARLKLDRDWADLTRPTDVQRRLRAGGGCNKPAWWPWAGRLEDFRSKRLMGMTPWEPVSWAQLGGLGVGRDRAATRAGSGTWGERCHAPGCDADYHLLPRGQSAGGVSLWSVIAPLG

SEQ ID NO: 962532 - protein, 77 aa, Homo sapiens
SWNSALWQVLRALKGRKSSPEGIHHVRCNGRSCSFLSLGAFPVLLRAENGIFVITDSELGSPRPARECDSLRTVCDS

SEQ ID NO: 962533 - protein, 172 aa, Homo sapiens
MRLGRHPLLTSSAAGLKIRHGPELEVTCACDWLPCRVPRGLWCTGPDSCMLVVPGCLWLYCRVLLNSCCSPVGSAGHMSQSYFNLDLVGDACMDNYPVPEWPSTSVIPCVPVPPLSMTFVARPRKISIPLQCSRRHYQMCGIIIPCRGVCHRRQCSWSFRSNVPAPSVLDYE

SEQ ID NO: 962534 - protein, 55 aa, Homo sapiens
MTRNDSGAPALKALLCWTNQKWPKTGSEKLHHPGLRLLAWRHNGSGSGGPVWVGS

SEQ ID NO: 962535 - protein, 174 aa, Homo sapiens
RCWLAGSPEWLMLPPGRRRPVTAGRLRVASAEHLVHKLLPVAIQCDLLSNPYHVVILFQPVTLPCTYQINIEPPRNPSVILEVQVFLARDRNRQMPSPLDSVRQPAQCPDGSGNPGYNPISRVPGQSAHRQGRGHQSMGNAVTLGYYYQGRRITITGNADLTFEQTSWGDSGCV

SEQ ID NO: 962536 - protein, 287 aa, Homo sapiens
WNPLHATADFRAADCYRATKKMTTCFHLPTCVGNKLQILEDYKDRLLCYEEATNTELQQLELLTLRWHNSLLHNTQLTVDKVLLFDFNCSRNSTRDTDGKTAQRNRHGNNQKRKHVLANENHDETMLHIYNSTAQTPLSFIPWTDYSYNYYTFIKTLAQLAQASNLHLEHLRSNNLLANTSDRFIIHPTSTRTAQLATNCHMKQVPNLFNTSQTKRTILINGPLQPTRKRSKAAFHIPFNFSNYTLATFNHISNSMRIPVKHSLRRWLNALGCFNLRGSSAPKPLEH

SEQ ID NO: 962537 - protein, 258 aa, Homo sapiens
MKHRGDKPDRRTRTDDHRHTGDTRSRPGLHKRKRAKHRNDTTHKKRHNNTRLGHLGTTQEQTTESKNTNKKYTHKTRDKDHKEQHQSIETTVGRTPKTHPGINATENNDKMTRKETNTKKTHDEQQPKEGNHQTKKDQKNNRQHKTKKQNKNHQHTRHPRTTRKHTRRHDERDSTSNTRHQTPTRPRRATPTTRQTTQPQKTKQQRRERQNRTAQHKTGKPKTKRTKPKPRSNRSQQTQEPNANRKHTHKTSDTKDST

SEQ ID NO: 962538 - protein, 75 aa, Homo sapiens
TAMCILTLMRDLREIGTICPNDLVFEPEYQSVNPGIKVHSVRYQCGMSKTKLRIVRSRRDCFGDLMIHWMVSCYV

SEQ ID NO: 962539 - protein, 154 aa, Homo sapiens
GTSPTRRRRMLASSLLPLALCLWMHPAPSSSGIPLHKFTSIRRTMSEVGGSDGVDLMAKGPVSKYSQAVPSRELRGPFPRCSMNYMEAQYYGEIGIGDCPPMCFTGSSFDNWAPSNLWVPSIQLRNLLDIACFDPPRKYKHATKSSTYVKNGTS

SEQ ID NO: 962540 - protein, 255 aa, Homo sapiens
GEGSSLGSMQLWMPRPTPWWGPGASSTKGSLARIHETNLKTDRACCSEPLFGVETVCVEDINQNADACPYTPCGTHALSHSMGPSQGLSSPCDYRPPVHVAFPISKMCPKPPKYWGTPEVHDPSPVSPFEKVPKRKPVFQKPWNGKPPKTSFRDTGSGFSPVDQKAILMEPKVCGPPRFSRPHGQHSHKTAWANNPFFGGPKYTRNSATVRPKPQSAGPPNRGRFGPHHHSIFPPQPSRWRSYSPPHTQVEHPPQ

SEQ ID NO: 962541 - protein, 116 aa, Homo sapiens
MPKVKSGAMARRGGGAAPGAEERWRTHVQHGDCADILKNPLIITALSDKAALRPDVGAGSLDRGNVDNIDCVKVGRKGQKGVSLVKLDPRASKLNFTKEFRHACGQQTSSTGGWMC

SEQ ID NO: 962542 - protein, 264 aa, Homo sapiens
MHSGHDRVRHFSKSMAIYLIYKAVTSRIFTPGLYQKVERPAWQHHHSHPAPRNTPRASATARADKAPVQLDISTPQPHWQAAPMSAVRSDSPLCHTYQRTFGRAHTTLCGTKHHNGVATQLGVGPLPHKTPHTITITPPHNSRRPGPPLGRPSTSAGQRDLYTTGPPAHKKHIGRSLTAPLFIGGLQERCGGARHGTDRHSMSEGAGPARPREARARTGDAPPKQEPAHAPARRESVRHDRQGGRFAVGGHNTDRGDINNAPRT

SEQ ID NO: 962543 - protein, 94 aa, Homo sapiens
MGHQGKNWVRNTRERMEQPTLVAKQTSPERPTSKNPTKTAGRKPREQEEHQTRQQEEKTEPMEQTDETDRETIRMRVKNIHIVARRVVPLCEKK

SEQ ID NO: 962544 - protein, 347 aa, Homo sapiens
SGTADGLAAVQHAEVWQLCSEVGSWLRCLCSSCETLNRWLNHCAQRMADRRGLCAAGKAGCSKREDMTKVGIRDQAEEVDVTPTVRHHGACWDVTMLLGQSTLYVLFEKSQYMANPMTSVTQVKGKDIKGERCHRQHDLKSRCIHVNKTSATITSTSSKIRFPCCIVGTTYKRFRCKTSNACLTTLGYPKKKKWDVASSKRGGLDMNHTSELTLNVVQVPGLHWDGTNVGGGPFQESWIYGNRHCSARGSSSGRCMWILITTTNNLKEHGSYRKVVGRGDESLIERVDYDVSTEPGFDRCFQGYMSLRSTRVVSHTVTRPVPRENFCDELPNQDSRHRPNTPMRGDT

SEQ ID NO: 962545 - protein, 267 aa, Homo sapiens
QWHSEVGSGTARSAAVQRGRERQSEVGSGREVGSEALLVLFPAGPLEFMADDRPRSVRTSGARGPNSGLPSNVGNDMTKGGILETSEEVDVTPSSTTMWPAVEDPCWWHLPPYGFEHTNQKSRQGAIKQIIRGEDVTRHSLNVGQQEKQTTFSISGPPGVGISRVRETSGLDLGPHKDDVGAGADPKQGCWLAPPCGLTFELSSCACLAFWDVHPIVGRGTIRKACISGTDKFVAGTSRGDDMDIDSVAKRSKGHVLIKMFVLWIKR

SEQ ID NO: 962546 - protein, 326 aa, Homo sapiens
MVSEKVLEGYRENYISTGAIGDGLVASGEWRLKPGVQPILGAHKIWGYPRSIATGYLVGKQKMARAYSSKPMGIDSRGRVHKQLYQGRSGESAWHRCPGTHVNIYYRGMERGIWSITRQPRGEKQEEIYCTHDYSARNIFARSRILTNHIYIIYHPVCAIHAKHGISISTCTVHKPGGPVGKVSPGVAVGDRTRGYDNEIATRDIYTNTRMGENEGTWHHTETRGTHAQRDTISPTNTFGDDHHFMEAQGTPRSSKIHMGHRGGETSARERGKHHNGKECITQRATPTQTGTAEALSSPPNQHRGGVEAPTHRERRTNQRGDENTK

SEQ ID NO: 962547 - protein, 103 aa, Homo sapiens
MNSNSKEQTSNSKAQHTQMQQQSTMKARKQSKAHDKETQQKRKAEQKREERTNFSDSGVVAETYRGSTSFIKSQEKMKHVIGLRGRGCRRKSKRNLAIISNNT

SEQ ID NO: 962548 - protein, 273 aa, Homo sapiens
STSFMQDCCLHVTLGTVVYSCCLQTSETHKGHLSEGDIMVCKYPVGFLHFTYEVEPRTPARLIWFAQSRSLGISSTYTLVYLFQQAIQSKKYGVYGHCWALHNRQWGLQHTVEQAYEFDLWFRNRCSYSQIVLPGNCNHLAKKVGPCFQVETFVAPMTDQPVVILCNTVYSLQKPTWVIITGKGAQSQLFSGYFLSGQKYSLGPKKLLHLGISTSGPRGLHVPRSTTSGLPRAKWKCRPRIFSLFCANLPSSLAFGHRFPHIYVPFGPGAEQF

SEQ ID NO: 962549 - protein, 363 aa, Homo sapiens
ATHPHHRPGGQLSERLRRPTMASSSPRSYECHRSRDSQYHVARIQHPGRLTKPPEPLLPHCHSPTTHLSSSFLYPLLDWRPRDADLPSTATLPVAPGLPQRTTVPYTSPPHAAPLPRRPPARLSGPTRPLRNQPATAPTCSLHALDHPAYHAHPTSPAATPTPALHAHPALHAPGCPNAARISCLRPLNSPPASELPLASAAPTRPAHPHAPPPTHNLDGAATPTPPTLTNQPHLAPPTSLHQSADQTHPPAPDPPHALPRPPSTPQQPHRARPPPPPRSPPQTTPPNSLGAPHPITRTTNPQTGPPASQPPPIQQPLTGTPHGRTPPPTLGHPFPPHPHPPPRQPRHLAPPPTPCTLDPPHR

SEQ ID NO: 962550 - protein, 108 aa, Homo sapiens
MVAKVVPRARVRGAGPRLGGGDTRNAGERRKRNDKGAPSATTATSQTRAAEAPRARSDPRGPGDGRGTTPGGPTKGPAAAGDPRDGTQGTRRHRVGPRGGPGGNRATP

SEQ ID NO: 962551 - protein, 264 aa, Homo sapiens
TQVALALIPGAWLSVVGNSAGRRLVSAEACVAAERPLGTSDAAGTRNGQTGEISKLGRRVPAPDPVVCAVRSMANETQKVGAIPIFRFPFTAYSIRGRLHGYERVPGWEAGKDGISESPTWHWEVLNVLLWGPLLDSVTLNRRSVKKRQRILETGTGPLHDEKDESLCLSSSCEGLQAPRGLLENRLGLLSCVQKKEREGPGWTDKGGQGQEEAGRRTPGEIADRVPGQSMQQGPEAGEEDTRGFLRSGGDVQRQAGVEVRDKM

SEQ ID NO: 962552 - protein, 267 aa, Homo sapiens
LPFTATAEEVVAFFGQHSPIDYGEEEGIARCHRTRDGTAIQEDGFGTSFARVTDMMRLELRLEDSIKDVVGLQRIALTRPFSESTSERGTFERVCVNSDLLRLAPSTVASFSDASPDLLPVTYAHAQLVPRYEMFRRAVLRRFCRSILYSSQTIGGTFLDFLGEFAHRLFCTPWRFTVRFGIHLGPPHQGDCHLIADDSAARREPFMRLHRNVSLKTKPLKDQHHVDSHFKCFRLQETDTCVVNWGEQLVTLAKGLIPHHHVKFSMA

SEQ ID NO: 962553 - protein, 74 aa, Homo sapiens
KAAGAVRERGWTQWLMAGPPLPPASEWIMPMGGSGGVLRGCDVTGLCAGACETMPVSSYNTWDHNKHNLPQEGS

SEQ ID NO: 962554 - protein, 243 aa, Homo sapiens
CWKPGDPATSPCRIFDLGSDNEEVVAGPGPAQRQGGLAALSGPRAGGCGRSHSCLERMLDDQGGQSCWPMWPHQATLSAVPQAQEQVPHPSPLAAFTVHPHTRIGIKPDPATPDDHGHGPCAGGGPGLRCLLRTALDHVIDIHGTHHRHGPVALTTGTCTVEHACALAQRCRWWPDPMQAQQIGGRKILTSLGCSDLQDQCGHREGRDTAVAAPGDIRAPNRRSGLLPYFLECQAVTFSGHAG

SEQ ID NO: 962555 - protein, 209 aa, Homo sapiens
MGPSSNIGRLFDRPLTRKGDNQHLHGLPLDYRIPCSNRFYPRRAVGTTGKGGTPKTQHTVGTHTAHAQYVTPNTAANKTAPQRRRTKQLATAFPDHRDIQPGPQVEARTVSENTPTPVTPGPKGARLYHKFQDGHSAKKYSGTTRPMGVGDSPAYQVVQRVIPTRYSDTYKPQWLGLLRNRTIGRVTCEEFHHNSAQKHWENGVARYYT

SEQ ID NO: 962556 - protein, 139 aa, Homo sapiens
VRRPPGRGRGTHVVIYDASDQGLYSAPRVWWMLCAFGHHAVSLLDGGLLPLAAARTSRFSSVQDANLLPPMFRAQLDPAFIKTLRGHQWMNLESRALPGGGLPRPLARSRRHRAPSPENAGVQLAQSRVHQNLRLPGFK

SEQ ID NO: 962557 - protein, 76 aa, Homo sapiens
EISSLLLTQNLLVALHSNANEIGAITRIRGPPLGDQSPVLLLLLHEKDPPTISAPQTNQPKEHLTNFKSDLLRLSG

SEQ ID NO: 962558 - protein, 440 aa, Homo sapiens
MVRFLAAARTMMLDDQCGCLLQQQKTVLEANMDNMFESYINNLVLAAGDSGPVMQCLTAWMAGALRNIACGPGWQALQCNTVIEDDDPINAYQKHVQQRNFVLINDMDCVMTWLTLRQCVDACDVYALDKGALTLERGLNRSVMAGYIEAGRLRGALQVAKILGDNNRVCWLVQWTKQESLIPVWTSGTWDYKLHEGSNGLPSNLDGDYFCTYLASTVRLTRLGDTNCYPRLNVLKGRWQEATGTFGEHDTPEGLEALAGQPASTQPDDILLARIDNTRETNTKTRSLPRRDRKDLRKAAPHKRGPKEEQGIVHHGEYGDPVHHFVTVKWSVKHCDMVTESSDPQNKRVDVVHKPTPDSVLTSQAGERRQTQQPKRRAPQNQARTWCRAANELRKIQRTDPTMTAGHDNTTTRMVSASMEQWKDDPTQTRTRMRLDSADT

SEQ ID NO: 962559 - protein, 76 aa, Homo sapiens
RKANGYSKPLRKQDSEQMQQEQWYLEVLKSRAMAEELDGSHNHVPNIAQGCSNETTPSLPRRSSKVNAITVQVTRI

SEQ ID NO: 962560 - protein, 149 aa, Homo sapiens
IVRNGQVYFLPFSEGPAGTSFSELSCLDRLEAFRTLQVKGYVIEHVTRGSYARSALPERYAQMTLVTNLIGLYQAWDHSFHPKPERVRCTLDIFISRLYCTVRRQIGSRAGPFNKSSVSADPALDKSSPNAIGPGASSVIECADLIYYA

SEQ ID NO: 962561 - protein, 118 aa, Homo sapiens
MRYILKKSRISKKPQVPREDPENGRTRSPKRGLSGAQDPFPGPRSTVPVEVVQKILSLLTNLETLPHSKATILEADVDGWLKLRKREHEVSKLLVLSCLLAEEPGFLAGGSDGDRHSH

SEQ ID NO: 962562 - protein, 202 aa, Homo sapiens
MPVDLSKWSGPLSLQEVDEQRETTVMSPTPGSAGGRCVGKVLTPTQVKNRPTSISWDGLDSGKLYTLVLDQTRMLPAGRIPNTAEWPSFSWVVNIERRKDIHACAHKSFSDICGLGASQGHKAFPTRIMSGLGYTEHGQAAKVVPEPILQRTDLGDHRGKFKVGVLPLKRMTLRGPVADHVLPGRVGMTMCPKLYRAAVWRT

SEQ ID NO: 962563 - protein, 220 aa, Homo sapiens
MDLLVLGSGAAVPSFWPVEWSVLPSSDECDRINSIEFRTREVIQSDSLWLVEFYASMVWSVSKIRHQNGEKAANVRLKDVVKVGAVDADNASFPEEVSMVFRGFPTIKIWDPNKKTDQKITKVAELVEAIVGCCAECSGQSLKDRLGGRSGGYSSGHNRARSDWFKYQKAVIELHRRQRLTKNCSGPLTALLGLGEYYASFVWTTAKNLNADWAARSSEV

SEQ ID NO: 962564 - protein, 208 aa, Homo sapiens
MTWPPSASALALCAPLTHAKGLGRVSRGLAQGLQQSSNIFPGWVATDTHAPGGPQPSAHLGCLPLSALAGLDSAPPCPVSLGVPRARMPPHGGRFECSLVENADWGPGMLTRALQVSSPQEACFSVPWLHPCRALAHFPCRVSRPSTGSDLRALPLLRAGGLWCGTPSLGRDPCPLPHSPRLISGFQQELFLTGCGLDVRGPVWRLWF

SEQ ID NO: 962565 - protein, 198 aa, Homo sapiens
MVLGGIQDGSNIGDGTINKEPLADGINSEFEIAKYTRICIVTWKECTQSLHAADVNETSPSSYLFPGSLYKWMNCGHFRRCRYQILLRKLLRIITGGAPELAVERNGAGESKAGINQGGQRANGGFRMTHAGEGAVFPQLMTLTEPADEPDREGFKRPHRNLAEREPGAVKKRSGERERNKIWGAPQCRWRTTRGYPG

SEQ ID NO: 962566 - protein, 263 aa, Homo sapiens
RARMREIVHIQLRASCGNQIGTKFEEVISDEHGIDPAGGYVGSTRRCMAGRESTSTTMSHPVQTVCMGTTGRKGTTRRARSLVDAVLDVVRKECEALRLPARAPAHATRWAGGTGLRLGGQRCSLSKDSVRSPRAPRVMNTLRRHALRPGVVAPAGGGMPYSCHTCRVHHAWLANNMTRPIASTREALYDVWFRDSEADNAHLRGPRTTVGVGHHEWVSQRRMRLPWASFSADLRKLAVELVLFPAPWIFMPGFAPSPTGAPR

SEQ ID NO: 962567 - protein, 267 aa, Homo sapiens
PSTLMLVGACQEKLDNDSRDGLFGVCPARCGHAGGMAQSMQARLKGTARGNGGENHGGEVIAHPNLMSSELETSQLRLTQMRMTPPAGSAAPQNRAVPHAVMRRHKRRRRKGRRFLGIERSSSFSSITDSSMSLNIITVTLKHGTNITSVGISIVGQSNERGDGGIYMGLYHEGVGAVAADGRIEPRRYVSQVHRDQLLRPLSYDACQSGYCGQIGAQSRAIALTCSQVLGPRSKWVAPHCHGARPSGPCPWWVPHGLTGLPGRGAS

SEQ ID NO: 962568 - protein, 277 aa, Homo sapiens
VQRGGPEALVALLDGNRGGFRGGFGSGIRGGRGRGRANGCLGAECRVARGWQAEDKEWYALTTVGPLGQGHERSCPWRRSISSPCPIMESRDHMILFLGGASLKDEVLKINAMCRNADPVPGQVAPGSRHLSAIGDYNVPRRSGCKCSTEGVATAIRGAIILASSPSSPCAEATVGEQDRQAPHCSLAKVTRAACWALVLGTPHPLHPVALASSPHLCLRKLAPLMVGIDDVLTPSGRGLLATLAISQGTLCILRTKGTDPTLEGTVLQFLSGSCTR

SEQ ID NO: 962569 - protein, 74 aa, Homo sapiens
RRMRAEACLTTFSRVCGYHVLSRGCRWSVSAWGPCMPQMDFNVRTYGNFEDDITEETNSPSRNIQKITKSMNTW

SEQ ID NO: 962570 - protein, 109 aa, Homo sapiens
DRILADSGGVTNIRMVELYGCISCKNVGYGLCAVVKNCRQYNRARWCPGVHSVPEVRKGFGELMVQNSIQGYQYGIPLQSISAPGSGIWSDGKDKSDGAQAHTWQCRKS

SEQ ID NO: 962571 - protein, 412 aa, Homo sapiens
CAVDCCCSVVSWKLVDALACACPLLHAMVAHRGFGPGACPRGLIGPCVCSGEQLWPSLLRCFGDVQVRLVSWGPCSNDWRRVPLCCTCWPKGLHLVCALDVLQTWCLSALGARGVPFVPKTWAKTDHHVCMVTHMRTRDWRHKVDKNPSLFGRDHLGDSACCDQGFIVRAEFQRLTPLEPVNIGSPGWSWRRITKQRFPRNSSRRIRSQANLNLQDLAIFAPTLVEDQLEDTWAHANTTLHLISLRPGKGFPFDLWVHRQTHEFVALVMAPHTKEGPLHLMAMEPRSITLDVCPKVNTHAVSPKEFPERQSAGFTQFPGGCTTWKDISSIWGDTTCGPTYTSIWYHIHVETKFRQQCGSGDPHTVPSKGLTPRKLWEERFSGGTSDPIYKEARQILFPQKWRSLCISTRFRV

SEQ ID NO: 962572 - protein, 101 aa, Homo sapiens
SGAVALTTEVHGIYGLVSRVIQPRTRSDQEKTVDQEKDFVVLYLLGTHLQDFSKMQVKVRSQVVVIEDKSYERSRVHLQSALRLQVYPSSSEETATIENGP

SEQ ID NO: 962573 - protein, 207 aa, Homo sapiens
DEEDSGLQSTLEASLELRGLARVADNAQQQYVRSRPAPSPESIKRAKEMDLVGLGLHPLFSSRFEEEELQRVRLVDSIKNYRSRATIFEINASSRDLCSQVMRAKRQKDLQGPSPGSSSDSRGGEEHAWMGPVWPSPEPVQHCMEKQSEKAEEEDGGQTSVEDSQRSVGRKRQRSGPNRGAKRRREGGPGSGTRKFYIPYGPRTFDS

SEQ ID NO: 962574 - protein, 135 aa, Homo sapiens
MPGPLRWTAIALSRRAWMCTEGCWTVPPRGARLYNEGLNLAHHVPYVKGVVVTRPWDWLGLSTTSLPCSIFVTCASHRLESNRSGDAPSSFRLEVQSIPGFTFSPEILAVGIGKSKPESSSPDFQLRKGLLACPC

SEQ ID NO: 962575 - protein, 123 aa, Homo sapiens
MALQLWATNSEPSISQFKTKNAYTLFKHGKGLLVKIKPKLNRAIDAGFQPFGHNIVSAPTPPWVFPNLNYTVLKNHSLHKVQQHRGGALAERYHSRRPGDKADPTCDAQRVPRDTRHRPGKPS

SEQ ID NO: 962576 - protein, 297 aa, Homo sapiens
MEQPNPTQMATHKPSAGKTHAWAKRDEAEEHGDEQKRTDGHYPNTGTGGYHRSGFIHLHNDLGDRTRHNTGTRRTRPRQRHTEYITTTPERSHPIRRAQPDSTPAKQRQEIRTYHNNDTHAHRRGPTDGNTTPRYPAPINPMGHRKTHKHTGHSMSTQTGSAPPGLPRSLRDKPRHDDNRASRTYGKRSTTGAPPKKPKDTPPIKASHKGTYRRPELGKTRTKEDANDNSPPPKGGDHNERNASTRQSTRSRPTQKRRIESHGDTATGKTPTNLRGPPKAPSQHRKNDQRTERTAHR

SEQ ID NO: 962577 - protein, 355 aa, Homo sapiens
MSPAVSYGNYHHRTRMMDVTVTIKSSIDKMNPTLVLGPLKSVQDADGGTQQLARDSRPAGSETGSTERATERSADAQRMTNASPVHGEWYDLTLAQGPVLCNDCLLTWAAGSRTQHKIHLVHRLSLTELALCNPPIQLEGRMSVGRTAWPRGKADSEIQMETGQAVILSARPASTPGVGTESHDWSSGAQRGQVHQLIHSPYTDDKRCLTGGRDPLPHVTLEATRVTLHTNTKRQMGPWTCRAETGHTTPEYPSTAPSAPVQDDKAPGAYKQLEANEPTQHTGKKTPLKPPQSSECPQCKSPNPVERRAEQGQTSDVTKQKRPEDERSARTNREQKRHHQGSTHSRDVQGATTAN

SEQ ID NO: 962578 - protein, 200 aa, Homo sapiens
LTVSERWPLAQRYPLLLWFCHADVPGKSPITGAARLSVWSLPTCMYRLPNVQRRSYGPVAVAAVANVQDYGALKDIVIKRKTRGLPSSHYSLLGAAQACSVSIFRLLSTVSHASSSVKELLPENLLKLLAGPEYDTAPREDYQVGDPRLRSGGCVPDRYAGIKMHASRRCCPIEGDGEPWRVLGPSLLGQKHKLLSRQAL

SEQ ID NO: 962579 - protein, 110 aa, Homo sapiens
YFPLLLCAPGRSSFPLIAGPIRQNEQLGAKRKRAARSITSLKEQAIGEYEELRAENQNTQETCDTQVRPERDEAVQKLAEFQTQFLTWSSRLSITVQKHLETREDLSRKC

SEQ ID NO: 962580 - protein, 400 aa, Homo sapiens
MSGSCPEDYLLMTLMPVMLLTDKQDGGTVKADSSSVTTVHSSRVIDTATRFHYDYPSFNARQKQSDGSTHGTMGWLLIYSRPQARTGAASNPIPGAGEPVDTRLPLTSDTPSHVILLRFAAECMRKRRLRVTHISPPLHVPLGDVPALRAVAIPKHAWTRTPVGTRHCARMSTHSCLCPFRLYLGPHGFADLGPISPFVPHRAEPLSPRNPPPTRATFDLHADLWHCPEVAREPGQTTHFLRKGTPWRSKSHRAPLSTKPRRKGPPSLRFHFPPRFKLSPSSLGGPLPRAANPWPPGAPGLSLYRRAGSYPQGPPRGRLTRPPQAPLGPLLRSAPALGSLPPREGVNFSPGIPPSGVPMATFFLPPGRPGCARSGRLGRQRLARSSRARDLPLLSHAGFP

SEQ ID NO: 962581 - protein, 252 aa, Homo sapiens
MPKALYITAPVSKRTGDADNVYPKHGKTTGEQVRDLLVHSDGRHKPLQDKLRRMPKIMIHVAHDKAMTAVLGRLPKVQRVDALSLTNLCVTSLALNLYHGFGRVANSFLFNGYYNRLHDILGANNLSDILFWLPKPTAIRRCAYKRQHTDEDPTFFTFCGPGTHSGGRDTCAQVYRSHDTSTHTRCFFPQKMTVGDMWTLCARTAKHKPRHFYTPYIITISAGSKQAVPSLGDNPQRGTGKRGNFTPVELFC

SEQ ID NO: 962582 - protein, 298 aa, Homo sapiens
RRHHHRIDTLSSYGPCTGPCCRKLRPRQTRVAGVLRFLYLQQPKNMGPLNSGTFRLKSLKVRDLISNFGQWRSQRRNKSQRPKYWQIKICQFKLVLLGESAVWQTQRLCFVCEPANSMNFQESTIGAAFAKPKLYCLDDTYSHDRLQLVGYSVVKNDYHSLGTNVTTEEHKAAIVVYDITKGGSPCATQHKNWVKELQRQQVLTCNSFIGTPGDLARLTEAVGFSGTHSPLPMTLVIIPRDIGRPPDCSAIFCHCKIARCPNPGQFGPARLTFWAQPPDLGRHPWSRKALSPSDPGGT

SEQ ID NO: 962583 - protein, 149 aa, Homo sapiens
QWRQLGAMAVTMRQIQSWERRVGAGDGCAEVVIDSCGKRAVAPVSGAERWFVVPCSECAERMALEIRRCQADSGAEVHNLRKKLESSRPDTGILKVMLGYDGPVPMYCRERCKPYYIGFSSKNVQLRCFQRRSKFQVLPRTIAFALLQR

SEQ ID NO: 962584 - protein, 340 aa, Homo sapiens
MALLRLSMTLGSTIDKCYLVILLYVLVPPCLSGYHERLITYLCLTLHYPSTQDPTPEPPDYTLPALCSYCCATLTTIAAHTNRTNMLDPIRNAARNCSRPDGALLHLARTPQRTPTTRPRTALHRAPPGLTITTTRAHSWSPPPKHIPGPCAQPANHHNLYQTPWRDALASAPCAQQVALTHRHRMTLATRWARNSSRRHINTLCTTHRTTFDHRLRQTNVGPQTYPQLTNTLSIGQSTPNNAISADAGPMPTPYVLTPITVHCLFPKPVALAVLYTSTDITGDPHTHIADKTHMTSLGPHASHSSHQQMRERLDMTAEATANHLCVPGNGNCIALYGSY

SEQ ID NO: 962585 - protein, 171 aa, Homo sapiens
VPAAAGSPPRSSSSSSSSSSSLGTPVPPSRVSLSPTLRAYSWDARLAPSFASFLPSFFLPPLAPASLSRSPSRGPMSRCPFPARALPRSPLHFLSRLRAVADVAATEPPVLRPEPEQCTWPRYPDSNATYSPRGCSVPEGSPGSHRGNGLQVEHRSHMPSPVHMTWPARRA

SEQ ID NO: 962586 - protein, 233 aa, Homo sapiens
GGRNSGPMPVTMYRNQYDNRCHCIGCPQGRTSSNKNMQLEAVKQGSATVGLNIKNYMQLYMCSALKRAQIRALHAHQKQNFSMIRTTTTRATPSTLAGVPYNLPCTLPTHLGLNCYTILILACSRAAAICDISPSTHCYSQHLRTPHCTCCSIRSYANLSYTCDSQRILSNTDTTNRTYAAAQTTSTEPATELLHSNLDIGLSHCTCNLLGRAHHPTHYRYLPNIPLVYSNVH

SEQ ID NO: 962587 - protein, 125 aa, Homo sapiens
MSAKLIVDPDGDPYEKSTYYDQELEARYVPSIGLPRYKRRWSSDGSNITLCQVSVYWPALGNQLDSYDRARTQQASSFRQRNGPCYARCACVPAIHERSYGMHGDTSIATLAHITTTIADPCTRH

SEQ ID NO: 962588 - protein, 280 aa, Homo sapiens
VLDFSKPSSAILVAAERHALADAMTDASMHPYRWRPSKGPQRGGVNHLGSVTDPRQSSQVPWILILRSQQCKDPINPCEKLTKGDAWTNLWIFRRACSRGVDSHLYVSDVVVSPVRMAQCLPVLRLLRHGTLVRPSWRIVCYTGYPATARRILVGPTYSIGNVLGAGAPLSSFIAVNSGPRNVSVCGLPPARSENKHSNANCGNNALAIVVAKNYSVVPQGLGWTPTSMQVGGGTCGFSPALLQPPKQDQHKPLYHVVPSGLGTKAWSTVLGTMSQLGSL

SEQ ID NO: 962589 - protein, 182 aa, Homo sapiens
MDVGMTKFETTSQSYYIQWIGGAPSPQGPNKGTSVPNMITGAAQADVAVQCVRTCRQGQGRVVKAWDFSDAPATDENHEEHLDVLWVPGFLTCAKVNRMAFGKVWPRVLTQQNSGTPRLYTFGGKTKSTQGFLKTRDNVTWAKDTLARPTRSPFNRPNRRRRLPLTPRERTPATCVTAPCLL

SEQ ID NO: 962590 - protein, 193 aa, Homo sapiens
MIRVRYTSVKNMLDRMFVDWGAIRLTIVSNFANESTLLSARMSSLYSLRKGTLLKTIVIMSAAFMNDIRIQRRLPVQERYHLIQDCKKEEKEDGPEAEQYTASHGGSSGLGVHAQTLSESRSRGPPIGEKCVIAKGSYGELLSNHIEVDLEASPGLGHGGIYENRLRARTCLVDCAPVVRVFILPSRHLGALE

SEQ ID NO: 962591 - protein, 173 aa, Homo sapiens
TARAPHARLPSSPSMPPPRAAQRGTQSTGKGRSQDGGRGDDSLYPIAVLDMTNVRIEDVQSSPQTAIKKLSTIALALGVERTREVSFMPFLTDTIYDEDEVLLAWQNSWEPSLPWWEAQSTCTACCHRGSRWPQWRRQGAGQGRESLRAISHEHSPSDLEAHLCRLVKRHGGR

SEQ ID NO: 962592 - protein, 110 aa, Homo sapiens
LREEVRPLRRVWAATTGRTRARSASPALGAPSASPAVTTWPSTPAVSPGFHRGKPAPVPWCPQYSPPATRLPCMLAGSPVPWSPCPAQPRRPVGPSCSQPDRRMLLPSRV

SEQ ID NO: 962593 - protein, 293 aa, Homo sapiens
CCFWFSCGHRRCPACLGVRTDKAWATAPQKPTQVDAGAGRRVGDRVSEGAGGAGGLGAKEGAKRRVGGGSAVGRAGGECRCLTRCRAPGRGGAEWQARRSMDAEMYSFMATVTKAPKKQIQFADDMRGSSPVFPTRIGRKILVSLISQSSSDSYEFSCIYTDSSDDEVLPEEAGTNSEGSSNFVCEEHQAGKNCGLGEDEIGRASTLSCSDFTSVKTCSVGRKPLVVLTISGAGHPFTSQTGCCLETLCGPGGPKAVAQLVTFIHPEGLACHWLSCVQVPWRRRQKTLGDYTG

SEQ ID NO: 962594 - protein, 142 aa, Homo sapiens
MARGAPPTPHLNVLADTPSGRCASAICRMHLRFRAVVKQMLDFPVEKARKKQLIRRTCGLRIDIYSKKTISNRVKVLVLAREWTEQETLLLLEALEMYKDDRHTSVGTCGSRTQDECILHFLRLPIWDPYLENSDASLGPFG

SEQ ID NO: 962595 - protein, 363 aa, Homo sapiens
KGILGKQQVRSTACKRTSERANSMEYSCRNGGKDYMLPGLHDNKEHLHRTNQCRGRVVFCREQLVCCSESDNVKSGTKASPSVEKHTDFQAEQAKPLREDILMQNIETVHPVSKRISSSDISFGSWKHDVHQNFLLKASPLLPEAAAPRTSTNFCTHEATEAQTFSISSLAQLDFHFQGLLIFRHKACWDFHHIGPLHYFPLQAWACSRIPWFPGHLLFHLPGPGTAYDGVLSHKAKVYRPENFYQVRHSEGQGALLALGVGDTTHRGGPKKGERGRSRIFQGFNHIVGQRTPKEGGNNIVGIRRTNARQDDNRHGVQATTKTTTPVCVVQTHIDVGSHTRVSATNTYKMQQHGQTEDVVTTF

SEQ ID NO: 962596 - protein, 108 aa, Homo sapiens
MAQWPRTILTARRPVKRQLIRSCRRRIKSGAEGRETQARLTVLQRCRVQWAATFVSGGHPGRQGMPRVLWPTPWEEGGDGTHGDGANQRRGPNRGLLGEQERPVKHWH

SEQ ID NO: 962597 - protein, 102 aa, Homo sapiens
LSWCLGPSFMGMACHLLYRRTRAQDPRSVDLGNRGEVCSVKQATQCRGQTPREGSRNWARGSNPKEKAAVNYSKWAQYWGADTGGWRQNGGERWPPAKPKEI

SEQ ID NO: 962598 - protein, 100 aa, Homo sapiens
ISWMRAAWEVLAPPSPYSRGVSAWETRMSDTWSSIQAHEKQHGLSAGEAACGGGSRTRGAWIVRNPEAAWSPTFRSDSPVPTAPTVWWRLSPAQRSGTLP

SEQ ID NO: 962599 - protein, 223 aa, Homo sapiens
PSDLYRKSGAANRLAGAPAGACRQTPQQSSWRTSRIHAIYMGWLTASRVARSVPEPLDDLRDSTATSSEAVELPEKQEQLAAIYAVLGAPSRSQPQLPWRDSSFHLVQGGPCIEDVNRMSPVCAGHYLRTLLLRCPGQTRTQLTSMKDVLKDHHVRGDADHTEQMRKYKVKMEEISQLEAAESIASAGFRSCDKNAPWPLELGLQTPYEGGPEQEPQDRDLQE

SEQ ID NO: 962600 - protein, 214 aa, Homo sapiens
VQWGGRGALVALGWVNRGGFRGGFGSEIRGGVACVRAGPGLRLSEPRCAGEGRRDKAVDCPGLTKFGAAWSVGTCKNQPSAGRVDHISFLPALFQGNPRASFGFSFSWGGRLYFLRAHWQVVLLETRFSGAPIGLPRTQQQVTPLVGLRGPKGGPNPQEGFSKLVHFLWCGLQSRRRESVKKCVPHVVPRVLRAGLVSTWCAFAKMWQGVRAAT

SEQ ID NO: 962601 - protein, 105 aa, Homo sapiens
MNVWVRCRIHAERSARRFLPLWIGGVRDSLCVCARHHLLREDAFVPWGGGRSFRPWDRGNEDPRVLRSRPSSRASGVQVTRPCYIFHPRVCRPSRGCKAGPRGSP

SEQ ID NO: 962602 - protein, 254 aa, Homo sapiens
HVGSFELSVQDLNDCSRTERCYSLPSQPCNEVTPRIYVGNACVVQDIPKLQKLGITHVLNWVEGRSFMHVNTNANFYKELLDVTYLGIKAKTTHRSSTLSAYFERAATSFDQACGQKNGRVLVPLPGTVSMPFPKALVNLPYLMMRQNDGRSSLPLSIVEGRTCENGPNRWLPGPALGSLRIDQTSQRRGTSETLGHPQRRLASRGSSVSLAILKLSRNHSYEMRGTHLRKTSKVPFGSEGSSNNPTGFSTQEI

SEQ ID NO: 962603 - protein, 318 aa, Homo sapiens
MQATLIECISQMVRSVMVEAGTSVLQACEKGWQCKIPSMSVHHANGCHGCWKLRRCAYVKLRKPLRLVAACAMPGNDRRCNILTNSEKSKKAREGVMDVLNQQNHPFGPVLMMVTRGGDCESAGIMSMMLWHMTSEPESLRRGTACWCTEPETFGAHSGSKDHINGPSMYNRGAPRLAIQGNGKDRRTRQRTPASHTGDTGHGPERETSDHGHRNGAPVTDFVQTPDIAFTRVPGRSAAFLGQNITPTIVGQNSKGPPGYKTGCSRHNSTAAQKRARATKGRPQLNKGVPTGRPNGGDRDSHIRATNGQSQKQEPRNK

SEQ ID NO: 962604 - protein, 223 aa, Homo sapiens
VSPVSNHVYERRLIEKYIAETWYRPHQATRPTLRGSSCIDYQSCSPNPAQASLSHQHPGHSESLQDEWDAVMLHRFHSAPAAADNPPRAVTRSVPARCRAAVSLPVSRKEVTAAREALATLKPQAGLICAPMALLPKRFSPKAKVCLLGCRVSPMDEGELVGMTPESLRSFKTKPAVLTTERKREGRLVPEELVKPEELSEIPAGWHPTGGLHRGQHSVGILG

SEQ ID NO: 962605 - protein, 136 aa, Homo sapiens
MKQVMYVMLMLPWGTGVVAVSTERRYDLVQVRENWITSKFEISLQGERLTTSGLELDGRQKSRVMEDLGSRERVGRSEKPEQKQLSEESQITPQGEAEDLHAILPDHSRSRSRTEDALVIDFIVEPMSYTVFPLFS

SEQ ID NO: 962606 - protein, 258 aa, Homo sapiens
WYLNPRQVFELRPGRVQGGAGDVPGKMHKLRILACGGDGRWAGSSPPWSSYAVKLTPPVCHPCPMGTGKRLGPNPRTGVGATLDEPVSKILSHVEERERGDSWDRLGPPRLSPNPRGQGLEDLMTDRRQRTGFADLGMSSTEELQDPWAFDGPPFNPLGRFPRESRRGTKHMKKLQTAGYYGNKDRIYAGGTSVYFVDFPLTGGRLPTWNPGQDTHSRSELIADMGHMGHFGFPPKEFRGDPLNNPHRGRSRIHRKQF

SEQ ID NO: 962607 - protein, 256 aa, Homo sapiens
ALSDTWGERKAWWGPPMPGSKRRSEPPEPRARPAGQWHSGTPPSKLVARGFSAADAREPDDLGSVRALGDFTADDLEELDTLAVTGPEPMSAAGRDVCQVIIGSTKIINGMSKKSFRENTEKLSHIKAITSRNLGPVPFRAQSTKEETLKRNPMTCTRDDREFLIARTWRTFSNFGGDLHYIQDRNPFYEGHQDERFTLCFLSNGENPKAPSGDNGTREFSRKAPLPWESGLQVYTMPEIRLGIRTNAPRPVERPN

SEQ ID NO: 962608 - protein, 110 aa, Homo sapiens
MSTENFPKMMSLHAHGRWHLHSFETSMIGPSCQVEIQHACTLSAFVKFHRATIVLFHARATTPGSTGVWREHLGLRPILVPSLVSHSQGAQHLERTRHLRRIFPRLVPKG

SEQ ID NO: 962609 - protein, 103 aa, Homo sapiens
WTAPARRGGNVCINSFGFGGSNVHIILRPNTQRPLTAPHATLPRLLGQGAPLMAVQKLLDAGARAKPGPGFPEHADTTIVVVPATACLPWLRCAGVVSAVAQR

SEQ ID NO: 962610 - protein, 108 aa, Homo sapiens
MWTFPWDEDAPNQCKEIEGGTGNCWQHNKNFLWNNLETVTVIKRTLTPNLLGKPQNTVVITGHDENPLKFVASQIGTHKGFSARLAAYTRFCLLFHQSSELGDFRIPW

SEQ ID NO: 962611 - protein, 65 aa, Homo sapiens
MNLSGLNQEGRVPENVTGVVFQLRLDAAAKENTKVCQDEGGSALKTLGKELVAHLGIGVTGVPRQ

SEQ ID NO: 962612 - protein, 183 aa, Homo sapiens
GQAGKQPPVESRDSAGEGSQKGAQSEVPTTVRRPSRGRTTEGKQKNKGVLAKGTRCKSNNKSSRERENPKGAEPKKIEKEDEEGISQGVLGGGAVTHAVPLVLTGGAVSFWDWTAFAPFQGPGPFPQVTTIKPTEPIGRAYSAILPTVVPINRGTGYTGNTDALLQEAPKSTLDLVRCSVSTL

SEQ ID NO: 962613 - protein, 209 aa, Homo sapiens
GCRARPHVGERDPSPAQGPHRRFAATLAVSFKGPWLGTAVPLECSPFDGYPRFRLFAGCRREINLLCTCVPWTICYIPGRPPGVPPWPPRGHRKTCDGFADLPGRHDMRPGIFTESAQGWSVRTQEGGTCSHRLARFNMEGDGALGPEMGIPPEHGLLSQLHAAFKLALLLALALFLAFPFALALLFFARSLLGSRRPSPPGRPLLGQL

SEQ ID NO: 962614 - protein, 136 aa, Homo sapiens
NGSSWTGISRRCCSTTASVHSWCVEELLRRCWTELLFQSSNIGTTTTSRPYFKRGKARRGRAGMAQDGLRLASFVLRVAASWDPRLAGRLGGEPESWRDPGRPPASGQEWTEDGPKPGFRREIYLPMDMEHFGPCL

SEQ ID NO: 962615 - protein, 176 aa, Homo sapiens
MNDLRRNPGGMEMRKATRALQPSYVMLAHVTELQWSKARRRDRMCFGSVREEPLIHYWTQELESVRKCPFPWLGRHESLADKFGGEPVIPNYCKESRHTLPEELRCPVTAWFQTLEYLRNPMSGELHANCSVKTDNGVLASPGRYRPKSKCAAQAAHEVKGCQTNEPEEEDAGNPI

SEQ ID NO: 962616 - protein, 242 aa, Homo sapiens
EEELTMGMSYVNDDIFRIYITEKNLVPVGARAQRVLREAPRNMVHLNVICMAAMGRVVGTRLTQVLRLCRPSVVVERLRRNTGLLRGQFLARIPQPLFGHLSEGFSPLCRWFRGTVNTTGPFSGCPTDVEVSSCQDRPGAALFSSSPVLRLWPGALGMKLTFFWLHSEGSGGVHFDLRESLVTSVGPVPLVLRGLLSGWYRLWTTGWAWQAPLTPGFSREFRALDGEEPVARPCTVLAWPQQ

SEQ ID NO: 962617 - protein, 136 aa, Homo sapiens
FVLCTGATPMLDASLLESSANQYPGSLPGATAWLVVTDPRGMTNSLSRVHLYVNLPTIALCKTDSPLRYVDIAIPCNKQEELSSGGLMWWMLARKFCACRGPISREHPWEVMPDLYFYRDPEEIDTPKSTAVLRRR

SEQ ID NO: 962618 - protein, 455 aa, Homo sapiens
VPVVWTWLVIGSDPVISGLTQLKNAMIFSCKDTVDRRRPINSLEVGATVTTQSDNIVYAAKESQGLTEMAIPRPIHADGSLCLHGQVSVERMARNSFCDLSIQFLELDALSDVTALGSMAARDVGVAMLQDSYGVTEAHDARGERAPSHARMGHGLGGRTMGDTSQLRTDLGETGPKRISPRGLTTETRQVPKSRRGYQRPQDGAIQHPVKTAKGATANTGNRCTRATRPTPRTHIRYEYNRKPITQHATVPPEGKQPGEPPSSESNPADGHKTPNRREQTQLRPRPLLTDKPTRTLGATHNTLSPTSSTHHRCGTERDPRPPQFSRATQSRHSTIERHPENIGQHSEQLADPNMNDPNASATREPLGGHTAPAPNIECASTPPHAAPHNDGATSVTHHRLRYHDDTQLRCVDSTHTRRETLSYHTNDKQATIIQPQHTRAIQQQQPPNESSHPT

SEQ ID NO: 962619 - protein, 298 aa, Homo sapiens
PERGLVGQGVTERGRAERGHGQCRTKVPLWAPRCDQSLSNRFPKGVATGKKPSQNRGVWAQGWLVSTPLLGADATRGAKGARISGGEKLAPSWAIWAQHPPQKGGHCGGQQSGRERSPSLYTRSDTTPAGEGGALIKTVFYAVFIKTVFVVAKQQPGCRGAPPFLRPRFGARTDINDTPAFLTNKRGPKQGETPPEGGQTGDKTPPHAKPLKGAEAPPRGGPRFKKPAPPFEVVGTSYIVVGAHTLYERQLTRRRTTAAHTTAGEDIPRHHQMIPCTAPASHNVTETPRLRRVPGGPP

SEQ ID NO: 962620 - protein, 180 aa, Homo sapiens
SILPKPVLIREEASIPKKLQSDRPSDRQSKRLIRSDTSQSVAPHHEVPFYRPRASRKVASVEDKLPASQLSFAGLSYQPAAPSPEVVLAWAVKGWHSDIWGPPDLLPLSLTELAWYLPQSPHTSTLPQPSTEACQLLCLQLQPVTHLRRPSLSVRRRRSQVTELTRGRSWDDESPFDKAV

SEQ ID NO: 962621 - protein, 155 aa, Homo sapiens
PGRLRGPSGDVRSRLLGHLAACLRQLGPSRRPARCPRLPPRGPRPEVYCLGLPCLLPSLGGPLSLSLCVPPLAAWGLTLGGCPACPHGRGAGGGPGVGAPGKGPVGLRWNGFVAPLEKLWQFRGEGGGCGPPGISIRASPWWAPFLCRPGEEPCW

SEQ ID NO: 962622 - protein, 292 aa, Homo sapiens
RQRRRAEGESAGGRSGSDEAGGPARSAGRKGASGRRVQAETPCKCRGANEPRVCFTESASRATCSVSMPRVGRRMSTRTSRSAKAGVIFAVGRIAACTSRMATPSTGLGGGHRVYMAAVLEYLTAEIRGAGWQVGGSRQQEWDGVTTRDILLVWAMMKELNRVLRGVTIAVWVVLPNITPMFASEEAGDPRESLAAIITAHPQPRRAKVSIPRNAVLRRGREGDMGPEITKKTRVKSVRGRMGDRRTGGHLRAGRGSFPQEAFPWDKVTYPGERSKPVEGGVKHTQCVGKVA

SEQ ID NO: 962623 - protein, 299 aa, Homo sapiens
MSGIRQILAFSTAIASGATPRPMRGRPVNRSCRGASFGSSVRAVPKWARDRRVVHRSNTGHELKRLLQPVRASTALRCADGGIWPALMRTVADYVVQAASRSTVQLLEEAGKEVADEVTRPGLRGEEVLQDIQVMLKSDARPSSIRSLKSDMMSHLVKIPGIIIARLVRSVPRGTRGLYPSAAVGRTPSAKCAMRLASGGYALARIVHHQIRLGAARNAMSPYFIMPDNMLMVDFQTWKCTNCLSASPTGEADTWGLLRQVLCHGGRDTGHVGNHNKMGRHKAEGGGKQTGGRGKFVWG

SEQ ID NO: 962624 - protein, 290 aa, Homo sapiens
APGRLPLHRVAPHVHQVVMVGMGQKDSYVGDEAQSMRGILTLRYPIEHGSVTNVGRACAENLCIHTFYNELRVAPEEHPVLADRGPPEPQGNREKMTQIMSGTFNTPASVRCYPGCAIPVQPLAVDHLAIGDGLRVTGVTHHCAHLRGGMPSPYAILRLGPGLAGVTLPGLASMKILHRSAVPVRPPRGDAGIGGVTLGDSCATSAPGLSQQEMGRGAFQAPPWGRPWRVPAARSFTIGTAAVRCPVGSSRPSFLGWGPGVHEKSSLLMEGAGGSRERWPLFLCAHVPGS

SEQ ID NO: 962625 - protein, 219 aa, Homo sapiens
RVQRGGPEALDGPGMGNRGGFRRRFGAVAFGAGVAGVDGGRWPEACGVRVRNGRRIEEWIARCSQCWAALCQGTLQGSSPLEGDLSLLPGPIRESDDHGFLPGGPLYKDEVQRDYAMCKAEPVSGQGTRFKGISRYRGLQWPRRVMGVKCSRDGGQRHPVGPSSWLSSPWSPCVKRLRGGTEIGKALEWSLAKVTGRCGLCGNSSSLDPGATGIVSDLC

SEQ ID NO: 962626 - protein, 313 aa, Homo sapiens
SVMCGTQVHSICRDETGIEELKKDREKMGLKETEWMNMKAVSWPSAFSLVLGQPPLPSREQGTGQIRTSMWSEGPRRHGHSDSKSTPQHYRPIRAHECLISKKQEQLLLELFLCLKYQWLSIAREKKPQVPTIYFLQNHPFRCSLGDRGLPLLFLFRHHFSGLCVVSSGLSCPGNDQMYEGRCLALCHSILGETDAARGWNSLDARWGCWKGRRRELPGGQEAMLNSGGIKTHRVWCFRLRLGLAGQRALEPGLTPKGQGAETEQCLLGHGGGGHVGRPETKPLSQRNRLRGKPDRYRDTEGEASPPKRWAHT

SEQ ID NO: 962627 - protein, 261 aa, Homo sapiens
MNKKPEADKKDTEQVTNQTSNTELSKPNETPTDQSKSNARRHTQKNHERNKQQKHDKNTDTIPQSKQHPNHTVLDDIRRATSDKQQNIQIEKAKLVVTVERQETTYTREKEKEEESSQELNDRTETNEMNTNWTQKEHVNTMNTHTEATKRTTYKAQQRHEETDRMNSNMSHQTNDTTNIYRDTVSTRIVIDYEDVGTQQIQNPTKRRKRTDNHENDIMKILERIDKHPHEWIDEERRTRSSDREISRATTDRDTDTHKMK

SEQ ID NO: 962628 - protein, 33 aa, Homo sapiens
GRNGLSGVWAGYWLYDVLVEQPINLCSCIKLEL

SEQ ID NO: 962629 - protein, 277 aa, Homo sapiens
MRQTTFQAADLIALCAKIWALSMPVLKLGSQCDALGGKLYCERRCPDFRITRCKVAGMPMSSMYESSLPMQPVPAGGPQKAPAMVCLIARCEEWISYDRAQFHLACLSIKPSRYGDNVTAVALKATAKTSPGYHEQNSHGTHLIGHPCRKWRTQCRSINHQGQTRTLYDPGMTIDDWHYAFLILLHPGKKVGAGHQVRAFPRTTNEHGANASSHRGTQCTKGDLSHHNQTMRSLNMHAYTSIMKGTPMRNNQRQKEGFDDHGSRNTGCVTTRENRPR

SEQ ID NO: 962630 - protein, 245 aa, Homo sapiens
MAIGRGLLGGVRARQHWGEGAGDAARRVAKRRMHQPVRGGPQRRRGLPGQPSVRTTCPGEPTARSRAPAPLREIHRAKIGGYSGRGPEVTCQEGGPGGTPNGPCGAGPGVCADVGLVSADICEDAPPKGPQYTSPFLNKSEVAPIVMPQDSSFKKIKGPSLRTQGPYGSEHGRCRAGSSFGTGYLTSMPSEEQAGSIYPNGPPPEAKLLERLKKRRKQRKNTLGDITRSHTDSTQNKGLVSWFRT

SEQ ID NO: 962631 - protein, 104 aa, Homo sapiens
MITMGTVVRVDVSSKRAWNQAEAAAAVEVAEFPEVAMAPIQGSEDQSGCLWIASKLDVGRIYRITCVKRGDVCMLIVNQMALVSVNVDGKEDMTYAVRKVVTVS

SEQ ID NO: 962632 - protein, 398 aa, Homo sapiens
WRYKIKLFSFLYLLTQELEPGALATHSVGRVPREFELRALRYFAIARCYVASIESRYSSRGRSRSCLTLKSPDDHKHRYLDPSILLDFYFNVSIHCCQTLTDDKTDNNTRHKKDKQEGRDQHTLIQEQNQTQQHSQHGNKPERHTTLTQTGTRRQREAGSDANTPGWPKVANTTNDGPTHNNEHTTAVPTQGDTQTKTPYTPKDEQHTRRENKHNDEHNTNTPTTPTQTSRRPCITAPMQATLRHQRRDTERTETTHGRAQTTSYTPQRHHQQRRNAPTTSRESHRGTTHRYGHNTTRCSPPTKKQHPTNTAMSHLRSNRAGEPTHTRQTHNDQTHRTYTSRAATDYNPPPKANTTRNRSNTSKPTKQQRCDQHRRRKPYEHNNQKKPNNKKQNEDHN

SEQ ID NO: 962633 - protein, 255 aa, Homo sapiens
MQATVRALWTPPQASAVRDEGTDLSAGGYADAGYGRLTLSTPEGHWWTSAISPYLLQQVQALRPRAGVDHVILAVRLHVAGAGEGTEWHTEQTCWRLRISIVPLTRKPFGDSWAPGLLAPGPNSLRLETHILSVLEHGDVILRVSPSKDNGCTTPPGTKWAKVKGLHTLGDPHAGGHPLPSTEHACLLLNAMTTRRGTPPESVGKAPQGVPVPVTNHRRRCDKPEARRRARGPHTSSPTPWRTAGSTHNGHDGTK

SEQ ID NO: 962634 - protein, 272 aa, Homo sapiens
VPYICLWVGTLGSGPFSTKTWQPLERMTMVIEECARVPDKRYVPSTWSSSANRNVVQSEARLLTRMCLTRAQKQAVDKGTGSKQRPADAVDLPAAPGAVPYDKQLPVYVNTIKAMIAGLALLRNPELGPRDPTCAYVGWIRPWAAGQPSHLFVHDQYSKVLAFDAGADRIPPCWHVGHPVVMAFSQSDLKQVQIGKMALNLYRPAWARSAAKKHGTMPTDVHTGRTFASTGSKNWATDLVRPPSHYAGNDSEALTRRGKIAFLDSLQRRVSI

SEQ ID NO: 962635 - protein, 323 aa, Homo sapiens
RAAGPQRTLLSALDGPSEGGCEGKPEGRGGGASLPRRRRRRRPQARRGGRAIAPDAAPEGPSCGLGPRLERIPHLRNRGDGGAHVYDVAYVKAKQTIVHLEELSNAATLYRLIILYAYTGVTWQLNDQHCYEPGFSETSLLSYRKKMCTTVLSTTFSFTTPTQCNHFVSDVEFADLSHLWRNYPPTCLTTNWWTPLFTCCVSIKARVQCQLVTVTLTLIGIFLEEVTNSTVARTGKEHPVRRKLQWLFGLNDEQRNPDPGCWLLVLSPTISFCSFPSSTSSVCPGCAHKTSRCYACVAFAHLQHMLAKRGMFVRHYTVVLVCT

SEQ ID NO: 962636 - protein, 67 aa, Homo sapiens
KARVLSLQYRLNKSSEDFSAIDYLLFSSFQEFLQAQTWLVLHRWPCESAYPAGGPLGASAPGQDVTW

SEQ ID NO: 962637 - protein, 343 aa, Homo sapiens
MRRDGVESSLKKWWTIARDARRYMVNHMRAHMCKYIHFTVKTCLYHDDPTASAWHDVTFVTLTVFCFCERGLGPWYDELLAPDCSPHQVSRLLMTSCVSHLQILTSMHVGKIVCPTLCNALGLLSLSVSIRSPNRVLRHRDVTGSSRRDAQGGPPGEEVFERHRCIGPNECRLCAIDASKAFRKLDSEVGSNGDPMSGFRISTRKILSASRIVGADPSQKEGPSHKGGVENDWIDRGSASDFGPPPRIMFRFRPCEVVSGNPERSVIFGRRCVESHWQGGGENPLKRWARPSPHCCDKFFPPYRYLNLIQTVALDLNLPREVIVPQTPSRGVRFAHHTRWTHR

SEQ ID NO: 962638 - protein, 98 aa, Homo sapiens
YPVKRQKMGKTENMTTSNPERLGRSMERSDVSIRGIVHHVPGRICIYTMRGGITEEQPSEENYEKEAAEDWEEVLRLQDMSLGSWYITAEKLRRWNDG

SEQ ID NO: 962639 - protein, 121 aa, Homo sapiens
MTATSQPRSDFSNIIRRQEACCLMANKNTALDHKRKMVKLIHDCEKGDVTSQQTELQNTNSEEQVQSITSGQQRMLVGAGLRLSDISKQEDGPTSVVIIAGLPSKILYQAIFRKGSTQPSF

SEQ ID NO: 962640 - protein, 124 aa, Homo sapiens
MYGYPEDMDQDKHEKTVLMTVTPTNQMENSDGDKLVHRDNGERDNNEEEKITGSECTRLQICLEESRKKKKNMKELTPLQAMMLRMAGQEIPEEGREVAGIFRGRLMKMHSDDSEAEKAITKAA

SEQ ID NO: 962641 - protein, 391 aa, Homo sapiens
MQGRSTCFNTGLSSTALPKWFVFLNCHIRPNERVAISIIERTGAAQEPQEADIYTHAAVAQPQVVGAEGYCGVFTALLGTYSFCGITAYLSCAAARLVARCTRAIAERMAWQKGERTGYQHTLVGYHFQGPPSNGENPLYAQRTVSLSTLGVGHINTKRNPEPFPGPTTRTLGPTVAVDPKSLFDNVVYERRTRLTHNLRTADPYERLALWFPQNNGPEGLTFRDKFAEPFTPTSSTITAIHDDTPWGNTRGYSKRANSSHGPLARLTACCTGSPTFVLIGRERMPGNPQGPLNNGNFALSFHQALVQPVTKGTRTYGLRKMARRKHSYGTACPPSGHNRALNKTLGPRSHYPPPRGAQERTHEHQRNQEPRGHIQPRRRYNHTETRAAIQ

SEQ ID NO: 962642 - protein, 192 aa, Homo sapiens
MLDYYEVLGVLRHASPEDDFKTAYRKLALKWHPDKNPENNEDAERTFKQRSGGLMTVLSDAKKRDIYDKYGTEDYNGGGGGGSHFDSPFELGFTFRNPDDCLQGTLSAREGTQFSIGRSFGQLQYFLRTLLQLPCDRLSHFSSGRSRNSVCDLPSVTCTGAEFGSAYRSSIFAYPFEGFFGTPPGPVDLYPC

SEQ ID NO: 962643 - protein, 321 aa, Homo sapiens
ERLAATGREEAYGVLPLGRRPGGNLGVQRFVQSGPLRNLVIAHWKAKPRFFGQVRAPASLYRALDEGSYVGLAFVASAAFLQQGTQRETHKHLLVTEAPVDQHRFKSEPDIAGLRTKAFSSRHTTCSAWQAGFSAAVVEEIVLTTANSMVFQSEHCRRYMDVTELAGCTAAAQYEGYPGNVTGRTHTKTPEGKDTQCASKLTYRTARCKKPIGGGRTLSVRLPRDPRARERVAGPRASRAAVGINREAGGPGRLTTSQDDPHAGLPSDYVQETGLRRMTDADTWNEKRRKTGGDHCNTYASRKTLQACRTYHPDGGKGPKY

SEQ ID NO: 962644 - protein, 300 aa, Homo sapiens
YPGKRGGAFKVLIAAQYSEVQVRVLSEPAHFHFGQTNRTPEFLRYSLPARSQHYAGLDKTRAYLVVFPRANAHCHTYVLTNEELSGKVLQRRAAQVCARRVSFADSDICAPSQYLGCSPRLGIMQQTNRPLRMQRTERECEFLGLLDAYLNDEDLIWWANECHWLTSQFVCTLLWLYKQVLEPTFRQAFPIPTVVPHLALTSPVPGCLGGTRKPVLKKNGPSSMPKKGSERPSYKGTHHGTDKGPGRRTEGSAARTAATQGGVPYRRSDWYCVRRCVPQGGAPFPPRNRWGAKASTPETP

SEQ ID NO: 962645 - protein, 404 aa, Homo sapiens
MLGKIPEITVSTSVVSLEEKLPRRGYRERAWIPRELEALGRWRLLFQRSMWASIYWHVGRKEKRCRNALAEQGGVLEGAKLNIDCNGLWTYGASQEMSNGSCYMQTSAGGWVSRREGLLELARLKSKNPAKGRRFDRTLLSTMYKHVTEDQRRYALRSRNIVVITKDSDQHGRGPSEQRLQKTRLCTQMWGLPWLSRLIIPGIISSRIINCQGQAWSFPTRSCVTAFETRCRRRYNSQRNGGTRNIVHSTPGISPTMGAKGAYHNRAFRSGLFDLNDKQFSPPGGGTPNQLYSSRVRIAEPLADLARFDPPQLRSRKTGKAIVGEHTEDDTTRKRLGRKEIPSAAGSRCVSPRSTRHGAKRGAVEHEQEPAKNTKRATGATIVRRAKKDTNTRHEQHHLEQRNN

SEQ ID NO: 962646 - protein, 70 aa, Homo sapiens
FGSQSLRSLVQAGCGNTRQIWGSLANLRHSLVFKRNFSWLLPTWMAEEITGAVCVSPTLGLNLCVVFIYS

SEQ ID NO: 962647 - protein, 313 aa, Homo sapiens
RIRRLGGPKARILPESLTSVFADETGPCGVRVEPGRTEGARVSSECVHACVRLGSPEKAAEGQAQDHPVLQQGAGLESPQGSQSQAQSVPPRVSKTYSLESRSKSSQEYSPEVPTMSAEAKDEEAPKVFSGPGSTCLGSLGPDIREELNPGGPPSDQGTCRSQDHQEFYTPVSQAPGSGTPLSTNWKADTQGQLCSPPGLSIGPSEATSSLAAELWTGGFGGQTTDEKVRTVRGPRLYKNVDLREGGSLVHPREEEMPQFGRLVVARGRPKKKDFSRNARRESPCGKLGEREDQETRERHWTRIALLGGNTRP

SEQ ID NO: 962648 - protein, 89 aa, Homo sapiens
WLLTPGLTTRLSRTASDVNLPTIALCSRDFASALCVTLFIPCNIKGAHSVGLTVGDAGSESSAHAWDHFPVNIPLGAVMPEFVLNFVSR

SEQ ID NO: 962649 - protein, 264 aa, Homo sapiens
RGTGEAGLGPPRAGRVMLHHRAGLEVKRGAERDQARTDLCPGKPRGAGQIIRKALTEEKRVSTKTSAADLVTRNQITLWEDLIISELRERFPSHRFIVQKRPRLSGGQVCAHPEPDVDHRTPIDGTCIFCAQIPDVLAVYACGLCCVRQELEFGGVIYHCTRVRRIVHWAPAGSGAPSGNGQRAPGSPGETDLSKGPWFLTDNLAQMVEPCDPCSLYPELSMGAVAGLARAAWVPSDGKLPIGPLPLGPGGPAVPITVGRAWLE

SEQ ID NO: 962650 - protein, 232 aa, Homo sapiens
YTQRKRFSRKKCITLFFLQRSVLRLKSALFLFLKPARTHLISQVVGLRRTKRPRSEIFPHKGKGFFPQKKQTNLWGGQKGKKKLFPLFVGRKNPPPGGGHAFLNQRKKNRFKGFEQFVDVGQNTNIMVVPNRWWANTRANIYNGGVFPFCKCQLASCNRLSELLGVFTMIRDAPFSARPGFIKERFSFAGEDRAQFLPPYDWFSHPLLWGCEGKTKGMNNTKRAGWGVKYTP

SEQ ID NO: 962651 - protein, 216 aa, Homo sapiens
DVGQDYTYGGVNAAYSSYPTNVCGGVSDEPEAGPSHARLDGRTLRGIGLGSREEVIRRAGTQGPMVLDPKGSGADYGLTVASVSTPSEVVPVTVLAVQEVPVQSDEPRDTVPKAPLYAMMDESQMEVYQEKCLPWTQLELSRNIKDILKVRHSNENFQGSHVFTTEKRIGQGILCIDNVHVWGDLLDSIAFRELPSEIERIQGESREAFTRRDTIP

SEQ ID NO: 962652 - protein, 201 aa, Homo sapiens
MGNPEKLRGRYRLGRVGTDDGLPARVPSLFPRSAPFASLRNGSAELRAGTASFPQAAAGFLRELFGRGVEAPIPKEEQAWLARRVCNPNEGGEPTLELDSSIPYVNLDWEPNVPYRTPLPSTKQANGTHTTVIAPPKCPIKLLRHPSLAENLQHKPLGERHITMLEDHLLLKLWPVVARLSCAPGLMPGPDSKIAHPGMFQ

SEQ ID NO: 962653 - protein, 244 aa, Homo sapiens
MTGNLKRFTNDHRRDGFLTAVPGSEGLQHESSKSGHFNLCAEQGCMTVAQSRLFLPIQKIPGRRAGSLAPTGPANVTQACMAEYLPVGRFPACEKQCLAGSWEPSGCLPIFGVSQQKEYQSDGHPGVTTLVCSTASTYTGAITVEAFLGTDIGRTHPGGDIPPFVFAAEEKHPQERLIGLPRGGRKHTVIRTEGTNGHYRGEAWREHAEIEEPGRIGRALGGIPRATHGRGNTPFGSTPGDARQ

SEQ ID NO: 962654 - protein, 70 aa, Homo sapiens
VPYDRCWLADIVHEAMPLTAIHDSGTGSACDLPPYSFTGNSGYSTTEMRVRYCSTYLSCQLGDFSVIGIC

SEQ ID NO: 962655 - protein, 207 aa, Homo sapiens
MRSRPEMCSFDFLLSQIGSSKKSPSCNRQLLCRHYLHNMATFYSYKPLEHNSNKMAEANSTEGGLPSITQHARTHTLSTHHDRSPSLDGRHLGHHSREHPQELGPSACFLGQLPACGHSHAQRWGFGQGSGRFLIGESKVTSSLSQVHHSAPLTNSHYTHQKLQLLAPASTSMGLFGVPSFHPRQVRGFPLAHIRAGHLVGPPKAHY

SEQ ID NO: 962656 - protein, 108 aa, Homo sapiens
MSPRSRESSPPHLSLLPIPLHVITIASPTPRIHTPHFSHSILHITHISSSISITPQIPNTRYTTTYSTHTTTTHNNPNNTPPPYTYTTPTYSHHTILYTQQNTHTLPV

SEQ ID NO: 962657 - protein, 87 aa, Homo sapiens
TTTRRQRGHTGLSGFRRNLREISQCRSLDVCNEGGDVLVLQRNHKVHILIRWTDIYTGQVWALYHKSQEDLGEASVEARAIVAIENL

SEQ ID NO: 962658 - protein, 45 aa, Homo sapiens
MTVQAGVRSDRVTARKNKLALDDKLKYKTIRSMKDVCDLVYLIPV

SEQ ID NO: 962659 - protein, 267 aa, Homo sapiens
MAVGSLVQKNPPIREYRCRTGTHDNETMPERLPGTHGRWKASHQATGSVRTHYGQHPPGPRGPNPPPCTDPADRRRLNRTLAHWRATQGDTTSVHRNFNTHMTLGSRTELGRTSTAYPSDKKGQNIASHTFPWPRVKQHGPHRNILSPRRIAHMARHTCIGHTEHGLTKWAITPGSKLSTLVRPRSITSTQFQRCTRCEQPRGAPTPRTKAHQHILATSQWGNPRKTPLPPPCRRYTALATIGTQLSRHHIKPRRRKPYKIGQQDAP

SEQ ID NO: 962660 - protein, 294 aa, Homo sapiens
MMVSQCAAETWNAQASCGMRDAETTVAISMFLLSAHGVAVTTLASLDSSLVFLPPSGSPHPIFILSPTRPCHLAYLSLGTLVPTGEGQDLKVFGLFNNQSSWVFFCQLLVHVIRGMFAPNEQVEDKTVGGEALPDPSLNLTGPSLCGGKWNIYIGRYGGSGSAENLLGDLGELLGAFCNLLESQSTMWIRGPKVTDNIPLKDLLYRAQMLTEWTIRTNNLKTIGTHYTSQTRHPAWQLTEATRNKPVQNNGPHQRPRTGGGQQAATGSRTGPTTPRQTKTESTNEHSNNTHKYA

SEQ ID NO: 962661 - protein, 80 aa, Homo sapiens
CLRAPPGLRAPCTVSLPSFPAPDVPACASLPAMVCLPLPCPTLVNVLLCGLVVWLPLLPCLLSLLCFSDHATAWLLSPLE

SEQ ID NO: 962662 - protein, 553 aa, Homo sapiens
MRPLILEHSAGLTTATTLTLTFPHYLHCFCNPRMLLPRTVHLLTLNRAPTAPGKPSPRLLTLLRADCTHTQSRPNADTHQRLANDQRLLHTAPLTAPPHAWPTHAPTATNNTRGADTPTATPPASATAGPNATYAPTPHDLAPTPNATTPLPAPPSPSTAGTTTSQRNRPTAATTHPPTQPQAGTPRRRRPQARATRPDGISQKHDHTTPSPEHSGAPPINFTAPPPLKPIPYPTQPCLALNSANRTPCLDPPSSDMRPQPAHLYQNRFDTSIPHELTVLAPQFHIPPGPFTARPPMTVHINHTYLQRSVGDPPNLQGQRRIYRPYTHFATHPLGPRRTPPVPAPITHTETSPPWRTPYGRADTPRPEDALGAHTPQGPQDSDKHDQRTLRTPLAQLLRAYSPDSLHTSSDTNLTRVLQTHMMRQPTQQTQDTAQTPRPDAVPAARSTEPTTTTPPATLTCGTPHETNRHHKRDPTADDHPTHTQPRDHQTDITPTPRLKGTHQASHHTQARQATRAHATTTTSSVQPTHARPARRRDNTHTRHAPDTTESGT

SEQ ID NO: 962663 - protein, 228 aa, Homo sapiens
MTYPLGHPPRTPATGQHQGRGQSPEHTPARTPRSPEETTRPHGKPHQPPQPDHTSEDTQRRTRKTPQQQKRHKKDTTKTKDYRAEDKQRQVLRTERETQNLALSKLESPKDNKTGNERQPAPPCKEHAQKKDASSDPRTPALAHNIGVTRLTPKMACIKEREDHHRSTTHHARSRRDPTRVGGTTRDHTPKGASAPQRPRNRRQRHDITRETATTHTHTPTTPPSAPS

SEQ ID NO: 962664 - protein, 546 aa, Homo sapiens
RGPSVGSWGPPYSLREVHPSNPGVHPHNSHAPQVLRPRTFPPKDQGNIPSPPSTQTREKQASTSPRAKDPDAKGGIYDIYVPTGEGQAGIVNGTVPRRNHINTGTSTTKHKEQTQAEERSAENSSETVIPHSRGRTQQGYTTRYTPRTPQSDTKEGRPPYHRRTHDNTIESKAPTGPPTGHHPTTRTVALWAKPPTSHTPLAGNSHQRATPTNPKKTNTRDGAGPHPTSTRPAHTHKPPKHEAELTTKRHKQQRKQTITTTSTNHASTNNPGAGSKPHQQHGAPTKLRPTDGATNRTKSIQADNTPRRDLQADPPATTHIVHPPEELNKHQQIQPPDTQHHTRPRTHTRPTHAITPQAQHNPTLYNRKPDKVTTHNAVHPQHTKQHDQHTHSSCHDIHALPMPAHTSRDPHTHPTSTVDDGTNHNTDRDGNPTSTRTHPHTRTHNALTRRDTPTKRRDSAEHRQRRHNDTRGPAENKGGDDKRGTHKREAYRREDRATTTTEPSERSSETEQGNSAGQSQGRGHDNENDRSNVRSRTNEAGRRRAA

SEQ ID NO: 962665 - protein, 333 aa, Homo sapiens
SRFVIWPLPGRGGVPERWSGWSYTGYIWHLIHAPPECGLSVILEYTYLPPTAPCDEKAMGTSPAPNVLMMCTCGPVPVCEMVGRCEVNACPSPYNKQQTLHHGDAYSWACNCSRMEMTLTLCEIYTSFLTLRTTTKRTTKVARKTCYPTYNEMLVYAGIPQGGPADSWELQLSVLSEQGYLGERPPRDEVNIQTCESWTWLMRRPAGSPWDPRGHGTHVEPHESHNPDIPCWLAELFGDGFTTVEILPCRQGPGTEGMPIKPRIQREPEANCRKAARNDAEPRPKPPTPPCHTPPAAPHDTDPHRRTVRTTHTRPRTDDTATTNDKRQQRPAS

SEQ ID NO: 962666 - protein, 158 aa, Homo sapiens
MCVNPKSVSSVYPNNHTLSLTEGVGSSQYIISIEDVCRESSQDCVFFTEQKSGQRETVNTTHPTRTILSPYRGVGERIYIPITFQFTYMCDTRCCCGGKIFGEKHFTPIAVFTHKKKTIRCGTFQRRDNLTTSSRVEKPFLLLLQRRFVGGQLEKLPQ

SEQ ID NO: 962667 - protein, 89 aa, Homo sapiens
MPIRDLRPQVVFAHHADRTYEGILRPGTGGDGPTRGGHSVWRPGLRRVPGSRCVLPAPLVYCSRLDTGVPHAGVLVRDTSLLPREAFQI

SEQ ID NO: 962668 - protein, 401 aa, Homo sapiens
VLVLQAARGPAAPPLCSVPVHDMQMCSMCLCLCVCVHCLLVTHVVPSGDYVTVCDMLHHCDVCCVPLHVVDNHLPCTLCLDLSTHPCVTTSHIRCAAYLALIVLTALIARPLAAPTLRLLHHSLTNCHGPNATKRCASTNPQQPAPHEAPTISHARAPGRTRDPLPTPLPCSPTRHTHSTATPLLSARAPSRTTTPMAAPHFSPTPTCAPSPHPPLPTYHYGHPTCPTGAPSSTPAYHTLRAHAPFAHLPSRTARPLSQPSTGSTHTWSLLPPPPSTRLSLLDYPLPRRCAPALAPETTGPPSGAAPRYPPTFHHHHTLATHSSHPFATPPPNSPATRSSLAPTPRSTFGPVDLLRPLAPPWARPRQRASPAFGLCPLAKVSRPAPCQRHHHFPSPPLLAL

SEQ ID NO: 962669 - protein, 159 aa, Homo sapiens
HLITVILCLSTEFSSYLERHGLINFGIYKRIRDPVPTKKTGKVIIIGSGVSGVAAASTVTKCLEVECHTFGKPGDRSGVDRRSPQFRQKDNLMYADFLAANGWLNRDLGRDILLGCGSARQVNMELAKIKQKMPTLEANGQAVPKEKDEMVEQEFNRLL

SEQ ID NO: 962670 - protein, 276 aa, Homo sapiens
RSWPVICCEWIRRTIPWLENRVPENTMHAMQQNAGGLPGTTWRLHNAAQWCSENVATLEINVQHCCMTNAACSDNLALPLTALLMCAVNVLSCTLTQLPVCACLVSMCVMNVATDVMLCLLDIDDSCECLDADLERTCARELFLAKKCLTYTMALDLLAKGWHMHAAQTGPTDDLHTTTLGRLNVPLSPQTAIDVHSEEVDPVHATPKEPLLDARLCQTIGTMEALMQLGPTYFDSTPVVKRPVARNDRVTQLVTHLMGPLTSQKPTGEPLLAART

SEQ ID NO: 962671 - protein, 105 aa, Homo sapiens
IRVLGIQVDTDGSGRSFAGAVSPQEEEEFLSPGCASHNVYEVISKSICPSIFVGRPDMKKWHWLCCVLVGLPERGSPDGLTRRGETSNCVMLGDPVDRPQSQTIL

SEQ ID NO: 962672 - protein, 70 aa, Homo sapiens
YTYTENWRAIKALIAAQYSGGSGPACSPHHPTIHNMAKPTCTPRISPPNFLHGNGRQHYMRCDDWILDVY

SEQ ID NO: 962673 - protein, 217 aa, Homo sapiens
RPYFFFWPVSVFNRGRGLTHARTYTHSGFRICVESCDIDTLHVLLKLGDLLLQQVWSPPGRPPPHTESGSFLDTCSPVGTTLVNAPQTSPVQLGYDATQCLQLSHVRLIIPRLDIQQDGGLGATSAGFWALLLRVLPKAAPPAAVPPPCPPPHGHGPNRSRSSSIVHPLRDEAEHSGLGGYHLAQGKIRAGHVVADGPVGQESTSPDTYSQRPPSLE

SEQ ID NO: 962674 - protein, 204 aa, Homo sapiens
SLPAPTPWSERRSEPRPGGLLGAEQCSAWHGIPWAPLPFLFPFWLLCCWAQCDAPYMCRPVITPRWALHYPAIPRCSPVPFGAPLWVPLARITKKYYTGAHSDATEPHFVRRAPGHGPTNTRFFTRTTALNDSRLIPDWFPHLDLVGTRHPRPPGAGHSNRLSYTAGGGTHTTIRPNARCDMTPDNSSHSLNARSNTRRQSGGT

SEQ ID NO: 962675 - protein, 664 aa, Homo sapiens
LDWPCHPTPVEPDELGPVRCPDGALVVCVLDELLCPCVPSEAAPVQVAPFCRSSEMRGASCVMLGTVCCFGGGLTRVAGNAAQLHALLLQRETDLGSTIDYAYKNETIRITQCNTALTYQNDKNPEVWSQGIGEREVSDEALGERPNIALGNPTESRGQIQGEKYPAITIEPYSGRAQKTVEYTPRHYKVEKPTMASHRQPLGELENLQATADPVGGDPKQGNPKNKTQIEQRTEQNQRHHRAAKHTPTDKTPRPAQIEEKDRNQSPIESKTHEAQTDKDTRQPRQRQAKHRRRHNIDHSRTPHTPPRERQTSAATSRPKTTSMDESHNRRLTPKQGQHRHNHERVRHNTRKEPAGGTRNAAEAGRQTKKARHQKRDRIHNNTYAETPPNHQIGEAQRSDLRNIDKNASVTHIDHDLTFRRQDDEEETSTLATTRDGTLYKDRMTSNHTSSRSHRNRTETKWLDIKHEHEATSYYTQLQPMSSDATIINGTEEHKHKRDDDTPYMRRSTAKKKQDPGQEARHRRHTERPNQTQNNRPTTRRRQMRHTHERRDERGALRTTDSTPGEMKQGEEDERREGEREEQRETTDVESDRGDNHADPLRHDLTEGRHEHRDHDDSETRTANNWTRSRRNVSHDTTDAPDDRSDSQHHRAHQNTSRHEQGQR

SEQ ID NO: 962676 - protein, 226 aa, Homo sapiens
GTSAIARPPVAGPCLRTPALRSTVNLLLRRSSSCRRRRLSLLDNGPACGPPIRSSQPTCTAGSVWIGCVGSRVWRLEKEYMGRGYVFGSIWRFKGNKESAWQCPGRRRWRAWGPICKCLQHPGAQQAYYIKALSKESAEVLLALLGDIVHNCGLDGSQIEYVTVDVVLREMLENDRSMRAVVSYYLPASRFHGRISSPGCGAGPVTTVREAVLGAELARVTSAALS

SEQ ID NO: 962677 - protein, 70 aa, Homo sapiens
THSNRNGIPNALPNGKNSRIDTTTQEAPACKPLRATTTPFAERHKALHQGAPKTRHIYASTPCYMTVPVP

SEQ ID NO: 962678 - protein, 285 aa, Homo sapiens
PLLRGDTSTVEEKSRLRGNWEATMLSAIEVEGAKNAELIKLLTWRSKTILQAKHHQHHHQQQHHQQQQQQPPPPPIPANGQQASSQNEGLTIDLKNFRKPGEKTFNQRSRLLWEIFLPTSLRQANAGNYLSNIMAKAGASLHSEGITRHLDFIQLGKPDTLEEIAKVELRHYANSVAKGRLRVRFACHSASLTSNETHSISMCTNELLEEALTGVGQVDKGLEVHKTASIRGERTLKETGPRTKYPGTASWPGKHGTDEVKGTSRVNTNTTDPGPGNHKAKKIRE

SEQ ID NO: 962679 - protein, 197 aa, Homo sapiens
ATLTAPVPLPASWAASLPIHRAPCRRYAPMGACYLRASHAPGGFRPPGTGVRSPGFPCTVMARSEPRRWPASRGSTELYYPSAKKRVECSYRRERGVQAATLETIAGWHTKQGVNNQHKYGNRWFRDERIHSQVGLCEYAFTKKVGKYHDRRHLRNPGYERRQVATSIDKYRRIREGVGEPYWRQWREGRKIDYEHE

SEQ ID NO: 962680 - protein, 222 aa, Homo sapiens
MAGASAVAENHACAYVALNDALCLVPMLVDLAWVALPWELPGLRCVVLWLAVVSAGCCIPHSKCTGLLWLCLDFGDVLLVAQVVLGWVMAAPCFVVGCLCPCCGCWPHWRPWFVPPVALGWMPGTSWPCLVAGPAPCCVALAGHTVVFGAGGGLGFGFPDWIPLGAYGWHPWVLPNNLGLNANPGLFCLGAAFFVSPPGGGLFPCRGALGLVVKWPGLLAPL

SEQ ID NO: 962681 - protein, 113 aa, Homo sapiens
MESQLPPSGAHSSVPLALTALNRPIPRETSIDTRGPSPKREHTITGREWNRGNRHTSNQRVQTPYEHQGRQNPAGPHQHKQRTHSAHETHTKQQSWRRPRDPQGHTALGHHKR

SEQ ID NO: 962682 - protein, 122 aa, Homo sapiens
SSLIVEKTSQKSGPQKSPHFCPNVPIILVGNRKDLRNDEPQGEELARMKQEPVNTCKTAADVATRMGAFGYMECFSKGPKMDVTRGLRNGLRELLCRARRGKEKIWVPCLVKTLLQAQPLCG

SEQ ID NO: 962683 - protein, 308 aa, Homo sapiens
MPTARTLRQVQRLALHPTAKTGGLAACGQAGVTLARLLIFALRDISFLLAIFPKTQLYWVVSFHNDRLRNRVTNLAVDPTQPMPQQLLHSALFLPTKLVRRLVHWLLALDPAAPLISRPRLIPLGWRTLPLSWRPRLPLTYASLGPPAARAGTWPCASTGPWLRPSRHFGPGRLFPHHPCVTHARPPQPGAPTSSTASLVHLRARSPHPAPAGSLWSRPFSHPLPNTLRSHFLQRPFRATPQLAPRAPTRLILLRYPKLERRRKPRLLRPPTHASTLMGTPHDAHKDKDAHVDGFSAIRVRNPSLWET

SEQ ID NO: 962684 - protein, 276 aa, Homo sapiens
MCLMTDPANIWWMCCECWHVIMMCDWCNGQYVLDAVIECSNGQNDTYHEHTGDCMPMTGLVVARWPLPQDNACQKYCLSTTLRNVSDADLVAITLDDNNVMVYIMNVNPDIALAMKLALASCCIATPHVRWTLIYRSHIDQRQCHLGVDKDVSAPLHMWPNLLQTDHPVASPPQQPRNKYPRETTGEQLLDYLVPYPRKGPRQCLCVTGHLWLYFLSPPCMVNIHTFYHLRLTQSFTLQISTQGIGGSKNFPLQLVILPPLDGALRLIPPQVATLS

SEQ ID NO: 962685 - protein, 265 aa, Homo sapiens
LVAYVLLEPEEGGRAYRALHCPTGTEYTCNGVPRTRKPWPVLEPYAAGLPPHKHVGSCPLRSWLVPMLLYAFFSSGPMGTCTCLVLKPATCIPEPECCLCSSCQMATCPGCTVTRHGLVLRDLKLCRFVFADRERNETLVLENLEDSCVLTGPDDSLWDKHACPAYVGPEILSHGPHTRGKARLMSGAWAVGSSTMLAWPYPLPGLGACPALRKTPPVGPTPCLAASRPLARCTGVLLLRRGATLNGSQAQGLPEPLVGGTGAYF

SEQ ID NO: 962686 - protein, 149 aa, Homo sapiens
MSLKLSAFFLPRASGSPDVPHTCHDASRRTPCSEDHHTRNLTGRRTEVVDSGRQMGTRTPLHNGEVLHERTTGEQEADKLKVERKNEDTNGGAGQTERRTEHRRGEERRMDDEALTELLRSATVQAGQLNDDYGLLTVDTKKQKTDEDD

SEQ ID NO: 962687 - protein, 78 aa, Homo sapiens
KQMQQIRMSLIAGRLCMLMGKNTMMRKAIRRDLENNPDSGETAASYPGGELWAFVFTTGCDLTDDHGHMFAVPIMVAS

SEQ ID NO: 962688 - protein, 72 aa, Homo sapiens
RAWASPSPDMLRKAEEYLRLSLGECVSGLSCTHHWRPAVQSCAWTLQLPVMKCPLDRAYLIKLSWFDNGDIS

SEQ ID NO: 962689 - protein, 119 aa, Homo sapiens
MATAEGPETYKTKPSPPQCRANIQGETAPRKYTIKNTLHRDRETPPTPGPPPYQTATQRAPSRTRWQETKHPRPTQAKNHRTSAAGTQILCTSANPAINRTPVPSLNNTAEKDDDHTVK

SEQ ID NO: 962690 - protein, 113 aa, Homo sapiens
FPPPRPQVHGHHGVLGAAAACGRSALCSVGSEQAGSASGKPPARLGQWRFSRHSAAAWGVNRQGHLRIEGSIPRFQQSTRILTRNELPEQRGVGGGLDVPPFDQVGLGGLKKA

SEQ ID NO: 962691 - protein, 78 aa, Homo sapiens
ARFHGTPQPCPVCHGLHMYRPGLRLNWHGLSPLGWHHARSIQTLRVLMWRSCGQLPTGIRDFSRCTVPACANQRCIHI

SEQ ID NO: 962692 - protein, 68 aa, Homo sapiens
GGGFFSAFWVWANPRVPPPQARPPPFHVIPNHHNSVDSGGGAPKIDFLWPGYVVPSLVGKRSLGKELL

SEQ ID NO: 962693 - protein, 281 aa, Homo sapiens
MSPLHGYQHPFNTDLIEKHDKQDENITSEEESKTPEQWTSAREGREHKGGEGATRIKKQAREHHRIKAIQIQKRSASQERTQQRKPHTGHNSGELGIEGKPHPYGISNSHGKEVYRIRPEQSCNNEHQLKHTEKSSHKKRTKPKQTHRMAGTHENGKGIHTRTSSEEKPKRGERWIGNEQGTTASTPTQAIGHDTTTREPRERQQHRTISHNTTKNYSVQRHADKKQGEEKETKKPKRRLLFTAKDKDDRRRKNNTRRQKHKHNNNQHHNETQTISTRSTP

SEQ ID NO: 962694 - protein, 399 aa, Homo sapiens
IRAWTGGQDVQLDGAGRRVVARTRCAASRQRVSDGERSGLRSGSSLRYGCCRLEEAYRFHEFHVGRALGVIARRSETRMPYGSLLGWAKYQHSGQEPPFSRDSLTGSQEFRAAALTACGRGKPQFNKNFHSIRRCEWYRKQTCRASDSPGGNGLFRSGGNAREERGAVFSKCFQGGVPENGLYRVISEFHCCVKQRPPKSGFPGEEHSAVDRRRPPVHPFTCGEHSSAISAGGLMTFLPGFLASGYGLRSGGPGIIPGSFGRVSKLGPFSGWTSQEAIKGLPGGQGRQIRVGVDKGGHMARRALVTGPSGGPNVGPMRRCLTRPREKRGNKMAPFGGPPPCKQQEKRALLGDAPHGHGNIPEPAKRSGTAHTPYMQASDKRQYTNTKETTLYANKPHYA

SEQ ID NO: 962695 - protein, 251 aa, Homo sapiens
TVKLPLMKINSDMSSLVVSLAHGAVIYATKGITRCLLNETTNNKNEKELVLNTEGINLPELFKYAEVLDLAGSNPKEIHADSHNTYGVMDGRGVSEKEDEEMGMCGTGIWTRGRPLDNLSRGWRDNSVLIEGVNKPLNRLGSGQTLPRIQQMTFETSFQFSEEATMLGSHDELRSPSACLWSGRSSGAVTGTVRAQAASEIASYPGTSAKLQDPWLRAVAQPDFLHERDQETGIQGSSSEQYRAQRELGPE

SEQ ID NO: 962696 - protein, 48 aa, Homo sapiens
MAVVCLALALELGLLVCPLGHAHGARRDVTPWDYTLLAAQDLGVALNN

SEQ ID NO: 962697 - protein, 231 aa, Homo sapiens
LSLNKGETSSGWTRGRFVNCCYIKFRFSITTHVHETLPKDCEYVGLFKWRFEDCISMDIHLLASEQRPEVQHYHSIIQAGHWASYGATIAPTLSQALYPSPFGGSCIISTAHISGASVKAAGNTVTGLPQVVPTETLPGTLTPRAQHSSYHSCHDGGAQAQGQGVFYHGFTSNGETIFHVRNVFTESQRGSVTCVGEKQFYTVLRGFYQFVHLLSSRSQRGYSQVSPGSHF

SEQ ID NO: 962698 - protein, 109 aa, Homo sapiens
MRSQYRENLEREKRISIKGRDRYSSRNKTCLAAKCTQEEMGGTKRTTFQSPQRRPEEAGRRAIEGSKKTTLRTGQDDHQKEDDQKRRGRTQTKRSHAQLANNKRRDKQN

SEQ ID NO: 962699 - protein, 205 aa, Homo sapiens
VLRWCVAPVVWPSLSAAAPGRCLVGLEPTPTGSLTPVPPAALVPWHASLPCNGQTRSVKGVSCCRVRKVPGAVPKLTLGSSDDEAAVRPRAPQVNAPASQHHCRVTAWGGCRGGAVAKQEDLEEKLKEYCATCLTDKSAKTRQGALESLRLALAVPLLPDFLLELPLTLADALEKCLMKREWRGTSPGDAVLGLLCVQLGPGPKR

SEQ ID NO: 962700 - protein, 102 aa, Homo sapiens
VTVVIVRDDLLGLCPPRVPLGPGIQGAGWKQLLVHTRLHDFSIYVGLVWRDKTRRCRAGEASSINLNNMRYDNLKDLRCPGSPKKKQDEYPFRMAMPKEMML

SEQ ID NO: 962701 - protein, 209 aa, Homo sapiens
MAGAAPTTVFVAGGDLARRSSWEDHSTCLWHDVIPALRWCLAAVAGGETWNPGPTQRASLSRSVASEHCGQQTGWGLVRKMIGTLLSNGAQQDGHLTLTCNGSNHGKAKPWNMGLTLPKDSEATHPDVHNITYTISPNLATRGPRDVACSMDNGQSNGQTIWHAKANLIYRTNWAAMMGNTFSGLGHGTGTTLPMGTYFHSNVCNRESP

SEQ ID NO: 962702 - protein, 300 aa, Homo sapiens
GTFYEKRLATEVVADALGERMEGLCGPKSVVWNDEGRFPHEAGCLDSMVVCACLLSKGHSCNRPGTDTWRKRREDQCVVCSCWMRRSERSLILVLGKTWEREEYSWTDCYYGAFAALGAPQELAEIRKAFFQVLSQERRWSDSNVVQDKALNKEKVKNTLETKALHMIQACLFSSTCPARQQIGGVNGLKKQRTTEQSIEEAENYADNCLAKETGMEAQEKRQDQIAKRRGVYSLRASTSKICIRSGNKTRGGNTIIRSEFRTENQKGGRVKTVPTEGARLTDPTVSWAGGPKEGGYKSR

SEQ ID NO: 962703 - protein, 107 aa, Homo sapiens
MTIRVHRRPGAPEGSTRTQRPPSTARSEPGASIAFLPFTLLHVFTTCTADDVGIRRAFAIILSFTYNLDVRRRATMLTKLDDRLPRNLHEVAPQSSFRHIKECSTGA

SEQ ID NO: 962704 - protein, 132 aa, Homo sapiens
QSWRRQSYYAGLMAEEPAPELLSALAAARERSSCFLSWLELVKQWAEARVFRGLLPVAAAAVINAPASPRCYLAPWLLVEALVGRLAGRVQVMALGCSSAVAALVRNILPQFVFFVDYASNCLYMEEQLKAQ

SEQ ID NO: 962705 - protein, 102 aa, Homo sapiens
MCSPRLDLNCWARASLCPCEPLEELGLQSVLPHPANTVCLTPVSLIPRLSMAAEADSCASVMSIPASSIQDLCIDKLSRFLVKHKIDEVGTTIRSKAATNCA

SEQ ID NO: 962706 - protein, 122 aa, Homo sapiens
GLRPGAVVSSPEPYVRAFLGKQEVLLAKLAAQGVVHGLIPTTPRLRGLNPAELRPVFCASGAPGSRSTIEPHRLSFPPSGHRLVNWPRRSLLCLSPRVFQPSNLNLDTCPARDPPSLHPGDE

SEQ ID NO: 962707 - protein, 265 aa, Homo sapiens
MSHARIVSVAKHSHFLILTLGCSSRDPGLSSGSLQGCRIQQRWSNGTGPYGEERPREVQETTVTAGAATIAFPRCQQRSYYNPVQESNQGPDMCCDHRVCSHTDYGAKGIQIKDQEQNGTRHTVDGNFQSHEAAHGRTDTTSEHLASVETQTSPQAEPSEDNSGTDRAALVLVTDWRAPRLRYTSKCPKRSWNQTMVDTTKHSNGKETNQRQEQTKRGHRERQTERPEKYKNEEENKQRDKEPKAKDKRKRKTKQKEKRNNKEKD

SEQ ID NO: 962708 - protein, 177 aa, Homo sapiens
MGHHRTPHTDTTPHHLRTLHHTRSIPQHNADTHTPQTHLQPSTHAHTTTPSPHNTQTQLHFSHLPYTLPTLPTSPRTTPQHQGTTPTTHPTHRHHALNPHPTPAHPAHPTPTPHTLPRHSQLRTPTTATYKPHHPRIAPHHAPPLALPNHDTHSQQQPQRPNTTPLLTPTHCQTPPT

SEQ ID NO: 962709 - protein, 216 aa, Homo sapiens
MYVSMCCELLRFPCPCTCVAVAYYVPHGHPTDLNVGLILPVQWCCPEDCWDVLPLSDLCLLTAMAADDDAECLDEVLDALSRMERSDVLCCASHTSSLGAQDINRGRAYDSSIYSYHWNDHNVVPGPYGIDHTETHIKDLHWKATDTYITTAAPTRQRTNTHNHQQHTQEHNTNTKNNKDQQHAHNTHQPTKAHNTQKRHNKQHKQQAPPNQQQTR

SEQ ID NO: 962710 - protein, 296 aa, Homo sapiens
PHPAALGSPGLTETWACSHSMRYFYTAVSRPGRESPFIAVGYVDDTQFVRFYSDCRESNEGDACRAPVGVSRMGPGSYLGPGAHRGQNKVTPPPQNTWLVLHKVGQTKGGPWETAPSKLAFGMRAAHMGARAKNAPLLWTSGQGGTYPINPHKRLPNRDTLAARWQTCARGDPPTLVAAGRPHISRRFFPRQKRAVDNYHSDPTPPSFRPTPAKTGGIRLMTRGTHQHFLGPTPLGPPFLAGPGGPPPHFGAAHDACIKDDRRPPQLSGDRAVSIGVHTMLPHAGGEQNPPGSERG

SEQ ID NO: 962711 - protein, 231 aa, Homo sapiens
MVNYQHRATLPTKPYFYNAPLTAASALAALLPLRFPLPLPPTPCPSPSHSLLPATPLAPPRSCPPPASPLERPPLPPHSRPPPPPPTHPRPGPRPPPPPTPPPAATPPTQHPPETPNHHSPHPPHRPTTHTAPPHTTPHTPRPLLPPPPHHSPAADTTRPPPPPLPLPPSYFRRTNTHFPPPLPTLPPHPPPPLPPPSSPTPPTPHPPPPPHPTPTPYHTTTHPSPSPPPP

SEQ ID NO: 962712 - protein, 107 aa, Homo sapiens
MGHHVGVLKTKIIFALWGTGSETDLEIQINCAPLCDDTQTVVALCVLTRVEVRGPKEGFVGQHGSHSMCEITHMRMYMWYRGDILCNIVKFDITHWREQSSLLQTVK

SEQ ID NO: 962713 - protein, 120 aa, Homo sapiens
YGKVLNRIIVNDLQGRNDDDASGTWDFYGSSVGEPDDEKWLHCIALYSQPPRTRRPGMMMTMPIAQCVRIGIFRDPPRYRVITSKYPVAQGPPENLGLPCVFRDDPFTEQCEQTGSSPDS

SEQ ID NO: 962714 - protein, 361 aa, Homo sapiens
PPCSAKPAPQPGLLNANRMRVCCTRPLGPPWLPESLLMAKTPASEEAQRKKNNAGARGEPPWRACLSWHWHVLAPCPLPGVASAWLADCARMDCCCSCKVRLLCAVWCAYADVPSTYPFLAADSGERNYVTFGPRIGELCQQGTEGGEQPEGDANQAAWREGSGGAQRRRPPCRQATLMENRTLPEPCRVPETDKRSATKGQTRTWSQNTDEPHGYDTRRNKMRRNEERTGEQRPGSTRGWPRDHGPAVLSPPEKKFPESSQASKITATQADREHPDGQLAQPQGRPMTKNITTTVTKENRRIKKQKRRKRNKSNKGKTINHHHKRERKQTQRQQPNATKKTLKITGNQNNTNTTHKSNTH

SEQ ID NO: 962715 - protein, 441 aa, Homo sapiens
CCEVEASSVAGPAETDHSALDIHEPNVPHTQCSDDVRNVKCDMGRTSEQLSCSVAKSCNGGSCWPHSSITVLGSAPWLSTVVIGDTAVDIAPIVYDRRMARELTIAIYTYPGLRHSCSAFMRTILSDITYSMTVPGNHSIPLNQKGIQHAIKHSEHPHPACYPPPLASRTTWLQLLVTPPLYAKDGCSMEQRSIIDPIDGYPVAGAQPGKAPPLMTSSALLLHGTRNRSQTDCGTTPENPNAATTPRREDAGEKPLPANTGPVNNDQAPQGTKQHTHVGPRKHPANEHMGTLKDNHDTRDQQLTRHQTHRQRTHRLTPPPAHTHTPLGDAPKQDEGTCNTTHKHEEEHLKTNHKHKHPTHRTHAAETATLPPTNTARPPEHPPETAHAMNTAPHTNPRHTHKHHHEATVTAVHNTKRTHHSTRAPPPRPPTHPAPTNNTHQ

SEQ ID NO: 962716 - protein, 168 aa, Homo sapiens
AGGGGQSVLPSRRALLAGWGACDAWCSLRGQGTTYLRMWRPSECTTGPGTTPQIELKLCMLAASGPLVCLGCVASVPFPLSDKTMVLGIRRTPRTKRFLNSLNVRPGLVVGSEPNFMLFEQVLEVNWCWGAHPLFAFLLGGPASSQLTTATALMTDPSSSPGLRCVRN

SEQ ID NO: 962717 - protein, 147 aa, Homo sapiens
AAPCPSLQPLLPLCGPPFPLPVVGGCPRGLGAGLVGPGPGCSGALGMCGRGLVWLAHDRGFRSAALELLINLLRRADSDGKYSTKAVRNEFLPLISLCPGIGYAQGGLSEASCWRDLAEASNINSHQWFGGLPEAPQQVRPMGTPPS

SEQ ID NO: 962718 - protein, 193 aa, Homo sapiens
MVEDGGFTCVGPGWSRSPDLVICPTRAPKVLANYRAVEATRSPGGQKHRNMVHNTLYIRGHKILKKTPCDTRLHDDSEGADVLQLGQEPGTLIRGPKLPNSIYIGDTGDFHYGTTPTKLTPDCCVERPTWDQQIPSQDPLNNMGLDSANDRCLILQHGIPIQPPRRGTKSPQFPTPQVDTRNGPYPGATPSPG

SEQ ID NO: 962719 - protein, 423 aa, Homo sapiens
MGRTHTTYACASSIGKQLPSFELLMQIKPQFTAMSYQAVEPSNIQCVNYPTMCTAYLQHALLCCCATPNFPSARTTSHHIVCPSIALVRTLRTLLLAPQLHSQLHTHSFPLSTAHQVQHNNPNMQHTCHHLLDTAHRIPHLPICTAVYVLARPAWHTQQAYIASFVQHNTSDGSTQSALPRCHRNTSLTLDTSRLLSLLHASQFILWAYTHPPELHRALISIGYAFSIQLSLHNGLLHLHLSPPSALTLCPTTLWRLKPLQVVHLTPSAHTNATRSSTTHNPWPTASAAPTCHGHPNQTRGTAGSKTRHPARPWRATRTHPNTPYGCHKLIANPTPNWLGNIAVWEPRPPPRVKKPHYCRRPISSNLSVTTQTLYPPLTDEVTYDPGAAALSTVQRIVPLSTIYTLTLCTAGVPLAHTRRATS

SEQ ID NO: 962720 - protein, 344 aa, Homo sapiens
MHLGTTGKLAFHATVFKLYTALQQYFQNGEKKTAEDADMELTQSAACRVQSNTMAPKQAHCTVILSQSKQAGHHRPQAPSRTPTQNHSPQFLSLSTPHQCFISASKAHCIEHSKRPSNPSLSLCQQRHSTTKSGTEHLHPLTPPPAGRHSFSTLTQTPNLRGPQQATQAPPPQLLLPSFPTRPDPHRDPDTQPQRPATSANRPASPDALTRPWHLNRPDTGRPGNQSTSTHPPRHAPHPPNAPNSPRNTPTTPTTHATAHTPSPPTHPTTPDHTPQTEQTGAHTENSNPSHRTQTLSHTKDCHPNADDPPHTRNTPPHPPPHTRPQQTQHTTDRSPHPTARTTN

SEQ ID NO: 962721 - protein, 86 aa, Homo sapiens
YADAWATTVHLNSMANESSESEESMNRDSSQTLVVLSDPNGSACCVMFIECRTARDMVSAVYPRSQSTGPVMWEPACVGIISSRDI

SEQ ID NO: 962722 - protein, 393 aa, Homo sapiens
MHLRPAEPLWCEECRVLPSCLCAWCFCPLDPSAPKDHALSVMLPLCLPLPLPLYSACHASAHACVSCDDLSVVLLSHFVVCTMLMLCVHVLCAHDVVTYFCAVLIPMCPLTASCVLLLLCNLQVLSAVVPACFTEPVLRVWWLYLCPLIRTVECCCSGTCVCETPVLCDPVSTVPACLCLGLRVLVLACAGSFATFACFLPATVLLVPVRICLLLLTCLPWCCPGAQTARRAPRLLDGLAMLDAAGPLKHVPGCCFPVPGHVWLGLLRTLGCRVLHLSRAWCPPWHCHALSFTSQSAGLGPPALANANRMPYHGPFQPKVAACALGETAPLTTPLANYYHSKNPFQMRNALQHTVTVGNASLSSHDVFANPLLETRDPQLVLEQLTPKLSTSS

SEQ ID NO: 962723 - protein, 63 aa, Homo sapiens
MDLLIRRHRYDLTSVKYCDLFSSMCDSGRMFERRVQTQVNRDNAIISSYSINAGVTVNVKLSF

SEQ ID NO: 962724 - protein, 218 aa, Homo sapiens
MDNLWLGMTPGDPLDTAAQPLVQTLAPPDGGAHGPETVRSTDNLPHSCWAWALCGLGSLPCSGPFQQHLSRDVVSFGGGRTLHLDWPRLPCVAPLEWPGADGIFADANWQFHNPILPSDPPPGTIKHTVLRHAFTGDVRATLHQPKGSTAFPKYESSTNLNSRTQPSTSRPKDPGGPQRQPCPTHQAQLTARPPIAIDEFGSIPSLHVSPVRTYADPV

SEQ ID NO: 962725 - protein, 176 aa, Homo sapiens
MAMKTCGTTLHALPQHPSQPGEPQGNAKACVVHGSCIYKDMTVRSSMDDILTVPHSDSVCQDLPSARSSSLWKAAKDRVLSVAVTGDVLCHDSPRFDPHCSTIWGFAYARHGLASPICAPKHSLAWTLDFHSWALDQHLTAHQIGDLGKLNTRHTRIGAWNSFSDLTFRTPRPSPN

SEQ ID NO: 962726 - protein, 109 aa, Homo sapiens
MAIEIETWRNYTISYRKGKMNKLTNQRTNIAQALTPTTLSALTEFTPSKLTFCTRRRQQLHDPRNTSTSYLSNSYQAAHPSTVAKYAGNAFIALERDHNPTRAWLHTLD

SEQ ID NO: 962727 - protein, 40 aa, Homo sapiens
MQEKSSTPLHQTNRGDEKTEDTAEDTETEQEATARQQINC

SEQ ID NO: 962728 - protein, 316 aa, Homo sapiens
SSQHRIYWLCKHVDWTLETDENRIYKQCCVAGLPVYYEEELYYRPALMTAIDGKTVTVCIRCSNQSLTREDSSQHVLQTAVNQSDQFLPSEHPPSGHGSWPDPSSTTLLEQISSMNLSVLHRFRCRSRVLTTETHAIHILTTISSPPGILLSLTLARSMAATCPVICKDQRKKFAGIFNGQRQYLNTDFRLSEHKLTLTTLEYPRLRTSLTRHVLLPTTEAIGTSRILIQLYSHHLSNLSKNSLLEGSYTTASVITSTTELTISHYRPGTHIESNQSKATKDKRKLPVAKSKRAKRPSRYNLTNKTPRPYTLPTGE

SEQ ID NO: 962729 - protein, 169 aa, Homo sapiens
LIQNELFQSWKEADIHESMNIFHDGKSAFGIRIGSDPNIRSFSTWCLITYGQQGQSSHDIFLCYNDYCSTRVARSLCPEPYSCELLYFHRRRQDIALVRKWNQRISGNALKLVQHANEIAALQKIVHYSTMMCPIMKLVQSDTRQYTTTSLQQKIEVEKERHQADERPD

SEQ ID NO: 962730 - protein, 186 aa, Homo sapiens
MAARHLVHRSLLARGCTARRQSPDTPRVQIVAAELATAIPASLQTKHSLTTQSSLINHGSFPPSASLLTPPTTRYFPDVHTSLLIRRNFPKWVPPSELFPSSGRQYRTSPLLPGSGVARPLYPCAHNGHPQETGTKHNPGSRAPLRPKRRPTSNNTHPPPHRRRPSTDPPPPRPAHPHLNPPPTRT

SEQ ID NO: 962731 - protein, 289 aa, Homo sapiens
LWFLNGLAQWLESGPRCGKVLRKWFEPSQFGTWWAILSDQSMNLAGGLGPILAEPILVPELAAGACDAGPIWGTVCGCLLPLSPARIHYMNAAECWTPRTGARMPSEGKKGSLKEESTLQELWCPLSLWVLSTGYLWWCSAVEDLRVLTWGQFFLIQEKGQQPLVGSSYMSALGSGGLDRQHRSWLAVRPGMANARDCATQREPVASGLLLFNDWLAIDECSCYLFGVTVTVTSPKLLDPGMGAVIGFLLGLGALAVWSIPKRVPFQLCGTPSHVEPWQGALTGGATLR

SEQ ID NO: 962732 - protein, 327 aa, Homo sapiens
DEEEIEEELQGDDGSQCSKHAWVKHKHKVSKDDASNQIATYRQLLPGYSKQHKNTERHRTMHMANGKFKWVPGRSTEQCRTRWSKTNCEGQGLKLDPCGQQFLACKQEQRTTTALTKANQQGSCSKRPSEEELPFCIVDLNDPYFAEAQLNKKRITLNKIGYICNKMAHLQKHSKSAPRTDTQGCKLAFALLMACRHEDSKQHTSHYKQQIVRAPKKFMMPQRERKNMPASMENTESGTYTRRELTFGASNCYNESTGFHGQHVPLSQQWLQIRGTALGIPDFQEKSKGPGKTSPARQQRAGANAKPERKPRTHNKRSKDKQNTRTT

SEQ ID NO: 962733 - protein, 72 aa, Homo sapiens
MNHWKHKHVVVAKTTPPPFAAIKKILPKKIYKTQLVHNGVVVWRNEELTETQVGGAPILLVCIQTTKQCGGA

SEQ ID NO: 962734 - protein, 82 aa, Homo sapiens
HHQFVLVAALQGLQAWMNILGTLCWMWICCPCAVSLPHVPDVNVSACYCTVCYKRRSSPPAVHLATIASDDTCGQCHLVEDL

SEQ ID NO: 962735 - protein, 225 aa, Homo sapiens
MDQWNTDGALIAIGDRDEIALTADVKAVADIVEPKASTIPVTRCTPWGTTSPYTKYVSHTQSLHPEWTYPHGGMAQAPPWHGLTVSLGQTQRVSWTQWPLGARLDQRKAHNLNPMVRAGNCTLDFGKGTLRIQALGDPSSTPVEQRGMACGSMALQHWARVERHLLAATNVELGTDSTLTKHRQKDSPGTQEFMVTLGVVTNVTTIWVDPQLLSVVFGQLLGHRQ

SEQ ID NO: 962736 - protein, 118 aa, Homo sapiens
MVRSSFLTPTCVNLTFVLAPLSRDETHFTSPANPNMGGLPLKFPGPGAGKHNSGVVWCVWHEPGRCLLSRLGGGPYFFALMVAEVLIFLILVGFQSRVIPWRRGGRVTPCLVALFDII

SEQ ID NO: 962737 - protein, 474 aa, Homo sapiens
NSTHVLNHNFYWCSLYYTYLQASEYFESPFTISDGIYGSTFICKPQDFHGTSQYIKESSFSSTSRALTPANLSSFTFYSSEHSHFCAFASPRALHTWTLIASTAVLLSYSIVVHARRTSYLQMHARSLSPTTNNTHTATHTTVTHNTQRAREGTRPSHDGETALHYSHRAQRTTKTTQLVPTPHTQRDTTPRQHTHPERHPKKQVTSPEDYETRSATCRDNSSDPLETRALTHTTADTHENNVGAKTTIAGRTPPTRAGNTANTADDNNEHHTRQKNHTAPASAPATKKHKTSGRAHRPPHRKQASNSRRRHLFTTDERAPPPPKAAQNAPAHAGQPPQDTSTARRAKDNDDAQYSRTQPPDDHPECTNTTIQQPNAESKPATIVQEKESTTKLRATTLNRQRPDYAPPPHHPCPQQARHHTYKPAPQPPVETTTQHVRTTATDITTQTQQQPGNPHNASTPRASKQGANQKQT

SEQ ID NO: 962738 - protein, 80 aa, Homo sapiens
SVWGAQECRPARHCLWSGASHCVVPPQHHVLTTVSTQRGPVYIGELPQDFLRIIAHTCSMLACVHAVTAHVLLPASCNVL

SEQ ID NO: 962739 - protein, 199 aa, Homo sapiens
RQRRRESERGAAGAVDRAGGAGSIGTGRQQISKTNTQTYRESLRNLARLLQPGAEAVVSHPPEDVRLQTWGRTGASSAGMTSPPTTGKDYIALNEDLRLLGPRSDTAAQITQRKWEAAREAEQLRAYLEGLCVEWLQQIPGEREGDCCMRADPHKTHVNHQPICDHDVTSEVLGPGFLPADITLILAAGMGEDHNSGLA

SEQ ID NO: 962740 - protein, 494 aa, Homo sapiens
GVVKTTPNRHTGKGTRLIINIVVIWTLYDSGAISTTTGHLIYKCCVALDKQNHQHKIQQQVQCLLAALGTSGSLPSNCLVAHLCIQHLHTDLQLLQLYGYSPNMTYFSLCCDTLIDDATAHCTIDADTESTLDLATHVHTIDELYNTPTTHVDLYHVVITHTLCLELWVTLLTWTYRLGLGLDVALCRLTPLMDTAIAANYSVQTIARLECAISTPCMKGQLGHHSYTLCHLHKQPIDALRTATQSRTASQALGYTSLGPSYAPQQRKVGPTSTHQPIVKPRQHHQVEPYDGPTAHDGNGERNLPRRHRTAPGLTNHARTNTASKQHHTPPPTRTHCRALANSNTQLTATAVNTDKPTPPPPRRIHTAKRATTEHQHHYHQERSSAEHTPCPPHRAAIRARPQTLGVVCTPTTPTHSRHHLGQRSTHTQEPLSQQHQPTNKWVPPYVAPYNPQHERGANTCRTKPHQAYPTQPTPRKHTVQPDCRQQLLGRHSA

SEQ ID NO: 962741 - protein, 48 aa, Homo sapiens
MQADRLTWMLAYGPERNEILWIKGCTVRSMMLSRDKLAEEGKTKEGRN

SEQ ID NO: 962742 - protein, 268 aa, Homo sapiens
EPGDVHARSEEPLPSSGPDLGGIRQKQAAHLLQVAACKLNRKFLQTQRCGGSTCSLWHGSWQGLKDDIIHLCKLADVFKAKNLIEVNAGKSTCKPVQTIAPSWQFFSEQVRMSLDWTHVKVDGALPNGLDVTYRSTLNLTDALHGARYYTHTGLANNERQYEYLDLKLPNLLGRAEKVTFQFSYGTKRNFVWPDTSSNHGPETSERNYSVNLYKVTGPEPLELTAGRRTAGMAAGVPVSPYGKTQPHGSSGDRRLRETLAPASPTPDV

SEQ ID NO: 962743 - protein, 387 aa, Homo sapiens
MTQETTEEPARRDRVGARQTKGPRTHGHDATYTDQKDNYTTKTNLIGGKRHTTSIGDTSLNPVDGIRTQGTPQHPTATGSTKHQESNEKTQHPQQQHTRHDHKSPRKLKRPTRQMEMRHKLATRQHTTQETNLHRAQSPEAQTQKTHDQEAKNTDERGSRAHRIRREPARTRKQTGQPHVGAHTQRPTRRQNAQTAPNRAMTTSQTQNNTNTKANLTNHKQTKEDNTGRQRTQQHNTSNPRDTPDGKHTEETNTHTRRQETHNNNHRDITTSEQQPQSRRKQKQETNTHITNIEDAHDNHTTRRNTNKSDDQQPHTTQHQAYTTTTRHQQKTRDNNTHTSNTQRQTTTDHRQTRHKQKRENRPRMTAKTKRSNHTETETRRTRTTHK

SEQ ID NO: 962744 - protein, 110 aa, Homo sapiens
EDAASYTVGTFGSQAVLVAENRGVFEVLRTQDLVRDVQGVRWQAAVGGAHRENPGARRPVWVGTLSAGGIYSAYAWTCMDDDSRSDVVAGRVGKHTNEALHAMRYENCLR

SEQ ID NO: 962745 - protein, 44 aa, Homo sapiens
MKAGYEDNGRNGSLVVPLGLGLGTTILVQHVSWRRKGAHKGDEK

SEQ ID NO: 962746 - protein, 434 aa, Homo sapiens
MPTYYCVAYSSALPGKQIGSRALKREGIDVGRNTGAERRGGPQAGLGDPHKKLPTAPAKSPSHRGNDHHTKSTPKGDNNEHQRTNGAYQGEDDQSQLATPSPTQAADALMRSPGPKPQATTRTTRTPTSRTPTPRTQANTPTAHTENDNGPTRNPPNSPTKKTRTRESRDMPTPSSRQRRPPDPANEHTTQTRPTATRTKTHNPPQRDKYTPTQRRTPGKPTAPTTHTQSKRPRTTENTERQAPTPGPRYRRQPQPTTTAATSRPRRPQSTQPTPHPRSASMQANHHPTTRQPTGDNEHSQRGSTRAGDGTRTQRATPQDDPTRGRTTPSAATPADTTEHHDDYEARPATRTGQEAADTRATLTRAHKANRHATDRSGPRRQDRTVRRPLDDEPPSSSARQPHGLHAPRLENAEQHNADTERHTHREPTKATND

SEQ ID NO: 962747 - protein, 388 aa, Homo sapiens
PETQPRSHRPTPYRRPRLRHLHPWSQSRGLAADRTRATICLRLRSDSGPPRFTEISTFRPYAARNSIRARTRWHRRRPGPQVISAREYLALDITVPNTRRTHNRPHERRGGRSGDPRGTRRPSESHTIRHIQVQPTVSRGRVSIGVRMKAYQYMDPGKRGHKHVQPKTVCQRDGVCLGPYTLVTEGHIAEPSDNIYLSTIWYADSGQTFLNTERRQDYPGAKTQNARAHLKDRDAHTAWRQTLGPNMLDRSPWHNWKPPAHIHRSAKPLNPVTEATNCGLPGCMTPWWHHHSALKSLTGALLLDVGRHCNTPSGMRQRPIQQGGDPQNGDHNANPADPSEELANPPVTAKGERQDMGRQRKQWPTPSEQTACEPPKTAHPQHRTQTKN

SEQ ID NO: 962748 - protein, 242 aa, Homo sapiens
MAPLRGRGLKNRTILQAAEIIIPPCPPTFSTFETHQRPIQDYCGLYGSRHAQHTYARQTRKVCSPMNYVRAHSTLAHLRSHTYTWRSEHRGPVPDTATIPKNSRIVEQQTITYKQHFRDVRPPHWGRADTYGPLDERPHSQHNWRTQQTVHLTPTDRPRDPKTLAHLTIVRHNSTDPNHMDNNTHSRWLCRNTRQHHRPHTMDAAHNKQRDYPTHDRRPRSTTYHHEDTKPNFIPINNHMRQ

SEQ ID NO: 962749 - protein, 334 aa, Homo sapiens
PRSASIRARDVVTDIYVVGRGVSILKLSYPFYRVDDGCIYERIIRSAFLYIHAVIKDLYSGNCRVLCSSRVEVNSTRRLSATCWLQRWRYAYAPRCPVVACYRYRGEVFRIGCVLLGLTVRDFGYIDRVSLCVLGLSARSSNSCRVGGKLNDGSVIPTNKGLISSDSGHPMWNSDKNPEGRSQGMVLNMGGAGRSFQSCPRSVWMVHGKVYGERVPLGETNTGGRETITRIVIHVKKCRRIPIDGGGSPRRVLIEKSLGRAQVDSGIIGGPPQGIDLRGVWKNSWGKEKALSLGIQRTDLMDLGRVQTRSLWEHPWSSCGRKSKLPGGSHESRK

SEQ ID NO: 962750 - protein, 464 aa, Homo sapiens
AECIIVKIEVKDRERRALRVISTRHDDVELQITCSTQSARQDMHALAREGAVCEYHYRTTDAPASRYSIRISMRHIVIRDRSMRYVGAHASRWLSAKRAFIGLSILELVVSRSLAHTLSCPGYDTPSRYTHRTLADRAKFYEWTYPNRSSATYPSRSVDHQNLTTVIGNLGAQGNELYRLQLVFKCFRFTYRLLWFSAIMDVTASNPHYWGKYIDSNSCPPGHALGSIEVIKKAPEVSTPAQWGITHVKPTHVGPPKRDEDTTDYTTKASERRVRTHTQKKAHRQYVNIPLCVCHNNNSAHTNQRRRQQHVKAATDKPLLTTIMKHKDVTVHRTTTMGSRRTSSQRLTAYVDHRANIDTPYTDTSLLHNTVTHYPSIGHQKNRASILLQGSHTGTHPIMQRRYHITIQRTQRIRDSPLTYHSSNITHTRHPQDPSYRSIVTSLPVQNPQNLLLDYNVDYWTLRL

SEQ ID NO: 962751 - protein, 326 aa, Homo sapiens
SPEQPTGARLVTITPREKPQLAEAGPVTITATMSSEAETQQRYRRPTWARQQNLKREAEASRPRADVDTIETRRAGPVETTGAGHPPHSATARTQAHTHPAHTTTEPNTATRQEPSGQAAPPAPHALATAAHQRHPHPTLADTPSQQPATTAHHPHNSTTTGTMRTTHTHTPRHHIPRHAAHDTPTQRTENSTQIGHRRHRHTQTAPATALPHQRHTMTLATGHSQRGHPTNHTHNEADNKHHGTAMHPNTPEGRATTPHSQHQSTRHPPRYRPPTTHPTLRQPPNPHARPYHRTKLTTPRSAGRQSDTTQQHTSTSKPPLRHAAQ

SEQ ID NO: 962752 - protein, 312 aa, Homo sapiens
GGGGERPLPVCVEPMAVQALRERLGVGGRTVGALPRGPGENSLLGLPVLLDCPDRGRRLLGLTIGCLCLWSAPRCPDSRHHSLALRSFMLPARGGASRMHEAPWRLMARETASSGAPGGRLREGAKAAKKAGELRSRLQVASLKAMRPARARGAKEDETMLIARLREEAGASWPLLFSQSRTLHLWFSPPLPRSCSPLFELGHLPGASTGQGARPLGTGGFPVLKDWAPAGCLSNELRPNRYLQEDLVRAEGFFPQGAAGDVGGTPWFILGEPLCFTAIIFRTGWRVWSPPSESGVGVALYSAKNRSFSPPY

SEQ ID NO: 962753 - protein, 120 aa, Homo sapiens
MSWNMQLKSPARPLALNGSILRIETSKVALHEARYENRTCYGWIRRCRRYIISHNRNKRPMVIYSKSRDRGVLAELDIEAPACHLGLALTEMNGKEDFQSLNGGLLAGGHRRSISFGHRL

SEQ ID NO: 962754 - protein, 224 aa, Homo sapiens
MYCVFNPRRVYACRVWQCHRGVLGLPWPRPFFLVVDGVFPPRISERLLEPASSWSLVTLLFSALWTFLWFVGFCFLSQTMLGQSPSPKGRCWLGADSCEGKPSPSASFPSSPGVCWPPLAYPALQGCRGRFIQELVDPTRGSPNSEEASYPGCILVDKYQQPSLQPERGGPPRATSLPCGLGGGLPWEGGREGLPFCPGISHERSCELRPPLYRSILLRVPTGL

SEQ ID NO: 962755 - protein, 265 aa, Homo sapiens
LPEQQPQHQEQERQRDGDRGSPTRSPQSSPRPWGRAEGAGSDGDGGGGLNWVTCKVFYAMGLYMEGDNCRYSHDLSDSPYSVVCKYFSEGTYYGDRCRFEHSRPLKQEEAGATELTTKSSLACFLKSLIDVGPLVECEYRAKLSQEHSNLCNCRSRFRGLGDMLLSFVPGQPYCGRTCAFRAVKHPVSGPQLTRGKSSGGRSEAPWRPNEAVCPIVQCESAIRGGPVCSPRGFLCLCGRRVLLSVCARDWVTWVWPGGWLLRAQV

SEQ ID NO: 962756 - protein, 99 aa, Homo sapiens
VSTDEESLPRLCPNFSDLEAEAEADLRPREEVRRGPSPSVPRAGPLREALWQPVLRSGFLSGLAVSRGMALRSLGPGVTVACPPSCLAGFEGVLPQEPK

SEQ ID NO: 962757 - protein, 243 aa, Homo sapiens
MVWELGTADEQVRAIAENEEDEQLQAGCVESMPMTLEPKMRMKRETKKEERRMAVRQIQPRIRPVNDELFASREDPGNTRRPLSCSQWVRDLAKTMDGVHSKAKHSRIRGDTACLVPKACGECWFRTAPIGPCGCLNLVGQLILPGRPLKTCPRGSLLEMHVWHFGARIVGSAKKKWYNPSVTEERMLEGLTYPTVLPIVHYRAELPMVWALPSTGLSPPKCNVRTEWRQGRKWWAIARPEKS

SEQ ID NO: 962758 - protein, 54 aa, Homo sapiens
MTGGLGPPGNPCEGVWHHTTPRVLVQTTVDVGNPHLTKRRTRRINTAKPTQEGR

SEQ ID NO: 962759 - protein, 174 aa, Homo sapiens
MREVYCVPLPTRGHGSWGPCFAPYLVIPRRAQWFLLFLAVCPRRPRSRAWADPTRWRFMDDFQKVDKIGEGTYGVVYKRQKQVDRETVVALKKIRLDTETEGVPSTGIREISLLKELKPPNIVKLLDVIHTENKLYLVFEFLHQDLKKFMDASGLTGIPLPLIKSYLYQLPPGA

SEQ ID NO: 962760 - protein, 105 aa, Homo sapiens
LQQCLDGKPWRSFPTPGPGTPICHAPSSHLFTLSPALDLPQGAPLCLASSMRPAGKGADLPAAASPFLSPFERPPPVKPKTPAGFHLAVFGPGPPKEKANTYQGE

SEQ ID NO: 962761 - protein, 257 aa, Homo sapiens
SSETKRRGSESELQWDVPGPDHEPEREMRRSHALSAPAVPVLQAMSHQRSAASGAQRATNADGVCLRCVAVGGRQVLWLPLQVVAYKQLESSMPPRTVIEEFYNQTWVHRLLGRASVPTYAHQRLVVPSQWPFFAVGGMSWLLLCGPFRLTGVGPAEFNADDEPGGLLVSAVLMGFSKLGQSFEMLILGLGSSSVCTVALITGFVPMYVGEVSPTDLRGGLGTLTSWRRGGSHRPVFEPRVTHGDQGLLAMLVGLIF

SEQ ID NO: 962762 - protein, 371 aa, Homo sapiens
CADPRVVAGKDPQNKQPLHLLSLSFRQACVRSHPGCCWALILMAGRSDLLSHEQEMSSFNVEDRSGPLGARGNVLLGCEACGSVDMQQACGQEVRFDLGDKRLPRLCITRYSSSTYRYIAVVESGSSLPRICDLQGEMPCLELRSQVATLPSDCKDAQGESESHWLHTHCGKIKAIWLVTATMQDAHELANTWCQQSGTHSHTGRAPKVDSGTTDAGGTWAIVSPFNMAGQDHVEVNLVTGCWAEVQQAPVHRGHAQIAGLTALNNYSHGRPTPNTGRGAGKCTPETTTTAGPNALHATSDNPRPQQRTTDRANSRHNRRGETHLEFLASPPRKVTDHTGHCAETREKHPAGHQNNTNSDRSKTTEMKRPQ

SEQ ID NO: 962763 - protein, 294 aa, Homo sapiens
AVCDDEGYLTTDIRDRLEWEWKAMEDQTYLEEIRQCHYRDEFSHQVQEWHRSWTMVIERAYTASSSMCRWQRTQEQAAGCMPEEYVIKACSRKLYNWLRVAPQRQISRWPEDDDFMDENQGKGIRVLGLLSPLPEITLCSQRPGPLVKEKCQTFLRMAHFTKRRTAWREEERETTAQDIETLREISPELRSLIVVTVAGRSTQGTPQMFAADVDAALYMMLDQGQAAVIYWGVQAWVRHRSGALLYFENPEVRGTIPGLTPRGRNRPIPWPGFRPLVYLPVWPINPWPSYPSNF

SEQ ID NO: 962764 - protein, 308 aa, Homo sapiens
MLADWACENRVRDWLRYDRQPMPIVVTRCWTEGAGSGQDCGPSKRILGSLLSDSLFLEVKELFLAAVRLDPTSIDPDVQCGVWESVFNLSGEYDKAVDCFTAALSVRPNDYVAVDIELAPPVANGNQSEEAVAAYRGCLELQPGYIRSRYNLGISCINRSGLTGRVWSTFVEALKHAEEKPGPRGEGRCHVRENHLEDLGWGLSMVRPSEAMGERKRREHDHTVYECCGWATESAQGRPGKGTRETNPARAASTAPPRGHPRGGEEPKGRSQDKAKEDGKEQYTHPRRRRIHTSSRHTQTTHHRRGPT

SEQ ID NO: 962765 - protein, 167 aa, Homo sapiens
MGTTGVAGSVAVGHLSTFSQVWETAGISLIKTMKCQEKDDLVQGWMASMLYPVPYSSLHENLVYLAAWDYLCSDCLRCQSHVLSVVGLSLENVLELLFPPLRLGPGACEFPIYGFSVPPPLCGAGGPLAGCATEGVSAASKAPNPGGGPVAGPGPSGGGFTEEFRTY

SEQ ID NO: 962766 - protein, 234 aa, Homo sapiens
MAETAAEWRRFKTNYAVERKSGALSRRAEKHSCDQTGQQLFCVCGTRVNILEVASGAVLRESVAGGPGGTSVPLTSCPDNEVLVTASRALLLAQWCLEVGQRYPTVEGDTHWSPGGHHGLRPISTLVAKGGCDGAVRVWDNRCGSTGAHHFRGSPRCRAPEVPSSREPYMPVVFFYLRPRYAAIRVWDTARTGHAWLCWTCPLQRLSLIGPSGVCRANLVQVRPCPEFFPWPLE

SEQ ID NO: 962767 - protein, 329 aa, Homo sapiens
MTDDEALTHTTIQRHESPVKFHACDGPTVRSSYTESGIRRVRTTTITLVLTRTASPATHDEYPLSTSCDGRTSAHMMRKTTRHDKLRKQSRSTNMGVTPGHEQHTTPYKRPLPADNPTERPLPHRNAYPLKPNQNTQRQTDIAKHTPRLGRTMTRHETDHHYQAAHTDRGETRNRHILPSAATFGVAQTRATSTDNSELTDKLQAHSYAIPNPPSSPPMRIDSHHTTAHTIPLHKEGIHNTQDNTRHPPHDSGNHPGHHTMDGRSTPSKTPPIGRAPTDTQTHVPPPTSTHPLQNEASSGALANANQTRAPFHPEHKTPNTFEEPNTPG

SEQ ID NO: 962768 - protein, 290 aa, Homo sapiens
ARSTCSFSSRPLRASPVFPRRAAADGGGCVNAEGAEGMPAAAEEVTGKWLEARCLTPLGVVVHSGRKKLDMTPMVTPPENFLEIGCEQPENGWVCRPGAVSPLYEIGGPGTNSSYFQGLKGNLTCREEGLRVDFWNLLLADRLTFYAKRTAVSNGSYVSPASPPVGKRAVQRRTGFPFVGSDDIELGNTISEVTHFLFGRQDGKPRALASQVYNNKPGVAWIHPSVGTEPHAVCLSTWFLPGIALFHLIKTAINLHFLKIKTVALKIFGQGTSCQQQRLLYYVDLQQDRM

SEQ ID NO: 962769 - protein, 260 aa, Homo sapiens
MIGPLIIVAYEPQAHSPDTAAAGMAASVEQREGTIQVQGPGPIFFREAHDRQDGTGIAILMILHASNGIYSIHHIRRPGRYTGDTQQHRTGPVLDYQGLMAHRPAKRFMEAHTKATQTAPLATLLGRERHARTMEDIRSDRPGDEMPIGRMRYHHGIAEPTPPHEVGNSYLPLDTFHFNGPPVMHKISPKTTDAQTEPPQSSHRTNTTHGPSHTETPPEGRKTTSQTPSHTPQLAKNHTQTPEETPKHRHSTPNTKTTRP

SEQ ID NO: 962770 - protein, 350 aa, Homo sapiens
ASLSDCGQLVSGVSPRSRVYSNPGYCTLRDMLLDSTVNVRLRVRMRQQRLDSVTVTLVFCPGASCRFSSFVDHSGSAWRGVIFDPGCASGLSLSGGALQGPGASWLPLRGHPDGDSVCRLPIASLHDCLPSPGMSRVRSLWPVILTLLHCVRDRCRRTPVGDLRRCRGILGGVSYEFSWVLLDTCSPRIVESNAEPQNLTGSRLTANQEGQTFRGCTTGKHVALMEKVLSDFSMTVWVAEEDACAVMTCYQGRLTIGPGELLALCHGYYAARPLCCEDASCLRRIVGARDAGIHTRFSTFMILLARCDPGSGGGGETGHEGGCREGRLTGLVGGPLPQPFGRARPVAAHS

SEQ ID NO: 962771 - protein, 76 aa, Homo sapiens
ADIPYHSDSMVLVKVQVDGALEQYGSCLVSNGACVANLRSAYKVGTTLLAQYQLTPLLIRAVKVDKWLVSSVVQEY

SEQ ID NO: 962772 - protein, 142 aa, Homo sapiens
AQLVPGGGCAHAVDEYSLKPVAVEVKSLLGEDVMGYDMDCEEVQKVEEALLHEPLAARVHVNPAWDERLALFMWRGKKGKDKDGFLVNNRIQTPEPAEESSKAYPQLSAFQRLWDVLLVECMRSRASCFPSSWRQQLANWLR

SEQ ID NO: 962773 - protein, 309 aa, Homo sapiens
NIARALVVASVFRCCTYRVAISDVGPLSLIIMSLASVRSPKCENYIKRSVVTSDRMQSMSNTSGRRIRSCINSVITLESQVAQSHKKGPPCEIEGSTKRGDSEASSQPYPYVKVKFSTSDSCDLIKENFSYCKLSTTGLKLECDNVGQVSNVRGCSVIYVMYYEMSYWLNIEMHKQAEIVGRLNGICAQVLAYLSQEHQQQVLCSIEGPKQGSPFPRLNSIDPTGSSKPTSCPSCKALALPLTHYRGAEWRFASGGQRRHRPALIAYPGHGFPRPNLSKEDKGKVLHVCNPTRGILVKNWNITVARTLQ

SEQ ID NO: 962774 - protein, 124 aa, Homo sapiens
VKLDLIHESILHKGIKTLLEKKKRVQLKDMGEDLEWLGQIMEGQGDLDETMERAKSLMGSVLWPNVLLDVEVRNWQQGFGFLLAGIPVEVARNTIGVPRQGLFLDNGTKGRINQNSVKDASKQI

SEQ ID NO: 962775 - protein, 166 aa, Homo sapiens
MEPRVNDSGQIRPRKKTAHEIGARQGAPRTAEQKRRGGTEDIATQSKTKRTADPRGVEAHNNREGALELEQRYPINWVACARNNDTRHKKPTTKQRTGGRRHPVSERQAENMLMGNQETQRSLRATRQADQESHNDQDGMLTRAQHNNTQQKGKAVKHELERGQSN

SEQ ID NO: 962776 - protein, 136 aa, Homo sapiens
VITEGVKPTLSELEKFEDQPEAIDLEVVTESTGKEREHNFQPVGQQCDGLVRGDAHQHCEGERSLSVVMANEDLPSCAKHEDLKDMFEFPAHGTYEKYVHKIVCGHTVERVEFALAPNSRVAEQQWLRTYVAGVVM

SEQ ID NO: 962777 - protein, 69 aa, Homo sapiens
MEENFGVEAAVTTKTVMGSRARYEDSGEVCKGRNMVSVTVFAEYLEDPCRLHCLMTGASAAIEGLPTIQ

SEQ ID NO: 962778 - protein, 237 aa, Homo sapiens
PPAPHADLDEPQISVVPSHVHGMCVCAAVPIYLTMCPPPACVHACGDHVAWECALGVSDDTCCLAPPARTPMSGLVGSGESVGGRKNWHLPREGDERFALILREASEKCFKCVCMRQACGQLGACPALSLPSLPQVTSTALSPADLPVMPNLLRKHGDPNTHGALDQTGRGQAQEQRTGTAKDTHTCLLTCVCLCVVSVAVISETVTHQSVQDKVSWPRGHSYCNFQRCVINDVNGY

SEQ ID NO: 962779 - protein, 145 aa, Homo sapiens
MPVAEADPVPGQLHQVQWHLLLSGDYNVPRRSGVVSAPSECWPPTSVWAIILCQALHTSPCAEATGGNKIGRPPNVPCKVTGCCGLVLVRLIPAPSGHWDRTPQLVPKKLLMMVGIRLTCTTSARGCTATLGKFAKGTFECISKT

SEQ ID NO: 962780 - protein, 64 aa, Homo sapiens
MTVRRPGINCPGGDPNVRSGDKEQGGCTLGSKYRKGPYLTKLVPFEGYIHIGQALENTYYSTPD

SEQ ID NO: 962781 - protein, 280 aa, Homo sapiens
MCMNCSIIDPFIDLNYEWSIHSCQYCSSQPMGTNSIGTVPMAARTGTGIDRFKWLNPNRAIFSNGRYTPVQKLTRATAWALSVRSLESNLGVFTAPVVTNEPRGSIAAKGGRCRKRGQSSRGPHLCLTPPSCTSTRVVSNHGVSRYRWDEAFKRIIIKISLLCNLANLHETTPLGGQKAHCDRTDILEYPDGKGTRWTESPMTNELTDPRNDLFHEAPARDENCCALMGGGGSPKERIIALNFYLVAAKCGLGKGSFALRLNGEARMGMAFGVPNGERTA

SEQ ID NO: 962782 - protein, 73 aa, Homo sapiens
EFGLVVAFRHDGTSNAPMSLDGVHFAIELVECDERVMARYRECDERIWLLSGPSSEHRISMALDMCYYKATKN

SEQ ID NO: 962783 - protein, 152 aa, Homo sapiens
MAIERGWLAFPKGKRSSEKLDTNFTLNHERSTPGSRGQNEQQWVDTLGSPSVALGHTNRNVALLLARENGALREGHKTEYRSPQVVTKEHDTLRGGQDQGVPRYIRRRHVSNTQVCNMIIPQLRHVFEDANGYFVGQTAHTFVGPNRPNRIA

SEQ ID NO: 962784 - protein, 215 aa, Homo sapiens
GTRDPVSAPVVFLAPESLVHYERVRCISIHVGQAGVQIGQVPRAQGALVPGTRYPCRWGQDGRDVDRKDHGGSDDDSLSETSLSSGEDEGRLDKDDVGRGASCSLGLWKLAQDTYDVRLLSAGLSIPHRHLSSAVSSLIIGRGKMLPKELCPDGATTPLRQEIIDLDVWRTEFSELAEQCYRRSGLLGYTTAKVGGTGSGYTSAASWNVSQGVWR

SEQ ID NO: 962785 - protein, 188 aa, Homo sapiens
MGTVHARSWEPLPSKCDLICGGLEMKKLTFVEVEAVKRNSRNISVIYKRVLVCSSSVQLSSGPLVEDLNDCISFYSLRVDDCLQMAQDNLTLDGNAVKSHDSPLQEIARVLRKFFMHTSEAVLSLSLELQLFDNGLEVGARLLFAQHIGVLVERYHPVLGDVNLNICREGLNWRQLYSNTWLGGTNAM

SEQ ID NO: 962786 - protein, 231 aa, Homo sapiens
PRPATLVGPCALIPDLVRCSHSMRYFYTSMSRPGRGEPRFIAVGYVDDTAVLCWFCHATACEPCMDGCLLGAVDSSSDGAWCIWDLEHTVNVKAQHKTDLRCDLGDPAAGYYNHELRPGSHTIQMDVWLATVGPGLGASSAGYHQYAYDGKDYICPEKEDLRSCALLADMAAQTTKHKWDGGHVAEQWRAYLEGTCVDVVPQIPWRTGKETACSALEPPKTHMTHHAVSDH

SEQ ID NO: 962787 - protein, 99 aa, Homo sapiens
LRCASVWEMAGASAPRASWAADTPAGAWMPNSDIDLSNLELLEKYLEASDLHEPGCLVHDACDVLHVAPDTCVVLEPYLTEVIFRGGRKNNDSPNDERF

SEQ ID NO: 962788 - protein, 215 aa, Homo sapiens
MWVREYSTSQEPQPTTAESKELRGEATKTEGNQMTAPQYRNTGIFKGQSTRGDQNAGKTKSGERPQTQNAEKRQMANARRRTKKGHATKKDQRISKKYNNKRKHHRPVKICAKDTECKITESKEEPKSHWKTLGNAPRDENHGKTKTPARKNELRTNTGNNTTTKKNQGKQAPHTTSTTEQEGDDINTTQPRQRKTTPENTQRTNTHKTTQRQRK

SEQ ID NO: 962789 - protein, 377 aa, Homo sapiens
MKRSIMTWLNYEKKYVALLGVFEGSIAHISVTDEPEQEDLIECINCIGTTGAARGSKFVMELMQMAYLIVAYGARLCSYDRVFRLVDIDEVYLNQGIVVLTTCGMSRLLGNRSVVEKSVRHDDVVRLWADRHTLASCTGPGKRGEGGKYHICPVPPEMSTDIFEVTHDELPCQNRLTTDFDNSPCLLAWLREASYGSPLNLGIWSDIAWLYGPSQEVVIGPSFGQPQYMKQRLRRVVSEHMWLSRGLRAGRPVSNWMLGAPRVRKAQENRRAVLVACDGTAMIVVHHPLFIKLTGNTVAPPRGEAEGTSRTPHESGEQAKSRGDPENAAGPGPQTHQERAPNPTEQPDTTLRRKTSTTPSATPQTTEKSARPTRPHQ

SEQ ID NO: 962790 - protein, 228 aa, Homo sapiens
MHLSKLLSSAIYCHSSKRRTNVLPLSEGYCANDEQSSLVWSCGINASTVDNVHALSSAGVYHACSLAVLLVSWWANTSLICFYDDTAAMGYSLTKKLVPEASGSAVGLLSVQKEAWEFTVGPGEDLVVVRESHRGRRVLFAGPVSQGRFTWFSVARAIQIHSDAGSAYFAWCTTLVSGRLLPRTPGNARKYGVEAGRSRANVAAGAGVVVLTLREVGGGLMVAPGGKG

SEQ ID NO: 962791 - protein, 82 aa, Homo sapiens
MSQVRFPLAACPNITESSTPVKSRAHELGRPVQHRCERRFDEPNWASPPLGPFSAGEIGTSVCDAHYGPSSDRLLAGMFLVP

SEQ ID NO: 962792 - protein, 83 aa, Homo sapiens
MRSSRYLLICQMVIVAQCVHSLERAGSKQYSAAIAFTLALFSHLVNHVNIRLQAELEEGENPVPAFQSDGTDEPESKEPVEQR

SEQ ID NO: 962793 - protein, 157 aa, Homo sapiens
MRLSNWMVSISIWRAQYIGPRLERATTPNENNRPEGPSREQNVALYGDDADSVPRLTSEQQRKSCGDPPPVAKKAGPPSNGTATVGWGAYSKNLVTGEVETPGCVYYTVSQCALYTVFPCAWRYGHWARLKRGQEYVGTPLGYNVRTHMVQMYALAR

SEQ ID NO: 962794 - protein, 67 aa, Homo sapiens
VPGGHCGKLPHGYCVHVAVAVVDSLKAELAWAALRESVDVLSLPWANPCLGLDGLLTAGLAPSVLGV

SEQ ID NO: 962795 - protein, 446 aa, Homo sapiens
QYRVQWMTAGWWGQRASPGYHQTTKARDARAILHLRASIPCAQLGRGAWHRITIGSAWVETLDDYAGILTVPDAPCQRSMALCDTWHGVFAGSPLMCIGPPCPKPHVVTTCETWANGRSVSGVCTDGTCTQYGGTLTQDLNTCTGPCGICSDAVTQSAKAKPCTWLWVPEDPIILMLHDHQYHSTRDPYPVLTTVLDTLLAWDSHRTTTPMTDTGTWTGPYRCPKHPGTSMQITGALVVHNAHMVQQDPVTARDAHHRSQNRPPAGPRDNIGKRPDATGAINGTNTMLQTMDLRTQSTPLAKQRVKYPAAINQHTLHWIIATEAQPDESHRLTTINHSHEQRGTEASTHVSTTQPSHNATSEHPQPTRTTNGGTRGIQQTGTQTNPRQTKTRTNPSKTNVRQPHTHPGCRHKASVATHKEHNPESVPTQHALVHTTKKYTHNAHTS

SEQ ID NO: 962796 - protein, 203 aa, Homo sapiens
MDAQSKHPWKQERNNDINETAKPHKQQTAHKLSTTNHLQRTKAGGRRTRTSRKQKHTKTVGRPNKRIKIASDARHIELCKKSGGTPHAALDPPSHSDEPAPTQPTKRTSPRTRHRQQHTPTPHAPPPLTRAGSDRRPPHQTEKHAQADTTPLPPSTHPPRPHRPRSRSTPPHTTPHTHQPATKTQHRIHTTTTHIHTHDSHPR

SEQ ID NO: 962797 - protein, 330 aa, Homo sapiens
PQLLALGVGYLQRGDFVPPSSAPAPGLCPVGSPEADNRYHHTPMAVCVDGPASSQATEIHVVLALVGIARLPGDNMHVRTPDPQASNRRQLEHMTNQDTRRHWTRHAPGGHRTTVEDRATRGAAANSNGTNTRQENSPIMTGQRAPPPENVGQQRNNGAGGSRGQHSEPRQNIRATDSDKEDNSSTGPRKGITDTRKQVSRTPRSCTNPPPSKDTADCTGTEHRQETDPQQTKIEPKRRELKDPHEADQNTPQDGPWNTWGPYTEDTKSSNRKENTAGQKTSGDVSAGSTARRTRQQAPRTKKTRRREREHAEHTHEPRQQKKRHSRRTG

SEQ ID NO: 962798 - protein, 412 aa, Homo sapiens
MPMLMLDHLKNCAPSKLRDAQLNEPAGWSHDVHLCCAACEMHGNAIGCVDDLNDLHLADSDDYAANMPSDMLLRWRHALMPALHAVTDTNLMTPRTLCLCTDMITCTTLEAETLIERMHNGLPRVLMCFPGDLGSRLKLTLQCSCLRSNATPHDDSNGRLASDAQPTPMPLPKDAHACRRFPLCMQSSHCVGPHAPLGLSHVPRGMAYTAYLGARLSTNQPPLGKLFCTPWTPTRLNTSGLVAVQALWALRPRPSTWATIHLLKTRPVTLTGVPRESYQATLAPPLANPARSKRGTQNTNCRAYQARATDSRLTPPNVKGRPAHAPPPHGQRHPTLNARTPARKTHPHPARTGRPSTAPGRTPQPRRPARLDPTTPATTRPNTEHHSKAPPPTPHTKEATTPHPTTPPTHTT

SEQ ID NO: 962799 - protein, 265 aa, Homo sapiens
MGFRPQHAINSLGPPKVYTVGLVHLGGTQVQHTSWMIADTAIEAPTEKALDHNTTTDKGKDDNPNRPLSTKGCTTKRPGGHKDAPGRLPPGRTARRCHGNSTHMRHAARTTQRNDQNRGDEGWRPPWAPHQRANDRHRRINNGAQPKEKHWYMDGGAPHEAHRGTPESGLKLATQPHNTHREEGTDHIQKEKNHHKNRRQQQPSVATMRPNTWEETHSKDRAESTTGRTDKTRQTTRQTQEHHESNAQRTTTKGGKKRGTQSQCT

SEQ ID NO: 962800 - protein, 228 aa, Homo sapiens
MTTKHQKAQEQLTQGARHTEQEPPKKVVEHTRRKATPTNPTRQTLTAANHHNAQNTTPQNNKGAGQWQSTKTKTKRKEAKADTTNKQSAPESHPQPRTPRGPTTVKSPESNQHTTPNQTTNTTRPHTHTQTKKDDSTTQQEPHESTSDANQSDAPRRRHQKKEQKHTGDKTTRQQQQDPPPAHRHTQTQTTHAHNSTTRNSGALTAPHHADATTEHRTPNTHKRRTVT

SEQ ID NO: 962801 - protein, 120 aa, Homo sapiens
MDVDEHETGKLPLEQAFLAVEMDISPPRLVLYRENPHQEQGFVYNRVGEMTREEFGVGKLREINRVERFEGSVVHVTSISNGQYYLDPHLYAILQLASGIRKCKRKEECRLNSSRKGAMW

SEQ ID NO: 962802 - protein, 109 aa, Homo sapiens
QPHSSYDPAAAGRRCCASPPWALTCYGDSGQPVDWFVVYNAAMLLEGPGEGGAEMGCMYKFCDEMLRRLAGRHGGTHQQPVMLGPVGRSLHAACTWSKHQAMTRHILAS

SEQ ID NO: 962803 - protein, 205 aa, Homo sapiens
IGENVSGLQLRQNQGLDNDPGEGGRTEFRYWSFVIMLIWQGCWQCKISSRAELKKAGVDANYRLSQNWSNHHEPTNSTQPPLAQQVTLALASTREAQQDPDWAYKTYNVRPNTMTPPKGEDKELPNDEGQRAPGQPMTGPQSTRPTLSHGVPAVYRNSLGPGPDRHKLINLGSDVKLEKTTIVLHANGDQNHIQNRFLIIRHTYI

SEQ ID NO: 962804 - protein, 447 aa, Homo sapiens
MWSSCEPVPWWEGDQYQRRTTPYSGAHRPLGVSRPNDHTGYLVQPGNQQEDTHVGNRNRVIAIQQAVEALAEQLSSKIVTQLLKRALRGLRGKPDTILPCVGRLLPRTDPALPLRRPGLGARPQYRWIDTREMSFPHGGRVNPVAPNRRFSVNGPLVVAICGSNTYLLEIRYKITLLVLVMVFTHGDARIIQKLGISQLPHIVGGTPATTIPTWGGLGPHNSTTLDQCGPPNTRPTTMKRLLTKWGDHHDYTPKRNNGGSDHRATRTPILPCRGNDRTHNVHPPNVRWRQRATGHRGHQPHNNTQNPDANTDNDVAPHFTTQSERDNTLSCGGNNGQIDPTPNNLDKHKRNMNNVNGRPTTGLPPTRTNPVGTQTHNTQTQSQGDTTQPPRQHTPGPDNGATEHMHTNTQHTTSELTTNRHNVGTGINQPTSTYEQTHHYSRNLDAT

SEQ ID NO: 962805 - protein, 274 aa, Homo sapiens
APPVVTGIVRTSRTQSLASGEVYLMPRFAFCDLVAEKGREEWMTSPLGGHMVSKMRYDQLSSEALEAARIVCQEVAMVENLWREAWLPYPGAAPPPSTSSASTRCCTCAGAERLQTGMRELPWKSPRHCGRVHIGPSYHVHPSQAAEQGACDLMDLRRAKFKYPGRRRSRSQKKWGFTKFNADEVEDMVVEKAAHPQDGCAGPRTVPNRGLLEPSDVPCNHDGFSNVADTLLVCTNKFYFLSKQTTQRGTAKKIPTGTNTAYQFLYTGTKREQQ

SEQ ID NO: 962806 - protein, 31 aa, Homo sapiens
AVDMAETLKTLRQVEVINFWGLPGALQGVHV

SEQ ID NO: 962807 - protein, 113 aa, Homo sapiens
MPFSLMHIETKLILYVFLEQASSLIVGYYSSINFYSGDYFWALATTEHNELNTASDFLSLQLNGKDHAHSKCQHLKCGSLTHFITYNGKLRFTGRDYQENKKRLIQVEQHTQK

SEQ ID NO: 962808 - protein, 168 aa, Homo sapiens
MTIIAADFQHNIMDQGMSIKLKTSQPLIGRPRQSRLAHTAVPPMNASPSSHHLIPMQTHSLMRLASINTSVLALPHPSPHTTSSGYTPVAHSVTPGTIHSCIILHPNRKARRSKTKTHIEIDERRQSATQHTHSSDQPETHTKVIFRPLLNSRQHHHIPKTPHHTQQP

SEQ ID NO: 962809 - protein, 343 aa, Homo sapiens
RCLQYQHPSILLKKLAPYLQVGAAPGSSELIFEDFARFILVENYCYEERGSWRPVTEGHPARLLTGGLLAAHSASPILYLGQHWSCTNSEPSSALCIGLTGATPSELGAREVHANTQSAAAVHAHMTPRSTPATLTASLRLGHTATRAPARAPSAGLILLRSPAHCSAWLSCACPFLERLGPVFSSTLCRPPSAVPPGALRCSTPGRSPLSAAYAFAPRHWVTRSRHWCDAPAPLHHPRVLALLVSSQTQRRYLSITDLSHRITLTDYTHQTPLFFCPLPVPLLTTPCHPSYYHHSSTLYKYRPAFPHLQYTFTYSILSVQLYHYSIRCANHTNLYIDSLTPT

SEQ ID NO: 962810 - protein, 167 aa, Homo sapiens
MFEVYERSRWVPCVGTVGCGVDAGCDRGRDERNGCTANGLCMTTISWFYPESVTLALPIDEASSVPEVCDLRWRLASLAIGPAKHGALCRLRRDVNVLLLFESVSEVRLSGISRGEVVCDFVCRGSMRRYHPTAVVRGSLDGYGGHAGLYALNGEARFRGPSARRHT

SEQ ID NO: 962811 - protein, 74 aa, Homo sapiens
ASVVVVDRVNVLQASGTVEVRCSQLRLSEVRCLMLTGRDITVFDFHVIFVVLLVSPMLSLGFECLSQGYHRLIR

SEQ ID NO: 962812 - protein, 116 aa, Homo sapiens
LSDVLLYTNLLTIGTQLVSIHTSWKACMTIMSNTGMDGQKTDELYCWHLHLCCVWSVERMHNFLEAVVDRVVSTHVLTYSCENTQRAYSTWVPSDCYIPSLYERNCDRTARDNQRG

SEQ ID NO: 962813 - protein, 362 aa, Homo sapiens
MPQHHGCAKGDKLTNSPIGNWWSMNTRACKRPSPTGFRFIGRPFTPANTANDFLLRTNGNDQPPPPTYTTYNPFRTIPMNKDKLRVSRNRVTVYHPECIVSELYKSNLSVAKKTAPYKLGAHHGTFLAMRTPSGKDTHSRRAHGKTQLTRRKRPTTGEGQALTKRKYRNPTIISTRWRPPLAQHGRRLIPTRITLPVQPAANTGRPSKSRTPHAKSTRTGERREATQTPDCHSPSLNNCAPKRIVLPNTPINHRHTTTAITGTHCETTALSHNPPSTDAHGAPPHAAKLPLGPPGATARPPAHQTHSTHNDPTYPTVPRASPHARPRHTATSHVAHRPHDGTPAPHNQPPHAEPQHTPYSTH

SEQ ID NO: 962814 - protein, 144 aa, Homo sapiens
MYTRGCTGYSDLSAPIYAPDKVESNQDERHSFGNLRVHPNALAFVQLRRSSSHILAKSLALSRGRKDVRSEGVGVITMGCAHLRYVIRVARLLGQGAVERYAIRPYLALWNGSVRWVDGCALIRTMVPVVAARFGAKGLNAEGG

SEQ ID NO: 962815 - protein, 138 aa, Homo sapiens
AHGVRAWQLLRPRFLDHSQVFYVALYTREAQPLAAHVVPGTFARDQDPIYGTSHGARIDGESFGDDVDKAAVLHHLETDRMSLKLVTWNREERQPLVEVVVCSLEGDACALVVQLRWVVTHTITTIRTERKDLVSNEM

SEQ ID NO: 962816 - protein, 284 aa, Homo sapiens
PRKPVTKAQKKDGKKRKRSRKESYSIYVYKVLEPTLHPDHRASHRKAHGHSLQLLRPMTSLAAHSLREAFPPWRHYNTALAPLTSRARSRRPCACLLPGATLAKHADVRGAHTGLSTKLHQLQAAASRQLPATPKASFSRSPLTAFPAAHRTPCCHSLRPRSAPPLPLRTSRPAPFHSPARDPTPPAPTALPTLRRPPLDPPPLISLLTPSYPPLPPLLRTARLTLHTPTIASSLRFNPLLPQLPHRLPSRTPTTNSTPLINLHCPYPHLRTATNAPASSPCPD

SEQ ID NO: 962817 - protein, 397 aa, Homo sapiens
PHPGRPAHSQPSVILVHLHPRDCAQGPRLPLQLPAQAEPPACLPALSFARLPMHDLLSTIASVLPGTYAPRTHECLPINAAEIIPGRSYAISTVYPCSHMLITEHILQPADCTDALSDTEPFMPRHYILLSTQIIHGRETRDTLASTNTSSRTGSRSNHNRTCLCTESRIHFTADYSHSHNPTHLACTWTLAQRTPVLPRHLAHPATVAVTTSTTHWRLTHHTASTLTPHPTTAQNSGYPPNPSPPQPWNHNTALDPPPPPNLLAGPFSTIATCTDHYNHNGNIDRHPRVTHSCPNHQDTTHPIFARSGIPTGFGPPKNPLIGPPNKRNISGDKPLPTGQPPIEPLMRHPSDNLTSLPLFFIPQSHTQPSFEWNTNTRYATNPIEQRLQTTITETTK

SEQ ID NO: 962818 - protein, 273 aa, Homo sapiens
MSDGTVICGMPSLVCQLPCLRLLKTNTPCLLPCLVTCVALAAADELLHFAMPVPLSVPLCFTFLFMLADHMALHAFSGVVELDCSHVVLPLEATLVIMWLTVLPMISHPSMCALASSHSGYAFLCPMVLSLTVDLASFNPPHVAFALMRHVFHMPSLTAFALMLDSCWTMSPVCLSLAPCLPMLMALSTACGSLVPWAPSQCPHLAFGPYVPIADGPGPGCCPPVPRILVRCPRAGLDGARVCPCPLELVTNLLIGGPDRFAILRECLPITSV

SEQ ID NO: 962819 - protein, 361 aa, Homo sapiens
MSVTAAALLLNLVQQQQHTYLPCWAPSAHSQLHRDSYSSALGAEQYLKSAEHYTTSPINISLHSSIPEHFNTPPHFHTLAGATLSLSPYTLFYTYARKFQQETCKRNTLYPGARYPIKRHSSTYTEAPIDSPFHGSAQLMPTMRTQAYHNRSPRAYCTKYQTEPTPTQLTRASRCQTATLRRRTGDNSSPLRPLPCPTPLTPQQQHIRPGGTNKVNTVVPLTHSTRKYHRNSDPPNQEDGYHKPCAHTVGTQRTRESDWHHEPNILNNSTCRRQLQRDTLKPRRRHQHAGQALHASRHTRDHPLNDEMSKTCRPTSHTRTINTLNPGRRDRRNKQEIAQRNTTRQQKDRPKPAHATTPTQS

SEQ ID NO: 962820 - protein, 425 aa, Homo sapiens
ARPDLPASGRGVKSRMIPSPLDMAPPHQIYCQRLTAGPACPRLFKAHCLTSREDPDPRNGQPCGAGQQYRTDDMPLPWSSRQLAATNSCEQNDLPTLTKYALNSRSYPRQLLGAPAPRASRHPAQPSPRSSAPSAPALHTPHATLTRHPHPRATAPLLATPSRARANHALAPLHTLATPRIPSRHAHALPHRHTNTPTTPNHTPDPTARSHPTNPWRTHPQLPRAIPRLPWAPPTRTTTSAPLTPPYLPPSRPATTPPPDPRAPPHHRTLPPAHMTPAPPTGLPCNHTLPPPQAPTSHAPWRPNTTRQPCGIRTPEPPRQAHAAARPATRPTPGPIEPTTPRDSQGTTPPQAQQDQFTPPKHSSSPSHPTLGNHPGQHASTSPTTTHTPTPTPRPPPEPPPTQRTPPGKPNTCATRTSPPHTTRA

SEQ ID NO: 962821 - protein, 381 aa, Homo sapiens
MKNEKMKTTSWYVPESRFDRRFTGMSERSRVKKWVRERRRCSALTEGDICATTSTMTCRPIETQAGAAQDTCRHLPGTAGAIERASSCPEQALDARHNPTVAAGSYKSPHTDQRTTQHCTTPSALLNAGLDSHCAARDDSSIALYPAFQPHRLNGAALYTRPLPSTVTPHNSTNLSLNTAPRQQDSRSVAARQTIGNQQHLNIRRHRHLLIGEHPNHTHEAPAFGPTHCNHRTPSTARTNYTTIVEHITPPLHLDITQRIAHRLMPSNRKHTHCTANTLRNTHGNQKKTHKRNKYKNNAWMETQRTRTNPQKTAKRERNTQHEQNSANYRNKPPPHNDQTTREQTRPTAGEPRNHNSPARGKGPRTTKHRNNRQYCNGEHQ

SEQ ID NO: 962822 - protein, 380 aa, Homo sapiens
DDYFFIAHQWMNGGALVVSFFDDSGLSAPRQEAAFAYRTEPVPGLYASFLHFPLCKQALLHCTSFTPQADSCWQQPQHSRHGYATTLLTPADMTRGPQQLLALFHIQGSSTLCQRYSSDCSFYPHNRALHWRDTLALQPIRSNFHTASPAHTSWPSFPTAHSKRGTWALRSEMPRAAHGLLTAALYGRATSTACAHPLPTLRPRTYLPNLVLRTVYSCCLYAPSSTSCTPYPSLRAPPDLTHCFSATALLQPALHTCAARLAATHSAPATLHLCTSHTDQCLYLLLDGSTNSNYYEPLSTFTPTHIWAPLWKAYTHNRAYFATQLHRAPPMFHIKALRPPPCSSNTAQTTSSLTVPRKTYLRSSTTHEPNSITTKAYLII

SEQ ID NO: 962823 - protein, 147 aa, Homo sapiens
GSLKTQDPDDSSQNAMQAAPRDGPCTSTLLQPAAPCHRRPPPCAPCSLFVYPSREEAYHGSATCFRLLGFVCTSGDEPNLLLTLPRSLPPAPSNPACPPPTLAKHLPLLHAVGLDFQHPPPRAPPRSRPHAHSTQQSQAHDRRLVRR

SEQ ID NO: 962824 - protein, 270 aa, Homo sapiens
MAPTGTHALLRSSTYFPPPNLYNTCALPRGNPQPVLAPSLHPPTASRVFTLRPPPPFYPSLHPLRPHPHHLISLPSPAPHATHTPSPPPTGPPPLHPPLAPAPRPADLAFWLPFDLPLTWHPTAYIPQTIRLPVLQTQHWATRPLFTRATHYIQGLYHQTQHTLQSQHNKVSINTRRSTVGKTQITTGKYNASMIHSTHIQITALHYGVAINHTRNTTYRKYNAHDNDITATLPQLGPYPRYPPRLPPQPLHTHPLDTHTSPPPAPPFSH

SEQ ID NO: 962825 - protein, 115 aa, Homo sapiens
AGPPAVLCGRWPAPVASLLSARLLCLSLAPATDEALRQLEAELGCRAGLGLLRGAVVPCSDLCAAGGPGLTYMLLVLPCCVAPPGPRGFAADLLAYQQRGPLLLRNVSKGFVDLE

SEQ ID NO: 962826 - protein, 132 aa, Homo sapiens
MFRSQLRSHHIGCRHDSVDMVTHCGRMDDVAVRCSSAELRAVESVVHPKRVCCGEDAIDSLRGSEMFCPIPLHSGVVLPTGVPRVEVVIQMRLLDCDAHTLMFPYSTRIGEIARMGYLVNAGNDGLYQKTLI

SEQ ID NO: 962827 - protein, 299 aa, Homo sapiens
TRTPCDPLCTSHIVRDGGSCVLAVSDRHPWGLAVWQEILYCWSATSTQRESHPKAYFILFGCLRMTCMLLKDPDSTNELENALVQDELDCETMCPCMATEATLNRAHNADTGERRSASTAIEGTRTCRLAPADGPRRTKGPDPRTYWQLSPMSTAFKKPGSKKVPEHIPDTSATHEPTSNITEPQNIPRAGTSNGHQTNQANDKAVKTQEITRSIQERDPQKMSTETTIGHTEEEKPGPTDTQKKLNQTTDPDDRSNTTNNTETTNITKHKQPTGQKEHHTHETQWRPTTNHPEDNSPP

SEQ ID NO: 962828 - protein, 266 aa, Homo sapiens
TVTGTPVACTTSSWNTEDEVRYGLIPEEWLPVTLSKNWCNRTLCTRNWAYRCTLYPKKIYVISARDLFTALVRYYGVMVYGIKEKYGPFVALTLLSKLKWAKILPNYEEAKQASIHDIQNAIDTEKSQQALWFTQCADYLVDVHTEIHIARWLWKYTYRERLYTTYYNWTRKRIAWTIIVSVQNMMRRKGTKNSDDKLVVGSTWCKASPQEQEKETIAKVHWGTKAAWQRRLEPQQYVNVSIPVETVRTVADKWEESICKSSVSGL

SEQ ID NO: 962829 - protein, 218 aa, Homo sapiens
RQCAAERALRRRRVLYRGLSLLALLLMRRLPVALEVIHCMYWLRQYLDCVQHLMWTHEGPCELLWMNIPILPVNTCVFHDWWTQCVFCMDHAGQHVVDDPVGLNCLKPDEYILQCTTEMLCLLQWLEAQEPLGTDEAVSWNGLARRTGKPQETSHLSALEQTCGLYYDGMTASELPVLDRTHREHTLVGTVGQSTKLPQGRVLPFRPNALDRQWPADR

SEQ ID NO: 962830 - protein, 490 aa, Homo sapiens
AVISLLAASESPPSLPGSPCLPTTVFGSRPSLTTPGCCLLPWFHAVLDGCAQWKCHEKTPMAWKCEGVNWDWSLRVQGFPQNPSGDILNYPSSSACKGLPKSYQKGWNEIKTCEECGTTAYKTQGGPCARSHVAGHSLWSATHPDPHSPENHVGLEEMAEVLWVYPQKKQLECGQCGRGYIIPTKSPLWWGSISPRSLYPHNKDYPSIGTHKCLTKRKSICPQGNFTGAMERNTTQRGPKADIRMLVRILAHRAQKRGYPRRHTRGHSRFTKEHTQKSPVHRGYIEAPITSAHKRWYQKQPTTRIEALCDRAKQYIMRRLAQRELVNRTIIRQQRHHLKSRCDNERQRCGEAEPHIHHQQKNSPTMWRQPTENPKKQTGDPTEGAPRTKSSHPREIEKAPGTREKQEDTRAKEVLHIHSQVVWRDTTRTTPDHPDKQNTQTEKIEEYENEGNTPHGSTTAVETHAHQIGGKKEQTVPHNKVANTHKWPNG

SEQ ID NO: 962831 - protein, 298 aa, Homo sapiens
RADGREDGGRGRGYNDKGGEQRLISLSSIPHPGHHEWSSPEVSSINQEAWVLTAKDTELFVQCLATYSYRHGSGKEKNVLTYSDLANHCISISETFHVSCRIYTKEDFSLVNTCNCVKEEPREEDEENDNDNESEHALNAELLQLPSALNNQPGEDSPGAIPMSLGKDSTARLERLHFFTEFQCVVSSEVFFPGRDGAPHVTTPQTGRGNATRSSAPREASLQVRHKKPRYWQHRRPNCTGRPINPFKYRSDIEELLTYRTGPTHTAPGTHANNPREYDNHTHRAETCQLAHSPQKVQ

SEQ ID NO: 962832 - protein, 157 aa, Homo sapiens
KLCSGLKSHWLPIGIHCCKKNCPEESHFQEIKNVVSGKTSVLFEPSLDYMVTKYSPAWDLERFHGTSSQNGSSMKSVGEVMAIGRTFEEEFPESFTDVPPIYRRFALPVLPMNKRMAIYYEILEKSGLNQASTRIYAIAKAIDDNMSLDEIAKLTYG

SEQ ID NO: 962833 - protein, 310 aa, Homo sapiens
RLRSRDWEPAFPHIWGCWTAGDSGERAGKPRSGSRRRTGGVLQQQRDQDASIGDPSQSDDPDDPEGARLPRQPGEAAAEVSRRRGAQGPASLTVTQRRWKLRARPSLTGDPKTPWGWGARPPAEVQYTPVARSDFPPFPSRDSGASGPDLMSCAGQPRTGDEAWGISASLFSSLASALPPGSPSAKGPVSLRIGHSRLVWFRASVRPAGGLPTLPQKGLPLGREAFCPPCSPVMGRRTGGPPVSPLVWSTKSPSARPHRDKFSMACIEPGDPWGVLAVRGPRGDNYNSPRGHVLLVGSPAFLLPPRGVWP

SEQ ID NO: 962834 - protein, 176 aa, Homo sapiens
LTSLRGQCWILVWAWLLGSSTVPALTPEQKNGCCTDICSPASWPPVQWASWSADESTVEHLPKRPCRSILRTLWTHDNLLTVAIAHPWGLPCLSPLVSMASVIAFGTHASGPAPLARLANPPPCMLFSRAVLCVYVPFITAQSPSNHASLYPPSRNNVARCPLALGVSGPLLFPRT

SEQ ID NO: 962835 - protein, 384 aa, Homo sapiens
ANCLRTRRRKERRFYTNAYTDWFRAAVTDRDSDPEPGRSEIDLRHISERIRKSGEERGTHWEVHEASGSLQYEIINLAYTVMRYIVRCEGSNSYYFDTCRELGAIGLTPRHYLSDHHDSADDMHAAHAARIAGAFQEFMLRAGSFEPRLFPTSKGKLMGRCSLTSGELASVMSHLRGPSSHFCFWYPNAVQRVGALRTHGSTRGTLRLNTLRIRTLTDQIPGHLKQVGKTCSTYSRVGQRLLALSSTFQLSPAVTSEPYWKGSGEISRAHLPFKAEEGRLSNSASLGLSTHTHYMFVPWGTSPICGFEEEHQEDPLSKPPKGECTLVFPTLIPEEINECQGRAKELCLYTFVPFTPNRKAEHIAVQGGINSPGAKVAPAEKQGV

SEQ ID NO: 962836 - protein, 129 aa, Homo sapiens
HPLAGVPPGAEGGSAALHSVSDLGASEASRLSEEARVFFSESKFLGDAGRMTAAPERRDSSDRRCVPRTAHGQEAPGTDSPTLRRRDLRLRSVAEAPEFATQLWSSAAQQQEKPVPCGGPGASRETAKG

SEQ ID NO: 962837 - protein, 264 aa, Homo sapiens
DCLVQRGGPWCALVDLEMGNLRWCFPLECFWHAGILGPGGRWLWTGAWGLMCPLDARCDVQRPSDKRGVIALSPMLVPACVKDMKINVPGMEIYLFSLPINGIMRSLDFFLGASLKDEVLKIMPVQNARPCAWPAQQSSMAFVCYRGLQLATVWSRVLMLLQRSVGTDNPVGPSSWQCSPSSPCAEATVGNKIGSPTVHCKCDSDWCMICAGTLIPAPQGTGIVIRHLVPKTLLMMAVYNDATPQPGLKCNPGQFASKFDAFLD

SEQ ID NO: 962838 - protein, 118 aa, Homo sapiens
RGLRHHDSFSDAMTQPIMWSSVMCTMGTISLDFLSDEKYVDISSLSCPSEKNILPCLMQHCSKRGWRVLHHSHHIVRTGAEATHKGDLMDASRIDVDCPDGHEQSEWHSLDPKEQRHL

SEQ ID NO: 962839 - protein, 288 aa, Homo sapiens
GGEVSECCAERALARSECVQQYDRQIRLWGLEAQKRLRASRVLLVGLKGLVAEIAKNLILAGVKGLTMLDHEHGELQKIPGAQFLILYWVCWPEICAEASLRSELTNLNPIGGTVTGWTLDDIREANHELIISLNIDAVSSDLLLQGMSELNVDQICHKNSIKFFTGDVPGYHGYTFANLGAAMSPWRRPLKLPKLATAVARCGPDTKRSKLDSSETTMATPTVVFCLSKNPEGAPGRTEQSTRYILKRPRARTNYPSFRLPQEEFRTEFSERRSQLLSSPLVYDSAK

SEQ ID NO: 962840 - protein, 368 aa, Homo sapiens
PHKYHYIDDLVVILAQNVWEHLYNRFGGVPLAVNHLYCVLHLPGVRSEALCQMLQEDRDLTLFIQVEQRPIQAEESHVASYYCISNASGSGELGGCSVTGKDNRAPRAHGQQQDRTGQPAADMSRLKQGADYRADNRRRPGTYLKQHCTGGGPENAIRQQCRQQTDGPKRTCNGEAERSHTVTLEPSVIWLGHSSSRLPAKNTSWQDVDCTCDMPLEPTCCTARLTNKNRWCPPPTGAYQRIFDATHSYSSMIQLDIYTPPTLWKVTCIDYHCLLTTCSTIPILPHVPAANEPKTNLEQIPPTKSPMHAPRVMQHSTRMTTHTSQPTIQLTKPGRRQSNPPPATVQTAASLGPPEQPAEPLALHHREL

SEQ ID NO: 962841 - protein, 219 aa, Homo sapiens
FQGEWLCDRHLRDVMCGLGLLLCAVCVGDAVMPMMLLCGACMRFGCVVPMPGMQPLSECACCDLFNGAVETGNGKCAPVFGVFHVDCLCNFNLCCLALVLYPVCSLSPLEMMFSVLWLHLVLRVLNPVQHLPTSCTLGALIVSLCGPPVCMLPMWPTRPCLLTALLQPLGHALPAPVGTIVHVCLTLSCFPLTCIYLHLLLAYRVASPSTFVGSLTHTR

SEQ ID NO: 962842 - protein, 428 aa, Homo sapiens
ILNEFDTAGFLPSSEVVLHSVALAAHFMPNMHNAITALLVGQLSQSNTGLVFKQQSVSRQFQLIILFSIIHVICFHSCIQVHCASGHFIPYSFPITHMSIQSSFTQHSMICSISTSSHTGAFILLYSSISTSTISFWHIVLHVHISYHYLQRILSQLHNIHTAPQLHNTVTSHSGRISFSQRVTQHIAASPISTFVLHLTNMGLSLRHQATPTILPHTGWDTGTSPSISGPTTGISRPIITLSPAHALSHSLTHHTARLLELNHFTNSTPLWTNTPFYIPYFSNNVSSQSGPSPHMSTKGNEDQTTIRGENQEIWTNWDNILFNLPLFPWLAHTDTHIPKQEGIMVTGPNPGQGNSVTQSAGTPPEDTDHSADLATLTGPTTRSRPTGSAPHHTKTGHNAQDNLRHKPETRARNNTTGRQHPPRHGIT

SEQ ID NO: 962843 - protein, 185 aa, Homo sapiens
MTDTYPMCQWSKMAFENEHFQQDPSGLTVTICPLVTVPGPVVSSQKASHKHHLISYVALCAMLLMQQLQLALVIVLVSLELVILLHVHVQAQHACTHNNGQHNSRSHLLGSNHGRGMFLVLVASKHNGQHCASGSRSLSTQLHPPSHVWVTHCVLAISQGGRKHCSPHSRGATDPVFIHRLACED

SEQ ID NO: 962844 - protein, 306 aa, Homo sapiens
DNACSADITQYYLGMPPQWDMFCVCMAVALSEIERVPLAVLCDTSGLQLVMNIAEHYMASYVEWDPTGRYVVTSVSWWSHKVDNAYWLWTFQGRLLQKNNKDLLLPAAVLRPRPPTLLSQEQIKQIKNGSEGNTLRSFEHARICSESSPNSLQSAHLGVSRSAPPCMASISCASHRKMAQELYMEQKNERLELRGGVDTDELDSNVDDWEEETIEFFVTEEIIPLGQSGVTWSTVGTDSACCPVLSYRDSRVVSRRSSEWQSTPMSDLDPVGRTCRESHGDYRLLPWAHLGLGLVLVMEIWQCEEL

SEQ ID NO: 962845 - protein, 357 aa, Homo sapiens
ACQFLIKFHERRNDTDHRLCLTMLFALKAICHFDCTQHPTTLRHLRSQPAAHSACPPFSQQLSTPTHTSHKFTPSISPYPKAHAAPPLAPATLPAQPHTAPSTSTTPPLPHLRCAFPRAAPATPPPHPAPTRPALALSRRPPPPRRPRSAPPPRYPRRPLSPPTLHPAPNSPRQQPPTAHTAPPPPSNPTPRPATHIPPPSPTPPASPTAVPPALALSPTHPPPSPPRPLAAHPHPRRPSPLPSLLPPHPPPLPPPPLHLSPLPPCALSPPLQLPVTLPPPRRARAGPAPLARATPQPHTTDPPPPHARTSHRAGPALRPPPLHPYPTSAHSASPPLCATPARPPLAPLSSPFSPAP

SEQ ID NO: 962846 - protein, 240 aa, Homo sapiens
MDVPQLVCPPSSFVDLDLLSPSQSFRVIEPRSDSRLPSVIIATSDGVSQHLNPCTSLAHATEQRPQKEPMIRFRQSNLFEDTDQTTASSSRSCCVSARQVFQAGTSKPLHSTGINVNAAPFQSMQTVFNMNAPEFLRVESEPEDFKSEQNQYQASYNRELGLVSRHQVEQTELQQEQLQTVVGTYHGSPRPVPSSDWYPPAAPQQNTGFPRSNQPYYIVVECLVEAPVELEADEWIRGLQ

SEQ ID NO: 962847 - protein, 99 aa, Homo sapiens
MAGPSGLKQRFYVALYEEREQYAMWSPWTKLTNQSSKSFTHTTTSATPTHHHQIATTHTHTAPPSTHNTQIAASATHIKHSIDPTTAQRQPTHHHPAAS

SEQ ID NO: 962848 - protein, 106 aa, Homo sapiens
MTYGDPNTLVPCTRQAVVRARPSVPGSCTHEYPTCLPDYDCVLMCFWCPVACVVETVTITQVQTSDVAHRRSRVYATLQCVSITGTSTMLFEYHLITLYFSNNASV

SEQ ID NO: 962849 - protein, 368 aa, Homo sapiens
MGKEKDSYQRVVVMGHARFGQVHHYVASLIYKCGWLRRRETIEKFEKEAAEMGNGLLQGIAWDLGITSGEAEAVNRGIHHVDILAVWNNLMNQTSDYGDVYICSAPGITRSTLIENSMYYRVPSAVAWLLPVLNGYARSGVSVQFCIAWVMLPQQLATVPRVAMPLAGVYTTKGWCREQLHLIRCLTHILRFQLEPTHRAQTEHHARHTSSKGSQLLTINDHMGLNNLTTPASIRCQVAGAWKGDNHAWKPQVLAMPWLQRDWPHATPTRMRSAQLGTQAGHEGLGHQVTYTANSAPNLEETSGRPGLFPTNYSPPSGGGIGATGMLAPMGIRRVPQNHGIEDEQIRTHRNNVKQQRETLPKDRQQHQ

SEQ ID NO: 962850 - protein, 354 aa, Homo sapiens
WNPALVPHTRPAAHSQSSVHLFTRTLVTCPKDPRRRSSRLRQTTDQHAAALLLSTPHMTDLRPPSQAAARTYHSGPQSAAYQPATIKPASSYALLTIYRVPMLLNTASLTGRTALLRISATHPYRPNNHLSPINPTTQLTRTTRAHHMALHAQRIALDTPCPATPNHARAGPRNTSINPIYKAQILHTHQPPHRTLAATRTTRRQHPPTGGPPGTTAHNLPPHARPRPPTTHLPLAPHHHEHTGPHTYNAHHPTTTRDQPNGHATPTPGHPHTIRHTNNKRSSVASPPKRFERPRPRHHFSQHIGTDKLRTQRHNTPLGNHCTTPRRICKHTDPQTSKTHTLLRTYRIPPAGKA

SEQ ID NO: 962851 - protein, 300 aa, Homo sapiens
KRHKGLVLINFLAKKVPRGQGLPGGGACAANPAAKAVPFGSRLFVPACAAGQLWPPSKPEGPGLQASGPGCGPAPGERTQAPSSRGRTTAPPRDSGSLTLGRGSPLPCHQENSVPGSLGPSERAPTQGGGKQEGQEAGGARPGDSIGPIPVPTKDDIGKRGQGRVGSPGCGACGTDMAAGLQSEGGRTNMSWEPHHMGGRQRLAALGTPSGGSPGVVPPVECANGAGTPKPREPRDVPRASPPATYGNGRRGHMRARCPGRDPKDGASDPTATEGDGRGGERGGDDTANISEQHGSTEPE

SEQ ID NO: 962852 - protein, 212 aa, Homo sapiens
MSRSPRNCSDVSAVKCERVRSWVNFDSSRLPGSLRASSSSLCLLCLLPGSGAACVLRPALRSANGLLPDLLTRCALPLAPMPCDLGPRWLGVAAARTWPALAWGLVCLCCLRMCHVWQPGGCMQGVGTVCEALCSTRLKSCKGVCLVMRWLECTAMGLQQRKPAGQVWLVIKEDGHMESLTRQEPRLVLISIIYENNCLIFRAPDNGPAGIA

SEQ ID NO: 962853 - protein, 147 aa, Homo sapiens
MGGEEKPMVLVKRQQKEGGKKYEHQKDLEMEVELSGILGLKYIYTRLEMYNILKARTWFHSGQKRRKTDSKPIKVTVPDGKQVAAESWKTNAISNLPVELVKAWSENNVIAKVNNVVWDLDRPLEEDCTLELLQVEDEEAQGVYWHC

SEQ ID NO: 962854 - protein, 140 aa, Homo sapiens
MMRKAIRGHLENNPALEKLLPHIRGAMWAISVTKEDLTGDQRTCLLGNKVASLLARGWWPLPHVKVTVPSPEHLVSVARRKNRPFFTRGIRARSTQAVENSFSKGGSIQVWKTSPLKVDLWQCLSQLTLDDNSWDARRAM

SEQ ID NO: 962855 - protein, 220 aa, Homo sapiens
MPDALLSLLLLLLPLLLLLLLLLLAPVSLGPEPCAGADVRTTGFACPAKCERDIAVLTLNVTADHFAMTAPVIIALHNGSSDLQQSDFANGACQRPLQTLHNLVHKVGQGGAWTSPMSCGTETSAEVADLKNAAVMCWWNEYDGGDRRLVQEPPASDDLTDSLCANHVLTGNDTSWPGTAVVRQEGADTAGLRRDDVQEEQQHAPTAACPKQYHQQFTVT

SEQ ID NO: 962856 - protein, 152 aa, Homo sapiens
MPNRDANASITTGYPYILGLDLAFLHSALHHRRSLSGSLENTTEGRTKSMDDLDGVARQSNAPVESWRSATRSMRGRPAKHRSHAHTHTDTTHTGKPKTPTITTKDTLPPHPLALRPPTPSAHQPPAQPTNEPHNATRPPQIGPPAVNRHPP

SEQ ID NO: 962857 - protein, 65 aa, Homo sapiens
MIPRSHEIRRIRITFFKKCRPNPMIWAGGLLCPGACLDDVLPFLLWMAHCFPTVEEDILRSHSSV

SEQ ID NO: 962858 - protein, 208 aa, Homo sapiens
GPLLWAGWESCVTSGSGLVLPMSAAPGRDALVLVSRWWWLPDCCSATLTSSFLSAFPMQIGWMTAVCMLCGVCPGGPGGPGMGNLRWLPAGWFRQLASWWPGGRWPVDWGLGPECLLELLLECNGRWITDVDSPVTNVGPAVVKDIEDQCPWEGRIYFFFHPLATNLRRGTSSKKSIWEFSLFTFVWVAISSSNGIEGFWTRTLIAQV

SEQ ID NO: 962859 - protein, 185 aa, Homo sapiens
FLPPAAAMLPAALLRRPGTCACLCPATALCLMPEACLPAPGCRLCAPTMMSFTFCLSHCRCSSTVPTVLAVWTVPTADLEPSASLCWPTVPTAAWSCGLGLVVVHAEDVHHLQILCEQLVPSSERLTLRCSCWPEEAVTLDMSGPGWQPRQTWMKAQAELVGVTADRGQLRAEIQIRIEANEALR

SEQ ID NO: 962860 - protein, 432 aa, Homo sapiens
EPVRRALRARPRAAADHRPATCYLQLHDLSDDPHGATLGPMVLPVPCSLPAACWLGCCCVNVLAVQCCVARLAAGSFHMPPVPVLEWPEHVLAGVQCSHLCACWACSVADASCCCMCWHVAPGACPCAAQLSVQPTPDRLACLHGSWPRKRLGRAEHVPCGDAMATKRHTTRGSQDACTGSNTRDCTADGALDENRYPTQRKNVTYFHCRNQTLASLAELTLGALKPSFGQGDTTVGYTGNTGRDCTRCERTDLNCACQWSGASTMEAYFPSQEPPQWAGTPKRKGHSTYPNRSRKQGIHWRQAIQTAQRHASRKPEREGVYRADNPNRNRAARRRNLGRVKRTNAAASGPSGNVPSAKTKRSPHTNSERQQPVRPGDHTRGTHEKENNTRPTNKQNKNKTATSGQQTTVAHKNPTKKHKDNRESGIKTGRP

SEQ ID NO: 962861 - protein, 289 aa, Homo sapiens
RWAGTYTSVKAGECGHECGALMTRKGRGMQEVEELSETVECVVKQHRVGEALRVVVLVLGVWSFGRRRWPGSWVCAWATTVGWLPCLCEMPALLRFLPMAHWGICTLCLPLHALLGLHPCALCSDAAAWTWFLPSWTIFTGWREQSPAHWSGVLADQVWTLTQTEEQLHCTVYRGDKSQASRPTQTSWSACASTFQLDVTLAQLYQHLGYRGHPNSMRWLRNSKVCDCCDKNPLNGYSHVSGPPKKTLPQSLALAAVMCQWLGPRLTRLMMSHTWIPSMKPGCKIEAPQ

SEQ ID NO: 962862 - protein, 194 aa, Homo sapiens
RCWAERRELLGSAEESQDLQMPCWRGGMTEGSMAPPGSANAWDDVKTATRSWMKAVIVLVEQLLQDIVSKFQAGQEQDQQERCFLRDAPSKELEPQCCRTQGTGRLRIHAHPESWMSIMTVASSDFDEYLDLEYERGSLGPIAKLMHDAGYWREQQLEDPCGANILPGQLGSEWPQATGMHCHQGAYPVTQCDP

SEQ ID NO: 962863 - protein, 289 aa, Homo sapiens
PRLECSGPVSPHGDLRLPGSGASPASDVLSIWDVQVHAYHTQSDLVFLVETWFRYFVQAALELLTSGYLFPHGIPKCWDYRRELPCLASVYFFLVCYSFFEMEFHSCHTGWSAVAPSQLTATSVLLGSSDSHASDLPSSWDYRCAPPRPANFTHPSKRQGYTTWSGRLGLRNSFTPQVISPTISLHIALRITELWDNRHLAPSSLFTQINSPALSTYNSSNNDHSFTQIISRLITKPQLGPHSIDALIHRTTYPARRVNPQHSTPALTPTPTTNKPETPALIPPPTRNA

SEQ ID NO: 962864 - protein, 137 aa, Homo sapiens
MVILGTKQENRAKLKSTLKMVHHSWMVHSRKDDVTKMATDLVPMAHSTFPTYWLGSPEYTKTSFYRVVVVFKEGAYYTSATHITHDTSTPRRLTPYYDDTTTTQTSQRRGGYYFKGDLVVVIRRSHPHQRWATRNIQ

SEQ ID NO: 962865 - protein, 175 aa, Homo sapiens
FPAGTESDPISRALHKIGACSKACTLATALARLDGRGLLVLVPTIQDDEELKTQVAMQPWVPAGAARHTPTLHAPVAVATTCAAEMAADCVRRSRIPKAPLLGQESGTPNRTLIASVFPAGPLAQRQLRHGRGPSKVNEGPWPLATGDRPERPCAFRTYTEVAVVFSQWNPGFLL

SEQ ID NO: 962866 - protein, 179 aa, Homo sapiens
LSVPTSRACRPSFAKQEEGPAGRNWRGEAPGGTYKKIGLGFKTPRGGYGGLTYIDKKCALHLVDVSTLEGRTPSLDVVTKMKMQRSMSSARDYLHLHPEVTTALGESATRSMSVQAVHPCLSGTARRSDDNRSQWADGAGPHEQDSAHSTCFKVHRRRAGTKKQYQKVLRRGASDRSPQ

SEQ ID NO: 962867 - protein, 267 aa, Homo sapiens
SVGWLCQVAVATRSLFAGQWPSRCLRSWLASPGSLGSPYFAAGGAGWLAAVSMGGGDNSLLVLGCWTCFHLGACGGSLWALLACCLRLADAATEIVERCGPASAWCHHLHGSPGGLPGLPDRLSCHGCCAAPRCCARERDVGPVLWPDGLLCQLRPCSHPEPHEVASLGKHVAPLSAAKRGVLLQQAPTSWWMSSGSHGCPVEGLIVGLRTHSIVPEAQSFLQTALGEKGGCQPMHACSCALPPSALGVRDGNHLLHPQLSLMNKFW

SEQ ID NO: 962868 - protein, 313 aa, Homo sapiens
RRRMMGVPSPKLSKSNGRLLCGTHRYDNGLCVPPEQVTTWRLLHTQGLDVACLMRMCPSTKKDGSCTSPNVAVVVHARLGGTAPPIMPVDRSVVQSANCYHVPRLLLSYSGPCSNCALMCTTTMSSRDDSVAMTAATTVLCKLHATYCVPADTVHELDDRTHGILQLDSSTTRSLRHTAPIAVQCPEPTEYIPHGPLHMTTTATFDIYCSAASAHALILINTTLLHCYHVPTSAMLHLRASTSIHDTASAQQLDGQAPTLPLQHFQMANETKGGRPLALTGPCGHHGTHTIPNTDRRARQRTYWPLARRLGAE

SEQ ID NO: 962869 - protein, 224 aa, Homo sapiens
MPDGPVQAVPPPPTRAHGAQTAHRRRSIFTRRIPAPSKPVVGIIYPPPEVQKYVDKTDSFVARNGPEFEARIRQNEINKPKFNFLNPKMTLTMPTTAQGQASSRKGTAQEPSAPYPKVMQAAARQTHQKELPQKGQAQVIQETIVPKEPPPGIEFIADPRIYLSPSHGNVVKLTGSVLWTRIGRQFMTQLLQYRAAQYQVDFLRPSTALFNKFRKLVGQAHQGS

SEQ ID NO: 962870 - protein, 267 aa, Homo sapiens
EKENADGQTETCTTYSKWDNIQELLGHPVEKPVVLLEGLPPQTTPTHWFHILALVFRRMILRSCRTTTSASVTLYGPPRPGRAPEKQRKLPLGTPAPMPLVSVELCINIRAQLGSLYHPVRLFYGLAWPVLKGCRDGSEVGLRLGCSAMELRGPDILLSIFGCWCQLGDTDCQEKHKVRALIPGPRSSSTNKGGRTRSTHVPMRHREDSGGTNRGPGGRTGNPRDYRTKRPALGAPHGRHDPYTGTRAQVYTVTGGKHRTNNHFRHR

SEQ ID NO: 962871 - protein, 103 aa, Homo sapiens
MGKGDDCCINDCRHGDASDSGIVDHDGPSGSINGGIDRRTIGKFEKEAAESGQRASILKYAMVSRINLELSDEPVVSPIRYLLWWKIGEPAKVLNVTYLLMPQ

SEQ ID NO: 962872 - protein, 32 aa, Homo sapiens
MLAIDLFLRRTSVAGTKKKNSFSRGLISIKID

SEQ ID NO: 962873 - protein, 346 aa, Homo sapiens
SSSQTCRLPRFLIIIAIKSPDTLCCTHTYSYCTAHTAPTVHADTCCMRHSCNTCFSCPLVTLHLDACKQSRWSATCQVHDKGHQSIFHQLDNYHELRLYHANLHNTTLSRTQKHTQRCPTAGLRYILGCARTASDTQLLQSNLSNALLYYCTSAPRTPTIAMHASSALHFPVVCLLCLPVPLDSPSEHCKDCDTTGQTHYVSSQDTFYTSTCSRRYSSDVLSQTTFRLGALHTSQPQHILAAQHSTTHDSSKSSIFSPNGLGSHFIAQLGYAPTSPLHPRLQLSPATSTCRTHLAHHTPLASSDSLASLALGQRNPLSRLNQTAKFRNLVQHIHQELKSRKERKSN

SEQ ID NO: 962874 - protein, 277 aa, Homo sapiens
LILLLSGALACSRPGLLPLHAGISTPPLSRPGRGEPRFIAVGYVDDTQFVRFDSRRLRVQMRWTPVWAACGVDAVMVAWRYLWTCGDTEVQAPGNRLTRSEPAEPAAATTNQMRWPVGLTPSSVMYGCDLVALTGASSAVYDQSAYDWQGLRSALIARTCAPGLPADTGWLMITQLQRGRLAREAVAVESLPGGHVRGVRIQQNTRDERERMTAAARGTPQKDKTVTNIPSLTVKATWRCWAWGYTLRNIKTDLAGEWEEQTQGQRSCGDQAEEMNR

SEQ ID NO: 962875 - protein, 101 aa, Homo sapiens
MVAALISAQPGGTTPHWGLDQTPFAARPLASARPQPASPLGRFGLGNNWVIEHRVQGGISNISFGTQGVLRRDIKYPVTPKSTRYPINARPFPKRHLTATT

SEQ ID NO: 962876 - protein, 364 aa, Homo sapiens
MACHGCPAWNGMVLKPLLPQWTWQLAAVATVCSTMPGPGMILHDCNVPCAMPMAAACNSASCCPCCLCVPIRGPFCAACPYCVLCTTTECVLLPVPAGFHALDVSSRRGLCISQRQVGPVTHLRIYLCASCRECCELMFHCEYPLHVPNLLAVLCLDTCMLPSSQNLQFHTLPPSESAHPCTSHMHTAHDMLPCLQRNRDTPCAQPHVLTLYDLQLPGSLETGRTTLTPDRQCRRSIQLATRTHTTFLRHGPIRITLLPASSATDDPKWPRGIYRCHTVRNTHDAQKGNAGYDTRHWSGPTRTPHFNRPLTLVDAPFAHITSYSGRLKLHNTIRNTHHKLTHPYDPHIQQPHTTHHRQTTPHKT

SEQ ID NO: 962877 - protein, 103 aa, Homo sapiens
GVVKTTPKSQNGNRTQTHINIVVIGHVRFGQVHHVLVHPDPITCAWPSTQQKPLDKHFDAQRGLHDERQQGLHINGTALAILRTHNPEQACTQLNSWVNTTPI

SEQ ID NO: 962878 - protein, 155 aa, Homo sapiens
ATLAPSKETKAYAELNARALAKQHCILNIPLIQTQLASFAYAGTCDDWQLLTSCSPQGHGKMQACAEDISAASTLAKLLIPAFTHRVSKAQIPSMILKRLPMNDKPGDYTTRMAPIATPSIARVPTNISYEYSINLRPKAQQVRRGIISNAKCGV

SEQ ID NO: 962879 - protein, 166 aa, Homo sapiens
CVPGLWHWNDPDMLLIGNFGLSLEQSRGPAWPMCDWCLACPPSCCPHDLRTISAQNMDILQNPLMIKINQDPLGIHVDCSDSQRNKSLIEVYMRTLSNNGYGLSLLQLQDRYALSLPTPPLAQAELHPGLVILSRPMDVYYGDITQCASDDETNFTVIINPSGVVD

SEQ ID NO: 962880 - protein, 211 aa, Homo sapiens
TSGGTQGCLSGQVIHARQEVRSRVTNMVSHQLSFQRERRYQLFGRGEQVTQVQRIVKRLCRDGSIRTVSVHMKESCLNRGVGCAFNFDGEVSSEERHQEQFGAHSMSGWDEILDSGVPHRIPRQARCNSFITQQGIERSASDKRRAVYRSPAEVTGQIGCAVEGIKYRRNELFLDVRGRAVNLVMSPQGQVLSAHVSGRVVMKSYLSGCLN

SEQ ID NO: 962881 - protein, 145 aa, Homo sapiens
MSTRAGYYCECANAVAPLLIVAMDGVGKTVNVAPPHQHRHRSDAPNRHKPPGYSYRYVPLPRDRNRYQNESNQDQAANCTAFFTGETAIEYRASGPSMFAQTSSRISVTLLRVLIAELHIAVIVTNAFYATKTLRTGVQFCIKYQ

SEQ ID NO: 962882 - protein, 326 aa, Homo sapiens
MISDGPGAPTSRPRLQHGAYSDVRPHTHHTALGKRACAPSTSRQPSYAIGPRGGSVCTQQLHHAVAAMQETACPGDAGIHARTRMDFISMARQPINTRDSQTHPDDQRRQVELHGAELTGFAQLTSDKRARSLEQAQNDRILAEPKLAAAQWAKATSRAWGTSYEDGDAGRLRTDSVDQITNDKSPTSTDGTQRQTRDEDTPGAYGQNMAGDRMLQTQRKAENTPADHTNQAVPKAITGTVMDAGRTGATEAKQNRHMRAKPPNREPPRRTAQKGNAGPSCGRYQDRPKVNTQEQKTEERETTTGRKRETPEEQPEKKTASKKNHK

SEQ ID NO: 962883 - protein, 75 aa, Homo sapiens
ADCLPGSGSRRRAEESLEELGPQRPFTAVGQSSGQVGGWVPGNPVSFYHRPSALSLELVELQEVLWSVGWDQLSR

SEQ ID NO: 962884 - protein, 456 aa, Homo sapiens
YQTTLAKPFTQIKYRRISKCTTVAQSASSVTATGQQHATDIHQPKPSIISQGTQRPHHLSASHAHSTQHTSHYEQGQQPKSLKHPAQHPARSSPSSNQHQHSSHTAVVIVSKHNNVGHSILHQSQQAAPTHSPAAYGCISMGWSHSISTSYQVPHVITHLSTQTSKPVLTNRPCVTNINQRSIQVSQKAAHTQHPIRNHIRAHNTPCGLSSQQVTHTHFQSERHQESQRALTTRKAPPEHSHDTGQLPQGIQTSRNVTLTNKVPQRRYYTRGHIHVRTNASKIWGRQNSISPATLTQAQPTYKWMKIIKGIQQCGKTTTLSSPPGTIKRTLGRHTHLQDTPQDNRGTTMINQGTPKVNTNHTSKHKTDRVIYNKTTHPPWIKSTQTQQGHVGVPHKRATRVTTAKRIKHGKPPRQQTHKHPEAEVENQKKNVKPQKKSNTENKKEDTRPDPKGQTK

SEQ ID NO: 962885 - protein, 193 aa, Homo sapiens
MEHIPLGRRKTTALQHMRRTWKSTHRARAILYTQETPQVRAVRTPSSLVATGRQIKGHICEEHIQPQVDIGRHSGAQQKQNKGAGATRTIGPNTSGGLHTPSTGPRPHHRCDTSITPRWMNRKNNPETTRRKETKKHSCRHQRTQDSHRQRTPDTQDIDGATTSEYTQQDETKTDHDTKRNDTYERTHQTNEH

SEQ ID NO: 962886 - protein, 365 aa, Homo sapiens
MTGFHTCLPGWSRSPDLLILPASCLPNVLGLQAVSHLCPAWYILKPSDLVTWCAVGTDENTGTWAMKHVPATNETSARRNWLVSGACDVTAMLCVGFKENIRYGATNGTVTKKPSSLRKKETFGRRETPVQCAVTEKPPAPRSGKRANGNAGCCDHEPGTGRTWDGEWDTRSEHRAHRSCRPTSAATRKTDLASAANEVRVPNQMTGAQEQTLGAGPAQCENLAAPRTTSDAAHDGANQDEEAKHTARTMGANSGAAGTKPQGPDNTQEGKTKDTGPETDGEPSTGTLSGTCVHNWLLVHNNSNLPTTTTLPAVCSLLLNTTKVWPTSPHTSRSEAAKNIANNSHPVTRHTNRTHDNTDEPYTPP

SEQ ID NO: 962887 - protein, 229 aa, Homo sapiens
RESDGEDGCLAVAASWPVWCPVWCHAHLCVLDVDGMHKTCDGLREEGVTRMEEEWLMDGQLACACPVDGATPLSYPSPGPQPPGPSWTATFDPVPTDAPDSPRCLRVDVKMLAHLGLQPHMGAPHVLPQGLPTQSLASPPCPVTALQCSVSHVTPRTPPTCTSCEMPHEWQPNVTGGPQPLAMALVKHRGPSGHLPRDPVLPQLLGQCTRDPLALSQLRGPQTHTEHRM

SEQ ID NO: 962888 - protein, 185 aa, Homo sapiens
QTADGSHCAVSDGEMQEHYDEFVEEVFTEMEEKYGEVEEMNVCDNSWESTLVGNVYVKFLSVRKYAGEIGCDFDLNKPVGLMDSRVHGRAVTRDGLSEKPAAVSMRWENAHEAASANFMHLDMPSFPEELRRATLMAAVAGGVDQDPDPGSVVARSRDRGRGWWLVAGGGGGGGRERDEEAVERS

SEQ ID NO: 962889 - protein, 82 aa, Homo sapiens
GAMDARPCVARGRWAGVVLPTALTWRPVVARLPGARLVTAEWVLVPWPPNWGCCTGACSWVGLLSPLPWDSEQPRPLCLPVA

SEQ ID NO: 962890 - protein, 342 aa, Homo sapiens
MTACVLRVVCALVVPVCVPCVMGNLLCVHSCCDVFLCMCASCVAWGLLACVTVCACVCLMCLLCCICCDVQWPEDNVSWMPYTNVWCLLVSMDMKINVPGCEIYLFSLPLMESEIIDFFLGASLKDEVSKIMPVQKQSRAWQRTRFKAFVCYLGTTMATSVWVLSAPMAVLATPSCGGHHPGQALHRPRAAEATGGTRIGKPHTVPCKGDRPLPALCWYGSSLAPRGTGIGLRTCAYRKLLMMAGIDCLATPQARGCLATLATSAKCPFDAISKTYMYLAPDSGTGSVEFSNCFRIREVTGELGKNPSKSLRTGTSGPNVAKHRVYSVTSVTIVNKQVAPES

SEQ ID NO: 962891 - protein, 179 aa, Homo sapiens
MSGLKRVSGLEPSVEVDVGDLRAVPSSGRGQTDSRSSTGRGKGPWDKRFMEHVFQRDVKDRGPEGDYVHGIRTFGGETDYGSSIQSVFVRRGFRLGATQQSKRHPRGYDMKREEGTGRTACLQIGRSMCVEISLKTFVREIPGAGTYGVWNMNEKCDKEIKVSYTVYKRLSWLLKSRIT

SEQ ID NO: 962892 - protein, 165 aa, Homo sapiens
PAPETQPRSHIHAHRALVRLFSGSHVRAYRRAPMPIAIPPAAMSTRSVSSSSYRRMFGGPGTAMPVRVSSRSYVTTVHPAPYMPLGQRACSPAATHAGQASYASVPASGVVCHALHLPVRLRSIVARGAVLQDFGGTSRLADAINTEFNESPGPHEPVELPGSWL

SEQ ID NO: 962893 - protein, 528 aa, Homo sapiens
KNTWVYCGDKEHGLKKLQVGKNSGRDTQQRYFTGYVIQGGPGPFRHTPHRQKGTHVGSGPLRGYDLYKNTRVWPQAPAGVATSSRGRRCVCPRGRGRKSARYRGDTKLLSRGGELSNERVRGSWACGQKWRGCSAHKASGVAPHRVDTRWALPKDREKAWVLVGHDSPSQATRSTCRGTISRGAYLSRVGRGGHLLCGPKAFGAQFRAVGPPFPEASRLPSVGGPLGGTQGAPDKQDWEYTHWGANNRRRDTAWENRATWASQLPFSSKYPYARGDKGGGGFGPPVRRGHEVGGALTLSGAVENKRREKLTVEPADYEGRADEQRRYNHGLEMDTLMCGEGAQVGVSPNRRTCGGCAPGKQVGGPPTEKTTRLLREQWPLGTPSHIKERGGAPLPLTWAHGGGVYQQTPYHREGLGDHRRKCVRRGATKAIQRKRVLKARVVGPHEVHQRIMLTPRAPVRPEEKKQPPPGGRDRTDRTSDRDTNRQRRPHHKQRGSTAEESWQREQPELNNQPRTTNGRQHTTNESEL

SEQ ID NO: 962894 - protein, 297 aa, Homo sapiens
WRNCCSGWAGVLSDGGLDSCLSWLAELGMEHQAVCGRREEPSGCWARSSRLNFGPPSTGELTCCECAEGGLPWDGHAMMALCVSEAFPHDVAWPRAELMRLPSGKCGLQQWPCPTSGFGWTRVLADGPRVFLSGGQHGGMSVQRLAPAGPVLGDMELRSLGETGEERAEEEETLLAEVNSEDLLVGAKASAFSTSICKQETELSPEMISSGSWRDLALSMALHTFLAHGVSLIGPLQPCSRSAPQFRQIFLALGVPPRCRCYFIGSLSDLTPLPARAPRRDRTTLFLDSAEAGSRVC

SEQ ID NO: 962895 - protein, 109 aa, Homo sapiens
MIADWGRVASSMGYCLDRHYNAGGNGAVQTESTCQELHTPIDVRDVNDTMEGRALMSEDAHSRIFRPVRTRWYSKPLMRYCSMMVETCSYTRSDTDVVRDVILNRKRTK

SEQ ID NO: 962896 - protein, 207 aa, Homo sapiens
YCLVHAGGPWCALVALGMGKPGGVLPACVFLAVAILGPGGLLGCVTVLPGGPKCLLELAEAMAVDNVMWMPVTKFGACLGQGHEDQCALEEIYLFSLPINGIRDHLISSCVVPLSRMRFSRHLVAIGDYNWPRGLGVKCSKEVAPHPVWAIILAKLSIVPCAQRLLWGTRSGKPQLSLAKVDQGLCVSVLVRLIPAPSGTGIVSDLC

SEQ ID NO: 962897 - protein, 265 aa, Homo sapiens
MAWSSNMNDLVSEYQQYQDATAEEEGEFEDEAGDGEWTYKPFSHLSGKMQGTRRVKLCYSLTMPCRCVPCPTGVHHCLVFPVHISWLYATPPVKDIFIVKPQKEEKPGGARSLGMSSLGWGARASHRYPPRLLPLWSLPCWSRLSLARVLAALNLRTPQVLGARQVVTTPRPPRWRQRPCDVRRVRACSRGSNASPVSCSWRRWTFRWERHYAYSKLLLACTRCRFTLVTSVQWCSKYPGVSRRIAKVLGYRRTVFGLFVGALSV

SEQ ID NO: 962898 - protein, 54 aa, Homo sapiens
MYIHTPEEIGRPRSDEDVPQRSEVAQQPPRAEENHTRDERRPHTNIQFHICPPT

SEQ ID NO: 962899 - protein, 68 aa, Homo sapiens
EFHIVITDYGQEEQKLYVMASVIMSDYSFLAEAVFYPLSLATIDVKYIGVNIRPMSVYDVQQRRYNYI

SEQ ID NO: 962900 - protein, 429 aa, Homo sapiens
PPEQQRLIFAGKNSVEDGRTHVMTTTSRKSPPCDLVLRLRGVECKLSRVHDPVYMAKTHQPSDASEPQVSSASTNCQKANRSKGTRQGPRAQFAFPWSDEAPSAVLRPSVLEATEAAQTQAYGGTGTRGDSTTRNRYTWPRFNENSVPPDRQPPASVPCDAPVARDPEAARPCAEPPSPKGRRASQHHVGEPDHSYLAGAEDPQRTAAVSKHMGGKHSAKPNKRADTQSHQPDLETKGAHDKGCEAKRANIQPHAPKGNPKRGPPKTRKHHANEGDPSKSQDNKQRDQKISTPVADHRTHRPQSDEHQTHRHTRAHTPQSHTVHTGPQRRTHTQGTTRWPHHEPNNMCGRQHGTNTHREKGDNAVGKRNQHPDNHEDTTTNRHKEQGQHATAKARHRHTGQQQTRHWNTHNKQRRTREDRNTTPRARGN

SEQ ID NO: 962901 - protein, 106 aa, Homo sapiens
GDAHAKRNPTCGGTNAKTKTPNMPRKTYRSHITTRTSSDTYNGPTAHGYPRTGPITNSGPYGTKIEKRDATRNVNDRELITAQPPWKTHNILRALTNTYQPATTVC

SEQ ID NO: 962902 - protein, 348 aa, Homo sapiens
QAELKALRCPQPHQEARPAEAGKGGGEPAGAEAAVVRMADNEVMDAFRKIMAALAASKLDPTNANATRHPVPRKTPDRSVSSILQAAGMGTPSRPASVLDYLGPSGEWEWDGHTSFYLEHRDNTWALVVASSHTNLCVHVILRRGRLSPYHHLMCTIILGTKPYLVYHNTMWTKHWAQGHPLVIEVTFNDTLDEPQYRSSLAYWQFPPWIELGRGEAAWEMNHNPGSINLRRSIIHIHICTPINLITHNYTGPKTDSPVAMRPTNKLPTNETDTDPYDHKKENNINQTPPTRPAPHSRGPHTTGQQTHTKANTYDNRRTRGAKDAELPTKRQNNTDDKQNTDPHRTRR

SEQ ID NO: 962903 - protein, 577 aa, Homo sapiens
QVPCPQDKGLPLCVLPAKTSWCSSTSPEPKCASAVSEHHALNVWHGAPTVRTCHCGRSCASCPSACATFAVNLLHAVPCPCAPPLCHHCMRCTPLLRCCVLTACVPHPYLPPISHGGALATDTTHSSANAPPQAAHRGLPFGPRVGHLSQHLTRPQATWTQTPYHHGAPTHHRKPKNRAPTYQPAEYQKRHPHTGTRPHPDQAAAPPGGARHNCNPKHQHAYPFGATATPLAPHIGPPDNTGHKRPTHHSQRFRISRQTRQLAAGSTTPCAIARRRTRTHSPRDRRHHNQLSDAPDVPPTPPAATHPSGQDIAPRRRCALPLHLGNNRPRRHGRPQAGDSVWPTTTMRGDSSTPPTRPPPAAAPHGPPVGLTRPPTDTTTTARRDAPTRHPAQTAGPPPHSKPMAAPHTVATSPWCRPHAPALGPAGGHQRAQGVTLRKHTRPGSTAPPCTPQRPQLCRAPPTRTRKPGPPPAPPRHLRPPTYRESRPTRHPPAPPQGPTARTHAAMPLGGKPPTGPPSHTRATTAHRPHHAHITTHTQHWDPRDAHTAPPRRPTLSRTRTNQRRPPPPDDSPTPPP

SEQ ID NO: 962904 - protein, 176 aa, Homo sapiens
WRFSNGNSQTMIPLQVQGNIANQIVVPKRTADEDNNTSITEANSSVPASSRSDRTVIVIFTSVVTEECGPVSSDISSCLINHTNKKILLVQIHSLRTEASPVKRHDYLRIRKVRGNHVDLNRRVDVGASSAKPNWSCVHAGIGIVSLRFVYCMLHRLPEHETAHSTHGPVAGRKPS

SEQ ID NO: 962905 - protein, 153 aa, Homo sapiens
SFGPHRKKSLSSQKPQINFSISGFWHSMSPVSHMFIIWALFILNLHSTLPLVTTSCIICTLHAQHIQSHIVQSYFSTSQPNIYATSSSSSHQQHSTQQHIPAHHFIFLYHYTSLTLTHISSHIYRQFSAFVPASHPITTIAPQLIMGIINTRA

SEQ ID NO: 962906 - protein, 245 aa, Homo sapiens
MPYQYPCTDPWSRRMACCLDIAHLPLWHLCTGAILCCMMSPLGAFANAALQLHMAPEQHPSENRRFYLPCCSLTRCLTCDEPLPSARLYILLPLTTTHTSKRGMTGRSHSPKLYHITPTRAALAAHSRLTHNGRGSHTEQRDHTARTTYHPHRRSATAAAPDADQLRPSPHQRDLAALHRLAPPAGRTVARPAPHSARPPTTHPLPAPPPPNITCAHHMPNPAPARRLMPHSALPCPQDRQLRPL

SEQ ID NO: 962907 - protein, 235 aa, Homo sapiens
HPIPPHTHRRHGGTTATPTYLPFYTNNRCIKKRKKKKKNKTKKKKNKKQTTKQNKKEGPRARAPTNRSLPPTRGRAPQKTLPRRAPRHHTTPKRLIIDGRGHATTHDGGPPGRQPPPYQAEEATEGRRRKASTHYPLNRHHRPTHRKRGARPGPARPGPAPAPRPRQPPTHAPRMHPSAAHNTTPQPRTTPKPGHAHHTPRPRPTGRPRRDRGRAPRHDNHTRRTAGRARRPRPP

SEQ ID NO: 962908 - protein, 317 aa, Homo sapiens
MGVTIYRRTSVCPRCRRWAPVRCAVSMDEYPSDGDYPCKDHSLIRYPDMRRFTARIGCVVSCQHVSPREWGVMSCRVMRIVGCRLIAAAVVGTGRHGHPLNRSALLSEWGLPVISLFGHVRLSRPVRCWSSRVGAGFRASLQAAPFMLTWEGGVLSYGENVHFSLCLAGMRECSVLCGVRRYGYLLRGDLRCSALTAAPLSRWVLDVPFGSVTPEGCACGLRVRAVCGLVAEPMGVLSLLNDRSPPADSLRSDGRSVLHSAVGSGRRHESVLPVDHERNDVVEGKCQVGRGLAQQACPRRNTAGGNRLFENAGNSYR

SEQ ID NO: 962909 - protein, 46 aa, Homo sapiens
MIDRHVVKRARYWIQSTLDERDNPTKHNPHKHIRQHRGTTNTIVQR

SEQ ID NO: 962910 - protein, 490 aa, Homo sapiens
VGQMSKSESVYCLFHPDPGTTDTWALYSHTTSDPRRSQGSSLLQGYPEHPDYQGPRADTEIRWSHSCENIPNRLDTRSDRARYEQLDDTKPRHTVDGTTAGWRLNETSALDTADLSAMMPSLICTSEKIIIMTLTDALTQYLTTLLHRHGLATAPHTHNTTDTTIKHHLNHGITTAQIYRAHPTRNHPTATLSSWGTAPVTGTNTTNDMETNINTQTNDTHTNPKSRTTGHNLRCVTPRTLNSHQRRHTHQHKNNKGTKTTYTTGETHTITNTQQRHTLLTTNTHQYKKENVPGPMISRQNKNMRKQGSDPHISSRHIYEARNDEQAQHQAPKDNKIKGPHHTPPDHSETTRTTPPPQERSHGDSPPPPDGTTNRQTTHHDNTHITTTQASARRPKTQYTVHTKPTWRHPNTKANRHSGATATTSKQQQEAKDRRTHDTPRDTTKNTHTGTPHMTGETHANHSPHHTRKHKQENKTKEETPPTANTTEQT

SEQ ID NO: 962911 - protein, 285 aa, Homo sapiens
AGACSGRMHVTETLGVASVPSQWSGLSSGIRGETTKLPDVQHCHCQCILPVPGIIVDCPMCARLDVPPCACPAVAVHPQFQSGHNPVLLRAISIGEMWSAMVDPESFERRIWQSRRVLIGFECELGPSQQRMVSCRCIPCGYPARPMAALGLAVLMRASPWNLRLGSCGCGLVPVRGRGWAPTGDLDARLKVLPVCAWNLGRGRRPLRSTGMTYETVVECPEELALCLSVSNQCKPPMWMMEWMQRLGQQGYVVLVVTGRNVSRKGKDKQMREEDSLKDECIRQP

SEQ ID NO: 962912 - protein, 511 aa, Homo sapiens
GPAALLALLCVACSAVRLWRAQYELLQLPAASHWDRADAALMSGLPGIAAGQVHASEHWCRELWATWQITPAAAPLAAATCEAFCHLQLHAPLPEAPSPACRASPGISTMLAPSFGGPACCPARNLPSMLLAMLVAFAMAVSGPGPPDPKPDEWFALSRGHIHKADPLKPPEQRFPLARYTGIKRVQCGRTLDSPPKMEAPYSGLSVWAYQASPEFHVSFGKQPFRLDTSDTVGLSNTEREEPSWAQLHIIKERRGLFVHFRDEARDGATNALFNNGQPHVVTTRQHGFHYVLQKQGPCAITYPGCATCSVRRCPNLQKCGVVLCKPVGQGNHTFRYSKQGNTIVHRPHARNQYHDPGRIFSSKTRSHNFINTRQGLEHYSTRAHIGARKGRVTPHAPKDDTTGVTHSHTEQHIVSHTTYPHNCKQAVQSILLHETVLLATVRQQYHELEQKRNHTHQGYYHEAEKPEVETYYFARPDVRSKKAQKTTQYDKSSRQQSKDKKPLDLRRQTH

SEQ ID NO: 962913 - protein, 135 aa, Homo sapiens
EADGERRERSALSFPRSAGRPPWGESFGRGGKAELEDMPAPTSQGCAFLRARSGAGMEGRKGVPLGPPPEVAFLVTLCLGVWFCYSVSSPLCYPVTITSLPRGRPGTHACSDDPPEEDLITVYSGGLLVHPHASF

SEQ ID NO: 962914 - protein, 151 aa, Homo sapiens
MSAYRKRTRKERTAHSHQNTDKANALTVTSDTVDKIQWDRSSKATNEQLEKRKHMRKGTTTQTYEDAQITNKRQHNKKKYTKQYNRKNNQDKHDNHTTKLTTPEQHTTTPTPEKSKHTPLGLHPSHNRNERDRHDTREHTHTTKNTTNTSH

SEQ ID NO: 962915 - protein, 261 aa, Homo sapiens
MSPVDTFFNLGKLLPMCFPCAPLSPPWGLLRGRVGVGGRRFFFYPGLLGRDTKLVSGWLPFPPVFFLRPFTGPLPWPGSWSKPGSYRPSAHPLFLRGCPVAAFQNWPWVNSYCGFPFCGVCIVPWFGRCSITLGRELHMVAPEKNFSQISQIPQAGHPTVVKLSPLSPPGGDTLHDNHWEIRGGGDTQAGLLTAVLFSPTLRFCGLSRWVHIVSPSHIVWPFFCPPVYYFVAHARHVVSVSIRGAYTGCAGVVSVLHFRAQ

SEQ ID NO: 962916 - protein, 69 aa, Homo sapiens
YEDISSSRTNPYSLCNEYLNKPEFLTYQYVAINFLSASELARAGFYYIGPCEIRIALLCRVGWDSLRVS

SEQ ID NO: 962917 - protein, 396 aa, Homo sapiens
LLPACFWDPDWCLRLLSACLTTQACAVPPTMHALMVFLQPDFHKQMNGTDACQQENIPHRQSCPLDEVILSVYARMCGQWNDCVTMAVEVPALWPAFQAGAHLWTPHGLHHTSGPGLLEPAIVPDLDLSSGTCDHTKAVPCEHTWTIGQALMSYSTNLGWILRHRYLQTALLSIIARLVLDNVATATQPSPFDRMTSISIHTAMNLVRTSVQGKIIPVADISRILDAMHWNAGPKTFRQPGKPAACRLDTASLDPRTTTSTSTLLWPNLTHNGRLDYTPLVVPHTLAATGTQRHPQTLRTPQQMHSPRTHYRTTRHTPRHTHTATLAPATNPTTSRAPNYTPQPTTPINTRPHQGQRQPSTTTPMQTRTQQTPNSTTPPTHPHNNPKHPKQTPHKP

SEQ ID NO: 962918 - protein, 295 aa, Homo sapiens
MKEPSLRMLWCYRQEREWLPAQSWSCSWEQAGPVHGFRGEDIVWNVSVQPQTTPIMVAAGILCGLAYAMAHTGVSSSSLALLACAFALLSVLLHPPPCLTLCWYCMCIRAYEQLVDRGHSGPAGEGMWWPHVICLHNVGCHVQFTCSSSNLSPPGYRHFPVHLTTDGGLVLEWETPQIIIRQCVNHHCPSPLIENTWATPGGYHLVDLVLVSIAMHVVTWTNGQILKQKVQTLGWTHTGKGERPSTDDVKAPEDISQARRKKEGEEDQLYQGRHTDATQGARNGRREGGHQIGCQ

SEQ ID NO: 962919 - protein, 31 aa, Homo sapiens
AQFPASHPHQRRNKTALEENRRERTFVNCSC

SEQ ID NO: 962920 - protein, 90 aa, Homo sapiens
WAGSTLPSLEAHSSQRVARTDVISAEAYTINLLAIIPVLPKRNKPSIHRSSHEVFPSCKATCNPDNPFVIGYPLHAMIHLREHLNGINAN

SEQ ID NO: 962921 - protein, 246 aa, Homo sapiens
VRSPSPVRPVLTACWRPPPTAAMDAIKKKMQMLKLDKENAIDRAEQAEADKKQCWGPLQAAVMEEHAGPPEEAEGDRGGVWKSILESVKEAQEKLEQAEKKATDAEADVASLNLRIQLVDGRTLVTWCPVKRLCYMPCRSLDVSATESAADESDERTGMVIENRGHEWMICDTMRTARKMHAERGQAHRLRIQTATYEPGGYGNPVILEGELEPHGGQDLAWPTTKCADQRGRHDNSDQPNMTSPG

SEQ ID NO: 962922 - protein, 250 aa, Homo sapiens
AGKQETPVPEQLGMNDLSPDDVGHFSAMRVLSLGVLHSSGLLNGLDLCHWCTHAMQLLKHHVAWRELPCSVCTGDPMLSSSSLTFHFCLFHSTAAAQGSQIAVCLNPSFCPCPNCEPHAKPLVVGRADGHCVCRVWLVPRPNHRWVPSCRLHIQASTLPKHTHDPWLFKETITRGNWVTVVTSQSKHCRPKPGMYPQRQDNTTEHRLSNHCELPLATVLPQGQAQDRDPSGAKSDNVNPGKSRRTGRNTT

SEQ ID NO: 962923 - protein, 149 aa, Homo sapiens
GDVVLGGSRVVEHGLRTPIARRAVTALVLDSSRCPALAACFYAPSTLSIISKRPGLSVLTMPSLWDRFSSSVHLLFALVLAPNSHPRSGLPALSLWGLADPGRRGYDLLHEPGEIWELQSTLDSSNSGIRAVTRQDNWSYHGMVVSVLA

SEQ ID NO: 962924 - protein, 133 aa, Homo sapiens
MPRRKTIDEWLTSLRFSCRGSRPCRWPEAEQLLGPQLGGVWNEDLDGMEGYVLEGKKFARLPEEGVGHFYTQDCYVFPLQDWVPVEYRGRSANRRHDPGVRQAMGKEGEDSTLRQKEQAARGGLQCLGTLAGP

SEQ ID NO: 962925 - protein, 368 aa, Homo sapiens
MAPSRNGMVLKPHFHKDLACCAAVATVVQPGLALEGLLHDCKVPWQCQWLLPDICVLCRLCRGPNTRATSVADLTPTDYCVTHTECVAAALACRDYHVLVTDAQGVRPVTFHKEMVGPGTITDISCVIPEECGNKSREYPCMAKRSSRAGMDVPGPKHYIPHSPSEAPRDPRRTVQTRYLACKKHEHMDHHQLDLDAVTCPSGNVLIKKEKARVTHLTDRDEFSTPSTSHPYVPRCKRPGSYRNTGATHDAKERPDTTRHGPNKEQNYNATPVGTLEISKRNNSEGATAPKDSHREGTKINEYPRLLDQGCAHNLSGRSKSTKDKRQVPERIKTVSYAVVNPSSACDIICGKNTLIRLRGHLGTTPKQ

SEQ ID NO: 962926 - protein, 188 aa, Homo sapiens
FDPLSSTGQPEVPGALTCALRLTQQMFDAKNMMAACDPANMAATCLVCLTCSGCLHVHEGRWMSKCLMSKTKTAAIYVEWIPNNVNMAVCDIPPRGAKNVRHLHLCNMQQDIHGDCTSSISEQFTAMFLVQAFRALVHRAEGMERDESSPEAESNLTGPGVLSTRQYQDATDDGGGRRSQAGGLRHGR

SEQ ID NO: 962927 - protein, 274 aa, Homo sapiens
RLSPESMSFITRSTFSTSYRSLGSVQAPSYSARAGQKRGSVLCRRMGALVARDLLLSRSPPASVVRVYGVSGGVPGPSLWYSPGGSVQGMGGIQNEKETMQIVRESTPPVHYLTWNKSERAVDDREPGGCRAKSGSTWHEEREPQVIDMEPLASGSSTDLRAQTLRQYCGPTAPHRTAGLTMPRHWLLMDLYESSFDDRAGQCSRDRVDETDDPVGLRLEVHLLTTKCSLQTCCWETTRIEGSSGAGLLFMKIETPIEGSRMGCNARIAQLWGD

SEQ ID NO: 962928 - protein, 359 aa, Homo sapiens
RCPVPADDFLDAAAWTPCNAIGIANFAEQIGVVWMFTSVPGEYIYMHIWRTVCQSKTDVLTTLYPLAASLADPYIQHVERPRTVALAQYLMDLFHMPLPLTLMASNVRTLLNPAHQRLRTDPRPACLAVAGAACTSSDMALTSTAISCQHCQACTGQEPQNTLASYRTYTLARQRALTLVLHKALLYRTPQAYKHTEETPQRPPDEPRARTEPPLDPREPGPPTRLAAPQGPMELPNTNPGPPQPEAHKRLNRGRRRAPRRTKSDKPPGLTLALDSTNRTPRLDTSRHIPYVVLHHERTTADRCTLHAPPVRFARPGSRRQKSRGSTHNVRAPPGVDNKGPSISANRREDKRDDPNRAN

SEQ ID NO: 962929 - protein, 234 aa, Homo sapiens
MQSRFTQIPRAKTGRRSWSRVDLTVLHWTAYAFSVHPTQNSLVTLHFGKGGLVSLSPPPGKLRNKPMRQTTNAANNVPLYTGVVRNGRNRPPGLLIRWHAVDKAKPTLPPAAPRRPKRDDLNLGHAGPPDEEGTFCTGTILSPQRREPCSPTTLAKSPPNHSGFPVLAATIPLLGYTILSFLNTSYPHCWGHQQPPGRLVLHSHNVLCLLGLPYAQQTRDAYQYLWQSPIDGLV

SEQ ID NO: 962930 - protein, 157 aa, Homo sapiens
MENEVVCTVGNGILVGDASKDELVNQVQQVNQHICRIKDGDCGFCTGVFQTQMQAIRRGHDWTNSCNSMAMIVAVANQRLSDIEYEGAVKEERSGSSEDDKRDWFTSGQIAAFGKTVQTMFLATLLGLDGQLCVTAEFPGLVSPGNGSPQNWEAGKN

SEQ ID NO: 962931 - protein, 128 aa, Homo sapiens
RELRTLNHPESGLNPVVSHLMFVPTLNLQRTVKIYSRSKYEYRIALYKTTQVPILTILRSWTIMTTFGLHDYITELYALNSKTYMHTHFVPFSIPWVVHVIKQNPTIHYGLKTLTDVGKESVDGCIVS

SEQ ID NO: 962932 - protein, 172 aa, Homo sapiens
RRFSREPWAGRAGSRHVSRARGSAPGLGLEAPAPWIRRPWSAESVSSLTIADAFPNFLAGLAEELQLQSPAAPRASQEVHHCFHIALDLQRQLQPKPGKLDAHLCKHTGERPFVCDYEGCGKAFIRDYHLSLHILTHTGEKPLYVQPMAVINNSDTKKNSKPWKKHLGTAKT

SEQ ID NO: 962933 - protein, 217 aa, Homo sapiens
CLCLFNARGSDAEGWKMAELQMLLEEEIPSGKRALIESYQNLTRVADYCENNYIQATDKRKALAGDTEKHYTTQSLASVAYQINALANKYSSCWISKPLSFGDWTLFHYETPIIPSNKGNLGWRNLIVPIYNAEAPHVGHAREIGISTNNIRIHQELTQIIAPANMERPVRYIRKPIDYTVLDDVGHGVKHGHNSLQRTGTLSENKSSYSETGKGSS

SEQ ID NO: 962934 - protein, 189 aa, Homo sapiens
EETCGHPPWCPGDAALVMEQEESPPEEDTERTQINVLAVQAITSLVLSAMTVPVAGNPAVAVGAAAPEQASESSRHQVGRKLSIIRGIGGRKRFNATGSQTDDQYSPPITYYTHLRIPAPFSVSGYYTLPSSATEAAATRLNPDRRAAAPELPHSATVSIPSACLPPPPPPSAAPAPAPAAPPPRLRPP

SEQ ID NO: 962935 - protein, 66 aa, Homo sapiens
MVLRTGRFNSTRRLCAITWLPTEMIDDCDSELIHLTDLYAALIETNVPTSLPRRTYRYRNTRPLNT

SEQ ID NO: 962936 - protein, 246 aa, Homo sapiens
GISEARRDAQEERTNWRSNYFLKIIQLLDDYPNRLHGVEQYEVGSKVMPQIRMSLRVKVCGCCWGEDSIMMRNVIRGAPGKEQPELWKKAAGLICGGMWGLVFTKEDLTVRIRDVLLAMLGASCWCDAGASCRSAEGHWWPVQEALVSGPEEELRINQALGEFTNRIHPGGTHLRSPEVMCCVVVTCETKLGASEATLLNMLQILPFFLGLVIEQVFEMGASTGPEGVAITEEIPGCIVLLEGVRS

SEQ ID NO: 962937 - protein, 77 aa, Homo sapiens
RDQYLYQIRRRPQIHNGKEVNDCRTFSWWSVSATGATLAVMLGSDSRRELVSREDEQQLLGWYLRALRRLLRKEEVD

SEQ ID NO: 962938 - protein, 448 aa, Homo sapiens
MAIWSAFTLPCTIHEEFQLLTPLKLVCSLFTSRQEEIVYMAGFPVCRCKGLHLVNSGTSIGHSLSCIMHGHDSHNRVPQCMHQCTNPVTFSHTFSYKQQSKCYINHQSSSRCALSFRQHKRKQPFGDNFATSLRLIASHHLGAISGLQLHANIASLQIMPLCFHNPTFPTITKPSPVSSSRTNASQTARISRFHMEVREMSTDLSLYRPGSVDKAFILHYLVNWGHPYRQSFTSASYPTSFPVSNSFPKVSLDGSITYIFLDGTTPEALGTSHRSTVSTPIVIPTIHHPYHNYPQKFPHGYYFKTAHIFHKPFSVMHPALYNLGPNWGVPTPTFFTPWDYTPYVANPLLHNPTRNFFFVSTRTLGLSYRNMHRCSPHRRNTAALPHAPEQPLQPYSPPSGTTEHAYDKDPYTTHNRQPSHPPGHLRQQHAHSAPKRSATNTHYRHTRA

SEQ ID NO: 962939 - protein, 372 aa, Homo sapiens
MYPMPVFCYMFDVTCANCFEQPESQPTIWHQLVLLLLGPSSTHIHVLCTMLFVTMSVAISSSTFHVIGSIIAHADNHPSACAHLRPRFLCTHTFVPFFRLHLPPHSLTSAQALQQFLAFTMSWANTCPLGRGVILVAPWPKHTFPNAGTPHPLAHLLCCPWLESSKTGASCAPHFWFADFGPFSTYGPRPLGCGFWARPTPVGVTTSIATAPGLNAIAPAQCNLAAGRPPEDYLRLPFCARGNPLAQPSLALPSPWRLSKAKSTRFHSHLLNGIWQFPTSEHSPGGLTNPLEGRGPPQLSDFLVRPHPTTPRAQSLLTPPKSNRTASKAELHGHSNSNFPTPLELKWVCHMAHFPITPFGAMEQLTFIAAYP

SEQ ID NO: 962940 - protein, 139 aa, Homo sapiens
MVHVYVKDDLLGHLNEYLYREQDFTLIFHTMGWKLPEAAPGLWAPYHLPVGRNLIEPEQCTFCFSGFSASDIVPFGTRRRDVQSPGGGALDGPRVHERAVGWCTGCRADGSNPSGFHPPGGAPDPLIGHGGGPGCWPNG

SEQ ID NO: 962941 - protein, 189 aa, Homo sapiens
RREEQDLWVQRPGTVENPDRQPCGGTWSNSTPRLGVFVRLLCDVRIGGAQCSASMECAWIFGPTYREELSVTCDLVGICCCSVCLTLGPGGQTACVSCLGDYAVPKEPVTHVVACCGMVGLALSFYGLHSLTCPNLAIAAHNNTLNPAPSVRVHLYLPCCNKLHHVPGWTNTRQGHYVAPKVFPFSREE

SEQ ID NO: 962942 - protein, 349 aa, Homo sapiens
MVHKAAKTTQNIRYTFGPGTANKTYRCSGGIKKFGKEESLEDEERDYGPWEVDKDQWRAIIELHEKLQKNSALTILRSLGSVQHSKQIGKVKKLDKWVPHELSGNQNYRLKCSLLLCYATTNHYSIGCDMYMKSEFNTKTVQWLDQRQSKAVTKANLHRKKVMVTGSGDLQAQSDTITVTDILVNTITSETVMAPAMVKMHPKLGITGGLHCATHSATLSTNRNKQVRDVATTTGPTTRNRQRGTKRLETTTNKDKTTENRVAKRKNRGTRRREQTRREYHHNERNKTVTDTDTMQTANRPDNETSIIKLHNHTEQQTDRQHKTNKSPNENKENTQRRIRLKSHSSTDS

SEQ ID NO: 962943 - protein, 264 aa, Homo sapiens
GLWRAREEHCRSQDDGAQPWVCHAAHRGCALRTWFGVGLLGRDLFMTRTLCSPGPSHALERKDLSECGPVCAAPPAPSTWEEPWWAQCIHATDANSTCQDLVCDRYERVCLDSPGGSRGPCGNGDRVLRKCSLVCSEVLVPRGSGATCEVHQAKLKDGDVDLLDRVSREDSQYLELATSRAQDAADGGRGFATSLICVQTTLSERKFSLLLCKPVRESHEKGAHKGLDEGRKQLVPRLGQHWGALIWVWMDQHYGEPVVRVTGG

SEQ ID NO: 962944 - protein, 113 aa, Homo sapiens
MSLLGGTSISRHSLISSPTMPRRNNTIAVHYSYSHNPQHPLPLSQYVPMAILVLADCEAAVGRSRVLISESSRRTYGLDVRYKPKPTPMLRVSRPQASYIDVPRDDDLSRKNT

SEQ ID NO: 962945 - protein, 256 aa, Homo sapiens
VLGVAEGKSWKLPSESWNVCRKGAAGEGGWRDIIARLREDLGSKNCDTVKAEESSRDFKMCDQGHVPLPDCCTVTDEGTVLGLTAVARGKPMELIIGKECSMLPVWETICVHHAEKWEIAQFLCDIKHVVLVPRWWTRVSATSRCGNGPPVMGHAGTAAGVAQMREQQLPGHADLDALKQNPAAIIFHMEMLKCGEPWTYQQGPLGMTWTKRSARPVRIIHQEGNLVCTREGHVKEAVASTTMQCCSELREGQPGP

SEQ ID NO: 962946 - protein, 363 aa, Homo sapiens
MHEVTHACVYLVPRTCHAAAGVLENLVKSTIVKQMSDPACYCVFNGEWRRRGPCRLQWSNSDGENGNQMCSDIKNNLKEAFETIVACMSNLVPTTVELAKPQRTSSEWTTSMSVMKCALTIDFPPEFYEHAKAADGRMNGVRACYERSNEYQLIDCDQVPSWTRSTMIKQADKCSEAIQGPAIRLTCVLEYLEILRGPSTTVDTQSTSTCMTVGGQARLNAATEDSGAITKCTANIIKGGNRKYTKEPQVEQTRTMRQQETRNLKHEMATTEAGTEMGNEPKEQTEAKKQQRVHREAKSRERATIKRTYRTGRKRERKRRREDENERGQGRRERRAKANTQPSAEKRIEKKIREYKKRHEKVA

SEQ ID NO: 962947 - protein, 274 aa, Homo sapiens
MGTYFPTMGGAFLGMKARWIRGIYDMWKKLDYMLSDRGLNQIPNRRFTLWWSPTINRANVSVGFQVQLDLTGYAFMHGKIPTLKISLIQIFRAHLLAKIHESIVPGLMSGCSDQATLMHWHIADSYKRRQSIPDKSYKMNSSCADILLLCLLKAGMSPRPLINWMTPKDVMDSTNTQNYCIALHEAAEGDYRSPRTYERYHPRPSLLELTPPTNMSTLTISPQSILHSPIEPCPYHPAPRRPIAHLDKTRHKRDLKTKSPLAQHTLHPNTTAPY

SEQ ID NO: 962948 - protein, 258 aa, Homo sapiens
MCAKTQEHTRTERSVLELVRQAPFLVTLHYAFQTDAKLHLILDYVSGGEMFTHLYQRQYFKEAEVRVYGGEIVLALEHLHKLGIIYRDLKLENVLLDSEGHIVLTDFGLSKEFLTEGERAGLLLLWHNRVLGPEIIRRQTGHGRLVELVGLGIWHSSCDGASPFTLKEETEPHGEGDRESGSVAPSLFPPLGLGPGRRMNLVHREADVKGPKQPVRLQCAHGARAVTSTPLSQGTTMRVRPYVRRDITTQRRSQYKQS

SEQ ID NO: 962949 - protein, 191 aa, Homo sapiens
MAIKSFHKMENNTPLLHSILPRLLTQLAHKHPRADGDGESPELSPKEGTHLAIEELHLIPHITVAGARIRGSGTLRKTRNPQMKVSSWTIIFLHEINILGLTSEWEGWHAAHNNGGRGLYKNLSSTGRDIWVSTCGDKTTPKIPSDSSDHGSTGGTEVEEPPRWILEAPVSYGIEATPHRQGEPQGAGAHT

SEQ ID NO: 962950 - protein, 521 aa, Homo sapiens
ATGDGGRACVRFQFSMGSVKVPRVTPLQANARSWRRLWVLEVLDRRDGLESGSISEQCESCRGRRVGAKRLMRMALRMQALEKPTVSRVSVTHRLLVTGVSELAVIAIYAACRGTDAQCKEIMVTCRSIGNHRKPDCREGLLVREAIGIAPRSHSHRVPRKLGSRPRIGDTAIGAWHGAVASSAMLHKKSSPHGICVRMGYSRRPCATREEASDRGTLLEDTSIGEYPGRGGGIHKAHSRGKQGVKTIEVRSKDMSEGSGALQHRHIGGNTRRRFQTRHCFVWSSHHKGKRHRPTIHVDVEPGEHVITKGKGERALWLTAKEYTVERNCTSPLLEAKGQLAGLGTAKGLTHCPKASRLAAFGPGLWGMGTRTRGHGAGSSRLHRKEPCGEERDYRTVCRLGRQPGGHFAQRTRRLAEEGIGGAEIETRSIRVGTHSGAPKRIALGVGEIATCEIDSMGSERTRTDSLRREQIDTLWDPCGDLRTTPTDYKRRNGPRETQTRKDEVNTRKRQGTPPMVPYNV

SEQ ID NO: 962951 - protein, 55 aa, Homo sapiens
AVVAAGILGASGADQVDWATLRSVAACVRREAAGADTRPTVRPRNDVGGGAGGGG

SEQ ID NO: 962952 - protein, 177 aa, Homo sapiens
TLKNSALSAQLREACYSRRHARPLWFHQYDKSYLGSMLYCACVSTDSGNTLAVSSVPLISYDSHVMKIHDSEPHANAGLVGAMGLSLFQDGHDLIPWQLSMTIQGARDRGPRSFGRSRCTQTLDGRRVHIISTCPLEVVCGEGHPLLDPHSTRDGPIEAGHVADGVSLGDAQDADWT

SEQ ID NO: 962953 - protein, 146 aa, Homo sapiens
KDENPEMHYSLRYKSVYYGLEHLVTWINIKSAIYPTNTIAYSPLLPVDCLSANDNGQCSITGNAYNLEDVTMGSTRNTLTHLTRSVYPNRDNPASHDQSTQVIARKGHQTLVAMIDDKCLLNRRTRECTLYICLHYRRYSVSSSRS

SEQ ID NO: 962954 - protein, 40 aa, Homo sapiens
MASSTWSSVQQNEERDGVRLSWNVWTSSTAGGYKNGCTPG

SEQ ID NO: 962955 - protein, 67 aa, Homo sapiens
WYASVYPVISSIHAVRSPNWTFEWTNHKQLERLNFRHKGMMRLKQKRSEELFEYCSYRILILTLLHP

SEQ ID NO: 962956 - protein, 142 aa, Homo sapiens
MPSHLRLARSTPRRNVTTHWPTLHTDRADTATLKTNRTLPPPGNTVHRQHHTTSDNPDATGTCSHRQAHTVNNPNQCSPNNAITRTTPLTHAKGTQTHENPPTQTVTTNTHSTNTPNHQAKTRPRARHTYKQNTHLNRKDLQ

SEQ ID NO: 962957 - protein, 163 aa, Homo sapiens
MRPTPTRVKTPRDSSAAATSCSLPRSHSWVSLRAWEAQVSLLADGAGCTASAGSLRNLGGCPAAAPVLPCRRLVFASCSLNLDGQLMGLTTHDHWCVSALRLVDPMWAVLTSLCVLPAPAAGWPCAELQEADGQCPVTEDLAEVEQLVQVVSRTRGSRVLSSR

SEQ ID NO: 962958 - protein, 92 aa, Homo sapiens
HELVSLLIRAELGQPGKLLGNDHIYTVIVTAHAFVIIFFIVIPIIIGGYGNVTRFPVIIGAPRYGVTPRINRHKHSDILPPLSSYIHASHSA

SEQ ID NO: 962959 - protein, 139 aa, Homo sapiens
MEKKCAGAPAPEGGRWMNVSRLLAAEPNVPMDPFAHLPKSTFVFDEFKRKYSNDVTHSLWHCHISGSTLIRTAWFPVVLRVSALPVRNSSQTLHDACNLHPLGHVSSRLGQAERRTGFRPVYSFLGTNNRQSTSGVLVF

SEQ ID NO: 962960 - protein, 168 aa, Homo sapiens
MLDWMMLGHSAVCLGLMTLTKALAHVDGLYLISAGWIDNLALSGVSCEQADIECTGHCSGVPGVHIYEMPVLAGQMMAPLSVLHVVGHLYPLNVGKSSYETCVSRNACVHRVPEPGTTVMVLGDPRSTGWISLCCARHGWFAGGPWAVEHEGVRAPGVGLSLAALSGH

SEQ ID NO: 962961 - protein, 167 aa, Homo sapiens
SPSRSRRVRSPRAVVRPATDAPGFRRPYSTEEKESYQYVRYPEAPLFRPLADASKGDDPAVLLAREDYIHIRIQQRNGGRPLLLSNGIADASDQQETSEGGPRHNLSLHCGTVIEHRGLMGEVIQTHQRLDPTARHTCHASSVTHSHLATDDQAEGPMGFPCAMWIT

SEQ ID NO: 962962 - protein, 381 aa, Homo sapiens
MPYVNVLSIATYTSMNPIVAVYRERCDTLTCCEYCQLNAHKDHQYQFLEDAVQDTSVKLLASLDEAPWGTNYATLQKSTKEVRSSIRQVSRRTESVEQVDVKMAILQIMTELNKTGPVCLAHLTAHDRLLLDVGYARQRPVQRLAPGTMTIDSHECTMEHTSCRLAPLCAPSSRRRCPTHTPPAPSLRLLPYATLRTLPSLPLAPARSPFTATATRVRHSPLAAPPLHPHPAPHPPAGAPLPLAPAPPPHVPRPAPLAFPRHPRPPTAASPCPHYTSTQRPLSPPLAPLSPPLPPTGPPAPSDTSLPSATTPIANNQDRIRHNHQAKAATNKNTSANSSKNKKHPIPSPQYKHEPHPAEPQDTDTPTRKHRHTANNRAQPR

SEQ ID NO: 962963 - protein, 37 aa, Homo sapiens
EDGMNDQDLPNWSNENVDDRLNNMDWGAQQKKANRSS

SEQ ID NO: 962964 - protein, 83 aa, Homo sapiens
RPPTTTKFAAASTGEIKAWTAHVVILCTGGYGSVYHWSTLAKGSNATATWRAHRQGAYFASPCFVQFHPTALPVSSHWQSKTS

SEQ ID NO: 962965 - protein, 132 aa, Homo sapiens
YGQAWWWQSHAVVMLSSSRDWEPEILDKNLFQSAQDLRLGPRFTFQQDNNPKHTAKDKSLNVIEWPSQSPDLNLNKHLWRDLKIAVQQRSPSNLIALRGSAEKKKNELSKYRYAKLVASYPRRLDAKITAKG

SEQ ID NO: 962966 - protein, 64 aa, Homo sapiens
SSLLIFTGHLDNNMSEYVMANAFPLLNYCHKFTYKIKHFIGIKFHLGLYFIKDAKILRRRGREF

SEQ ID NO: 962967 - protein, 130 aa, Homo sapiens
MIRQHFMTWINEDGPQVVGCKASVGALAGRLIFPEDTLFGKNSHSVRSPKFRVDSLFPIDCCSKAIVLISSGTSEWSRSDASHDSHAYYSRIVNDDKIAFAIEVGAAHHVICKGEFQVDAAANLVVVGGR

SEQ ID NO: 962968 - protein, 75 aa, Homo sapiens
VVHTKQRDVVYTSKQAEASTDNPVGAGNYSAGIINQIQPRADLFIEQMVGGPKIFVDCKQICLVDAAANLVVVGG

SEQ ID NO: 962969 - protein, 371 aa, Homo sapiens
SVVARPLPVQPARVLRNLGVVQICLDSSVQWSLSDGLSLACAEVGVSQKSQESKCFMEQPTLAFKFRLELIVAADSRDYSELLYIASQTVKKVIEIKPILLGTMAGGAAGLQLTGNGLLDRENVELYELRNKRSGIVCSSRLPNCLPNMVVLQVPIGHGGLSHGAPVDLVGVGIHAGRPLAFLLTVGTGDRGHRDFQGANHSRARFVAHVYAICGSMGLGGTIAYDLRSCEQGLMICGPVRAILPRAQRIRRLPNSREEGRDKPPNQKLREQNKIEAPEITTCWHIGAEKTKEWSKRTGAGHTPSTQIGGKSTMRESTTGDQQQQQEDDCRTEAEHHRRTAQNKMRDETAHNTSNDQVTQQYSYEEETQIS

SEQ ID NO: 962970 - protein, 232 aa, Homo sapiens
MSGTFSRLEEPGDRAVKGLVARMASNCIQASVNSGVLTPSREPGGGHASNDHLTESSLSGALHRSGNGGDLTLPGVGGAYESSQGPDDRVLAYLPVATVVPAAVPTRDTLSVPCGTVAGRGSWDCVRVGRMGKLCGRARAGCSWQASTHHGVIVVSPARPVRRAPGVRGESNARPDWRVRVHAPSGVSPVVGAARGDRPGGVLRPWGRLQGFWAGGDLAPGAGVTPAGDPAL

SEQ ID NO: 962971 - protein, 114 aa, Homo sapiens
MGGGGAALSPPSKYLWEKRFCGGARGLSVWSSWPVVLNAPVCCVPERGRVPPRVWGASVLPRDVRESLPPKSARGTRGVSPEMCVLGGALLSRRAGWNCGERCVMGKKIFLGGG

SEQ ID NO: 962972 - protein, 70 aa, Homo sapiens
GVKMEEYAREPCPMANLWMTVVGPLRWVPWVAGIVLKQSKGFRNVSSGTYSHRATREFDSYENQGSTVRR

SEQ ID NO: 962973 - protein, 467 aa, Homo sapiens
KPSSGLGSGSGSLASAPAPLGYPRPRPAAPPGPRAAPIAVPGLRLQPRARVGATCPGPAPYGPRLEAPPPTARGAPDCWPGRKAGLLPGGSPIKALTIGRGATIPITQRKGASEAKDRGGTWQTERLGGELGTFDRSRQKESVVGKPYCSPQKMRKGRAKLQKTDDLRQRDLQKLGPRAQTGGGGSPKCSRPQDPSGPSIHGPRERLNPTFGASNAGAPFVRHPEESIPGEGLQGAPWPREIGQTFRPGNQIRWAAYLRAAPFHNQGARAGPNPGHLALGNPTLGTARAAPPRDTRVVVDKAAPRRGIPGEHEPGARQRKAAAGTTGGRMGADPPGRERDKDNAPRNVDAPQRTSGNPTQADDPRWGATPAGNGRSPKNSWARHYWGHAPTYGRRRSGAPNSEGRNRKRSLRRQRRQTPTKRIVLRQRENNTQDERKRSVVCLHKQGLGVFSPLARPSFVSSGFYRG

SEQ ID NO: 962974 - protein, 330 aa, Homo sapiens
GAARARNLPSRSPCGQRTASTRIGPAPRGRCMGARAQAAPGPGGLCCCCAAVVCSGCWAPGRAGGAGPGGAGEEQVNAQGQTPFSQSVRGHVGEENVRADREVLAEADLGDLCGEWNVVENACGKFGRGSLDVLEVEVSESCPSILRPEPRLSKSARGAGRSVGAGRRPSWPYVVLVPADRLGLHFLGVLDGWVFGRFVLDRGGRPVPMFRGVPSAESEGEPGNAGLAEATGGPRNHEPGQGSKGGTVQGARIPRHPTVWENGVPLGRAAERQPSKGVSGGASGHISARGAPKTAFKEEKTPRLKGGGGDNRGGQRRRHTGQHNRATPNT

SEQ ID NO: 962975 - protein, 209 aa, Homo sapiens
GPWMTLRASTAAPLSEEGEVTSVPPGSGRGGYRRPLLPRPVKAEDEGEGGREETEREGSGGEKAQEKSPALGEKSLAEEDSEDCVAVPCMGRRRWSLPCGLGSPGLPPALPKFQRLYELLAAHGTLELASRDPAPPGLPGREGPKSEEERSDEGAGGQRRGRGKNHILPNGISDLDDEPVDTKGLPLFDRENAPQEGSDREPETGEARL

SEQ ID NO: 962976 - protein, 272 aa, Homo sapiens
EARLRREYLYRKAREEAQAQPRRGRSGAARAGKNRLIPTELRREALALQGSLEFDDAGGEGVTSHVDDESQIGQESRIPRFMITYLPRPQFPASRLFAKGADSWCSRAPSGIEAEVDIEVGGALLRACKGQGGTESAGRHEPRGHTLWGLIVSHLPFGPTAYFTLGALWSVRLDFPDLGTLSEASPTFIDTRVSPPAWGKGGSDILRYLFPCPKMTATGFITFATQDGVPFHFRPMCLEDRPPHVGAHWGRARFELKCTLSGLGPLDGGPAT

SEQ ID NO: 962977 - protein, 146 aa, Homo sapiens
PFYALGKTQLWNMSWGKLCTGPCPREWVDVVFGGGGLFPGSIPHCCPVGSYGSAGLWLSLSWVLFLSLQIKGSCRDSSRAYTKGVGGQETWVRVGVAVRNTGAQMCLHQVWQPVFCAPPSGLFSDIVCSQDVDKNSLSVFTKISVI

SEQ ID NO: 962978 - protein, 216 aa, Homo sapiens
MNLLRLLGELFVLRKGAYVGCVSFSMGTAGMYWLAGVLSIHTLVPLMSEDVSFSFPKCFEEISGFSAGARRRVGALLYLLGAVGVLSGAFQGFIVPTWGVCSPLFHEVGTFSFCWRVRPTAVVQFYNPLGIRTFALQRGVYTFFPRDPAGVPVVVTAQGLGGPLLDHWVLNQEGGRVEPSPFAGDKGSAPPGLAPQGGGPADKVYPSCAQALASQG

SEQ ID NO: 962979 - protein, 85 aa, Homo sapiens
NSKLQSHLSFLPIPLVSLQEQGTSTYDGCTNSFGANVNITNLLLSVIPYNRHLLLACLLDGRSHTKRTLIASAICACAWTLMVTF

SEQ ID NO: 962980 - protein, 156 aa, Homo sapiens
MRKVHWVSSGVPPGNVVGNPIFDSPYFSPCGGTLGSLGLNTQEHTVWELQRGPSKEAKRKGPKYKLQEGGGHNVGILNLERGPVAYSGKHSKRGGPKRAPRVVPRGLLCGLKGFRSSCRVPPQNSGANGCVERALGGRLLFSPHVCGGRPPRPPLW

SEQ ID NO: 962981 - protein, 453 aa, Homo sapiens
MRNIFAYDLYDSTHTRLCSTLAPKGPFIQTIAQGIQSQGLRDWNAPPLAVPCLATIPMNYYLASILNINGVVGLSCVLGTPLHWGNTLYFGNPFQTNSQGRGFPQGSFPSGDHPPSGRFFSRTLLVSKRLTKKLERKPLAYSNLGQQCETTAWAPVGGLCTKVKTSNTFMWTAIGRLVGAAVKRARIDKRRASCTNLPNQGSCAHHVTPTWVHGPFPGSGTLVAQLRTPQPQTWAWCPPLAHKLFLPSGCRSHVGKLGPSPSDFVGTAPGCPTELVTAPRRCAPGSNTTFLNPLRGKNRAVSSSERGYTQRGGLSPTAYTPNGNPTGVCPQSKDLRPTGADHTHTATYLWRQRTNRVGASHPTEHRRLSRPKIRGRTKRLTHGELIRWRTRCGCSTPQKQIEPYRETWDHQQPGDLGAAGVTRTGLANTIGRNRNTTRAVLSIASAGDHTTHT

SEQ ID NO: 962982 - protein, 171 aa, Homo sapiens
MSRQAKDDFLRHYTVSDPRTHPKGYTEYKVTAQFISNEMDPRGCQRRVVVWKAGTAESGKACNWKTLAYNPRKASFRPASEGGSLAFPRGPQGVLAGLKGPQVESEGSRAKGGAEGDLLSLSLCHIPAAQQPAPSSRSSSGVGRVTLTLGGVQGPTIFANRVIRSRTGKIK

SEQ ID NO: 962983 - protein, 327 aa, Homo sapiens
LKKQPQHPKAAARSDWTAESACRARVRASMAEETSNSSRSSRAEHTEQKTPPPPAKSKLSCHQSTSTTHGRPAATVSHSKRNAVRRANHKKSDERADIISDTEGSQASTTPESITRALRAHCTSQRDRDRSPTKLARPREQPETNSKKRRPHALVQQHYTHIARHSTRVTRSKRTRRTPHKQGKALRDSAYAAQQASKQKRQGYNKTELQYKSYKEFIKELAYEQASSATQTRQTLRNSVATQYIRGIYTSNKSYHALSGPDQHETTTSYPTTQSIRQYYNDINRTQPHTLTVTQYMQHSHDMHHTAVRTTHETHNRAHQHTHSNNS

SEQ ID NO: 962984 - protein, 244 aa, Homo sapiens
MTDGPLSLPNAAMARGPNEASECGWQLQMHCDAVAKLDLVCFAPRSIPPGPHNVEQDVSPPSSFVLQEHDLTYCPGQDDDSNRRLCHARVFITTRVATVLNCIYTYPDWIHGMSSAIDNEGENFRLIYDTKGRFAVHRITPERGQVQVVQSETDLQLGTNRQSLIWLTHDARPIRLPRIPHQGDMITTPRLGSRALATHYLHFPLNVPPPGYTLVYCVALGEAAQNLQATNFGMVIPSHSARTK

SEQ ID NO: 962985 - protein, 271 aa, Homo sapiens
IYDSVMLEAPKCSCGDKIAGTREHCWRIRASGPGCRSGGSGASVSVSEAVRPPRGRSCRVWSKLLDARTVRPSTGSKARSVGAQYWTIGESLARAPGDQRDVLSTACPGGVGCGLRPFGAPVVGILSFHLPPKCRARLWGTVWARVSSLERIRSLFIDRLGYPRLEGLNTEDLGCPAFGRLGLGNPPPDGGSEIRQFGAWIFKFFQKSNWRLGLESALRLEISVIRKLFECLVGQNPATVGACAKALAKQIGNRGPNGGRMPKNSLRVGLR

SEQ ID NO: 962986 - protein, 224 aa, Homo sapiens
MPKWNVIVNELDDIILTHYFTLFDTVLCWWCHVTCVPSLACHGCTAGTYTNVPLPAQRLSVQILTPWTQCPVIMCLTHPWTSVGHSLCQSLELVQRTSTASFPPGALLWTLLLSKAPIISKILDRSEVKPYSALLAKQWRSVERQLGRTGELGRLQLKQKVSWNLVWVIPQQAEWTELKLDGGNGGFGIPYNLFGTTSHIVGLEQQLVGAISSQFLLKRLPRAW

SEQ ID NO: 962987 - protein, 293 aa, Homo sapiens
MRPHLEGCGNDIVSARPDEWLVAAILDATGVVCTGDHEGVHYNHLELSPGESVQEGDPHFRSALTAQPVRDPVHMYQLAQSFRPELNWKRTVLKEIRGVTVGDPVIPAIWPLMGTGRAAVVLCGIPCTYPARDSLLMRCCAGTIFAGAACFLLRRWSPRCPTACGLTWADVGDVLGDSSRGAEPPVLTRTCRFQKQQLVNGYRRFDPCRGYENYTLDLQLEALSPQGGRRLTRRSAVLRRLRRVADLACAYVTGGPRSVCGALAWLSDCARVLGALALGCLGVWGLPFFFSGG

SEQ ID NO: 962988 - protein, 298 aa, Homo sapiens
AARESDSGGGPAAFAARAARLAEWRRVDRGLGDLAWRPMDKFEQLLTPPCLERASKGWQRRSWSSRVIAKDALNLAQMQQQTLQLEQQSRLIRVCSACRGSELIELIEIRAQVEERRMTLSEETRACTRPGAQVFKSNAGPGSAEEDQLNLEQVLNEEIHRKQEESVQNPGSLCWEPPVSGEIGLGSKTCDAALCSAVGRARVQAELGRIADIIREQIRLKAVEPRQTVLDVPSGNGWHLGLGPGFLAFVGDLASVTSTVAGLNACWLGGGYLRARNARLCYRHGPSRGPPVWKNRSP

SEQ ID NO: 962989 - protein, 316 aa, Homo sapiens
RVKVCVSFCVTRALWRCLLKSRARGSVIMSAYGAVRRRNQGVCSVNLGHLAAAHKEQSRNGLLSLFMVLLRHCTGLQSKSSRTLPIVRIRKTPADADRCSYEALRWTLVTNVGSRREELNYLTGMPQDINVLIDQLPDVPEIQMIDATECWRKRATHAFHDYVIVTAGEQDTQVPDYNHNLDPNGKANLLRSRTQGARATDGPRTASSSDDPRPNHQRQLSISHTHKHPGLASSTKARRPYPLTNAANESRPRTNHRTTTAATQGPDSQHQKTPTPQGEPNNGAPTDGRETRIPFADSGATQTGQGAEQRTQAIKR

SEQ ID NO: 962990 - protein, 134 aa, Homo sapiens
MPAGGGGAGTGLGLTRGDGAIARVPDAGSRIYSSSHASDGTCKKLENAKGATERGREADEYESTFQANAGPVIMSIGGEDCEACCPFHRMLAIVDYWCRQQNELECSLSLAVCSVNRCYPYCVTNFSGHPKGYA

SEQ ID NO: 962991 - protein, 77 aa, Homo sapiens
GLEEPAPMTVRVVTVGTTSFDDLIVCVGARSLQQNSESLGYNRRYPAKIWSEGTVVAEPVQVLSLLYSGCATGTRIP

SEQ ID NO: 962992 - protein, 193 aa, Homo sapiens
VCAPNLRWSTRDALERPTLVPSRWPLIRSWQDDKTLIMNQEKRRPDVQAQVRIGGKGTARREEDRLVQQQTATADDEELQFSLETSGVNNSSLAMEEVRYVMQNQGTVIQFNEPLKVRGDHLGELNDFVNHLQCRAGDERSMSRRWLPQASYKTRGDGWRSTITELRSGREHGVPRQGSIGTPKKNTLPWWDI

SEQ ID NO: 962993 - protein, 193 aa, Homo sapiens
MRCTSLAECLFPPARGYRRVPRVGSSPSRFPSKSRSPDRCYGMLLKVVHNSEDSDFLTMHISMPWQCHPQKPRAAVGGARSSANPVPDPSFPCHDSVLHAGGYAGGATNSVVTWPSLKGSLALGATGWVHQACRGPSLCQGPGQGTRDLNLGLPRPGGRNLSYVPGKMDVLSRHTPFNTARMRGVEARCIRKC

SEQ ID NO: 962994 - protein, 71 aa, Homo sapiens
GELTLLWAEWLGNDARRMGADCYGGVGDGSLDWNGEELVCTSGLNHRSVSLCAVSHRKSAVSWRMGEMEDA

SEQ ID NO: 962995 - protein, 281 aa, Homo sapiens
QPSSGLGSGMLARSPHAPAPLGYPRAPGPQRLPCPRPAPDACALVCLLALEPRGYALRLPDRGPGSLAPLMGPRAKECACLADTDPCGEPPDKHRTRKGTCRVSLAGARYSAIRNRLTQYRPARGTNIPRHKPRAGRGPRHTTAGRVHEQPHSVIGTPRMAEEQATVARDGKRLGVHPFSTLNDHMSQRNEEQAVAIVATRTKKRIKGPIGKKAPKRGTPRREKPNQEAANREKQDVYQAKTRGHSHRKRRANREQLKGGDPHTEQTETDKGRHNRQRRDG

SEQ ID NO: 962996 - protein, 70 aa, Homo sapiens
GGQFLRLVLATADRKECRSGECYTYGGTLCSPELSKPLAVNAKMCQVYKIISPVLNVQTGRQIMWVSFFF

SEQ ID NO: 962997 - protein, 68 aa, Homo sapiens
MLPPPTLCARLNSFMSGRPPADASSYRGGGGGHITPRPSSLRVVLAHRRREVISPPADFGVVISRSFI

SEQ ID NO: 962998 - protein, 163 aa, Homo sapiens
MWVRVGEAPGVLSLWGGGDTSSSSLSRGGVVPRRFLWCAPGILCVSKRGPKTCGEAPLWGGFCGFTRGFNTQREEALPFVNPCVGSPGGAICGVHSLSRVVSQRESAHSPEGVEISPRDSRGGDISHSLYRVGDENFCFTERAPVVESGGSPRGEEFHKSLIR

SEQ ID NO: 962999 - protein, 69 aa, Homo sapiens
AETASGLQVPRLGQLPPEFCLFSCSEGSGLQNLQTLQVDLDRFGYAALVTIWKHFGYKGEVVSVFDAAI

SEQ ID NO: 963000 - protein, 69 aa, Homo sapiens
DWRGGGVTCERCAGASPPTASWNRAVLLRGLGQDNNLLEGPRGGDTGARKVRAAPWRVPENQGKESGTF

SEQ ID NO: 963001 - protein, 545 aa, Homo sapiens
SAVSSRAGAQAYLSNRLSTGFDRDSLWQRLTSVQRGESSLFNIAATFARNGRCLVNTALLTYHLCENACEPSTRALLQALLNTTTFPYAIAPMKRRVGTSTRHSPPIWSEICLYLVWPTCRPWARICPQASHHAALTLCPFSVPLTSSVASPRSSALPRGPCPSGPPPQAPSCPRAPGRPIVLPRGRTPCVGRPGPFHFPGPAPLNFCSAPPQCAWSLPPPYLRLCPLFTCATPLSPVGPSSPVDTRGRAPFARPTLGLPRTRRYSLRALPGSVPAAPHRAVGSSPLQRASDSPRLSAPGPRRLPVFTPLSDVRQLGLGPTRRSHCRAPRWRPLCTPILVATHLHTSARLHRAPLSSRLCHPHTYVPTAPWHPFDLVAPRCVSPPCAALTVTTADPLYRDDPVSPSPGCPIPCAPRLLTHGLGPLVVPAPVASDPSRAENSAAVKSSPRRPVHLLGALPHCHSIRSLLGVPCRLPAPMLGGRLSTPITRVRPAPTCGCVAWCAPPGRSSPNTASLFCCFPGVSTTQSIRAAPPCVPVVVHPSRVP

SEQ ID NO: 963002 - protein, 190 aa, Homo sapiens
PARVSARGSAPVPVGFGGAWRLNPAYRGRPEVRVSSLTIADAFIAAGESSVSDPYVPGVPRRVHRCSLPLTLQRTNLTGKQLKMLDGAPLVVGHTGGRTTIWCGDLMKGCGGQGPFHQAELTPILSPAKFLDLNNREETRRLGGGASPNWGCVHSTIFQARKFQHVWTQTLLWERPTLLETLPPRTTINY

SEQ ID NO: 963003 - protein, 234 aa, Homo sapiens
MKETIMNQEKLAKLQAQVRIGGNRNCSQTRRRWFTRTSHSRLTKHFRYSYTRTLPGTPTISGIDELNTVTNQDTVIHFNNPKVQASLAANTFTITGHAETKQLDRHATQNLPTSLVPDSLTSIQETGLKLCQSNLWTATRTTASWQRMMLTRKLQEYMSNPNMNDTIPSTDTHTAPCVHSCTHNLKTLTGSRHLHIITGLLKHACVSRTPPKPSTFYITHPKTMGNRQNYNEPA

SEQ ID NO: 963004 - protein, 166 aa, Homo sapiens
MVDHLGNGGNLSLNASANRTGGGITVGYGQRHGIKSTVIPSPTEDKQQHGADLNSTPVAQKAPAGCEHYGTHTGQRTLTITLAVRQHKRLGTRVRLTTHGAVGHNDTSYFYTGFKYKPRQHNILLTLIKGDFHINTHWFVAQRKLSLETSKRERSQTHTQGRAPHQ

SEQ ID NO: 963005 - protein, 58 aa, Homo sapiens
MLPSILNQLGADSLTSSRRLAEALPKQSVDGKAPLATGEDDDDEVPDLVETYDEASTN

SEQ ID NO: 963006 - protein, 152 aa, Homo sapiens
KQGNPVTKQAINHYGFENTISYVSAKLTRQYEGKLVALIDAFCKSKLLKQKDFLQFSFPFYISYFYSFTWLISHQETFISSAVFIFRMCYHHLTTTTPITKRLAHTVAFTIQQQSFSAFIVLCKLTGHHSIRDLLLRDLLIINISWNILEIH

SEQ ID NO: 963007 - protein, 258 aa, Homo sapiens
MAPSRNGMVLKPHFHKDWQLARGHVVQHSRTRKIRRRKARQAKARRIAPRPRRVPSGPSCAAPRYRVPPRRCAPSAASAWREPQGGRHSPMNGVPGPTGISVDPEEGGTRPRSPCRAQTCQRLKGVPVQHSSYFPQEALRTPRLGRQSAEGTETWAHTSLTRDRSHAPSGTRSIHANGEPARVHHLTDDARPSKGRYGTISRSGPVQTPGQLTDYGTHQQPRKPANSMRHDNKAPGDWNRSRQDGQHSEVAHTGARAT

SEQ ID NO: 963008 - protein, 116 aa, Homo sapiens
PPPPPFFGGSGGPRTKKTKKKIFSPLGGVFLFQKKTTPFIKAGAAKCGWGVSPQAKPGENHLCRKADGGGVRRFLSPPPIFYLYKEDRGREKHKQTSNIKRAKKRHPPPPGGRRWG

SEQ ID NO: 963009 - protein, 140 aa, Homo sapiens
SKGGTGNSVLELGPPFKSNFIIFIYKQQMNTKRASLKMVWPVTQKCYEGFRKASWILVGPAWPGYRTEETATLGARKPKQAWWKPGTGIENGGGESYEQRGGVLEAGQGRKGVSNTKGAVSLQGNIQLVTLNTSRVLRGS

SEQ ID NO: 963010 - protein, 204 aa, Homo sapiens
RRQPWRPVRNGMVLKPHFHKDCAVGCVATWFNQPARKIRRRKALCNAKAAPDRPCAPASGPILAHRALPHWFGYHTKVRAVPRVSALEELRGWPGHFTRRWPGPSAYLWIRGRRNKSTESLAGQRAAGLKELPDPKLNPSFPPRRKVPLSGGPPLQKQSGGRNHGFHLADGDTLEQPLCPDPQALNPGNPGSLPLSRKPVLFTT

SEQ ID NO: 963011 - protein, 114 aa, Homo sapiens
MVTTIGELTGFVHARSDNCPVWLRDDFLNQVMRRNRLCRMSVDGRHQTCHDASGDKDELDPWPWNLTWRLQIEMCLELKELGTNLKEENSDGWKIRYTLKGAKVRKDRINVWEG

SEQ ID NO: 963012 - protein, 207 aa, Homo sapiens
RFPAALVTWRHPQRCLVLNAGACNHGIDEGPGGTSCYVGIDSILEQMRRKCMNAVASEFNIMVVGQSGLGKIHLNQDASSRSKISAEGGAGPPQSELHSPMTILRSRSITADIDGGKASGMNADKDCDTSQGLGDHIEQARTAWLAHRGSSSIDQYEKYLQEEVNINLQEAHPGHPASTAAIYFIPAELATPSGPWTSSYETPEQWW

SEQ ID NO: 963013 - protein, 118 aa, Homo sapiens
LRPPPAPPIRVEEAEAMAEREERSLDNFFAKRDKKKKNGAGATWAAECRWAQRAAPAESSGAAGAAGLGGGRGDPGGGAGRDLPARGGLAGPGGPPPKACDERDGRLNGKGFGAKKEG

SEQ ID NO: 963014 - protein, 494 aa, Homo sapiens
TAENEDYSQQSDCLTFHENVDITLTVDAQFIVKWPQTGTPCGCVTYHSHISTVRHYTAYLWEPTNNNDVLLWSDQIGLGVHHCTGTPLAYPGIRDLLSCKVHWYQDHHWTQLALITDCGLPGFTNATDGFWVYFDFNLYHTLFQHRSDFTSQGEDNLWLPPLCVVTHIPGKIFILTTLDTAMYPFLRHGASGEIDWTPQLRIESGTIWIYHRFIPYQNGPPLANIVLDDIHIPQFAHIWHTVESRSRTALLYLTHNNFIHAVSPSLARITNATTQAHNHNPGSKLPTANRGTLIQAEPNQQRGPLRHTRTTAPAQSEPQHGGKTLSTHGHAPPGTDQSTVTLTKRCNVIIPPVGPATNGHADTGTGPHENCHTTMKSTRINVRLATPLPQPGTAPDQTKKTPINRTLAANNPAQTTTQTHHDTQRTNTHKRDYWTDHHDQAHTPRRAKHDHTNDSTHIDRPDRRHDRHHTERADENTQHAPRQTTNPTRHTTRD

SEQ ID NO: 963015 - protein, 151 aa, Homo sapiens
MVPVCEEPAETSVMAVTDPEGGTSPALYPGGGDCSQGHLKVFHSIEGHPPRIGGENHQGPLTKNAEERPERIPFTQQKLKSCLRDDILIRSLEKQITCLTRHRCHEVEGAKKWLQYLTELRREGGLCWPPRYTSSQQMKKFQDKPDRWLLQ

SEQ ID NO: 963016 - protein, 178 aa, Homo sapiens
MSSLGSADNMLSSSWDCETGQAAVPILNDQIRLSGPAVLTEGGNIIMYSTDKQMGYQCYVSFSDLRGSSQIDNNEPYMKIPCNDSKITSAECGPLADSGIIAGHESGELNQYSGQSGEVQAHGTGATPGRINDHQENRHLTNDANRVHSQNTAQATDPTTLTHLATSTETKARPQQEP

SEQ ID NO: 963017 - protein, 277 aa, Homo sapiens
MRENRAGTQNLGRPWAQRGAPKEAKGTQGPPVGHERHTRGRGRQTVRDTGTHAAGLATRARHRKKPMKPLMMSAHGTKTMLVHKTRTTNREPLTQLWRTLGGPKRPRRRETHTPRRKKKHGAHPQRTQGRHPYPRGREPHHQADNSGPPKEECSARDKLSKTSEEPRGGTPPATKRKSAYRENRPPKRRDTQRRGPQRPLPSGEKPPPQEGRGGHTPNGGGQPQVTTASHKDNTPRKSRQNRSTTRSRHEQATSKPARNTHEGDATTTKDEQSINER

SEQ ID NO: 963018 - protein, 171 aa, Homo sapiens
PQTIYNGLNDNISPKLHEYKDREHLNDYFLQDISSEVNPASAMKQIHPLLLPRERGGRQRTNTTTTIFQASNAEITVMITLIVAKSAARGMLSRCTVYYTSNFPKGMLLSHVVCARSIDMGKLLKKKLSWLGKKYNPMSFREKARLMFQVNQWLTWLETAEEEESEERTLS

SEQ ID NO: 963019 - protein, 106 aa, Homo sapiens
DLAAVSRGLRSVVDSAVLRQMQAWGSLLFWTGQAEDMVKPLVPISALCCWCGFGYHDVTGGFWWDSLAMYNGQRAVPGLQGCVFGRLAGLGAYQAVSGSRERLGLT

SEQ ID NO: 963020 - protein, 203 aa, Homo sapiens
MGKVKVGVNWICVEYCGVLCHQGCLLTLVKWILVAINDPFHGASTTWLTCSRYEFHPMANFHWHQSRLSNGKLVIEWKIRITYLPRSRDSTRENHSGGRCLVAVSTVDGGPTGRVFSHAWRNGWALILQGREAIKGSVTRLAPLVLMSPHVRSWVENHETVLTTSLEIISDALLHTLNWLAALAKVIHDWALVIGDGLSDHMS

SEQ ID NO: 963021 - protein, 150 aa, Homo sapiens
MSLPWLKDDFLLALHSVWTPGLTPRATPEYKVNLRSSSQMNGPMSDVKAGGGLEAVQRLPAKLHGDLCLQPTGNLFQPASRSSLAFPLWPQVFAPGLRAFSDPRQLGDNGGQHGPCFGFTCAHYHCSSKQQATTASTGRNLPGGWRDGRP

SEQ ID NO: 963022 - protein, 199 aa, Homo sapiens
MWGGRETPASWRGRTEGKGQKKDEGPKRDPRARDAWERRRPERRKTQPGANPSTWGVGTPPKMAGRKNKRPAPGGHPAGANLLYGDAGSQRSPVPGEGKLLSKGAPRVGAKRRRCATKALEKGAGLGNNQRPTIKAFKSYEQMVMPREMEGGQVGVPRRGGGGTTGCLESQRGLTKERRQEDRWKHGSVRDPKELGEER

SEQ ID NO: 963023 - protein, 85 aa, Homo sapiens
GLQWPKKKRGGPDNFEKHQIQGTGGRGSGRHGTKEGAGKGAWGFAKRGTKRLAGIAPPPAVEPAREPRGGHREAEHGEGGGHPRG

SEQ ID NO: 963024 - protein, 228 aa, Homo sapiens
MALEFNKGCQSQSLFDLLDHQVRMSLMWLLQPPRYMLSEQCGRMKSMGPLDLKIRGSSFPGNIGWCVTSSGTASQNEKPGAIKPLPDVLAEPLSSEAHVFCDEPTIVNCLPGNDAPVGMGTFTQCGEPYFGRCQSTRCAWPGCSGIAATRFGSLVPEVAHVHLWSGGSQPTMVVAVVPHSLANALYIPAGEDSLASTGGGGADTPSGGREHPLGGAVVRGGSACVVAA

SEQ ID NO: 963025 - protein, 94 aa, Homo sapiens
MDSKMNLNTVENSLCIRCVSKPGVVPCEVIPCSNRTSLYLSSTSITLLGTKLRCDCTLKLGRVKLFVSVPRSGYANPQELVYGGKNFVFPEKNA

SEQ ID NO: 963026 - protein, 262 aa, Homo sapiens
AGGLRAQVARGVLSARRAPAAPTHHRGGLGGDSGLRGCPGPHLFPAAPANRRDDRGCPSLMSGGCPPLQRATPAGGFGAVNAVGGAGGLGLVGPRGAPAFPSLGSPFENSAGQFLHLSLRKRGNRRLSRFQLSLPGRGRLDAAHSGGARRNPFLGDPGAPLSPSGRPGFRGGGTKTNSRGVFPFPIFPLLEKPWDAEFLLQTRLLGILKPFSGLGAPFSRVTPRGKGFHGGENERGRGAPLSPRGAPLGVFVSGTPTPEGRS

SEQ ID NO: 963027 - protein, 88 aa, Homo sapiens
MSPANFTGMHLYASCRAESVLETKKPKRSRELREGALEALCIITLHLTESLGLVRNLAHPEGPILGGGTAFIGPIFGRERGEKWSVTV

SEQ ID NO: 963028 - protein, 30 aa, Homo sapiens
MALTTPYLPQPSNPPIGHCFPRITSEQNVP

SEQ ID NO: 963029 - protein, 419 aa, Homo sapiens
KFIHKKQSGNQKGSGRSRVSNPLKPPQKQLKQSEKRKGKGNKVQHWALGLIHEVFPRSSSGNVKAKLFCGQTRGLLKYTGKGSPQVPSVANRRAASWCQLRTWWGVSTRRAPLSERGGSVGPLVSHSTFTPSPGKFQPAISRTAWGLRAVGVPLIPPEDRRGPLGHYMLPRRHRGRVPRESEKYRVGGESPFAFIYKRFWGGCEREVRSKEAAIPKSFPPVFPKVPHKGVPNFASPNPIPRWNKSLNFPQGVHTTRQHQEKAFKAHGGGGNPNSIQGFRIPARGVNPFFCRFSNKEISHAVWGSPVYYITNIIHHPISNPQKFSHERNKSFSPRRPPCMGLENEGPTKQRQAEELTELAPYKGKTPKTSFGVSALSAPPGDNAYTQYIAYKVARTAWCTHSWRDNLDEYGGCRTYTRKG

SEQ ID NO: 963030 - protein, 360 aa, Homo sapiens
MSVVVLAGLGWDAGSAQSTTEQIFGAFTYLQLSARTLPLNRCWLLADTSFSEELEFNLMNIITHRLHWKPQHWKQGELLLKHVGRTIYGVTTEFFYRPPRANTRWAPRNCHTIHATCNTLPQENLHHLINGVPDLLTTQSQKFYFPDTSLTRHANKRAAKFSDYLVIWETPLTKVHMARCILRWRFRTGHNNSPAGRPIFLTSRSMPGEPSEPSGFYPATGFQDLITQQGTFPKRNTYFHTTGCYLKGDGRSQNGRLDLRRGKNPGWTLYKCAKGSHYHFVGPRAKRRNTPVWERQRTKNPLAQGRYFSPHYGEQTITQSSPTCIAEPDPPPRYNYQKPAHPDMKYGPPADTLSTENTDH

SEQ ID NO: 963031 - protein, 99 aa, Homo sapiens
CAERAAQSLLLSSVCRGNPGPGPWSRFPGMDLVWKCVVLKMCVKGKGSLPFSAHGIVVAWLSRAELVTSDGIYLFCDDHKLAAGTRLSRITVLEEQVRQ

SEQ ID NO: 963032 - protein, 107 aa, Homo sapiens
MPPARAQPPRSWGAAFGGAPSAPGPAPYVATDDGTPLLPVPSHPILGVLFPSQLDLAHGGHCCDLALFGGIPHRRATVGARFDDIGTACAAPALHAQLPLRAFHLRL

SEQ ID NO: 963033 - protein, 167 aa, Homo sapiens
MSTDTGVSLPSYERKTQGINNSFEKLKRHHSYPWAIAGFGSNGGYGTHITLNEQGNILPMSIHLIHMRVRSPRLRPLGAIDLSGMAAIPVYSATFWGKHLMPLDSTSMLSWGLCSGRSLGYQALTMLLTHFTALPYFTGQGATSPPTLRHCRASTDLRLTHWAHSRT

SEQ ID NO: 963034 - protein, 309 aa, Homo sapiens
HALSYWKPFLVNMCVATVLTAWRLPLLHGSCSTATHMPDPPPLHLHPLSASARMSPCPTSSACRGRYRACRTAYDEPGPLDGTLVLALKPIFPWMCVSPLILLTFLPLSTLQYQIHKPFPLRHECTESYHAGGAEGTGPTPVLGLAPPMGSLPWSIPVRAGHAHSPPPFDILARRRNSSTPIFHSTTTHSPKWHPIAALAILLATNYMSSPLPRLVSPFLSRPFIPKRSLTSIPRLATGELQRFAHGACLRQHQLPGDRRRLVSPLALPAHYRRRSPSAPSPPILFSLLGPLGSSHPHLLVAPLSPPHP

SEQ ID NO: 963035 - protein, 334 aa, Homo sapiens
VWLDLVSRAAIAQWMEEERAPRKRRWRGLPVPCGSDSEDARVCRSMCWTDDCPGPGSWDLEDPCPPSPPRNAPRDVEPGHPGRWLRAQNKKTEERLAGFQSMGPELPGVQRHHDTKGYKVPTPIQRKTIPVILDGKDVVAMARTGSGKTCCFLLPMSERLKTHSCPDPGPCALILFADPRAGPVQTLKFTTELGQSLGLKTALILGGARMPTRLAALAPQIPTYFWQARTVGACGLWQLSLQLPVLRSVVVRAPCRALRPAFSLIPFRGAFRRPPRGGPTTGGRSLRRPPHPVVLGDCPRLCLRGAVVTPAAGDYTPRASVPLFPRAGGPTPRR

SEQ ID NO: 963036 - protein, 155 aa, Homo sapiens
MGVVARTQVFVPPALLARLAVRSLMGAGGSLRLGVGLWFGVSGALGKPLFSASLPHLGVVPRKRLILRTAESFIHEAHAMGEAPCAEAPWGIICSDRGGQRKCYMRPMVERSNGQDQTTQRPSGDSIKPLLCRPRVWDSANSIYPGRLRRINPKH

SEQ ID NO: 963037 - protein, 264 aa, Homo sapiens
MNKGIANDKHTSAGMGMEGIWIRNKVNMGGMEGPFGGGMENMGRFGSEMNMGRINEILSNALMRGEIIAKLGVAVAVELKRPWDREDVVLAIDSPRWCRRWCCLVAGPGPWLDRVSSEIYRVVLVLDRMVSVERMGSGDCAHGPCWGSTTWLQSLKRLGQQHGARLALSVERMGVAFGVQLERHGRVTIDRGGSNIERDGRLALNAHVARVHRARLRPEHVGAMCARGVFVACPGALWAPRLVLAGPRTWKRIWPPNPLAGSVL

SEQ ID NO: 963038 - protein, 113 aa, Homo sapiens
MHYKYQSQRVDELVACYGNYTDPSMDVRETETESSRLNTWAAEEMESHSVTQAECNGMISAHATSTSMVQAIPLLSSQVAGDTGEHYLISVVNLISEPQIPKSVSVCGYPVGG

SEQ ID NO: 963039 - protein, 226 aa, Homo sapiens
RALAEAAPWARAPPRLSPGRAGVSVMALAGAPAGGHARRRWRPCSGPARCGVDSSQIVIISAAQDASAPARFPRGPGGALPPALQTLSCCSSPHRRGARAHTQCAGARLGRPGPVTSGGLDLGKVDHQYPGREACGAKALGQEACQSKGTQGVKTPPGGEVQRLIREPQLNLDATKGAFPGELVEANSGERVSVRNLNVGCRKGCLKGADKGGAFLIDISTQKRFL

SEQ ID NO: 963040 - protein, 297 aa, Homo sapiens
ARESDSGGGPAAFAARAARGRAAAVDRGLGDLAWLPKDKCEQLSTPTCALDAAACQCADALSLEHSRYARDALNLAQMQEQTLQLEQQSKLKEYEAAVEQLKSEQIRAAGLRRGGMTLSEETRSTRPGPSIKDKLARQRLRKDPVEPTREILLKAGRISGKQEESVQKARKPCGEPTVEREMELGYQGMRCCEWRPEARGRAPRPSGRMQTSSASRSAEGWRAPSERLGVHQDGLDLVGRRIRAFVTDWDKVTGPVAGLRLLAGGSTQQNGTLVPAVIEDGWGNRYGGDSAHALRPR

SEQ ID NO: 963041 - protein, 110 aa, Homo sapiens
QPVGDPGLCLYSTPGGGPACGFEGLLGGRRLVRSLASGCAPKLNEGPQGLWQKPWAPDIDSPWEFPHTGENSKGYEEENAKILEHGNWIEVGWGHEMASLKLADEVDPLG

SEQ ID NO: 963042 - protein, 240 aa, Homo sapiens
KAPTRVCMQDRPGPGPQAHTAESKVPRLPAAPCLPACPGAGPGLPTLPCLPTLPSVRVASPARRAMRALLDKPRSFVRHSSGRPLLLYSGQRTAARTFSPVPADNSNQSAWENPSPFSEHQKDVEVGIPQTRISAISSRASGPGGTMYIQVEPVLDYLDLSACKGEGADSEEQSPPPGTMQAVELLLSTFGDRESGHLGVGLGNSWEALRENRAGLLAAGYLNPWSSPDLPFSNGLENGS

SEQ ID NO: 963043 - protein, 285 aa, Homo sapiens
SSAAAVVVVGLRLVQTWSAACSHGCTQLHCKQPDLLAIQQHSLLLHVIFDHTALVAWHTSYTTHNRHIVAHLSNCSILLCAKQSPTSTASSFLSAPMAFHMEQFSIGLHWVTLWHTKFGTFAIAHFSWNHICIGPSQPTHASEPPPATSLPQHSKTFQPPQPISQLIARSHQRGIGPHGRFIIPDLPCPANTLSPNGCIAPDTLLGRQPSFKHCNAIGQSLALETCNRQRPQFQAIILHRASQCAPPDSHTLILKSSLAGSSQIGYLHLVPQWLTTNPFVLPLAT

SEQ ID NO: 963044 - protein, 290 aa, Homo sapiens
PGAWCGVVPAPGLAECSAPEGQCLRSCPRPGAQGGLGMCLRAVAALLHLPAACRFAVALLPVPPAGLPFFVLRWNAPLVGVGTQAGMSLLGFAVPPAMPSVPAAGGRVVLLLSNHEPVSMDVRTTFPQQTGDSAVRSFGTGDLTVKLPRSQLPDKPNVYDFKTSIMTRCTMIFLGKDKELYTQNGILHMLDRNKKSSPGHERFQNCKDLFDLILTCEERVYDQVVEDLNSREQETCQPFARWSMLDIQGQARSEAHPCVAVSHSVSSASCIQDPGPPCERDSRAVSRVEG

SEQ ID NO: 963045 - protein, 182 aa, Homo sapiens
ETCVDDADQSCWNQNSGEPCAMSLLIVKNLPNGMKEERFSAAVCRFGTLTDCSLMFTKDGKFRKYMVLLASSPRKSAQKAQKHFSKSFIRHIPVITVEFYQVIRGPGQTQSLEQMCPETNAMANAGSKRLYYSMKLGEDETKKKVGSVNWEKLEGGYRVPGVSCQFIKIAVCCMACHFCVRS

SEQ ID NO: 963046 - protein, 280 aa, Homo sapiens
MAPSRNGMVLKPHFHNGLAAARGHVVQPCLALYDPADCNGPGNANGCCLHLPLRPCVGSHPGPSVLLPHWFGTTLKVRCLACGFSSGWMLSGVPGIHKNGGPGPSAFLVDPRRRNNVHWMSLHGQRAAAERSTCSKLILFPRKPSAPKKGDSSAEELKLATQLTGPVMPVRNVYQTGEKLESSLRKRRLSNAFASLRMARANARLFGIRAKRAKEAAEPGCCTLNPLKPSWGLGNSVGSHAGSPRGVFVGTIGPGMGLHCCDFPLQGIWGAFLVTDGPGP

SEQ ID NO: 963047 - protein, 149 aa, Homo sapiens
AEMRLRHADYEKLARVNENRVHGKIASRNGVRPDSSAVDRRAAYLNESWRARHGRWLMRSRSRESCGTLTKGYKPPSSQEHSRRRAWVQLSLDRGAVACLLGVPLSFEPQTSVCYGASLLLHGQQLLFPSRVSGADEGASVPSLPLSIR

SEQ ID NO: 963048 - protein, 519 aa, Homo sapiens
VWGGGNPKNFFIITPRGARERERRKYPRAGGGGGESASSGGGPREQTTRGGEETQRAARGGREREGAARARGGWVSPSPMWVAPFTRARRRERHTRWTHRAVHSRAGVVRECEERESERESALRASGDSIISLSLSLSLVRARRARALLSRSSRRRARERERESEHHTLSLRAERAEGASHTRQTMRAHPSLVVDARVRRFVPSREHTTRARGAPHDTHATRRATTRRETTPTLYYTRRRREESTSRDRSSRRTTQRRDTATHRRDTRRAYDAAEHRAESKAPPSRSERETNRRSASEHTPTLSEEAKMKTTNKEAERRRCAEQPERKVDKQQYESTRRRGDPSTQKEDDHNADTPRKNNNTKQMNIYNQQPRKKKKDAQTVKTNNHTWDEETKHKQRHSFLLCWRRETTNQVAIQQEAKPPPTPPKRPGQEHNLHPNDGARDLTITPTHNAHRIEQRGRRTTHKHATYTPRENEEKKTHTNTSEVRSHTHSMRSNEQQTKQTTASPQQHKAKKTQKPK

SEQ ID NO: 963049 - protein, 313 aa, Homo sapiens
KLEGFKALIAAQYSGAQVRCSPHIPLPFWPKQSGSPCNFSDKFPAGKVPALEGDDGFCVFESNAIAYYVSNEELRGSTPEAAAQVGACVVSLAVFRYSAPSTVAGCCPTLGIMPPANKQVTENAKEEVRRILGLLDAYLKTRTFWVGERVNTWLSITVSDPCVVSISQVLELFFPQGFPNTKRWFLTLHKPVAQFRAVLGEVKLCEKMASLMLKKFAETNKKEKRGRREWFHGTEKQKPRLKRRAEKRGALLLGVMVNVHRAGCESKARTFRHLAEYVVLVNERQPKRHTLWAPFGNLRGGSGHKNPEITRGT

SEQ ID NO: 963050 - protein, 272 aa, Homo sapiens
HGQQGVAREPPAAPSPCQESSSRSHGGDEDRLRGLHRARHGSCGCCGRGGPRGRVGHACGSLGSRTSAGCSVKIVEQINRQARTGQTMLFGGEHEEEWLLQYATWEQLGAQFTGICGGSHALFFGPQPSARHPSVAANRPRTEPPCQLPPRPLFQAVAAILRAVLSRSGKPPMELSLLRAPEKKEKNEERRRSQEEERRMTVSRVVLAGGRGWLHCSGGCPSSLLVTAPRTEGCERMLSRAQRHRSPLLQRLRGQSLRLTGHSGGGSSGGSG

SEQ ID NO: 963051 - protein, 254 aa, Homo sapiens
GRAGVVLLEWLVPRSRWAGVRLAGGGCGRGLPAAARCRARRPCGHAMDFNMKKAGCRTLGIFFTRAVQFTEEKVLARLRTTELDAHFDNLLCPGQTGTKNWTEKILRQTEVLLQPNHQCPEWMEFLYEKLDRNGPLKGTNGELLAQYSGSAVSELWADHRPMGKTLIEGGRSVNKQLVSQRRRDVIQLASISFLRTFRQLPGGGTGRPSRRTTAAPPTTGRLDLDACKARVKKAKAEKQKPEGCLDFQETRTRK

SEQ ID NO: 963052 - protein, 271 aa, Homo sapiens
MSNIVRRSGIESVGILHLHPRNHLLHLSDDDELRSLTEEAWLDGFVHDRLDEGYVLSPEAYEKTMAINECHGRIPRESIHVGEKALVRVQCGERLDGLLYSNSTIGWVWKNLRARNYVCAEPCWRKANTHEGPWQRDKLVRLYGVSPRGGARLRHYRVRWQAVAGFLKTMQWPMGPFQKAYGFRSQDAGEMCLFGAGKSQFPGAGHRQRMGARPWREAERAAKKEQESTQERGTPNRGEHNICVSKEEERPRRVNHKATNTHRRVHKERSG

SEQ ID NO: 963053 - protein, 66 aa, Homo sapiens
PPPFSLRMGQKEKLLPLALRPSRRLHAGPEAPLSRRRVLTEKSSVSPPSCSFASVMVDLLPNVRAR

SEQ ID NO: 963054 - protein, 87 aa, Homo sapiens
ELPLLEKGFVRRNEVSPSVNEVDLPAGFLLTGPEAVLRDPGDFPSRKSEDVCLKVTPSGGRNALEYRMRRRCCSFSGRDVAIDVVSA

SEQ ID NO: 963055 - protein, 387 aa, Homo sapiens
RARRGRAGATVNGWRREAGAAARSAQIPRNFSVRSPTTFLVNAAACSCDVRVTVNGGMPEAGNVWVESVQWMPGDDSNPAVLCVCVMSCQLPLLPPAVPPAIFLMHPSPAACEPGAWSLEPESAACSLQPALPGPRRHAGCVLSCKPGAPILADLPVALVCSVAATLAAVVSACVARAVFRGTHETVSAWCHCCMPLAWPRVPWVPVAPRCNVACWVLWCWPLSLAVRKIGHGLTAERCGAENTIHDLFSYCDIEEHPRKVVVNGRVLELFRARRCRTTWVLPDHGQPWWVQQDLVNTGDRQSTWLETCTVAKLVPLKMDKLTTECTYHDKMVAPEVRDLPMTSFINRTPGDVDNHNGGRHTPTKNTDMQSTPHDTPVHENPPKRSR

SEQ ID NO: 963056 - protein, 274 aa, Homo sapiens
YNWKHKRLYYKGASQLRGGDKKKEQTGDRPFPSAKGSEPDFQDPGSSQAQRNLGASRSDSKGVSTSPSRRGPLTWRMMDRLVSSMNSSAHLGALVPENRVLPRPVVTLASLIGCTRLVSMMGGGGGRAERSVVSPLSARGVCSPIDIGVLRKGGVIWAKMSLGLAVFKVLFDQMWDLWVTPILRKNNRPALCWSSELGSVIRHSGRSLGGNWQKLGVEIPRVRRGGGPTVLGQGGVLATMWSWGADCCAPTQNLVPVAFVSGKPTQTRIALCFG

SEQ ID NO: 963057 - protein, 210 aa, Homo sapiens
MKRPNGEPELGICTDEAESLFRIMRGQAIHLETRDTWLHVGDLDGMTDCILDVFHIEAGTGMCVYVRLRGTRAIVLLQKHHVSCIEPTINILGCENTASSEFRPMVPGPRSGNEIDIYFPCHFSPSSNAFVGPVRYTGVLLVREHVAFLLVYCNWIARRRVRGFAGTSRGGTRLGGRILPSVKNPRPSRAGRPSGVLLCPAVVLSPVCST

SEQ ID NO: 963058 - protein, 207 aa, Homo sapiens
MPLTPQISRPCLWLHLSDVLMNDLLHGADETISFHRCGSIRTTHRQRLALRLDEETHEDVLSPESIVSLPTADAELIHDYSSSILDRRDCTWGYPSKKTLYEIIDNSIVYGGQYHLLKISSWSQRWIRHLLPWSSRKGARRRLVSDYGQWRAMGLFDIVLRIICNITFHSCPNIVHSGLFEYARMYPINGSPCNGVLVSPVVNRTGL

SEQ ID NO: 963059 - protein, 434 aa, Homo sapiens
PVTSVVRARLLVLCGTGDIREAWLAAGQSVLTSLGMSARDYRYYSRREKTGLPTMPRRTPRWTYCIRRAQMSMYIVDKIAWAYARMGQLLPSHLCLTYSTIDEWAATQQRTRPHVCELTYCLTAVSVRQSATGSNAIADCGWNEECIRTAKTRMSEAWRHLTYALNPQSYTLGTFPPGSSTPWTYIGPFRGLHTTGVPLEHERDDTTTCREPPHPSSHVVGIRKNVGACETNTSCREPDVTFPHGKYIASAQITSHLPSSGQDGHTRAFDPYYDWQNYIHGQPLMSTCSLCRIHWISPLIRLRPLKRYRPWLLKLSAKQTRMPSSLTHCSATSTWTRSNSTDINSRMTSYTFTRALDANPGQPTKLTHIQTQHERPSPKQGGKTTPQKPTRTPATPKTPHTKPLETGTAPLTPPTAPQAAPSNIRPPPNRTIHN

SEQ ID NO: 963060 - protein, 258 aa, Homo sapiens
EAEDDTAHKSKEESTNTDSTQHITNEQGMKIRKKYKPQHNHEQRIVSIAATNKRNTKRQNELCSTEELDERHQSQEYKEITQKNTRQSNLNQNTTVTDSDIEKGGRRAHWSEERKAESSVQHEQRAGQENRLGRKKKAFKQSRNSRGRGGSSTRRTGLKDKDDEQNRGNVQVKGKVRRRVTRYNENNSNDLLTERQRDRGDKTGRRQRARRKTESTRRQRRKIGRDRGGKTKRGKPVAEKSRGAERAQRGKADAGAAR

SEQ ID NO: 963061 - protein, 294 aa, Homo sapiens
PARYVSLERRSFISVRLLSYLSACRHPMARFDWTWTMSPLQAPELSSTVCATNRPTKHYHFKVDELTDQLSTSYIFTEPRQLIRALCAHTACAMHHRSHTPEATLTLRKQPGPTSTANPPGPTSLHHLLLIRAPNGPNTPLGERHIETIKRPPNPKPGAPSYTGLLTRRNARASPSGGSPRWQANFYDWGPPSNPYTPITALGSTTPEPHLRKKRVPTNTELDRATRTLPGHRFTTPLSFHTVALSSCGNNSRGYLRPPIGLSGVRPHHTARLYPPPGIHSTRSSLHPLRVIGA

SEQ ID NO: 963062 - protein, 163 aa, Homo sapiens
MVVETLAQPGRSNTRTYPRPVTDTITRTRATNHKVPVPLRAHNKHSHCSPTTCKNTCSCTHATMTSNSRRRADKPGTNGSQTTELSCGLARRYDDLSSLTQRNAGSSIRSITRLRYRRNSRERKHEPNHSEDVSSQSSTHLKDDQSKEITSYEHVRYHIHMIT

SEQ ID NO: 963063 - protein, 249 aa, Homo sapiens
MRYVVSKIRDETRKYLCKVNVTLANHIAEQRESQLLRLLDESRAFEPAAQCAMLDRGAQMYLTGTFQPHEAQLTKPKPIVSSTHTLDLATKCAINLSEHRSQGGTLVPTTGMTHTSLPAEFPTVNPLEPERPQHKNSSTRWPHILQHTTTNHVLTRPKRPMDATHLAHRRTFGTPQLYPRTPAGHTWNRTNPRTPHGHYSHIAARTRLTRQHIQPLRLHTHAAGLTSSRWHLSTIHYTLSSHGTNHFAS

SEQ ID NO: 963064 - protein, 156 aa, Homo sapiens
MASVVPVTGQETSGGQTGDELPSWDLDAGLQVLSGISRSVSQRGHYRVLQQCTFNGARKGSISGNYHGCLGIATDGPLSITPYTHTEHSTMPRSRDSRQYLPSLERSDHNFLQALLQILTVNPIGALNGPIPRRSENHLISFKIPVYASEALPCST

SEQ ID NO: 963065 - protein, 57 aa, Homo sapiens
MLCGGEILRGGPSQRTYSAQKWCHPRKPPYNRRSSPANVTQRPRIAFTTRKRNTGVV

SEQ ID NO: 963066 - protein, 148 aa, Homo sapiens
GERQQPDGRVLMIRRQRPPSSGRQGVQHGVRYLKRIVEGILKLAFLTEQRLYNGLTTFLGLMGRDTWGEVWCFTQSNSTGHDGPMPTCGGVGPFPGAMYATFLRPLVAIGPGFFQAVPKSLPLICDLKGPQGLSGKARWPIETRRVPG

SEQ ID NO: 963067 - protein, 60 aa, Homo sapiens
MQDRRNTPPIRNRRLTETGAAPRPPENRQHTTLQHNGTVTSRATPDTTINKRRETAVTTH

SEQ ID NO: 963068 - protein, 399 aa, Homo sapiens
ISCLVLMFPRVSTVPTSSAPFPDQPIIVLMECHGDNHAADDYMLHQMIRASEHVTVTCMYQAAFDMALAPQNITIPKGKLYGAHNQCASCQPSNAYSQSVLKLEWQHFTRQTISSRPKHQLEPGNHYRTTQALEQGNQSNGAMHKSHIPRPQPPLTRNQPDEEAPHNSKDPCDDTQAFGDKHNHPMGPAASATAAYHGKIVASQTNRTNLDEPPLEVPWQNRGRAKDMANPRHGRAPRNVHSTPSNRTTAKHKSNTVTKTGRDSPRDAQAAPSRERPPHGANQPVHCQNEHPQPSSCHIKRHQVARASRTPHARSALRKRSTKGLGTTHHDTAAAHGRGKRNTTTPPGTSATRPNTTTHGQPTYTTATEKHTTDVQYHTTTPPTTDTNPHDRQRHSQHA

SEQ ID NO: 963069 - protein, 252 aa, Homo sapiens
MVTKLQLIIHSTSRSLQHSMTSPATQLAIPQMNRSSDHCAVLCTGTACKTHWHHPTTADLAHVYDLSHDTPLYTLTLRWAYALLALCTLHLTFTYNVPGSPYQQATPRPMDVNHTYVDHMAPYTQTHNTRTYNTYSPTPISNGYNSNSSQPSHTTPDHPHGSQQHYNQPINLPRDHTQPWPQHTSYLPQAHTATPQPTTTARFKTPATTEHHHARAAPNTTRRHRRPTTPAQGARPETAAHARRARARARPT

SEQ ID NO: 963070 - protein, 113 aa, Homo sapiens
MLRTLAGRSCSRLLLYSAWLSYLPSGIFPRSTGPIRIHTGLTCYNTGYMGVPLGTWHYLLGPSLNSTRWSAGTRALNGTPPTSIRLPKTKSHLTNSALPHPTQSHPGRAPPAH

SEQ ID NO: 963071 - protein, 274 aa, Homo sapiens
MIALIAGTGNESTAQRGSIVVPWMGHPKGSPISPFSQPPLSAIRAFCAFQASRPQVHGRWTYLSLHTNNTSPGAFCRTWQPYSSPAALHHIMLSIFNVRNYMRRVHMRIIVTIYPPVSPFPPCDTPFTQMRSPWTRSKESHKALGVERTNITCGDKGLTRWKPSPFTRGSFLYVAFYMVYSPEELYGPTPIGPQSEIPFLGDRERAPCGTETLGLAKVKHGCTFSRTTQESKATPNNLWVGLSQMEHGDQLFPHHRAGLWPLNTRANLGALNFG

SEQ ID NO: 963072 - protein, 225 aa, Homo sapiens
MTLKLPTLTYYSHLHTVTFILLFIISHFTITYITLAEHVDQLEHAYSQITCCARLYAGTYQDVYRRSPDLTLHHGCTWSDPTDHWLTTPTITSPLPLDHTNVGNYTETPTLTYGGQVHGYHTPSPTQAHGFKQHYTLVYGHIPFNFQSLHSLSLWALFTTPLLLNLHYPPNWDTVDTPPHGNYDNPYRGHSRVTPEENKLEETATKAYRTKKKQQINPKTHTGYH

SEQ ID NO: 963073 - protein, 104 aa, Homo sapiens
MAVVLCEACTIPYMTTMPCGTDDVHEYTYYNDMLGLKHVPTNVLTFYWNLNPLAHKRYHDSAKHTRPRLSLEDFTTMKPYRTHFLHKLTFARTLNNSNGIVPDP

SEQ ID NO: 963074 - protein, 107 aa, Homo sapiens
MCPRKSMIRSKYRAKVMATNTCAEHHLIRLSYLRAGWTGSESTLVSLHRDYKIDPELKGKWWDKYARRGVEEKFAGIGCNCRSPAVYETYDSTLEKIIYNWQFSMLL

SEQ ID NO: 963075 - protein, 217 aa, Homo sapiens
PPSQVRGYILVVRRFLSPSGKAQYLGRSDPIFQVPSVTPFFDSERELPDPLRFPSEAMPRPASARAWCSLPLTCAHCLALPSEMNPVPQLEMQKSPVFCVLTLGAVDRSCRQELFLYGHLGSSLTKLEGEHLEGLLIMSKGTGFAWRFITGQYPSLHDSPLWGTAPRDFNKPWQHQRMEPPSADFDHLAWLMRPDSQTHTAAFAAAHTALRYNAFNH

SEQ ID NO: 963076 - protein, 150 aa, Homo sapiens
MLFQTGQQLLTCGGLGSLRLYLTKTNTTTTPSSNANVTTHTLYDPPSLLLLTHALLSFSTLLSSNTRPTLPCVHSTRHTTPLSTHSCCFTSTAHTLTLRATPNPNLLYLWPQPILTNNPSLAYATHALLSSNSLSLSHLWHQRQRTTFSL

SEQ ID NO: 963077 - protein, 147 aa, Homo sapiens
MLYLAPSILCRLLGPFPVPDENLVILASQQRLVPAVSHRLPVAGDASLPDPGMTIAHLSSCVGLLGGLATASSSSSPILTPSCFGGLSLLYLAGLSEHACPLLAVRPGLPFLLCIALLSPPACSRHRLLRPSLSSCPSATVSSLPSR

SEQ ID NO: 963078 - protein, 191 aa, Homo sapiens
MASLRCDDAGASMTMCIKTYMRSGSCFKADAEHPTIVDCSPRPWDIRSPLTATTLLLMPRKYLYLTFVRKWARPFGDSSDIGKDNLNYKLCEREQAPLTIINYLMFENRAKYRSYQVVLANDRCSQPGPSLTRGGSGPLACDRWIHKHTQTHAPTVDHGPQTQAMRPVPLGGINLRLWDPRRDQESTRDTE

SEQ ID NO: 963079 - protein, 348 aa, Homo sapiens
ARLLAHNAGDLGLRLTRFSLLLKCSSRPTLVPDAVPMASSNTAARLRVWLALLHILLASTHGRNLTSSRPLLYLPDTDAPLALLAAHASTCCQPRPCTHQPPDPTWPQTAAICSLHSGPPANTLPPKPPTNSLRGAHHRILPLSAAERWTHPSPDLRPDQPQLAHAKLPGPATPQCPPIRAAYPAALLQLRTANSNLLLRSVGCASHTANWPTPKANNYPENRILSFASPWLNHALPHLRRTFALYCTRDNNAHQPKRRSILNPDPIIYHTLLERPRTPPTGPGRTRSRGNKSWREHTNGHSAAAIRQHTTLGNKSTHGSDTTPLHSPTDHPKPAIAPHAPAYLDQAH

SEQ ID NO: 963080 - protein, 327 aa, Homo sapiens
TARLPRLVHALCPERKRLARHAPQLETYTAPLNELRNRRNADQLRCRRAVPPTYNNAHLTLTLPQVLLSALPNPATAPSTLGFALALRAPPHLSLPANTPTFFLCFNTHLLKPHLLLRPYTTLHNTSARTLTTGHAWYPETHFSPHLIGSPTTQQLLLHHPPKTPTAPSSSRNANAHYNSWTPSPSPGAPHIYKLSHRTFFIPTLGLRFHAERLLKPSGKPPKPPSMAPSSTAPIPLQLAHAPQTPHRHAASPISSPWGHTYAPLTPNSPFKRTEHYCTHLRPLTHHRKPATSPNLATALAPSNRTHARTPGHTANFAQSTQLPLHI

SEQ ID NO: 963081 - protein, 320 aa, Homo sapiens
PQELKFLVIFARLEELEEGQKGARRRYSYAGALKMTERYDTYKAGQATDFIAATKAQTYANTELYSPESRMLDLNTHEAPPLSLDFCNNKLNMNRNEITSSWALAAMPRQPYQLLSTNGNNFILALKACTFKQPNDDHNWCSQRTTMTASTSHQTGTKHYNQLNLTLDLKTLLSQHPTTLPHLHCLHLLLCTLHPTSHQLPPNSTPLPSLPQHISQPCASHHCTLRTIRLPHSSFPPLPAPHPHFTASPSRFTPGRRTQRGLAAPSPPAPSLWSRVPPRPFLAALYIPWPVYCGHTEHLSAAPPPSLAPPPVAEPRSPWP

SEQ ID NO: 963082 - protein, 137 aa, Homo sapiens
LFIIDPNGVINAILSAQRLSQPGPKPWQRNPPLWLKAFQICRTHMAATSAQRNWHTAHFSLRLNATAPRLPSTTSYLFTQGSTLTLALTPLLLYCTLRQACRETNPTTLRTHSCPLLIQLFSQTHCALTLSYATVHR

SEQ ID NO: 963083 - protein, 257 aa, Homo sapiens
PFECSICGKSFRCRSTLDTHQSNSHWLKGLMSASELWRHTSLAHKLNIILTTIGANSLSDDKVFAAASELCAELFSSNIPYLIRSPNKFTSEGKELTNCTQMWRTFFTATVSDTPLAHAAAVHYWQTNALLQLHADMLGTALIALHTLSPHLTHRENFTSGAADPYSRAPALLAPPLLYPPPFSLSLQLSALAPPPAFKHLSLLPQTARPPSPPPFSSAFRTVDLRYPLPSSCSSFSFPILYPPTPAHAPSPAPPPP

SEQ ID NO: 963084 - protein, 393 aa, Homo sapiens
DQRSFLNPCYCSLLTGIHRTLLIRKRLRQLTASSPAPHVAFCSGALTAPQLSRAAARTPHSRHHCSISDALLRHTPAAASLTTPPLDSPPLHWPRNCLLAHLALSSSAWIPPISTSLSSHAALYFLIYTLDPLGLPTTPDTHQRHFQRNTQFYPAHSTPTASTPARPPLTLPLAHTFHFFQPAHPTVSFLVLPTAPPHSTLSSTTCLRTLLNLLHNTRTQLPLHPTYNTLSTPYSTTPPPHPHTFNTPYLQTHHNPTHTSYTTAHTPHRGAQPTYITPPHPTTPHTPGPTPAHPNAHDTPTPCPHTLATPTPVTTSRHNHPTQPLTPHNSHTTTRAEPHRRHPPEHAHPTTPHPQRTSTPAPPPTRHPRRHTHDTPTTHHPRRPPHTHHHLTH

SEQ ID NO: 963085 - protein, 344 aa, Homo sapiens
MEAQTHSGRLPASNGCNTLLQQLLASNATTATPKHTQTHNSTDCPALLTAYLNLSSYTYKRTGSLLPLLLLPHSTSLATLSDPTSSSQDPHNSSLRTTSLYCLPGTPTTSPSSEPSHPSCTGTPSNPLPHATRLSGTTPLRKQLPLATLLLTYTSPSPNLHLQHPTARHTTHSPPHLAHTTNPLSLHHTCSNTPHFLARQPHRLFPLTHNSASLSQALTPHTRPPSHHSLPPSTSFPFPFLLPLSPDPTHPSTPSCPRRTPRPHSTSPSPLAPPRAAALPLLSPTFALPFSSRPLTRSSSPPISHPRPVALTTPSSRDPSPLASRPPRSGALSPRASRPLVARP

SEQ ID NO: 963086 - protein, 442 aa, Homo sapiens
MKKDNKRSRRRYSLAGALQRLTEDTDTLHRLDTALTSTSGHHRHKLTETQNYYSPATAEQLLDPTNTPRKPPSASALSTLANTHKHLHYCNRAHNTNFSQLRTGWTAPGMALNLRLLYAKHTAPNNIPLLRHSTTLCYPFTRTPSTHRLLHWNCSQTRTHTYLQTPFSPPSPHPHANGHHTPLTHRHFTPFSYALAHVIRIPLAPSTLLPQPTPFSVPSKWRSHSLRSLSPLSHTTSIRTHNLGRSRSLTLPLFSHGLSPLTPHSLPSALAYCSRSLDSPAGAHPLSGSHATLTSLAQRLTHWALPTAPILPSPSPPQRPHTPRRLLACHPLCPACPLTPAIATSPLPLAHHRRPRFAPHSPTPPRMNTHRRNSATPRNDLHRTLPQRSHTHRTGQHPPPHGTHTRARTPARPHRHTAQPTALPTHTRPTTSRAEHQRHTSH

SEQ ID NO: 963087 - protein, 84 aa, Homo sapiens
MGRHGYLLHMSSKLACDGVGNVHLSYIFDDELSSRGEYEGDPGRYSLVDAEVDIGCGERGPFAPGELHFVAGGAGVCKPAQRRR

SEQ ID NO: 963088 - protein, 109 aa, Homo sapiens
MHSSLGNKKKKKKKPKKLVARAGLWAYRKKLSRKPTPVGPAGRQVVGYTSGHGGPNGSLPKETLRGARDPRGGGESFTPNIKHRRGGHPERVRGSTLPKGAVREGTQAG

SEQ ID NO: 963089 - protein, 374 aa, Homo sapiens
ALGHSASVHGCLLLSLLMDARLLIIARNSACSWHGLVFQNTEDVRNSSKPSLGPERSFSTLRQSRRPYHSTSGSRPGRWTGTADIHTRSALTQPPIYDTANRTMLDQIYTDYTHEARHASATQVRTNHNALKTQTTTISSWDIPSPRSIVLPMTLFHDSPRIRDVTHLAKPHSRHPHIGISRQGPEEQLDLAPTAAKTPVSNPLSQSHPALQAIPRHQLWWPWHTTPTYSYTQPSHPQNAHQDDPLKANGPHTYHHHGRTRPTHTTPHSTGHRWAGNSLTPGTIPPQDRNHPEQGSHRTDCTGADTTEGDPAKAMIHNALTRQRCNWGAPNGYQHRTQEGGTTPHRPANPASDTRNAIVSTPLPGQHNHNTVAA

SEQ ID NO: 963090 - protein, 145 aa, Homo sapiens
TSGPISGWASSILVTLMSGLADCTTDAGHGSGVRGETAACPSSHRGRERRDFDGALAFCGTKDFDQDSQYALLQGLLTSWTLDEWLIIRGTKQQRAAGQDAISSGNCGSGHTSLLTFPPALCAAKHRMHWNDDPVGFQTNLFTSR

SEQ ID NO: 963091 - protein, 133 aa, Homo sapiens
MPRLALSKPPATTHTTADAFAATLIYARAGLSHATTDSTTPSPGTDSRYLAHTHALDHPHNLLHALQLDPDPLTTAHPTTHNQPDRPNPGPDPISHSALTHSPRTHRHGPLQTRPSPDSPPPSSLGHPTKNHR

SEQ ID NO: 963092 - protein, 400 aa, Homo sapiens
LRKPDFARTRAPRFAFPPQPCPDNTRLLADALDDTLRTKLEHLNDSTEHAQQTTSTCLSTRQPTRNQDERTATANSLNARRAPAQLLPPAHTSHHSPLCALSFISYTLSLPLAPALYTLPWLHATATHRDAARATSTRPLQPHAEPQWADPLGPTTFPNPTPTTQQALTPVPHTRNTGPGPPPLGRTSRPTTLPLVSPNASPNPTPRRAPRSPNAGAHNRRHTHAKHATYSGPPRHTRRTPEPPAGTPRTNAPWNGDQPCDEHTPRSHRRSAPPPVGRPTPDTPTPPPAPASRYNRHGTNDHHPPHYTRALCAAPPPNTARRTDSDHTADEGDQNVRTTSAPFTHPGRSKHGLTLITTPPTDTKHELGTAPQPDVPTPAYRPHRTRTPTPPENDSGPQDD

SEQ ID NO: 963093 - protein, 459 aa, Homo sapiens
LCIALVRHPGYLLSADTRPAEESSAPHRHVARRTQRPQAQELTDLSTHSALHYSNSLQPRCAGASALRSHAALPASTRTLPHAHYYPPLAYNPYTCTHAHTVLTPHKAAIGSNLHGHALTHSPALSAPRANTHTPHPDTPRHHPPLPPSLWPKTGKRTGHAASARSAPRCSPTRTPTYRAERAAPYPGPHTRAHPWPYPLIHPIPKAQLFRGIYLLYNHAASHATLPTCPFNISYAQTSLWSPPSLGAFSPSTEGKHTLGHPLTLKPRRFTSRSLLSHPLSFSVVSKFSFPAHHFITQHQSIPRIIKRPAYPTLSYPRYQPYGAYNYTWRGPPTHTAPTLPSGPTSLTNHTTINPTLRHPHRPAMTPPHIAGAANQWLPRAKTRRHRHTHRPPPPATAAAPRQPQTTTTHPPGRTLMDSRHHTSSPPPEYCSHPQPLTHTRPTCRYKNADPPPSPTTAR

SEQ ID NO: 963094 - protein, 404 aa, Homo sapiens
MACGFSPRYCLPAFQSVESSTQKHLHHINYLAASNFPNNRSKLAWLFSISVDFLLLRHNKTHDPFKQPSTISTASNAHTQTSPSTNAYTMLHHTLAAAATSSSPSAPTATWYNSLNTITTQQQSSSPHPQATSLPNPNQRSPLPTHWASDTPSMRHFNPPGLAERILQNPSVGHPFSPHRGQQRTQQTLAGALRNRLLRGQVPNPDNSCVRTPTNPPALPPTRLRGAPPAMLGRPLSSTPARSQLPRATTLSPPIHGPKQLRFLTHATSTCFQAAHQFANAFRTQEENLPPGVNAFGGRNLGQGPPGQAPRGGLHTHPWGGKHAAPFTPGPRVNPRGPYTDARTQLTPGATMPPQHDPPHKTSPHFPIPSQANPTAHTLHQPQAHFPAPPHSQHSTQPSRTSDS

SEQ ID NO: 963095 - protein, 381 aa, Homo sapiens
MAIFGPTIALPMDLINTHLKHDCILHTGCSLLHRSQRSKGNFTSSKHYAYTRRSLHMHQKPQLEPCVYCCYRHHTLTTLTPHTLSSTSLSSPVSHIDCIDNDIKALLSTKWQKLSYTPRLHGTRLHAPLCDQATHMRLGLTTPRLVSTLAHFSHNGLPHLSDLHSPQLPPQPGPLTLDTRFNLSRTHHLGMAPWAVCNPHTKGPITRPPRDHNLHTWQPTGIPSTTSTTPGNSQNNTAQTHTGSLPPPNTAAPTNPSTQHRNIDPMGHNNAPKTNTPTPLGTILCSTSTDNPWESTPLPRTSHTSQHLQHRQDPRHRHEQQNPTFAQSADTQRGLTEANIYHPWADTSAAATPYTRTLPTTHHRRNVATHNKPTLAAPRSA

SEQ ID NO: 963096 - protein, 310 aa, Homo sapiens
TSFFTGSTSHVNTCVWLTHSTQTMGPRPAAARRCSYSCCPHRLHSYKYAAGVRNPQQHLTAQPQAYNCTSLLLHVHGSGTFGLLPRSAICPSSRAHSQLSAVNAPVSPTLFKPTATLSLCMAHTLHMRHGRSCRLAYLAETLCLSASPLSRPLPSVLSCAPPARSLCLSLPSSHDSLSEALLSTHPHAIHHLSYLASFPNLVPLRLASTVTHASRTPLHAFTLAPSPLSSTQFCHQPSNSLHSRTHYKTRDASTTHPHPACTTGRTATAADHPTNKRVPLSPEPLTPTIERTPQQRHPRHPYTPSDRPKR

SEQ ID NO: 963097 - protein, 159 aa, Homo sapiens
KAPRVKAKIMLKVPMVPTTPEADNDLPGRRNNYWFTSSISSLNCSDGCDQYFLPFELADSNLRLMSRYWLVLSHSRLLTRRLPKAQPSMASIGLVSYCNDALSCNHDTIRGKSTGEKLSSTLCNTHWATSVQEDHGYYFVVCTLDGTRNKFRLGPITFC

SEQ ID NO: 963098 - protein, 122 aa, Homo sapiens
KKKEKSPPRPPRKKGGERFFCFVWGENPLGVFHLSLISEKLGVGQKVRWRKKRMLREQSAGHSRTGKQTRGNNGRLAPLRTKELYDERENIWVQPKKKPLKRSPPPAVLLLFRPQFFVGGAL

SEQ ID NO: 963099 - protein, 391 aa, Homo sapiens
RRPHRPHLRDTGLSAQRLGITPGLGAAQVLEQLGATGIRSAPAPTRHPQESPRPARGRTHLTACILSQTHASPAQKQHQAPMRQTPMPLDPTRPQHAPGPTRTTDAPTHPGINSPASRTTPATPPPLPTTTPPPHTLHTPPTPQRHKRTGTPHHSHHTNTGRPQLTPAPQHMPHTTRTPPTTHPPQPTTNSPGTPPPAGHTTARHIAPLARHPATHSTHRLHSTQHTPQTTRPNTDNTRRMLHTPTTLAPTPTYAPSRAPPRQHLQAATTSTRHNLRSRPDPDTRRHAETDESSPPTTRATPTPPPPTHTTTGQPKHPNQYTPQSSQTPGTPPDTPAAPRHRRPGHCAPHPANHPHADRPDSPHATTSTNTRPNNTETPSTPRPHTTPTTG

SEQ ID NO: 963100 - protein, 410 aa, Homo sapiens
CYMASAALNMCVNRFMHHTCPRIAMTLGTPAWGHVYQLTWQSTSSINSLQTHSLSSRLSGKSVNSSLHSTPHANPATPRTQVSTRAHARLSPLGTQKTGATALRLLLDALRTTPSSCSTKRTPRLDLGTATHVIAHGPQLATLLAYRTYTLPRTCTPGPATATRSHADHTLGTPHGNWHRATASGHSNAHHAAGTATWPPDDRGQHRPPANPWATHVAPHPTPRPTQTTAGTNPSPHPDNSFTAPPARSNGPVRTTTHHQSPVKQPPTPPPTLWAATQRNTPMPAGQAPRSRSLRQVAVHDRLGPSPPYGAHTSPTTRSRAHSPSLRQPTHSRPTHTRHPHTDPVGHPTSPAPLCAPPPPLPLNAASPARRTSPLPYPAPSPAAPPQLRSYCPRTASRCHTSPPPPGGPT

SEQ ID NO: 963101 - protein, 113 aa, Homo sapiens
NGGTSGAYYRKCRRESWRPDGIELGESSIWQQTVHIISVCKIGYHVMTWVHDVCTCTCVCEHISTTVTLGVRLDVKGVDANSLKDAFAHCVREYYRGFAMSAYSYGTCLLLPR

SEQ ID NO: 963102 - protein, 334 aa, Homo sapiens
MKDNKTNGTTQDAIEQGCLVEAKALYNHIKLIPRYPSGTEFSTDGHTSLHHHSTRKLPLLLLNLALYRQMPTQRAHCTASSSHYHAHCTSALSFLLTPAALPAKPHAPKLHVTTTSTPWTRSRKHRMHSQQLPTSILELLASQAPTKPTPTATTWPSPPHPGTLTPTPHLNNAKPQAPQPQHRPTPLHSTLHTDPASHHPRTRTRNSYTHYSTPPTRPHHRGHDHARHLSTPPATYPNTGPPLRTTPTDNAPPALHPNTTATRWAHKQINRGPLNVAIPQRKPYAPRFTKAPNHHMQPPPRPVPHRGAHPPPPGTQTKTTTALPHHPKKPTSSS

SEQ ID NO: 963103 - protein, 132 aa, Homo sapiens
GPVRQLLLSGCTTEGILCETHPLLHIAEHINTYTDHTSPGIYTHQHMEHEPHMASRRGPMLPTSPYLPRILLPQDARPTPSAFLRHIPSYTINKTNSNTHAEQGIQEPHKGRDRDHKTTHPHIPRDKSNREP

SEQ ID NO: 963104 - protein, 101 aa, Homo sapiens
GEAGAVILLKCDEDVAITRGPVTVSLNEHNRAIARSGNRSNSKCRTIHGIWPGLFTNTPGINSCKTVSDQNTITAANDIGKHTQTSIDVYKTTGAQQKQAN

SEQ ID NO: 963105 - protein, 343 aa, Homo sapiens
RRPDFARYSVRHRFAFSSATMSDKPDMAEIENIRITVAHTARTAQQHASSKKSTAFPTHNDGTQAEASQAHSSLQAMRPDTPMQLITVSQQRHSAHIIYLLALRIIDLVLNHIANRHAPTQGCGTHTFIPVQLVAGPPWFHQSNETITCTNAHRDRRHLDHMIHNRGSYSYSGLGQGTRKRNHLSTGYGVHPDRTRGELGPRPKGGTGDRTRMTTVLQDLQHPNRWEPHRGGPLARAGTSGTDKHYTDVATVISKQHGTHTFDILTRRLAAPCAQQKQLKKQAHNTQHTCNTDTHKNTKAQQQQNKTRTTHTTHTRSNQPKSHTSNPTRKSKSREPAKKHRDS

SEQ ID NO: 963106 - protein, 158 aa, Homo sapiens
MVKKLMKTIQKKFTMYFVSCLRIPLVAVDEIAEDNDVMFLEMSCMHEVGSNLTQCKSGFWFLAYTLQFTVCGLYFGNPKELIPKVNIQEEPWHFGTESTTYTIEQEVKDTYTRPTNRSAGQSSPQHVAQLQGLSVKQHWPLLADTNNLKQMHIKICCQ

SEQ ID NO: 963107 - protein, 95 aa, Homo sapiens
LSGCGGRVSETGSAGSMADRLTEEQMVRIQMKRFFTYLTKMVSGSYNQQEEVGSCEIEISWAVIPQKQELQDMINEVDADGNGTMTCPEFLIMNG

SEQ ID NO: 963108 - protein, 260 aa, Homo sapiens
EWLRRVSVTEVADSVWPALGTRQDWGLHSLVAFRRLLLLYDTVETMGKDYSHQTFRFYDTGVTQKYIEILHCMTGIPVAIFITLVNVFIGQAESRQNFQQAMYQNTWELLKASHITLDCTVIFYDSPERYMTEHMDVLQIEAAKAELYGYRSDRAKIDACAEEIGPRSTYHEDQLDKLTPIETKHPKQQIPGPIRHLNPRLHVTHQQLDNQIPNYNLEKANEHTHEHGMRHKERTDREQRESPHQTGNDTKEQQAPTHTS

SEQ ID NO: 963109 - protein, 82 aa, Homo sapiens
GAVGRLLRASVARHSYVAIPCGHFLPLAGPQCHCLHVGKNTKHLTTHINYVVHSVSNVKANNYFMQPSSLNAIATLLVQPDN

SEQ ID NO: 963110 - protein, 169 aa, Homo sapiens
GVLSPGNRAMTEADVNPKATPLRCPPHQEANGPRQQSCTYKQLRKGANEATKTLKRGISESIVIGCRRRAHWRSFCTCRLLCDDQECALRVSALQAGPWGEPEWGLQALSSPVLVTIKEGSQLETADPIQFSSPFERALSLNLFASCNGCSLPVSPPCEGGVASYPLVC

SEQ ID NO: 963111 - protein, 69 aa, Homo sapiens
LLTPAGPQAACGGTPRGDSSKGEDKQDRTMETKEALQQGCTSKITSHFDQEQLQEHLQPYGMSIDNGVS

SEQ ID NO: 963112 - protein, 209 aa, Homo sapiens
MAVGLLPFRFPPPGKALLLCGSAGEERVCGIVEPGRKNQRLQERGAPVLGPLPIPGFAGERPLGSFRDIGAEQAGVLLGARLGAPWWESFASPKVGKTNTIPLHYTRSNHCVVAAPYRTDEKCLVRTTIPWCGARGAQKVEIGQRGHLFPPKEHLRVSTRAGLCFHTHRKTAGGQREVLVENNSIVGFEGTYGIYTGSQGPDEIRTACR

SEQ ID NO: 963113 - protein, 104 aa, Homo sapiens
MAHKKTHAYSRIVNLHSGRITVAYLERCFQEHRTNPLDEWPCDMQATIAAYTLPRSHHNLVVQSDRLHRTMCTLDEKSRNNEDLASVIVMCAGWLIVRSVAFMV

SEQ ID NO: 963114 - protein, 310 aa, Homo sapiens
TGGGTGLLFLLLGSPDGVSLCQTRMDLISRPRDPPASAPKVLGLQAEPPHQAYCFDFKNEEISLSETESLKPRLNSYTSCAPGHSQSYSLQLSNTYLTMTKLVTSAALPKPGYIQNLRPFPKLQMLLASIPDPNLAHNMGSTLTPANWPDDRYPCASPPYCHKSFSSPNCIAHDTTSTPDITTSTLTTKGFSANYPTTPARTIFPQQSTTAQGKYLRNQMTDYNVYARQQENLTPGQQHSKTSCPSLAVPSTRGLLNHSYRPCPPPSQIKTYILPLIYHRLTSPHTPFTPYYHTLPLPSTLNHHFAPNRL

SEQ ID NO: 963115 - protein, 143 aa, Homo sapiens
PSEPGVGYSLVVRRFLSRSEKRNIRVGVTDFPGASVTPFFDSERELPDPLRFPGEAMPRPASARARCAHPLACAHCLALPSEMNPVPQMEIAEITPSSASLTLGAVEPEAVPIRPSWLLQNKPIFWRKYNLLKTMMDNFFGRI

SEQ ID NO: 963116 - protein, 177 aa, Homo sapiens
MVFNHSTKERAASRVGKQRGEKSKNLFKEYPRFLRGILTPCRQPLQTLFVECPLWDLLALSCASPAHGTVFRRYDTFGGRTVGFLPEICHHLIAPLELQCFTLKWTHSCALSVKPPPVWSPACCMLSRLHGEFQTAISPMILNFCRTAFTWQRNASFVTSPLVRASGRTRAWDPPAL

SEQ ID NO: 963117 - protein, 119 aa, Homo sapiens
MASKGLQDLEATRWRGPSKEAVSADRSGKLQETWLTKANRRRGTRQGLLCTQAWAQRTNPGNNPIGTKALLPQGLQEEPYHQANWARPKNIFGASLYRKISQQHKGEKHHWAISGHQST

SEQ ID NO: 963118 - protein, 234 aa, Homo sapiens
MTEARRWSKGSILRDRCWRHLKGTLIQGKACWGIFRLPGGCNPCRGEWHSPTRFSLECKPHPVRALEGDFDNTYPVCRTRKALPLVGVELPPQLFGSKTLLKFAARANERLSFTHNGPEDHGGNTLGRIVTFERPPKPGSKCSKTIMNNGRSAGLNDWWNHVGKFQEPGTYKLVLVQDCLPEVKLAGYCPEIPGIMGDAAEFPVQTTDVEFPAGAHLEWHLIAPTLVHRGSSPR

SEQ ID NO: 963119 - protein, 127 aa, Homo sapiens
VVVSVVAGCWLSNSQDAADICWLFVRMWAEDDKHLLPAGHFKNNVPEKQQTVPARLMHIPLYLKAWVADAPPLYKSHHDSYSCVNSIMPYMTLLSLHFPKKPGCDLSSPSPAIACVQFPSALYGPVI

SEQ ID NO: 963120 - protein, 252 aa, Homo sapiens
MPSEDRANLEVQTTSLRSSNYVMIIRNVSLWEQTIVGSKQNAADPAMSLRGKACGADGQRNTMMRRGHPEAHPWEKQTQPLGRNSWLASLSGGHLWALVVFHPRGTGPSLEDSGHIVVAAPLSVPACLPCAWCAICPLLLKRSLVPAPRKHVVSWPGERTLPFFPEGLLSVIPPTKKILPGAPPIWKHPLQSGLLPACIQGLCGRQHVVAAQRNAQGCWTTIASNILPPFLLVGLAPPSTGWSDNWGGILQL

SEQ ID NO: 963121 - protein, 326 aa, Homo sapiens
MVNFGRRYRALANVLASLWALGYSWPMDMAEQPLYKSIYTTGRNLPGPLHNLTYVGWTEWFTTGLAWDLTNFPHGPPGRRLPYLAGPFQAAGLRKLGNVKKPFLSIKRTLGFLMQFKPGLITAPISGDPFEHTNTFHTGYKGQPNRWGRPPETEPRKGSNPKTQCPINLGEGRTGNIWFPNGALGKLPRIYVARRHQSGDNLGAICRHNIEASHVGSHTSVYSLPFSHWNQGPSFSIIVALPQRPRGTGAYGPPNGFVWLIATVVVAGQGLNRPSFPNWDGGMKRPNPTPITYGGLGQIAGQITTQYYQPLWYPPVWDRFRPSGTT

SEQ ID NO: 963122 - protein, 110 aa, Homo sapiens
MRISSHYKVHAPAGILLPTKHYPGVAVIRPVTSVGTRNGPGAEEIVRGVPWAVSRFGFRAAGFARYVVPVACAALGRVLLHVIVPAVCVRVRLSFSRSRRSASQSCHRRP

SEQ ID NO: 963123 - protein, 131 aa, Homo sapiens
MGAWLSWVSMPMRFVVCNPRSDEKLSASSTVVEGTVSWAFSDTESGRWPLRCPRRDGGVSVLYRRSRGLACTRAHRDSRVEGLLWSVRVACVAACGHLVARVGLNMELPSFMRVLMTLVPGVEGPDYDWPL

SEQ ID NO: 963124 - protein, 142 aa, Homo sapiens
GPSVGSLVGPRVVVLQFTRLRLRVVQTRGTGVFPWPAEGGLGLRRISVCPLTPSGFANSVGKENLGWIGGGRLGSPCGTRTFALCLTITFFRDKRGTKVFPPRRRGYCGPQPRLGFGRQPHLLAPRELTRKGLWHIGTTRQR

SEQ ID NO: 963125 - protein, 289 aa, Homo sapiens
MDDDIAALVVDDGSGMCKAGFAGDDAPRAVFPSIVGRPRAPGRDLVGMASVRIPMCGDEAQRQERHPHPEVPHLSTGNRQPNVGRLVEKIWHHRLLQVMLRVAPEEQPRAVLTEAPLNPKANPGEDDPLIMFEDLQHPECMYVAIQAVLIPVTPLAVPLASCMDSGDGSPHVPYLRGCMPSPSAILGLGLLGRDLLTELMKISPSAVQVSQHGEREIVRDLQGSCCYVGLEFGQEMARVVQLLPGKSPVLEGSVPLAYAGPARGGFNLLLGEAVGPTNSSPDVWVPRLF

SEQ ID NO: 963126 - protein, 382 aa, Homo sapiens
PRVLSPSPRPPPPPAPFPPRGGGAPPHVCGAAGGCGRVSHTARASAPGVHYNGVLHDGARAGGEGCFPLPRPGVGPVCAFLRGGHTHLAAGVSPRGGALSRPRGGLLPPVFSHTCVLLFSHRARGAHTGGASTLCLNIYHAGVVSPTLHTSTTYISSHSPRALVTLTPPRVCGDRGGDSSRAHMCDIPRIYTARRGGPCGTHRAGGRAPIIPPPRVCHSYLTRVVLCGATPFFIIILVPHCVWFVPPTTYFLWAPTSPLCALPLSLRDDVRPPTVGPAGASYRRRGGAQPPFCGVLWCASGGAPLYILARVIPPTPLVVWGGAPYPMRVVAPPLLVFLLSSGTFVAHLHGGATTSQATTFPAGDVPLILREDTPCETTTETE

SEQ ID NO: 963127 - protein, 132 aa, Homo sapiens
KPRWRIGVSRLQCWLPYQYLSGVVLEGRKRGCWKTPSPPVMARGIGMFEGYNSTMKDFCDAIRLDSLLKGWANGPWVRNGEFGFNLVNYPGRVPNMALPQRSKHSSFQQWVVDQKPFTVYGSLGWATELVTY

SEQ ID NO: 963128 - protein, 267 aa, Homo sapiens
NGGQTTLRLGKRGRVFKTQKLITTCLSRWLQKEMKKVSCCVIDMSGLREKDDIQRAECMLQQAERLGCRQFVTATDVSENPKELGLLIGKPLFNRIAALLTNQKEPGHDWGCSLKRENETKKRTFRKLDRDSPGCKRLELNHFVPVDLYRCPLVSRSSSYEKIKRSLLTWNRGKLNRRYPRTGERNYEESFENVTTPVAIGGRHRSSPLVWHPAGARSSDEARTLLSTGLEFGELMQTGIHWRYPPKKLVVGQKVHDDLIVNWVMNI

SEQ ID NO: 963129 - protein, 144 aa, Homo sapiens
SLEGLGAEFRKIPTSMKAKRSHQAIIMSTSLRVSPSIQWLPLSTQPLVRKPWATSCENTDQRYHLEGLFRNSWSTKKRQEAESQSHFGHRSGLWQEKSAVPVMGLERTRTKDKLFQFREHWRKYPIKFTDREEEWIRTLSKKWT

SEQ ID NO: 963130 - protein, 278 aa, Homo sapiens
MARYVLAELHGCPEEVSCGRVPPSGWQDLNLAGWEQACQCDDKRGNRGSRSVDWAWSRRESAMSGPGRRTSPSPWGVMSRHSTIVEAAWARRLVVPRAGASQVVPLVRPWDLGSRSDCLCVGALAASRFGRPLRALPESHHVRCEHAALPSLRDPSETMRPMWRRNLLRKGPQACGTLRFAASQGDKTESLGRAVCSSHVVDPEGHVAGSISRSPGGAHYGEADLGCGLIETLDERSFKPRLLHQDIHTKCPPCMELVINSPSMGELKRFQREPPGDT

SEQ ID NO: 963131 - protein, 231 aa, Homo sapiens
MAPRTSSAALVEPWPYRDLVPAPTPYRVFLHAPCPGPAAESPCFIAVGYVDDTQFVRFWQRRREYMDGDACAAPCCVLLGRVGRELFGYLVETLIVHSPRHMTVPVVQPVERFALYYRIGWMRKAVVFTRLQVGCIGLRTLGARRAAIAPARYDLMFVLIERRIDYVSALTMDLRLLWIAADTAAQITAAQFGCGRAGVAAEESTLEGRLCVGVRSCDPLENGNEDAVSGA

SEQ ID NO: 963132 - protein, 102 aa, Homo sapiens
VPYAKDSRSSTKREDASCCERMKDKRARLPRILKENNRSCVIKNIRKVGLMSGRIAIEQKKIALFHEDNCSSRFGAGGNPFTWEVVCTNMSLQENCMNEIPI

SEQ ID NO: 963133 - protein, 244 aa, Homo sapiens
DEELRLGTEAGGGTRGLADDRPEKLHVELTETVLDMMARYVFSNFTAVPKRSPVGEFLLAGGRTKTWLVGNKLVSVTSSVGTGTPVVDYGLEPRGSLSVRRRSASLQPRGAMCRQTMGGCRARLVVPALGQPGVPWWPGIVRSDVVGGAMGSSRFGALELCLGSSQFAVACASFSRTTGLHQCAKSEKASAGTRVPVQEKTNLVGYVPLLTRGWAGILVREGPGNAMVCDEPWMKPLSPLSSDI

SEQ ID NO: 963134 - protein, 215 aa, Homo sapiens
IVPFVNTRSERYIILLVQYLTVLRTKLKKEIPPVVKKLHLKRGSGVGVLKGISTLAPRSSQQSLMGSKEIEKIMGKMYTGAQGKMLNFTDEEKVPRKWASKGELVGRGVGLMGWRRKAPEWIANRGGGPLDAPMVLFQVGGHTGERRLQRIYQCAEAIRTGDDPVGKTPNVEAPRGGTLPNGRRTAPEMSAYQGGRHGAGWHWPPKALGATQRRE

SEQ ID NO: 963135 - protein, 115 aa, Homo sapiens
MRWMYPTECECLKLTKICLMMSLPIRLRRHYNNFMEYWVALYSTSVHDDFAFYDPLRSRTPFIVRFTFGMTSVVLGMSACRPVLTPPNSFALFPSNSYKSCSSKIFFQASVPLNG

SEQ ID NO: 963136 - protein, 274 aa, Homo sapiens
MEDLPRKRDAVSSGAWVPGLQCPTSFTTPLGSLAIWMLRFPVGLRLRWLVVKERKGLSEGCATSLPGGFQLLRGHHAVPISTCLQAAVAWVPMSSCLLGSRGSGFRAPPRNVQSSRLVLILFPGTPPCLSWGILLLPVWGAHSCWSNRYGNDTCNYGMAPEIHKMVRQLFLCPVNPQFQVTYLLMSGGALYMQQCPRWQTCRVLALVVPAGSGHRSVFPPGVGRAALGGLQHVTMRGPLSTRPLFGANPNGGHFLPCVSRGKALLRETSSVFLL

SEQ ID NO: 963137 - protein, 202 aa, Homo sapiens
SRLGRGWVLGEGPESLAATRAASYITPREEPSCAAAQSPSPQHEQRGETQQPPRHPGRPRPQRRDTKPGHYWADGAVDAVARGGASHSCGALPAWHTDRSVSSAKRYRATRLKHGFNVLTETRLLRFSPTRDFDHRRGKHCIRVPANGRLADLLVAHDCYSAPQSKCYPFRTRLVQGEDLARKHLVESVSGLVRFGIVRTKR

SEQ ID NO: 963138 - protein, 49 aa, Homo sapiens
MPNLSNSLLIQHWNKACPVATGLNRSFVPVCSPLPSRLSASFYGTRREQ

SEQ ID NO: 963139 - protein, 313 aa, Homo sapiens
WLDQAGVAESGPESLAGHRARLVTITPREERSSAAGPVTITATIAARRDPAAARRPPRPPRPRTKPGLGSGQERCPGGLTSAAPAGGHTKVIATEGLGNSHTGSLNGNRDMVHSQGLNPKEDVFCPPKTCPYKKITPSESYLSPRCYGSIGRSHLVAGFGMLRSHGAATCGLAGRAAKLVYRRSWGGLFPTVSTAHAYILQPVTGNPFISTRLSHVRRGFLPRNYPAKLPRHRSSRWGHRGQRADSDRGAPRKGQGAQTNGRALPAGRKGSPAFRTICGRTPYGAVRPNRFSTLPVPGGTVDCPGADNPVLRR

SEQ ID NO: 963140 - protein, 279 aa, Homo sapiens
GARVAAERTSRALKTMLQEAQVFEDCFYGSCLRNQGRVKRVSHKNSKKAKSTKKAKPQVPCGAVCDNNYLKGTCSIIDYSTYTLSLDLKLGILKNSGMPSSPSSGGGGHPRQLRPLRLWKEMNLSTVFTASCRCKNLKFHLQGGHEKKKKISTHKNIVGGRASAAQEKFFKPPLVWGGRRPNIVMNPGAKRGAQREIRGQQIGGGFPPNKKKARGHRGFWDPLPRGSGAPGFTTGQELEYAPPHQGKPRTPHTKNKRSDQHTSAHQTKNKHDRTTQEDS

SEQ ID NO: 963141 - protein, 271 aa, Homo sapiens
MALKDYALEKEKVQKFLQEFYQDDELGKKQFSFGTQFGSGWVHPGTRVGSLYVGPEDDVSRRMTPEGWGGLNFVRNARRYAEALLADALQGACCLKYKGEGEWVNKGLSLDVYNLSIGYMMEQRSRDPGDGPSPQNQYPAELMRRFELIFKGPSSNKPRVDPGKCGLTLVGKLVTVRESSLVSLKSNPRWWWPLTLCDQCGAETYQPIQSPTFMRSDHVPQPGSANTNLVREGRLYLQTRGSRIPPRSGDFRFADLVVGPWGNSAVVYRAG

SEQ ID NO: 963142 - protein, 229 aa, Homo sapiens
RLGVISLVLKAVVRGCAHSHVKRYASIRSAGGSQLAAGDSPGSSGGPEVARGGSEASPGARRVAPRSAVRAMSLICSISNEVPEHPMCIPCLYIMFMSGGSSRKYIAEKWVPTPSKPALSEGAASSTIKVCSPKIRAQSLPQPPASRAILKAFAGIEVGCSHCCTVSLCGQQAARQPGQELVTLLLYQARMAGLPVSICPVSPRECHLLPEKALANPETTGWASFVPQA

SEQ ID NO: 963143 - protein, 251 aa, Homo sapiens
MARYVFSKFTAVPKRSPVGEFLLAGWQDQNLAGWEQACQCDDKRGNREPVVDYGLELGGAAFRPGVRVSSPGVHVRQHHVGLPAGWWSQAGQPGVPWCPGIGVRSDVVGGALVFEVAARGACLSLPVRCEHVLASPGPLDCDQCAKSEKASAGTRVPVQETTNLVAYVPLLTRVWAEILVREVHREAPGVVMSLDEPLQPFCSSDINNMPLQELSNALMAAEAAFKEPRDTALFPSSLSVPADQEGKTPLC

SEQ ID NO: 963144 - protein, 237 aa, Homo sapiens
MRLPPWPWPFRPAAPPFSPSAFLRRWLWPGGGTWREAPWLARAPIVAPRGRPSLRRRFWHRAALWLASAGAGVPSVEGPLHGESGAHRRGPPLVDAPLRPGWNLPSRPTLRYTARTYQRRLQSGLPHFRTWHIGEILHARDPKEVPSLGTLRGQASPSFGPHDLTPTRSSGNLSRNSFRCPPKSSKRSFHARVLFSETRKPVAGDFCPSPKLVCARGEQHHDTGSHQRCSLLLLETR

SEQ ID NO: 963145 - protein, 135 aa, Homo sapiens
MPWWGLCRAWACRWAPPTRLVLPLLPKKLGLPCKATATQPGGGSWGTPRGVGGGHHPRRRGRGGPWPCFLQDHAAGARAAGGLGKPQSPALLIKGHCAFSPFTPVPPRGLPLSCPPRGGLPCFAPGVAGRLGSEH

SEQ ID NO: 963146 - protein, 217 aa, Homo sapiens
NRLGTRPWWFNSAEAPLPAPPVPSSEVGKLKGRCLSFWFPRAPGVWSAAGCAVPPVSPEPGPACAPGAGVSRFTPVRRRKLVGWLGPRGLGPESGMLEAVWEVTTHSRGFLNPAPPVCRWARVRSEGGGRCADSHALGQGLPLLRPGDELRDPVPRGLLWHACRPVLGEPGCPKLLMPRPALPPWAGGRSNATDVGGLAHCGGLSAHIVRAALFGPI

SEQ ID NO: 963147 - protein, 230 aa, Homo sapiens
MAEPLGLASCRSIQTLRVLSGDLCQLPTGIEIFVEHSARLCHSEGITICDGTEAENTATLTLLEQQGLIRKLPKYNNCWLARQTPRDVARVESKTGGFVTPFSAGTRGTTPDLGRGPVGTRLGQTGIVPSLISSRAVDREVSRLHAGRTCMCFHSAWVLWDSPMSRIGVQLTDSAYVVAKHAYYDPTGDTCCFRPWEMVTLSSVCDSVGQPLTGQGEPVKQRRAHQKKLI

SEQ ID NO: 963148 - protein, 234 aa, Homo sapiens
MSRYEAGFSRRLTVASSSSCGPPQPPLPEAREARAPRLAVRGRARCERGRGAAEPLKRSWAPAARPLLGPRIASARSSPAPAPGEMPCGEDWLSHPLGIVQGFFAQNGVNPDLGEEVIEYFKEKLKENNAPKWVPSLNEVPLHYLKPNSLVKFRCMIQDMFDPEFYMGVYETVNQNTKAHVLHLGNTIEMLAELWALNKELDLNSPRNTTFGKGQTFYCVRLPGESTLGKKKPM

SEQ ID NO: 963149 - protein, 301 aa, Homo sapiens
PPRPPRLCTTAYVFNCWNRLFGCPALVHSGDYEHQLKLSGLVWPFCAHAEVHRVVADHPGSEEYEVGGSPFILVIRYLAVVNKCGRCMKQVECAIAMTVNRQAGCTTTAWPRRMAGCARSAFKLLQLDKEFQLFQGVTRAVDLCAAPGSWSQVLSQKIGGQRVRPRGGMWTCRHMAPQPGVVQIQGDITTDVHMPREIIQHFKGCPADHSGSVTGLLMNPVSMIVDEYNAGPDTSLACSEHLLAQFSLKAKGACLVGPKNIPKAGIVTAPSKGQLQGHLSQRGYVAKPRSSRKSCIEASVA

SEQ ID NO: 963150 - protein, 142 aa, Homo sapiens
GTQQWQVAAGGEHSQVLSSLHNDQEITQRIISEGVFFFISFSFFFFPFPFFGHMTVLVWGTFQGRGMLCSGAGVPGLQCPHLFHHPIGLLGHLDAEVPGWGRLRWLGVTRRERASEGLATSLPGGSVLRGHHQFPSARSPCS

SEQ ID NO: 963151 - protein, 325 aa, Homo sapiens
NYGLGRGWLGAESGPESLAATPRGLVPITPREEPQLRSRPSHHHRNHEQRGRDPAAAAPPRAPPQAATQARIGGAGAVPGRLTSAAPAGGDKKVIARRFGNSKMVHCTEPDMVSSTGMTPRKMFCTPDCHKEDNPRKYLRSVGDGETVEFDCGRRRHRGAEAQLLPVLVVSSSGQVIQQDRNHYDAIHVVAGPPRLPANSRIVRVGNDRRARRVLRRARPNRARPYRRRRSHLTTLRRPLLAFDPQFSHPSVQRAVMAAADTQVLETGYTTWAALFSGLPRTRGASCKKPKRTPERRHSGLTQVRPSGPAFWGGELQWGRPRIPA

SEQ ID NO: 963152 - protein, 361 aa, Homo sapiens
DALTLRLGTRLGGAEPGLFLALAAAPMNGICICYQRRAACGACAGPQRPAPPLPATRSAHRRPAAGARAFPAITLPPCSFSRRAQTDVSRARSPASPLAFQAGNRTALTKRGRARPRKQPPVSPGTALVGSQKEPSEVANTLKRPRGRTKGNATNHRACCQDPENHQQHPGKAKPRAADPKQTWRRERRHGGHSRQEAPRHRTDPGDPIALPACSFTGTRPAPFLGDCDSFCSVSHSGSMTLSPTSLQPTHNPSNLARPPHALSLHCSHHITHIQLHVTHSFRGFAVAVDFGGLCFPAGSSFHEVSAWAPTSLHYPTNVPPYPTPPRPYTTSPYSRPRGALLRLHYPSLAPPPRPHSAPYT

SEQ ID NO: 963153 - protein, 146 aa, Homo sapiens
MLVDSRAFSLGPYISALRVNKVIEINPLPALVPMSGCASDVSVLGSSLAWSEEMQAVHICEMENVFQCRKSPSCCPNMIVPVPGLMDLSMGSMICGWDNEGSWDSTTWMTIGTLGLSASFVLRLGRGNIVSAYGGLGLWVIGLILA

SEQ ID NO: 963154 - protein, 276 aa, Homo sapiens
WRPMAGQACVGRGVSPAQERRRRQHGASRNGMVLKPHFHKDWQRRVATWFNQPARKIRRRKARQANGAPSPRLVGPIRPIVRCPTVRYHTKVRAAAVQPGGAQVGRLIHKKVARTIGSVDPREGENKSTESLQAIVQRLKEYPSKIILFPRKPSPPRGETVLLKTGNGHPVTGPVMPVGSVYKRRKGSSQSVRKRRISKPSASTPYGRANAGSSAYGQKSKGSRKTGFEKKNKGLLGLGIRRSHAGPTWVFRGPLAWMGFTAGNSSARDWGLKDSS

SEQ ID NO: 963155 - protein, 129 aa, Homo sapiens
MLRESEAARLLLAAGGLALALLVSAGPAGPARHGEDELIQKAKLPSRPRLENGTCMKAVTEQALSVHEERNCLRAYKNVVGGRSPLEGSSLASSRRRTSDKKLQLIRDYREKVESELRSICTTVLGIVG

SEQ ID NO: 963156 - protein, 262 aa, Homo sapiens
MVRGWVVTASTWSDGRLEKKKYERGSATNYITRNKARKKLQLSLADFRRLCILKGIYPHEPKDKKKVNKGSTAARTCYLIKMTSGFSSQRNPMFKQSSREIQGVRPVEAPEGLWEERSGTRVERLQGRISSNYNSSTTVIKERYIPTFMRIAHAGTRGELNALSNVAVRCFPTPSLRDLAEVAIVQTQFKLVPAGSSVEFMHYSYRCRVPVRKVLPVHQRHLLPGRGTGAAIVWITPYAFSHDHPKTWTTGSWHFSEFYSTL

SEQ ID NO: 963157 - protein, 354 aa, Homo sapiens
RLGSEAWVVQVCSSENAFRPEVRWSPSGWTWRIDGQKLRDAFTWNMNEKLMTPGDVVKKSSVHDLDCEARCTFVPAIASGIIQQIECYPTDQASWEGPTQTMRVIHLELNIHVGTQHFRWLGAEFEVGTMSEQGVHSTERKFALEAVAPELGVGAGAVVSTERIALLRIRWHELKLCIEEKTIIALQAEKRHLATTVEDASILGRAAARMRIPDGCPLACEYSEHDAENVERDGIRELGQEASRRCEASCQGPARGVVTSALAHRRPSGASQIDGARSSSSLLAGAEAMGQARPSLRIGGGGGRGGSGWPLAGHFLWLGPGLPPGVPARLFVEGVPCVAAWPALAGAYWASGPG

SEQ ID NO: 963158 - protein, 69 aa, Homo sapiens
VPPEQYLGVPHPVGIMHQNKQATENAKEEVRRILGLLDAYLKYEDFSGGRTSDIELTVTGCRAAHVVAL

SEQ ID NO: 963159 - protein, 361 aa, Homo sapiens
YSNENLDLARAHGSAGMEDHYGRWRTYKKRILDGSLPISPAPWCPPRGKILCVLWAPWLWRNTSIARSIAAALNREYFLLQRRGHELTCAEIKGHMAERYVGAMPGKIIQCLKKTKTENRPDPHRRRWTRIWPEATRGDPVDRRLLELRVTQSRMPTSWTTYRGRARGLVQGCCTVCTVQASRTRIPVADCGDRMDDDLTCRATWPRRSWPFAELLPVCPRLAPCVALDESKAELSSHVADAAHHAVLPRERVFRNWGSTWARCSAPPPALTGQRSRRIPCAGAPREPVGTFRGDTLLLPCPSSFSCHRPSGSLGVRTYRPGGAPPCAGHPRRAPRIVARTVVLRARSPSVCSACRALILS

SEQ ID NO: 963160 - protein, 133 aa, Homo sapiens
VHAREPCRPRCPLQSVQVFGRKKTATCCGALQTRQWSTQGERAGPGDDLSRARYSTRLSGVQFCFSCQGSDFAGCIHSVSAVKGGGHVAQSLCYPVRSISKALVAYYQKYVDEASKKEIKDILIQYDADPAGS

SEQ ID NO: 963161 - protein, 140 aa, Homo sapiens
DASSPNDRRAYSPFMITPSSSLSLICFLVLCALCLTLTTKLTNTKHLQTLRKKKPSEAILPAIILVLIALPSLRILYITEQRSTIRPLPSNQWSALVTEPTSYTDWRRTNLQRPTYFPRLLLEPGDCDSLNVDNRVVLAI

SEQ ID NO: 963162 - protein, 118 aa, Homo sapiens
MSRYEFVSSPPHGSLSTHGNSTLSSRPFHLGRFCMRGEKQTVLEEGCEEDMREQLIINTVRFTGCAVPTSSPWEMNFSDRLEGLFSDSMAKHYGAPGPPPMSSYWSLGNSTFQIFTCA

SEQ ID NO: 963163 - protein, 101 aa, Homo sapiens
MNINGSWISWILQLTKLELDAEAKRRLRKNSSRDSGRGDSVSDSGSDALRSGLSCCQTLSPKKGQRVCLDMADPRSGIGTRGLPIDQVVQEAQVSGVHLDR

SEQ ID NO: 963164 - protein, 253 aa, Homo sapiens
MFCVLPALCPCPTRCPAMLAAAAACSRVALCRALLFPAAPVPDAASPAVPAALHAMVLLCDPVLFLLLLWNPALCTCDCGLPTGNACSCLLWLLDARMADVVPNDTLELQSPVHLVTNGLRLQRLHLPQGDPVPSCAMAGLTYTKPASGTWRECPSTGMPAYLTRTLHLNAQWGQCVLSMANAGPNTNGSQFFICTIKTRLVAMAQPVVSGHVKRGHGPLVTDPYNSHGFSAAADVTYQEALVINRLVAQLEA

SEQ ID NO: 963165 - protein, 72 aa, Homo sapiens
MSGTQWKDRFTRWTQWLGGGDSMDPVVQHGGVWTRSSWACSREGELMSGGMDTFIHRNRLQTEVIYQPCRKR

SEQ ID NO: 963166 - protein, 76 aa, Homo sapiens
MANADPTTTHHHPEPPPTLVLPTPIRIRPTERPITHTTHPPLPPTRYHNPASLAPSLPPAAAAIARDIKPDRCLTH

SEQ ID NO: 963167 - protein, 67 aa, Homo sapiens
PKKPNWEQAQTHIKHSRHGHVDSGKSTTTGHLIYKCGGIDKRTIETLEKEAAEMGKGAFKYAMASVD

SEQ ID NO: 963168 - protein, 77 aa, Homo sapiens
YTYLKLEGFKALIGAQYSGAQCPRALQSPSHFHCWSKATRSPEISHAKFPAGKVPSDLEGDDRITVVFESNGSIAYL

SEQ ID NO: 963169 - protein, 37 aa, Homo sapiens
MPDWLTKSGDLPHHAIQHGPPAVGGKAQTPRGHAHVT

SEQ ID NO: 963170 - protein, 270 aa, Homo sapiens
CGGWAEVGRLSGLSVAGRVPGVTEGVDAGGLLTQPHEAPRSLCRRHGGRSISVLCGKRLCGGYLCALADGGSGTSGAHRALPTRVYDQVGTQEFDGRCPTRARSRRWLDVEVTYTVQMEYPDFPQHVSPSKDIRTVKHMRADKKLSEFLTVEMTHDGEDVYHDGSVWLQEKVQKDSLRPELLRYLERLIKLGRRNGLHLPRETQENIKRIKKKLSLLCIDFNKNLNEDTTFLPFTLRGARRAPRGISELLEKMGTEFEVPKYPIISPLKN

SEQ ID NO: 963171 - protein, 241 aa, Homo sapiens
MLPRVGCPRCRCRAAAAAAAAAAAAATGREWRGGGRARRCCSAARPAHPSAWRLRAPAGLLPPACGGRKLAWSAALLPCAELFREPVAACAARVCALVEGEACGVYTPRCGQGLRCYPHPGSELPLQALVMGEGTCEKRRDAEYGASPEQVADNGMTTQKGGLVENHVGQHHEHVGRGMAVVVRKPLKVGYEGAGGVREEGHVSSTRADWATGAKHHLGLEEPKKLRAPPSGLLPTGTGQV

SEQ ID NO: 963172 - protein, 244 aa, Homo sapiens
SPGGCPAEFCCQLPEAASLCPIPVPPGTLEWQLRRDVPMCCPCYCALLLCADADARVLACMPLPGWCCTVQLLESADAACPVQRVAVAAMTPWLGAHRAPGQLEPGGLGRRGVHMLAQPPPGRLSATPTSVILVPMVVREEAGKRRWPFGTLVYTIKQMTMYRGFTKMPHVQYIHTEASESLCGLKLEVNKYQYLLTGRVYDGKMYTGLCNFVERWDQLTLSQRRWLNYRNHLGCNCRITYCYT

SEQ ID NO: 963173 - protein, 216 aa, Homo sapiens
FCQMWYAIFLAVVASWFAEGWEPPSVSGTCPPSTSSSVPCVLCQACPSHQHVPRGSGCPRPAQLVLSVPSPVGSPFPCRRMGFLSRAECRPWPLWVALEGLDLCPQLLPSPVDWLCEPACSLERWILTCRPDSSPSASWPKRGFQVSDTGSQVNELCSLGGAVPGTRRLAYRLSFLTSSVLGVLAHSSACRASVYPPVANSRYQWGNFVSIVRRRI

SEQ ID NO: 963174 - protein, 101 aa, Homo sapiens
IPAPVRSCTVAQGEPVQFKDCGSVDGVIKGSECELHDPTHSCQLSKGSLTGSHVTLHQGIFSLKAGMAVVCMGILDGSFPVPLPHSWRPDGLYGVAPLNWR

SEQ ID NO: 963175 - protein, 302 aa, Homo sapiens
GEKIRSPPYGGVYKVSTLGKSHSPRTSAKQASICICSQSCICTDESSGCRAPLPAMEVVSGVALAQLRGGRGCRLPCSQIRGFVVVRRGLRRVSAIGRRCDRVGSIALEGVPAYLAFGMVGYRGGLWRSALELRHSQVVFGWWVQLVALVRLGGALLNEEGTPSAWQTDDMDQHDWHRYTVKRSDLRFAYRWEERCSRPIGMEVTGALTLEEVKDPDDLGTLQQIPSLGDLSGEHKRSLNLLVSEEEASGYYDSVTVKQLNRERGHASGDSDECQGVVGGRRSWARCLIMEPGSGAQSVGWP

SEQ ID NO: 963176 - protein, 141 aa, Homo sapiens
MSSSEHVDSGKSTTRASLIYKCGGYRQKNHVKNSRKEAAEMGKGSFKYAWVWINWKLSVKRGITMDISLWEIGDQQVLCDYRLMPRGRHEDFIKNYDYRDDLRLYVLLSVMWLLGVGEFEAGIIQEWADPRACPSGLRHWV

SEQ ID NO: 963177 - protein, 228 aa, Homo sapiens
MCGVSPLLIISPQKISPLILGAQIPPMGWPPKINSDDNTTRRGGGVPTRKRPPTREHQLRERFSPPPREHGKGVYQNSPQQGKNPTPPRGRAHPTQKVFPKRTPTFAPILPLGGSGVVKSAYEATFFCVCGTGDFSSKALPQVVVRHLTRSGRFFREMATTFLPGGDPVCVPRVFDKGQSLYYVHQGLRRTTLYHQPARRFSPLRLQQISLGSRSITTRVLSAPHSIF

SEQ ID NO: 963178 - protein, 429 aa, Homo sapiens
MWNQQRVPIQPVCQAGCGGPNVLGRGGSQHLGAWWLENNFFEDIMWVKEMWCAFMKWGEEGTYIYRRRKLHEGECGSQRGVLYSGPRCERLWVVKLCVGEVRESPTDRGGKTLCGTHERRVTTLKDARELLRGETLSLCASRVWFVVLSPHKSALSRKRERLTINPPTSSVNVGVAPSGFEEPKSLGGVVRVWEALMGGGLAPLCPKRWSLRGDLGGARGVWRNRVENAWGSITFDGGGRAIKRSYSSERPQKIGTLWCGGVATGAAGKDFKKERGGFIKTPRRGGGEKETPSSLHMVEEQRSGFLKTRGGAVEKKFFLKKWAFWTRGGWATNSGCGCAEELCAHHIGYPLERSLEHSRDENRMAQQGGFPRKTTWAGVGEKNPGFIIWWAHRGGRDQENIWEWRRHPGERYVPLMKAEGAAGKKTPPI

SEQ ID NO: 963179 - protein, 193 aa, Homo sapiens
SSMLGERTMSFGAQPTGCFSFQSHGSKGGLALASGIQLSGLPPDAWVCFPPRARGGAHAWETVKCDGPAPWGHCHLSSCCILWLPAAGRGDPSGAQNWGATTPRWPNVPPVCATTWLFEKINSPHAKGLIGPLLWPHFTIWNCDVGQPIISPINILRLMRPLVVVPLANLSRLGFTLDVEYGAYWWRGGLALG

SEQ ID NO: 963180 - protein, 317 aa, Homo sapiens
MSPHYSRRAYLLSLGPTKYLRREKQSVGHSKRPTISTEMRPHILQLRASAPQTILEKGAPQDRHRSVYEGCQRNKSTHHVRARHHQQIVVANPKETGRFKQPREELTPHPPQEQTGGEETQTKLTPEGRETPPVGGRRPHPTGEREENMSGHTQTHRRKDVYITTHKKTTKREGAPVRRSEIVPTTRNKQHGKQNCGAQTTNTVCWAPPQQTRWIVCKHPSGRELSKTVREEVKRTKKSELVSKKDIPPGENTDYPARTTAAVVSEQLKTPTTPSWIQNDLLGASHTNNSERARRHRPLNVDNHHQSYYYAHRYSYA

SEQ ID NO: 963181 - protein, 95 aa, Homo sapiens
EYARSLAMGIVMTVVGPLRWVTIVVVSFKQSKVFGNSPVGCKPQTTEGVDSLLKPRAPQEGGSLQLGRAVFHALTVVWFKSEERKIPELHSQVVP

SEQ ID NO: 963182 - protein, 147 aa, Homo sapiens
MVLIPYKPQPVPDAGGLLTNQCQAQENDSRFPMDGVHSVLRYTELTSELTFLSRTDEVTCKLLDVDEPVFTLMPGIRGENSVMRTKADVGRYSLVASMGSEVCLGHRGLSCITRNVSDMKSKQWFRLSQLVTLCLRCILSNKYRGLH

SEQ ID NO: 963183 - protein, 168 aa, Homo sapiens
MRGRREKTSAEERHPRGKRREGGGGEKTHARRRPTTSARREWCHTSLTRQRAERVKRERETERERGAHRAARGPPTTRRKTREENTTHVERKRVSVGKTAREKHPHARNTERERREPHPTEKKKTPHKKRKTKTESEREHPQTRGGGKEETTKKQVTHTKTKRRSVRN

SEQ ID NO: 963184 - protein, 251 aa, Homo sapiens
MPLPALSVGVLGQLTMNLTLPLAEEEQAVRSLRRERSRCHPHENPVPDSRDDSRHYATMYRDPLMLLCSGLAARACPFQRLRGLRSTHMPLCPGPRTTVGRKLRYYKNLSRLTYGATTLLYDRIRKCARAEPTFHPCWAERLDTGQPIYADACMGDDDHCITAARSASVPSSTRHGLFVTSPLPVLRRLRERGLGCTTWYLVPRGSPGPPEASESPTKTWPSWHERALHTRGPFDIYEPGKCARKNMCECR

SEQ ID NO: 963185 - protein, 127 aa, Homo sapiens
RLKMEKEKEGFPDHVAERRSTPSYKAQSSNIVTDYERLSVGMQHRTTSSIVMKLCGCTNLKSLDGDHANSHFLTRVTVKTLHDPCCVGMKHLARTTEILAPMNLNERPDLAGCDHDRSSLKCAVTIE

SEQ ID NO: 963186 - protein, 71 aa, Homo sapiens
GLSPTPQPGPWALCPPLSLRFALPSGTGKCPMPDAWCALSVPVCVPACLPLCVPIVSLPESLILCEARTVY

SEQ ID NO: 963187 - protein, 190 aa, Homo sapiens
LPLLVLLVCSFWCGTWSPLSVKRQLRRLRTAVNGRPKSPRKESQTENNDHITLKVAAQEWSLWLQLINDYGRAYYQTIVQLMTPAYLRTDRGFVNMSADHDSDLTGQPRSIDKPRQHPAPVRAQLRRDDSIPSLTVLQRVRRPRLSTDKAETLFLNSANLCSFDRPIGLRSHFETLHVWGSASIPGLLTV

SEQ ID NO: 963188 - protein, 118 aa, Homo sapiens
PAPPRFFSPGRGPGDQSEKRDHVRRKCDGSRVPQPRRFQLQRMKQNLESFIVWLEDQKIRHLQDVTDQRGTFKETIHMQPTWAPKRFPFGKQGYSPENVKPVLSRFKIDKKLLTGFCG

SEQ ID NO: 963189 - protein, 52 aa, Homo sapiens
MAQAVVKEKVVFSNLLVGVLRSGITWTMTQRSCVNFSTGLCRKDKFTTGIVI

SEQ ID NO: 963190 - protein, 287 aa, Homo sapiens
MPSAIQGDLDSPIYFLNDHSNYCDDYPEMFHLLGCRQVWAPEHDAAGSACPFRGKAVVLMGKNTMMRKVHSEGTWTNKPMLCEKLLPQYPGGSVAAYGDSPRYVTSRETQGHVAVPVRCHACCSGAVCHSAPCESHWCQPMNTGLVARIRPPFSRLKVSPLKSPGAPLKSRGDVQLIKTGDKRGSQRSHAAEHAQDLPHSPLGWSIQQVFDNGRSTTLKCLIFTDETLHSRFWSGVRMLPGLSEIGNQLLLIPHSIITGPRVRLVLVHGYPFQLLRGRASRQFTALW

SEQ ID NO: 963191 - protein, 339 aa, Homo sapiens
MWCNAINDDQAANNVAAHNDHQSVSTRQPSPFLLTTISCVITTFFSPPPHVWGSQRRSYHGGDCCNTAGGVNPNTLGGHYLYNHSTTFPINVGGGGDNTSGSRGDGIIVGSITATTILWGRPNKTALGGGVSGGGSYYNKSPQPLLTRRSWCRGGHKVGPGAHLTPGTVWDSTSNVFEPAATHTRGGALTTRGSYHTAEGRGGNATPTFVGGDNTLTYSTLWEPPTPGGGAHKTDHLWVPIVCVTRHKPNIRPRGPPVAYCVPTKGGGVCPPVEGAPPLLCGGHPPQQRFATTGGGHTTPLQVVTDWGDNKRPNYIRTLQFHTRDTQPLYEREGNQPLG

SEQ ID NO: 963192 - protein, 115 aa, Homo sapiens
GARGYPLQATPPGPTDTTAAPGPFAPRARNGHPRRPSTTTSLKLSLWEILGVGKSKSPVSIYSNMSLIWESKSTNGSRVGNKKHPGGWKNNKGTDMGHSRARAISSYNISILSWS

SEQ ID NO: 963193 - protein, 163 aa, Homo sapiens
MREKPSIFHPGDLQDYQIESLSKKCWIPVVSNVNIGAGSDALLLIHMVGRRVLTDELNTDMIRHLYVPEFRDIQIHHYPNGIVTVRLCPAPESRAPCNQRGGAPHRLRSSPPSPTNIQQIIEIEDTVGDPSGCCGCIRVQGRCLKVKRQYRFGPTNEAFEKMP

SEQ ID NO: 963194 - protein, 284 aa, Homo sapiens
VIGTRVGREEGGKMVLEMHYVCVWTTVSICWNGDFLPTRLQCPAGCCQHSYVIQRPCSNPENNCGPYHTGYMTCEVLTTLTPDTGLYPVQATYLSNPMCKITYLQLGIRCGPSGSEAPDKAMNHNDAASFAFSGGKPMWQAHMQQGILVAPLVLNNASKQVQHTVNLVCTIHTNYYWVCTPRSVDKNKQNMPVPAILLQSTVIDMGPRNCRTLDYSILGRTSLHFPLWPHASVAFVLPPSSSWFTPRTLLGLGFDNRLGCPLAFAGTSLRSANVVAFGHFLGRS

SEQ ID NO: 963195 - protein, 221 aa, Homo sapiens
MKLTMQNLNDRLASYLDNGAAALEAANGELEVKIRTVYQNAGAWALPRLHATTTRPSKDLRDNDSCVPPLRTPGFVLQIHNARLAADDFLNQCLRRNSALRMSVEADINLACAVVLDELTLCQRLTGDADSEGPEVKSLVYLKNDHERWTIRYADGPCWEATVSVEGGSASGHRSRQILSDCAHITPWRADRRFGLFPPANDRVLARAPMRQVCSRPWSIG

SEQ ID NO: 963196 - protein, 124 aa, Homo sapiens
MISAERRLESVIYTSREVYGKVTHRWRGRCCEQLRLRRLVQWNPLVESSRRLTDDTCWFMVSPYSGLGVPLKSRSPVFEANGDNAVGLAMSTAVPNRFVEDGWVGPDRISGPFGSFALGDAFGS

SEQ ID NO: 963197 - protein, 228 aa, Homo sapiens
MFYIPECLLCLYVVLLVILFTNAADFLYGHWLEQVDSCENGPLGTPANYSQLVTRSLLVGNGTICLATLMRQRQPALPGFLALAGLLWDLPGSHTTFTLLLRTNRNYGLQAIDPMVITSRFPLSWAWGQFRVNRRNPIIHTGRAKRYENGLCDLWAPCLFPSGNFLECTPSLPGLDNQLTTPRLIQNPLAFNSGTPKRLLDWAGVTCEQALPHNLAYAQQLPNNKLGI

SEQ ID NO: 963198 - protein, 466 aa, Homo sapiens
TGSKKSNKNKSGKNQFNTTVVATTRTLARTSTMRWREHFQQRRSPWRTRWRDITEDGATMPQTTVRCADAQRSCVAHSRYPIPSLPPCSFSLPPAWPRFTSTHQQRATPHTPTQRCATLASHHSRRNLTHPQHNLSQHAHTAREQTTIQLENIIHTTTLHNLLKRDNKTHAAPTTRGPPHLILARRSQHNAPTGTRFHTHLYFTPHKAPYYTLAQLTPHKTFNPPRTTLQLTINYFLLQKKPLSNNEKAPEQFVITPISSPTGPYTPSLFHPHLSPTTPHAAPAGPLPRPHLPLFFRDTTRPFLARRAYAPSLSRLPLCPLFRAGSPLSLLHPLAPHLFHPRPLATFRSAVRHTPSPPHFGCAPAPTPRHGCLPRTPPHSAPPYPTDRSDHTTALPPHHPPTTRNTTTTQTNTDTKHRTAHITHQNRNAHHPTTRQPYSPPPIYPTHNTKQRRDHKPTPPHTHSHP

SEQ ID NO: 963199 - protein, 306 aa, Homo sapiens
GVKWGNRWWRWRRARWQPGAHQRKSPRRWNPASRRDGHPERPDPVSSFYPVICHHDPDKRFLHLLQWGGISWRVEGGPQACAPGQLMLCTHWWHLPGSYLRMGSLHGLRGYGPSQHGFKAMRGELCPGQASTGVGDLHPTMTTMTFERGIHTNGTSRWSGLLLFPDGSHGNPPTIDRSLQTEQTSCCDVSKCPGHWSSRGPEGASEGKAKKFHMAWTDAIGATSLDKEQEKRPVAQQAKQHKRGTTRRLKNTNELAHRKLGNRKTMDIATRTPRQTNTRGPPNKRKTERHQNHRKNTERSHASRRT

SEQ ID NO: 963200 - protein, 126 aa, Homo sapiens
MTPARASRLASSGTILTFRLCTNHFLVVWDFFSGASPFALWPLAPCGPMTRPSYTRTGRVHRYFVRVPGVRCGAFSPCTPAFWSPQSSLAFPAYFPPLVETAPRARLSPPASPRAHSVRALSPLRL

SEQ ID NO: 963201 - protein, 66 aa, Homo sapiens
DNQQYAILMVPEYLVCWVMISNKCCYTCRLTCRYLIHRLDQKYAISSVDTIVTLNHSAIDAKYSSS

SEQ ID NO: 963202 - protein, 187 aa, Homo sapiens
NSAQLIGCRRRGADSGGEERKAENMDVYLLATPRHGTDFFPGFQIRFARPDFSGHFQMETKPAVVMQPALLPETSLAGGGVPMMIVHMWGFVSPFNMILAGLVVVLVFHGFCVGMPTNNDVLRRMKNVRTPPTVRSMVVMLASYFLISMFWRQSWSLCLGNTFALAVNEIRCIVEDFRNLQGTRLRD

SEQ ID NO: 963203 - protein, 89 aa, Homo sapiens
RCGALQYAHPEAVGVRHGGADVRAHDRVLQTPLSRDPVLRSEVHILGRGGDLACLRCASRPEDMVNFINHVSIQPKGGRVATYLDPSLG

SEQ ID NO: 963204 - protein, 202 aa, Homo sapiens
MAAGDPVHVILIRTGWAFKALIACSVHAVGSGSRVPSPDSTPTFQLCAPKPNRQTGLNLRPAKFPCSGREGPEQLEGDDWNACVFWRATAIRTNSCELDEGAVGGEQYLLEGLVEDHDVWVRPWGETPGLNSGYYGAPATDKYPGMFHSNLGRLSMAFTYKRRPICMTVTLDANVRLKFLVRYWMCRLRGKTNVTSIMGDAK

SEQ ID NO: 963205 - protein, 338 aa, Homo sapiens
CAVREMWYADFFMHDDCMNGCLCDPVMWTCEINMNLMLNMRACACTHVVLCCSTCDEPDDVTNEMMLLVFGPFEPCVMCKHLVPEQAREMSLDLLNRCLIFDYIFPKLHSMVLELQVYNALRRMLISPCWYCTKNQIYNYYLPSHACDMSKFCEKHYDTSAHIELRPTPFSVRHPGSSSRAIRQVSSDRHSFVSLSLVAVDCTPSSPGPGVLDGYVNLLDHGLTMPPPWAILPWTAVHLASNFAPTVALCQILLSQCSLGSSRIHASPATTLSHLLCLRPGLDPYPQPTLQILSGRTLPYSPHFLPVPGLHATAFIKRPQAVVFSVPETLGERSVRHT

SEQ ID NO: 963206 - protein, 183 aa, Homo sapiens
MATITVSQMKSYPAYMNIHARPFSNISQTEGPGRDALRFSLPPKCINSLHSTDFGTQQVLYTRLEFWRKKVTFYTPGNLKSLLRMAPKALTVATRLTDGGTIFSDLLGIIEDVVAKQFSSKYGIVDDITRKGLVCVTLSLGTHLYVGSRMRIRVKGIEADFVENQGQLCGARNESGQTLHPIY

SEQ ID NO: 963207 - protein, 136 aa, Homo sapiens
GAKAGVDVSLGNCCSFTSQAVTESSAPQAGNSCTIGQRLGSWMHLCDHVFPKSPGEAISWPFPETLPQKSLVLWRTRNTHFCGTFRGNTISQKKHADFNDLRTCKAIDLGETAFKDAHTETSKGQLKGKKASKPGQ

SEQ ID NO: 963208 - protein, 172 aa, Homo sapiens
MNYNGQHTYCDNKRAMWAHQKRERTPRGPRDTNRGGRVIFSTPKEIQTAAAGGGKNPEERASGRHTTPQTRKGGTIPGRREHNKPRGGELQYKQHNGGRSPNQARKGRPSGVNNKRLQTDPTSGVLVRRTTDERQNNTNDQIAAHQAHKPIKDSTAEQSSTKNEHTRNNDKE

SEQ ID NO: 963209 - protein, 111 aa, Homo sapiens
MHVKIIQTHSYWMSEENQNTESSRLNTHWGKLTNSQKAFIPGSIPNTWLTQPLFHIDDTFCVFSRPGDTSSDSGESQHTGCDYLSRGLMCPSSYKERVLPQSFTLGRPSIL

SEQ ID NO: 963210 - protein, 115 aa, Homo sapiens
SKVTGGPEHFTICCVHLVHHSPCWLLRLVCLRDHLAFWVCHPGFINGLPCCDEFHHEESMAVNTSREYATKARMGIRRGKQLGQEYSKEANMGNHSDGTKYLKIDQNAASMASVA

SEQ ID NO: 963211 - protein, 90 aa, Homo sapiens
MGDRHTSRPNYYERGGSLHVRVARCLCKANLVQTNPAVASCRYYTQKQQPEYDLVICTQAALTIGYTYHTRQCGMTRTRPREYNTQTAVF

SEQ ID NO: 963212 - protein, 69 aa, Homo sapiens
DCGASNQRDSVGVGPSGASLQEISSERIFKLSGCFTQPSVQSYVMSESKGCFIPCCSISDIQALPLNVS

SEQ ID NO: 963213 - protein, 237 aa, Homo sapiens
AAVGRLLRASVALTCDVPFLEGISAICSPQAWLHVEERCLTKFIGVLGSSQCKIIHAPSSSLPMHPACHPCMHPNFTGYMPVCQWDDVQMTLSLGLTFNRGAQYLRWAYSFVILCGHFQPLRVVVHNRKTWVGLFNGGQKGLHGHCSPDWWKPGWQGLVPARFLPGWGFSPKLYYGPTPWDPGNLHNLPTTKGQTDTWGWRIPGEAQPLWKTNFRPNFRMVPRNPYKPLNVQGILSP

SEQ ID NO: 963214 - protein, 163 aa, Homo sapiens
MERPCKGIFGNLSITQFLGLLLGHGCVKQWKITSAARKLAQRVDDTNSLHTSGNPRKVLPQCQGQGNTLVARELRPLYNTLGNRVKSPHKRVTLMELLVDPCSLLSGLWEQQRNKLPRAMWTIDNFSKIPRSTEAQRSWRQGTVAHGTCAHSQQTNTMCGQAR

SEQ ID NO: 963215 - protein, 70 aa, Homo sapiens
SRRWPNQKPCRSFGKTSGCMNKSCLYFGRQRRNRQSALKRKSWSRACLSKCHAHGPARMLTFDEESLIKM

SEQ ID NO: 963216 - protein, 528 aa, Homo sapiens
MSYSENATALGTRCPAILQQPSGCWHARIGFEFDNDTQRSVVVDYNMEHSIGSWFISLLTPIMWTLHPYRVVALHRKDSIWHLSSMNKARNERTFLPGNRRNMAPKGELEGSLTWVGEYQFEDIPAVHYSLMPHEGRSKNDGPLTGKHRYADAHLGGETAKWAHQFCTFLRADSIRTEKPHPVIQCLCNEAPTIRGAVPKRAIVTALGGGQTTHSKYTRAPYCTALGTHGGPRFALTAIHNRVGGPPIHLHNHVRQTSGKLHNDLHTAEAITIPNYPGRDRRKFIILDGGLSQILWIARLPPSLDLRGDTPVILRMAMCRHLCPAQHIMMAKANLLTGISQAWAPYYTAQAFIPLLCSAHTASWARNNTCDSLGTTDQWRPDGQKDPHAPRGLDNSAHLREPRGRGPPRESKARNEKPTFPATKAGQDKRRQTGHARPSAFQRGGHTGIDSTLRPPPRTVHKSSKKTLPYPREEHTQRDCHPRERRTGTNQSFNDRLQTTPDSVAGAFIQQRGEKHRFNTRSGERVKT

SEQ ID NO: 963217 - protein, 183 aa, Homo sapiens
RGGRTVPGVTVKDVNQQEFVQSSWQAFLKNVRGSLKGSPKWVGYPVKAWPMHKRMLCSPTIEELFLHARLVSTGAGTLVPSGGWPLGGLAPMTPRSMGATSERKRCVIAHRPLFRPEGSQDVWPLPGFHPKPLEGALKNCVEKRAPTGLCGAEKLEHPSGDTNGDLGQNSPDQVGLLPKQSKA

SEQ ID NO: 963218 - protein, 131 aa, Homo sapiens
LSRAGDCFSGFSADWDLGCPSESTALHSALALFGLIIERAMGPPVQGGKHACVVYIVDRSVTHRREPFPSKTGDAFMPIYNVFGQTWKTCTGHHRHFTIACIYYQCAKFQTCNTHGAIANHCLSTCLANPN

SEQ ID NO: 963219 - protein, 144 aa, Homo sapiens
VRDSGSRPPVAAPPAPGRRPICCPRGSWGMEHAAQPWPMATGDGGGGGAPVAGSPTCSAPWLRGFARNRQTNLSCTAANALAQPKAPELPGGGPALVGAGSLPSVALAGLPVTPVSPARVPPRRANVFLRGKVPSSTYGPSGAN

SEQ ID NO: 963220 - protein, 124 aa, Homo sapiens
MWIGGGSRSVGGFSLYASSDCGINTTGHSRALLRAVLHAWCCLRRVSQVEDTVTKRVLQCTDGSSASLGIAFTCLVTKMISVATNIAFFTLSQRRDGLLPPRQDISMMTFKKVCRVVKVQLCCV

SEQ ID NO: 963221 - protein, 112 aa, Homo sapiens
GKMAATKRKRRGGLQSGEEAKKKRNRCGAAAKRHATAEEVKEEERDGSQAPFARECGKFKERILIFSSRGINFRTRHLMQDFENVMPHSKADTKMDRRISYGDNEVGEMKNV

SEQ ID NO: 963222 - protein, 80 aa, Homo sapiens
VAGSFKMRLLLLSPSGGVCDGPERGLGNLGGCPARDYRCGYATGPRVSDVPDLCCPEVIGGCREEYMRVIGASVYPDIRY

SEQ ID NO: 963223 - protein, 108 aa, Homo sapiens
LGLVEDLRWRRCTECITASLRGCARRPKYESTNKCPETRQLIVWCLFKISENNFFLADRLIHTDEAGKCAEDGVRSVWPRLCKGLDLWLMEPRASPVQCGSPCLSLPE

SEQ ID NO: 963224 - protein, 67 aa, Homo sapiens
DGNAEITLSSASLTLGAVDRSCSYSAIWGLDSALHVLTEKSTQEWIKDLNLRLETIKILEDNMEKPF

SEQ ID NO: 963225 - protein, 37 aa, Homo sapiens
EHKMYTRLCQFISLNGEGLIYERGSGEQTSYSIHIRS

SEQ ID NO: 963226 - protein, 103 aa, Homo sapiens
MAVVGSMVAELPLEKCCSLACIAPGVSILYAQAVYRARGTCCVPVPSPCWLIVLACNLFPRWVLAARSSGFFDLACSPFSLLISKAVNLSRNSGVKVCRLFWD

SEQ ID NO: 963227 - protein, 69 aa, Homo sapiens
CAVVLWTRRTLISVRLLSYLMCVPAPDGTHQMDIGHRSPLEAPKNYSYIELVTLQGRQTHYSPLQVDIH

SEQ ID NO: 963228 - protein, 104 aa, Homo sapiens
MALYHTEERWPKPLLRPEITGPSSFKTWLIGVTTFSPLFSDIPLEGEPLKEGNKWHFLMKEKHEHDGHYEKSCLSNDVSENYPRVGTNIAYTHATHWPTKRKPN

SEQ ID NO: 963229 - protein, 111 aa, Homo sapiens
MDSKHQCVTLNDGHVHAMYGAFGTYAPPEGTDPSIALEVTKSDNEAGFRHMAFVLYVIQYSEEQVGLAPSAFEDVVRVAVVTREHDIFLTSVKRFGYHFVIRPELVRSQRL

SEQ ID NO: 963230 - protein, 218 aa, Homo sapiens
SHCCTLSSIDDSAGGHVTSRGRHCRDSVASLHGYIIRLIAMGRRSIPKHKAETAQMSIHSCLVVVHPSSWRALQYFELPDASVNVLSRFIIDEVLSKTDAKDHALAKTRTGALVKIWSKRTMSVYEGETELPYYFPSQRAHTRDQTVQRIPIGIREASFGLLSSSDSEYLPIEVTWRTIPGLSYCVDFCEENWEQNVVINTCLPDDQGSPYEQEAGDS

SEQ ID NO: 963231 - protein, 263 aa, Homo sapiens
MLACSASLRSVPDYLLLCKRVAVGEYITFASAQWPECKYHKWKEDVESTGMQHIVVHYLHYKEMGCAGESRAVVYLARDCHDLYRISQYASVNCLSELMTLNGPVLSVVKAVVGVVCQPDATWIMYFTVLADRGTIATIPDSENNRSTNKRMANHCFREEMEQGIRSALIEDWNKLFAKDKGTHLSERVLPLSGGGPGGEPLEAFLVFNLHKYTMLANFLEMGIANRNLIPVGFDTFRKREPRQSISGFRTQYFPWNLNVTRW

SEQ ID NO: 963232 - protein, 69 aa, Homo sapiens
ISWGQSKIIRSRKEAEDLESGEKLDVYSHEGIEGKADGRKYHLLCNVMSCCSIELHASAYNKKQGKCEL

SEQ ID NO: 963233 - protein, 80 aa, Homo sapiens
SQLLGRLRQEKCLNPGVRGCREAIDSTTDSSHGRDIAILCLVKSNAAMLTVYEHRSGFNQFFPGVLVNLTKGEDVQKLIS

SEQ ID NO: 963234 - protein, 181 aa, Homo sapiens
RDSGEVRFQCMVFPAKRFWLWCHMEGVRVGLFLAALWLAEPEPNGWLASGDRFSPRSKERHWAEFVLCPGSAKAAYGVVVVMDTEHEFAEKWNIPVESYSLCKELQKENPVLCKRDSSNPYPNFNFNISHQGDLCSAVLLNLSWQVWHWIYWKTSFPGRGSIPEFFHIMTTNVYQQRMGNN

SEQ ID NO: 963235 - protein, 106 aa, Homo sapiens
PAARGIPLVLPGRLRLPPRRLSSSALRVPPFGPRPGSGAVAVAGPARKGQDFLLGGAFPNPGRYVLQVKGQGGEVRARRPARRVTPPGTGHTKGPGRGLWGAPGGR

SEQ ID NO: 963236 - protein, 96 aa, Homo sapiens
GSKQCGLPQAVKQFLVNFLLSRNSNLQARHKHRQSGARYKFSCGPLQACMHSIFATFTHGWHQAMHIIWAHQSAPYIICIHTKHIIIRPSKRSATL

SEQ ID NO: 963237 - protein, 84 aa, Homo sapiens
RRTSSEQKMAVPPRYADLGKIWPGMSSPRAMDCALNKAVIENKIWTTWDGAISQAQGSANTETTKVDGQSGKTKYQDGTGGYGP

SEQ ID NO: 963238 - protein, 106 aa, Homo sapiens
MLHCPIRSSCCKWCTLRRRVTTNLLIKVLYLIVEHSWLYGTEYIYLYYEFTTKLSINLWNSNEHTYGMYDVLQQRMHSMCLIVTISHQMAQAYSGHNAMWQHDADT

SEQ ID NO: 963239 - protein, 88 aa, Homo sapiens
LRGSLCIQQCFGLEQIQWALSSSLLTSHPDYPSSGYATRHGSHSFIWPLSKHICGPLTRQPVIIDGYMHPYLMTKTQNHLSIHMTICT

SEQ ID NO: 963240 - protein, 407 aa, Homo sapiens
NKHQQDLKANTNNQRSHTNHTTRSHPNRRTPPHPHTPKNTAPHPIFPPPHPTTHTPSNTLNYDKHPQTPSPAPQHPPTHNTTTHTPQHPTTPPGTAPERPHPPPPRPGQTTHSDPRTAPDATPPYSDLHRAEGAGHPPPISHHSVRSVPPPTVATGSTYPHALQRRASHRADPPPPHHAPPTPQATPPLATQRGPRKPAPAVRPRRRGGARAVTRTVRPPARATPPTTPPPTAQRRAPGTLLQQTAMLDRQHARDLPSPLLPPLANRRDSTGQRCRRTQGSAARRRQRAPSRSPRRAKPRDARDPLATPAAARSGDTPRAQGLDWRSTAAHQTRASLRRSHSTGGQDPDPSPETTAHLRTAPPPAHQRREHQCNPPRTHTTPPRSARPDEQPRRTDEPTSTHNARHP

SEQ ID NO: 963241 - protein, 121 aa, Homo sapiens
KPSLHCSSSASLPAAVASAAPKNKGKGGKKQTSGVRSENESEKRELVFKEDGQEYAQVNQKCGKWTARSNVYRWCKEVMSRSEEELRKRGWINTSDVIMGGLRDYQDNKADVMLKYNARRS

SEQ ID NO: 963242 - protein, 376 aa, Homo sapiens
MQQKHNSKKTISHNRQERVAHTPEKHNNSKRTEDTNQQNTQTQKHNGKRNRPEQIADRTKSDTPTDIRTPNTKRRHTTESEMNTKRRRKIKGNKDQKRQREASRGHDTAEGARRQKENITQTAANAQAAKRGQRALPPSKGRQRTTANRHATEKHGKQDYYITTYHRKVRKKSRTNRIDTHQRRIPRRQHTQQDIQTEATRKRETTPRLSITAKKTKHEHHAQNNESHTSEDTQDKSTTSKEQRRIDTNGNHTTSTRKEKQRRTSMQERRKQMRYHKLRTIHKQTASEQLQSDTQRATGREETDDERVRGCDEAKQKRAETTRLASIGHNSASLRTTTIPDRREKHGSTSVDNATSTQETEARDVKQVAQGDEAAN

SEQ ID NO: 963243 - protein, 98 aa, Homo sapiens
REILQVNHDVKRNRCIPFFHMRKIEGIKISHSEKAFPECDQSRTRVEKRGLWLRTSSSYGDFIMNWKKRVREASLRICLISSGSHNALWGSPLLGLGG

SEQ ID NO: 963244 - protein, 67 aa, Homo sapiens
APPTMVRMNVLADALESINQLPENERARLRRMSQFESLLSPLMFDRSVFASACDRLTDSEFALGWKL

SEQ ID NO: 963245 - protein, 92 aa, Homo sapiens
AFQSTGAEERLPGRNAAMAAQGEPQVQFKLCMMSGRNGLVPWKKRPLVKSVHCDGVKFWRKGQVHVLAQPCGGVVAEGFIPLSCSTPNRGPY

SEQ ID NO: 963246 - protein, 103 aa, Homo sapiens
VPITGRGPLPSTYTLGSSMTVLGGCRGVTSSFMCTYCYSKSLSLQNLQEDTWLIKIRQLGDTKHLGEADDEPRLNYLLRTPRLPCGERGGPPKGVFRPAVATI

SEQ ID NO: 963247 - protein, 270 aa, Homo sapiens
MSSRPGREDVGAAGAAGVPVCAGREQELQRRREQKAGGHDAQASCSRFKAPGVLLREKTPRGLIRDDDDYSRGRLAYPDVPWHLKQGQREYFRGFSATPTKEGTCGLPSGGTTNVQMLLPGGWAVAQTGYGSTRRGVDQKGLPLFFYQEGNPKRLRAVKRWHIERSLWFCLSLRRTIKADFETGAVGDYQAVNNPFTWGRSYPQIEEREPASNVPSEGYTPTHRQTIITTTTFWGALGPQEEVLKTICWGPARPMWDGILRIRVPRDSGQ

SEQ ID NO: 963248 - protein, 111 aa, Homo sapiens
LIEQPPLKISRWTSQRCQSVEVSSVDQGLERSLLGAHGGKDPRRVVLITPTAVNVERILAWIHHNRENLQRLEILGGKTKSGQPLQSDPEEDDKPCSSHTQKLTGPRTAEA

SEQ ID NO: 963249 - protein, 164 aa, Homo sapiens
MYRGGLCSAQGEENAKRRKSGLNSVIPPKHIAGRLHVTITARWIQGTLGFKILTYIGTDTMLIFKPRKQILLTNDWFWEDAHPLLTKLPWCGRMCPERARWTPGKVHESSKASPMLLWAPFALYNGLARGRYTKKNLFTTIRVECISDKMEAHKPICWACGPCY

SEQ ID NO: 963250 - protein, 109 aa, Homo sapiens
MKVCSYTPELRHHELSRRNEQLWTWRNEQLQTIRLKTVTTHRESLQLHSKASETTNPPEGRNSDTSEHQTEQTPDTIFKNCNTHREGLRFILEVSKSKNPPFRTQWGCI

SEQ ID NO: 963251 - protein, 307 aa, Homo sapiens
DVKEWVVWAAGKWERLIGACGCEPSHCRTLDLENAYVIPDSMELYGLVVGANTLENNWQIHTTGLERLLGLSMDHSEVCGIARESSRRRLKKNLGRIPEMQADVRSREPGWREHYVGLPVVRKWPSVANGRFRIDMYGLAVDRISSFGVCRPSEIDYREERESIHTRPYVSSKEGMNAFLSHPGVTVPVSRDMETAIARWPREMEIRRRRDPFLKVSKCDRGQLTGSDDSCGTSGVGEHTSSDSVSETSAVELFSMALEQYPRTPAGQGQRTCWRDEAYTSVTPHIGDMYETSPGHKRKHASYPTRH

SEQ ID NO: 963252 - protein, 119 aa, Homo sapiens
AQPCVVPRRSRAHACAAAGPHALLSRTYHAAHTPSALRRHLLTHASHPPLQHTQRPYLRSATAALAMPHPPPAAQSQPPSGSNWPLFPNTPGPTFAHRRTTEPLAHTTNQLPSVPETGV

SEQ ID NO: 963253 - protein, 207 aa, Homo sapiens
GGGGGGQSQSWNQGYGNYWNQATATSRATGLCYGCYDYSPYVLLLATGPGYDYSQGSTNYGQEPADVVAIRITTSHTEAAAVWLWGPWKTATEGTEAAECGGRQVEWVTSQMFGLTGYGNYLNQATGYQQGYRAWLWRYDYSPYGYYGYGPGRLTVRVDTNYRHEPATVVANQNTYKPLLRQAAGATKMIDTCLGLRSGVHSIMFQI

SEQ ID NO: 963254 - protein, 183 aa, Homo sapiens
GRTVAGSFTDEASAASPSGGVCDWSGREASANLGGMPSKRLTDEYATGPLLKFQILLLPRALLRRVFEEYTAGLSRQRKPTTSAIDRRRITSLNQLYRHIAILPVRSLKTSINRPELIARQGSYHAITSAMQRLLAIMAAEGPKTTLTVHCTVLNWLPPSSHPPTDSHNPPVLPHTASAHTDE

SEQ ID NO: 963255 - protein, 52 aa, Homo sapiens
MTLEQQDMVCYHSSDSRPNSFVQHLRWCPLTDRSFGQEGDASYLASEISTGM

SEQ ID NO: 963256 - protein, 67 aa, Homo sapiens
QVRRTKGITDTTDPCCFDRNLSDDRSGIWENMSVLLVTSRDWIWRDDEQLIPCLILGFLPTLAGASP

SEQ ID NO: 963257 - protein, 149 aa, Homo sapiens
MFGHSENPHSQKTNIQAAWRLISQEMNLGQKLSHIPFACRKNRLKLPAVDSHPQHDVQRAVQVKLNLQLIRDIRRRGKNNSWLLRIAENKKDLVTQYSYELEPHDSYDLTFRHRTVTHMEPKFGFANMEQTNGRKDDQKALSAPYLGID

SEQ ID NO: 963258 - protein, 43 aa, Homo sapiens
MRELWGAPSELETHCGALSANNAGATRHAKDTRRMGARLSQPQ

SEQ ID NO: 963259 - protein, 373 aa, Homo sapiens
YYTTQTYNTEHTLAYCLNTRKPSTALQHNLRTTQPLNGPRSTLRTARLSFVQRLKPTATLHTPAPTRHNTNCTRANCAHHRYVAPERARTLQVVRYSNASARLCAPEISKALAHKKTLAAPPHEHLNLTTLLRPHHVLANPCCGGLGGGFSHTFGVATYPPLRPPWPSPPFPPPRSLAPSSPFGPRSPSTSSTPPTAPAWLLPLPPPLLRPPPATPPTPFPLLPGAPSPPPSLPPPPPPPPPPPPGPPLPLPPPPTLTPYPLGLPPPRHAQPPWPSPRPPPSRRPSPPFPTLAASTPFNPWRRPPPHPSRPFGPTPPLSPPTARSLYPSPVPSSSGGPPPSSSAAYHRSSPPPNNTRAATLCNPPPFPSYPPP

SEQ ID NO: 963260 - protein, 390 aa, Homo sapiens
VAGQPGLAMRGCVCDAWSWHVQTGGVVHPPGCLLTCVWTHFTPELAHTALDNQQCVLCLRVAISARLTGHKAQTTLHCTRNSFSASSILCTDTHCTQSTDSPATALSSRHSLHLTSSRNTALATCAHLLSHTHTRLNLSYGVNTLSTLLDLVFTPPPCDPLNTLTIQPTPRHTSRPTLTPTPLHFAPHRLPWLPLTLSPLTSRAPFNFLTRLTLAPPVHSLLRAALGPLYTHRNTPAFTNVLYLTPWLATRPTSVSPLGNLALGALPLSPHSLPSSPLSDSQISSGQTTTAVCQPRSARRRTFFGASAHELPATPPFGRVGQSRFLGRTRSLGEPSLLLCLFTLVHASLYLSQSLSMPILVERCLLWSLTTTVLPLGSAPPQRTRGQLST

SEQ ID NO: 963261 - protein, 81 aa, Homo sapiens
TPSFEEGKHGHQVLRRKRMSPKSETLLKSKKQRDSGKLLIFSNAGLERGNATRWLRELKVAMRAGWACMSSQEREEEFNEK

SEQ ID NO: 963262 - protein, 73 aa, Homo sapiens
TVGRLRASFGGGSLGVRTSESFVLQGPVFFAPEREASYLCTRWGVDMAGFLKMSVSVNLLQTFQQVFGAIYPS

SEQ ID NO: 963263 - protein, 118 aa, Homo sapiens
MSKSESSYRARTAEEALHGGWSFEDRTDESLRSHWSNGERSGLCGNERSRDTKRSRAWVVTYATVEEVGAAMNAKATQGGWESVWNQRELSPEKILKRPGAHLTVKKIFGGGIKMKDS

SEQ ID NO: 963264 - protein, 35 aa, Homo sapiens
EKKTQNSTTEEERQTRDKEETENEERKKKRKNRTG

SEQ ID NO: 963265 - protein, 184 aa, Homo sapiens
MTDAVVSFAMDTYWEVEGWPSIVPRQGVAAIERVEACNGAGAQPLASETRSLLYKRKNKGIYTMCSGSGSPDGIREYMSLLRAVIHGPHVIEIEFLHANGRVSFCRIDRLTSMHESFARGWCGQSSNHELQARIFAQESLASSGAVAGIIPGFVYPLDCAVTVYRRMWGKAGAEREFRGSLNAW

SEQ ID NO: 963266 - protein, 71 aa, Homo sapiens
ALRAWNPYASLGVQHDELNRALGMTCQALDSLLTEEFVKVNMLEGGGKVVVQYGIRCKDGVSVGVEKLVVG

SEQ ID NO: 963267 - protein, 119 aa, Homo sapiens
MTMRMAEPLWLDRGNSRQHSAMNYIGGSAHCKTDPEHPKSNGQGTTHPTESPISSNDEQKYSNINVWDMDGRKTYKQQGHTQHNQESTTAEDTTNQAPQTGSRQQQLQNLGEPTPATTT

SEQ ID NO: 963268 - protein, 119 aa, Homo sapiens
ARDVYPVIENEVGAVAIQAERLSGSEVRRKRGWSSFNRHAYADGASVASDEWAMVKRSRVQTGHFMRTLILPATSPWSLLALSSICGLSCVFLMSLVHRATFFPHWALRLVATCWLSSS

SEQ ID NO: 963269 - protein, 265 aa, Homo sapiens
MADCTCYTFLLTTYTASLRTVLHPNNCDWNLYCVLLTLYTFTLHSPLHTQLTSLCYSVRTPLTTHALTNPAAHVLLHRHLHHATAPWRSTRKRTRGTHIHTVALRTPNCPLCYAILSCGRPEMYVIQLCYFLSIDPPWPLLGYTTRHCINNQGHRRPPIPCITYPSQGAFPKQLHLNKELSETWNAINAISTRTHIHLWDTHTQGPTHTRFLQHNLTQTNTQAANTQHCVYNPRITNTQTLKTLTPQHAPLIHNRHAGLTSTRPT

SEQ ID NO: 963270 - protein, 102 aa, Homo sapiens
MLRRRRMLASCYSDPTVSINKVPYEASSLESVDCRCLKRRSSCTCREQLHLRERYLLESASDLEMLKIGDVSRCPEVHLRSSYSILGERERNRFDQTRLSLI

SEQ ID NO: 963271 - protein, 179 aa, Homo sapiens
MNSPLTRSESCVVSIALAMQQCAVTHECHGDLVAKMRLVHNIYTYDICEQRHVVPDHAFVGPTWVALRRALHVMLLYPWKRKRLENVRTCRTYPADADASLGVGRPGGGWALDSVPTWISTGTFCVRGTANCCLPGAPIYFVDISWAPGAFRPFWFPPISLPKLSHIPIEGGSDRAQGI

SEQ ID NO: 963272 - protein, 90 aa, Homo sapiens
FWRREDQQVIDAYTYPESRAKLGTVRRHPYQAVVTYNSEHARVSRHTLQRSMSWCKSGVLLELAEVSRNINGTHFACKSFLTTREAVRGR

SEQ ID NO: 963273 - protein, 163 aa, Homo sapiens
MALLPIRSSIQRTCPQSRGNELAMNAQLTLQQYESFKITLHFLLCAERLTAHRHTKLYTLTAHQHCLKTNCHAYQDPGTFDLSLTPYRTDTNTPNNIAQTHMAVTDDSALWVTRPVIPWASSLRPSSPTLPTSLGYKAIISTLISSPTTNPNSTAVLLKPLNP

SEQ ID NO: 963274 - protein, 114 aa, Homo sapiens
RSSVSAMLVSPWDGFLLLFLRGGVWVQCDPQLQQFQSTVETQKQRLPLQLVHQMTELMWGEVHGQAWAKVGRVGLRPCDVNCVERFDVMTSQFILNRLEQTQKSKPVVSESLSD

SEQ ID NO: 963275 - protein, 180 aa, Homo sapiens
ERAYQKQPTYLSKQKMRALLGETGKVEAPGDYKNIGLGFKTPQGRLLEWHLHCTRNAPFAGNVSIRGRILSGVVTRDEDAEDHCHPPRLSALHPQRSNRLQRGAINDTCLVHLSPSGFTGRTVSDEIRDSSGDVPGSDARQLAAVNRCSRSPDGCAGRKASQFQKLLRLDIGLRSTQNDT

SEQ ID NO: 963276 - protein, 292 aa, Homo sapiens
TQWEDPRSQGQLNEKPFTCKAWEMRFTAGLEFHTFVDHNRRTTTYYEIPAQENSALDNGPQIAYARAFKANALQYFRLLVSANWPCHSHIQALQLHKKTHRSAGTSLSTDNEPSAPQASAQAPYGWRCTFLPAHHRNASHHLTATRCYPPTQLRPPPLSRHTTEPCFHTPNLVLCTWLMTLTCIARTRALTPNTCHFSPTIKHPPRITPLTNPNPQRIPTLDNKEITIPANIHSRRNELFNFSHPTMSTHPSRIPTYGAKRTLSTHSNPPARHHIHLHSLSPTFPPTLTDPT

SEQ ID NO: 963277 - protein, 174 aa, Homo sapiens
MHRVVARMHTRLCTLSASRGPGACILGISLVLWGVQSSASEIFLDPDVSRLAWLVRNETASPIVRFGHGDHTIIGGVISPLTGLFGGLPKRAFCHNWGRAVSGGPVCAPARIANGVLRPIWPQGCESVAGSRDCMTEDAALNGFEAARFLCWIHVCVNSQLRTGFGSREQHVYL

SEQ ID NO: 963278 - protein, 137 aa, Homo sapiens
EWTNSSMQKAVSVSEQIPSLMYATCNTSTALELLRALWTACFCIPCALPWWARTSWPVIKRVLCHCVARMCAVHGLAWTRSRFLWPAAIPLIFKALVSFAKLFEPPLHLHCSLAVPGPNASMLQRCLHCFMTHSELE

SEQ ID NO: 963279 - protein, 407 aa, Homo sapiens
MITDVQLAIFANMLARVALLACSFSLPPCPPPPPPHRTDTARCAASLLPQRFHGHISSCSARLRTRLCTRARLPHISTYPTTPLLLRSNHTIPTAKPNHPLGTHTISKTKPFFTYIPSTHALPPSNTPYSRHQPGNALPTLDTKESPILTESSSAFLSYYHTLTFHHFSSLANNYLNTPHLLNETHLARNHPTTTTPPHHQTTPHHYLHTHSTTAVSQLTTPTRNNKRPPAPHERTKTTRSSRWRIGRRNVMKQKEGAQTSSEVVSQEERTNQKRGVRLRLREQHRWGGGESASPNSGRHTNTVGAQYHTTMTRQTRRKPSSNTHTKHKHISRSSSLLQPSTPLRPSLMHHNTSPLLPPYVHIYLSHTRLHILLLTVLIINTTTLITLSHTTSLLSSITSYLTHSTF

SEQ ID NO: 963280 - protein, 174 aa, Homo sapiens
MYSALTKLRPLPSSHPTAALNTSQSSAQLVNTCCYALPKTHKLATNETILLASHLPIVLFHTMTTAQHTTTTPHTHSKSPSVPPTNVTMLRSTLSAAHRSTLLPGHPGTPPSEVPFPPHKHVHLAFLWLRRPTRLVPQHRTWASNVAESAHNLSVLHLFTHNNTCTRNSLSYAQ

SEQ ID NO: 963281 - protein, 231 aa, Homo sapiens
ANDAGLPHLLSWIRDTKLIGTLVALLALSRQSILNTDACPRARDAQLSLAMQDYTWNFARSLCTRPVTAHCSLGTVHACCRTNRLDTLHRTKERTTRYSWILTHPALNNHSLLKIYSQTPCATPGAPMSHNHLRTRKNKTYTLNFAQNQNFVVHMNDSCSFRAQANHATSPGPFPGFPAPKETALTRYQTNDTAGTTRHSYWAQNASKYGYLPVTYLAPHRLDDSSVETPS

SEQ ID NO: 963282 - protein, 71 aa, Homo sapiens
MESPGLNSSYTPRRTFGTGRYSLRPPLHKMGLPPGHSSYQKRPELHGRTENRRGRTRMALNVGQTTDHDPT

SEQ ID NO: 963283 - protein, 474 aa, Homo sapiens
NRKDTPKRHNKPKPRTPHDINDTTDAHTATPPPRDSTHHIATTDDKRQYDNKHRTNRHTTHDTHAPARTHGHTHPTIQHTTHHRHTHNHNQHTNAPQPYRQQKPAAGTHHIAHTQTHKALQTQTPLTQALDTTPKEQRIIANIISDDATSDIIPENPPHDSNAEYKEDNEKHTHHTIKCRVQGKGPISIEIPRGTQHIIESETIEEIAHTSARKANRDKAELERKTGSQTPKSPTTNRPSHHTTERDSDDEHSASQIAQTERQIDREQDARPEEALNDIMTEAVENLIKYRYNSSNRTKQSMTSIRVQSQQHRRRDKEKQRHQQTDTARRRTLSTHYHHLHNNRKCKIDRNKQGDHGRRIPQSRHHTHRMEIPRERNHHNTNEKIDTYIHHYPHAAREPNRERTDHTIRTMNASQSACNNLRTNRYDTDTQTRHTAPPTPHPTDDKPKSRNGSPEDINTRPPVSTTSLLMQDIH

SEQ ID NO: 963284 - protein, 348 aa, Homo sapiens
GSDIVFKPCVAIPARTAVMPREDRATLASSNYFLKIIQLWDDYPHNCFIAGSQTTVGSKQQHARLRMSLRWEGCCVLPGATNHHCMRTGHSAGPPCEQQPSFLAVNCCLTTPGAKCWRSCCSHQQAHAPLHLPHSRGPLLCHGPKLTALASPVLPRSPGCPLCPLTCLHPLTLLSRSAGTATFAFLRRPLPPQDTPPRFLTPIAVVAHVAYFPADLPSQPPSRVGCPLPLSAPTSPLSRVDLGFASPSSPPPSRLPFGAPDLPLTAFGAQSSLYRSRSTVSPLSLSLVSSEQRHSCCPSHTPDTSPFSTPPRFAPSPHSPLPALLSSRSTLFHTSHLCLASPPRPQLS

SEQ ID NO: 963285 - protein, 93 aa, Homo sapiens
VCDAADRLEAGRFNDLGAIIFWLLLMTLFQLFLIRLKIHKAYINELRRTLDPALVLQTVRPTVTKLLPRQTLITTTCDRTPVRHDTGKTLSRN

SEQ ID NO: 963286 - protein, 141 aa, Homo sapiens
RSLASISVGRNEIRWTLFQPPPPPISSRVVTSGTIFSVISCFWEPDSDRLWWLVPFAISTMSSQIRQNYSTDVEESDSRDLVKFCDLQSSYTYGLLVGFVISDRDDVASWKGRCWHFFRRIGRGEKRRWCTKRSPEDAKAA

SEQ ID NO: 963287 - protein, 252 aa, Homo sapiens
MAISWPHLPLPHEGGQYLQINSASGEHMENEMAHYACDCGDAEDPKRSYGWIEMWDVLIVRYDLSFMHGSHKVPLVAEKPLKEPKTVNVVQLDPVKGAIGKAYNEGCEHWVMEICHCDECYITELVMLCVENGNSQLRAEGNTFQFRNAMIKRRDAEKTDKGQTGPDVMERSLRAGGSVSDGHYIQVRAGDYDRSEFALNVMKGAAQQQRVAGQERATRGSNTRRTRTQRQERSSKTQIRRRHGPTRQGKKE

SEQ ID NO: 963288 - protein, 111 aa, Homo sapiens
MGFLASSENGHEEETIWAFLAGNYSSGDNSQNNFGSGFGQGWAIMNKAAGETFMSRLLVVGHKWSTHWDKDQEVGLRDYMYYANQSGQIPGFYTEKPKTIKLRMDWLTLPP

SEQ ID NO: 963289 - protein, 258 aa, Homo sapiens
MSIFVDTSYLVACYPIRLHLTFANNPWAPLTEVTTLPAGTRKLVWGGHLDQTFLSKGPILQTPVCPGHGNGDQRGPNTLEPDHKQTSTKVSFATYHRNGTTGGKPTGNLPIRAPRTALNRGWELPKKSKPPPPATLHTKTPTTKAEATYGINTRPRANINEPMRETKAWSPLPWAPWGPTGTSHNNSPSYFAKIDTGARSEDNHQSRDLLVTYHTWDYTHRYAPLKCRHMRTLEHRTTAATAPPHHPTANSAGLTPHT

SEQ ID NO: 963290 - protein, 88 aa, Homo sapiens
ALAVQTMEMMLDKKQIRAIFLFKFTMGHKAAETTHNISNTFGPGTANERTVQWWFKKFPKGEESLEDEDACGQPSEVDSDQLRAIIEG

SEQ ID NO: 963291 - protein, 209 aa, Homo sapiens
MTSTLALPWLPEHSNASLVLPTRTAQPSKTLNKRAKPTNTEHTPQSRTPALHTMTILQTNLAHQSLFRKPQGHSQRLTRAQLSPVNPNTKTHARRTFTLPKHLPPSTAQEQERGQHTQTLSLTGLLDSPTPPWPGITRPPRHSNTRPGKTRYRLEQLYLLAKSADLIGFILEPDLYRNTKPYTGQGSTAFHLTKRGMRARTTDRGISRH

SEQ ID NO: 963292 - protein, 395 aa, Homo sapiens
SFSQRRRCVPAGPLATELKLAGILADSHCIQRTNKQANATTKRTEERYDSIQACKLLLNNNLRKEQPRTHCTSEPKRMSEHAKARAGTKPTDSTAASKSSRTDGPQGQQGTPLLARNGCTLHISSQAAFSQRKDYSTNDGHFYTHTAHDYALYQDTLRLDNYATADYNGSSFQKTQTFITLMPARERLHSKHQSIYPLILTARFYPCTRHLEYFTNTIITCLTRFRHSPAIFPFAPITSLAPTTPVGLLTWLPPIVILLVPSAIPLAHWHSCTPIHKLLRLLTTELFALVPPRLWPRSSPAQPPYYSPLHISTSNPLPLPFSLTLRSQITPPARHTPPDATVSSAPLFHPPFSRHTGPHAPPPPTPTQRNRVNTPPQDTTQHQRTVLPPPYPPPD

SEQ ID NO: 963293 - protein, 105 aa, Homo sapiens
MDSSDIRGERTWRSCAVMAYAHCLDAVISHPFVSKERYLVSIAIPPLSHPPIGDERIFPWQGSSDELLEAGEDTVARPMKLEVYGSSPGVDDTRARKKEVRSDRH

SEQ ID NO: 963294 - protein, 228 aa, Homo sapiens
FIRCPRSILLPVSMLLFDLARFCLDTTMDNLSFNWLQVVLGVAVYELPGGLRTIAASAAEKETLERRIGEVDSIFGGTSIQHLYLFPVLRGVSGEPAHRVLVVLPGNIVSEIIVLATPFLAHPSYLDRIADFARHSLQRHLASFFVAGSTIASWNPSQPTPCGYIRDNPSCTALWPVLRVELYRFDRGSHQERPSPSVVTWATRHRGSLALPLAPGRPSAPGWPVLVS

SEQ ID NO: 963295 - protein, 116 aa, Homo sapiens
MSKQATSRVLPYPVIMRTRITRYSGIHLRTMRRKTGHQFVTRLAITQGFASTLGVHIAQGYINSTEQWLPLLRDAPLCILIHDACWQPNGVQYARTQSDLTGSARYSDAIGAILML

SEQ ID NO: 963296 - protein, 402 aa, Homo sapiens
LSLPTSFYDLSAISLAMGQKVAFQYVPGQGRADRDCGFALRHNHPGTSPSLNQLQCRLSQAPWCVLALSPCLPTFGTLSSQCRRPRTLANTPPLRRMSLAAPSRLPPVAQRPTPPSALTSKLCLRRRRSPPRTHGTPTACPLCVLEREPRNAPRHGLIRLVLIDFYSFSLTSPSRAPARTRPDTLLTHPDAADFPLTSRVRPRASLASPVPHARPLCGTKRKCRLAFSVPFWFPDDLLVEAWERGGSEYSSVSLARSSAPNAPVTRAQLAFACRRPPSHSQSACPPHLSPPSGWIPGFPQMVLPPGFGAPPLRVCPAAPPVRACAPSGPALFRRTCFPLRLVGGPRHRAVCYAARVSVVAGTTVVPRTLLLLSRARHFSPPLLLAHRELLLSRGGPPFYRHL

SEQ ID NO: 963297 - protein, 125 aa, Homo sapiens
CCMTVAPSVGCPTCDVPCLVRAFSATAALRPAAMWKDTRLDKFIVSLSCRSQCIQFILCDQFPHAMQPAVTQSCIPILTGTACCQWRVQVTNALYDFDRGNYLLLDFYPLDFTFCVVLQKLLLFT

SEQ ID NO: 963298 - protein, 332 aa, Homo sapiens
MSELDTQSSNLTNAIHHSKVPATDSSLLRDNGPQRIACRSLSLSRYRRTLPAWPWRSTGLLLRCTGAPACAAPSARVGRPPGVFSPLGFRGRRTLSPRRVTLDFHHNCASSFSLSGATSLRMTRPFAPRRGPASMLLAFLRGAKGFPLAPHSRAPSAAPSSQPLPPASLHHPWRPLTPGRSPRPSRHVFTGSPHDPTPPPLTPGHPWGGVGTSAGALALLAQLQLFSWGSRRPSPLAVDFLRCPLRMRLLTWRLPPPLLPPRGLQRGARPPVHRGPPCLAPACTPPHGYPHGTLQHASPFAPHPRHPNRTSASTRNPTPFTRSMGVLCTHPL

SEQ ID NO: 963299 - protein, 157 aa, Homo sapiens
RPSRSAAACSACAHAHLTTDELNPTGLHCLSKRPSKHFFYFIDTLFPAAYTRSDTSGRAHAHTQLAPNLSHWPLLSAAAHRPGSAPPCALPPYHSHGHHYSTTKSAHSTPGASSALQPALRSYSSRSKLAQGTDYDSPCANTQQCTPSAPATLTRTR

SEQ ID NO: 963300 - protein, 66 aa, Homo sapiens
AFTRPPVSRCPGRVLGGVVMRHKGAPHLRPEPDLTWYQYHSFDVIGFLLAVVLTVAFITFKCCAYG

SEQ ID NO: 963301 - protein, 49 aa, Homo sapiens
SPPPPPSPPLPPPCPPLPSPPPPPPPPPPPPPPPPPLNRLHYRALASVC

SEQ ID NO: 963302 - protein, 341 aa, Homo sapiens
MSLEHPWAQGKGSGGEVGCVDPPLKGVCRHYESEPPGVRRAYKIRAANRSPSVITQGGSHPLWPSAYHTSPRHQHRGNQDIAKIRVTSLLSQVPQENWHSRWGGPMGGAASQEDCGDLERVAPTGVLSQNIVWCSLRNRAPHRYRTITQETHIRVIVGPQYREAKIDDETEIRRPFGAALPGQAPGYQLEGALCHKRTWHTTQKILQNERTSQYTMEGSNSRSRNPNGTHPKEFMDHSTNTWHHERLINQDVEAHTMQTTTTNKDAPKNETMTTNKEGGTQVGDIIWATYEAQEDGVCEGYKLRRQAPPNLREKNRAINRGGKNKQQSDQKRTNRGANETR

SEQ ID NO: 963303 - protein, 39 aa, Homo sapiens
MVLTISRHLAVPLIDNYTPLGKHSASWQGAVGPIYDPVG

SEQ ID NO: 963304 - protein, 251 aa, Homo sapiens
MFKTGRIKTWRCVDLGDNLGPRSILGWDGGGPLGTPAERWRNGRTARGENIPARRTRLQSAPTQNTSRPRAGSRYLGDISHTVAVATVGTPVQLTPGDTTQKEESAHKTGGDKHIYTIYGGHSVTAKTLRGGHTTKSPTQLNKQRGALFTKPNHCAAAQRKKQFPDKPPPRRGKTISNKKGVQHKIHPLYNAWCPPAEQRGRANKMSRDRAHQQSPGPPRWVPAHTQENHAGHPPRAGETQTVTQPHKITN

SEQ ID NO: 963305 - protein, 157 aa, Homo sapiens
MKRSDTTWHYTLRPLAPYTGTLLGYPPKDCGASWRYSPACTNSIWPLSKPSVPISLLPNLNRTHVELILATFGTRLWNLPQWKRNTINKRPTTTLGSHAQQRLHSSRLRLKQHYFSIRKTLLLWTPKKWANMKRKTTSDHDGTPLLTRHDVIAESEL

SEQ ID NO: 963306 - protein, 524 aa, Homo sapiens
MWVLLRCKLFLSAKSKWGAPICVGPTHSRGVTRRRGRRAALLKEGQQRERGVAQCGTLTRGVCLHSPPGVSQPPAASSQSGVAHTNNTSHQTRGGDPPRGPPPVQSTSHHTDEVGRRLPRRPGETSRPRGHHAPPHSSDGAYYTTPLHHHTTAHPTNTSQRAPHSARLHPLTPPTERACSLTPAAGPTDTHTRRCLTPILRTAPPTPQQSVVRQPTHTTCPDTATESYYCEPPTHQTHYILAGAALTTLITGSTVSSRLTLTLHVTPPIALPNTRSRTPAPPNIETRSHTTHHPAATPTQNVPRRHAQQRPLHTEHNPRHGRRANTHPHQGERRTKRKHHESNTTLAESRHQQPTRGATHSERDIQTRAPTPSGPPRQSSILTRRDTGSVTPLREEHLPPTHPVSTTANLNTGSTHKAGGAHNDSLDREAYTATEVNRRQPALTSCDDSEDTHETTTDNNMRAKQHPPQPSAKHHVRQPRRLTPVHTKQLPTRLRSDQAPSRTRTVTRVHATALTYRLPQQGAP

SEQ ID NO: 963307 - protein, 82 aa, Homo sapiens
EEHFIALRIFPGGFKANFRDRFVEGGKTVVVRKTLARPIWEVVHIGEKSLYQGSGLGPRVFNNKSVYMRFSLLIRRVVVEIA

SEQ ID NO: 963308 - protein, 295 aa, Homo sapiens
MSIYRQEQYFISMFCYNEEYYRRSLPRNTELWHVTRLLSATKERRYINTRGNKTKKAVPRVEEQYHKGGHCGHKHKMWQHKAVSVKELRTRNRAGAPPSPHSIELNEESRHHTDADRAHNPPNNECGRNLSYQQRGEKPATTEHRHSVEQHHVGGRQNTVRYTHERGDDGVEGGGKHHTDNRAANNPPITTGEAPPPPEEVNEINHDGAWTKHRVIIRETCRVVENNPPKGGGHDPRYSGEQPAPGQRTNSSVRNERMTADDVVNQLTGEKHVERDEAELFDNERKRRTRRKHTD

SEQ ID NO: 963309 - protein, 322 aa, Homo sapiens
RGRSSDFIMGKEGLRVPAPPPQSPLSGRLVISPQCVKVRFSCQGGPGITQVTRALVDPGANAHWGAVVVARRKRWTAEKERSPWPCEKKAVERKEKSAQQDSKKHKKRGSGLAGARAENTTASAEYPTMRGGSRGAPYDKRGTPHKESALQGVGIQRVTNKTHEATREDDEEVISQSDNTFGESPHKEGNPQGTWKPTSVASNKDGDAGGTTVSHHKKTYVAQKRAPPRWKGTPRGGRDTWRSSNRTLYNESYQEKTWHARDTDQGLPHHTELRKSRREAIHQKEVAAVNTACKGEHQRTIATKENGGNRGQQHTARGYEGP

SEQ ID NO: 963310 - protein, 282 aa, Homo sapiens
GTKGFFPQNQTPCVGLKKRGFGPQGSLCVCVCVAQKRFPRLFSSHKEGGGGAAVILWGKKMRDYTKKLRRYDPSKKEGGDIRARKYRQRGCLEREHLSRPSGGDHKGSRTQGDTPAGGESRCTHERAWRGDKEREGVVRHPGGKSKGEGVPQVVNPQLSMREGAHISVSWETLLWQCVLASETPGGGRNNPTAGSPRSSMRRGGNTTRKDTTTWVRTRGEQTIGAEQHFGLGIQPHTTKSTSGWCSSREDTACGTIEEKKGRARREEVINGPKCRRRSNNTS

SEQ ID NO: 963311 - protein, 380 aa, Homo sapiens
MSRHALREITPARVWRAGIIAAGERDESRYTTTTEDKRRAGGAGAVEQRPTPHQERRDREARGADPPRVGRREKGSAAHPPQKERETPSGVGGTTHTPTEGGSEIKQPRGDPAPREEKTHLVRDTARQTHRRGGDDKHRSAAAPASHNTKRQPHTRQRRQRKPGRPTQQPAKDGWRRAPKQTMFVVQQHKKLHTAEEDVSDQPQPTHQKLWENDARNDTSQLSDEHATGRRRIEHTHPKWVGRQHRAIDVGPRPGHTATTPFVIATARASETTGQVHTTTHTKTVMKECEGNADAHATSELPEHEKRRASAQKIIPHQAVADPTDARQPARHCMYRRGAAPKQKREDKTIQASRPGRQPTRMKNSTPVALVDDHTTVSEM

SEQ ID NO: 963312 - protein, 256 aa, Homo sapiens
CAVPRGREAKRLGVPARSAGVRKGASGQEGSGRDTLQCRRLSSRPARVLTDPASRPPPCRAAVREEDSPPRRPGLPKQESSFPVGRMLRYIKKGHPKYRIGSWGHPLYMAAVLEYLTAEILELAGNAARDNREGTGSHPGHPAWLVANDEELNQLAKRSQHSQWGCCYPKYTRVASEEAGIQGKLEAIIKRPQQKRQSPSQKKACIYKKAGGKKGGRKSKEAGVKVSKGGKRDRKRGQTCEGYSPFHEELSWQKLT

SEQ ID NO: 963313 - protein, 189 aa, Homo sapiens
MWLLWRLLVALFARCSFLSRFRSPSFLVLCFLLWFYLVSHALCCCVHGCCGCSTLPFFFGVVCRLLVWYSCFLLGVPLVFFFVFYGSCFGFSLHLVVYFCPPFPFSGSCPLRWFTSVVLSPLLVIVSGPPSFHRVLIFPGDGPPCVFSMCVTLLLLGSLTLNCVPLPLVPHVCIFRGRYPVSVGIVILY

SEQ ID NO: 963314 - protein, 209 aa, Homo sapiens
RGVTARQDLSRTPLQGSLVGMQEHLPPIPRRSPRSLHLAKPGEGGKHRERDNQSASWRTGSDAQELRVENFGGSSPIFMGLQRTFPVSQSQSAIIIPSWQQLRASFILHDQMPSEIRRRTETLRLWERLLCPFYPAPLTRDGQVGFPSFLCVTIMCRALTLACNDYFVVHMRAVKAKGRVRQNMSTFCSSVIRVVPKGRLRNLPHSFPP

SEQ ID NO: 963315 - protein, 119 aa, Homo sapiens
MVAQGRGVGVRHQSFVVLMVAQRYLLWKAFGRAPGVLLGEASTSGNLASGGLQPGAWVEIPGPGPWGLGAFVAPVKTNAFRAPPLWGDKYNRGAHPKKTTRAFSPQKAYWEGVWAANLG

SEQ ID NO: 963316 - protein, 535 aa, Homo sapiens
WGKGGHRYNWAGKRNHSTAGPEGGTGGSLTPLLSLVWSSRARSPTSVCPFVWVFCSFYSRGARGGAPARRGERRGATEREENRQSVTSAVGETLAGAETKEKRDSARECVPTHTRWRARRHPREKSGARVRGDSSTRARQRVRAESCENCGAKSAPSACEKDTTRADRARRGRPASKRKNSPKLIKKSPHGMWRNLTRLANLCGAPAYSTQGHPPKSAGDTQPAVSANNTGTRNTAYDAKGHTTRPRREGSTPFFLDNIQEARWSKQRRILPEERGDAPCAREDIPRRRHHGGAKKIRGEPPAHRKKATSQIAEWGRHPGEKRHPNINTSRQEKIPTHFCTAPTMEGNNSKPDDKHIYPLEAKGGAALHPRGGGGGAPTTFIQSRIYEGAGRHKHNPPTKRASAGGGTLGGGVPTMSACEHTCAGPPSPQMVIKQTLRRDNNSGAIQHLNRKEAEYTPPSMRRGGGTTNETITSAADMPPQTYSPAGYPKGVGPPTNSRATNGIYIQSKDDVLPQSDDIKTPARSNAAQPKRPAA

SEQ ID NO: 963317 - protein, 151 aa, Homo sapiens
MPYLPRDRAIKSVIGQSNALLMDLAITTLVDKCIIGTSDGGTPRQYRVYNPQHVNRSLVELHKGPMEDWDEGEEAGNTFRTCGLTPWIPRILIDKRANVGSRCGYIEVASFLLASLAFEFSSDIVPIFLWNGLGFHKISFLLAFEASCANR

SEQ ID NO: 963318 - protein, 151 aa, Homo sapiens
GGGPGAPCAGVRRMGGWVRVPGALSVRLFSIAVRGSTLGPVNRRARAPEIGSLWLRGRAEGRSCRGGQMARAKVKKAPRKECVVVANVDAGDTQQGPTPSEAAGLRGACRGTVVNQSEARERAARARTPMVVGSVRTTRVNSVAAARLGVS

SEQ ID NO: 963319 - protein, 133 aa, Homo sapiens
MFTSTPFTLLILGSTVSTHFTIYLMMARCDTCSHITKATTHHLSRNRPCDIGDESLLITLTSVILFAGISSEPFTDSSLAPTPSYEECIGPQQASSSAKCPLEVATPYTHPYYSQQEYQSSVTLTSSLIENKP

SEQ ID NO: 963320 - protein, 38 aa, Homo sapiens
ISINKSHLKSHPIFTIQKPEIYLYRTLGFNSVSAFHIL

SEQ ID NO: 963321 - protein, 130 aa, Homo sapiens
MASISAPVPVTLWYPHSLNSAIPGFIHPDPLSCFSLSTPVCSIVTVLHNIYGTCETAQRATVERLLNCSTIGELTEESSRKQLVWLHVNSFQPERKTKTRSKGDFSSLMSQLHITLVYTARSNSELAIDT

SEQ ID NO: 963322 - protein, 243 aa, Homo sapiens
MLRELEAEVAVEVRADCDQAGHRSPSSSLAAAHPCLENNFFRSKERKTKVVVRPSRPLLPLSLPPVRKPGVAAPPSGPRRRAHGYAPGQTPATTRTPMHPFIHPVPPLTERARNKTLQSDDPLDSSQRYSSGTKGDFTHQNDTHLQHTYTGQDALTRHTAMHNNTRHYNTNTRGSQQRDQRKGARGKPRYTPLNPSTLDPVKTGPRQGTHRTATGARKKQEKRHPPKWNTPNGQAPKKRHTTS

SEQ ID NO: 963323 - protein, 186 aa, Homo sapiens
NVVIPLALHHMSVLDVGLLASSMSNVYGQDLTPLKIFYMPVDVKHFLKYFRKTVAKIRSIRGGGSPAVLNQRHPSLCEDPPGLLMSACRLGLRCADATFLLRWDWALDTTPQPLCPHCLASLGLEWACDGMTVGCLCPQLVPCSLSGSLLAFRVLFPQSPVWDSLLLLRADSMAPGQIVLVTRLQY

SEQ ID NO: 963324 - protein, 358 aa, Homo sapiens
MASSFCLRVSRSSSFVFCVANIFCSSALCGDQCPTGVPLSEVPVLFFLSVAQYRSVHTALHLRHLPGWLPLVLSWRLSLSGVSFVACLLRDFSHRVPRDPVPLVYHLTVSATFAFLLLFLRLAPFRAVRLGILSLRMCGELPVRLLLFAPLFFPSLCDLSSGDGVVIYGVGFGRFFLLLLVVSVCVCCLAWVCGPPSTDFLFAAIRLVCPTSGVLCPYVSLDVCSPVGLMLSSPLFVECALVCTRVRSGPSVDSLSLLGMEGSIKGGSLVSVYRVVWLDVLWYADLGCALEPLAVLSRAVPFRWRMSTACALGHVPLDPLDVYSYTAFDFSPSSDTSVGALERFLCELFSNVLTRLSV

SEQ ID NO: 963325 - protein, 193 aa, Homo sapiens
RVPAPFAGLGVSGPFLDAVSLGFFFRWNLRWSRQDLRALPVWDAARAVVLHLPSLGDSVISVRPIPSRLRALSGRPQHLLEDFGLPLSRRAELGSPGRRGLAGPEGLRWEPGRSTWYTGTSSSRVTCLLGGHLGERTEACSLASRLCYVDSNESELSSVKPTGEPGRSGPPIAAPFPFQQSSTRQSKHLDTST

SEQ ID NO: 963326 - protein, 80 aa, Homo sapiens
PVARRCLFCFAARRCVIYVAVLLSPVGALPPFRSNSCGEGRAALSGFMNALLIGSSLSLFERQLDGSFLFPPPRDAGLSL

SEQ ID NO: 963327 - protein, 249 aa, Homo sapiens
MVRVCSSTEALSDHHESIHGRHLGWKPNMVTLQAMLVTLEVVLTDGDSAIGDAYHYRCDLHQCTPVCASGDATFAVLEGQMCRRYGCLMQPANAQLDIVSPLSESPCGSCRVLPYEPERLAGLMALKGHEGREEWRTVNGHAHGTEYSHSRVHMANRALALYKESTAAEDGSGHEVLSAQRVPAYRPRKPSAILKSEVITQGHAPRITSRPCPTLHSGKKEAASSGLQAGLLRALSSLVTVVYGVVCEC

SEQ ID NO: 963328 - protein, 104 aa, Homo sapiens
MMWIKHGSVYFIVFAMLRMRSSPRLCICGRRRWGQCSLRYRSGAETCFSLKRVGMQLFSIKGIICYSLLLSVQKFSFKATKSLGAAAEATAKAVFPGESVISLS

SEQ ID NO: 963329 - protein, 176 aa, Homo sapiens
MRPTFLRFLPASAYLGAPSVCELRSPRRVRELCRSQAEKGVVGATWSRYIKGAYIWCSLFRRCASPQRFFLSRGHHRCSMEAPPSRHNAQRLFSPGERLLFCIKKSYNPTLPTPEKVCSFICNSAGEALYTRLWVIAPRFTTPPTSSCTYHVGLGFSIPRTLILKRKKSKGASALY

SEQ ID NO: 963330 - protein, 105 aa, Homo sapiens
MAVAEVSCFCLPLQLVMLLRRCAASYWARVVCGARRPLGVAPQLPSPPTCFVAGWAAAPSLTPCSLAGMATTSAEIELADVEPAAFLALAEIFYIQMKFKLVQKQ

SEQ ID NO: 963331 - protein, 114 aa, Homo sapiens
MLIVSDTSAGVVLPSGLPGVSHFGCAPSPHGGRLWFRPPSMVVDHRSFGGTQALYGVFCGTTLLLQPAIKLVWTTWGKDTMFRRLVGGPPQVFPSILCVKWGREPRGDCPVLSY

SEQ ID NO: 963332 - protein, 125 aa, Homo sapiens
KKVTLFSLLVWDKKKGKGGGFGGISQKNQSPFPAARYLPLRTLAGATNLKAGAVEEQPAEETSRVGAASHKGGGRTAHKGDREVGTQPQKRGAWNLLTDPRWDRGCITCAILTERKPRGTERLPV

SEQ ID NO: 963333 - protein, 102 aa, Homo sapiens
GKPVGLAKERTWNGREAQDGGAAKESPPGASAKPGQQTGTRKMPACLQKKADQKMNPLGGKQFTGITLAQGTVRFRVRVPASPTRVQGAYEMGHDRCGLTIV

SEQ ID NO: 963334 - protein, 115 aa, Homo sapiens
CLRCLRVPFAYLFYCLIRILDCLWSDFSYRVTVLLVSHSTWCVLRGPSYLAVQSSFSSWVSVAAHADLVTFPVCLPVPHLCFLYITFLFLCHEYYSCHVAAPECASEPILVLRVA

SEQ ID NO: 963335 - protein, 139 aa, Homo sapiens
MKPLGGPSHQRRGTSNAPERGENFGGGRKNTARTTLLPQKKRMIVDLPPPIIYPQDVRCMIFKGNHTTLWKRPTTHRNLLGPPQREKIGGNVEKAHKPCPWKGRYIPANESYLENWGRKKTKFGFSKKIYGAPKREELL

SEQ ID NO: 963336 - protein, 78 aa, Homo sapiens
CDKADESVSIREFPPMGPTSSGFQKAIEWRGPHPRVSGPQRGVSGQPLSRVLAISDYGDHVGSPRKCSEPYSGSSGVR

SEQ ID NO: 963337 - protein, 334 aa, Homo sapiens
MSSRPWLRRVQATTGPDSPMGPPENACASDHHPAVLPIDVMGTSPGISPAAAAPCHPDTSTRIPITPDALVADQSQDHCIDTGTPWPSGSVPSAQREAQPPDRLVTSETPTPQVTRHLLTCHRRHLRFSRHRCPGRLSQEAFPTLTDPLTRVHTFPLSQPHSLPSDPLGWTPSMAAPAGCWSHHALLSGLKNDLCQSHLAIDSKPRTMKPFLQHEHSTTHSARHRRPTGIHTPRRDQHRCTPNDTNRPHPTWPAPTPLPNDPQITGGTQTTPIPPTIDPETPYPTQLMCTNTNKLIDNCQLEADNGYDRYTNDIHASTLPTNVRAAVHNHTSNF

SEQ ID NO: 963338 - protein, 72 aa, Homo sapiens
LYHVTVHALPDHYCSPVAGSSTSVFRDTENRDSERSPLGTHLRIPIKITVSSPLLSTIKDALGLLLVRCLVL

SEQ ID NO: 963339 - protein, 63 aa, Homo sapiens
RAGRLPASRSAIRRMWTDEHRSDGMRNGREGQMNGMDIRYVLGDETIEMKSREERDEREHEAE

SEQ ID NO: 963340 - protein, 129 aa, Homo sapiens
CVVCGGGAGLSVVVCRSLLGVSVSVSWRVSRLDGVFTSWRLSVVGVSRAVVVGPAPWVVGGPCSLLFWVRAVFLARWCPPVGKLVRVVPLEDSACPEGFQMARLIPGPHFVGPCLTPWPVLATCTLLFP

SEQ ID NO: 963341 - protein, 77 aa, Homo sapiens
EAPKPPEEPTLKHSVADELANAGIRTHALRQRPRIRRTLDRNDRSSACSQSHPGELIWSHARLKYYEDNIIAGVICP

SEQ ID NO: 963342 - protein, 172 aa, Homo sapiens
TLQSGWNVEPLPWWTLVVSVIPLASWLAVRGQGACGLCRAQYLLWDRGPCLSGGMASESWIARCRRLMDEELKRCARNVASLVVGFALSCRFARGVVESSLCWLLARDGACLGSHALAARYHERNTQKRVCPGASGCGASVFWVIVAQRSVESAMLARSSRSPSGVPLGTTC

SEQ ID NO: 963343 - protein, 311 aa, Homo sapiens
MLCVVCVCGRFVCCCLCLVLASLCLLVFCFSAGGAWVSRPIPMGGCGGFVRGWARVRCSTFLALVLSFVSADWALPSDCARVSGVVVCGVKRCVCLALPWDAAPWRTRCRSALKYHVPMISVVFLTDSAHRTARRPVPVRRDIDVRVQIGSSSTCGHLVSPLRCGSDKREQFSRCGSRTRVAYYVAACDDSGVYVDAHDAIGNGRPAFTQATACERQACLRPRVMPRVRARNHIVIIPPWRRILAWLRSVTLRLQVPPYEECHATRHARGKLWLPRQLPLGSLKLRPAGMRHPASPLHSLLACRRLSICDP

SEQ ID NO: 963344 - protein, 264 aa, Homo sapiens
VVCGLAGVCVGGAGFVFCLLCVVVASCCVCVDLVAVWILSLVCARVASVWLVSSSSSFVGAVLWIRWVRCCLAASDDVVSCVVWRAGVVNRAGLFLWAAASLFSCRGKPLLRRAGLLPLPMRSPPAALVFLPLLRSDCLSPICSPGHRSDPSCLFARRGYPLVCCATLCAPLFLGGPAPICEPTRWVRHENVRRRGVGSTPGLSGVISPPPGLYFSFWCGPSTAVVSPAWQGGWFLFAPPWRAPRVWRRPRQHPPIGGAVYFLE

SEQ ID NO: 963345 - protein, 118 aa, Homo sapiens
MHTVEVSKFYRAFALLKGFSLALPYRLHTLTGSDSLLLQHGQGTSYGHGAAQDISADKSTRVLDTTLQALDHEGLSVLKDSTVTPRRVATAKNVAKEAEPLLIAGPGAQDFILLTQIR

SEQ ID NO: 963346 - protein, 264 aa, Homo sapiens
RLETLGALNRGRNSDICGHQWRTLNEYQAITVRLGKCTATIAGPVLGDNCPHCEGHMSQPRHTVLGPEKTSRFTRHYRYDPLKNLPGAPDEILSDSAGMIKNRRQSGSPANASRMLNIAQHLPRLPLVLVIQQSDRQWQHHTTSRSALISQRKLCILASLEGVRDVDSVCLQIGYQLVHYYPILSLNGYKRVLALSGGDGLHLSHILTEKVEAFCGCSICLCGCCPCGCCHYSCSMLLLQPQLKVGTKEESEESDEDMGFGLVI

SEQ ID NO: 963347 - protein, 174 aa, Homo sapiens
MRRPGQRQGGACPQARARRARKEGSAAQAKCRRSAGVLGGFLRKRPPRWRSVAAASAAGPPQRRAQRVESARRLREGAASQPAAEAARTLSQLASAKEVEDAQEEAALEQRTAAAKEPGLRSSGPGGCQPRASGRHEKVAESAEGDGRSAKDSCFIARMAQAKQRGACGQPDRP

SEQ ID NO: 963348 - protein, 71 aa, Homo sapiens
QVGVATLTEIVPRSVARSLAASGGGTHVSQSALRWAHSHRARTDPQYATVMKAQTRRTGSATRESGATSLY

SEQ ID NO: 963349 - protein, 315 aa, Homo sapiens
EKGGPAIQIREVVIRLGEKIIQGSAIVGSRADPRGHFSKETFAYLGTGPCLVKSAEPRSVKNIAPEDFSVVVSGQVLRPLGGSQGHWDTFPHMPWFFIPRWARFVPCLTWNGVSKTTGRWRVPQPTPSNPRVSTPGFILSGVSTHRYWRTFLGPKPHGHSVNPPPQLGHTSPLGWAPAGQSSSQHNAGVQMLLRVNPPPSSTTSHGTHSTCGLYMAPATLAPLPYFLFTFFIKCCKENFLRERTPPRLYSVKVGSRERGHPHALVPLPFGTDHGGCSMCVKRWDHFPCGTVASACPVCWCRFSLTADPEKGVCAL

SEQ ID NO: 963350 - protein, 100 aa, Homo sapiens
ALRSMHKLWSKSCDYGRKLKCQKESQFSTPSVIALTYLATCELFRHKGDYSLSSVTDITREACDMKALDIVCGVHDPDGSSDGQASACYLSGKLLQIAND

SEQ ID NO: 963351 - protein, 125 aa, Homo sapiens
MHVCAVSSAWVPVSAGPQVISRAAEAYVTQDRPLNWTPDFLLGLLNRRMCDSHWAQTGKQLLSLCYPVISWKPWGQHCVSLRLNVTLFRFSSLPDLVLGAGRPVTVRYCVAVSVEIHPSSFTAMT

SEQ ID NO: 963352 - protein, 135 aa, Homo sapiens
MGTGRESSLGDTANVNARVLDPADREETSRGTRNDPGRPGDCLSAEARRGTADIHIKVCDQQGQTRLLEDTLAESLMSKGETPRIRKDTEVLRNNQETHVGSVNRVPGRISPRDNIRPEPQTRSGKLCFKTATSG

SEQ ID NO: 963353 - protein, 33 aa, Homo sapiens
MNSHSIPPIPLRPTHTPHYEVTSYNLTLALLIY

SEQ ID NO: 963354 - protein, 119 aa, Homo sapiens
MKAWNWLLYQSTPLHSQGSGDSPGGYWIACQLRYCYRPGEQLPAFAKDLSLILRSRANALRRDASIAQQLMKRHLSPEIITVSFCGLVLCPMAVSETGNHRSRRHSLRRVCLTSKKALS

SEQ ID NO: 963355 - protein, 171 aa, Homo sapiens
MARYQPANHRITGTQPQYGCFLKANEGPVLAKWSREHGVFKMATDVSAISGRRQNGAPTKRVHKSNSEDTEIHGHFGHQPTLRVLSAINVVRPRESTTWVDTKSTHYGSNPIPGIYLPDSGAREWPPPITPGPPEADRFKTTWGTRTKSVDVFPSDNYNKHKWVSFFVSEN

SEQ ID NO: 963356 - protein, 534 aa, Homo sapiens
ASQIACCFSRLGSIPVSSGSATSGVNDWPVDVLSAHVSRRRRRSAGYSCRSKILEGLLALTLLRTLLSRITQAGHARSCALTAYYVCNALPCHTSQLRDALSRRNRNTPSPWADLTRGTLLYTKDNVTCCDIAQVYPRQHNGYRRYAYLELYRSFTLHSAYFAHATKPNGHIKTSQTARVRRNAQQTPLYQSTTDSSQLSRSKTSFPAIVPLGPRHILTAHMRSAPRANTTTLVALLSHLSSQPTRTQDPHLGRQQTADSDFDPNVWPWTRNTRNQRHTTPTSAANANAPPPTTAKRKPTDNIWQSTSPSPLAAICTPTYEPLSTTLRQRLTQPNHNRRYLANHILLALIGGTLPTANNANPAADLPTFHNQTAPTITKLWCNPYTKRHKPHPGPSNLAHNTKPFGSSHQPRTASAPTFGSPQRHITRSHYVRKSTHKRTNTQPLPAFPILPHIPQTHTSLLRHSPAHGATTAVTTVIDIPLVAADNTHHAPYHTRKNETTHLIEAPHRIGADYVKYSSDHLSTNNMGQTHCTR

SEQ ID NO: 963357 - protein, 163 aa, Homo sapiens
GQRIKNRRLSSAWRGLNSGGTPKFGKKRAVVRPQNEGEGEVEGPARPPSPTTKPCDCAPQRWSPLGFSPPLEYAYIGLFFGTIINNQDTHPQKHENTNGEIKKKHYFTHRVRHYKSSPLPYLANIPSGTPVARERAQQALRSTGAPTMRARYGTTGCVNTIEG

SEQ ID NO: 963358 - protein, 191 aa, Homo sapiens
CPTSCGLRASCEPGRIPASLLSGCTCAAWHLALCHFPMRYLCCCCVLLFLCDYCVPCVSAAVPFLFLRLCLPLHVKHAGYLEDDAACEMFGLQLRDASVLPGAHALCCPRMAWRHGLLGVWPELPACMDDHLPRVPAVLRRAHDALTAGHNILLRVPRPLLGALAETNVSLPAVPGDLPAEAHACQPGTLA

SEQ ID NO: 963359 - protein, 111 aa, Homo sapiens
PQARIVEESADEMFLATHFAVGSIETPGGSHPSRELYQNIVLGGVHTPIRFGRGKQRVIGEKILVGNFVEDRPSSAQRVTRSPTKYFLLGTTKDPMGRVPSWGFPSAPPTM

SEQ ID NO: 963360 - protein, 165 aa, Homo sapiens
ECVAQAAVLFDLLTSQALRSERTLVPAWLPPFTRSIMYKTESFRACGRDEFGRREFDLLLMRGGEVPMRLRVAKPGWRATLRGDEKEVLHERQVRRPSNQTEASAKSGRDSRKLSPQRWKVGRPRYREAQTGLPTSVEACRRRERDRRIEEVRQERRIQTDPCVT

SEQ ID NO: 963361 - protein, 241 aa, Homo sapiens
CGWDIVSVAGRCVPERGLGACVVKRGPTGDPFWDVCIRGDAALSPQAPSGVAPGLPAGWGSPMGLVGQRASSRVHLRHNGSSRRPIETPPDARGRPYKPPRSSWQMSSSGVSGWFRHTAVFPAPPRSPGVLQPACAPDEALIWVYAPRTGVVDESPAERGGAGKDRALGDNPTPVLHAGNERRCPPGVDPFHSFLLPVTLRALCSVEAPMPAAAAQCDEITIPVAFESGSLLGGPEAALIR

SEQ ID NO: 963362 - protein, 55 aa, Homo sapiens
PGAADGRSAPAPCRLPAAAAMPFSNSHNAVKLRYPAEDEFPDLSAHNQTIMAKVL

SEQ ID NO: 963363 - protein, 220 aa, Homo sapiens
VLYSLSLLFSLSYRVSVLFLPPPSLLLFFSFFSSFFLAISFDYLCLFLLSTLFFHVLFFLHLISFLSFLSLYLCLFSSSFIVLLVSSPLLSLSLPFSSFFSFYLFFFFIFSLSSFVFQFLSFLLASSLFFFFSFSFFFLLYASFVFLFFYLLEFFLPFSSPFFSPFLFSVLSYAFFAFFLLISFVFLCSSPFSFSFLFRLFVLFFAFLSSSFTSYSVVRF

SEQ ID NO: 963364 - protein, 192 aa, Homo sapiens
LEEQLEDSCNNYKIWRNAERNLIQHAIMQANPKRQHSGSQLSAISIAFTQQQNSCLAQSCTLCSMQLTVAHAAWPIPGQAHSALVSVFTTAPQAGVHPSNLAFGHNMYKPTRVLTDVYRQQRLQPAGIVDQQELNWLVKKAWEIERTLLQLQSKYRCWAAINLRQDVPYKGQKKTVMGGKARQKGGFGKSRG

SEQ ID NO: 963365 - protein, 189 aa, Homo sapiens
SVPAPPRGDHRFQTKTVNGVWRSESRQDAGSRSSSGGREPPQLCEPPDSAQETGEVDQPIPIARLAQHHHVARSSPHTPQTSRLMQEDFPQAFTPGPDLQKPFPMNGKPWFGNSNGLGVDSHNTCIKTDANTKEKHNHLTAMTYQRPYHQRPAQTDTYPELDTYTIGTTQRFVDPYEENNRDTAGTWQH

SEQ ID NO: 963366 - protein, 305 aa, Homo sapiens
VRCWYVRWCLVEYLRGSDVVVGSYCRFVRLRQQGGSGVLRLCVVGSLLGTLGCRGCLVCRRIVPLSSIGCSLRGASGSWAVRGAAVVFSCPGIGDLLLCLGAAVYVSSWGCLRYGALVSRSSRGGGLFLRVVRVGCVAVASCALATPVPDDVVRLVRIGVCAMCDWWAEWSVPLLLCVSVPVIMCVCVVLNVRSRFRVTTLWSLRLVRIPLVGAGLVSCSGSDAGSAALVLCGCALRCLRWGPHVVAWVRCQLGCHGWSGALLHNAVAFGARCVPCGRGVRVLRASSLGFDGLVLSSRDSEGVCD

SEQ ID NO: 963367 - protein, 240 aa, Homo sapiens
WVGYHQVASAYILHATRVRQPCVPAYIFLGSDSRRSSHAVCAKGLTGALRRRTEYRVSGNQRRHTVWTTVSQNTEGARRQAMHGHRLLVLPESRARVLAGPCVYRVRPRLWSLGLVRGGLWVCAVLLPLTWLGVFRRFCGRPGVVARGGWGRGAALCRLCLPSVSSGSRRACGSRDCGFWLPLLVLLVVLSSLLFPWSPLVYWRRSAGVGGACSSLTSAAVVQGRLGLLRASLVACLVPR

SEQ ID NO: 963368 - protein, 127 aa, Homo sapiens
RPLCRGALVGFPLRPLAMLWLWVGLLCAVFPVFVGPCPLVLVFGFRLLGEVGVLLPLVALLPHGAWVLCCPGCFFTPYGLCAGSRCSSLFALSLIHLCFLLVVNCPACHHRQWMTDWLRLVASGSGT

SEQ ID NO: 963369 - protein, 354 aa, Homo sapiens
RRIEGKDLMPWSSRQGALLFTMSLSPECKSLGVPLPKSSCVRGLSRRWGGSPAPCEPRVGAAIFIENTNSSSSERVIIRNPNPLFVGPGSSLSCGVVRSGRRCSHIGGSSLMGPVWKGDRNLCSKAHWYRQPGGSHMSSLLWAWMLNVHVLGERLSHRLLMMMDAWLHGRRWLIPVGVHFPLPPTYFHRSVWSPEPFLVDRPGIPILEGVCLLGSKGPVVSVFAFLFFFSLFFFDEQSFIYLLAQAGVTMTRSRARSNLCLLGLQAMLSPQISQVAAITGAHHHAQLIVFFVFLVQMGFHHIHQAGLELLTSRDPPASASQSVAIIRCEPSAPAQLSYLTTPCVVHINFTLLHI

SEQ ID NO: 963370 - protein, 101 aa, Homo sapiens
MPPQSAVFCGAPFSRGCLGGVSRGAAPFFGTRRVFVGGKFLYLRWVENTTFCLGKRAARKLAVAARRRKIGVAAFAAFCSGGNRECVRWEWGAPRGGACSV

SEQ ID NO: 963371 - protein, 108 aa, Homo sapiens
DSLCFVLSDDMLCRAQSQGSVLGARAVFRLFVGVPAARLSPEVLFGMGAPVPPSLWSAGAIYSGLPVVRARVATCGIPLFVRARISRPFVVHRVSSPVRELARNHWDP

SEQ ID NO: 963372 - protein, 104 aa, Homo sapiens
MQTTWRDTTRLARREGDQQSRSGHPYWRVVKHDTSANQSPAVQRQTTAGVDSADRHPPRETVRPTTTTSVVGPLARPRPTLSRAPQAAVKHPPQQHNSHQNHHT

SEQ ID NO: 963373 - protein, 89 aa, Homo sapiens
SFFSLFSRLLLSSLFLFVFVAGCCRLLCVVVFLSSVPLLLFSLLLPASSLALFLFVSLLCFLFSSSLVLPLASLLFSSCVFFLCSFRYP

SEQ ID NO: 963374 - protein, 108 aa, Homo sapiens
MFAPRKSPHFAYWGDQERHVLDHTLRPPEDWDLELTPGIPHPLETVDVEDLGSPGGKGFETLKFDIRVENRAWWLTPVVPALWEAEAGGSRDPEFEARVAHMVKPCLY

SEQ ID NO: 963375 - protein, 66 aa, Homo sapiens
RQSVEADINGCAGCWMSSLCLRLTWDCDREADEECYFEEDLTRVQDFAPVSAHQVVWCPPDACPFA

SEQ ID NO: 963376 - protein, 191 aa, Homo sapiens
TWEAEAGESPGPGRLRQENRLGWEAEVAVSPDGPLHSSLGNNTKLRPKKKKKKNPRGVEVGKTELPFLFITAITSVFNRGGILRRDRYSRRESSQGCTDTWWRGWTLQELLALTKSSSLDGVNYSPSIENVYRGAALGVREHVGGGVALLGGGEGEYDQGEVIAVYKRRRPKKRREEIIQGVWRQGRDLGP

SEQ ID NO: 963377 - protein, 208 aa, Homo sapiens
LIRLLDRRSCSAARLLRRRGLRQLYTPESLKLCAFLFNAPASDHRVPHHVRRSRRHQLRNHHKDVTEQKKEVWKRQKMEETPLLTGMLMRTNGEQEADNEETHEEDEGGAGRGRRKKKVMVQEEEADEDEEAESATGQAGLAEDDEDDDVDAKKQKTDEECPRRAPKGTSYTLDKEGGRRVTYSTRPIFPVFQKIVKTGGSTSGDRRR

SEQ ID NO: 963378 - protein, 503 aa, Homo sapiens
KKGQFYFMGSEREDSPRWILFPTLLPFPQILRPLFPTYVAYSAFSNLTLLSPSYFHNTILNPCQKYPKGQGPSSVVGGGGAVRQPRQRDLSPGASHSLTVLTQDNRDPGGEHSEKASRGSVPSRGQSWAPEHPTTFTESGQEELKRGGPHTEGTPRGTLHSQHDNRAHDQPCRTKSGGKSAHTTDGPHRWRSNPVYQTSVGTMSTAETGPSRGARQRDTRHNCGMRQGGPNTDHARDKRGTHPPRLAPAKDRTHAQPPCVCAGREDPPEDRSCVRTTCGHDTRGPQSPHHGRHSEELHSTQRKATRRSPTTRGVHIVAPQILPGRRPPITEQRHPTGGLGGNNTETRSHVCPLHSESGHQQNTTDGVHTKNMMRTTTHSRERAPQGDLFRNRAATMLGAGTLTTYGAAVWYANNKARGGHPMRDRREEETIKGARWVTSSEVGTQRSEGGVIHTKGRTRVPPSCGEERKRTSQRGGAALLKQEDCVCPTSLLDVVAGKHSREY

SEQ ID NO: 963379 - protein, 146 aa, Homo sapiens
WQTFSPRLCQLTYVGPLPPMAHPLATKGSSQVSAATHWGARTAPPPWFIMGLRPPHAMGRDNPYLGNPLGGRAATGRGYVSCGSRPFFQCGACNIRPFACLMYRSLATWVISAFAGYRVCDVRLSRPVWGSQRLFWQPGVFSWYTP

SEQ ID NO: 963380 - protein, 228 aa, Homo sapiens
QGVGSMAPSRNGMVLKPHFHKDWQRRVATWFNQPARKIRRRKARQAKARRSPRAPRRVPSWPIVLLPHGSGTTLKVRAWPAASALEEAPGLAGAFQPRTRVARDQSAFLWIRGGGHKSTGVPAGQQCSALKEYRSKLILFPRKPSGPPKNGEHQFVLTEPETLATQVDPGPGVQLPRSGHGLYRTEKSSSSSPEGRDRISKASRLRSSGLMGPLPTAPGFFGAYRGNN

SEQ ID NO: 963381 - protein, 279 aa, Homo sapiens
TSRPQSPEPVVPARRGTRGTVPASCFPGEDLLQLRVPLVFIACCPPSAPWDGPRGEQLQHMAWPCSSVLEWSDNGRAERRHTWTIPWASARACPRMSGDVLKPPLAASALPVTVLAADLGLGFLLDKLAGTGSADDLCRDSWPAAVLVALVSLILNNSWRAFTSNWVCQTLGGWAQAAAVGLMEGPAGWWTVTRGGPSPGARAGQVDAHDCEALGWGSEAAGFQDVRGTVKLQYDMMRACNLVGNWRAHRQGNSPSSCAWWPCPAGTGAPAGGGMAAHQ

SEQ ID NO: 963382 - protein, 160 aa, Homo sapiens
MAASGHLVWPPVLRAGVALSLCDSSRGVVYFRPSGSLCACGRYVDAFVRGGVGYHGRNLVIPSPWMCGVYRARGLSECFISEYCYHSQRKGGPGYQWVQLVAKFTTAPDMYLAPHFITTRFESNMVGVYIEFHFSCLWGDLISRVRPTSTRPHCERYDSL

SEQ ID NO: 963383 - protein, 517 aa, Homo sapiens
SPVHCPAQPPWAATTMVAWLVCVLCWRAPLMQCGHCTLYWAAHTVLKMSPHGRAWMPVMHDHSSSIPPAMSVMHWPIPCLTSSQPCTVDSPVAQPVMLLPTMRHHTTCMHTHTMCAHTCAPYVTRFHTWTVFHLHCRHCYLSVSWSPRSTSHWRYISVRTRGTALTQHQLHNIRKHILMAATLVCPRALYHAHATIPSHANPCAYQERAHIVHSKPWKPHRVEKPSHWTCERSWRASEHTLDKIIQNPSDCLSWNTYHSTLLTQPPPVEAVLHGTQPTRVVPQLATLLSNRLGSKLGFPHGGLPFHIAAVELESEHTKLTVVRFPSRDEGEETRAKRPTSAVFSSTGESPFGAYLGRLAREARSTHTAVDPTQHRATRSYPQQHLGGTHSQPTHTWRNGGIATHRKPQGDPREPASDQDPSTCRRIPTWEGPGYGRVLEKRRRQRQEDTEATTDPKKELLTPFPADPRAAQTEAHNRTQQAAITEATSGDDATRNEAITLTATKQSDRKTKPRHVVK

SEQ ID NO: 963384 - protein, 103 aa, Homo sapiens
MAADAVSPGVKVCYYYDVWMYGNYYICDNGQPMNASPESCMTHNLLLNYGLYLKNGNLIALTNANAEEMTKYHSDDYIKLLAAPSVQITLSGVQQADAEIQRR

SEQ ID NO: 963385 - protein, 55 aa, Homo sapiens
MRGALWWLDMDKHGSIWISVRTWAGVEAAAVGGGDRRSKMEEESGAPGVPTGNGS

SEQ ID NO: 963386 - protein, 63 aa, Homo sapiens
SRASKRKEVPRAPQPMGLAAKTPPLETEPTGSQTCVKYPIDHYMRTGDATNLSPSQHMNQHPR

SEQ ID NO: 963387 - protein, 124 aa, Homo sapiens
VAATRVELRDARGYAYWVRSSVVQGERAETEPIAMAFADMWPHIQQLGFVSSYEGGRVYYILVVYIFETSLVLSSRLECNSTISAHCNLCLLRQENCLNLGARGSSELRSRHYTPAWMTKQDSV

SEQ ID NO: 963388 - protein, 260 aa, Homo sapiens
CILGLLAFVCVACSKLFSWDVFGTLSGVVLYFGRLSESVLRASRWAMDAILKAGACGWSTADAFVPTVIPEGVCLRSLVLSRVFRSFAFTMHGGIERLHTGCSSAIGLPGSSLPSCGHMFVAESPMGVQPRQRLRRRACMLRYQKRLEVPITRPPPPASPAPLAESVARRVGWTCPQGCSVAVGLAKPKRLRGPYPMKKPPRSLHRAVCMGPQGTKGCGSGRGLEAGFTRPQATQICPSPVSYGSLPRSWGGRDLIPSRK

SEQ ID NO: 963389 - protein, 127 aa, Homo sapiens
ARLFDKAAVSGGYSPEPSQCRLRGRQEKKEARVEKSRPRKDKDTRGEQSPGAEAKKKKGGSKRQSSRAQTLSIYTYSLCVCVCTKAITYMCIYNSLCVGGEFSQSYIYTYIYHAAVCGLSLWKRAQL

SEQ ID NO: 963390 - protein, 532 aa, Homo sapiens
PAPEFRDPGGGGCALVEGTGNRDGAGRTAECWECVLMISLLWALGLSYPCASVLVLLPPLPNDPSVVTHALHDPACETILLLCDALDVLVNNHYVSSGLRLSWLSPALTNIQSSHFYAGLPVTPMVASKCHSFGVDNALCLSPVHAGCTIGCLTDPSGLGPSNCRCVGVTVAAPPFSRDTCAVRFSSCGTQHVTASPTLVEDRRLRQAGFALKWPNGLPHGSPAFHFAKRTCNQAPCSSTSGTSGPPGLERPTHGPVTTLRYPQLALLSSSGDPSPTTQPTRHCLRKPRWRFSPNAPPERTRTCPRQRHWAARTHNGLRDPKRDLPPAAPYSALPAARTHPCQRAPTSTSISTPALGAHPSAAITMRDAWTAMSTTHRGATHRAPHAPPPRPPHVLCDASGRTHGAHGAHPRAPGPHHRTPRPRTAPGAWSHPRTAATPAGPVRTPPSQRATRARPPQPPQRGVRPRPSTAHTRRFTRPPRSTPRGAANATARTQPTHQSQQAAACTAPHQRSPTQRPQAHAPWRPPTRPPP

SEQ ID NO: 963391 - protein, 155 aa, Homo sapiens
QRAILSGRVVFLPWFAVSCLCACFSVVSSFFLCFALVLVWASLFVAVCPGPMPPVVCSLVYIEVGVRYFLSMLTGLALLVLIPLFKSVALWFSRFDALFVPGLGPSLGVVMLGVALRMPPPLCVLLGSYGLAPYMAIPELHAEFAILYVSLAQKA

SEQ ID NO: 963392 - protein, 33 aa, Homo sapiens
TIENHEGGSRGSMKSWQASDGIMVARGDLGTRD

SEQ ID NO: 963393 - protein, 290 aa, Homo sapiens
MWCDRRVWLYVRGLLSFHRGRLWLMSWVGDCAESWWVELVCCVDSSYCVVCCGCSLYLNCDECDSDCRPISLSVLSSGGSLCVCLVCGRVSSVLTDVVPVVSSALCGVCEPFWNMQSVVLVFFCRWVVGGAALGPVVVCRVPVVMGDLFVFMCMVKLTAASLWDEVIWLTSLAVGVDPPGKVELLQWYISSICNVATEFDVLRVIIVVTCCVCKLLLVCGLMQMTVEWKHLLRVLTNLHSSVQRRSGVTQLHSYADVMHITWRIFKLDSNGHFSPILVNWICFLLYKYDH

SEQ ID NO: 963394 - protein, 111 aa, Homo sapiens
MVIWSEPETQAPVRILPLASARPRAPKRWENHVLNNFSDIVKQWLREDEEQEARDLPGVCLAGVPEILQQGGPQRLEKYSSMRTSVCLRGLPQMVTEISNCQVCYACSPRR

SEQ ID NO: 963395 - protein, 210 aa, Homo sapiens
MHCAQRNGIVLNAPLPQWTGSGAVATWFNQPAVRSADVRPGSQGAPDRPVPASGPILAHRALPHGSGTTRSVRAGRWLQPGGAQGGRHSQEGGPDHRHFLWILMDVRNKSTGMVPAWPTVHAGLNGGTGSETHSSSPSELPSVAPMKGSTCSCLNETCELVPILSLDPGPGSFAPVRETVVVEDTEDKGSSSVTVMRHARTEIFRRAPFA

SEQ ID NO: 963396 - protein, 112 aa, Homo sapiens
MTGGKNTSRTFGLLLPDVICLRPGAVAAADRCRRVVLAVVVPTPWLSSRVVDNGCCAVCVTCSVGFVCGSRGQFEPFVSQCSRNPCGGSVVLSCVYLSCCSYDPVVCLVNNL

SEQ ID NO: 963397 - protein, 214 aa, Homo sapiens
ALGWGADVALSGVSEDVGSRSPCLFWAEAMGGRDDKSVVRHRPLAGSCLGCCSACVARVVLLLWRSAWLRAWPCALGWVGVGVSARACRAVVVVVVPMCELGGLAGWACSPLWVGRVCRVAAGGPSCAGQGVGLVALGGLRGRTPGLARGRSGRSPIVPECEGVPHAVDCLMVASADLWSHWEDSALPASQARGLCSPPGRARAEAGLDWAGAS

SEQ ID NO: 963398 - protein, 366 aa, Homo sapiens
QARRQPWLPSRNGMVLKPHFHKDWHAALWPLWFNHAWPCNDPADCNGPGNANGCCLHSAPAAPASGSHSWPICAACPTGSGTTLKGAAPCRVLHAWSELMGCAVHFTMKGGPWTIWHFCWILRMCGTMSTGGPLQANVAAADSEYLLQTHPHSPWKPFGPQERETVLLKNYNWPPMLDLDLVIALSRNVYKKEKARVITEDEKNFKAFASLRMARANALVFGIRGKTEPRKPQNSDCVTHRSELHALPGDLGEFIVTHTQIQSGIYGTDAGTTRYSDLAPLAHSPGFLAPRAILCTTGGKHSCRIPPEIARDDALTPSQYTPRLPLLMMMNAPQHSIDDRHEYSEKSQREIHISKLAREYKHEADY

SEQ ID NO: 963399 - protein, 275 aa, Homo sapiens
MRTRLNCDLCIFSFRSWTSFLGVVLVSILYVAHRCFDPFSCFMLVVPPLSPWASPTVFLFCCVRPPVLVVPPFVGSLAPSRVHSTGPPVPDPSGTVTMFRGLLSRPCWGSAPEARSHPRYPCGLAFHASFRKLSLSIPGAPLLASLASVPLEDSVRAPDLALGLCRPPGRAPQSQAWTGLGPASPPGSDVGGPGGADAARRALPASLLDGPAPDPPSAPWLSQSSVSSLRLQRTLEAPLGFPIGATARGGTWHAHHGRFVKGSRCHLVGWRTSGP

SEQ ID NO: 963400 - protein, 144 aa, Homo sapiens
MNCLASKGVLAACNRLDSMIDELVQMVHSLASIIMLLLWDAALLFGEKLEEYPNVENHDMRSWDLLFSPGLQKPDTCYQSRKELYHKPSLSWHENWLYSSQCTPVHESWGVVVRYVVVLVVLCLCLFVVWWWDVLVWWCCVVGE

SEQ ID NO: 963401 - protein, 114 aa, Homo sapiens
MYDHNGWATLHALRCPTSAGLAACAWTFLLQGLLLAAEMPLALPLLCLLAGLWMAKNDLLCADNAIIVNVGTIWPCGPREDHADCSHHEDSSLSATVGLMFNDSTDGRFDQLPL

SEQ ID NO: 963402 - protein, 123 aa, Homo sapiens
MRSCCVLLLVLWGVWAVAVSACVWFCFWVCRGVVWGCGVRGRLLTSVGFGWWGWGGGGRVSCLGPVWLVNRVWGCARVRCRRVAHCGVASVGSVFTGRGARFVRSVLVVGVGRCWGFSVSWWC

SEQ ID NO: 963403 - protein, 112 aa, Homo sapiens
MPIAEEASVLFEGQPTPSYFDPRFMENVRPSPPLPSKLLSPPYLLALRSLGESLWSWILSPKTSPPFTHLKGPKALDQLHGAATLRRRRGTQIVRYRGGSRSVPPVSAYPHL

SEQ ID NO: 963404 - protein, 45 aa, Homo sapiens
GGGEGGCRTPSGVSREPEGQLACPPSSMGICVLNPLSPLPHCPPG

SEQ ID NO: 963405 - protein, 169 aa, Homo sapiens
MEAVLNELVSVEDLLKFEKEISAEKAAEGSVSNAVTQFEYAWCLVRSKYNDYIRKGICAARGAAAQREAREEQRDYVFYLGLWVNYRLKEYLRKALNVLSCGLLHDQSPRTSRPRNCERVIDKAMKKDGLVGMAIVGVHGPWDVAVDWSGRHSTIAVVPNVQILKVDCG

SEQ ID NO: 963406 - protein, 236 aa, Homo sapiens
MRFCLCRARCIFAVLSCVEGCLCPVLRPFPFVALYAPFGASCTLFSFIPWRIASVSVLVVLVPLDAVDGKSSVRPVPPLLLSPPLLHLLRAESVWPLPVPAIGLWDGLPGPHPFAKSRNGSFRLFLPRDSPGFPPACLMCPPPQLQRPAQLSTIRPGLACRAIKSITTSLDTSLQYQVCGAASRLRGGPSVAGNACAFAALEANAPSVLRLALSAIQELPSSVGRSGLPSFAPFLY

SEQ ID NO: 963407 - protein, 225 aa, Homo sapiens
HRSIIRASPRWPGRVSLGQEGQTLVLQCQPFVFVRASHSGSIALGQKLVLATHCPLPRPMGSGSGLPLGAPALGPARKGNLSAMCLCLGTQHPGVFFPRASPEWGRPLCLPTVERAPPPLSALHRHWPCRVPRRNYTINPYAVTPVCQSPAVLVNPPPGVGEGPRAWERPVPLSAREAHAPFVLPWPCCASPEAAPACGRSGSFSSLLLLFYISDFIKGIFQGLV

SEQ ID NO: 963408 - protein, 280 aa, Homo sapiens
AALLPYLTAQLDEELGVYPCPEPCGPMARSPAHLMSLFVLCELPMIIYNGAGTSLRWAGADMPLPCYPASSSVLRQQLLEPPGLYEVLPKAGALNSNDAFVLKTPSACLPDGWVHGAMRWQTRLGCPGAAPPCCWAPTCCRWQKAASQMASGRPWAGKAAYRTSPRLQDKKMDAILLAILACSTKIGRHVIEEVPGELMQEDLATDDVMLPGHPETRDFMTGLDRDPPRINTQNSKPGPSCINSVTVRSNGTTRRKRGICEQTYSTVDALQGLRAYPPSE

SEQ ID NO: 963409 - protein, 172 aa, Homo sapiens
FSAFGGPYSVRRLRVASACVHRIVVECTFAVGPGEFSLGARVPALVCPSRLLACPVLSVFPCGLAFFPASTARVVTGGPTGPELCVIGLPVMRGPTFVNKKGLGNRRKGWGPCGGKLCGGRAALFFFFYIDKHRLFMCNFLQIQTLTYNSIMSIYEMTAKCSIGDFFLFKRP

SEQ ID NO: 963410 - protein, 174 aa, Homo sapiens
MPGALALRSSLLAIGCPDALPQPLAPEEWLDITGELGLSEGTKTLVPGPARFEPPGKGQVVTVHLADVAGEWHTGAGGAGAGVTLGDCDVIQALDLSVPLMDVGETAMVTADSKYCYGPKAAGAHTLPPNAAMCLGGALKTAVDGPDLAQLPHGGTETRWTLAKRETESAAKAH

SEQ ID NO: 963411 - protein, 109 aa, Homo sapiens
PVLLPRAAVALGAGVNTALFLALVFVARASRAGSGWPALGLEPISARACGMRAGWFGLSGERGAGRWGMRWGTVVDAVFGMFARKGGGCRSRRRGGNPSILEHAQEGEH

SEQ ID NO: 963412 - protein, 265 aa, Homo sapiens
MHVCNPGAQLLLMRPGAMWFDVPQTAVTPECALLVMCGLLPGGLVCPPELMWTSKTWLSEEIEKKWHGAGEAAPAGRIMRVPLTALLNPKPAGRAAEGPQVTGHEALGEGVFRLFVGPRWMCVALQGECSSECTEIPGGLAHPPGYISQEACQLQPGRDESSHQQVMEELRDQERELRACEEKEWLADENGARLSIEAMRGYRESLSESWQTGVQQAGMARRPVDFGAEESGERGIGVLDVGLGVEGDLAVMAGFATSIARYGFG

SEQ ID NO: 963413 - protein, 198 aa, Homo sapiens
RANQRDAGAQSMCALIAFAPANRIITTHHAPTRRLLHITLMVLCSVLLKHLGSCNSAKSTRALGNLTRPISFVHAEYNGQQPERFPTLATAPPAGGVNQTLGGFLPFGAINAQFPGREVANQSALRAVWNLLRLVYLPLVNAQAYLYLSLLFAVLGTYPLLLYMGMAYGMVPARIREVTVGLRTVQGYDLSMVPDMTE

SEQ ID NO: 963414 - protein, 134 aa, Homo sapiens
MVAGLIGEGGSQYLSRWSSLAAVVALRRGVNTAFVPQRLVFRRPVPSRRRALAGRPRSLNPISARAVRMQLPGLGLGIEREEEEERLAAWAGMQMGNCCWTQLLRTVRKEAGLVQRVGGGEDPSILEHAQEVST

SEQ ID NO: 963415 - protein, 109 aa, Homo sapiens
MSLLNFYSNALPEPAFCLQLYQPRNSYADIYNFSFVVNNLTHFTTWLLRHFLCSAPNWVTKLLPPSINQLRNNPVHHGSHWFHASTLSIHGIISTQHLGQLAGLRKYPL

SEQ ID NO: 963416 - protein, 332 aa, Homo sapiens
MATTEPGSIIIVVVLIKVMLDKELVRLRGSLSTFIPRKQWCERKLDCPLGEDEEHCVKSFPEGSAVGSPTLQGSDPHCGVLDVATGKLVLCSCCDKLHQRLSLMTGPVGRWATAAKPLAERWRSAQSRDLDVVEITEDSQELRMRNSSGPCLSGLPGLPALSLPCGKKPERPAVWWVGRRPRVDSVALAGQLSTYDHSCPSVGGSMPGAPVGPQLAAHVFMKHTDVFNWEVRAGSDKLCKFHPWLWAKIIIIEFKPPCYPKRNDHRLKEAEFPFISQGSRAICCLLGESHISTHLVNGWREADGGNLAWWGPRFTHGCRSPGTKLGAGGARA

SEQ ID NO: 963417 - protein, 379 aa, Homo sapiens
MPGPYIRDPPGALSWVSCALFCGFVSREREHVWCSRTGGVLRGGSKATFVGPGGLRVLRAPSLVPPSGGGQFLERRPPRGNVGCPRVGPRANKQKHEAGEQQQPGAKTLQGKRGGRRIPQEERTSPGSHTYLGGGPPAMEDAKSESPTGEMWSTPTLFEPPEERQNLYGNGGHKHPEWGPWCGCVGWGENYTGDEQRTTGKVDCVAQEQPPSRRKRTPRRGLTREEKLTTGCGPPRWLCVTPPTHKEDVLDSSEVPREKVAHRTWEVERTHVRPRVIAQGGPKRRIYQSTEHLRLRGPHWVAHQKRDNPRIRAAPIMTLQEQATTVTTSQVLPPRVELSKHKRWSSKTTSTSNKTNTHRCVSSIAGRLAAKYRYIETHR

SEQ ID NO: 963418 - protein, 339 aa, Homo sapiens
MVPSRNGMVLKPHFHKDWQMCCVCTCVQPITGPVMIHADCNVPCANANGCCLTSDHLTPLTSGVTILARSVAACTELCSCVPTQKVLLLPVHCCAFQPIVMCCIMWLCLAIPQGKGRTQRHILDNYLVGSQMSMAVKANVPGDDHPCKGTKPVQRRGSNGTVTQGYTTSGRFPLLPHMGTAPSGAPHKGERGAGTHGSLALATHHWHPRGDPTPKTIEPGAPGSTWPPVPGGTPDHLIRRQRASTKAPTDTIQPEKRKMHDTGNFIPRSAPSSGRKETFPGTIGAPLDAPKLAPGDVHPTGTLHRAATQQGQPYVGPAPRQATHRGTGFGHPRQQTTHK

SEQ ID NO: 963419 - protein, 338 aa, Homo sapiens
ETLETEREQKNSLRKAAVTYMSINDSFYTSHLDVSLDVPLSSVTMLPSPTTDAEALVNGFEHWRPGQAATCDILMTSIAARMEGLAPPSPSHRLLTYSVSSDISADPESCKQAAACEMEREHRRAMLATAAGLHENAARRHTAVASLVQNHASGRQVDPASQTNLECPVGALQGQATDAGMTWPLDQTQEGTGDHANLTRWGTNYEGWDISTGLSIFEPLQVTMVAGGLKRWPQPPTGTQPSKGHYAACTKRKGRGIGVTGPQANGRKGTKGSPPTWTQVRQGPIGHTPTANQNGIIPSGIYNTTDHDPASRNPAEDLEMEPKDLAQHATLSSPQRTP

SEQ ID NO: 963420 - protein, 423 aa, Homo sapiens
MLGETTARKAICAMRGLTGALGKPDRAFAHSLPGWLCYPVLLPAPEYLLLTMCTPVPVSPACWRCSPARVLGGWCPGAGPCSGPSPRTACGLPGMCTRNGTALLTNDDSYTATGYGRAPGGLSFTQITNSLKPEPWRCQPVPSPLAVMSQRRLGARGYPGPMSGGVWLARLLFVVQGSGHPAASLRARLFGRWNGLDCPRTATAVTHDVRLTPPRGTVLFTPAARAKRWTVQRGAGGGVPEEQEGFARGAFCPQALGRIFAMVLTLVCIPQGVSGRLPRGPRVGPGRLSRPVALPVYPAQQALFPRPLSLSGSGPGIRQRGPGGPSTREPPSWVSSPRGRRLSGAGPRHPLFCGGGAHPHMWERAPLLAWQSSLSSAWVRSIVPYPPHLLHVSVSPELRSCAPSALARCVHRLLYSYEHASRR

SEQ ID NO: 963421 - protein, 117 aa, Homo sapiens
SFPAAAQPPSGLLVARAQTRVQPALAPGSLAAPSRVSLGASWHRCPVGLACLPARPPEPLRCFGPLGWPVAIGGPDSLRGQGAPGAGPTLHLQTGNLLNCGPLAEECAPSTHSEELH

SEQ ID NO: 963422 - protein, 243 aa, Homo sapiens
GLEAVAAKLAGLKDELLCSICLSIYQDPCEPVAASTTSAAAASRSTGCGREAQGALLTAPSAWRTVRRARRWLPSLKLANIVELATAPSRWTAILNCWPPCLRDPAKAHEKGQCSSASLGALLLLLSLSLLADRALHLRRTQASCVTWHRRLPSTTLAGREAEWNQTSRALQRPAGGGGNNILKTRLPRLDSTGRSENLGLQKERTRFVSPPQGRPLAADPPYSGRRGPIRQPGLGHPALLAV

SEQ ID NO: 963423 - protein, 107 aa, Homo sapiens
RRVAIAGGTSGAAADESTKRSYWHLCIHDGLGCWKEDCHRSLGRSDGVTDVPLLPHVLPYVLYLVIGHQSLLIAWAWEMVLFPNVSEETVSPTMMHGTVNGLRKSSH

SEQ ID NO: 963424 - protein, 363 aa, Homo sapiens
MVTHPPEDQVVDHVGLWRASEGSCYHNACSVSTAEINVTVDNLARWANAHYLSTSLAHPFTAKGAQEIPYGLAGWLPRNRDTHALWTEALAGAPPNVGPWGTQEPQSSVLGNPISKGYRMFGNMREHAISANSKRYGREGYHNGAWASVGERPVTIHEAPQRFPCNAEVLGRRRESLYGFSNTAKLFAHTRPPVRKQRPGGTTRHGWVLWFLASAGSLTRAAPAYGWGSQQPASATLDTGCPPPISEHCREFAEMRWWRTSWVQLYGGSHYIVDRPPLCHHQAVGEQIPQKENIVDTKQLVDPDGPLPHTPLCNPSPKLCSVCNGYYSAQVRDVNNMRDEVGECRSITALVVGVAIVTLESSL

SEQ ID NO: 963425 - protein, 245 aa, Homo sapiens
MDDDIAALVVDNGSGMCKAGFAGDDAPRGRLPRPSWWRPRPPGREWWAWCQKDSYVGDEAQSKKRRSSTLNVPQSRHGIVHRTGTTWQKYLGDHTPFYEESCVWRPEEHPVAGDRGPPEHRKGKREKMTQIMFDRLLHTRTSTCTLASPWLCVSLYARLARATGASVMRLRVHGCRPPVCPIYDGVCPSPDAVRGSGPLAGQGSWTGLSQWMILDRGAGYRFGTRGPTREIVCGMEGEAGATSAW

SEQ ID NO: 963426 - protein, 197 aa, Homo sapiens
MDCAPHVQHLPVSSRYCARGPGYFSCAAVSGWMYLATDLPRAGTLPPERACYVQPQKSNLTASEDLVGPKSFLAREKKEESELNDIFQSSRGHSHSVRAFCYNLDDQQPELQMSAAESSDHASEELSPPGKFTSDPLCEVLVQHRVNIWSSSVPPNASILLLELEHWNLLNCVCLLCRLSLASPGTVRRVPSFGTPC

SEQ ID NO: 963427 - protein, 416 aa, Homo sapiens
MDKVKIHNRIINALRKLHTAGHQAHGGGAQTRKNTTHESRDTTTKRICNTQLQHDMSEEIKPDKYYKVTSHQRKTGPVGPHRGGHIQGINVNHLGTATSSGLRRSDNTVHETSRREVGGRTTMDSRTAAIPRGHGKPPSDSDRKRTESRTGTYHQYGEGTPETKNKTTDPQNAGAETTTQCERSSYTWIGARQQLRQHYPQDKKDRKDPPSKNQPSVADKPVSDRGGTSPEKTHEREQQKGHTEDTESHDAHDETSGLTTQRNYRSELTGPPEQARDDRNNKEDDNDPQEQNKTGQRDDRDNEETEETTESTDANGEDERSDDAPEKQETVERTNERKTGGHQNTQGSTEKGKQGETTRSRKELNETKGENKKGERQDKEDQRDDNADSREANTQKQTKTRISKRRGHVREHKQHR

SEQ ID NO: 963428 - protein, 390 aa, Homo sapiens
RPRIASLEPEPEPGPAGLLRPERQDAQRGSAEPGCPVCDEACLPASALPWLPAAPGLAMGAGHWLSLHVRLCMPMDGQPAEAAAAHCPLHGLHASGWLWAAPMPRAPWELPCSAGPHTPLDRLQRAGHEALERAAGRGLRAGLPDTHKHQLHTRRATAFHNTCAPGTQARNPTDEASSEENITELWQEGFRSLGQPATLSTTNQTGRCRSGPYNPQQGGPQKANQVGVAEDRATRRCHLQDVRRTTRKRRPDKITQGTRTMTWHTLCRGQKRINQDDIFKRRGPTTTVMPEKGLKKVANGFPKRQGQRREFNPSPGQPLWKRHFRTRATAGPRHAGPRRGVWVNPKIDQFHNPEIATSRAPGLAGGSTIGGYPKVETPPGGLRLASQQAS

SEQ ID NO: 963429 - protein, 260 aa, Homo sapiens
MLTFEAYSPQNEHDTALYNARLSSITIYTHNKNEDFIANHMTDAPPTSHSLTRTSDHTLSCTATPLALIIYTHCTAHPIWHHSPNAPYTPTFTYTRLHSAPTAPPTNGFSYNTCTLTRTLYQALTSINAAATRPPPPLRVHDYYPALPTGTALTTYFAYRLNRYQPDTANMLCRSLPAPLRQRYWHCTATHTLRQNQSTRSKRIRPSYPPLAARWLCYHTPAPTLAHSSNLDCTSPGSHVIAARTHFASLSDTHHLHCAR

SEQ ID NO: 963430 - protein, 282 aa, Homo sapiens
MGTVLRTFDRPDSSVSQMHVPAPLWLLPLSDQHLPGGLAIRMWFQWSEQRDYIDTTWNCGYLLASSFVFLNLLWTADWLQSWFPSRNFVAVTACFWASYGNHSSAGLICLHAFPWDLTVSDDGTWPWEEACLLLLAESRSAGKSMFAGVPTMREQLPPNMYMQTRRQGLAGSDVHDPPSLLTASFFAIVQNIVAHSSAGFSGHVAFTTQAGWFDSWCCGSLAITVYLNAFLDHPALKAMLDFLTLDFFSTCREWGHVTGDGLWHGVHQGVTQTSVVYGLRVS

SEQ ID NO: 963431 - protein, 258 aa, Homo sapiens
MYNNSTTEKQWRYHSPPGGGASGRRGDLGPYLLLREESGGGALYEMGQGDLSLGETNGLSPIYLGKCEFINNDNHTTIWVGQIQKCPFGAHLFGCEHLCGEEMQIEGPKTRKVAWVHLSPGAPKFFQKTPLGVLQSAPIQKKHMKNTTPPDNDIQTQTKEKEHTTIYKRAMLWPKHSSNNIMLCGTPRRAAPKFHGRTLCGATQNTVVGLTPRTQEEGHLKYRARALTKTSLHSSSGGGAATTYVRAGAHEETSVTNN

SEQ ID NO: 963432 - protein, 112 aa, Homo sapiens
HEDSAGGCAYLEVKVPPHGDPAAAPRWELIPLLPAPGCGTLVASFVGCLLTCLGLFYQLACTMVDNGKLPGMAGDELLACLCLMWPMCVLVHLSLLVSVCVHIFPLLLGVPL

SEQ ID NO: 963433 - protein, 492 aa, Homo sapiens
FVTPVLRPQGAQQWCWCLGHQSGFGFCSCPGLMLHVDLHWCPGSPACRVSLLALWPVGDACALTTCAAVPCMCSLACLPVPDHLDARLSGYLPGADGLPVLPAVPAQCALMLLRDSACLYCWCPVCLVTCWCLMCLLVVCSACVACLPAPGNPVWPLAVLVALRCLPCPPFHAPFSGLLPFSACACCGAIAAPLPALCCADRMYTLGPLLGLVAHPTAPAGKGPPPVGPPAMTIDGTKELPSNAPSPARTRLDTRPLRAAALGTGLETSSPEPNGEGEALTTVHDIENAPLGNSTPCARLSSPQRDSASPEHNMHTRERYLSPLSDPTAQAQKVPEPIALTNPAKPIGERVRRSHGPSTRAHHQSQRLCLNIGLTEEPGQPPDTELAKSQSTARARHTGEPRTSRSSRHETTPLQPQADPGPRRAGSTLQSEVEENTQPASENAKGASENTRTVSNPRCGNLRRIEATEYEQQQRVAKTTACPAAPARASGD

SEQ ID NO: 963434 - protein, 102 aa, Homo sapiens
MPMIESGVRMDLDASQLLSTNEALDPPMRLARRTLRAFESDVCHNRTTNRNGTLQARFQFRNNLSKNKERQERTRGPTDPPKEGGEESAKFGLSWLALMSVK

SEQ ID NO: 963435 - protein, 317 aa, Homo sapiens
PSHSRADVRGADGGGNGGGSSSKNGGGGDSGAGALERGVAPINAVNTSPPREQFHQFLEAKGQEKTCRETEVGDPAGNELAEPEAKRIRLEDGQTADGQEEEAAEPGEQLQTQKRARGQDKGRPHVKPTNQDKEQAVSLPNPGARQLSKVFLRVIGCRFLHDVGALPGDQAGERGRPACVLFETFVPVPLRVTWRFAGAQPVGPVGTSNLVQEELAGPRDQPPSNFRKWLDLKPCSDAAAETGEVRSSELRRACAGFSQGPTPGCLLSPGGTAGEAVQADTCVPRGPQGGGYASSARGGLWPVGYAFRFALKKRGPC

SEQ ID NO: 963436 - protein, 479 aa, Homo sapiens
MSGPAGLLACLLELQWTFTSLMDMAAFPYGTLCSPACLLPAHVPAACLPNASMHGCHLMDSMDAPHVPCSSCAHMLPHPVTPHADPPCPALLCVLLDLSWMTLAPVCCASAMTYCNGPCCRWLCVTVCDVCCAVSLDGLCCDDEMCVCMLCKSAAMATRVHIPSCILPGERCAYTKTTGTAARTGNDTEPQDSRETNGHFRVPPCAKASVTQSNWFTRIQAYKFTFTHMEPIGSVRLDRFRSNIIYGWHTCKDFELVKAPPGTGALTARHAQGTWTEGQGEEHKHCEPESPGNARVNIEQYYREPKDVEERPHQRKTADTARHYKTAETPSKRTGGSVSNSASNENEPTKTWTPVSEDLRHRIRDRDPLWPQVQRRLHNSPPTFAQHGSVTTQAVTPPVHMHGPSRRQTTKGSWTLLPTTSVTMCAQQPSSKLKPRRGQSEFCALTGRDPRERTLPQDGVDEHTEKRGNTSTAEEEHTH

SEQ ID NO: 963437 - protein, 449 aa, Homo sapiens
IFRARFPDRQQELSASRSPMPSLWAALRGDSCSTGSSSDGGYSQAPQLRVCPSALVWSSPGIPAGRMKVSKCRPCQVLVSSRMQRGHSGEPSKKVYDYSATTLHRPQGMRFLLKQQICPVLYHAGDGPAQLPLLDTVPSAQCTVDELVGIEYSLMKDPVASTSNLDMDFPGGLRSPVTERNWSLPKRAVEPQLQEEERMVYVAFSEFFFDLPWRATSGAGALKLLLVGGQGAQELDMLAEGQLLWEAWVLLTQEVIDSHIEGWSCRVMGPPASTVMPSGPPTLAHGSVTMAGYNQKAEVSCSADNKEARGKGKEGSRERSQRNTKGHDGPTLHKKYESETNHNRGEHDSKSGETKTRTEGGAPTRQDPSRRDKKTRRERNGRENRGPTNLGCRVATQLSTRANKPNKREDQHTENRTSKATRHDEDANHTRTSTSNNDEAARRQHEQER

SEQ ID NO: 963438 - protein, 72 aa, Homo sapiens
LLAERDEGDQMSEVGEWEGVCAECNADFICATRMVHLSALRCPMCMLLACGAHGCSLSSGVVSGEVGVDECT

SEQ ID NO: 963439 - protein, 142 aa, Homo sapiens
MARYEARVNRPRVLRQWLTTSKAWLGLRSSLSGSGDGRPTSAGSGSPSVLDTPASLSHRGSPDHDGRLSLGHPTDLGVATQWKVELGAGRGMGGTDGEPDSREPKGGTPKAQAPPRTTDSRNTASDLKATERQHMRPPAPQS

SEQ ID NO: 963440 - protein, 178 aa, Homo sapiens
MRRVLSARLSGRGGLTLRSGLGSERGEADDCELLSHPAASWGHRALRCPGMDGARTPSSSPPLPLPAPGHTLQLPMVWPWVAMGQVGSLMAGPCCSGPGGSPSDGRVARLQHSSTRERVANREENEILPQTLNGVKLEMDGHLIAVHRGLQARLGGFDEDAEPRRSRRKLMVIFSKVD

SEQ ID NO: 963441 - protein, 268 aa, Homo sapiens
SGIRLLLLEGICSRLPGYYLRSLEEERTPYSRCSIGLMGCPVHCINASSNLVQRGMRVADVPIPIYFPPESQRVVVGRRGLDPGTLIANNDKLSKRLKNVWSHSVFEQSEIHTVKIYGQSKFTSDCDHVQDPVNLIDEANGLDLYILKTPKEDRVLQVQGMDLKRGNADCRDCPVRNPRVHPEYPVAAGIHSTYKVQGICHPSRRRQTGWCLTLERGALRRQRLLRETRTPVSRVQDLCGGADPDRLQAAVQLSRSRLVGAKTEQVAR

SEQ ID NO: 963442 - protein, 363 aa, Homo sapiens
CYFRHEGLGYLGNASERWVLAANEREEAHLDVPRVRQCQPPTTSSSSDVAPLEDPELSVSDAYEIEYLVELARGALIRCLKRSCSCMPCRAAILVLGPWTANGLLPAPSVNVERCPGQHGCVGPWWAAWRTGKPGADVVDLTLDSSSSSEDGGGGGRGRRKTRTEECAPGPKRLSDPFQTGPGCLALVSPAWHSTYPGGYTNARRGHGAQAIEGARGREVSLSYITLESGSDRNGTFHPFKAWIPGEAGDLLDSPNRGDYTKTKVHTCHKTRDTKGTHIEPQSSDVFNTQGRRTQQKAGIPRGRKDPEAGGRGKRGRLIVTQARTPRGSQPPQQNDTRCDELTLGDSNALKRSDSERHPRPRQ

SEQ ID NO: 963443 - protein, 212 aa, Homo sapiens
MPGQELIWALGPPPVCTSKCLVEHDHALDGMMELPASKARAGTMLAACKCRNRSEGTDLTFLQCCETDKLEDEKSGLQREIEELQKQKERLELVLEAHRPICKIPEKEPMEGDTWQYQWHQQTNSHPAGLYLVSPFPQGLCLNLRHCTPHTLMTTPSLTPINPSLVYTTPALLSLVPQLIAKSSSSSGDPSNLTPMGSATNTSTYEEAAMSH

SEQ ID NO: 963444 - protein, 168 aa, Homo sapiens
MGSWRRGRGGLILARLPLGAVEGAPAQARVKPLRSTPLASPPSPGPGQGMSCSRLSLPGAEGRGAWGVLASSPPPHLLPPGASRMPPLALLSHGSRRPGLSQRRVWDRVRGWRALWTSGVSRGCHLAALSAVCESPAGAWSELSSALIRTQVVSGWPHDKVRRGTGNL

SEQ ID NO: 963445 - protein, 320 aa, Homo sapiens
YSVARDVSCKYVRLVGLRPVDLQREIGICKSPPGKDDTVRPRPAVSDMVAKLLAQSYEHAAGAREAGAERCALLLLAPSEDQLCGCAELLDAGSGAMLQGRAARCQKMELRKKHGLMWRNVERLQQALGQLQAACEKREQLDAALRTRLEQELKALRAHAETCAGAPGGSSGSGGSPELSALRLSEQLREKEEQILALEADIEPKRLGASPVTHGIWEERAMRQFAMDAAATAAAQRETTLIRDSPRPHPAAASMRGLLTGGHRHQEMESTVNLGGSPFVAPPRDNSPFGADREKRGAHLADRAWNIPKRGHPLSQGVPG

SEQ ID NO: 963446 - protein, 199 aa, Homo sapiens
NTAGTGGVTRTGEHWTYACTWCGITQPLPLPALRVENSRSPATDCPATPSPLAARPSCEQKVPLSQPSADLLGHDAGTGSELREAVFISLPSPSHATPAPLGWVLLMRWDLIEDHKLNREMTPTPITTQSFETGLSKPDFSVLDGADVDGEPWTRATKDTVERAAARCGAVASGLGHDVGVELALWRLDLAHRDPGNVC

SEQ ID NO: 963447 - protein, 310 aa, Homo sapiens
MRRGCPRVCQMWKTEAVESAELSPGDPLFPRAPCRCHRMEKTLLCNLVYHWLLSRQKSSQAWWRAACNPSYSGVLRQQNRLNPGRQRLQWAEIVPLHSKPEQQWSETPSQMNNNKKRRLKLFFSKMATSWFAPLVVPGGNPVISCRWRGSALHFDGVPVVALLSPAMCLTTGLFQLGGLSNSPAYLALVHSYIDMAGAHCPRHKGLVVSRPVDLAGALLKRSFKPMDNPCWDAPSSEYEAFSRALDTWEATTPRPPEFGTYFGAANEKTGWDVPQPRPNFACPERTVTRAEALSLDLVRQPGPGEFTQPR

SEQ ID NO: 963448 - protein, 323 aa, Homo sapiens
LAWASNREPAGAGSWCVKRLPVKCYRAREGGRGARVNALTCWLFAAHACLAGLLTLPRAKPPMNAADHVHPCPGVTCMLEMLCLLAAAMGLDAVPCMWTLPKTCLGCLPWMCTKMEHALLPLTDSYTATVDTVPVCPCVASLYTDYKLLKPKPGCVNLADPYLESQMLPGGSAGPCAQSGWRCVVLCMLPFLGQGSVTPGCCLSSSASSGGLELPDCPQQQLASSRLTPTPPGDSTFTPRGGWHAVDVCLLWRTGAGVTEEAGGLRRRFVKALDDLHQDDHVNPPSVPGATGGAPVGRGRLRGRAPPVYQLRGSPAFVSGGPG

SEQ ID NO: 963449 - protein, 292 aa, Homo sapiens
QTKARWRPVFNRRGREAGSLGRCPPPALGVGSRRRPQERGGRSIPETEWQAALWRGSFPVSPQLPLSSGSRQSGVVAVWAGAVGPRVPSPLPGPGPRAAAVVMRLRVRFCSGPGRGGARDGGRLLGHLRSHLRQSLLCTLGGTVLIPIYKLHVNYKDPLTGDERDLWFIMGWFPGDLICGFFKMTFQRPNIPSSTRFRAFFTPEIMSKPLVGHQLQSRTSITRMEQHKVIPFQGQGSPRSVCVGTDDQYVKGLVNNFEAESTARYMRHIGSSAHGLLYLRTMFCTGIAAKGP

SEQ ID NO: 963450 - protein, 156 aa, Homo sapiens
MHGLCMHHEESCTCHLLSAYLGQQKIPLFAPDWLKENLQNADAMKYTIVVSATAPDAGPLQYLVLTLVSHGERIFETWQHACHLLGFSHGCATAGALCRDPGRGLLGVSTPPVGGAMTCWGALRCANRRVWPPCPCGACDFVPRLPRPRALLGPPL

SEQ ID NO: 963451 - protein, 203 aa, Homo sapiens
ASSVYIGRVAYVPSYISPGEVPCASREPLLKGGPREEKRGHLRGRIYSHFPKFSQEVPPPGTYNIWEKPLFLEARRFLSLKGRHTHLCIGAGVVKKKKFRERVYVVNFYKKSVALWVIYSWGVLKKRNRVLVTAPFSREMGGEDFVSRPPWVFAFRVLLLGGALIFLLGLKIRCRPSPKLRAPSTWKKEFHKKSRAEMGPPIV

SEQ ID NO: 963452 - protein, 113 aa, Homo sapiens
MWPAARPELTSPKSTLRLIWLLSEGKGMVPHPLKCKELRACSSGPHGGQGSAWKSSVVVPVQAGGRYGADPREGGTRCHCARCLAPLQEGGSRVRQGWQEQTASAHVPMPAGR

SEQ ID NO: 963453 - protein, 165 aa, Homo sapiens
MSHQKKTLSDEDAGTYREGCMKKTPAKSPGKAASVKQRVPNLLLIVSAAQRGKARPLPKKAPPKAKTPCQRRPDPHPQSSSKPSGGSSKQACNLVPQHQATYTHCRATRANPAMQEVFSSTSQQHVQHLSLGKHNRRINDCTHLHQILHSLSTVHVVPSRLNVSE

SEQ ID NO: 963454 - protein, 146 aa, Homo sapiens
SWNRGDAEGNPTRPSAPRRSVEWSLTPRMRPPCLATAVVGCALPVRCSRVSSGSSTLSVWRCWAGSSLGFFKGPLCPPPIEGFCSAAVRDGRLGVADLTWAGERGMLVASIQVLFDMWELDENETLMSAKFCKYEHDDTRCLQSGS

SEQ ID NO: 963455 - protein, 123 aa, Homo sapiens
DKFIRRWVHKEGFSGFKRYVTAAEDKELEAKIAVVEKYNIRIPELVQRIEKCHIEDLDFAEVDILGTVHKAKGLEFDTVHVLDDFVKVPCARHNLPQLPHVQSWKGPFLAAHCNGAHSTVCCQ

SEQ ID NO: 963456 - protein, 428 aa, Homo sapiens
MGTSVHPDETACHMVHLFEISIHYGHLDILTSNRRPHKVLRHVTRTSVNQLRDMACNDESRATREPGCSALGMLAIVRSSTNDAGRHNARHSSRLIPSVANTHSLAAGKWSPYTAQNRVPVEDPCAIYLTIPTLVLGIDQPDHCMATRSAYRISTRPWTYASGSVTTQHVLALGICPWIPFAPTLLTGIPKGVFYRIRGDNSDARKTEYKARRCRGSLHSTTPLICGQSYATFLSPACGQAESQRNSGPETMLAHRRLMVPRNGVGVDHQEPRARAYIYCRHSFSPLRVPTMVQRTFYFSERHSGVRTRHKQSLVGKPQREPTAKLVRVHRRRSQKQKGEPTDTKRRGGKRCAHNTARELRDTESHRYTGFQQRPPVDTPKDERGKRQCRHGPKGPTIKIVTPATSECDKHHIYPGWDRNRWENIGRG

SEQ ID NO: 963457 - protein, 215 aa, Homo sapiens
FRSCFSYWVVCLCVLQHALGTVGVLRYYVYAFYRGLFVYFFMAPPPLGFSVSAHYLKALAPWRSSPLLVLLRFFSASLKPPLGRTPPLVVCSPQPRVWEAVVFLYKRPPPTTVCMRPFLRLLDVWGVGGGLPPSPRLCPGRRMICRCSSDTGRVVFRPRKSVTQLRPKCCSPLLGEKQTTRCLPQRAQPHPPSGVNYLYRPRCCIPQTLVNLLVK

SEQ ID NO: 963458 - protein, 132 aa, Homo sapiens
MTSKERHHKTIRHDNRPLHVRHEQQESDKAATRTQEQRKQGTTNREHGRNDHTRGQPAVTTPPHRERERHEADHKHRERRPTDAHRTKHTTTHEDTTQHRNTDKHEAHTRRRRERRKEQQETAGDKRKIKRA

SEQ ID NO: 963459 - protein, 150 aa, Homo sapiens
ALDAAARAAIIVCVGHVLSGDERDPGRVLSVMQRNACGHVLAYILVYGSRRMAIGGSTQVDAPSNVRQSSGQNITDVRNYNASNAVSSTWRGIQNAYMVVGEDVRVYQDNEKTNEAGATWITSERKMTEHEGEHRRWEPTCKGMNKLGKG

SEQ ID NO: 963460 - protein, 108 aa, Homo sapiens
MRKVATDDETLSARYASRAGSQAKGCTRNVAEGSHPFQSAYTVVRERGSIGGIVGTAYRRKNSGQNKAIHLYVGSMSRCHGDRDEPAQALILTDIPGEQHKEREIELL

SEQ ID NO: 963461 - protein, 95 aa, Homo sapiens
RAPSERSGPGPASTATAATIPWPAAFAATTHTRATVLPEAPSLRPMEMRPPAAMGPPKEPYRGRELASVPPELTASRQSFRMAWETPSESVVDVM

SEQ ID NO: 963462 - protein, 388 aa, Homo sapiens
PPPPLSSSRCAVGCGCFLIILQLDESVSFSWYVRVLHLSFVYCILLSRSVAMRRATVIVDHDRRRSSCVVVGVRSSASLYLRGEEDYILPSVRAGRLMCFYHRSSALPCAQVLFGLPASWWCYRPARVCLRVVVALARVSSLSTSTIRRVVVSDPPGLLFASSPLSLVASSLCFLLCVCVRASPRLLWSVAPTALLLFVSSLLTKRCLSASAARVGVSRFVAPARYFFLLAAGGVSVVLVWLPLPHALLSVLRPSRFLLLSLILSIILLHTTSVYALVCAVPFLVVVQQMAPRCIISLSVASLFCVVERSPVPAREREFCPFVLLSRARRARVETCVSRRSMRVLIERVAPALSLCALFSRSLAARAYRRALTSLSVVSLYHTITQIT

SEQ ID NO: 963463 - protein, 145 aa, Homo sapiens
MQRSDAACSLFSAVSLTMCGDHAILASPVRYCKCACGVVPNTHVEETKLSLGIARVIVIECVEVSVFHFRENRQSSFGGMMWQAGFSPGPTTEERIQTGGPNSKGPFLAWRRPFTHTQHIHTHTHTHISQFSHSACCISVILRSI

SEQ ID NO: 963464 - protein, 148 aa, Homo sapiens
MSTVTWGQHQFVPDPNSANITVLATVPSSENIGSYQAGAQWHSGKMGDNIREWAAVWKTPHSLTRSWAGPTWARNEAALQGFSSSVAPVTSPRSQKKPLPAHHHGEGKLNAQGDGLHGGPTWTLFCNTLEKAALPCRLYTLQRAGTQS

SEQ ID NO: 963465 - protein, 127 aa, Homo sapiens
MRRSQGCSQSQTLRLPTQYVLKYERASARHRKSNFQSDVRHVATIVAGSSIVALRSKPCRVASSAPLQPFADRHLRLKHLFVATGFHRTSRHLMAQRFLTICFIRQRNISALQPNITLASKPPTLVL

SEQ ID NO: 963466 - protein, 169 aa, Homo sapiens
MVNLFSEQRGNTVAAFLPLVKWPFVTVKCLREAFGAGTRVGVGFPPSNCVSRHHAMVPIGFPFRSVGFRMAKYKEDYTVGCECADFMSVRLRLWKQLSRGDSSRCTHEDRVVHMRRDKLCSPGTSYSWGQYGRGLESEGVGKMVQNVTSTEDGELVKGVSLLLGLSVCP

SEQ ID NO: 963467 - protein, 112 aa, Homo sapiens
PTAVNWIWRHVVHASCNSPMSVTQHGNVGNHDAFHGCADMGLRATHYRYVPEMKGWFPSWAWTTLWVALWHICCNHGTRLLLFWLPHGYKWKVRWTHQGLFLITSSGRRNTC

SEQ ID NO: 963468 - protein, 186 aa, Homo sapiens
GRTLRSPRSVAVNIVSADRPNVQEPGRAREALQQPYVGGRVTVATRASRGQQDQLRILRACINEAGEPAHSWALVHSEQVFALRLQDKKRAASCLSEIWDVHRFEGAGQPSPHSLAMTTSLSRYDLLGTPVLFSRDGMGALGTMHCRPIGSDRIGTKHPVPGTRRLPSPAHSESSRRGERLAGPDH

SEQ ID NO: 963469 - protein, 345 aa, Homo sapiens
ADLMQHYSSYHNACTAEAAVPVKDTVNLPTYQLHPGHHCCAVALATPRHAAAAAEIMAVLFFHTMRYKSHGPPGILHNDLLMCSHKVPCMIPYRLRGLGAECWFPGLRLDAALNLSEDQLRLVTGHPCPETKLFTYVCHLCYPGAMGLRVACLEGSAYTLANTSDQGHATRVYMLAGETGSCPDGLCPAEAMAFASIYTLDNLVAILDINACGQSEPAPLQHQMDIYQKRCEAFGSACHHRGWTQRDRSCCKAYRPGQAPPNSHPSPRTQGPRDPQGYPHRAQAGNAHHQQPARARTTTQTTSPPPTTHRKPWTPPQQNTPRARPTTEPTRQKRGTQSTKDKPND

SEQ ID NO: 963470 - protein, 384 aa, Homo sapiens
ARLVSIILTSLIHPPRPPKVLAHYRRESQPPDIIQHFTKIIAMLGRAWWLMPCNLSTFGRPRRVDSLVPRRFNDQRWDNDGRTTPLLYIRKLINNTFTLERRREIRPEIPRADTRRRQYKQGEAQTSDVQRNGIYNTTNFEASLPYVTLCNGNGEHIHPSHAHAPHRALATDTERNSLDIFTINMNPSPPFHIHSPKIGSTPETWLKPYNPVHKLNQLRYKNNRNHNFRDTNAQTYLINAHSGGSQTSKRLDWSKPRAYWYTHSKQANVTLALLNQRPRTNNPMPSRLPLPHTSSPRLSGKHTKPQADHIQRKPTLHINEPTANRDYRHKTTHRPVDALLTETPKTRIRHEPYHRGLNILGTSASTISYGRLTTCLLLRTTHNS

SEQ ID NO: 963471 - protein, 279 aa, Homo sapiens
MAQAECGLVATASGPDVAANRLWVTPGEREPAVAPDFVPFVQLRPLSALAEAGEAVLLLREGLLRRVRCLQLGSPGPGPVARRPGPASVSGLAAGSGRDCVLLQEDFLAHRGRPHVYLQRISSKPTERVALLQTVGPTAGQPQGLHQVPLEKGRRPYSSSSYSGRSPLRPLGFGAPWVVVAAKKLGEPPPKFSKKAVDETVLWVVGPFSCPHLNPKVLKRQSSQGRLKGAWRELPGRDMLEPLGHSSGGAVKNHQISGVSLQPRSGFSKITEPQPGGFT

SEQ ID NO: 963472 - protein, 176 aa, Homo sapiens
LGQQSETLVFAQFYFLKRGKSPGERVWCPRNSLASLPKAEVKKATPSHLPFFKKAVEKRSSQLCAAICAKLSRRLLSGSWRRAGCAETFSGIVSPVCENIFSCGECGGASVISWLPVVPHKGPPNSHISEAEQYFAQSTPCVCCVILDTRVLLMESKREDVTRALGCDILKTEHRI

SEQ ID NO: 963473 - protein, 364 aa, Homo sapiens
GAESILDRRWVVARAGPAAWRSTPAEPTLAGAGVPGALGTRLSSRSLVFVFLFLPLSLACLPPGLPLMPLLPRMHACRGLAAAWLLRCLHACGVLGPICYTGPEEGTKRKLNAAPPWPMPQPLGPDPPRLPAPPAHRQEAPQRPAWTGMGLRSSTIPDASRCRPPRLSSAADPGICPPAAGDMLLLLMFRHRADPTQVTANSQPNVRIQKCTTDFESHDFINLNSAVDVLRLMRLCMALQCYDVGTSELQKTAVGNLVYQYSREGISDLMTKGMDHGWTKVIYQPRVNMTLQHTASRPQDTAERGPDVPGNEQGQGRRPQTGIRGTPPLTTGRAPMTANTEDTHRPAQDQIAERAINTGGANPA

SEQ ID NO: 963474 - protein, 146 aa, Homo sapiens
MWFDNQIHEADTDQRIRVVSLLRTRLQLPGLLLSSNCRSLEPGSSSQANARNKVLTLIDFNAGHVGQRDALMQFKQLLNRWHRSWCQGATGDRAIEKTTILANIDAEYPKVRANTRAGERIHKPRKYEAPTPVGNQGAPHRVTTVP

SEQ ID NO: 963475 - protein, 248 aa, Homo sapiens
QFARTLNFAGLFWDTVKKKKRNNDTHTHTAHSQSLLWLALRPLGGKDSSKRHGPGDMGGPGPSSGRQLSQGPAPRGSTRPGIISPSARNQPTKEGGSKPCYHHGDGRSADPDGRGPVSSVPVSRSQGLRGAVSSSGESFPSPDKDLVPGWSRSVTVIPWPGSACMSSPRNLFDHKRSNLCGTQANEARRMGIHLRVLQPGGCAVGSFRRQAPRSHVVGASAPAQVGPQTLRSSWAASSVPRVLYHPSR

SEQ ID NO: 963476 - protein, 352 aa, Homo sapiens
PTGAPLVRTVEDAGLAVFTCPVAASGCPPGYCPTSVALLPRGRVSDKEMKTYRPGMLEDRCIPSDGLCDLERGAAEAVIQGQAVRKEQHLVAHAPVALLTTETPGPPAQPRSTPLEENVVDREQIDFLAARQQIPELWSRRTRRAHHSSPARGTLQAQSPGAMQDPKAFNKPQLANGHVVPIKPQVKGVVREENKVLLCHLGQCQVVDDPGSLGSVEVPGSPRETPIERRSSGQERQETCESKRGKAENRQPGTGGNPTVRCDQGELTGPGEKGAVLNVMRIVTGNQIYEPRADACTMAELTTKVSKDHNVHRNPSLTLDRRVLSATAKIVTTTESDTGRRIDQRSHRPRST

SEQ ID NO: 963477 - protein, 402 aa, Homo sapiens
ATRLRYSSHGKKARESERIITGATEGRAQASGISQNQRDQKQLTVILSDVRSDTYRLGRTWAFWLLDTNSLAFRARVYAVSSEGDRVGLISQVFLIRTQQLSGDATLSPELEGSDPCRRFDLVASSIAVYRRISTDDIRSQARASERANSTGTLPLSRNRRGRTHTEFEWLGANLEALDLHRQVTDDAGSWRDVARFLAVKTWRVFPFIFATNRARRQRSRRREGVWILTPLWSRRMRQGEGLHQNGAHRQVPVPTNGHLHFLKQGRFSHQGPIGTAPVFFPPRIGVTPFRPSVFTAPTLKWRKPFLVRAQWALSDTRTRKTHHHTLASCTLRASYSRASTTTESNLGCPDKAPNGAREYVFPPKGGVPMRSRCGFEPTRGPGCSFFSQRSSEFAPVCSKTR

SEQ ID NO: 963478 - protein, 214 aa, Homo sapiens
LIQNPLSCSGKLVAAVQAVAGWEAVGAWEHQLVSHVKVIEPPGAFTREGTTQRKLFCAPAIMHSATAVTVLTATDPQDRRWTNPDGTTLQDLGIVAKKPGSPWENVCHLLLSELDPDQTCWRHGHLHHQSSTWARENEGRSTSSEPTSEHCPALPAPHSPHIPVAGTQETQEKAPSLSEGGVGIRPWDTAYSWYRRTPSHAQLSGQAHKIDLAC

SEQ ID NO: 963479 - protein, 236 aa, Homo sapiens
MVSAGVRFLVVIDTSWDTVRTNSRRLLIANLGSFRQAYAVSTVIGSWFAHGAQRVFRPSGNTGGWLDGRKADLRMSISCIRSSRYEEFPRHILRLRTYGVTHLAFLIKHSVDLVPWCVPSGCAMGGQGHVEAPASSSSTPSGRNAFDHVAQPLQVSPYRGIGTGLHPSLLRVASVGPDAASPVVPPNQLVTRVRTAYGTDCHGAITSEGDAVQAGARRVHAMTPTCPYGSTPTSCV

SEQ ID NO: 963480 - protein, 52 aa, Homo sapiens
MQEVSGQLSLEDPLTPPQLLPCTLKHLRTVQSRVVIKTSKSQGLVKCICDNL

SEQ ID NO: 963481 - protein, 121 aa, Homo sapiens
MTQQDEKTLWSFESILMQTVPNEPTGLLYYPNACIENVRFGATSEQNPTSEQYMLRRSPVKANYYTQLDPITLITTGQVTVGITAQSYSRVHIYYRSVRPPMLDQDIPRVQPLLKVRLFND

SEQ ID NO: 963482 - protein, 61 aa, Homo sapiens
QGERVVRGHGAVRQPNGGGGKQGKPMRGMTRGGTHVHTREHKRRLWEGRRKAFLKTRWGRQ

SEQ ID NO: 963483 - protein, 235 aa, Homo sapiens
SASYPSRQMGAQRMLIIMPSGLVWLSLRSPLMCFTTTLVFCLTPVVLHHTSVGGIYTSPSSVITPWVIHPAPPTPPNVCEKPFCTASFFSTATVGADAEFTQSPCPPICCSSLSLFLLCFIKGVSTPRLLVPNDPQEDEANSRVPGGFPEGDLPVLTLRPPRAWLMGPPTIAQYESGSLLDGVLAWCWPQSDIDTRFRGFVAPPPPIAPSEAPKTGGPCAWPTFTGPQATVAPLV

SEQ ID NO: 963484 - protein, 51 aa, Homo sapiens
MLVISKHWKHIFLRNKACVKRLKTPGLTIYSPIFTINPQVIITLTVNPTQA

SEQ ID NO: 963485 - protein, 299 aa, Homo sapiens
NGARSYPGLRHTPMPLQPTRSLYNDALCPSTVCAQYAYHQRRTFFPRLCGPPMKKHCVEGVHDFRVQKCTPAWTRRLWTPPTSRTWSTLTAFRTMVMPIAHEFSPDVVLCSAGFDAVLNGHLSPLGGYSRHRQMFWPLDQAADDPGKGPGGDWPWRERHDYEPPSVMPSEACVLGFLLSVELQPLDEGKFLHCLKPTINAVAIAEMITSFEIPEQNTGTVCRSCRWLGRSLREAQAGETDEARDCERHGLAGRVGTDQAMVRQPGYTAYRPAEEPMSRSLPVRAASHPSGLHVSKSCYK

SEQ ID NO: 963486 - protein, 192 aa, Homo sapiens
VLTPECGPSLPPGLNAVWKDTLSPFWVGYTLFNRHEWFWATLETTAQLSDPGTGALVVHGPGEAHDLTRHHVMPLEALCLRLLLQCRDCQPLGYERQIFASQIAPHIYASGHSRESLSRSQSQTLELVCQKIRPWFGPVPARGPRPGETEEAETVSAHGLAVGGGRAGPRLRQPGNTAPGRQRSPLEQEPAL

SEQ ID NO: 963487 - protein, 79 aa, Homo sapiens
GKCQGAPAQEGTFARGCRNCEARYIGTWKLSAKVTCATVGHCLLGVHKKGYWQPSVVSDSYQGGMLGEIVHALSHIGTR

SEQ ID NO: 963488 - protein, 263 aa, Homo sapiens
VFPCPLRLVSPRLGSDCAPWLSFSCIDLSAFLASLRMRSALLLLLRPLHGAGARVGIGARLPWAHLTLCGFTLLAVCPIPVVVGAPPLDWPLEDSRSTVCRLCPPHPLSLYPSHCRCYYEKAVGTSRPIPIGSSASCRTSRPSNMPSSIYNNEDFQVGHSQGGPEEQGMTKVTVIGAGVTLHEALAAAELLIESNEINIRVLDPFTIKPWTDKLIHRSALVPPNGTGSSPVEDHLLRTVAVGEAVSHVTVVGEHWAITVTHLA

SEQ ID NO: 963489 - protein, 125 aa, Homo sapiens
YFDSPPGVCPPLFSAGLFGGWTPPVHLEWPPFVSPALSPQSLWLGQRRYCDYMTFRTTLFSARLSLGDPPLHPLSRPPLGTTLIILHFLSNNGALRCATHTRATVFLLTRAWKEPTYFIVKCGTW

SEQ ID NO: 963490 - protein, 140 aa, Homo sapiens
MGLGRRVVALPVRFMRIRTLLDWSYLTVCPIFLMGYLLGPRRTFTPYLLKTPVHCHFPYCHRYPKPRATLRPRLSLPTGAGDGCGVGLDPRDATLSLSHLRIPGERWGRGYNWRYEFWGNEESDDLLLAASAPALQGGLA

SEQ ID NO: 963491 - protein, 260 aa, Homo sapiens
LGGFLLDNTHSVVFCHIYWGFAPFFGVRGVFLRRFFVDGRFCRRNKSCVSCSVWSIHPPHLGCAPGEASLNVVFPNTVGVCLWEAPPRHTIVVGAQQGGALVVTTRECGLLGGFSSSPLLGRFYNAGGVFAHHPSLSGLCGFLKPLSARLGPHTSVCSLSGGITLRRGHREETLYSLITPPLEKESLLCHTSVQMFVHHTWATYRVIPPIIGPTGGRPSLRGAPKRFQSALRTHSGVASERLRRFWEIMGALSDIAEREI

SEQ ID NO: 963492 - protein, 187 aa, Homo sapiens
MPVGRIVVTYVHRMWPLPGVSGNTWHRAIYPLILINSRVGDGVTCLTGLSKRCCSEAKQKVPPVAAGAALAGMSPCWTLEESAPLCLLRGPGRHRITRLPRDSTAIASTNAWSATVGSPRDVALRTHRLQWTSDADTSSLLCQEASVPKTATSLHIQQPPGQNQHFSSAGLEMGQAGPGCLFNASSD

SEQ ID NO: 963493 - protein, 179 aa, Homo sapiens
ISHLPLFHLAALQSSFLVNNRYHGFLWWLTSILCLCLGTMQALWLTVVVGLGCSPLPSSPCALSSLSVVGLTCLPIASSREGQGTWLSVTSLWLFVRSKSSTLHVWYLALRGRLFFSWPHSAHQEDLRTVHSPPEHYSLLLSGVKCLVCGRDADSIFPRQQVSVEEAILPSCHWGHHLT

SEQ ID NO: 963494 - protein, 175 aa, Homo sapiens
HALLEHRSSSATLGLPTVIGGDGEAGPIMPTVDPACPGRPSMDQVRLVGYFPQLRGYPLLLYELRGLRDAALLSVPHGPDAPRVPRVPSGYKRRTRFRGTSPIMIGAGYLESRSVVGKKGRRTEKVGVPQQGGRRKRPTTRRAPPPYFGDRSRRRPESAGSRRTWPESGKFSRLI

SEQ ID NO: 963495 - protein, 209 aa, Homo sapiens
GTRSPPRGQGKAGACGAKAGPGPASGGTPWDEPQPRPVHRRVKGGRSPTRVMVGRRNTGPKKPPREPQAGNERSMSHRRTRRETLSHTAFPGDPHLTSELQVLREAPSCRTPRCPPTTRRPGKTLGRQPGSRSGEPPLMMGGYLEGGCEERKGSEEKEETPHKEEEEEAYYPARAAPVTRRTELGRRPEMRHGSTEELGPESGKFNRLI

SEQ ID NO: 963496 - protein, 188 aa, Homo sapiens
MGCTGPKVLVCVQKGVSSCVTCLSSLPVCWGRLVRAVWWGDFAVYGRWAALGVWGGASFYFLCPCSSRSRRDFRARAPCDSARGAHTGGHSRCGGSRAGVRTSFPHQGCLSALPRLFRSQALFCLCECFVAVPFSSHATHYGAHAKRSFKDMLVSWATDWLRRTCAGRHGYSLWMGQCPQVAKAVPCV

SEQ ID NO: 963497 - protein, 105 aa, Homo sapiens
MLAGSLERISLLTHDGDTQGAPVSLAPHMGGNKFHLPQCLSPVSHPFRPLKVRHSVHSWVRLVYPHATHICAQYKFRCHDFMSLGGHRNGWRRSSNSPPAYHWEG

SEQ ID NO: 963498 - protein, 66 aa, Homo sapiens
CVDTAHTLGTVLHVRLFNVVELPRLWVDNSHVVPTLVFGVFWEEKSDHDNNLCPRIQCPLGPDLFT

SEQ ID NO: 963499 - protein, 175 aa, Homo sapiens
SHIYCMVLFGCSEGARSFVVDLVTWMTRECALESLFVAEAYFPAVSVMYRYDVYVFISFRGCQEIRVTTTAPKSWHTLIRTRIGRLTLYTEARDKHGAHTDDMRAKYGLPKFWHRHDCETAACAGYTSPRAYWGLMKQLYDFMGPNLNTLTWSYALLEALKKHEDSAYSPEARCV

SEQ ID NO: 963500 - protein, 112 aa, Homo sapiens
AASKRSGAPPDRENRLGPPPGRSAGQGGPSRAPEPPPIRAEPYTGWITSAPQRSSGARRAHEEGYTLESMRDPPAATEAWVTGHEQGGADLIESPGQMTDELLVLYSGEDDE

SEQ ID NO: 963501 - protein, 162 aa, Homo sapiens
MPISRDCRALNVMFWGTHWTTGPGINRLEAARQRHVCGATTVEPAAHRRDTTALPMKQPGIHGRDRPKPCMRCGRASLEYSSGGLGGDRIVLVVMGARAQVLDVAVCARGLRLVASARGTAESVLLTRKSEGLGETGVLGLCISGCTAALPSTNMYTACFQQ

SEQ ID NO: 963502 - protein, 237 aa, Homo sapiens
MKLGIDSFWEKLVCKDFWGNRLKSGLNGNLRCSLVLVIWFLVKGTPHLKCVKFLKRELPKIVQHERPRLQHKGLVVAPRVTLCNSCARPTREFAHPAFGAHTWLGALALAQGLLLWLRRAHFFGQQGAHTSGPNPFHGHLGFNGLTFKPFLGLRAFLFETTRTGALRDALSVVNGAQGQQVLELLCVSKRAQRLVAKCTGAHTESLSCDAQVLRVLGGGRLGLCIFWLHRGASQHPT

SEQ ID NO: 963503 - protein, 107 aa, Homo sapiens
MSNKHLGVGGLLTAWPAVHRGCLLPFATTMVLYVEILRNNWTDAYGTSAGGHVLCSNSEGMTIGTTRQHLSAKHEIHGDALELPGDTMWFNNGITHALIKPPGSYTS

SEQ ID NO: 963504 - protein, 207 aa, Homo sapiens
MQNSFQGEYVATHGNIIRRFGCARRAISTRPPVCQRWDMMIVPCPKWARTLGVRGILYQCFIAVVCCAGKMSGPYKDKGSPEQGGYYQIVPGCIKAFQGRISCAALVPPNVSPGCVRLSSGKRVRVETPYINDGGPTKRGAPRYMMNCGELTPSGGNLGKPGGNSNPALGDACGAIWERCVCRCSVWSSTAQTGAAPVEAVVSCNPH

SEQ ID NO: 963505 - protein, 267 aa, Homo sapiens
HTGDYAAFGDTAASIRGQGWAMCVTKGGHSTEIRDMLQANKVPAAARAGASAPSEVTVPAQDTWSRAQRRPPFSRPLGITRSNLQGAPLTILRLIVQLDQDLETKWDASAKPLLLNMRQYISPLLLWDWCIQQVFDNGMHLQPLKCLDIRWKLCNSRFLEGVRNVSQCLSAELATQLLHQYPILIINGDKRVLALSVETDYTCRTAVTEKVKAFLADPSAFVAAAPVAAATTAAPLLLLQPQLRLITKEESEESDEIWDLCSLFTHH

SEQ ID NO: 963506 - protein, 319 aa, Homo sapiens
MCLLFPRDLSLFSLFRRSAFSRLGDSSGFLEFWGQHGLQQVVHAACPFGEPFVLMGQTSLLASAIRGTWYHPLSGDCSSFPGNLAFGSPRGPPEIQDKFVPIKGQVLPSGPLPHVKSLCQPRTLVSAREDLLFPGFRYHPYISRGTLEILSDVQLIKTGDQVGPREATLLNMRQHFPLVLWAGHPARCSTMAAFTHPEVLDITTRKLCTFSLPGGVSAHVARVCSARFGYPHLLHSRIPTSITPPGTQRVLALSVETDYTFPLAEKVKAFLADPSAFVAAAPVAAATTAAPAAAAAPAKVEAQEDSEESDEDMGFGLFD

SEQ ID NO: 963507 - protein, 106 aa, Homo sapiens
MMTLSVFFSPPDISSFFFPHAQVFFWYATPSFHAPLPPFLPLSLPPCVGAHVAPPHPLGLALPRAYYLLRSSALLLYNTPPGFIRVRSWVRLHLPLRAPPTLFFDE

SEQ ID NO: 963508 - protein, 109 aa, Homo sapiens
MPRALYSELSPIAYTHHWNTPIICRLNSFLLYTPVYINNFHEFEKPSLRSDKVLYSRRDPPYTWSDYMDAPHPTTHSKNPYTLNLDQKGRNRTPPSWFQANPMASMTFS

SEQ ID NO: 963509 - protein, 202 aa, Homo sapiens
AQFPSIAAQGSLSSFGGSSGAKIFDYVAQSGKGELNVLTSLSATLTPMVSSQHNGSLSCGDLLDEEELRPERLRSHCVDCGGHLRSWSRIAVALKRIAGADDRAYRRRCHYYWVRRAPAVPSLYGSLHWGARVTTGDVSARCLRLSLCRRAPRLSSGCHPFCIDAVSALLNSEEFTVFILLTRCEHSHGISVTLVSTSREPF

SEQ ID NO: 963510 - protein, 73 aa, Homo sapiens
WSHTMLEEVTICIATLAPKGPGCGLTHRRCPHRSLCGEIDSNDNCLTDREWGSLLIERGPGSWNSGECIILRS

SEQ ID NO: 963511 - protein, 204 aa, Homo sapiens
LATPRAPLSVPCVVPRSFWGPMHWGPSAHLQGACALVTTRSESASESKGLVTPQLEEVHLHGHLAPQGPAVLTTLEGGHIGLWGEKTSTENCLTEGNGALVKKGARHLESGECIILQELAHARLHPGHPAFPITLGAQPFLLKTPLLALTSVSPFHGMRLGLLYGDWPSYGLRPHGTLFTPRMHVEHGPVLPSHAIYHPPWRPR

SEQ ID NO: 963512 - protein, 114 aa, Homo sapiens
LTRPGAVRFLDCRLCLFLLLVFVLCLSLYCWSLSVSFVFFCSYCIARLRVCVLLYRLPSICRVSVRFLLRRESARISICRALVSLSCYQTQLCFCYPSLRALPVFSSKSKPRVL

SEQ ID NO: 963513 - protein, 149 aa, Homo sapiens
MTLFGGGPLVFDEPQMCVRTRPRKVFVCIGAVRLFSPNTPGAATHVLLGVVLDGARPTPPPHREKRCFVAPWIVFGGGERCLSPPQWPPPLLRVLTWLLLCGNTTGADTLPLGERFIILNSAIFDPALVATRIAAPRGHCSSTKERFLW

SEQ ID NO: 963514 - protein, 114 aa, Homo sapiens
MYQAVPSFLILVFLLPARTSNEGIRSQRLQCSPPEPSSGHACGSVAHLSVTAGPFVGASCNCSGAQNGCWSTFTRHPTALQRVGKGACPHGPPSLSDSPHNPQPCPANPPSGKH

SEQ ID NO: 963515 - protein, 208 aa, Homo sapiens
IVFADVVVFRVCLSLLVGPLLDVLAAHWGLLHTLPCDLVSPPSQQFFVPVVLRRVRVVFLRGRHHTVSPHSTLSFAGENSPWGAPAPPQGPPFAGVSFVGCVAATRASSVPLPCRRSLYVCPMPGFYLIGPKGGSWKWNLFCLRTNQRGSSRALRKLDPHGPSSQTCCPPSVRIVLLRFFEVEVGVNRDHAYCDSPAWATRVRLSTEK

SEQ ID NO: 963516 - protein, 69 aa, Homo sapiens
MKVGVISVHDFFRSLELPRIFRFLPTEFSVSTLTAPSRSMQEILTVPGLNPLTSQYIVYPEQNDSLLNF

SEQ ID NO: 963517 - protein, 109 aa, Homo sapiens
TSETVPTQLGTHPSNDCAHSAYDPRHLGNPSATVGVRSLLIVISLWQHRDIAPELSYGYVDVLARLWTPTSLYCVVLTCRRKALSIVALTLRAHSAAIGRSGSPYVLTH

SEQ ID NO: 963518 - protein, 112 aa, Homo sapiens
SDLRQPPHLLRMFFDGPVRRGLVKEDAFYSWESSTGPPEHRARVWPPKSVTAFFKWLPEPEEESDTTQLEGCVGPGDLGAPHGHHQMAPASPPWTSRGAGQPTGRLANGSPC

SEQ ID NO: 963519 - protein, 110 aa, Homo sapiens
MQMKVNSDAGAFKNSLQGLCLDEQELITQVRSEKCSLQAAAIPLMQIDLIKQRPPPPKFKDNKPLVERFETFCLDPSLVTMQANLVHFPRRTVQRHSLQAFVLLTVASQP

SEQ ID NO: 963520 - protein, 111 aa, Homo sapiens
MVACLGLVVAELLTRHSYYTIRTTCVVTSAYCPDPLGLYLPSLEASFPDFPYFSGFSLGPTCRPDPCSTDQYVIGVDADFRPRHTFSAYPDAPTLLGAIPDAYPPWTSYHL

SEQ ID NO: 963521 - protein, 86 aa, Homo sapiens
SCRKHKPQDGFSRAGKDHTTADNNEGGCLFFPIEEGGAPQTSVGEALFWRGGNKTSPPREIKRGCVLVCCAASLWAKKRISRGGNV

SEQ ID NO: 963522 - protein, 285 aa, Homo sapiens
MCAGYDIYGRSSERMTTMRFYGHYNNSHKQEAITDWNNEKTSAVVEETRAGRGHHVYNLSQQKQKSKNNTALILSAVAIAIVLAAGMVCMAGVDNRPSHQTATSDALANQLTRHCKKPRSSQKAELEGISLRNKLHNLSRRIVSKKRWPNSWLKSNKRSPPFPAVMLTPGCGSGRFSGETRRTEAVGGDQDVNDRSAALLKTCRRPACRILNDPSLITVVGAITDDIAGLSEESKVALMTASSFTLNQRQSGTYLRLGANGPERRHALQRHNSHVPQRSGSTRNT

SEQ ID NO: 963523 - protein, 48 aa, Homo sapiens
MPLHSSLGNKSETPSQNEDKTNKKTQTRSLIGEWEPQTIRKVLFPKRV

SEQ ID NO: 963524 - protein, 211 aa, Homo sapiens
HSLLSVFRYGGLLDETQDAQWQRALHYLSAISEQLTTVTHDCHHASYDGQRHKDPFISRNGSTVEQYIFSPPELKWLSDGNDRHVTPGLLLLAFQSKPTSDAMTETDKPNQQAAMDDTCAPSDKALSMPPVPAHCSTSAPASLRALALSEGDHRLIRNRKQLVPWTVLSETSSSRPGGYRLFSSSRPPTEMKQSGLGSQCTGLFSTTVLGG

SEQ ID NO: 963525 - protein, 135 aa, Homo sapiens
MPAHACVAKIAFKDRGWKVSRLHSLVSSLGTMFCSNLHTPLINTGFHDNTMRSSIPSLEDITYVLKPTLHKRSTIGHTVDNAKPIIVPGIIDGTSYLPGIGGLNNIKASDYADAVFRLYLNVARLRNYFREDEQL

SEQ ID NO: 963526 - protein, 72 aa, Homo sapiens
MIQWSAGAPPPHRRRALAIVVRPPSRHNTLLVCVSHFANVGGSASVFRVNSIWIARMYGPPWAAGAHSSGPC

SEQ ID NO: 963527 - protein, 179 aa, Homo sapiens
MAVDRLSPLTGQSHITPLLVKSVVHRLPLTLQVHSKKESSPLTSLPVEIREFVPGIGRGSLGTEVSERSIRAHMRCVERTRGLRWHFSNITVHVFIGLVCRSFNASSKASGKSTGFTLKKDGLPHSAISGADDGGLMAALAWHESLVPLEAVDGAVRFLKFCTKFSFVISSHLYVFPHL

SEQ ID NO: 963528 - protein, 62 aa, Homo sapiens
MLDQDIARWSQPLSKGSYWFNELKSLRDLSSDRSNPGRFYLLKFLLYEDKEISYSSNPPKVV

SEQ ID NO: 963529 - protein, 89 aa, Homo sapiens
GDPVIPLSFKQSLMPPASGHVFSPVPGTRGVPYQGTAKLNGLRNAPPAGASSMAAVGLPRSALLVAECVTPCRGAASAARSKRTAERGP

SEQ ID NO: 963530 - protein, 115 aa, Homo sapiens
MRVRVLPRVYEPSRRAESFIKEKGCKNGFIRGYLGINLFVAAPWCCPSREMAAFVRVSPPVCYGGARRGFPVGNAPCLSRARRCSLVLPALLRGGAIKSPTGGSLSIFGGALCSI

SEQ ID NO: 963531 - protein, 108 aa, Homo sapiens
MHAASVLLVDEQGPSDPGARYPSCRGLRNIGSVQRNSVYSDVYTYCMHVASEEKLYHDLAYNSYSHITDRSIESIMTCEELVTCVIPHLKVRAVIRSVACIGLTPPRY

SEQ ID NO: 963532 - protein, 71 aa, Homo sapiens
GDEAGPRGPPVQRNGNKPAQALRSASRRPLTPVRRQLQVNCLLYQVVGNRKYTLNTLLKALRCLYLQKYVL

SEQ ID NO: 963533 - protein, 405 aa, Homo sapiens
FLIPGSFSLSPPSDHAGLQSAPAVTNTLALAEAFLYTCITSYLTLYYELFTSSANAAYYCCCCAGWHWPCGLSALSTQLTTLLGAAQQLYPSLAPLEAQLRTSGEPRALTHTTPKNLTPALLSPPFATLYSLLSTLYIYSTRKAPSAYVRTAPQGAWHALRTRGPPAPPCAPFQACPQAHPNPVPQGLLPLDRAFLPLLAPFPRRAFLCDAYALAGILTAARPQPHTHRPVARLTLLSRSYYSVIYYISGAYYFYKPAAYRRRNRAAGISTTRRVVDIRPPDVPMLAPSSSGHTLIRCGKPLCGVNTSTTTPRGAPFRPAPPSRPKKHVRDCVGATDISQPAGGRLVLKWSHTPDGPHPTKAPPSYRTLRERFLSTNDPRRRGDPFIPHIPIYNIARAQRRATPI

SEQ ID NO: 963534 - protein, 132 aa, Homo sapiens
MKRGAQGHVLNNGRAVVTNVPVGAWGAPYVLVLYDELKKVIQGPRPPPAHTQHSQGNAERTSVRITATVRTSQPCEKFQLSVFPAASCRVDRLGEGLLEKGQHCDPTIGSQIPCLDQRGGREAVASLRGAHG

SEQ ID NO: 963535 - protein, 230 aa, Homo sapiens
MSGTQTQKGVVSRDTPAFSKNRLSQCLAFTEVQALMQLRCRGEIVTTSSSRQSSRSSVNHREYGSGGCCRPGIAEHNHQAVASVTHARLVLTHDRICEHQAGASLLVHPSLISPYTTVAGSLAQAQAGRVSRARFTDQCIQLGSSVSQQFEATVINANPSLLDDPGPSINSSSSLVHLTRGTGRKGIFVAFAPLPVLAEVPPVKERQGRRGAANSGGAPRRATFAWPSIL

SEQ ID NO: 963536 - protein, 83 aa, Homo sapiens
MYNIYLGLYFTLLTSLRVACESPFTISDGIYGSTFVCSHRLRTDFTSPNGSTFLTICFIRQLIFHFTSKHHFGFEATGPDTDI

SEQ ID NO: 963537 - protein, 41 aa, Homo sapiens
MSGISHNLLLDLPLPSYIENNALKGDRDFCKTSFSSNFSPM

SEQ ID NO: 963538 - protein, 115 aa, Homo sapiens
LEQRRQGSPLDEKETYGVVQRLSTATGELRQKIHLSPEDRGFQGAKSAPMALQPGLTEETLCSKKYETKTTWETNFESAQLIGKMQIKRINVLRMLHRLVSYPPNACMSEGHGHP

SEQ ID NO: 963539 - protein, 284 aa, Homo sapiens
LEVTGGCMEVKPHGDLVSAIRAGGNDHQVCLVVAVQTDEFFKKCRVIRISGSDLNGPLPVPFTNGVVYSKGDTVVKPLAEAGLGEPQASPGEIRPPVTQRGAEFPETSPQNRTPLAALVVPPPSDPILDFNISLCHGQREGRSMKRSSKRAPQMDCSNERRTLRGTSERRGAPSDWEGDASYSHPRYFLLPQLLPWIGVKFEHPIVPFLDKWIFLENMFFPDFSGTVNVFPVVAARRAGDSCLRVLPPWVLILAGVPLAAALDFAGLARPGLGPGRGGSLRPVD

SEQ ID NO: 963540 - protein, 129 aa, Homo sapiens
MSPATKVSNFPVPISQGRCGPSGPYGGRLGRELGSITYRANRSNGRNHGPHNAGCEDAPAMASPMSGPNRVMHLLRSLNVIYAPCSIGAPLKFPVAHMIDCLYDLVSRLIHSLSVSTLDVLYEDACGWN

SEQ ID NO: 963541 - protein, 178 aa, Homo sapiens
MCSLFVGFYLFYFVYVIYAFPCICCVSRLYCFHREIFFFWGHALFGFSTVLQFVFFVVPPLFPSLCSLFGCSPRTLLSRQMHRCLPRVARCPHHIRTVHPGFPRDSGQGSEVNQRHTEDSPWQPASPEERDIQTEEKSPAPSFLAQSEENLPPPPSTDAREVGGRSGKFPFPSDPPDV

SEQ ID NO: 963542 - protein, 86 aa, Homo sapiens
SLNSRLRPMTAVFSSQKLVREMSPEQLMNLFCAGFTLDTPDDEPSLSYVSMNGPQRSPAAVFVSDEIQDKRQAASQSAVVVLLRLC

SEQ ID NO: 963543 - protein, 104 aa, Homo sapiens
MALSQPLCNRSPLNGQARERQGTIRGSRPLRSGHRHRILILDKVGTAPSQPTKPRRHASRPHHGNHTHRTRPARMVHSDMRHPTDLNLGARTNREPAWRDWRAQ

SEQ ID NO: 963544 - protein, 348 aa, Homo sapiens
DGRMYVECVEPEGSHWLDLGMGEPASELPSEKDYRGKCASQENPWAQQCLVGLGARGTEVLQESRRDGYSADGLMAVESSHSQPKIREPGYSVSMGPFDMMSKVLAWAGRILSFCTALGRYSYTLTSSSHAVRTLSFTHVCGPHYPFTRATRRFSLDTATLNGRQGCQGKGQVNHPVWHRFNKDGQRLVDFHKCANFLDERYIREDTYITSGLKLVEDPWSVVHTVPFPKVKAGWRRKPGINSTVERGTFTITLWLQMTSYPIRFPRGLTATKEYNARENTNYIAEAQARHITMGYSLDIKDRSTGAWPSQANNFVAKGLSCRILIHPFGICPTREDHLGGTIRLITA

SEQ ID NO: 963545 - protein, 280 aa, Homo sapiens
MLVELVLTSDEPPFRNGGVSISPQKGKYTCVVSRRTEFFGGVHIDYRAPPNCAGAKASHPLGGPDYYKAGLLGKFLAPSTGGPIPAQELGGHRGSLRQGGSNLAKGPMRGPHGWDPPGMKARVSHHMPGRYPRSRRGSRNTPRLAPRGPQLKGAKGSEREGKGGIKGGKQGAPLEDSRAHYGHPHYSDISEHNSGDLAPRYLHAPESPQGPNVHSTGAPHHMGEISRFTRTPQPRTENGEHFLEHICHSRTPPERSSGAQHPQPRGLVLAGTRRGTTLKE

SEQ ID NO: 963546 - protein, 111 aa, Homo sapiens
DGQAPATGIGPPPDQCRGKPGAPFPHLARSGTANAQADGGRTRQGAGNSRGLTAPGSFLPAGSWRETTLWALQGPPDTQGSPGGGLPGTLLLSSFSLINASDRIPCLRGPQ

SEQ ID NO: 963547 - protein, 364 aa, Homo sapiens
SDEMKSGDGDEGADEPCAMCTCRALVAEVSELMVQWQRRSDGLEMKMNRCLLCSGMTVLAGSLCDLQVSMCYVATCNLLAPVVELVQCIAVRHAARMRRGTQSRARWRARQTWGQTLSVCDDDESPLHGARTQHADVDMALWKRDAHPHTHAASTRTRADLRKPRTHTCTATRHSSWYRNRATHEHTRGDTHGNTRRTNAKSQGALREQETCPHCNSGHGLRTPTRRTDVTQLPALRARTRTVVTPVRGLKRVTPRPRQCKRKARAEAKRVGTHPCLGRTTRGGTNAKDSHKVTEWCEQSPPTGGRGYARHYHILGATKEADIQEKHMGVTIHAPMARDDACTSKASSEHTLGRSCNPQGEGST

SEQ ID NO: 963548 - protein, 229 aa, Homo sapiens
CGWFVSSVCRGFAGSSRPRWGVCSGFVSPQPCRRSALFAVPPSPGPRVVARAWWPPSVAAVLGALVWLRVPSRLFILVFRRCVLSFLRLIGALVVFCVGLVLFLFFMCAPLGLRPMCFCPWVWGALCVWLCGCPGPFWAPPSLLCVIGGVSALLAQWAPLIFLVCCLSPLCELPCERVDGAVLPLVDHCLIVWRVSAPCLSSRVMRLVSVMPPGPLLRRVLSRGVRPGF

SEQ ID NO: 963549 - protein, 369 aa, Homo sapiens
PLKGGGWGDHQKRGGGALVTNPLPPPPPPPPAVVQMYIFVCVSPPPTQTRVDISGRTTHTPDPARPHVVVFLKKKEEGGPPRGARAGGALKPATPPGEISPRAPHTPSTQERRGESQHEGVNPPPHTHHTHNINNNTPHNTTHAQEETYNTHQRHVSLKKNINTQERHSEQALVTLDHHIDDQHHHKTLPTVANTTKRHTQNTYTHTTLVVEQQHPNYQQKITKIITSTTLLHLKENHTPGRQKGNNTGRRTQGEKTTRPDTMSHPTHKNSTAGDTATQKKLTEHHTSHQVSQADKVEQTKTHPPQRDGTKTIINQRHTTTTHPPTHQKKKHTSAHVGRSEDNNKNQNTHAREGAPEHPREARTAHRKH

SEQ ID NO: 963550 - protein, 171 aa, Homo sapiens
PAPWSLQSPGKLCLSGSGTDHILSAISEVHSSQPSSRMALPPSPLAMEYVNDFALACKFAGKAANPLQGRPPPLSRLTGALTPLHAHVASFTHASVQPRHCVAGNPRAPRPGLDGAVLAGYPARTHPARRLRGTRHFGALHVLQRRPMARCLHGLSAPMSLLDWAPMASLP

SEQ ID NO: 963551 - protein, 86 aa, Homo sapiens
MAPQGMQMPGKQGVMMLPGGDVCKERDARCTGPCSRVASIVVVLPGILCVPRCACGYSVSETVHFATTQVTSMGFETAKEMNASPY

SEQ ID NO: 963552 - protein, 70 aa, Homo sapiens
PDRIFNFRPNGSPVEFPYAAFAPRFPPGNRANFPVCTTRHRTVGLQTSPVPSNTLKVKLARPIRYLKPIE

SEQ ID NO: 963553 - protein, 115 aa, Homo sapiens
MPYYSHQEYQSPELTISLIENNRESKDEFKHCSLAIFELGLYFTLRTSLQSSFESPFTISDGIYGSTFVVATGFASDFTSLNGSTFLTICFIRQLIFHLIQTSLCSKPPPDTTLC

SEQ ID NO: 963554 - protein, 97 aa, Homo sapiens
RNGYVGEIGVGPGWSLMGHKSVRMRAGVLAGKGRRRVPAKKAREGQRQKGHDDELARGRWATKGKRITAAGASTINLVDKLDPVFGIGRSCREGENL

SEQ ID NO: 963555 - protein, 149 aa, Homo sapiens
MSRLLYQFVPEQGTPRWAIRLCPLTGNPYYYGNNSRLYSVMYLPKYSMGYDRFRMEAGDLEETNLLVTSWTPHLVWRWPISDRASVGHSSTALLISGYLCKAYLPHRRCPHEEQLRGLPPVHCKRDDSQVNAHCGTLYEDELMQSLSPC

SEQ ID NO: 963556 - protein, 292 aa, Homo sapiens
GPRLTVVHDKPNEDSARPRERADNVRYTGYYVWLQARPGARVAAVLGHSGLRREEPPGSTMRLGQPTCSSTSRRVAQTPFGVPSSFPASVACEEASSHGARAPQSRRPPTEGKQAVPQAENEAPQTHGHTHQSGARPEGNQRLRGQWTTRIHSSHPATPRPEFTSGPYRAGVLKQDPVRPMGPGPPHRGPPTPTLLHAGFLPHGWCGACAHPAPSVYGPDGAGPWCTQHQQRHGSGPRAIPEAFNTAHWALPIPRGPQRHQAAAEGGLRTGRAAGARACDNRVPQNCPPALD

SEQ ID NO: 963557 - protein, 218 aa, Homo sapiens
MCSFFRCPAHISGLDENSSLFLTHLHLRCLQYYLRRVGISWEGAWELGSTSALPGRQFRLCRKEQSPWEALGEGGAAGPARMVLPATGGLRVVSAPVHFTFFDDFPSLCFPHLFARGVGLADENSPEDCFYPRPSPRCDSGVSGDYREPGHLAAVQPRVNLLNWNCWLTGGFSTICELNLMAIAGFLSAYTQKHPGSICQVLATGPGSNWRMIYVTFH

SEQ ID NO: 963558 - protein, 122 aa, Homo sapiens
MAEVAYHVKNNNNNNNNKSLSVNQLFVPPYQGYQPVFLPFFFLGIIVGFIPKFLTASFLFSCIELPCYARMRVQDWLCALDSASTWKHDVPISYCWRNSNLQALGVAILSSHQLYLRTGITA

SEQ ID NO: 963559 - protein, 381 aa, Homo sapiens
RFFDGWLFFGAVVSVFGRAYQGVCHAGVSLFYMPGVVGLVLSAAWGPFSRICSFPSRFSVYAWHVVALGRPEYPVADCDAGVYVCIPVFYSMVWSSLVFEGLHKVSTMDVLLFFLDIGYYLLISVICSKGFLRGYSENSQCESSHVLWRRDMREHIVLLRPAVLEEGEWNASGEQAAGLLEGRKATMEPPGLRHTAPIEYPLCWLVLNFYGASRYLAIEDTLLLLALPYFLGSTCDYTVWLGATDGTLTSYLSCPEELHVQTRSVTLQVIIAAGDGCQTSWTHRLRKNAFRQCQSFIWNQATSRLAVSSDVSWSFHEAMELCLLPLSATSWQRGPTTSYTCAENWILAGEETQTLGSRVLFLGGGLSSSVGKAFNQGKIFK

SEQ ID NO: 963560 - protein, 121 aa, Homo sapiens
MIYKRMHVSPYAASQGLLGSRNIPALINVLVIPVVCSQNLSPDKMLINDNMCPITSLAILILPRSCGPVILLCLHLPCDILLPCGARDLCDSHPIHTLPPFLKITNKNLLVLRLVGHHGTC

SEQ ID NO: 963561 - protein, 80 aa, Homo sapiens
GVAHPWWPAPAECVNPPFSAVELDVRPVVPARDKGGECLGRFGAPGRTRGVSRARCLPVSLVERIICGKRGGIYVPFGTL

SEQ ID NO: 963562 - protein, 90 aa, Homo sapiens
MSSMASWPLSDPCEKEDHVMLWGILDRQQTGKISHRVRSTQCGSLPSASSYKVTRHGPSAFHDAQETKEVINPVDYTVLRSHPKLTPGPY

SEQ ID NO: 963563 - protein, 178 aa, Homo sapiens
FHPYLGKHRVTKPGLLITRNVGLTYGELERTPVSKRRPMGVVHTQLNRATWEQIAFNASYTLNSLFPTKAVIWNSLLPMKVDKALVFRITPSSIFLVGNPSTGIRPPPDCGNRPNGWSIYALSYAYREFANRSSLNNACSANRGLYGLLLDSGTVPDSVQSAYLRGSFVQAMYSAYVI

SEQ ID NO: 963564 - protein, 105 aa, Homo sapiens
AVYSFLLLSVFCACAPPCRVSLQGVPSVLRRFRVPVPALDILRLSVWVLVSSPGRLLPFPLLSPVYVVYGFSWAGVLSSILLCAYCPFLLRRHISFSSFYLRLCA

SEQ ID NO: 963565 - protein, 164 aa, Homo sapiens
MGGFLCTGLLIVSWLGAPVCVTPAHSGGGSYTRSGGEMWLAFVGSACPLCGERVSLLVGVAGLVGGRPPALVPGSSPREGPVWETSLFPWSYTGVILHERWGLLPSAAKGAAPARSPCDRVRVSWSRRAPGINIWGIMPFLLGGIFFPQIRSSAPGAALGSPRV

SEQ ID NO: 963566 - protein, 84 aa, Homo sapiens
FYHNVLRVVRPKQHYVEHDLVAQGSVRCKAMMAKAITRGHLTQIGDVMEGTDILSGILQNVKPKKAKKDGLKGFPGQTEVTSRS

SEQ ID NO: 963567 - protein, 86 aa, Homo sapiens
GHTNFANPTTCCVANVNLHDAAPVGVSGIAPKYRHRLSVRCATFLACSGVDLSLVNIVLNPPFSVAKRTLSLGFFTASVSVCLLLS

SEQ ID NO: 963568 - protein, 105 aa, Homo sapiens
MDACYINYAMQVCECVLRGPRQGLTETRCRDLKPVEGQSQEPVTVKMVYSIASHLWSNNRKKLAPPPLCEIREFSEWQGKPCTEVAEKHPCHILCQKPVGLTWHL

SEQ ID NO: 963569 - protein, 261 aa, Homo sapiens
PVETDFGGTMGKPQWPGETRGWNEAKERGPGIGLEGPTLPGRRPYTRVRNSSNARAVGDTSKTHLRRIKDRLKQLATPSAVEYSRSTNRGRPSSRSFLERGRRDERRNGKGRELTHTYTALDHETEAVRGNSTGASECALPCTAPWTEGGQATTTEELQARGLACIHALLPRGCHADTPTFTKPTRALGRSHARSEEHGRSESKAQPTSFFGAAENLGEKQRRSPPADAPAPGPQPFQSCASSLGPPLWPEEGPQADSLGL

SEQ ID NO: 963570 - protein, 78 aa, Homo sapiens
QRGSQLEGVQASVAAFLRSVPYWRSTAPGRCVEQLAQASHVVLTPFARPEYYSTAAVLIRVDPEELIRDFRNQLSINT

SEQ ID NO: 963571 - protein, 173 aa, Homo sapiens
MEPIAAKTVGVIVRTAVWLGATDGSFVGADGASISVTAGCPHRLLFGAHHWVTVCAQWVSAVCHVRWATLGHAIFGPPGMSFRFSKDLCFGVNLLHVAKVLLAASPLRSKPNAVTPWDQDCRVCLYGRKVLLFFLVVGASREIDLELWHVPDFAGIVSPRSAFEPTGFSPCNA

SEQ ID NO: 963572 - protein, 349 aa, Homo sapiens
GWWSPAGISSLLAAHCAPVGFLFFRRVSPPQRWRHLRNVVGVWSPLVWECPPPLPGLIARGAPRLLLPPFSAAPLVGPSGGGVSLLSAAWVCFRGRDGVSALGMKGEGRFPEVWSGPQSMCALYKSLVQLVSPTGVEPTAHGLVTSLVWGDIVGDFPARPPPHCVSQRRHTPRCLRGGPLCSPHPSRVGALLPRVWRTAGHPPVSHFGGPPHNGPPTAPHLLSPPRGLLFFTKGAPQSLWESHGFSHPVPHVFSRPAGESAPFLPLTLVVTPTRRTGATCETQRDVRMSHPRGLERGHNTSERDLSCLSESEFTPAIPTREGPTATEKKERRGDFRVERKGPQKKERRL

SEQ ID NO: 963573 - protein, 118 aa, Homo sapiens
MTLEKACSRTTRGLAHLCSTDRLQKSAQPLATQYGKLALVLVSLEICALPCERPLHYARDREWYTGFRMNLQGPIHDMCVLLSEMGYALEGPCPVVIMLDRSRDAREEFALLMLRGAV

SEQ ID NO: 963574 - protein, 71 aa, Homo sapiens
MNGKPLKNKVQCEYMMRSPPMKTAMTGVRPLTCDLSKAARLVRPPSPSWGWTSVSHTEPTTVISSACLNTE

SEQ ID NO: 963575 - protein, 235 aa, Homo sapiens
TVSVCPVCCISLGRCVWSLCNSLLCHLVKGLRLLAIVFVRRNVVAFNVSLSCFLGFIAADSTRLALSHALGPLAGVGVSIVVHASWIPVQWSILGAVPQVMKKCLVRSTLAVSAFLSDDVNVLSMELCRSTFCIMIADLCTAASSAAGYVCDNIAALISVRVRGHGCREPPVSSHLVYHDLDVRLLVILCLDNYEHGTIGHGAMPRNSALLSLVCLSYDDVLSLGLLPSICMHRS

SEQ ID NO: 963576 - protein, 207 aa, Homo sapiens
MGALCCRAVLPRRGVNKSLVVLLVALGGKKYLPLYPPQRRGKGKKWGKEGASKMERHWEPHTVMRNFGWETLWRSPHIPRGKRPGAAHTYTHMGGKATYFGEEIEMEKHIILLHREGGWFYTGVLQKPSVIMGGPQVRYIHTRAPWRVRTSYNRGQRYRCRMERCREEHALDISHIIYGVHTILCALSVCLCVVYNINLIYGIGVFV

SEQ ID NO: 963577 - protein, 127 aa, Homo sapiens
MSYLHVYLAYIGDTCTDSVCSAVPAQVPWTDGVLDGLRSPRGPQAQGLGPCATFPVKQGLSLSCRGRHCDATGLIYKQQACGLFKAEPRPFDCPGGDGGSRMLELNQTLTVLQAFLFHKRMTHANKY

SEQ ID NO: 963578 - protein, 238 aa, Homo sapiens
KAFGGQWEWYLRMLSSFHEYKFITTSYMETSVLHPEEVYAVAKLAGLHDAILRSAIIGYDTQVGGRGLKLSGGEKAKEVANLLRCTCSEATHATSYSMMKLFIVRFDLLKDDVDYLVTTKDMVVMVKEQNFYFHYAHRLSTVVDADETHLSLDQGKVDRTWYATNGLLAEPLIVSIREMWHTQSSRVQNHDNPRMGSKDKYNISKEEERKILQEEIVNSVKGCGNCSCYSHIDISFLC

SEQ ID NO: 963579 - protein, 148 aa, Homo sapiens
MSKTPLFLFVSVGSLRLFARVGDLMSFLFFRMFRCFMHLLRFLHLWVLVYYSWCEALSAFSLRFGMFILLFFELLTSIALLYGSIDLDVSGVVRVLMRLMLCIFFFPFPGFVGNYFSAPSSVLLSVTLGHFMLRQHSIFLLLTISEVF

SEQ ID NO: 963580 - protein, 103 aa, Homo sapiens
GGVFSAAFVRSFGGWCRGCFRVSRIRLLLSGVCLCFESFYVWGARGCSPHGVVLRRGVLKLLWPSQVELWFARWPLLQKCLGVIRGGGAHHAGHSGYKLHTPV

SEQ ID NO: 963581 - protein, 117 aa, Homo sapiens
MRAIMFLGNSFSEETGFVGKFWILDEAKIWEIQKDTRRGPLVVLYRVFSCIKKFLVWKYSLHSRSKVFRFLVIRSTHQALAVTCLKHYKAVSNEYFLLHAHIFDGWGLGGEEVKSRF

SEQ ID NO: 963582 - protein, 109 aa, Homo sapiens
GGLPSIQMHLHRPSVCSHIETAHSMHLLVGKYRLPPSCFKQLESWSLNPQTVQRLLGTPPSQEAWHPPSVYPLRGQGVRLYSFCILLLSVATDSINDATMVCDHVGAIK

SEQ ID NO: 963583 - protein, 288 aa, Homo sapiens
GWSVVFELRMRVPAVCGRAGRVPTQRSLRGWAASRYWGRLWGGIMVWVAIWKGDRSRIVSGGTRGRFPFGASVADAPSAPLGRRGRLGDLREALCNWRDYLCALGPPRIRPRVQVVSGWVIPRWTCDRFAGARRPLERTGMFAWRHVMRTTAQLGYDSLTGGLRASLVSAALGQGRYLPTWLEAPFGAAPFVWSHLGVFRRVVPRPIVVAPWDGVSRSCTQPWRFCPLALYQAPLLKLGLMWRMCLSPALLEPRKGNGLQEELCEAGRDQMEEAKQLAIAHWGDGCGR

SEQ ID NO: 963584 - protein, 290 aa, Homo sapiens
PVGEQGPRKAKRVTSGKARRLPLQGGRLGGRTRVQAAARVHRGLASCRQMDPQKGETKDVRWATPGHAWKWKHLPSPGPILGCPSYPLSRRRLSSSGFATFARIGMRGIVFQFDMLNAFQILKATNGFLYTLGKRSHTHYQLSLKLFAREYRAFTSDHSGSTGSGPCPVVACRQPAFGPFKAVCQWQPVQLGHIRSPGQCSGGLLCKVGSSSGCQVHLAMYARAERPYRRTRGSSSGVGGSGTESGVSNRGTREPSMNEPRVLSIQQDAKECTPAEEEEDISAEEAGEEA

SEQ ID NO: 963585 - protein, 150 aa, Homo sapiens
MRPPCDTPPRRDNTHRAAVFRWSEDAKKEVDEQKLNGQNKDSSYFVEGSPTMVKTTVCDIPPRGLKMAVTISGNSTAIQELFKQHHRRQITAKFRRKAFLPMVHRRGHGRDGASPRLRATWTTSSAEYQQYQDAPAEEEEDFGEEAEEEA

SEQ ID NO: 963586 - protein, 172 aa, Homo sapiens
MTLGASHLFVLLANRSGHGASRIGLRPLPLISPPPPGLCPFCCNMCGSSPLVVGEMLLNCGSKGCPIRRTAGSVLPEAVWAATPFTRLFLFSPSAHVYSLHRAAQLQRDKVPFGLISLVMYALGGHTTFLWNWRHSPRGLMGLIPEHNGKRCNSNIRKFPRHLPFAHIALYR

SEQ ID NO: 963587 - protein, 142 aa, Homo sapiens
MALGRPLQCTGRRPCNPLMGPQCDAKIAACKAQSYAVRASPRYPCNVCASCHVVSLQAPWHMRMDRRVGLHDWATHHGKASALGSCELVARSAATHSRASQRTYLRCVFHAVMETYTDSRSLRGSDYRSVREEPAVVTQPSH

SEQ ID NO: 963588 - protein, 100 aa, Homo sapiens
LRVQAMNWEYLGQWWKVVPSWYLPHCLNGLKIAMVFQRNASPAWGTLFGLSTESPSRIHAAPANMAAQSSHPGLAVLLYLAYYHFTWSMSSRKRLARISQ

SEQ ID NO: 963589 - protein, 97 aa, Homo sapiens
MATMQLAGASQVIAGPNHRTRALTEGYQEPGATTAENTVPMERRKEATATPATAVITTNTKGVRTTRQAKAQTTRWSGHQTGHTRQNQTGSVDHHQL

SEQ ID NO: 963590 - protein, 119 aa, Homo sapiens
METLCSTNTDVCLFAGYNMGESPTGFNIGENRVASPEELLSHRGVLYLLGGSQRDLFSGLHRGTTRTAHTCVFKTPVGSLPTVRPSHMVSHTQAHIYTCATGPSGKRRCIHHTAHAFCH

SEQ ID NO: 963591 - protein, 222 aa, Homo sapiens
LTPEVPPTLLNQFENTGPPPADKEKIQALPELSAATEEHVRLRARVPLCAGTNTRWVSVCGSCTEYHLFARRLASCPGWSSTDMLPPSAEQSHHGTEQRPGTPHGPHMGVSILLLDRHRSSVQLAQTTRTPQATREPTSAVGNSTGPFPHASTQTAPNRQPTDWVPRRRQTHRMVRACRYRLIQGQGHPRPQTTRTPRADEGARNTQWDPTEHRPQDYNRHS

SEQ ID NO: 963592 - protein, 266 aa, Homo sapiens
MLQAGLTANMVPPAPTPRPQLPPHGQHFRGGHPTQAFPTLWRELSLAFSLEKTPALRWPPLSPLTGKLGVSGTPHSWSPPLSGGFFVAPSGLFLSRRSLGISRTHSLICDTLFSRTRGETPHRALCATPLVHTETPSIRAQRARGVPAHSCAATFPPEWSPLRGRGAQPHPQALPGVRGAPCVCATGTLASQPPLRVGRVLGHIPRRKLGPCTRHTHRARPKTHRGAPAPEPHPLGCPALYCPAPGTPTPSLVFVCVCFSRKDSNC

SEQ ID NO: 963593 - protein, 394 aa, Homo sapiens
HYSSPQSRSVVHDGFLAYIREYPVMQGRCSRMAVQRQCCVNQQSAHGRTREFRMMCMAPNEDEVSRFAFTVTVLPRVGVAAAALQAVSTGVDARDYVSMRCCPGVTGSVPGRYELASGRQGITGVFEDEVDQRFPGSVGVSTKVEPGMLVKFVQVWRLGDMVRHGCDGNVACKAFLPWWPDDYQWHSIPLPGRGDRSCWYQEDRAWVWHAIDDANLLVSMLSTGLLKLYGREQTYYLNLDELFLQSSYQTEIGQTWSSHSPRARGSGQITEQRYNIYGQYKTVSTPLTSIGWSITGTNDGKRARHAGRHRRAKAGDTENTGGQLNPWEPSVRKFGRCSEKSVVWASGEVPKGRYEKWGKGESEKHRGSKIKRKQSLNSHMGHKKGGKYKDIVFC

SEQ ID NO: 963594 - protein, 237 aa, Homo sapiens
WTLCVYLLTAAVMRRNTGPPGKSDYSLYYHATIGMIISKKVHSGSRPGGSTQMTDQQDVTALEDVSVLMRLQNRHAIRSAMQEAEPVKEHNRFFWQEEVMNSICGVESEASVYCKERNSLKIIESDCWPEKVADRFHAEFQPMHPCSRCSVAIHKDGCWDLHSRSFDISYSVIEQVNNLRGARKKSLEMHVQVIEDGKKLGEALEGNAVEDAHGSPPFYCAPVIQEVSRVCDLHREC

SEQ ID NO: 963595 - protein, 72 aa, Homo sapiens
YQGFKSRRKGFRCLVIGCLYTFLISTTLAVLHLTDTEIKVNPPQDFEIVGSRILRLSAYLQWQPAPLSLDQF

SEQ ID NO: 963596 - protein, 506 aa, Homo sapiens
MWPNLPRPTSTSIEAVARTTPKSRSSALDTEDRRTGDERRQRILHNNRMPASLAGAGEPAPTEPPYSPLTAGQEPELMLEHGGTGLPAACCSYPCIAASLRDCTQTIVRLTSQAPTKLRNRYRVRVHSIVPKHNETAPRYSPHLHLGLGRLPRRPLPRIAWLLGPARPNRNRTQRRPARTALAREYQRQATKQCGLGLARPNPQQLTPSTPRDENYDATQETGALAGTRRAPTETQTHITAPVPPGPAQRHPPNHEMLAHRVPDPNTEQSPENDQTEPYRQDTCAHTEATVDLGRRATKHGGPNGPHGAAGERKGPPQDPAPPTRGTRHAQRPDNPTETARRPPKAAHHDIAPQRATLPGTGTIGRRWGPHRRSPTRATQAAQQPESRPEMHRTNPAGATKQSMGHKLRSRPAQDTKPRKTHQQRDRNNIAEHAVVNRQSNAAAPRDNPPWRHSTTPTSSVSSTQYSAYAPTRARRRVTTAEHNGADKQQAGHHTANDKDERAEQT

SEQ ID NO: 963597 - protein, 341 aa, Homo sapiens
MLGTGGRGHLLPSPFSLVAPLKRCVPLFSACALTGGCSARFHCGSPLSVVVGGPLFGQYCPGLRHNTEWGHYLGPWVLFVLWSSSTPYVPHVARGVPHLLWGYISPPPSQVTGFHGLEPFVRRTSRPLAGTDTWCTPRVILGAFLSTFTVPSPCSLLSVGAGPFCFRGLMPALAPDAPGRATSLGLPVPVSHRFWFSVPLCTRFSRGPLAPPLPPARPAAPTFTPSTQGEERRHSRCCTSPFVPLGEVGERDEPSAGGDMEGLLNLFLFLVEASPSLSPFSLSSWWHLAPPCLSPPRPVPPTRGGMAGRPKGEGGSPLLRGWFLLIIWITPQKTVKLRERE

SEQ ID NO: 963598 - protein, 551 aa, Homo sapiens
MSPHRDNATMESVKLIFNGDEALRMQTAVCTLNGQGYCGALSNMVDSLAIRMRRAFNRALIAGGIETDCEHEMLAYGVLRICERSQDQSIRRHGSSRSSTLRLIASSMRDTDVALGPQRDPALALQRGPGRAGTSRTVCDANYAIDTQRDRADRFAVSTRVIANSLIVAHIVAPTEGNIANRAHLPRKRNELRAAQECDPGEYPEIGRLSNGSRLPKRGRNRGLGSSFGSQRITYVTEDYPVVRRTSAIKAVAAPLEGTSSSISKRTGPTFCRDRQLTYLESHNLGDPTVVNGGNRHVIPRFRIASEPLTIGHMVYGLGDNNGPCANLVAVVGVLSPPGAQTFPFSTRQQNFRPVPSVGGQLHSDKVWGVQHTRPHQQRVARNAPNIYRAPSEPAIQRLGTNAPPHAVTPSVNNAGDAHNGAEQSLSQGRPPLKTKPPRHRNAEAHFGARNLSQLEHHNSSLHKRRAKSTGERANDETTRKESLCAARTTTNMSVHTATEDGQVTLIELAQPTEGGAHSHHSSPQRRYANTNTRSPLHKHGPRHTITDRVV

SEQ ID NO: 963599 - protein, 177 aa, Homo sapiens
QGGPQMRVPFDHRADGHPYTFPAPGQGAPGKANKGHHPPRQGRLSKEEIEALVQGGGEVPTEDEVPRREGVNPERLESYAFHHEEALEDEGLQGQIRRGRPEEGAGPDVQRSSRGWTPTTLAEKDEFEHQRKELEPVCNPHHPLDCTRVPVVPGLGASGLTGPQGGSGSGPPLEEVD

SEQ ID NO: 963600 - protein, 288 aa, Homo sapiens
MNTLSAPRHARFLMTAVVTEADGHMGRTDAHRCSDQFTVVQMPHHRYPTAMSDLLDESSGYPGQCSTSQNSGTVALIRTRTCDARPERPTCATAEPLPCPRPYVRPFRASFLSTESRIPLIEVECAFLPLDRPAALQQRQCSVHIRPHHDRQRDEALFRAASPNQLPQEKSVPKSRMKQAKASDNAHHSDDAEDPSGKPAAFQTWGSEDMSATGTLEQGTQYVYIALPAVAVIVISDLDYGDNAFGAEKGTVSGMHLKSACTQNSEINVKKHKTIPGEKTIEIALESP

SEQ ID NO: 963601 - protein, 144 aa, Homo sapiens
RVRHPFQIRIPDPFLNPFQMDTGQWIGTFPLPDSGNRSPGRYLCPQTPPEDLEPLLPLQLSPFSPCSSTESPNPWTLKCLPPPTARVLQTAPLFIPHPTPSCRPRDEASSEPPPPTRFLRKSPFPKAEMIAESQASDMLIIRIC

SEQ ID NO: 963602 - protein, 219 aa, Homo sapiens
GWGGGLACVGGGRGCGVRGGHVCVGGVQCAVLSAGWESAARRVRGGRAQAVQTVRFLVDGLLRCLAAPCLRSSAKPYIYSQRRDQGQLCPGSQRSEELASPLRLPHHVSSQSQPRGCVQTGLCGTTAGACSLWNDRSRSSVSMLWPSVSEPWRPPETRVLYEDSVSASALRNVQSLGTAGPCHVLVSACRGPWRCGSLHSRRTVGASEGSSRKEQRESG

SEQ ID NO: 963603 - protein, 102 aa, Homo sapiens
MATGTVSQSRRVPALSRSHRPGGGEGPQSKGGNTCIRCKEILFQSIPVCTNRHMFLTRGVTYFHHRFNNFVFLRVYDFEFFLFGGKNFESISLSEFKYRERM

SEQ ID NO: 963604 - protein, 84 aa, Homo sapiens
QDIIHCTLAGAAKAVGKVILELNGKLTVLAFRVPHCRIVSVVDRDLPCQWNLPNMNDIKKVVKQASEGPLKGILGYTEHQVVSS

SEQ ID NO: 963605 - protein, 156 aa, Homo sapiens
MIHFCGCSVGSHPPFPPGGVIILLLVVSSLVSLGPPHPGGDHLLLPTVEPYVLVVPPCGAVLLYVWVRRRLPQQKRLSFCGGNHKVVSNCPPLGARCCHPWGIRPLPTLAAHFGPPYSGCVLRPPTDVALQNRIVVSRLVVCGTTTWNHSRPAFFF

SEQ ID NO: 963606 - protein, 468 aa, Homo sapiens
LLVLDPVVLPCFVWMRFFLSSLFSLLCVPLCRFSRLSVTRALCARALLLLRTRFDTVFGGNTITGLRFLSVASFLRCAFSCLLGPSWFVRVWTTGVSITLWLVFAGPCHGWECLEGRTWGAISGAFPMAFCLCALSFYHPVQVCPVLPFYIASVSVLPPVLTFFRIGFLLYVYYLPHVFSLFSLLSFDCVTPLHDTPLSLAELIRLVPIIWDKLKSPLPSVVKYDLCQLYAVPRGQFPLQCPTLRMPWFSLHFRGKASYRLSWCLVRLCNDFCGFDTFLPIAHPRDEFSPADSSLCLWVIPLHFAPELMVPCPLLAFPTSFSKAAQCLWSLHMLIPHLVSRQCLPLSPTFQVSPMAYRQWLLICPLVSPVSVPGAASHVRTPIHLRVSLKTTLVQECCWGPHQPGARANAVASRSSLRTHQPLQEHPQALCVTDSFLVPQACQQGPRFAIEQYDNRRTFVLLVVLINI

SEQ ID NO: 963607 - protein, 101 aa, Homo sapiens
EALDTLVGNYGRWQPWKQQPPWECAIWGWNQEGFFGWHRAFVIEGPLMMLLIFISCYLNVESERIVPISDEVGLAKRQIHKVMSEIVSVRSRVYVLRNRAH

SEQ ID NO: 963608 - protein, 168 aa, Homo sapiens
FPLEKGVWGLFAENGWKNPKPPREMGAPLVSEMGPGLPCRHAAPWTRCSVCWLEPSPVRAALAAIYSGLLRRLQAEGCLPPSLTSVVVIVCGGNNINSLEKCMTGPYLEKSPPLGPVFLKGVTHAWPQRPLRGPWTVLCLDEEDSVLADGSGSPVQLCCCLNTPALLT

SEQ ID NO: 963609 - protein, 223 aa, Homo sapiens
GGGLLPVWCWPLEVGLAAVTHHCAWRPMGHQCFNAAITAGQTGHHFPDNHTSVAQRPGGPDGGPSGLECIAGVPDSLCSGGGPRGCERCAASSWMMSVFWWSLPVGQPLASPSTQASFGGSTAEGCLPPSLSFSCGNQCVEAHNINSRELQALKTHPGPRSEGSQSWPPRPLRGPWTVLCLDEEDISAGRWQMETALCNCAGCLLKEALLELLFLAFRPLRPN

SEQ ID NO: 963610 - protein, 149 aa, Homo sapiens
LLSDIESRLLITQPRRCLKQVASKLCRYRACDHGTPYEAATRFPLTKVYVNNMARITDDSMTWFYAYTYRLTYPPPVGLLAVLSDESHNFVLRFMERGHAAFLGKQTLAPSLEGCASTLYSRVLPLRYELGSDVGCIGFPETSSLSRNS

SEQ ID NO: 963611 - protein, 190 aa, Homo sapiens
MATTHPPVQKRPSIRDKSYLSTSDRFVFFAGFVPEPIYHSSLAPTPQLGGHWPPTRQSSPLNPLEVPLLNTSVLLASGVSISLRLTIVYIEKTSRQNPKYIQARALLQYLAGYQSIVTLTTSLQSSFESPFTISDGIYGSTFFVATGFARTSRHLMAQLSSLSASSANVIFQPFTSKHHFGFETIASTAL

SEQ ID NO: 963612 - protein, 197 aa, Homo sapiens
MPSAKVKAAYTFSGNFSAHCSFFAPARHPCYAQNALAAVRSDSSSGPGMILNVYGIMSHPVLYKHLLPSLVAHGSMPLNPSILRAAEAGLWSTLSPGALRSSLDNMADKPWFQRTYIKIRWAWMVRTYGSSYLRRMRWEDQLSVGKDRGLQWDGDALPLLTEVQAWAFRVRSLLSKNNTYQIKSNISLSIHHYVCAP

SEQ ID NO: 963613 - protein, 59 aa, Homo sapiens
NGPVEGFAPELSPHYGTSTTGVGHMTGHHLPALPGQLNADLRKLLVNMVPFPRLHFFMP

SEQ ID NO: 963614 - protein, 189 aa, Homo sapiens
MRARLTGCALTTGQPTIRALTGPSSPHRWSDSKNMMAALRPAARPLPDGGCTFSGPQVPEGGGRPEAQTARTRTAATSWSGVPHHVKTAVCDIPPRGLKIVGPLQSATARPLHGGCSSASPRPFTATVPAPGLPAHWYHRARELERDWRFTEAESHMDDLVSEGPSQFPDAPADEPGEIRGGGGRGRGV

SEQ ID NO: 963615 - protein, 192 aa, Homo sapiens
MGGARALDTRTTTSIVRYVCSSLPRMSYRIGAVFAIIGGFIHLISPILRLTPLDQTYAANPFHLCIFSRRKCELSFPQHFARPIRNAPTLLGVPRCIHHMKHPIICRLIHFSNSSNINNFHDLRSLRFEAISPNSRRTLHKPGVTNMDAPHPTTHSKNPYYMYVDINGRIDPPINLSHPCSAALGGEWGESG

SEQ ID NO: 963616 - protein, 104 aa, Homo sapiens
IEEMEERREKRELRQVRAALLSRELAGGLEDGEPQQKQGPAAGGTRTRRKGDGTGGTKVIESLEKTLRNVSKRCRVFCPTARTRILPSLLVEAEEHGPPGGSSG

SEQ ID NO: 963617 - protein, 88 aa, Homo sapiens
MGSTLLWKAKSLFALPLCSIGVRVPKCGYVAHLVIKSRVCTELVSTIVFTNLLCPKAQLMQGPIVGAAMDGPETVFVMDVCHPEKAQA

SEQ ID NO: 963618 - protein, 229 aa, Homo sapiens
ARVFSSRCVLGFDPFVGLHFALSSLGVFLLSRAPWAPFAPGPVSFKESVLYPYLRARGSFRAIGHGVALNPPEVRYIPRFLPEAFAEVCCCPWTPPFAAAFTPGPSLPDPAPFREPAFLWLLTPGLTPSLSRSHLMLTYLTLALCNPDSPLPYVDLAIPCNHPGSSPPVGLIWWILAPGISCPLRGPLSREHPLGGHSLICTSTRDPEEIEKEDPAAAEKPVTPGGISG

SEQ ID NO: 963619 - protein, 105 aa, Homo sapiens
SHYDAFNLYLHFKAYQDINGDSKVEIDMYSMCCPKYSLVYCVFHRQLNILKLVPYFLFQRQILVNGRLFLKSPFVPNPIFRVASSFFIEKFVSTPVSKNAHSKFC

SEQ ID NO: 963620 - protein, 85 aa, Homo sapiens
EFMIKTAPWKGLSEDVSISKFVQMILCYWNLPNRMLCSNDPHVSAWTPVSSCSLQWAATPVFEAETSYDVAFVLSESVWKMLVPS

SEQ ID NO: 963621 - protein, 207 aa, Homo sapiens
MRRPLRLNCLYSPPLALFASFIQGGAPFSSSLSLWCDSSPSSSKPPHGWWFCIHFSPSLHSTLAVALSLRTVRGGPLLFVLPKQPTLLVCPPILMPPTSVVGGAARVVFFPPLAVVVVRTQHCLLRWAPLSTDTARTDRCVVSPIRRAFCSYPRREYSLPLCVLSPPPTESVCFFFSPPRVFFFGGPLLCLTLTPRARAPLVPPPLI

SEQ ID NO: 963622 - protein, 268 aa, Homo sapiens
MFVIALMGADTHGMGMTGVPGVGYNAVKTPGLPIAYAINMGGVIVLLERCCRSFPAGEAHYRRIWSALRDERTLCAYCNAVSLTVERYSDSVSVFRVGSLGSKMCANRVLELLLVIVRLEESCNLNEVVSPLLLRGCPEGVEPLGHLRAPFWPQAWALRAGLVYVYRLYKSAKQFAVGGLVIARVQRMQSHSWTRQKLSCSDQRHRCRPRWCKDASTSGRTHYLTVTAGISVSADVSRDSSVASAGISCHPSWSVNSGTQEVGSQMSC

SEQ ID NO: 963623 - protein, 111 aa, Homo sapiens
MEGAPLGESLCSPIPIVWRHPGHPLGPHPPGPAFYPGVTPREMWETPPVDLPVRECLGSDQGSPCTSFVGPLSPRPMAGYEASGPGSYTFLRFWERCSKMYMRGGVNICFE

SEQ ID NO: 963624 - protein, 124 aa, Homo sapiens
MLARTSGGLTCKGIPSLQRRGTSAWRLEADRNRATYHQPAPTTPRPSSCLDRRCPPVPQVPSRSSPVPPRPCLLWSSVPVGRQDQLGAAFTAGPCAAGHERRVVPLVQMGETDANVAKFIHQTQ

SEQ ID NO: 963625 - protein, 211 aa, Homo sapiens
RKLPQDCEFKVSSLFGVFFWEISSPEKGPLTFCRKSFLEKSTGPLATDGIWTLGGPHIALSGPAVGFSPLELYPPVHRPGAHIPGAVDQMDRPSSTQPSVSHHIYGLSILALDTTLCLPRVRPVPSTVLSRSLPALPTLEHACPLWEAQIHASALHIFCAGRCAARAAETCGASCPDGRDRSNVAQIFITRLRDYLFTLSPDMPALKEGNP

SEQ ID NO: 963626 - protein, 107 aa, Homo sapiens
MLKVYRIEDGSFAGDIWGEIDTRFSFCTVATLALVGEAVMLLMWKRQSKFVFILYETLTRGFGCRPGSESHAGQIYCCTGCSGYYRVSGHQVNSDLKLAGGLVNDND

SEQ ID NO: 963627 - protein, 202 aa, Homo sapiens
RGCIRRAIVTMRKAISWGNDVYRGGYKSTYTPGLPKLRSLQVYDQVPLETVTNGIGDQSWSLWYIMKGCHHGTGFATAYKCVTKATEDDSKWSKVTVLARVTRLRSICRVDNAHSAKCRRGCTWCIQGAKGRRGMCSLGTGVGDRGRPYVVPGKPCAYQRCCALMVTKCAAYARYRSDSGIANSESRFPSVDTSDEARGFAG

SEQ ID NO: 963628 - protein, 145 aa, Homo sapiens
WFPDADEVPRTVGCVTATLPPVGSFFSGVVPATHTSSLVRGRDTSRSLAAFSALSHGGVSPSLSPFREREVCFTRPRRHRCSLAAGDILVRRQEMMPCGRVKRRTQRDPTPGVVHLYRESEGHVFCGGGKREPPPAGGVSHHPPD

SEQ ID NO: 963629 - protein, 291 aa, Homo sapiens
ETRRHEQSNLKTVPPQTRTGKKGLDGEEASPAGYKTGTVGPKAPGSLRSGRHIREAMPTCPRTAKRGLSNGAHRTRESKPVQEAGQAPGKVELGPQLCTFTVQLKVPRAHLDLLRLLWGPDLVVSVTADNHSELEPKILDSPEIALRTRMCIDWGWMTEVPGTGKSTMVHVDCLREALNNHLEEDDQHKGPCRTEGKVQVQELGAMGARWLPPTIGIDRGEREALAACHSQTPALCAHPGSTGLKSHLPTNVHKAKVLMAALLLGVAPTPLSRTFSRKSFPDYLCTRVPLH

SEQ ID NO: 963630 - protein, 142 aa, Homo sapiens
MASPPIGSERGEDGKPLLPAIPRAPTPFVLNPGSNWSRKVTCLTNVPKAKVLMAALLLGPPAPCEDFSRKSFLSYLCPECPYTETVCPAIRCPIYVSVCVSTPADPPRANLPAWTESGFSSCTPLNPMHPGVGIHKMNSSTD

SEQ ID NO: 963631 - protein, 120 aa, Homo sapiens
MSLDEDEPRFLGRTCITVQEVMMTLDIELAANSEEIMNLLLKKKDFLTLDYQEHTLTCEPAAMLLVHCKELMKYTGYLFPMEDLREMSLVQSVTTQEDHKRELWAQFWCFKNNKCAYLIN

SEQ ID NO: 963632 - protein, 172 aa, Homo sapiens
RSGGTGLACGTQSASDTGGVTECGRCSRDMAGCASAECQVAGMVCGGRRNPVRIALTDALLPALSDWTMALVDANIVTIERTTKQAHTDTTHHFSQWFLIVQHHDGEHLAIAGELTRGTNARNKTNLAAGSLRNLAGAGASSLRRTGLESVNTFTAAICYDLLAHDLNAIIS

SEQ ID NO: 963633 - protein, 215 aa, Homo sapiens
MFPRFLGPPIKPRGLVVVDPRCVRGVPTALSCPFPPQGSHGSPSGALPPLLMTALFPPRGRTVSLGDISVGPPPSGRSLGGTHRRPSRSCLPQRPLALYPGGSGETPSEGSLRSTGAPLLPLLLGHMLLRPRVVFPRHVLRSTLVKIGEEREIGGPSRATGEGEGHFVGKGHGRERSCPHAHHTPTGHRLASFFTASPRSPLRAPLCKGGCFPEA

SEQ ID NO: 963634 - protein, 345 aa, Homo sapiens
HTYNYHTPDANYLKSQTKSLIELAYISRHYYRLKLDTSYFSDSLIMDYCLKAPRSKGPISEVCQQYSSGKLVLGYEINTSRFITTVLNTSTELTETPLKHITTITLRIPLFPYCRTINYMYATVNLIHDTYSHIQHDTVTQCRHHYRHYALSFKVHSPHFIKVPRPHTVRARSNMLQYAHSLLHVHDIHPGTGTFSFASVSRSQQVTFGTTRAVYTSSLTLRVINVHTYVHGNVGPDFHRESGSLHTVLVHFSHGVTLSHITHCVTFPTTFNIHASPHVNMNVFVDAISTFRLDHLPVLFKTPAGTLYQALNLDGRHFILGERKRSYSGGCTCSCNTIIILRFSR

SEQ ID NO: 963635 - protein, 137 aa, Homo sapiens
LISGRFMPPRFVGPLAEIMGPPLGVVLPLGRAIFTRLLCVLGTQGPYVLPCGDICLYCPPPSPSVGGPPLFVPPPPLVVFPRRPICFFMMSPPGCISSHYIIFCARSPSRRNLRAAPSRLRSVLILTLSLRGDARNA

SEQ ID NO: 963636 - protein, 126 aa, Homo sapiens
MWPRGSQARGSRGSSGSVPRAQASCSLVLAYAQKRYYTFTEWTSINWALCGGASSLKGGNGKIPPEMFLQAVPGPITTERKGLGSSLKQKRKKRKAQQRATNTDTTPRKKGGKQRSSPFWARKSAD

SEQ ID NO: 963637 - protein, 265 aa, Homo sapiens
MISKCHPSVYRAISTLCNEVIRHAKVTGHVLCIDFHASSRMIVCAQSMCCLKTYHRDHVSTFALLNMGARESPVPDVQKERTEYPRAPWTFCLMHECLTRIKKPWAFHDCVHYQDWSSQRDGAYGSIVGIRYGKLGLSGMPGHGVGNPPRKVETGVGLLDGAVSTKQEPPLLMLFRQEATDRTIVPDHHAGPITFRSKNHLHCEPTKPSQASKLGPLTVDSLPGPCNQHLGIHRLPNVTANIGGVLPFDTPHHVLYTKDDTISAQ

SEQ ID NO: 963638 - protein, 438 aa, Homo sapiens
QRRSRAPTHRIDSHTSPRSASSIREPVLLPPARTPKDTSATHPHAIVPTTVQCPRSSYRMRLFRKDPWTPEYDLSPQSPRHVRLTFDLTVATPKPYPALGTSRRVRTAQIAHDLQATRTTYDSHQWTGGVVIGKQAAIPYLARMHAVQGRQGEKPPEGCMGIPLPGDPYGDVRLTVSVESSSSSIQITPETFPHGKLRPLTQRQPHGLDSLEMRRPEQFSRPVGPNLRIPHPRGGGPLPLGRQAHTLRDTLHRTPDATGRQASKADPARPKTRRPKRANRHSHRRPNRGAVRRPGLGRPTFTPTRPKVPHIHGLGSADSILARGPFNGALPRSDNYARSAILVYRYICGSARRAPRGDTYANESQTQRAPPARLQTPARQPGDRRAARPVPCTTQRPRDAHTGDMQHPAKRTRGAQPRTESTPTHGEPDKARPHTTVP

SEQ ID NO: 963639 - protein, 140 aa, Homo sapiens
MWEYNRSCTSLEKNELWGLKGGEIIEDLDRKTIICYIPQRSTTAGEDKKQTTAEHTTTTNQRKTRPKSNHNRSQNENEQKQTKQKDPNQQNEHPNKREATNTKNRREREEAQQKTHAKNRTKQKQKRHKHQNRQQAKTTH

SEQ ID NO: 963640 - protein, 68 aa, Homo sapiens
RYGKRIVPPTPPALVWLGLQKDNFLLLKKNNVCVVSFRSHSIGGCCLSLPPPAACCMVRRRRWNRVLE

SEQ ID NO: 963641 - protein, 141 aa, Homo sapiens
MLRGETVYIEKIYFFRVRVPLCSSISFIYSAWCVTKTIAWLYTTHDITSLTHEWPLFSAWERVYYNSSTKKMFAATPLWHTGSSVFLFTHTMCVVSYSYMTAPYYTPRGDKSSASNQNIKLLSIKHRIFKTQEGADKTSPL

SEQ ID NO: 963642 - protein, 134 aa, Homo sapiens
GLSKKTHNFESTQPAHQPTLLRIIRSTHFCNRNVNKQALFSVVPRTLFRPYAAYDNAPLHRYLNYAGLRNPFDKSSGKAQLGLVAMPFIAFPLGIQCTQHTHIETANTISTLAKEPLGPGHRRTRTHKRNLPKH

SEQ ID NO: 963643 - protein, 177 aa, Homo sapiens
MRETAESLKAGKNLYNLEGGLCPHMHLGAHLHFTQKLTALQQISINHISNVATKDDKFPTHKRPQTNAQHHTNNKTGGGPKKKPPGGHTLGRTPPSLTTRAPTGTTNKHNRGGAHPHTVELETRTPEYLGIEPNLGGRPQRQTHPTTNYRVRALTTSGTGNPRNPRRHHWVPLDSNN

SEQ ID NO: 963644 - protein, 214 aa, Homo sapiens
MRAHTRGLDCNFGAKLHSLLTGDLHELMSRGQTRVQYDAPEIYQNGGKFPDQTVTHQCTMYSMGQGGCIPLMSQELSHPQLGHVRTLRTGQRYPRQCCEEWRRDRGSSQGTNGGTATALARTQSTQTTKAEYIDHRDRVPMRTSTHMNENTGLGEGHRDGTTLQGTNGWSQQERPGTSRGRAINEARTKSARRHARGAAETNEKLRVGSETPEQ

SEQ ID NO: 963645 - protein, 199 aa, Homo sapiens
AAPSVPSPRPPSETTIWQGEECTGEEERKGSRTRLPSTEPVHMGLCVTSVYGAFDKKAGHYTISIAERHHREAYNIAERDATQQQTQKEHNTATTDTTTKQNTPQQTTQRRHTDAETHERRGQDTEQEKAEPTPRKPQTHHTKPTLDGEGDTEEREKTERNPSTRPTRDRREKQMQGESRQKQKHDHAPNAPNRAPTTH

SEQ ID NO: 963646 - protein, 109 aa, Homo sapiens
VFAMCSCDVLVFVSAVLFVCFLSCVSCFVVCSLFWFCPFRSLLFFPLLLRLLLQFSFPGAIPSRVVFPLGLFVTPLYVLCQMRRPSGSRNLLPSVDFICSLVFTYLCQL

SEQ ID NO: 963647 - protein, 118 aa, Homo sapiens
MNLLSALSLCGGAVRARARERCCCVNTTRGRERVSPLGAHTDVGAPSLPLSTPAGGGTQQGERYLLCSHNIIKHTHTHTPQNFIFFCVVVCGALVSAVFFLWRRYIVWRILFCSPLVW

SEQ ID NO: 963648 - protein, 129 aa, Homo sapiens
KKNEKRKIIYIVFPIYLCASLCIQLWRRLSIVLTGLYMSAFDVAWSPLPYGAPAVILPPDSFTAPMVVLQFTSCPLFLSSVLAFPSAVALRACTIRSECPFLSHDVLFSQTSPTTIAVPCQALREDLRA

SEQ ID NO: 963649 - protein, 98 aa, Homo sapiens
MNFSVHSADPERKHSRTGYDNYPCLDRKKHLITLKLDTIQNLVIKILTVHRLSYLCMEQRKTETVEEPMEEEEAAKFEQEDSDDEDNARREIYAVPSL

SEQ ID NO: 963650 - protein, 106 aa, Homo sapiens
CSGLPSHTGPGRFAVLFVRRASQCLGAPKGVWVYGSSQPVLEFCTELVQAFSFGGCTAFPFSALGEISEKSVRRANRKFPEGGTCVGEAGVENKEISVRDWMFKGF

SEQ ID NO: 963651 - protein, 122 aa, Homo sapiens
YSSLDQGFTQRSHGQGPGSTRDTCNSKVQRWNSMGTNNEARIQSSSNVKRPQCNEGRQCINPILGSQKREAPEGCAELGCIAWVLDVGIRPLGRWEWSVTNLLLFFYPPHVIRLLLSYSDGS

SEQ ID NO: 963652 - protein, 103 aa, Homo sapiens
MDSPRWPRGVCEFLCQSFLPPALSQGGVAIALRLCVEREENISLSGGRTCVSHTLVLSLLVFSLFFVNLSSSCIKTHRSLYKTLSSSLLEEEKYKRVSLFIVV

SEQ ID NO: 963653 - protein, 138 aa, Homo sapiens
MDDEQFYRINPDDDHSDILLDYRYPKGAYHAFATTQLVTPSTHQTLRTMLATCKTKRNNDYATALDSSANTSHAHTTEALPPSNLAFSTNGPLSKIHKNNSLIIPTIIATITLLNLHTSTLRLIYSTSITLLHPYLTT

SEQ ID NO: 963654 - protein, 330 aa, Homo sapiens
SLCWFLCCCLLFSFVVFCFLAVFLSLSVSSRSRSLSSLVFSSFVLSSLCLLCLVARFFFSSSSSCGVCSSPACFWSLPSLFPDLARTCALSRDVSALVSRLVGCVFVCVVPASLVSSLLVSVLRVCLSRFLSSLCLFLFSSFCCVCRVLCSGCGFLSLLSLSCFLLSLFSLRVLLSSVFSEQHDVVVVACVVFSLLVLLAGLFCFCSLFLVRLLSSLLFHLLILSVLLFTLLVYSPTFLVLASLLIKLHEMSSLFLCLISSVPRVRPPVIDLPQFPICSLLYWNPSPTYVLVSSLVIPDVPSPSSVIIIRPPMCSRRGESGINPSFLSST

SEQ ID NO: 963655 - protein, 115 aa, Homo sapiens
SHSLCGAVDVPRLLLMRTLRLTTDPPSLIYPLLCSLCPSSRPLGDYLSLHLRSASRTRVSSSARGSGRAPPPGECRRALIITFFPLFSPHPPSPPLTPPPLPPLGFKKFNGGFNF

SEQ ID NO: 963656 - protein, 178 aa, Homo sapiens
MDILSRSEQQQGFAAAYCRSGKGPILMELQTYRYHETQYEMTLESSYRYTCKKFRKYSNVRVTLIMLLKDRMAEQQSCQCGRTREDNVMWKLTEGAFEDRCRQFASADPEPPLEERGLTDYLTPATHLLKFVVPDQWIKFKSVTLRGAEQWRGYTFRGLPDSVLTLVKEEENPVNDIQ

SEQ ID NO: 963657 - protein, 132 aa, Homo sapiens
LVHPGLQRTSPGRTCCRASTGSLDDIFQPHFHSMTEHTPDCPHAPTHVQVPQPLSQTLSMGGWESARDITNTPPPSTPACCVLLLPSCCSVATQAHHGGRAVPWLSLWLLTWPLATIHKKRGLAGRNSPAAT

SEQ ID NO: 963658 - protein, 139 aa, Homo sapiens
IVRANKLLRNWTIRASHTIGTDRSSTVIMRRLTPVRPVPTLTQILYHLHVSSGRLQVMSSPELSAPAVLVLARKRDSKQPPRKSPPSSDKESPCAPLLTAYSIDRPSALLLFLRLLNDINTILTRPPRRPRQLYPSQPR

SEQ ID NO: 963659 - protein, 107 aa, Homo sapiens
MDVYPARNFALMQIFRQISGRILPWDYQVNMFYTHMVDLNVTTYSYILKSTNMHMACTPARGPLLVTVALWQPTFMLVPYLVKMHLQKSALEKPNSPGTRCSLLPAI

SEQ ID NO: 963660 - protein, 113 aa, Homo sapiens
MCLFRGAPADDWSRFTMKYTAVRRVLCLHERAVPLLLVGWSTLFRLDLHRGHNDSVGGGRRKRHKQLLGGESAPLIVVLCARIWLSVSLWERRPALVIYRERWCSPLPPPPLG

SEQ ID NO: 963661 - protein, 168 aa, Homo sapiens
WPLGSCLCPPLCDPFCVSWGFPSGVPCTVTISWLLVSSYRHMGPPTVLSVLLYRGYIWLSPCLLTAPVLPRPRFRCARFVTPGPSVARPSLRRSNIGRPGPLALRHRSSYVGTPLPCTQAPESTRLAQAFAYCIPSARSSLSTFTQSSGYRVSHLTLNYALNRRTARQ

SEQ ID NO: 963662 - protein, 111 aa, Homo sapiens
MTLAHEYDLSPPLAETHRTPFDLAEGESELVSGFNIEYPPGPFALFFIAVYPTIIIITPSPTTNLPRNQHMTHSPLNSTPTYFVHPDPTSNLPVFMNSTAYPRFRYDPLQP

SEQ ID NO: 963663 - protein, 247 aa, Homo sapiens
NSRCDSCYQGSCLGDDTADLWQPFTLPPNCFCHCDVSNESRSPKIAPAPHGVRAPAHSGLGNFVQSCCCPLPAPVVLAAVSGNCQIQYRPFFPLTANFWALAGFTLLPQSLWPFCHVPPVVPPRAAWQRSRPLRTLLPAPRQGAAACPGHASPGTASSRMPLEPSPLAHSRGLPGLGRRPRPCDRTGHRGHLHGAADPQPALGVGSSGSGICCRCLGPGQSRAATGGPSSVFCRRTQPPPIPDSSLG

SEQ ID NO: 963664 - protein, 251 aa, Homo sapiens
SAALLFSSVAAPPCGVGAVLVSSLRRPFVFVGALCPQVGHPSGCSSPRRGLSWTVLLRRPPSGDDLFVPPPPPCGGVVFSSAHRETPLFLLRLLLFFSSPPPRYWSSPPSSLSLRTRGTFAAGLSRRDPPPPAVITPGAVGVGAPHTRALVLLASPPPPVGEDVRPLSCVVAVSLSLLLTAPARRRRAPPPRPLFFLLCWRRPPPPSLLHTSLLRCVGCAPPCGGAVFVRGGGGGAQGSPPPPPGKSWGFP

SEQ ID NO: 963665 - protein, 244 aa, Homo sapiens
MYKNLQLFGFSRHYVGRGLLEVQLNPEYWVSGPHLPLMWRFPTVSQCAMDLGTSSEIQKFHTGIDWGNLSNQLTELSYIEGLPGTHLVHVGCPMQRSGEACTSVTPTLFSSRFRQVFSTHLGGLGTWNTSKGRPSARGCHCDFEACHRHVLMRGAPAPRARTAGNARGYLCRHLLHRETYEEYGYDDTYAEQSYEGYEGYEQPESRGLSIFIDYGHGEVARFCDEAYGQDDWNGTRPSLKAPLC

SEQ ID NO: 963666 - protein, 113 aa, Homo sapiens
MSRRCLRGDFFPSARRYIFVFAEPATRGVLAPRTRVSRGGLYLTLLWLPAAGRIILGEREKRQGVVFLVAPRAVSIGFGWGAHTHSVCNSPHPHSLWRESTLMRVCVCGVVVS

SEQ ID NO: 963667 - protein, 346 aa, Homo sapiens
CLIVRPSWCVIPSLFFFLHCPLLHGLHVPLTAFPSPLVRLGVLYPRVSSPRSWCSPPGSPAPFGFALFVVILVDRPGPRQTVAVLRFIVCALGLCLVPFSMLCFSSLSSLRFLFMFWLLALCAGYVPVYPSVPYTWMRGYLWSLACLGASILPGAVLRRFMGFLGSLRFASSSSTQMSLFPFVAITLYVPFAVGTVPLVDVTFVGPSCLVCPSSPLRVSLSHLWITGVNANGVWLHGTLGSPPNLSDGSPLMAAASPAALQGRSGQAMDFLFWAPRSVGDHLVSSPCNLSSDTETRASPSRMGPIDLIRTVSVAAHGIFRDTTTLTARPWSHGASLPILSRRYAPY

SEQ ID NO: 963668 - protein, 182 aa, Homo sapiens
LLLLLLSLTCCPSLTVRPLLAGPVGFALALCGNLFLFCLLVRIPVICLSYGHVTYCVRYSPRPGLFADPLLFCVVPSHALIFFLCLPVVCWWSASILRYPSWLPLEQPTFFGAPGPEYVVRTPYPVYPHYLFIDLVGSHLKFSLFAYPYPRTLGESSTSHIVTHFASRFYSRDHFENTYGMV

SEQ ID NO: 963669 - protein, 346 aa, Homo sapiens
SGPSHLDSPHAADSPTRPGNNLSVGPPINRALPPSLRDHGVLTPWRSLAYFPEGPTGSSSSAPLCLMPPMSHSSRLNRDRYDHRAPRVISKRPPAPPAALAPWHKVHPRQLLVLTGKTSTEPHVHATHCHPEACGLAPSGNIAPGADGPRGSPEHSIPCLYLGACQGCCARSSLSCYGKLTWHWPFPCPQLPMARHVVDHDLPVIEKPAKNWNDTQRRLRESRTSEGPLKGSPGLQLKHQVVSLSTFNTANHPHPPHLNGSGPRAIALHTTSFVQAHFLRYVQRILAYSNRVVDLMARTWPPRSKTPGPPAPARAQEEETRTLNCWGVLPHSVPHHTESPLLTVAM

SEQ ID NO: 963670 - protein, 72 aa, Homo sapiens
LPWGNANIATPSTGNQGLSSGLCGPFEGNYRSLKADFSPQCLSIDALCPFAMPKVAKAFNPQNGNFVGVCPL

SEQ ID NO: 963671 - protein, 103 aa, Homo sapiens
MVRLSQFFLFDSLVVLPRRVVSLSLVFSLFATTTLVVRPSWWVIPHWWGASHRSFVSRRTDDLFFLFFHRPPWGVVSLLFPFFPPPPAAPFFFSFSPSPIFPP

SEQ ID NO: 963672 - protein, 104 aa, Homo sapiens
MSLWWFAAPIDLLSSCRPLVVCFSSLRLVYVFVSRLTERPPGCAIYHVVMVAERIIDTRGVPLSSGGIILLVGGPDHHHYLCCCPHLRVIYKSRCGRDRPGGDR

SEQ ID NO: 963673 - protein, 68 aa, Homo sapiens
VQYNVLSVLPEVLISQCSFPEAFQPVEKSSEGRIGDHCHIQGYSAVISMALVGQTAGPQILDLFSSVI

SEQ ID NO: 963674 - protein, 120 aa, Homo sapiens
SHVGHEYWRKVPPYAFVPTTGRGSHPSGAGNGIRRRTNESPRPSKVSPVPGPNRYAPGKEFTPGLRGLKRDQTQKATHPGQLDSRNKFWQRVQRRILGGLHPVSTTIRVFYGIKEDVRVL

SEQ ID NO: 963675 - protein, 238 aa, Homo sapiens
TRTPDRFSPSSDPPPEGPTQTRRPRMSVPRQHQERDQPRHDTPKERTELDSALGTDTLNPITGEPPRRTPSSGMWQKRSYKLPEEEAPSTVCAQNRFHSKTRKFSTCFREPEKRPPTVVSNTFTALILSPSLLLFALWIRIGANVLQLHFVLLSTIIFHLGHAAMLGLIVCLLGLSFNMFQTLKVPGHLGQCDVSWAGNRMLAQQACAQNEQHISSRRQMEILNKLNVKQRSPEPFTV

SEQ ID NO: 963676 - protein, 235 aa, Homo sapiens
GKVLGALGLGLREPHLAGFQGGGGISRGPAPGAHLSPFALTPPSLLQALSPELCPRMSDARACIAGEPDPKGTTERLAWVRGPLGGGPGAPHPPLGPVVPVLVFPPDLVFRADQRSGPRQLLTLLVNPTKATALRFQSMLIRHGGTPTFPKPHMIAPGNRLFREFARHALRKELSGRVVGRKDITSILRAPAYPLELQRTRRSSALAQASCWDKHPNPKTPQHREPKGTPPSPQS

SEQ ID NO: 963677 - protein, 441 aa, Homo sapiens
MSDAAVDTSSEITTKDLNGEEGSSGQQADNMAQRRPCYRAMLHAGNTWGSQAGCTMQASTQRKQAQQVCRRRPSQGRAQAHQPKGAKGRQSHSTTCAAIATASQRPAPQLHPHRRPQTAPSHGTGHALHATEPHLIPNSPHRQRPANEPRTDRAHCTSRTNGHTQATPQPTPPTASVHPQPQPKCHDNTTSTDMAVRAPQHTAVNTSRRKTPTARAQYNTLRRQTRQHRSGGTPPPTRKMTETEHQRNMYAQTRSSNRAQQLADAEPTVRSHNNRDDQVSKSSDINTTTTLSTPTHTPSSNTTYPLTITSTTEPPLIYTYSPTSLLTLHQHTHISMRVNTNLEPAINHHHTRHTHASHHDKTARSHTDLSIPESTRRYHTRYILTPNQPPATPLADPVNASEIEEPDERHHYGTLMHRLPNKHTPTPSAPQTQAPNHPSPD

SEQ ID NO: 963678 - protein, 158 aa, Homo sapiens
APSCPGCELARGHLPWTCALACELRPAAKVEHLPAPALECWLPVCCLPGPCALLLDLQLRLVNVMYMPDPACPGNAPVAPAHALGLLVHVPSRCLLAHLVLHNPCALRCRRLCRAGMPGPERFCPGWPGRGCGHGLSGRPIDPDFEREPLFATPLQNP

SEQ ID NO: 963679 - protein, 225 aa, Homo sapiens
MPARPTRPGPPDPVLLRPSSRGFLLRALLRRGRPAAHPGQPPFHGPLFCVYNLGSVDSPSMRVLQTACLPLRACAAPLSKALAVDLPSERAICPPVPSCSQTLPYLPRLRCAVPSGPMPPGKPGPLRSCLLAPPRAPTLSSGLHGQPLGLDGLREQRDLCPAPGLPLDGEERIVFLRGRYVEEGLPPARTCKGVSGDANFEDVTLEEVVMAEEENEGTDRPGSPA

SEQ ID NO: 963680 - protein, 193 aa, Homo sapiens
FSHFNWTKKVALACTDFKKPKVPLKNIEKWGGGVQNLQWGTDRDQLNSNFRAPFLSQKNTFINNLHSSTTQPLQKYTRVGTLYVEITRCGGTVTIRVCRCTLNEGVGRISRVKKRWDNTHRAPRLHPHEDTHPQQQARKKETRTRGQTEAEQSRKQRTTTKQQEAENHRTRNKKTRKTTRREGTTTQRQPKKQ

SEQ ID NO: 963681 - protein, 169 aa, Homo sapiens
VVASRVFCGCRVSLSCALLSSRCCRYATCCCSPCVCIVVLPFPGALFLCQLAFCPCGTTVLAGVCLLGSCVLIPLCRCESALGGGSLSCALGSFLVFGCPFLGGACCSVGARCVALDREFSLDIPPLAHVYRSCSMPLIAQAGILEVPIVPGISYGPRSRESQLTVLRP

SEQ ID NO: 963682 - protein, 78 aa, Homo sapiens
GVTRVLMDSPITSKAGGPPSLLPAPPQHPSPFEVTGPTLREWVWQVWARKRQQASLAHGRKPPLETRWGNQRQGAGPF

SEQ ID NO: 963683 - protein, 197 aa, Homo sapiens
MHYTAPRQVASPVDCSVSYLVRSVTHCGVVVLGTSMAMSPVDMCHIHSHAHLMPSPTRNLTVDSVSLRCQHHRPCDDCMRVCSSLVGVQPCVLTAKTPASMFQVWGDHQGIHGWLTCHSYTPLRCGVSHTGSQAPFLFMVHGARFGEAHRSVACAHHDSMELPAVPTRLPVHAPHSTPARWRVHMMGLGAGDRIWYG

SEQ ID NO: 963684 - protein, 75 aa, Homo sapiens
GPFLPFGEKGTSAYVSADDRRGGCLLFKDPKVSSTELFSLERVTELLSIFASSHSCKKAILVRPLESLEIPISLL

SEQ ID NO: 963685 - protein, 115 aa, Homo sapiens
CSMCWTGACVCAQCALCACRVLPVFFVCWLCCAVLCCAVQLCCEARMCPCMKCYVVCDDLETCVSSMRCRPLHECAQHSHETELSQPTTNLTLNAIHLRHIAEKRPSGFPKRAHC

SEQ ID NO: 963686 - protein, 553 aa, Homo sapiens
MSVRTMSEVDYSCDRPRRPMDVSGQMKYCSVPEFMVPASPLGGPNSLQASDPTMTTRKRRLYQTLSSTDPRENTTNTAALNTEDIPGTEQDKTPIDAHILDTRRTELATFAVSLQQPRQKQTPQARDNLEPKTLNAPPDHRPPQTTPRAAHQIGPRYSHSIAPTVEVRPGEHPTPKTVDKLPKLDPKHRTRSQISDTRQRKTRPREKEHTNIAQRHAPSTHILPQQHHQSPQRPPTNNPPTKKRPHTTTNTHTRDTNNNHHLTLHHRNRTQKKTSTETRDNTNRHPLRNVELKHPHSPHAREHSDHGTTNNPSTTPTTNKRTPRTNTRWTHDQQSPQRLPNPTADDVTQYTNTHKINTADTPNTQTSTNQTKHSLNSTINSKALFITSNQTPLNAKIIHAYTSYRIMHHHAAPSALNTRTPYHAETINQHTEGEPTIQLAEPHSTITSIPARAEFRDTPSNRHTWTTPTQATSSTTALAQIHSHRSDERHDSQMTERKRHCRHTSHTISIAENTTATKHTHIRPPKLHTCNAHDQEIEQERTRHQDATRQSHD

SEQ ID NO: 963687 - protein, 388 aa, Homo sapiens
MGRSGGPDVKHPLLRQDNPRTVQKQLTSGPLSSNMRELLIDLQGKPDFPSKCRANYCHPWVLGDLQLVRYYTHCWLPKESRGRTGKLPNDWVRFMRMPGFVPCAKGYQFTMKPKHACKPSKGTPKGGPHREAKLPTELARASSLTKAKKLVVLGGHRAVKQFPPERKKCLRPLSFPVGGISLITDRLSFHGQLRTSARESQFRGKRRVRANMACFLLGGAPPGISPFVQNTTQKYRLSMNYLLNEKECELAFHGAPDKKGNKGFGTVRKNESRKRYDTHSLAGGIVATDGSLQFCPGAWTKWTSGPPAAHEMEEHGTQYNNKQHRKSCAQQGDRTRTTDKKKRTGLKQHPAHIKRPVVQSTQGLQRSTDYTPNNCSNQQAKHDRAYRY

SEQ ID NO: 963688 - protein, 139 aa, Homo sapiens
MVLTAGSTPRWPAQTWPNIVQPSRIGTQGQSLPPNTTHHSPKIIPQQTHPPQPHQHTPPHHNKPTHKQQGAYTYHTTPQPPPTPNTRHKQGSTARRTRTQPSQATCAPTQTWSSTAAHQRRHIHRTAHRDLIQSRRPRR

SEQ ID NO: 963689 - protein, 265 aa, Homo sapiens
KARESINLLMVTLTRIYKETFRFVWTPKTNELKSHFPKPVSCVSPTCATPHSVLINWQMAICWGFTHIPGSSPFSGCDFPPLPHTSLHWSPVCALWWKCPRACFSPDKVFILPVHALDSSGCGHPSSGNHLLPGGIWGDKGLDRKAQVTGVPVGTLENQWPPHDKEGQTRGLPIIDMGYDHLDYAPSLTGWGLLAGYPQKLKRTPLGQDTGLFQSKVNSRKCREEQINDLGTFPEHNTTNTNTRKPHKHRNNTRAQQQNATQKTR

SEQ ID NO: 963690 - protein, 302 aa, Homo sapiens
MRERHETRKKIEELSPTTRTVEKQQHTTAALNYEKRREQRQQHTPHRPAESGEGQTTTTTPTRGQRETTNKESSGAPHHYYKNAAEKSDTYRVDEKQPQNTTGHIMMRMQHNNTSGRTTRKSNKKHIKTLHTPQIAATPKQQYERTTTRTDLTGPHHNQHNNDQEETQINGRQATRPTENEQERERDTTQTKQRRTGRHKNNEAAEHRNHRQQERRRERRTKKHKNQHNEHGSERAQDIKTNTIDVRGESRNTKHDADGNQRIVQETKATAQQDQTRKAKIQTTNTAGAAHHKQKAGERNKQ

SEQ ID NO: 963691 - protein, 82 aa, Homo sapiens
MSTLVQTERALAQTALHTTNPKNSDRPTVFGRTERRGANALDWWSRSWGYPHPWVQIGRCMMSSTCCSAETTTTHTDWYDTT

SEQ ID NO: 963692 - protein, 342 aa, Homo sapiens
GAQDSFPLQQKILSMLFDALDQAVDTSQRSLWGPLYEAYSKVCRITAGGGMMDQSECLSLSRALGKPGAFSGFKEKQGNPFDQQVLSLSIAQSNRNSTHALQQINSFYIGTHILQQKQHPQGASPNQERGITPPRERGTPTAYNRRITRNTSLMRTTQNAGTPTSLAGQPQQHTTHRTYGPPGRTRQRSTTPKGTTAEQADDTTNRGQSALRATTQARTSKREHPRTHQYERGGCNAPQYNWGNTNPKRPHTDTTHDKTRTPRKRRPHPAHQNHLHQHHADTTHTRQRQTPPTDTPPDNNTPHHDTPRPRQPHRTTRPTHTPEPTTRTQQHRAKHTTTTTHN

SEQ ID NO: 963693 - protein, 74 aa, Homo sapiens
DDLEPRRSPRFLPSSAEDLGLLFDALDQAVEIQEVTLGKLYEASRKVCRQQPVAAVDPSECLSLSGLLEANGAF

SEQ ID NO: 963694 - protein, 383 aa, Homo sapiens
MWVAICNASHTKRGLREDTQWAERKKDKCYTLSLFLTTRGVRQRLRGEPPIMTKHLPREQLHRGADTGKQAVTIRHPAGYKAYQTHGGRSLTTATLLSRRGRTPSTVHKGGATKLPLQKAGHSKKHVGPVRNRGAEPNTRLLTTNRGGKFAKHRYDTPQSWDSTTRQTHKYRGGQGPYVYDNNHRYYHNPTADYRRHTRRGIRRTTHRTIGGHTPTAPKLRQMMLVRSVLHNTDRTPHPWVGGILHNDLYKTLSWEKPDTLMARNKVRKQQRRGTTPHRRTRPTGRSVDQLKVTRNTWLQTMCCASITKHSVWETCPDVCEHTEPARATTRAQQAQLLTEHKSKAPATHINVGQEYRIVEETPINNVEDQQRNENTQEKQGTA

SEQ ID NO: 963695 - protein, 202 aa, Homo sapiens
MGPATTSVKRDSLTNNKRGGGDPTHKTHSDTKRKDESRPAINCSSTQEHKEGATWCHACSHPPPGWSGCTITRGGGPHNRPRSTNRRPYEHPPTQRTQRRITPPTEHTTRRAKILSVRQTEPAAPPRGDPKAGNNHNRSTRASKYPSNPANKQHHHTNNIDARRGGPHKNNTPKGHRGLTYNKRHPHQITTHKKTGRSTTNY

SEQ ID NO: 963696 - protein, 102 aa, Homo sapiens
LVVVGSPLVVVAVLFVVAQLFVCFCCFSSLCFVVFCWLCVSGVRSFVFVSSFSSSVVVVVSSLCVLLSVRLVVVFSFLVVVFGCVCLCFVFLSFVVCPLLVV

SEQ ID NO: 963697 - protein, 157 aa, Homo sapiens
LGVLGAVLAVVLQSDSLAVVFPPPVCADFLVLGRGLCLWPRVGGVAPPPRSGGRWLGFTPARQYSPVCAGCLGGLGLCRSPRWGVFAAAPCGAPPRWCSPAGCGPPRAFTLRGVSVGVGVLSPIVGRRPAPPFLWCAQGAGASLLWCFSRLRCCPAS

SEQ ID NO: 963698 - protein, 476 aa, Homo sapiens
SSGPCSTPSSMNPCCLGFISHSPHSVQVSGHRHSMVGARAPVAPEPHASHRQVPATSGPCIHGPSSMHHILLHRSSPDASIIPRPHGISIQAGINCRARQHLPNATCIHTYLQPSQCPRPMTPTRDRDPDIRPLIYLTTTLILPKWPLSSKRVTTNVNMADKHTNTNKQQHKTKKQKEEMRERTNNKPQREEANRQQRNKPNKTKQRQHTENKIREKSNRHRTEQAHSKQRTRTKHTKANDTTEINHKGETTRENTNRKTREQPTHSDTETTTQESPQHTQTRDKKQTNKRRTTQHTTQKPNRTTRTKRTHKPTHNDHENSREHSKQRTRDTKGKRRNTNTKKVTKNRTRKNRRKKDQRKKRHTDNEQNRAQKKREEKQRREDYDQKNRKQKTREEQEKRERKEKRTRQDERENKSGKEQEEERRQGTEHTEHKRKDNENEKTQEQESEGHERQGDEKKARRVEEADMRETRSTSR

SEQ ID NO: 963699 - protein, 153 aa, Homo sapiens
DTFSARQHNSSWSPGCDNPPFSGTPRPAVGFYTQLPHPWSIRAEKIVGDTCTRAPGLFLPPPMALCNILAAILGISPRHLVVYLSIPRRDFPRTWIDPEAIFLATGFPRPFSPTHFLFSPPPRAGSFFAPFPPPLFFQAIQKRHRVLGPQKKK

SEQ ID NO: 963700 - protein, 61 aa, Homo sapiens
MEKPPGFIGPGGRGPQSLSGGGGPRSFTHPTPGFGAPKMGLAAGGVCLAPRRSSGGPTIGS

SEQ ID NO: 963701 - protein, 148 aa, Homo sapiens
MREEKQPIGGEPPNEVGEPSRKVTTYVDGRNRSGWINRRIPPMVVEEHGGRLSPNAPGCTRHNTPKDIDVGAPTGVGAHKKPPHRGGKSPRGPYPVNKRQYTPGERKNPQLNQFVISPRQKFIPVGGGAPPEKKNGAGPTIKPTASRA

SEQ ID NO: 963702 - protein, 139 aa, Homo sapiens
MLVYYHYIIIIMLLSYSSHLLILTAGVLHSVVDEDDAAPTTYPSSTAEAAYYYTFILSSSLLLVENEHRLMINHQPRTINNHSPLVLLAGHHHTCFFFSNKDGCSSSPNAALLFFPAAENKRCVGIISSHNYFLPPTGC

SEQ ID NO: 963703 - protein, 371 aa, Homo sapiens
MLTEPERFLITPAWDRGLNGNTKGDKHDDLQRARFICPACWAWRLNGRPQALCLPFGCLLACCCFSLSRAFAKQTNKRQALATTLLRACPLPGSDCLSLCASTLRQPNGHGTVRPLPCNATAHWHGTQHTRLHARRTALRNKQNTTNAQPANGHATQAPGLPHTHPSQLRSSLKHGTSPPPAGPPIQTKSLSHATHAPKGPLQAAQWPQSPPLANLSHNSNRRATRNNHYPLHPLLDATSPPTTQTATHGPKIWNTCDRMPRSFHRCAQQPKALMAPKTAPIPRHWHGAKTPKPLHGNEGSTNIPGPLGNLKAWQHSETTFRRTPRPPLNPQSFSHTFTLLLNSELFYEPEAPYPPVPPNRRWRVFPKQWP

SEQ ID NO: 963704 - protein, 468 aa, Homo sapiens
MWLSKGGLGAKCVPRGCGECAPRGPVGGVSRVSLRSPRATLQRSAGLFLRRNRVARGDNEVPQCGPRRVCRAEVERRYHSTQREPPQERLCITVCAKGGHRECVGRYCARKLCVCIPRQRVNPLCGGTQRWDKNSGRERLVGPLRDSGQSGPPAEDNVGARWGPHPLPVGGETHLYTHTRKKTPEAAVAPHVWYKVPPGNMTPTPKKGGSFIETPPWEMSPTGRSRVARGTLMSAATPDARSGGNNSTTALINTTTPSSPSPPLSATQEEGGTPPRGDKQQHSPTEATPPARSTPRSNRGGSPAAATTQASKGHNSLLPTQEGHPENTTLYDRSSRVMTTHRERGSPQLFVYAISGVKSHTSSIITSLRAGMYAALRGKDIRGEADGGPSRHPRHNSGTGQPPGAPESHEQRATKPLWRVNTPTEQLPQPPRRPKGSPGEPTREEQEDSTQTNGYESIDRARLHNTPL

SEQ ID NO: 963705 - protein, 269 aa, Homo sapiens
MCVKRQYYTHPEAKKSPRVPLAWLPHKVRGAPECSSLSLRESAPPKGEVCHRGLSRDTLPQRTRADSSLWGVLFLKKTSRVREREKPCLSHRGGKMMRGGTPPRGGATCGSGAQEVSSYLKVSDTRVRFVSPCDKPRRFLRPASGGAQPPCFSAPTRGRRVDNIRGGAMGRAQHLWLTGRGISPSPSFPPSSEHAGGTSGGPPLTRWSLILGPPFLPKATTTLVDTPQTAATGPTTQATKTRGGALEPDTIEKTLSTRRRGGGPSKGVF

SEQ ID NO: 963706 - protein, 336 aa, Homo sapiens
GQFYFMGSEEGGFTQGIPFSLYTSPLPPNIVRLLFPTIRAIFQHFFYILNPLLLPFHTSPYIHTPYPRGPRRVHPERGRGPFEPVCAAAGVCAVEPPRGREGEAWSPRAPEPLSPGVLEAQGHTQRCNTEGCDAISERERSLCGGVPSLCGPVCVAQRFSHTLLSRAACAQASDKRAGGPRHREGANPRGEPTHDTQGDHHVSSQGVRASTRGRERSSRGQRAHICGRVNPRGFSVHSVAPICGPARTRRPCAGAQCVSRRARARVRPHHTRGGRSGFPPPHMWCAASVSTRGRTRGCGEGETSPYTRVWTTQAWAQKPRRKVPRGEHPFCSRPTR

SEQ ID NO: 963707 - protein, 322 aa, Homo sapiens
TGKQNPFRGEKGTIFKSVLEKREYKANLKNVKTSSPTSHSIPPNAVTGSRPATLLSPYFFFSPVCDRGRKFSRFSRQDILLLSCAPQRVSSQPQRYKRGLCRDTQNFCVARGDIRVRTRGALSEKELSYLSRALCERLFTNRAVVWRHPECESVRGTIITLPTQRHKRHTQASHTPYRDVVGGATRRCVGTREERRVMRGSIQISRERPQRRLMREKRASWHESLRVEENTTNRAPPKIIQPSVVRPGAQLWRPPSQNKPIDGGAGPHPSSRSGRRRACTKRGEEECRPYKGGILKGRDQPLLTNEFITFLLATTEHGNNGG

SEQ ID NO: 963708 - protein, 53 aa, Homo sapiens
MTATGCAELLWVVPGVLLCDDLTDVLAQADHPTWGPLTLGRLEHELDEGLAIR

SEQ ID NO: 963709 - protein, 40 aa, Homo sapiens
RIIIQELDDLEEVVDFQVALVSLGHHGGASGMAALGYKDD

SEQ ID NO: 963710 - protein, 187 aa, Homo sapiens
FFLAVPGFINKGGKKPEGSGGRDRAARSSGFFNLSQKEGARACGTPCVCVRGLSYKAAQPCVWSPLTVQGHSVTTLTVPRWETGGSLDTTTYPLGGYISRGSAASLSLLPLSPTEYSLSLHSRVVGSGNRATQRHLCGRETLSHPRGREFLSQRCAQDTERRAVRGLRRVVEREACDNLSRERAPAR

SEQ ID NO: 963711 - protein, 377 aa, Homo sapiens
IHCLQRLFFENHPLTYHTAAKGQSKFSLKTALHCAPKSKPVLEPLTPPLGCSIDLEMLEVLPLGEGTQLHLLEPSVIRRGRRQSEPVKDPYVMFPQERYAWHSSTLAAHGGHSTLQNLSHQYQALHPLQDLEHAGPHNTAPPLATSITWRNSWTLLHSAEASRDPGTAPPMTYPTLPGTLPERLDDRRHPSHTTAHAQPANISAHTTHRTHQRRAMTTSNSKPEGPTPHSHTTGPRDPTHKPRPPQTAPTNPTHLTTQTRTRHTNTSTTHPTTTTETSTHHYPHTPVTYQPANTKTRTQKTQSVHHNQNTYPTTTSPTHSHRAQPNQKHHPPHSEQKTRHRKQQTGNKTKDHNKHTQETRTPNDGQTHKRHNTNKTD

SEQ ID NO: 963712 - protein, 179 aa, Homo sapiens
KGNRLLIKGGYKIHQNQVPGCGEYPRETKKSCQGSLQTSLRGRAGAIRKAVTGTRRQLLFPQEGQEEQVRAVPGVTTSVLCKAGKGWGRAAEESAQQAWRLPAWTPGRSRGLGVKPSGPPGGGGGGLKLTMLTANNRSPVTERGAEEHRRQGSRITLQGKHTRKTTIRAQKTAARLTPL

SEQ ID NO: 963713 - protein, 181 aa, Homo sapiens
QAILARVTSRPPMGEEVKNLYRNNSVHRKCLSSAHVPITSWKRPQLKKSAADTSQNLVDMKLSAGQGPENIYYEQSHALLSFTCCGPLEEASNSKKPTRDSWFLKTGGHKWDTQVRKTLAFTHRIGHRPASGPGTWATGKHEARARCSDMVDIGHMKKKENGRGTFIQQDIGRSMVLTNRE

SEQ ID NO: 963714 - protein, 306 aa, Homo sapiens
MSEAHNTYRAWCITRLAPSIESQYNIPTYAHRTHPNPLDNIHTCQIQERQQTHQDPYGKPHPRYDQQYRHSDTPNSRHIERTAHHSHENAYKRTQRAHQPRTTEQSQRHTTTEHTIKTPTGTQSLLNPTRHEQYEGQHTTLTQDNPTPRPRHPHHVTPKRNNNKGTQDKPNDAPNYHTHTLTQSNTQYIRHPSRAQNNRTHKAHRAPKQTQRGNRQHHNHTDNENTTNIATTHKQAAQDDPTHEAHEHQGESTSKTQYRRDDKPTQRKNNQNDPNRQRKRDNRTQQGRKHTDTGQHERQQRDDNKS

SEQ ID NO: 963715 - protein, 236 aa, Homo sapiens
MSCRAFSARLVFASACAVCAESARFARRSVILFGRVLSVCCETASWAPSVRSYVVSRPSIGGDCERLFLQGGDCFPQCGGCRYLTAELRALSFAPLCMARVGGRVEVGVLYVLSGDMLGWLRQWGVVGPPNGGFGGARPAGVDCRAGAGRALIPPYRDILRPLNMGGVLPRLINGWARREFWWGACDCLYMGYRRGRRQKLLMAEGTLGVRIETWGFGAHTEDRRYVCRVSSTGVK

SEQ ID NO: 963716 - protein, 141 aa, Homo sapiens
MAQTIKETAQTRRGPTNKGGDKIARTRKHNPRANTGRPQKVHSPSGARQTWIWCDTGEATRTPPLCNYKRDPIRTAAGGQRDQQELSAGAKITSTGDNYHEAAPKVQIKTTTGVILMYKKRGHRGSQALKRHNSIGGGHTA

SEQ ID NO: 963717 - protein, 104 aa, Homo sapiens
MDGRLDGMGGWTVDGRGCAVPCIPKPGGSVLVEHDSLQQEYMCAYLCGQKYLHLGLWSYSRGNVTEAAKPRTEHPLDSESQDGGRAGLEGLLIMCPALFNKAEP

SEQ ID NO: 963718 - protein, 98 aa, Homo sapiens
MAGGKRSALHTPTTVGALLLSTDKPAAGILCVPICVDQNSYTLGFGAIPEEMLTTEQLNPRTEHPLDFEFQRWGHGLAVKALLSHLLGPWFHKALSQL

SEQ ID NO: 963719 - protein, 176 aa, Homo sapiens
TWCQMYMSSCPLKSLESARICANKYMVQTIVAKDGFHIRYSVSTPSTSSASTKYCCPVLGLTRSPNRHARCLWTSPRALWPGFTFGQVIMSIRTKLQHKEHVNGGPAAVAKFIVSWPPSKIHILNRMWGFTKFNADEFADMVAEKRLIPDDLWAQVHPQSWPSVQVAGPTLMRLPS

SEQ ID NO: 963720 - protein, 184 aa, Homo sapiens
MVCCPLVRFGVPRSTVFPIPTSIFRERGPSLGNAPPGAHLVVPTRLFTTCGPHSYITVPAPAHPQLARHPWRHSSSLKAPGATGAKFHKFASRHERVPPLLPMRVGAFTPCSTAERNLKNTGALKNAAHSHDGSWGLSSTPPFLALWNQVSGPCTFTEGLPMCCPPFNTPPIHFYFLSQRKQKK

SEQ ID NO: 963721 - protein, 113 aa, Homo sapiens
MPKNHGRSNAIAAGIFHRSWAPDSKQLTSASSRKYQCIDFLRPYTVPNKKGIHGLAGTVCEKGTLLRVLNLRYITPSGRFDGDWKETVLNNDTSMNGISGWLPRFWKTVSIEA

SEQ ID NO: 963722 - protein, 79 aa, Homo sapiens
IAQNTVSFTNSHEEREHAEKSDEAAEPTGGRIFLQDIQKPDCDDWDELALNAMECALQFGKIIAESRHYWNCTNLAYVT

SEQ ID NO: 963723 - protein, 171 aa, Homo sapiens
MQIYFTSHTEHIHILRDEETYFPRRYDTYMSWALTLYCPFRENPTLGAPIRACIMEQERRDRKRLFTENIDCHTTVSLLANPLLLETFFFFLPHFILRGLPTINHAPPCFHGSQRMPLKTKLMLRPPLVRKECARLYFLSPSTPQLSPLHLVSTNSRDCEFVKNTGRKSTH

SEQ ID NO: 963724 - protein, 148 aa, Homo sapiens
CPIPETVLGNVKGASRQIAGSVIQGQDHGLCRRPRHAAKLVDCASSGPPRDFPDRTSCQLSVPLSPHYDPVVLGGGPEPWMYPHLPPDGQFEARFFPFGPEEEFGRLQGHFGPINQCCPSHPDGQSYSSGGEDGYVRIPLLRPPVLRI

SEQ ID NO: 963725 - protein, 242 aa, Homo sapiens
LGFLSVLCLLAFSCLLSRVFCAVLRFLSSRGVCFCSFSCLVVFRSCLSCGAFVAVCCLFLISPSFSLLLCWWLVLSPVSRLVSGLCIGLLCVWGSYAYFDVGGLFCSVCSVDSETWLGWGALLFFHVSWERGLCGLVGCRVVVGLCVLRMRFTVDVGLCPCRAAAPVAVPSSPALFLCAVPILRVCCLPGVWLVLSSLGSPLARLGLDVCHDVLGLSLMGAVPHLPSTQACLWVLVSSVSCL

SEQ ID NO: 963726 - protein, 329 aa, Homo sapiens
RSCRVCVTRGSVCPLCLGVAVWLRVVCHVPVHYRFACCVCCRGPSCRFCRGACIAVGVGWAYGLSGVALLGDVFNVRVLSLILACRACSVWLLIGCRPTCHRGLSAVDVHLSRSCYASRVKVCGLSHGLVDRRSVRESLLCSPYPNSVSYKGIIKRGLWDCVSVRVVSEVELKRPLCASKGNECIVYVCLYLCVVYVSTSIPVISTIAVHSCVLYMRRSPGYLSAAKAVSNQSVDYVRSKAPCLPYVLQEPDMTTYYCTDEWYTTRRQLDNALHVRIQYIWTHCCTLGTCYNNMMCVGARKTLLLTSLFYEFDTAYPPIPATTNSYTFL

SEQ ID NO: 963727 - protein, 296 aa, Homo sapiens
CRPCCVSCAVLLVWSLVPVLLRPACWFIVPFRRCGPFFVVLGGLPCADLLCLYPLHHAVRILRSPLLFYVLLLFARTLVLVFAGSRFVLFATFLFASPASWSFCELMSLLSSVVSLSCFASPLSVRPSSSPTVSAAICMWLRYPMELLLPPIGAHVVCVPASLMCLASASSLPLGREGCGCASGLQCQLHFVLPCAIPHPLTLQLLLALSRCPLLLGLYASRTCRWWVAGYSRRNRGLLGRSLGGPALMIVPHLLLPHNPLFMSALFIYPHLEPLSQMTLERFTVTNGFLYKDDFV

SEQ ID NO: 963728 - protein, 152 aa, Homo sapiens
VDRLLRLRVGAPLRLCVASLDCVVRGAALCPLSLCRCAARAGVLSVSLSSRGGVLLCASVRWLCGGAASCGLDVVLCVGACRRRGVVVVSLSSCVPRGGCGCGACRAAGRAVWCVVSCRACVAWGSTRSSGLVACSGGELCVFVYLSCAFVG

SEQ ID NO: 963729 - protein, 197 aa, Homo sapiens
VTGALLVILSFALVSPRVGNELVVPIGLLQCVMYTVSGECPVKRRSGGRGCAITMAPHYAWHNVGCVECSGAPQVGKEGAMKVTLVAHSCAGLKQPLQLMGYVGVSLAWVLTKGFASNGRRMWSLVLGKGVLRDMSLCFRVDNVLPFAGYESRVTHGVCQYYVKRAATCECKMREHELGFGASKSVGMLRRLGKGRR

SEQ ID NO: 963730 - protein, 114 aa, Homo sapiens
MRKNFSQSKRNVARRQVDPITGPTEQVTLGMNSAIAIARVHINNRVYEPRVLDQDIPMVQPLLKVRLFNDYKSYVSLSSDRSNPGRFLSTFKFLPVRKDKRNKAYFSKAPSPRK

SEQ ID NO: 963731 - protein, 95 aa, Homo sapiens
ELRRGYSKATPSCTFRPASCAPRLSNNGSPRCSLSITDPEICCRSARTVIAYLAHVFSNAVSMQVAGSCRWIKNLNPAYAVIVSDYSAAEYPTIG

SEQ ID NO: 963732 - protein, 195 aa, Homo sapiens
MPGYLFFTAMQSIPPRMLSVLWHSDSYCVRRAGPARRPLFFFFFALPLRHTPITQWGLATPAFLLCFSNPPPLFSRGGTSRPLDGGLFSPTRGALVARRECHSSHQQLRVFGLAPPLLGRAPIPPPCRLFVSLSRALVCFFLPPPSPSCRPPFFVNAQKKNPFVTHNPTPPFSPPLFPPPPLFPFFSPFFLYFFL

SEQ ID NO: 963733 - protein, 84 aa, Homo sapiens
IEDFVRRWVCLECESINGGFAHGEWVESERRCVCMDPVARLVAAEIGLSYSLRGSSRGGFARVSSRDELYGDVCGSQSYFLIDA

SEQ ID NO: 963734 - protein, 261 aa, Homo sapiens
MCDPGLSLSGRSWRFRMALGPLIGFHSSVASGSSCMALAGRDSPWPDSALGAPHVTRGRNFRRPPGSPTVSQKSPFSFRGLSMMLFALQEVFSFAQNFLEAPVAPSSGRALSPHFGGHWPPTGDLPPVNLPMRGLHCSLDTLRCYLCTPGYSITLGSRIMFIIWHPPVDPINSSPSYIQIYWVSILPSYQYLTSTSSLPSHISDGIYGSTHFCKPQRLPPNFTSLLAQLSSPILLHPPTKISPLPTQKHFGLKPPPDTGLF

SEQ ID NO: 963735 - protein, 137 aa, Homo sapiens
FKGWQSYRGLDAVRMRGQRDHSVGQLSDHVAFGRLNGAMKKAGYGIMGCDGSLPGVPYPTCSRRIQVATQEGSPRSSFLSPTRLVDGFREDHESWTEMGNRKESGIYIKLSISCVSDLGVIGGDGVWRGLVWYFSWP

SEQ ID NO: 963736 - protein, 212 aa, Homo sapiens
MRRGSLFQTLAGFLFAYCILSASPSCDLGTSQVVIAQLNPLALRAPFGEVSGMICLWALACSFHLSYKMLRGKSTRSGYTYRGWSTEGGHPRIKEEHSAYSPDPVCTLPSHRPIHARLCRESAQFSPSSHPLTTHPKLVSEVDRAVTSPITALQEKRSQADQSLCNLEDIHMSLEQEHHCHDQTVLFIDRQKCIGPNAYMLPHHPAIGRLPV

SEQ ID NO: 963737 - protein, 170 aa, Homo sapiens
LPLKEDPPCPGGSFISKHLCQEPPDWGPHPIQERLEHVQSRVKSLWVEEFRKETKWEMPTAFEKNGNVGRNHLAETKNLKERPADREVRKVIALEIGEGESCRQMVADSDEDDYSFLHDHGPPGPQSLKWLEVLLDHTFAEEFPTQIRNPRMLELWEGELVKELSVEEPR

SEQ ID NO: 963738 - protein, 152 aa, Homo sapiens
SLVSTRQRYLTAVSRTLPPIVPTQLRMHVFCPVTSEVLHFNVTFPYFSMDYITLDLRPTPNIHCHYQYCHSRQLIFLTCVFPHIHFLGTIRNAPYDVLGRILRCIHHMKQSLSSVGSFISLTAVILIIFHDLRSLRFEAKSPNSRRTLHNLE

SEQ ID NO: 963739 - protein, 107 aa, Homo sapiens
AGRLSERVLKPSFFDPPAGQCHPLVRGLPGYPRSLVRPRGPDGHREVSGSFGDAQVPRDSPAFRGATQGFDQRDLASPYESFEEAPAPCYSVGYPGVVFLRLWAGPY

SEQ ID NO: 963740 - protein, 141 aa, Homo sapiens
LLTNNYLLNVLVCLFSYIFLSPDAPIVNLVVAFCSLWSTHALVFLSPRFVIGTPSGRYKILYVRCPQVALIERNLKKIRVLSHLHKWGAHTPVSIPMKCSLGLIRLFICLFAGTPFSMCVLILLYGVSVLPLSLCYVFFFV

SEQ ID NO: 963741 - protein, 130 aa, Homo sapiens
SNALSLSKDPRAVGQRTYIYTCDRASQPSETATPTKAEVLALASGWPTIAPAHTTSVTRCSWTTLSFSQRRCTARVTSNPPRPSRPQSCAPCTALHIQPSPVSMPGFGFSSQPHPVRWANVMIKPRKTVK

SEQ ID NO: 963742 - protein, 69 aa, Homo sapiens
CVIDDRHLSVPHSLEDAGPSGAPQAIRFLGPGTYKRSVTRGVLHMSHGAMSVMSHAWLLPQSWISPLDG

SEQ ID NO: 963743 - protein, 149 aa, Homo sapiens
MVNRTCPKEKPILCRPNHGLISCQSIIHVPPCQECAYMGPAAGQAAFLSVHTRHCRPRRSQEATAACGVPATDRTSCIPSRDLASWHEGIKEGAEARRVRSPSADHARLAPHRPSRAPQSVSPRLPWVNWSRREPTSGNMFSPWIQQQC

SEQ ID NO: 963744 - protein, 247 aa, Homo sapiens
MRAPQLRALRAKPKGQGTWVQPQWPRHFAMWGLNQGTPAKSDSSNVGVPRRHQQSGELPFKPGRLAPVNKGPNHSRSSRQGRPPYAYTPTLATRIKQEEDNIPFYRASRKLPNRWAVNKLGDARIPARDTGGPPGTSVSSAHFEGNPLCGDESMTGRPHGGPRYPQRTDCDPSGHPTRTPPMTPADHQGWRGPPPPGPTWGARSGRNDTRPGGHPGCDKSTRHASETAPPLAAVTPQPKRKGRQPAK

SEQ ID NO: 963745 - protein, 390 aa, Homo sapiens
LQVPDHVSVEVWSPRCPQKKCSWLYVDITPTPRGDLLGHWLESQTWAVPGRLQTPSAATWLSALLISTLSSTYQSLVGRAGGRGAPSCNTSDTLESISSEGPPEAGGHITDKYFKAEKTAEFMEQFRHLPNALTLEAGTNSSQRQACERLQHRDRGDPTYSEHALQTVRALNARPKDGLLNSLAYEHSQLIGHCDPNIERPGPLAHSPLKNHLGRKTKQRQPPHANTSWLDQQTIPKHYQAHTEQSKQELAQGKMRRHRERSATAMGPPQHTRGTKRRCQKNHEREHQTKRHHNNPRQNSHNGAQNKTTEAPPGKTTQEHNQNKRQSTEETLTGTDRAREQTPQRTLQKDTHTEGETIDRSTAKGQQTKKKQNQQYPHNAHNTEQAQGTS

SEQ ID NO: 963746 - protein, 128 aa, Homo sapiens
EKAPCSSVSLVTAGQGARKAGKHIQGHRHCCATTTAPPSVLLLPHLMGTTYSSTGKERGPPRETPQRETYSAQHTRQARSACVNARRQSHRIGARMVEIKDGQQCLDMNSYSQHVYSMPHRGVDTYKL

SEQ ID NO: 963747 - protein, 123 aa, Homo sapiens
RRWLPLRCAREVADPVSVSAPVLSVRSFDLVRPWAQMGGAHPSLWGLSFALVKAAPPSPVSEGESPPPLCPVPPCKWSDTLIPVPLSAWEGEPCTPAKFPGVEPCPQDPLGTPASCVSGVNPG

SEQ ID NO: 963748 - protein, 106 aa, Homo sapiens
MVSVVAPCVITPCGTTYLSRPQRGAPLCALGPTLAHRWTRYIPRPPLDTLSPESHPESRCPVVRVLIGTTRTCTPPVNSVVMFLLCLVFSLCVCECVCGLCCGASL

SEQ ID NO: 963749 - protein, 170 aa, Homo sapiens
GSRSLAPQRHGVRGKLLKLAHGSSEAAAAEPLAPLKLAVRCCPLCPGPDSWAYRPPGRPEPAACAFHDHDPTDRVLHAALPRPARELAAVPSSGSKTLSQEALQHQAHHSSLIHERWARTTSTQGSGSVEFQELHSLAASRDNVNRFSFPSGQLQLGDRKGFFAGLTRQW

SEQ ID NO: 963750 - protein, 71 aa, Homo sapiens
GLEHEIRSTLLQRLGCAGMLSVSHTRLLTTWLCITTRRVMSSTLAAADNNVLVHHVGCLRSQLFINGSVEL

SEQ ID NO: 963751 - protein, 159 aa, Homo sapiens
CLRADMSPCCAQCWSCACVLLFFLMSWGWPVQPVPDGLRCLAVGACPLWFVCPAHAGEPGAVEWRPAVVRSCELLALLCFACLPGWILWDPGARCCSAWRWPGCCAVGAWGLPWMSCHFVAGSNCLGLRDWLHLLGTCCHCGFALFAANGTPVLRKVAL

SEQ ID NO: 963752 - protein, 152 aa, Homo sapiens
MNAPLVVKDLDIFDRVGHSTSSRWHYTYEPSRKGKLSVPGEVSPPHRENSTLSLSRGTMTIPRSVHSTSWLGPWMMYPSFSLIPGLEKKEEEEEEEAYEKGLISKNQTHKNPGASQAPAHPTPMPPDHSSLMFPILVAFGVFIPTLFCLCRL

SEQ ID NO: 963753 - protein, 189 aa, Homo sapiens
MHNTGVQNKNKTKQQTTQQKTTKQNKKKRGGGAEEEETTPNEGGGTTQKSTHQSSTHNKKLSGKKTTRGAPTKVRRGRNKNKISKTRERRERGGARGSTKKQRERESGKGRKKQREQSKSRRKQSSEEQRRTHPPTIQSGGGGGAHKQTARRHTTLTHRQNSKVRKTPRLRRRTTHKIDNNNLPSRTDT

SEQ ID NO: 963754 - protein, 342 aa, Homo sapiens
QPGQQSKTLSQTIKRKQTKKKDTIKSGRMAIHIYGKHVAGHIWVDLRCVVYTNEIFIEMEVIPVYRSMETGGPLGRVDLARDSGWKVVHQGWLPRVDWSSIGGGMAGNWNPKKGLWWKAGHRAWAGLGDRKGPGTLAGRTEMAGAWMAYGGERVLRASKAIWTGAARIAAWVGLGTLDRWEDGPVLIGEPFVNPGVAEGSSGVPSWQQSFYHPRTIAEGCHCQRLGNTGLYEPGKRRTRDTREYPVGRHWSRPRGTSKERVPFNMTSGREGGDLKPNLIHNPSIPEGRAKDTRGQSPKGDPRTGGVNKTYTQECWAQEITHGGAVTPSGRKTGSKTQLCSPK

SEQ ID NO: 963755 - protein, 183 aa, Homo sapiens
TVVTFVCRYRARGVFSPIVCARLMRSRDAVMVFVPLLSAAPFLGNVPLVGHLPRWCYVSAVVMLHAVVGFIPSMSVPGPGSPLRARLRLWPACLDLVFPMSPFRLFWGLFPCVFVAVRLAPGHYLCPICPGTGDPSSSPGHDGGPQAQGTLELRWSWSSSLSPSFLSLEVRIWSHPSPCVFAI

SEQ ID NO: 963756 - protein, 344 aa, Homo sapiens
NAGRETKGEEGQCWCWVKLLHNAKESGPPDLSPPSSPEADCTLPPSARAPGPTDSGQYPQTQQMARNGGTPVTASRTLDSPLAPEPASSTHAARFRHRAVREGGAVDACQQPWSPRAAAHARPAAHDKAPPPQRHPREPLASCATNGPPTLASPGAAPDHPAHTPQTHTPRRPPTGHTDRKTPSTPASSCPHHARSSHSGRHAPPRHPRHRLPTPQRIARPTPALALTARVHCPRHRPQLPTGNTGQHTRTHAPPTPPNGTNPRPIITRRPGPHPRHTPLGPAPPARTARDPHWQPPPRGPQLTEPPPWHTHHANPLHTPGHSPPTQRIADHPHSHNHTRQHNR

SEQ ID NO: 963757 - protein, 116 aa, Homo sapiens
AGVEGSLPFPPSMRCLEQGGAPRISSLGARSACFEPSCLLRSFPSRKHVVRPGGAFSAGRLYFLCVLVACRLYLPASLCGRHPSLAVTLSGGLFPPPCGPPTLRSPCFLGMLPGYN

SEQ ID NO: 963758 - protein, 644 aa, Homo sapiens
EATLHTLHKQLEHSGAITDRTHNDKRHDHAPHAENKTATKKPSNNKHTPHTPPPQNHTQENARGTRATATEPKSTSPYQLPQRTPTQTTTNKNINPQAHQHQQRNSTHATQHDHIQQIPLTHSPSTHPSATTSHYHNITFQNHHTIYYFQYSPFTPRHHHPHIIILTSILHNNPILKPNTTPSNPAPIDTHTHAANPTTATAARQPSQPAANEDTPPHHAKTPNAAKAHITHPPPHNLTNIDHRRHVHDASTSTPYHATGQHSKPDLSPSRHSPRSDYQPTCSATAAQRQPQARSLDPTMEDNPTDQPIPQQQTDNEPHQSAVRNSNHTPLASRQRDIYSQQMTTHAHAEPSRAQRSQRIVRARDKPQHNRRDHRERITKRTARRVGELAAARARTTRQRTIATKNYDEHRPNDSRRDRDRHHSPTEYARRPQQTNRRTTNAGALPRRSKPRPSWQQHHTQLTPAPTTTASNRRENAQAPDHTDATLNSTEGESETKRQTHLMDGEEITDTETTGASRQETHHHSHTEDIKTYDEPVTSPTRRQNTRKTGCETATRRTAPTRHDRPQHPDRTHHTQKSRNRTRKTDRRRTDSSRETGEHEHEGQNEHTGRNTPQTTAGHERTDQTTGHTRINVNRHRRRRTGQN

SEQ ID NO: 963759 - protein, 73 aa, Homo sapiens
KTMDLNPVSFNLYDVTWVLLILDLRAFSGGAGDKGSYIKMSSSYSPTIHPFFRVASNTSVGQEGAKGLRGSAR

SEQ ID NO: 963760 - protein, 370 aa, Homo sapiens
PGRSSSCFAGVLALWAGVSVLRRGVAPGDILELLLRALWVEALVYVVCPQKFVGGDVCWAPSSGFVAPCSRRGRWTDLPGVLATRGSVPVLWTPLWKVGPRVDFTLGVSSVPEGLVIVAAQALCGVFISLCSTEGSVLGTALRGRAMCEPVVCGPSGSLGFVVWGLGPHCARALPWRTLMLRSPYVWGALGALAVSVAHSLLSHGAFTWCFVPGCAEWSQRVYARCSTLSVRFWHGLSVLLRLVGGPLCVSHMASPPLARGLQPLATEMPAHVVDTVACRRQLCSRSRVHAAADGPRDTWLLMCPRMFWSGVSARRWGCARVVSGRHPVLRSPRELTAALAHCLALTYSATYHDEKGLSAPRRGPLGKKY

SEQ ID NO: 963761 - protein, 219 aa, Homo sapiens
MTNLVFPRVDFVYSRGVPCSVAPPRLCGVVAARPPPLRRSLGWLVESLSVAPPVGLVLWFGAFGRFVGAPLCAVVLISVWSDLFLPHGGVFLVICLGKVSLFARVGVVSPYSPVSWGGGVSTFFCFSLLLLVCVSARPIMVRGSVGHPTLWVALLSLCGSVLSCSRPWVCPLPPARWPRSSRGFVCPHALFVCYPPHSPTSRSSPTSGGCCARPTSFLE

SEQ ID NO: 963762 - protein, 133 aa, Homo sapiens
MVVVDWYALMVLSPVGNTCGSVAGVLRTLAGSACQRGRVNLFGVSGDTGTPNVLPLIVELRRTWLRNTNVGGRRVQRHATLCIALVRSVPSVSGFTCVISWERNGTLPVMPFMGSLWGQVVCDTAFDAIWSLH

SEQ ID NO: 963763 - protein, 145 aa, Homo sapiens
NADKNRSKRHVRIASSQQFYSYVFVFYRPVLHECYRRSVYVPTLCFADCVWYYLCTIHIVCYQQYPYLLSILSFYIKLHVAPSSIHVQAYALSRGMITAIKLAIGKRMTGCSITDAHHEFEKYASHVGESVANVENRAVIVRRAF

SEQ ID NO: 963764 - protein, 137 aa, Homo sapiens
EESIAVIYGGCGCLPGFVWVFEVFRSFITVDWPCGFQSVDYCQLLCLNHRLLTSGPVRHGRIYCLMSVTSSVAQQNSWLTCTSLAGSFSGHQGPRLLLSRSWTSGACRQSEGGKEVTKLREGRRKVARQRSFRITFD

SEQ ID NO: 963765 - protein, 241 aa, Homo sapiens
SAFFARPKYSCDDSVTASFSGVSLVLGAIAAAVHPFVVRLCAPHNTAGGLFCVTSLRRCLQKDSVLRWFHPSFYRVCRVSSLCPPCPRFPNDSVVVPSFFGACILFCGLPPNGGALFAGFPLGGLPLSVRPSRGLWPRPNEISPKGGLPALFRPLGGKGGVFGQWGVRARACPQSRLGGRSLRVLIVPCAALKQIQVHPVAITWVYTATLARTRMHCSNPLMLSCLCGHGLLPFICSLLLS

SEQ ID NO: 963766 - protein, 96 aa, Homo sapiens
RSRPASNVRELSVLRALLSVDEQAGGSGEFMRRNGLEGRGVVEEVVTVREGDDLSSSAVWCRVYIVYVMRIMALRAVQASVVGAMEEERGGGQRRL

SEQ ID NO: 963767 - protein, 137 aa, Homo sapiens
TCVLGRSATWDCPPSIDPSGHDISACCYVKLTSVCELAEHHLCTRRSIGVHDSIYIGIPSRYECSVPGVYLCNVAVGDEGWRELHVEHCDVMSIFSLVGVREWHVAKRRDEDRFSQVHLLVWNCVSADGKTNLWDAL

SEQ ID NO: 963768 - protein, 293 aa, Homo sapiens
PVCLFRFPASVPGRPCALCCFLCCPCCALLQPFWPLSLRTCCDLCERLALLLLPGALRVLPDSFRACSMLRGPYCGLPLLGAAVGPSRACHKGARLITMRDQPRRVPAITAVAMMDSRLAMNGQGHPCAWTLFSRIIIPQQEQASYDIVDTILDMVFPRPSEKDRYLPDTLLLEECRLCYRKGDSRFWLTNVICPGAPDFLAHRATGAAMLYECTHYQSFLEYSGGGGRHMEEAILQGPPDSRNRDLSAPLGPHVGLYSPSLVQKVPDVLLLTFCGRRDCVLYAKHTSPEACA

SEQ ID NO: 963769 - protein, 34 aa, Homo sapiens
MHPHAGPGLAAPAPGLTGGTGGANVGLMTCFGAR

SEQ ID NO: 963770 - protein, 53 aa, Homo sapiens
DGGMVSAIGKTSSPAVVLLNWKRWCVSEAQTVYSSALRTVKSVDGSMTSAQCW

SEQ ID NO: 963771 - protein, 39 aa, Homo sapiens
DEEENEKQNKQNSTSDSSEGKTKSVRHAYVHEPYLYYEI

SEQ ID NO: 963772 - protein, 35 aa, Homo sapiens
DALRQVTSFPFDFPDFRSEYSEPPRRLRAARRTVA

SEQ ID NO: 963773 - protein, 90 aa, Homo sapiens
LPQKWAAVVVPSGEEQRYTCLCAARGACKMPLTLRWGHSSQPTIPIGGLIVAGRGVSVACPKLVLSELVVGLVVDSSREEGALGRTKGVE

SEQ ID NO: 963774 - protein, 61 aa, Homo sapiens
APPVYCKNGCFYLRIHPCTACVDGLREKQLTLTSSYNYKHKRAELCLSKECVATRSPGYKR

SEQ ID NO: 963775 - protein, 69 aa, Homo sapiens
KSRSQECAHYGRGNRNLIVTGLVTVALRGNIDVIRSPLNLLIRTLPFQLSGARILLHDFRNIIKRIQTR

SEQ ID NO: 963776 - protein, 71 aa, Homo sapiens
LTAGLYLKPGLFKIISTCRWLMLQAPIAFTSPSFTSSSMAAHVSRKLAPHGNHIARLIQWEKFLPRLKATS

SEQ ID NO: 963777 - protein, 32 aa, Homo sapiens
GFHWNKHGAVRAPPLARDTQRVGVSVFVPVKS

SEQ ID NO: 963778 - protein, 50 aa, Homo sapiens
AQAEVTVPPAGCLPPVAYCVIRGKNYDASETRERPKSLQRLTLEQLEPYS

SEQ ID NO: 963779 - protein, 85 aa, Homo sapiens
SDRKFQTHNLAAFGPLSMMNLQHTIAVPSAQQCPPMELCNCMSYCLWHMAHMTYYVATYFMHKCSTLALLERPTPLLELTCSHVP

SEQ ID NO: 963780 - protein, 115 aa, Homo sapiens
ALCGWWRACCVLVVASSKMDAPHGFMATPLYSWHAVPLCLIFVVLPCPSLGMAGRSWTHFAACRVHLCWMVCVLAECTWWFANSKRMLHRIHGHTPVLVGHAVPLCLIILWYCPA

SEQ ID NO: 963781 - protein, 43 aa, Homo sapiens
PTISTSPALPPLPCAEHSRSGVREVFEMATRAGLQVRKNKRRM

SEQ ID NO: 963782 - protein, 128 aa, Homo sapiens
DGGSLEHVLKEDKRIPEEILGKCQHLRYLRGLAYLRVEAPDHAPEDVKPSNILVNSRGEIKLCDFVCELCQLIDSMANSFVGLLLLHGSGAVFACGTHYSVQSDIWSMVPCPWWSLCRREVYPIPPPF

SEQ ID NO: 963783 - protein, 102 aa, Homo sapiens
CTRRETILILLTLYEPSHESWPWQPWGKTILKTAWERLLLSFMLETATVRALFPQSMRSAITAREDTANLDRSCTYVPRMVCSRTRRELRLLRFKRSRTRSQ

SEQ ID NO: 963784 - protein, 70 aa, Homo sapiens
DRARYRVDLTTGTAYRPYGLRCRSLLYGSASVTTRNPIEPSALDAGVLPRLCIPRPVLKHFTIAPVDWRG

SEQ ID NO: 963785 - protein, 104 aa, Homo sapiens
MGCLLSCLSSNYGHQRSRPMNICTVPSHCMGPMGVATRNTEANIVTNFRVVMMMERVVTTLHDRHDDDPLTLGLDQPKEPDVIDDGRVPLSKVHEVPELPGERD

SEQ ID NO: 963786 - protein, 122 aa, Homo sapiens
QLKPDYKIWSRVTNQEAEEMERTVVMDKSTGEPVISVQNHKRVQRERGVLPLPSQGQRVSHDGSTARVIRIMKTALFCTLKISKLVGGAIMVEMADTDTDMNPGAFCRAVPIRVGFPYWLLI

SEQ ID NO: 963787 - protein, 59 aa, Homo sapiens
MVGSHVIHADKLGEKVEDSTMPIRRTVNSTRETPPKSKLAEGEEEKPEPDISSEESVST

SEQ ID NO: 963788 - protein, 40 aa, Homo sapiens
LEDPMINYNPLLKDGHQAPHPDKVLYTQDSTSLCLNPWAF

SEQ ID NO: 963789 - protein, 106 aa, Homo sapiens
VYLDNRYLLLVSEWMLKEPWSYADAGETGSNTEALKNEFTCNLAYAKRVKHAEEWERLCESNRVDAKTKLEAQAYTAYLSGMLRFEHQEWKAAIEAFNKCKTIYEK

SEQ ID NO: 963790 - protein, 37 aa, Homo sapiens
IAVHGSEGARGHGAIREQEYYYIPQYKNWRGHTIREH

SEQ ID NO: 963791 - protein, 115 aa, Homo sapiens
SIGGILLLLRPSGLEGCFMDRSTSSSCLARIYGTYNLSYRALQLSFQDHQLPGHLFIFAVLNPTAKCYGLLQLHLLTSSIFSSSLHGPGFTDDLHSSIALHQAAFSASSPASCRA

SEQ ID NO: 963792 - protein, 101 aa, Homo sapiens
GNNTHYRKNSNQVPRRFGIPPHCRLSDLKVGPTGGVPKLPHFLSVRIYFNNLLDPRLRPPEHNCLSFLFSPPGSWMENTSYWASLYSLHQMRDITCYLVGS

SEQ ID NO: 963793 - protein, 68 aa, Homo sapiens
ADLEDPSSNKIAAAPERALTYKYRPAQAQLASSPALICTLTLDSAAHGKNRIAPCMQLNSIKLSCWEL

SEQ ID NO: 963794 - protein, 75 aa, Homo sapiens
GPAPQMYYDQLSLSEMCISIFVILEKSDVSAVRIPVRHHVQCEGNNPIWNMSVIPRKRFFLPDSSLSKVKILLGS

SEQ ID NO: 963795 - protein, 60 aa, Homo sapiens
THHRMIAVQVCLTGEISICPLVILWAVGPGLYSRQGRNSLVFFRVASRVSMLCSDSMQTF

SEQ ID NO: 963796 - protein, 46 aa, Homo sapiens
QQSECRVRIRAEAAELVPELALLLGDVHSSLWGAAAHLVGSLGTEL

SEQ ID NO: 963797 - protein, 38 aa, Homo sapiens
VAETGVDVQAIELVMSHRTCVESKAVRALKNNSNDLVN

SEQ ID NO: 963798 - protein, 34 aa, Homo sapiens
LQLSKMSIKRKVKIRAKKDNVAGVTLPVFEHYHE

SEQ ID NO: 963799 - protein, 84 aa, Homo sapiens
AHAVGDGSLLRCQHSGKSVPAFRRSGWLPPSGDDSHGGAQCGFEEAITYDEFCGCECSHSGSFVGQHSHREVQFFSVIVVHCTT

SEQ ID NO: 963800 - protein, 146 aa, Homo sapiens
GGAVELEDTGSRVIQEELTKSEQELKYWYMLTIHTRVSNDLEDSETQVVKPVLKLCDAKDSQLGCTESEIQEADQLLSTRTEALEALQSEKSRIMQDQSEGNSLQNQALQTLQERLHKADATLKREQESYKQIQSEFAARLNKVEL

SEQ ID NO: 963801 - protein, 43 aa, Homo sapiens
LPGDYGITVPPPVWKEGGGEGEGEQSGAAGIRLWLICGQPGAQ

SEQ ID NO: 963802 - protein, 115 aa, Homo sapiens
PTQPKAGLDTSILPICKGSLGCMYNKLDMNYDLLLDPSEINAIYLVKYEPWIKPMFNSSDFSKDGTLSNNEWCYCFQKPGGLPCQNEMNRIQKLSKKSLLGAFIPRCNEEGYYKA

SEQ ID NO: 963803 - protein, 76 aa, Homo sapiens
MWLSCIADIPSNVEALQDKPRKCCREESQIYADEYDSRNGLRRKYELRCTLRIGDISDEDSSDGKYSSLLIGHSGH

SEQ ID NO: 963804 - protein, 55 aa, Homo sapiens
MQKVRIDEYDYSKPIPGAKKKPFEDHWRKHTLSYVDVGTGKVTLELQTLDRHSLL

SEQ ID NO: 963805 - protein, 44 aa, Homo sapiens
LSIIAHGLTYLHYYYCLANSNYERDSQSHHNTSTQGLQTYYYPH

SEQ ID NO: 963806 - protein, 39 aa, Homo sapiens
GGMREAGRQLPWQGFWSWPFLLLRPLPHGCQRNFFLEVA

SEQ ID NO: 963807 - protein, 106 aa, Homo sapiens
IRGYYFDEAKEISALSQFMVQPTPEAMLRRAKPMASDEQTPLVNCHTPHSNVILHSIDGPAAVLKPDEVHAPSVSSSVVEEDAENTVDTASKPGLQERLQKHGEDW

SEQ ID NO: 963808 - protein, 42 aa, Homo sapiens
GYIPLLITQIQSRRRKGRGRQAVAVRRFWSCALPAPEAPSYR

SEQ ID NO: 963809 - protein, 69 aa, Homo sapiens
LGLSCLCQQLPGRRSVCVGPSDVSELPDQLTGTCLQRSVQRDTWTVSTEPDVRPGGPIDTTNLTEERVS

SEQ ID NO: 963810 - protein, 89 aa, Homo sapiens
KRIYKNIRAVIMYTAVYPGNKDTVVAWELLTVSSYPASELSSSTSSAPCKRNVAVSTGLVCALRPIRTPPDGGGFLASVELLMVISYPR

SEQ ID NO: 963811 - protein, 132 aa, Homo sapiens
MDAARPILQTSHKPYQQRDAEGQSPLSQKIQTQIHREMPDLDSGDLMTGIQTHYFIYFNKRVSQQSHVLEAKPPKDDQTIIEEQATKIADLKRHVEFLVAENERLRKENKQLEAEQARLLKGPIEKELDVDA

SEQ ID NO: 963812 - protein, 68 aa, Homo sapiens
TEAYSYTITDEREIVRVHQGEAVLTSPWYFEHRDGHRRDPPLTLEKSYDAARVARLITTWQVRRFRLS

SEQ ID NO: 963813 - protein, 42 aa, Homo sapiens
MLVSAPPCLRRSCLGTPFAVRLPASDWQCLQSLRCNGERGGE

SEQ ID NO: 963814 - protein, 53 aa, Homo sapiens
YRGYINLLRTQIKSRGGTGESRKSSCRVAQVLVLALPAPEAPSYGAGYQRLEI

SEQ ID NO: 963815 - protein, 76 aa, Homo sapiens
DSPDSILRSRDEGGSCYHPRALNIPVSDLDECSAVLSQLPSRLYILLRQPTLDDEHLVFFCHMGNAGPSRPRSLAR

SEQ ID NO: 963816 - protein, 98 aa, Homo sapiens
SRGGGSLVTIPGSLNFPGVRVGTTCSADAASCLPGFIFCLQKPDLEDEHLVFFCQMGYAGASGPRSSPGVLDTLGLATTLEPYRVMVGVQRVRQEAAY

SEQ ID NO: 963817 - protein, 46 aa, Homo sapiens
LVELQEGPEPAGIHDHVKRACMYSTKYRISVHGEGRHGHEKKDFAG

SEQ ID NO: 963818 - protein, 81 aa, Homo sapiens
GSLTTFFIDCMAASVLAYDRKKVSKAAILDRIKRTGDGNYKSELSLGSLQVPFFKEPRQAAGFNSLVYSTTVITATSDAKR

SEQ ID NO: 963819 - protein, 129 aa, Homo sapiens
MVVRRRKSLCGKVLTQLHINLSGQKDSGISLENGVYAAAVLPGSPAAKEGSLAVGDRIVAINGIALDNKSLNECESLLRSCQDSLTLSLLKVSLRAPRGGGQNFENIKDSDKMLSFRAHGPEVQAHNKR

SEQ ID NO: 963820 - protein, 45 aa, Homo sapiens
MIRIELVPLPLDKVYSVDSSGDQQLCFVPREEHCMPWVSKSQRVM

SEQ ID NO: 963821 - protein, 61 aa, Homo sapiens
YNRARYLHIFELNLYTCGLALRWLRKNVLVEDKSVAVVSLCGLQNRHVNTLHRSEAAGHTD

SEQ ID NO: 963822 - protein, 44 aa, Homo sapiens
QPINDMSYFCLDSVMENSKVLGEAMNGISKLWQVSVLGILGDAS

SEQ ID NO: 963823 - protein, 88 aa, Homo sapiens
TSLDGTTQHLTIRDESLLQLYNPIGFTSNKNNSVSGMRTAYLEKLDGAYEVSSRISLILAAFDPRYFLLLDSDDSTASSSGMSKSLPL

SEQ ID NO: 963824 - protein, 40 aa, Homo sapiens
NYGTERLANYTGGIIRIPGHHILTIVVSVAGWGITDGRRC

SEQ ID NO: 963825 - protein, 154 aa, Homo sapiens
MLGAPAVCGAPLLCGYFPSTRGATQMPWHLGPPCCAGPWEKVLWVSRPKGPQCAHPRSWAFGKCEPCRNRFPLRRVPGSEGLSAKSRTVDQSGYEDGCLIQMTLSNPSELGGLMSEEAYENDRNLLRSENGTPELTSMELPQPARVVFKIEVVD

SEQ ID NO: 963826 - protein, 37 aa, Homo sapiens
MTPALGQHGAYVAWSQRAHLPLGELIISPKGNRLTDL

SEQ ID NO: 963827 - protein, 58 aa, Homo sapiens
LVVAKYAPVDSTLPPADVSGKLTDLGYHAEGAPVEVLVAWPFAVKIKYIAWTDGIRDA

SEQ ID NO: 963828 - protein, 128 aa, Homo sapiens
MLAVVAQHAGAQSTRPPVGVLHSCVDLPNQRGDFVVEDHAHPGAPTLALIALQELPDKHILHLIQNRQDGPTRSLAALSRLLVAHQQLHVERITVLPEGNPRGVCTSLGTAAMEAYYSGRRGPTDNPT

SEQ ID NO: 963829 - protein, 45 aa, Homo sapiens
RTCAGYKVHGRVLKTHNSHRISYLFEAYSLFSRHRITVEIVLLLS

SEQ ID NO: 963830 - protein, 343 aa, Homo sapiens
MSCSRALVLPPCSSPSCCSGVVLLWHAVFARRLPRGYLLFVGVCGCCAHRGVVVSMCVRAREGSCAWLWLVSSSSVHSCGLFCGCFVGRFRACAACLRSFALVYLSGHSCGVVLLCRAPGGLTPAGSPVCRFCSVGYWVYGHRVALNVVVLPLGSVVKCISELVPPVVPLVIKVSQGEHYAMSRRVYLAAYVCLVRVYGYDNILLKQNLGSVACLGYLALDCPRLLRHYAALGAGAFAQFRTPGTPVYTCTSTATLSVTCAYTGLGLRSERTTYIRDHVRSEGALLWMIDLAHTTWALLRAQGIRPVVSRWSYDGSPYEERATLSAPRWGIPAPCTAYLFGGS

SEQ ID NO: 963831 - protein, 67 aa, Homo sapiens
LQPGAIVPIAGCAAPHAAWRPERLPSEPLLAADLITSGFVSCRAVLSFASFLLFPPSLLSFPLTSKR

SEQ ID NO: 963832 - protein, 81 aa, Homo sapiens
LIFLVEQTSPALSFLNMGINTMIVLREAETPGDNPRLKTMESYTYATHQWELILLDEVIHQAMRYQAMEAQLPVARKNSWV

SEQ ID NO: 963833 - protein, 74 aa, Homo sapiens
DELKVRQNDRVLIDRLRYPTLKLENTEFDVYGYSFLVKMIVDSYNLQHQKIRMSLVEPQIPGISIPTDTSNHGP

SEQ ID NO: 963834 - protein, 154 aa, Homo sapiens
LQQHIDGAPHSAVQCSCMLQEVCNLPSPVCFFASLFSVLVRDPETVPQLYPEDSDLGLITTPAPKAGFSRGLVVDYTYRAQAKKFYLCLFSGPSTLIPEGLSENPDEVEPRESVFTHERFPLRMSRRGNGEEESGLGAGERRSGTGARARESQT

SEQ ID NO: 963835 - protein, 56 aa, Homo sapiens
MKCRNVCGKKKYALTKRSAALIEVNKSKERSGSRSDFPCRGQQVKCLSGPQRETIL

SEQ ID NO: 963836 - protein, 60 aa, Homo sapiens
IPHHPLNHLLELPLSSDFRVWASPMALNPEAALPDPPWVAMAMTLGQDQSSATQAEVLRG

SEQ ID NO: 963837 - protein, 126 aa, Homo sapiens
AFAGRAGRLVRAPGLCLDPPPCVSARADRIFERFLWGEGGFSPLPRGARFSRTLGRSEETPLGLQRPGAVFPSHLPDSRCVSPPPSPGFNSHASLAPGCNGYVATRAPPLESLLPKRPSSCGSAAF

SEQ ID NO: 963838 - protein, 51 aa, Homo sapiens
MVLHCIVSVLLDCLLYHSSRFLLSASVQHHLFSCVSLLSSFFISYNVPVTS

SEQ ID NO: 963839 - protein, 158 aa, Homo sapiens
MYISPSSIHQPSASLPPTDSLSQLLAQWFMPCTTLGIMEKTHDPHIQAITATPRRLWTGPWPANCSVDAHAGLSRTSSLPIPATAKAARQGHNPGAEREAHRHRPCRVPTANVSVVDSDLPSRNNLPNMMTSRKVVKQASEGPIKGILGYTEHQVVSL

SEQ ID NO: 963840 - protein, 167 aa, Homo sapiens
MVGAFVACGVFQALAPFTVPVARVCIAPVICGSPWGPLFPQGLPTVVVLPFWGPHHRAHRRVGSFASQCPRPPPSGPAPRVCRMARNPGTLARPGALAPPADLPSEPANEGPCEGAARSLCCALPPTGRCPCNAAQPTPGGPEALRVTPPLAFWELFPCVAAPPMPA

SEQ ID NO: 963841 - protein, 68 aa, Homo sapiens
RRGRSSVIAVDERSVETHETMKSACNSRQQIRKLIKDGLVIRKPVTVHSPGSNARKKHLGPPEGRHMG

SEQ ID NO: 963842 - protein, 71 aa, Homo sapiens
AQHTTIIEVLLADTFCVEAYLQNLFSLCQLDKYAPENLDEQIKNSVHMQILEKSSLYASVLTPACDQGNID

SEQ ID NO: 963843 - protein, 100 aa, Homo sapiens
DTIRLLIHTNYALDRYAINQLTLLAGHLLMHLIAITTNNDINTTNLKTNNNHKQNDKKLYLSILISLQITLIITFTDTELIIYNIYIETTLIPTLAIITR

SEQ ID NO: 963844 - protein, 66 aa, Homo sapiens
LTDLSAAQRRSAARYSKNFCLWCAELHDSMNPRVIAMATKGGTVKAASVIQVPCADAHDPVVKATE

SEQ ID NO: 963845 - protein, 67 aa, Homo sapiens
WLAGHGGLDDSVVRGRLPGGHGVRTRCWCPYCAWIQISGERGDPRQGKESQCDKPIALSQSIWAPEQ

SEQ ID NO: 963846 - protein, 72 aa, Homo sapiens
PLHRLALACSDALVLKERKKAANFRHETFTFPRATALAGIGVVYHVAYRSACTAGLPSVPVATWSFMKKHDT

SEQ ID NO: 963847 - protein, 45 aa, Homo sapiens
MSSNKEQRSAVYVILFALITILILYSSNGATEVFHYGSLRGRSRR

SEQ ID NO: 963848 - protein, 35 aa, Homo sapiens
HIISTAHTSTHITSTHTTSEPLSRKKLYLSILISL

SEQ ID NO: 963849 - protein, 76 aa, Homo sapiens
CKLACCCYDPSRDPPLHYRVVTPVWKPPFRIMNYITRRHCTHELVPYNWLENRFISRMSTPNHFHRYTVYGYRRSK

SEQ ID NO: 963850 - protein, 41 aa, Homo sapiens
CVMQWYSGTVQSSDSSLSELFMYSLQSYGAPRGTTEELTPQ

SEQ ID NO: 963851 - protein, 44 aa, Homo sapiens
MFVAIHDPHSLCRPDSCVAIDFLLMLLFEEELGLYSVLQFDSPP

SEQ ID NO: 963852 - protein, 67 aa, Homo sapiens
MAHEDAKQSLQERYYPHIIEELITNGTETYEYTDYGETNLQTPTYFPHYSYNQANCDSLNVDNRAST

SEQ ID NO: 963853 - protein, 46 aa, Homo sapiens
RTYQGGVSFSEVSSATRLKSYLSNTTQFQIRVFGARSSGELGGEIR

SEQ ID NO: 963854 - protein, 56 aa, Homo sapiens
KGLTYTLSSVTCFHKLASAYGCRQLQATGKLFAILLPQERLVPSCPLDRVVPYAGG

SEQ ID NO: 963855 - protein, 34 aa, Homo sapiens
GSEQRGLIPVYRYQPVDPRGCRHCPTVRLWLTRQ

SEQ ID NO: 963856 - protein, 65 aa, Homo sapiens
APLIVCQTFCLQTEQVFLWSGSHFRFGDELVSGVCSNTITSCEKKMDHSSNSKPRGSLRTTQVSR

SEQ ID NO: 963857 - protein, 44 aa, Homo sapiens
KGVPRGLRELQLRSLTEILKGGVLIQRNPQLCYQCQGILVESDP

SEQ ID NO: 963858 - protein, 192 aa, Homo sapiens
SPKLLQSGFYFCLPAKFLLLAQPLRMWAPARTHLWFSLVELFLVSAQGCFQWLFHLPPSQLLTRHALRSRDQVPRAVLLACSPTEWRLDWSPGRSVRLDWSPRNGVEAGLGSRNGVEAGLGSPSGGWSGLPPDVEAGLGRELHLPPAPVSREGASIGPRGKSPLALSCPAPLSGPLGSWVPVFFNRQPPLGN

SEQ ID NO: 963859 - protein, 42 aa, Homo sapiens
FTVPPRRLRELQLQSLTEILKGGVLIQTEPPDSATRTRFSVG

SEQ ID NO: 963860 - protein, 351 aa, Homo sapiens
MDAYMSPLLDLLLLRVSCSSSSPRPICSVTRLIPGASSRCYPLSARVVAMPLVSVSVVPTWVTVTKLFLPVTHLHRDLFCLRKFSPLSVPRFFLPSVWDFPIGEAFKLVMDPVRRVFPHTCVVPYFNGIAVSSAVPTSLDTWRIAKLSRHSYVGPLFPVPNVSHITGGKAKPQGLERHSGNVPHFLCDPPSMISSRLSDEYQSCKPPGRSSCLPCGGPRVTPTVDGKHKNLPFVLGLSSGRNYQGLLLPDDKALPYQPSWFPVFNGGPSMPWASPVALRSGDLAPFLLRILICPPILPSAVPGDEASLERVCLVLDHVYVFAFNTQPSSAVRFAHPGESGVSCSATGVWLR

SEQ ID NO: 963861 - protein, 34 aa, Homo sapiens
LRRVLNVGRDSDGTGAAGITTLALHDGWWVDVVR

SEQ ID NO: 963862 - protein, 198 aa, Homo sapiens
MDRDRCVEILPLRGASSGQGPDWVTGPFLCVLNYTKRVKCTWGKFLDYPSFLLVRGLVLASFLFVAPCGPVADTPGVKVPIGIHRPWDLTNVVGTDTHSLAKVMGPVRSLARSSLRPRLVCTIQSWPSTSQLNLEGARFTVEMELYNLSDVSGGRALTFTLLMDGSPGRSPCQAAVRHAVRCTSIEESYIRFAGAVSQ

SEQ ID NO: 963863 - protein, 96 aa, Homo sapiens
GVRGACVLWRRRGPLDHILELVVQAQHEGAPHAPQDVGPRTLEEGLAPLISENLPPTVTVPVYMMSAPLRPECIIMRRRTVSKWVGHHADHGQPPG

SEQ ID NO: 963864 - protein, 114 aa, Homo sapiens
RALRSSFSWCGRPRFPRLILCLRCLPSLGCPPFWSSKQSRVFSTLFSPLLSSQAQWGPEPPGLYFRAPSSSLSFSPARVCHGGPLMSLGRPDCFPPPLPKCQNFLEDPDALGIC

SEQ ID NO: 963865 - protein, 134 aa, Homo sapiens
EPIAGDVCVAVHLPGVLEEQRAQNAAIALGGWVSLSWLCHVYRRTHGSVEVSDYISNQSVTVHSLTGTECFLGTIRNLFLSKGNLAPLQLKRLVTSSCNLDVRIRCTKSRANRRQGTQVSIEGWKFRLTYFVED

SEQ ID NO: 963866 - protein, 38 aa, Homo sapiens
LKIRGKILDQGEDSPASEMTRIARLMAKNKMSDGKKEE

SEQ ID NO: 963867 - protein, 202 aa, Homo sapiens
GALTGLSGLQRQDLPEVEGETWRLFFCPVSPQRLETCSERTTVVSQDCRLLSANCSGRKGEVGVLLLPGRRWAISELGPVREGGECGGGLGTLTTGFLGPYSISLTELASPLLSGARARRPLGRPKNHAGLGVWLDGTNGSRCPAASHFKEGSSQLGGVRRRMASRHGAVLCLMAGRGSQRVGDYCCSLTCLARWSLEFSSL

SEQ ID NO: 963868 - protein, 103 aa, Homo sapiens
DPPPSSPVTVSSSSSSSSVLDLLVFHYLSIFIILLLILLLLLIIHGLHVALSIRITGLLVCPGHISLPDVSRERSLNTLPRKSFRLVTSQLKRSKLLRLTHFF

SEQ ID NO: 963869 - protein, 97 aa, Homo sapiens
FIILLLLTSHDLLIHLPPPHPSSSSSSTTYSIFIILLLILLLLLIIHGLHVALSIRVTGPPFLSRVLCSLPDVSCGRMLEHILCGVVHVGKLAIEKV

SEQ ID NO: 963870 - protein, 49 aa, Homo sapiens
MPNISYQNKEQCVLAVLYFNNFFPKWKAITLKHIFKNIGIGSCGVNRRR

SEQ ID NO: 963871 - protein, 54 aa, Homo sapiens
CCCVRCTGRLWKVVDTSLTPELVVLAGESVVAGDLGGYCGTVVDFSLTAWQMWY

SEQ ID NO: 963872 - protein, 81 aa, Homo sapiens
WYNRLIEHTDRRWSELICRLDITIYIHVAESIGYNDDFYEKYTIVQGNTEKGHYLAGSSLNIAVQRVSWAVLPDVTSLARH

SEQ ID NO: 963873 - protein, 72 aa, Homo sapiens
SSPQLQTFLGCISRTSLKSLIFSSSCPGVDHKRNIFFPRSSVKICVTFLTKDSILASGHPLQFTKADILNKS

SEQ ID NO: 963874 - protein, 101 aa, Homo sapiens
MIYVRVIQKDRGMPTIDLVSDLCPPRLKSGPLEVCTSRLPIEKSCYKWNLTVYLGSIPSRLIIIYLCPQRSCLHYPSPLIASEKEVYKLLYPIRRWVIVFG

SEQ ID NO: 963875 - protein, 102 aa, Homo sapiens
MVKEDQGCWDSIHVVEVQEKSSGRTGHYKLSSTVMLWLQTNKSGSGTMNLGGRLTRQMEKDETVSDCSPHIGNIGRLVEDMENKIRSTLNEIYFGKTQDIVH

SEQ ID NO: 963876 - protein, 258 aa, Homo sapiens
RCGYVVRALLMCGLSLLRRFCHGRALLWPLICSKAWWPGGFRGLFTPPSVFLVSPALIFPPSKFRRSPGVFCFAPPEGGYRIARVHFAALCVGRRLSALLPPPHRGCFSRNPSDPTRGWLTGSSPLFDSGYLFLFCGPLWGVSLVARPFVVPRTIMFCLSPLFARRWGGFLSPSGGGFLIPVVFVGSLLLSPAGGSPLLALWCLSLCLSPRGECFGSHKSTPRSFSRGPSMPVSPHWCPPLPLVCNTLPHTRGSFSSW

SEQ ID NO: 963877 - protein, 35 aa, Homo sapiens
MDIPPFGRTQILTSSVPIPFTAPHSFAPLSSPERY

SEQ ID NO: 963878 - protein, 55 aa, Homo sapiens
MNGQLTERRILNPLSKEDRTLNLMVSSRLRYPLRQDDGNSHFYTLLFRPSGMLGI

SEQ ID NO: 963879 - protein, 156 aa, Homo sapiens
IIHVFPKVLYKHGEFRGLAPSSASRVLARLESAHKYSAVMEEHGIHLLNGLVGSLSGLEVDKGITLRAVLITHHPAGQYVSKSRKSIIKCLVIYRFVQVLDEDVSHTRFSQRGIPLRPHDADWLSLNHIKVHGVQSPLSVGRLLEVDVGIAQAAGD

SEQ ID NO: 963880 - protein, 142 aa, Homo sapiens
LRCVRSSLVFPLSFSLRLCSPALSSSPLVVSGCSLLLYPLFYALVAMSLPCFGIYAPVSFSILCRWLFHSSFPRAVDRLSASGCRQPQFLLACFVLLRISTSCLCCAFFPGEQQLGKVSKASDTCASVIRSALQTRYARLPR

SEQ ID NO: 963881 - protein, 229 aa, Homo sapiens
MGYLFPFVVCVWFSSCFGFGFAGLCSLRDSCVRSCVVCLVFVYLVSPVRLFLLLRYWARCLCCVFVCCVVHFFSLSSLGSFGLLWLVRFLCGSLSFVWFFPLCVSILCPICRFLCFTLLILVLLWFSLLLGVIKYLSPVVILYYLPSGSPSVCMSVAVFICGSISFFGCVCGVVWLVLVVFVFNRSVVLYRPCFVLLALRVVSVYPALECALSLSIWCMFALVSLVVVS

SEQ ID NO: 963882 - protein, 88 aa, Homo sapiens
QAGWSVATGRKQHLRIASSSISQWAVATLLPLPQRHHTAKNKTRQQHTLHKAKPRPPLASWFKRVPGQKASRPLPVSSFTEEKLIQFP

SEQ ID NO: 963883 - protein, 39 aa, Homo sapiens
MRIRFPFNHIKVHGVQSPLSVGRLLEVDVRISPVERRVI

SEQ ID NO: 963884 - protein, 387 aa, Homo sapiens
MWLSLIAPWPLHFCFLVTGVSRLVLRFFGHFFPLCISPSFFVYPRPGALPLPSAWRFYFLFRASWFPRVCFLCSLLFMSVFCPCPPVVGLPASAAFSLCGLSLSDCVSPFSVPLQIRVVLSFSSFRGRCLHTNLHYGLASVPMENVVLNCITVNVSVVLVLPLSPGARLISDPSLCCKVQSKVSGHRPMGHVDRATTTYAILAPTWSPVQSPCIHLLVPVSVYLAFSGLMVAVHKCYMREYRLSTMDLPRGSWCSVHIPSGASSRVPSPSLPAFRSSSGAPLVCFLWALQSGNPSSGSMTVVTEASSLTVPPPNCAQAQGMAPPSRVCHSRVSPCLITGTPSELPQGSLEAPSPLSRDPSYPPFLRRWDLFLPNGGGWAGWRHRTCT

SEQ ID NO: 963885 - protein, 73 aa, Homo sapiens
ESAPSDQYYYPFFRHLFPGRSQYLCHSTGDQALLHLSFPPIPQAALQAAAHASVDFKNVLDFYKQCKEKVEID

SEQ ID NO: 963886 - protein, 119 aa, Homo sapiens
MIPSIPGPRTLRLADDEAEPTVIDSDARVDAVIFRGHAHNLQRGLSQVTVGDAVVTIVVQGVVFRALPGNGGFGAATDSTSRNNGLPCLTRDLTQWNDEFWGNVINVVGIEKLVAESFP

SEQ ID NO: 963887 - protein, 184 aa, Homo sapiens
MLAQVKEETMLTVKQEWPSWQEKAHVNIRIQQGQKLRAVRICNIYICLACKLSRRILWARESPLNKQNGSQKSSVSYSSSPESSSVIHGRVFEGNMKSSSCLCLWVNFFGNHCDHDIFITPADHHVQGAFPFNDVADIIGGDHGLSIDADYDVVFLETTSFCWGIRNYFNYIAPEITSGKSRCR

SEQ ID NO: 963888 - protein, 97 aa, Homo sapiens
MSCYLRAVLCHRRLDCARLLSLAGQCVWTAADHLASSDDSPAGDHDYALPVGKQKQDLLEEDDIVRAESVSMWTRSQVSVEFCSACARKASSSLKMK

SEQ ID NO: 963889 - protein, 307 aa, Homo sapiens
MLSFRTAALLVSLETGASSCLIILLAGSIIFRSGTCFTLCAFVGPPRATVGATRTPGCCPCARFFRGGFRDPTPLRRLLVLIPPPCPPPGNVCFPWGGMGAHTPGGGVVHQGFSFGEERWGPFPPGEWPSSGSFLTVRCSPKRSSGGLGSPRLLGGSNYWGLPAASRGDLLLRERHPTEDLWRWPKMGHTTFRRGVPIVRQPAPPSPSGGFPTGGLCPLGLLGPFSRGFSLGEIYPPAGVPPAPPPAPPAVLYLWGNFVYGYREPAGGLPPPSGGAPPESSPRRIFTRGYPTRAPLGLSPTNVSAGV

SEQ ID NO: 963890 - protein, 76 aa, Homo sapiens
TGLQEESRYLRAVLANETGLDSLAEPGERRGICVLSHLASSETRAAGWPRTSALSGWAKQEGSDLAGYDGRSRPVE

SEQ ID NO: 963891 - protein, 44 aa, Homo sapiens
GLRAESRYLRASYAIETGLARLLSRSERRGDCVLHHSRSSRMTS

SEQ ID NO: 963892 - protein, 70 aa, Homo sapiens
LAQVPRILLRIHAGLGEGAAPCPSASPYREELLCDSWPDGPAEGGCDEVSRSMFRASTFRDCHRGSGSRW

SEQ ID NO: 963893 - protein, 186 aa, Homo sapiens
MSLRIDSTCVCACRRRSSRLGRSSLAYYPADIVIFSDLLLVGCDSVVSKIFLGGPFGALSSGVSTDRRCLFCVGARLWVTCYARAFSVVTPPGWARCFTPRASPFWGTRPQSCVAQPQGVFPVGPRDRPVSALFRPSVLPRAHVLLGGAHTQAWGVGVSHPAGGSTMRAFLGYTPLPRGPTTMWGY

SEQ ID NO: 963894 - protein, 84 aa, Homo sapiens
VTRLYSIPLCIPEHLCHGGLLDSHYSRILRLVVVSVRHTQVASDLSHPPHAPEAIAFVYCCPSLSTRYTPLLRFVHEDLPFTLD

SEQ ID NO: 963895 - protein, 30 aa, Homo sapiens
MRPAERRWALRLTTSLFSTTRPDRLPTTYA

SEQ ID NO: 963896 - protein, 44 aa, Homo sapiens
RLLKDDDWREESVSMWTRIRCQVEFCIERCARKGSRYFYLKCRV

SEQ ID NO: 963897 - protein, 84 aa, Homo sapiens
TSIKGKLTGININKAVQRTLGTSFLLEQLVQFVAKLVNPCLMLQMFISFTRNTWLRWPVAVSLPAGHWEPTPIAGRFTSWNRSL

SEQ ID NO: 963898 - protein, 67 aa, Homo sapiens
HSNLQDPPDVANDDNIKNDSDRMKLQEVRSKNGCNYKGYVELIEEYAMSDLRSVCRRQMELCHNYAS

SEQ ID NO: 963899 - protein, 238 aa, Homo sapiens
PLEPCLMVQGNPSRYSAQRPLLRVGWLPPGPPPIAGPFTPGPFPYPIQAAFREPRLLVVTDPRADPQPFPGGILINLPTLALCNPDSPLRYVDLALPLPPPGELPSVGLNLVDAGSGNSAHMRGPSFPWTPPGRSLPESVTFYHEDFLERGVVKKKEATVCCPEEGHVTPGGISRVNGLLPLLSSLLLSLRFHELVLKGVHTVPSVPIQPFPTEDLERSRLPRKNWSARSPCSRPLNG

SEQ ID NO: 963900 - protein, 102 aa, Homo sapiens
MTSQHHKGILGVPRETFLSKMAPRSKRRYLTDQRVAGWHFLFSAMQSALFTNQLSAWNHRTNTLGIPETKWKTEALTTLGECRVHFHGKAVAREVITSSNNK

SEQ ID NO: 963901 - protein, 72 aa, Homo sapiens
RLGRRSVTKQSSISRSSDTCRLLSSPQYDTNTFKTSIGHDCRRESYIQVELGSAMTASAATASLDRRDCIPP

SEQ ID NO: 963902 - protein, 41 aa, Homo sapiens
NWMLQQLPLWVEVLFLHGNPCRVSAVYNFIGASFDQFRVVF

SEQ ID NO: 963903 - protein, 39 aa, Homo sapiens
MSNSAVPLRTNSLNLQGGFYEGSSGQTLTVELQILSMDN

SEQ ID NO: 963904 - protein, 114 aa, Homo sapiens
FVLYPPPPPLGAGRYYRKGVCPIYVWVFSSFLVRARSTPPSGRDTHVGCTLVPTQERGGLVPQERYYSRSPRCYVWCCYMFLTQGGIDLSDNIFVFYIGAELLPPASSPLRGVL

SEQ ID NO: 963905 - protein, 338 aa, Homo sapiens
MVHWQDFRVGHNKSAGREPGGPFEPLSFWIMDCPSRNPRTSRFSMHILPGIARIPHAVIIHKKEEQGLSLMCSGGSNETSPALSWANVNAIFAPRSAHLVGNTAILVTTRVHYTGQRDSLSSGATTCWHLADKPKIQEVKEQRLRGSAGLTLLDWDQSSIVYRGIMPPGKIPLAVLSWEFFLLHWESPSPSRDPVSYERLHLLLMPPKHHPDVTYVKKVRTLRMHLFTALQLLCLGLCIMGQSESTCMPPGLPLHHVILSSAGSDMVVLTRIFTDREMRCLDANEAEPVFDELEGVDEYNEMPMPVYLPLEGQPRDRWMRGQAGGMGFPLPCPSLLII

SEQ ID NO: 963906 - protein, 145 aa, Homo sapiens
MTRIRRITARYTTNSHSHTKSLEHSKLLLATVKHSPSPVDDHRELMSSNQVACTMNEVPRMLNESSSGKATYQGKTAISHLQILSLSITPGLPLHYASRQVPRISYVAYRSSTLLSHRRTRNFCPFPKIRPRIKSAPETLTASRA

SEQ ID NO: 963907 - protein, 59 aa, Homo sapiens
IPASLMRGAPPVIAAGHIEHSRYLSLLDAVDNSKMALNSGSPPAIWTLLLKTIGYKPGK

SEQ ID NO: 963908 - protein, 50 aa, Homo sapiens
MLDHDIPMVQPLLQVLFDQGLKYLRDQSTDRSNPGRFLSTANSSLIPMTR

SEQ ID NO: 963909 - protein, 111 aa, Homo sapiens
RSGLASRCMVALMERVSQLAQWCSGVVRHLAAPVHSAVDTRVDWDKKDDVVFREAQRFGEADEVLLYFRSQLLGSPVEGDLEVLPVLRNFLEEHHSMLVVVGAHHSDEVTR

SEQ ID NO: 963910 - protein, 38 aa, Homo sapiens
PLRSVLTASTLMEPSTCGDQCPEQVSVASTGFEQEAGP

SEQ ID NO: 963911 - protein, 38 aa, Homo sapiens
YEYKRTELIIFDIFFESRLYPHLGYHQPMRQQPERLNA

SEQ ID NO: 963912 - protein, 65 aa, Homo sapiens
SRGSLVKDLCSLCTAPQQLQLSAEALARIILCPRWIWFRKYVVQFHLRLRLKCITCNRLERLLHV

SEQ ID NO: 963913 - protein, 70 aa, Homo sapiens
MEAASWVALVSPLHCMTNGGGNSQQHIHALQQCGGPTKELPLFGSSSDQLRHHQAGVILQQLEEVLTVHS

SEQ ID NO: 963914 - protein, 47 aa, Homo sapiens
GECWRMLVLWALHHIVRIVTGCITDVWEPSAMLHSGSPSPNLEVTTP

SEQ ID NO: 963915 - protein, 50 aa, Homo sapiens
MKLQQVSIPTMTVDKSHSEKSRNTHPQVMIRDLQQLTECSNSSKITLSFI

SEQ ID NO: 963916 - protein, 40 aa, Homo sapiens
SREQGLPLTVKWDQQEQKPACSGLHYSSWTAGGGTKLMTS

SEQ ID NO: 963917 - protein, 39 aa, Homo sapiens
MDGQACGIIVGNIIGSGILVSPKGSAGECWFCGPCSRSS

SEQ ID NO: 963918 - protein, 117 aa, Homo sapiens
EYPKSDKELLYVREAGINGSCCQFMVVACESGDLGFSPISTVSELCNVGKSLSSELQFPHLSHRYRQDLPGTLLTVLDAVVAKPTESLICVESQRKNDPVDTWGLSVIQDPSFNPKV

SEQ ID NO: 963919 - protein, 49 aa, Homo sapiens
FTANIISRTVLLTGMDGIQMDEELVEKTIINIHFQRAKNGGGEVDMVKC

SEQ ID NO: 963920 - protein, 43 aa, Homo sapiens
HNTPCHHPITKRPSSSAPSSLQQSYYLIVHSSNDHSTLLHVLD

SEQ ID NO: 963921 - protein, 36 aa, Homo sapiens
MSLYDRGDLESDLSWNGDALHVYILLRANSKRLVTK

SEQ ID NO: 963922 - protein, 86 aa, Homo sapiens
CISGRLFNTNARILATLDRCLLPTHCPEAMICVMTGPDLFLPSPSQHKFAGIMECTSPTIIFGVTILNLVRANTFVAELKGLDPAR

SEQ ID NO: 963923 - protein, 40 aa, Homo sapiens
EVTYRERLYRVYQEVKNRLDYHISVQNMMRRKEQEQMIKL

SEQ ID NO: 963924 - protein, 46 aa, Homo sapiens
HFGVLRLDLWQVKSGTVFDNFLIANDEAYAEEFGNETCGVTQAAEK

SEQ ID NO: 963925 - protein, 46 aa, Homo sapiens
YRAGSSTLWYQTKGSPESRCTSSMTLRPLCMVLRKPGDKVCLPENE

SEQ ID NO: 963926 - protein, 78 aa, Homo sapiens
AIPRLIWLIVTLTVRFPLLDKHRDEAVSVIGNPPGVACAGVNMKVLNKVKHEMDFDAEWLFENHDEKDSRVNASKTAD

SEQ ID NO: 963927 - protein, 40 aa, Homo sapiens
DSEDPNVSTTWAESSPPGRHLVHCLSCVAACLSPTKKESR

SEQ ID NO: 963928 - protein, 104 aa, Homo sapiens
TSALLGGEQESQLVVIAHDVDPIELVVFLPAQSVKGGSYTWQYTPSLGKLNVQITEGFDLYLELREIERAEQNTGAKEAVGRALWEILVPMAAISDFVSQGGAD

SEQ ID NO: 963929 - protein, 63 aa, Homo sapiens
IARGAPAGDGSAGAQRCPWMKREEAQEGECDIERHDLIMLFHFQCVMLFVHRCVPVDVVMIRV

SEQ ID NO: 963930 - protein, 47 aa, Homo sapiens
KNTMMRKHPRALEDNPALEKLLLISGTVAQLIVLSDQLTVGWNLRGG

SEQ ID NO: 963931 - protein, 35 aa, Homo sapiens
MASPYERAQRLYAYASKIKNALAHFLPQGTPTPLI

SEQ ID NO: 963932 - protein, 71 aa, Homo sapiens
ALTLLQATYSCTLLWKRHPSTISHSPSLYTYHLHNSNSTDYPRNRCRLNPRLRLTTLHSKTQPEQLNSSES

SEQ ID NO: 963933 - protein, 35 aa, Homo sapiens
IKWVHDLSRVTAGLCLVASKALPGRSPSIPFYLLF

SEQ ID NO: 963934 - protein, 76 aa, Homo sapiens
VPPQFPTPAPPMISTHCSSTIPITSCCMIVSSTTNVISLATSGMITAASPYYGLITWFLLKHKSNNEMSPTTPLVM

SEQ ID NO: 963935 - protein, 30 aa, Homo sapiens
MGIPAVSNPIFMALDLCLCAKILQLLNWKT

SEQ ID NO: 963936 - protein, 47 aa, Homo sapiens
QEHAGLETEDGDGATADPKGPGTGRLVRLWERVQLSGSERTEDASNG

SEQ ID NO: 963937 - protein, 43 aa, Homo sapiens
VGPRTNPAAVIGRIDEEGRLVLGYGRGFREQQEFSREQQEFSR

SEQ ID NO: 963938 - protein, 38 aa, Homo sapiens
DRESCCCGNQFLQVIEQDREGPFYGLPGGHCCCRNSRG

SEQ ID NO: 963939 - protein, 111 aa, Homo sapiens
MSSTEVHVEDSLIIVGKSNASNIKTEEDRTVMRDFLQEFKFGRCVSSSSNAQIHLPCVLRHTSLRFPRSRAHKLKSEHQSPLCCGKPTTICEGGKGMRDGECPQTSAKIRL

SEQ ID NO: 963940 - protein, 112 aa, Homo sapiens
MLPSQEWAASGGSIQHKIHSHNFCNGVFVWPTRIHSHSYSSVMPYGLEPSESPQSLSYQQVPSLLLKGSLHCDQSQNPQYHCHLTPSNMKIILIVHGGLCWRGTAVTDVQPH

SEQ ID NO: 963941 - protein, 34 aa, Homo sapiens
MHIHRHHIEHTLDETQMARMNVTHEQGLYSLYLA

SEQ ID NO: 963942 - protein, 105 aa, Homo sapiens
KKYAYLIKIVTRSSGMLSKKSFLHKIKANRYSIIESSYNFNNKVKANVLTKYIQRPTDNAALAMLNPMLTKVNISALRLLAPIHAYIMGTYLFYRMQITANNPHD

SEQ ID NO: 963943 - protein, 45 aa, Homo sapiens
ILLLLLHVSDHEPRMKQFFTDYMGGYFSGSVTLMSVSLNSRGSSR

SEQ ID NO: 963944 - protein, 66 aa, Homo sapiens
PREYLLLPREFLLHPREFLLAPARIPAAPARIPDCPRENTCCARENTSCQGCNNEGHDEVKGNRLV

SEQ ID NO: 963945 - protein, 72 aa, Homo sapiens
NSAIVFILETVILVIQHISGELYSYALTYMQATTHAPDWKRQPNNINHEPSLYTYHLHNSNSTDYPRNVLLW

SEQ ID NO: 963946 - protein, 74 aa, Homo sapiens
MGQAPLVVSRVLTTGASATCCIAALGQTMSRDLGHEVEQRVQQQQDQSGSESNPLDVVDFGAKTIAVTPSWCHT

SEQ ID NO: 963947 - protein, 37 aa, Homo sapiens
LEDPIFLIASKELELITLTVGFGILIFSLIVTYCISL

SEQ ID NO: 963948 - protein, 37 aa, Homo sapiens
QQTKAPSSGQLCSVSSSRSHLAHPFFPFLTLNRRCGV

SEQ ID NO: 963949 - protein, 184 aa, Homo sapiens
RERDAAAARAERNVRQHQFHRAVLGQPVQRGVAVGHCIGPRAERRELADHRVAHLGIVVDHQHARARAHRRRQAAHGVRPAGRRRAGRQPKLDARAAADLAVNPQIAAALPYEPVHAAEPEPAAFAGRLGGEERFDHLVEQHGRDAAPGIRHAQHDRRRAARCVRRRLASRGQRERPAFRHRGR

SEQ ID NO: 963950 - protein, 71 aa, Homo sapiens
MTIDDIQPTSLEQESMIGEGTQVSVGTGVTVDKEGRLVSPPPHIMLTGTQTHIRCPNARKMMPEDLEDHKG

SEQ ID NO: 963951 - protein, 58 aa, Homo sapiens
AYAVDGRAELLQFLQSEDKQTKHEPILKAEFLPYNGLIHRMTVCVKLEAEGKGVVVVI

SEQ ID NO: 963952 - protein, 46 aa, Homo sapiens
LIEDPIANTSLLSACLLPDPTFSDCLPAHAGEVARYPTYSASAIPR

SEQ ID NO: 963953 - protein, 32 aa, Homo sapiens
LFPSERTISGLAENAPLHTLVMEVKTTDGRRL

SEQ ID NO: 963954 - protein, 100 aa, Homo sapiens
MPPKAALTQQHPPVTNGDTVKGHGSGLVRTQSEESRPQSLQQPATSTTETPASPAHTTPQTQSTSGRRRRAANEDPDEKRRKFLERNRAAASRCRQKRKV

SEQ ID NO: 963955 - protein, 45 aa, Homo sapiens
MGLTDVLYSRFLLSAFLEPAQNRGKPDTPYRGPDSRQGWLLGARS

SEQ ID NO: 963956 - protein, 69 aa, Homo sapiens
MPWIQQRDSSGVRLEDRGRVGMGEASLYVGCHLELDRCIETEATGMGPIAPGEVDVLGPAVGAGVGRPC

SEQ ID NO: 963957 - protein, 48 aa, Homo sapiens
PLQRLVVPRKDSRSQVKDCNWRRVVVGFDAGLAEQLRVAGSSVCQVCK

SEQ ID NO: 963958 - protein, 51 aa, Homo sapiens
PNVNCSLQLQRQRSWLPGVIGEAWLAPVAAGRWWTCYGRGREAYWPMLDKV

SEQ ID NO: 963959 - protein, 32 aa, Homo sapiens
MLAFIPVLTNNINPRSHRMLPRKYFLYARQPH

SEQ ID NO: 963960 - protein, 59 aa, Homo sapiens
RKEQICFVSSKRLSSPWCRVPGDGHVEPVSHCLRVGPGKKRSVTEKFPKAGYRTSEIGI

SEQ ID NO: 963961 - protein, 59 aa, Homo sapiens
GTNALRNMALDSQKEVSYIGNYAMRDLVPRLPVMEQQQQHLQARPMSDDTVTAVCLHTA

SEQ ID NO: 963962 - protein, 51 aa, Homo sapiens
SDSFTSATPRNMREWLNVAITRTLHQCEESLFELTQTDLLFTSRQHQSSSP

SEQ ID NO: 963963 - protein, 98 aa, Homo sapiens
RVIPEDPRLSGMLRGEWYRELASTNPESSGQLCGNPATSGFPVQILRYLYLGCAKDSTNLDVLGKYGNKYILKVTPKLPNAFEHGGEFTYKQIPISDH

SEQ ID NO: 963964 - protein, 94 aa, Homo sapiens
IALEDPNCIRTDRKSRHEGSQKRRLEYTHDSTTEYIPSGTFSDTSCLNPKGQKDRDAPAFTVCIRTEKSRSSELLPFCSTGGIAVFIRELALET

SEQ ID NO: 963965 - protein, 55 aa, Homo sapiens
CVTSIGSPVSGIPPRKFTSMLTLDSEIAELFGAGTALVLSAAKEQIPSGGIFHYR

SEQ ID NO: 963966 - protein, 35 aa, Homo sapiens
RVYDNKLCSPKIILSRTMISFGAREEGGRSLTETP

SEQ ID NO: 963967 - protein, 37 aa, Homo sapiens
MAKPTGVVFLARHASQLFPWVFKCHTEVYLSRRISVH

SEQ ID NO: 963968 - protein, 34 aa, Homo sapiens
VNCSGAVCRTRADSVLVSSKRLSSPWCSVRGDVH

SEQ ID NO: 963969 - protein, 64 aa, Homo sapiens
MTSDRVVCAVALRCEHGLGVRHKELIGEIRHARPSPQASRREQQRQDCKLANCRGDTRRQLVCV

SEQ ID NO: 963970 - protein, 41 aa, Homo sapiens
MICSFLQTAPEQFPSEEFPISESKVYMDVNFPGSSSTIGRT

SEQ ID NO: 963971 - protein, 48 aa, Homo sapiens
YVNCSVGYRAVQHMHIYPIVIFIHYKSAKHIKEQRDPIYLRDKVTQRH

SEQ ID NO: 963972 - protein, 44 aa, Homo sapiens
GALVSVFLSLRLIISRVKLGHLLERLLGDTRTWGDEEGVRERGV

SEQ ID NO: 963973 - protein, 135 aa, Homo sapiens
LVTAPVMYCLLAGVLLLSAWGDGCFLGWCGMCNLFVLGKRPPSLLRLQQPSCPYLLRYDDLFSTAIIFCILLTFPHLHYLLLPPLEEEPFAWGHLDFDLPSGATTMMAAECEADKWLQMSPEEAKRRRWRPRVLK

SEQ ID NO: 963974 - protein, 50 aa, Homo sapiens
APELIPFVISSSKGANVEGVAGVSSPLGGISGGGYFLQHDHLPFQGAEHS

SEQ ID NO: 963975 - protein, 52 aa, Homo sapiens
LGDSRGSLTELHVCHAASITWGSQGLYPSPSVANFQAERVRGVNASCQKFAT

SEQ ID NO: 963976 - protein, 35 aa, Homo sapiens
LLRRLEIEAETITAEHAYMTLEQERGHAVCAGGGF

SEQ ID NO: 963977 - protein, 80 aa, Homo sapiens
FYSLPSQITGTSVHCPDRGGEADLIVRVPIPTKIPLTKPRRRLEEKSEENQEQDLSPRRARRKKKEYVECLEKKVETFTL

SEQ ID NO: 963978 - protein, 105 aa, Homo sapiens
RVLHLTYTHSPGRGGSEGAVGHVAPTSRYPTCWNLVNGTVVPLAEITGYAPLQTRTRTPLGSDRRVRGAILTIRKPDYYAKIPGFRRIRGESELYTSLYCHAQPT

SEQ ID NO: 963979 - protein, 95 aa, Homo sapiens
IPPCVLFEGDEVYSTIRSSEYNGKIPLFRRIRGESELYTSSYCTLQNPHVHLSATIDAPSTRPYPDDTGTRGVEFRQSIASIACFLLVVNNPVPT

SEQ ID NO: 963980 - protein, 122 aa, Homo sapiens
SVGPDYVITWSWCTMVVDELWVLHDSITGDTVVTLAAVDVGENLMGSSHCIPVFRMVEYTSSPSNRNREYSSGLKGAEPLISPSGTTVPFDQVPAAGVPGVGATGQWPLTPPLQESDVVLAV

SEQ ID NO: 963981 - protein, 86 aa, Homo sapiens
YGSNVSCLQNGSRQLFPKGIGEELCFGKKWMLDVISGPIFDYQYNGSHDTEELNNTVRGRQFHSCSRLTYYIYNHPADLDFTSVLP

SEQ ID NO: 963982 - protein, 32 aa, Homo sapiens
CSCEAFLIIIISATVMFLQFSERRLSLPQVGV

SEQ ID NO: 963983 - protein, 53 aa, Homo sapiens
GRSEDPELLLQFAYQPDLDMLERISVEERETKIMIAFQTTTNFNFLSCRNIAS

SEQ ID NO: 963984 - protein, 87 aa, Homo sapiens
DSLLRSMYTRNWVYMLIIVKAVDSHACLCCTTCRNSYSLLNLAEVRSQYCESQGDANPQSSSLGSSISENFLIMELSAGIFCTRIYE

SEQ ID NO: 963985 - protein, 54 aa, Homo sapiens
PSLVSSTYCSLPPCIPHTSTPHSPRVASRVFWILCATSKLSPSNLQSDPHPGYT

SEQ ID NO: 963986 - protein, 42 aa, Homo sapiens
TLFPGRGERGRHRFLTKLVLLRVFLHDLVRNTLVVSPTTPTE

SEQ ID NO: 963987 - protein, 64 aa, Homo sapiens
PYHQTTQRPADQGFILESCRSIGDLIDRDGNWKLGLVEFNILWNRIRNYLSIFRKFDLDQSGSM

SEQ ID NO: 963988 - protein, 71 aa, Homo sapiens
RELRSGEMCHAEAEHTLLLLLGPLYETRHEATQVWSCLTSHPCCSCLDSLMTSPSRISTVFPTMFLLWCAF

SEQ ID NO: 963989 - protein, 43 aa, Homo sapiens
NHLAPVSGEANYDKAPSAYDKQTLYRSLHISFNTATIALRIKQ

SEQ ID NO: 963990 - protein, 46 aa, Homo sapiens
IRECGERVRAQRERSENGHASCPGASLAVITCTTLHIDLAISIDVS

SEQ ID NO: 963991 - protein, 41 aa, Homo sapiens
MSWAWCSTSISMLFTFVHQNSRASLHSLDLLPIPHSGLHPG

SEQ ID NO: 963992 - protein, 63 aa, Homo sapiens
FDGSMVFEGVKGVMKNDDKVLQPFQVPRRLKTTAVLFTYALNQGRGLVPGNKQSPEEQKVMEG

SEQ ID NO: 963993 - protein, 157 aa, Homo sapiens
FDGSRLLLGDTKIQCLFELWMISYKLFVGAREGGCWVPKRWRHFLAVANVYLCFCPLTASSVRPSRVSFLTGRRPDTTRLYDFNSYWRVHAGNFSTIPQYFKENGYVTMSVGKVFHPGTAPCPESGFSWFVVSESSIPILGMGLSLQSPLLAGRVPR

SEQ ID NO: 963994 - protein, 49 aa, Homo sapiens
GSPRALRFDGSSDDVLVSPLEKAQPHIQPREDSPGLPLLTAQSVIRETV

SEQ ID NO: 963995 - protein, 80 aa, Homo sapiens
LDSNLSGAWAAGFDPNQKHPALEVRQGSPGSGRRKNDPIYAMKVVKTELVHDDEDIDWVQTEKHVFEQASSNPFLVGLHS

SEQ ID NO: 963996 - protein, 93 aa, Homo sapiens
KRLSYTKICMTHNNPYERSVFYYVALLWIPIVIVTDNFWFCVMYHRSDEQQVMSLNSPFQGPIGDNDKNPKLIESSTLLTALLIISATSSLPY

SEQ ID NO: 963997 - protein, 41 aa, Homo sapiens
EDPSVRYADSQNFVIQMTLMKSSFNVYKAMSAAVCFMIDAL

SEQ ID NO: 963998 - protein, 51 aa, Homo sapiens
MSSRWWWEVPGEYQEKHSHRLQVYKHNSIGEGAHLSCMAARGRSPVWQQRG

SEQ ID NO: 963999 - protein, 42 aa, Homo sapiens
SKYLPGQASSRGIELRWGQISLGSELIWNPDSDIGTYSRQIQ

SEQ ID NO: 964000 - protein, 35 aa, Homo sapiens
RILYNTLGLLWQAPPFLVMVPVTALMAAQGTRKPG

SEQ ID NO: 964001 - protein, 41 aa, Homo sapiens
TDFSTSGSSTSFPFTYVSAFTRLQSDHHFSIWLGDAPEQTV

SEQ ID NO: 964002 - protein, 39 aa, Homo sapiens
SVCTDSEEYGGIELRELMSAIADVHVDSQLPLPEFPQVA

SEQ ID NO: 964003 - protein, 78 aa, Homo sapiens
PPLSTLLFTLAHSLSVLPSSLSIVLSGNRSMFILIPRCIEILVIGIRLLPAVRQMALPHTAMQYSSVSKLFRLPPHPP

SEQ ID NO: 964004 - protein, 45 aa, Homo sapiens
LEDPSFQLVQLSSPAPLVFLITSFNPVSSVEASAVGAQIFTSWSR

SEQ ID NO: 964005 - protein, 35 aa, Homo sapiens
IHYRFFNVISRYGNSSKGTEGDGQITAILDQKNYV

SEQ ID NO: 964006 - protein, 50 aa, Homo sapiens
MKGDHYRSLAEVASGEKNNSVVKLTEAAYREAFEISKEQMQTTHPIRLPL

SEQ ID NO: 964007 - protein, 39 aa, Homo sapiens
TYTVCGIKEAPRTCHPMCGKTAAHAIPKLYSLDSDQKDQ

SEQ ID NO: 964008 - protein, 55 aa, Homo sapiens
MVFGCCARPDAYNYGGTLSDLGSSLIYEPTVSRTSLSYVFRAPDAPGYGGIAECM

SEQ ID NO: 964009 - protein, 100 aa, Homo sapiens
VGSSNPERLRDAATHVIRRARYRTIEHSDVPVNAWPPQASYPCGNFSDTSCLKPKRSEGSCGPAFTVCIRTENQDQASFCPSAPREVSVLPELALGHLRY

SEQ ID NO: 964010 - protein, 33 aa, Homo sapiens
ESKYLVLRIRGGMQIFVKTLQLDKTITLEVEPH

SEQ ID NO: 964011 - protein, 56 aa, Homo sapiens
PSSANTLSKATKYSASTHVKDVRSSVSPMSSGKKCGLHFLPLADYDALIKLKGRKW

SEQ ID NO: 964012 - protein, 34 aa, Homo sapiens
VKGPGDAARRACSFSTTWSADSAAIAVTGAEAIV

SEQ ID NO: 964013 - protein, 106 aa, Homo sapiens
RILGQMDFWFTQVKLERSPKCQWTEHRYLNPVPPFLIYPLPLILLPLQVEPTINKCKVRRTGLTLLSQASFSDYKLVRQKQVPCKEQSHELVIGKWRQKELMERGY

SEQ ID NO: 964014 - protein, 120 aa, Homo sapiens
DPRHKSGPNEFFICPTLCPSQLGPGTSYVGCTEVDFVRFIGKGTESIPIQGPENGLERKRWISVGFLAVLDGLGERLGAQPELQQDDSMAHVQGSRAAGRGWVCVPGELNEPQHQQPAFV

SEQ ID NO: 964015 - protein, 95 aa, Homo sapiens
MATTLAMYVSHSSCLSLTASCAKDSTFSWKCWITAFLSALGKYFDKRFSLFPFSHELEQFSLGALDSSLSLDYKEMGMSITHPQVSRDTCQRNQG

SEQ ID NO: 964016 - protein, 148 aa, Homo sapiens
RTYCSYKCLSVSHALLTVLTNAFLLRHTLIQPFMFRLHNRYQPMEPNPRVPLSRVFFASWRVVLECGIAPILRCLMATPAKLNLSNHIAVDEIRSDCLMQVMRLGLDLLALNMPRPRDHGLPGYNAWRRFCGLLKPETVGQLGTVLRN

SEQ ID NO: 964017 - protein, 125 aa, Homo sapiens
MPTYLCLQVDSVDPRIANVFTNAFLLTGTPSSKPSLSRLGNRYQPMEPNPRVPLSRVYFASWSFVLEGGIDPILRGSMATPAKLNRQNQIAVDEIRERLSERVMRIGLDLPALNMQRRGDHGLPG

SEQ ID NO: 964018 - protein, 60 aa, Homo sapiens
RYPRGRIRKLCPRYSSYRVTQLDPRIANVFTNAFRDGHDPHPTLHVPAKTIVHQSHGTQP

SEQ ID NO: 964019 - protein, 71 aa, Homo sapiens
MLGHAPIQIRYVGRAYGPSVSSLNLQVPQHRAQLAHSFRLRELTEAPPGIVSWEAVVPAALLVQMQAGPAH

SEQ ID NO: 964020 - protein, 77 aa, Homo sapiens
PAAGSCTLRITVEDSNEQVLHKARNLPSPQAEKGLPQLCLVIIDKYSKIRSTGHPGHHVHPAEVCATADLGEPACAA

SEQ ID NO: 964021 - protein, 70 aa, Homo sapiens
VTLDLSRVCNLHHSSRPRRILNPLSKARKGTHILTDTALGSYPIEPQQELPYGQLVSNLNFTCVYFSFAV

SEQ ID NO: 964022 - protein, 66 aa, Homo sapiens
SGTFPINPTSLVRLARVHRYHPQRLAPSVLPCAQATDQDAEEPNNLVDYSITHAEPANVFDIDAHT

SEQ ID NO: 964023 - protein, 67 aa, Homo sapiens
CPFRLWILTRDCGGVEQQQELILNIFFFRRSMARLWPLLGFSLLDITLEGRDLHLHVLQLMVSDMGA

SEQ ID NO: 964024 - protein, 66 aa, Homo sapiens
DIAKIGRLYKAIPFTTTALIIGSLALTGMPYLTGFYSKDLIIEAVNIYFTTILILIPTISLIENKI

SEQ ID NO: 964025 - protein, 49 aa, Homo sapiens
MWTLNREGGVEQQQKLILKHLLSSGARWPGSGLCWLSPSGFTLYEGSRS

SEQ ID NO: 964026 - protein, 52 aa, Homo sapiens
STIRESFIIHHLDSSPDMMLRSSTPDAVVLTKGDEYYFSRDGSEEEVYSYNR

SEQ ID NO: 964027 - protein, 51 aa, Homo sapiens
SGGVEQQQKLILNIFFIQALDGPALALLAFSFWISLYEGRDLHLHVLQLMV

SEQ ID NO: 964028 - protein, 41 aa, Homo sapiens
ARVVNTTLTDCCDDSPDQSTWAQRQISAAVHSYQESTNAAH

SEQ ID NO: 964029 - protein, 107 aa, Homo sapiens
CNSTCYTGISDSSLGLIRGHHNRVSPGCQSGYELSRSGTPEQSRKARMDSSECPLQLMSRRTFDATLVGRPPQPIVHGRPKPVRVGELHIAQVVHDSYVDETPGIVH

SEQ ID NO: 964030 - protein, 72 aa, Homo sapiens
PDVFTWSGSSTSPSSFWNSDMLWTHTATMEASTTLREETRNELGRQAIGCVCHPNPDLLAEFPESQHHVEVH

SEQ ID NO: 964031 - protein, 85 aa, Homo sapiens
MTPDLFNVVNGESHVSGTTTLTDCLRDSPDQSTWQQRQVSSCSGLPYATSESTTAAHYEENCPLVAWFSSRYEFEHLCHSLRAEG

SEQ ID NO: 964032 - protein, 62 aa, Homo sapiens
LYFNVVHGESHVSVNHHAYWTACDDSPDQSTWRWQRQESMCSVLPVATMESTKSAHYDRNCP

SEQ ID NO: 964033 - protein, 36 aa, Homo sapiens
YTGIWECEPVASSAGTTKSFTVDVRVGMVVSCSGQP

SEQ ID NO: 964034 - protein, 136 aa, Homo sapiens
MSLILRGTNIPLVKHRLSLRYHRRGAYTWQGQSIHGLDVGFSVDVYPRIPMATERNMKRWERPRARGLGVPIPAMCRVTFLGLNPPAPCLCICEALLGRSHLTPLYCTQQICSPPLWLLTSTIPAFYGILSYGLYH

SEQ ID NO: 964035 - protein, 33 aa, Homo sapiens
MPSPLLPPAACGGFLTKLNGSITSPGWPKEYPQ

SEQ ID NO: 964036 - protein, 36 aa, Homo sapiens
TWSWTLAPGITENSPGGEEVGGEERTQRAPVSYTAD

SEQ ID NO: 964037 - protein, 102 aa, Homo sapiens
CTWLANNCLANPKQDKRPVLYLENENKALMASWEEDGEGEWDGGSSRDLPRQHTQHEVQHKKGANDDEGEKYNQFQVFPEASLLYGGEEGKQVSTEWYSGMI

SEQ ID NO: 964038 - protein, 45 aa, Homo sapiens
SVTLGDWEGNICALIAKADCLVPSEIRKLKERIREEIDKFGIHLL

SEQ ID NO: 964039 - protein, 71 aa, Homo sapiens
RPGDSTISIGQHADGGQLRLKPLVSDKGVLGSSRPDDFTVMPTPCEDPLITPVPLLENPFREKKFFCALTL

SEQ ID NO: 964040 - protein, 31 aa, Homo sapiens
MPFLWKDPSPPDNPLSVQTRYRGAKDRGVGG

SEQ ID NO: 964041 - protein, 42 aa, Homo sapiens
MDTKGIKTAESESLDSKENNNTRIESMMSSVQKDNFYQHNVR

SEQ ID NO: 964042 - protein, 108 aa, Homo sapiens
YEDGSYPQKLSAEQACCVSMFYDGTVKIRTGVSKAKESGSHYHDSLKRIQASLINVQPQKQKASCQREAHSGSFQLRSCPRGNGLGHLLIGRWYHLSWEVQLDVALTE

SEQ ID NO: 964043 - protein, 47 aa, Homo sapiens
SVYEQLCVTIFYYGILKILTCFSYANESGSHYHNSLNRITGLLSIVF

SEQ ID NO: 964044 - protein, 65 aa, Homo sapiens
VIAVAISQISSRHRAALIRRPKSDGIAHFHQALEHVCLELCVPDDVLQLAGGRTPGIPGGRYRRS

SEQ ID NO: 964045 - protein, 38 aa, Homo sapiens
MSFKGEINLPKDYCSTDLDLDTEFEILLPRRRGLGTED

SEQ ID NO: 964046 - protein, 69 aa, Homo sapiens
MSKICVQRLNSTNHYLIVLVLRINKYKNNIKIYNQLIMTVLQMLGKLNLALICMQVCLELSEISGVAVG

SEQ ID NO: 964047 - protein, 137 aa, Homo sapiens
YEAMRLLKVKSGSGSQNEARDNVSYHQCSILSYVTTLTMPLTANPSVYNMGVSLTLPQTYCLDELTKYLTACKYLLDKMTSCRISNTIFTGHRSHVPPVECAKVHYYNTDSTPYMYHLEIRPLSCWTTFPTQSYKTV

SEQ ID NO: 964048 - protein, 38 aa, Homo sapiens
MAYLSSVSERAFPGLYSYLLQVEDHALGGSRRKLYYQP

SEQ ID NO: 964049 - protein, 59 aa, Homo sapiens
GASCCSHMDKNGQDMVDADGILELQSLKGPIPCLYYLLLQVEDHALEDPVEALPDPALP

SEQ ID NO: 964050 - protein, 107 aa, Homo sapiens
MCAAQAAVPVAGMLGVVLAPAISAHVVASCMNSRCGICLGVKLVLPACACWPGSVGSPPVQRLTRGRSPPQAVLAMGCFLAERFPSDSSRLQVDQLGTTLVEGAGSR

SEQ ID NO: 964051 - protein, 36 aa, Homo sapiens
HWSVMRQRRYWEISQEGYGHEELFVSIHGARTCYSP

SEQ ID NO: 964052 - protein, 121 aa, Homo sapiens
ATNTPPPPFLVISLARRPTTDSERGGGRRRRKNSRGLWRLGRRRQEESGEAERTAVESPSINFHARIIIGKLESWLPDSRFVSPNESERVGAQRRAAEGGGGGGSFRLYAASSNSSMLRRA

SEQ ID NO: 964053 - protein, 151 aa, Homo sapiens
NLQKITEKFEISWLDSQPGPADSRPRASPPYFWAPRAGRGNFQKPGLWGTAARGRDLRSHPSRSTAWAEGVPAGNDDGAARVHRARPFPSAGAGYTDRMSGRRYLVGGAQEVRDEVRSGKGAGESTAGALLDPCHTQKQELQRHPSRLERP

SEQ ID NO: 964054 - protein, 57 aa, Homo sapiens
ARYPVDCHHRRGEDASQKTCATEIDRRETSLFSFASSSRHAQGASLRGGEKDLREIV

SEQ ID NO: 964055 - protein, 85 aa, Homo sapiens
EGRQGRTMSGGSRFNRIGVPNPWATDRYQNRATQQEVSSRRAREASSVFTATPPLIPQQPELRLLSDQWRLEIVKELEPYGELRM

SEQ ID NO: 964056 - protein, 51 aa, Homo sapiens
MRLLVRALSRCHLRSVLLSVFPRVTPFLLFPECHRRLCSAQTRPHPQFTYR

SEQ ID NO: 964057 - protein, 112 aa, Homo sapiens
DWDLFLKSSGTSNLGCQQARNQSLVLSLYLRWLGRSISQHDGRHPVVIRQQLGSQASGPCGSMSCRFLCVKTLQNLMYTVAGICFTVVLSGHNVFKQLPAGNKVKHEVVKPF

SEQ ID NO: 964058 - protein, 145 aa, Homo sapiens
LPETCRELDFISSLLKSHPVRELKKSKGSRRSLSSRLQRLGHQPAHSAKKPYKCDDCGKSFTWNSELKRHKRVHTGERPYTCVECGNCFGRQSTLKLHQRIHTGEKPYQCGQCGKSFRQSSNLTSITGSTTVTESRASRSAHKED

SEQ ID NO: 964059 - protein, 51 aa, Homo sapiens
SSTAELDCLEEAYTTEHWLVRIYKVSQQEAAEAALVLKNGPHVSNISGRRV

SEQ ID NO: 964060 - protein, 125 aa, Homo sapiens
RGYRPKEAARRQDTEPMNTEALNDPADLMTFSKQDHDWGLLPQRRSPGLMPPYRLFNTWLVHPSKIPVMLAEVIKIIMRGGDLLNIAAHADHGLLTGLLDLQALSPQYISSVRGRGTFCSFDTPD

SEQ ID NO: 964061 - protein, 33 aa, Homo sapiens
METPGVGSGCLTTDSGPINLPTADCTQTSDKSV

SEQ ID NO: 964062 - protein, 75 aa, Homo sapiens
GGHCGQCRDSNPLPSSGKILSSRTESRCNSLDQVVIQLGSAHPGIQASNSFSIFSRYAQTISIYFSLPSADILLL

SEQ ID NO: 964063 - protein, 35 aa, Homo sapiens
SMLIGATPPSVPPRSRILGAEAWTGPRRLIGRLTF

SEQ ID NO: 964064 - protein, 52 aa, Homo sapiens
ADDDLNFSLPDIRLEEGAMEEKSMTNLNWLHESKNLLKSFGDSVLTGLPDSG

SEQ ID NO: 964065 - protein, 35 aa, Homo sapiens
RRAVATVLALGERHCCSNHASHGWRLWVLGTSQNP

SEQ ID NO: 964066 - protein, 38 aa, Homo sapiens
SLRQLYSAESTCSALSFSIRIFQEQGEKLKAYTCQTVE

SEQ ID NO: 964067 - protein, 119 aa, Homo sapiens
LIKLNARMKNSQLATGAQSHSRPFPTGPVNDNRESSGLAIQSVDQLDLIDTCPQLPTWQIYTATTPAEGTHCPAELHVTIHHQLANAELPTQGKHSQNEILSFLGGRLQLEVKCSQAQE

SEQ ID NO: 964068 - protein, 104 aa, Homo sapiens
MDRHLLVSSFSNNSQCCPITKAGLTGPTWEHLDDVGSVALMERVTAPKDERCSIPLLPVHDPYHRIMSIADDPSSERCEVFKHHTGHDAARGYLVATHDPPPRS

SEQ ID NO: 964069 - protein, 34 aa, Homo sapiens
MTKLVLPSRVPYRLGNVDTFQLRDGWQDICAHFG

SEQ ID NO: 964070 - protein, 53 aa, Homo sapiens
LKLHDALRYVHVTLHHQLSPTQNFPTSGRRCVPKRDFFLSFVVSVITGLRGTE

SEQ ID NO: 964071 - protein, 75 aa, Homo sapiens
RIPDSSRNVAKCTGGIGLETKVIVVIERGSGSYTFTGKEDTLEHVEVLHKAITLWLGTQAPHSVGNASLDSTFQG

SEQ ID NO: 964072 - protein, 167 aa, Homo sapiens
QVDSVDPRIAKVLTNAFLLRSRPHPTPYMFRLDNRYQPMEPHPRVPLSRVFFASWRVVLQCGIDSILRGLIGLLCQAESVQNHIAVDDIRYRLCERVMRLGLDLSALNMLHRGTTGSQDTMPGGASCGLPEPWNCGPAVHGLGNLNLARKLMEQYGTPNNIDLWIGG

SEQ ID NO: 964073 - protein, 63 aa, Homo sapiens
CYRILDKPPYTQLLQRRIEPRCNLHHSSRQRQILNPLSKARIEPATSWFPVGFVHHCPSGVRS

SEQ ID NO: 964074 - protein, 57 aa, Homo sapiens
ILRNPTPGHKVWWGHVQPAQDFSPHYAPNTHRRTTVALDILSMTSYILENPIAQSFD

SEQ ID NO: 964075 - protein, 103 aa, Homo sapiens
KSLKAFRISSYSIFLRHFLGSSQLKSQQSSLFPVPIPISISLHHLLKLSSFYGFNSPEALHLPPFSYFQHTHGSQLPSRIRKRSHSLPGIYLLYRTIRYSSRA

SEQ ID NO: 964076 - protein, 150 aa, Homo sapiens
SLQFGLLGSILTCEIEICLLGKPSSEAVPKPKRAPKQKKVVEAVNSDSDSEFGIPKKTTTPQGKGRGAKKRKASGSESEGDYNPGRKTSKTTSKKPKKTSFDQDSDVDIFPSDFPTEPPSLPRTGRARKEVKYFAESDEEEDDVDFAMFN

SEQ ID NO: 964077 - protein, 67 aa, Homo sapiens
MTILITEIVFKDICIGWHEPGHVPRKHGVKGRSRRDICRVKWNGCVSRFRFLCLFQVQQGRCKQSSI

SEQ ID NO: 964078 - protein, 134 aa, Homo sapiens
KKRRVVGLLASYIPEDEALMLRDGRWAGAICSHRPVLDTLAMLLPTVQFLQRFYGKKQPVKERKQSAKHQNELRRDETKAEAPLLAQTLLITQSATHRAPHYNSCCRRKYRPEALGPSVSLSPMPPSEVKLQSG

SEQ ID NO: 964079 - protein, 46 aa, Homo sapiens
EFRGGSTARGLPEIYVGAYRWSAWFFMIEAPHQEVLTSQMCSEYQV

SEQ ID NO: 964080 - protein, 61 aa, Homo sapiens
MTITHAALSHTYLSKSPATVAAQRSLGGDVRGVPRVVIHDTLALMKSEWLWLFSAFSRTRE

SEQ ID NO: 964081 - protein, 52 aa, Homo sapiens
SLLFVSKLKLRTHSQSHHNPLSRTSGVLMLLEPHGVRYSAPLVYDAHVWGLG

SEQ ID NO: 964082 - protein, 38 aa, Homo sapiens
NDCVMNEDELSHGKQILMVMVKLDYEEFVQMMTCKVRG

SEQ ID NO: 964083 - protein, 46 aa, Homo sapiens
KVLGPDDSTKDGQKGIFLGDDEWRETAWGASHHSMSQPIMVRIKIL

SEQ ID NO: 964084 - protein, 46 aa, Homo sapiens
AGPEHDTDTHRGAKPNPEQREATPTATEWLGLPRHHDGQGLLKRLL

SEQ ID NO: 964085 - protein, 117 aa, Homo sapiens
MEQPIQNEEKDRPLLGVEVHQPAGNRRRQARRLAPNFRWAIPNRQINDVMGGDGDDIEIFMEEMREIRRKLRELQLRNCLRILMGKLSNHHDHHDEFLPYALTPAIYHEINTVIPAG

SEQ ID NO: 964086 - protein, 53 aa, Homo sapiens
DELAPFHPVVHAVPVTSSGFCEHCAELQIPVKLEPRVAMLLAPCGLPARASSR

SEQ ID NO: 964087 - protein, 87 aa, Homo sapiens
DASTAAMNPEYDYLFDAAFDLATQAWAMSCLLLRFADDMYSRESYLSTIVDGSPMIRITRAGFVITVLPVEDSRDHRSAAKCNRVPQ

SEQ ID NO: 964088 - protein, 45 aa, Homo sapiens
LPRDYQMLHAYQLHTYFRSNPDAGPLKSVADKVSERLEKNPSPEI

SEQ ID NO: 964089 - protein, 44 aa, Homo sapiens
TSSATLLCSPPAFLLPCCDVQAFAVLPNSSLASLFLIGMKGLDR

SEQ ID NO: 964090 - protein, 81 aa, Homo sapiens
ELEHFISELHAHRGLIAGLVLFGAVITGAVVAAVMWRRKSSEKEGATLRLQAVTVPRALMCLSQLVKCETAALCGMKGLDM

SEQ ID NO: 964091 - protein, 51 aa, Homo sapiens
FISSAFMPIRKREASEELEEDGKGLDIHGRLECKAGGLHMTGGGGMKALDM

SEQ ID NO: 964092 - protein, 88 aa, Homo sapiens
NINASWDGWLQKQLAVRDSEPPCARGATITFTPSQHGSRNNSSTGFYCCEGKLTQWNRARLLRAVPLIKFGCILKIADLNKGMTGLDM

SEQ ID NO: 964093 - protein, 121 aa, Homo sapiens
SISSGSQSGQPAPWNSYPTSMQPVADTRTEVRADDYLHVALDLLERKLRSLWRRPFNVTDVQTPAHLNVESKSSGCALPGRGGDLPGSQDRNTRTITGMCNNIRRPTLRASNRAFVHWLPA

SEQ ID NO: 964094 - protein, 84 aa, Homo sapiens
STWYTFSWAGVSTSMTLNGLRHRDRSFLSSRSMNHVQVCQRPSPPSWLAATGLLECRIGMFHGGWREPAANAVCLSAFSCRSPG

SEQ ID NO: 964095 - protein, 70 aa, Homo sapiens
ECPDGREVILCVQRVSSPSARDTGTVDLSVHGLSYAAHGTTSDKVLVWARILTHHEGMINKATFPFPPSS

SEQ ID NO: 964096 - protein, 48 aa, Homo sapiens
QGPRETGLHSQCSLLWNLILSPAAASLGGPAGWLCLGSVACCMDCALL

SEQ ID NO: 964097 - protein, 111 aa, Homo sapiens
PYKGRCDVIRILKSNNPCDNHCLNAWMALEQVYGSVCELYMDAQIKFLNTYQNPGRKIVCLCHSVWSLCYKNGGREGCAIDKDNVNQCPPRACVIDGAKHMCAILNGMLLS

SEQ ID NO: 964098 - protein, 99 aa, Homo sapiens
RLATHRGSPEYKADSDKKSSCDLVSALKLTFLALRSALPVPNCRRVASASSSSSLCYLLTDLHQQLKEDVGLDLPQTPVSHSCQRNGPAVVGPGNDLII

SEQ ID NO: 964099 - protein, 51 aa, Homo sapiens
TAVQRCGKFSGRLPPTWRDFRSLEASMTLPAVAPTLAQPQTHQHFQTPGSH

SEQ ID NO: 964100 - protein, 38 aa, Homo sapiens
DPPYNTRKHAHGQRGAWRCSSDPPALSLCVTARTCVVA

SEQ ID NO: 964101 - protein, 72 aa, Homo sapiens
YRPDCREGSKSQVPDLDKRKYLVPSDLYLAMFYFYNPDRESTCRPVGRHYSSFVNNTIPSHHVLTTGALYVG

SEQ ID NO: 964102 - protein, 37 aa, Homo sapiens
GGTTYVVVLCTGCETRTGVEFASSSADIPCQGIILGL

SEQ ID NO: 964103 - protein, 119 aa, Homo sapiens
MPCLLLSGFITPKSTPSKSSARAFSPLLPCLQELRGPSWCQDFLVHASWPLLRSQDGVQVPDGPQCVPWGSVEQSGRASAWRKQCLQSSWEQARWQLIRDLPTLPVLELPSPRSAGPCT

SEQ ID NO: 964104 - protein, 59 aa, Homo sapiens
RGTQREARWLHTDRHMLHTSSVPHRMCPHPVKMLVCLSSQPTLCQCILPVYPSVYNYTY

SEQ ID NO: 964105 - protein, 59 aa, Homo sapiens
ETGLHSQCSCHIDLVQCLPHETGIPITLCQCSVALSARLVAVRCPAVCFPMVFSWLSLW

SEQ ID NO: 964106 - protein, 30 aa, Homo sapiens
MRALDLVYENMWMSNNMYLKTVDKCTEWLV

SEQ ID NO: 964107 - protein, 64 aa, Homo sapiens
MGLRLVAAGAMHPLRRATVLLAVPPALVPAMPSWPSPGDCCSSVTGGWFHEVATSPGSSVGRCG

SEQ ID NO: 964108 - protein, 52 aa, Homo sapiens
RTRPAVEVAPAGVSYNPSFEDHQTLLSAGPRGGVAAGRSEAENAGAAVWPLP

SEQ ID NO: 964109 - protein, 74 aa, Homo sapiens
RYKAPQESQEDLASSENGTECRSGFVRHNGSCRVSVLTIFPMLLVTSGWPGATVCGRTYGCLLQCATLQDYYLA

SEQ ID NO: 964110 - protein, 99 aa, Homo sapiens
MARPAPKEDCVCLMSDGGVSIAACSVYHMELAHWMADFTWGQLLSNCTGHLHLKNCAHTYLDCRCLNKYFTQMHVTPLNGCITLIALTCALACTVFHPL

SEQ ID NO: 964111 - protein, 73 aa, Homo sapiens
MGVHAILILGLMSGEWHTLWLVANSCNNDWSDNGYLQNTQRTGSLWNRIRSGGWNSTHRSVLGKDLVCRVALY

SEQ ID NO: 964112 - protein, 115 aa, Homo sapiens
LRGSLLQGTLSWCPWAEWTGACGTPAQWPADGCGHRRRQTSSPVSARSPQSRTRPRPFLSLAAPKAYRSPWPGIESEPQVIPRHKLQQLPGPIIHLHHKQQPPTLASIKRLRLAE

SEQ ID NO: 964113 - protein, 114 aa, Homo sapiens
MRLCVVVPAFLIQDVELVGLLLSIHCCPPGLPGMNSHWGLVIAGLSLPAMRTIAEAPSQGQVHSELWIVLGRRITYAGAGDYSSLQLPQGPRRSGSERVTSLGALLRGYLSVAF

SEQ ID NO: 964114 - protein, 120 aa, Homo sapiens
YKAPHGKSCVDTPPAWKTKLLVTGPNARMVSKSKDGTGSDDKKAKGADGKTKITITAGGALYAYKAPRGGAASWLKMLRWQGRPGPALGLAWGHPGDREDPRGYPFGEWSFKQFRKLPNF

SEQ ID NO: 964115 - protein, 141 aa, Homo sapiens
MRNGVDLLRRNRAQGRNGVHVDDYGDVQEMKSFMYCPGSMGCPPTAGWGMGIDRVAMSLTDSNNIKEDFLSPAMQPDHEKVECSQATDITGKQQRGRHCCLEIVIGKVYNSGVSGELREIKVCKGSLVCCVSIVTPDVRLG

SEQ ID NO: 964116 - protein, 39 aa, Homo sapiens
RVNVTVRPGLAMAAERVHRALLRSCPSPPSGVVGTCRGQ

SEQ ID NO: 964117 - protein, 67 aa, Homo sapiens
PANIGSGSFIEEQARTRLQVMMRPCSETENLMYCPVNMGMPPNSMAGCMGIMNRVASVSHGTPNNIK

SEQ ID NO: 964118 - protein, 45 aa, Homo sapiens
SPAEPSWSTDQQGLIISWPPAYGEQWGLGGNLADPTVALGEKGAQ

SEQ ID NO: 964119 - protein, 66 aa, Homo sapiens
ILMPSSLQTPQTQEQNGILDWLRKLRLHKYYPVFKQLSMEKFLSLTEEDLNKFESLTMGAKKKLKT

SEQ ID NO: 964120 - protein, 34 aa, Homo sapiens
MCLTVPCCVTCCGLTLTRTVQGWRARTDLCAYSF

SEQ ID NO: 964121 - protein, 35 aa, Homo sapiens
MQDPSHICNLHHSSWQRQILNPLREASDQTRNLMV

SEQ ID NO: 964122 - protein, 84 aa, Homo sapiens
KRNAAPNFPFIPPVDVLVILQTSSVKSVLRAELTLTLGKHFRDSENQLLYPQDICDDPRLIVGNISNHQLIQGRLGHKPMVSAF

SEQ ID NO: 964123 - protein, 82 aa, Homo sapiens
KTNCGRSMNQLFLREEKKETRQIDLWSRTCGLCSGFLDRLGLSSTKEHEEGGSCWMLVGTQDGFLRKDGHIPITNGGSAERS

SEQ ID NO: 964124 - protein, 50 aa, Homo sapiens
MIPKRYIGPNRGPSSKTAKNPLLGAAFCKGKPCSGIKPQPRCSLAQDRSA

SEQ ID NO: 964125 - protein, 68 aa, Homo sapiens
IAEKNERLLGSSRLFKELGMLVNTGQLPACSPREHAGALRADSPKQSHMKNSSNHNTISTPNKWINIL

SEQ ID NO: 964126 - protein, 74 aa, Homo sapiens
SEHAAREDVSAPRGTEELLTSAEWWAGSLGPTHQATVTIVAEEVVCTPTGRNDFVHLVDPWDWENGWQQSLLKA

SEQ ID NO: 964127 - protein, 63 aa, Homo sapiens
SDMRQANMRGLCLPPCLTALLPMPFATATSLWEEEEALSDFYLCSLLASGTAALACVFLGVTV

SEQ ID NO: 964128 - protein, 117 aa, Homo sapiens
ALPCVDKHSKLFEDAWGPQLSAHSSAEIISSVSDVKYMPHAVANMLTRGLPYSQGLGPEHGGKTHIDLAGPCTYLRSELCSLYENDCTLDKSDCAWNGSDSVIMTGAYYNYFRMSAC

SEQ ID NO: 964129 - protein, 37 aa, Homo sapiens
MRAAALCDNAFQCSLKSLSDPSNLLILLGNHLLRVLT

SEQ ID NO: 964130 - protein, 99 aa, Homo sapiens
KRYAGGLTDHAAAEWWLCEVAVGLAAMHKLHFLHSDLALLEIVFSPPDLNCEMWEIYWNSDSAVYNGGLYMKHDDNKSLPLCEWTCSMNYVSHAFNDST

SEQ ID NO: 964131 - protein, 55 aa, Homo sapiens
MSGAVAVNVDDTCFPWSVLLQSVVTSLVFSVYICRPRDAYYTGIKYIALYNIIYV

SEQ ID NO: 964132 - protein, 116 aa, Homo sapiens
QRRTGSALCDKHSKLFEEPEDPSKRSFFSVRIISSRVRREVQPQWLYYMLTRDYSYEIKVWYLNMEARAIETYQVHDYLRIKLCSLYDSDCIFQQVLMCLDAGADSVIMTGAYNSF

SEQ ID NO: 964133 - protein, 57 aa, Homo sapiens
MSVKQMDSLTWQIGLDHKHRWCCASWTPRTLCARFLFKYPVRCHLTTVLVDTLISHT

SEQ ID NO: 964134 - protein, 113 aa, Homo sapiens
MRRCGNRSRFSFPVGTYILVNQICSHMVIYYLKKKSGVPIVAQRLMNLTGIHEDAVQSLALLSGLRIRRCCKLWCRLQTQLGSRIAVVEDGDYSSDWTPSLGTSTCHKSSPAC

SEQ ID NO: 964135 - protein, 180 aa, Homo sapiens
MKEPQVSRLILRRKSVSSVLRRDSSATAVATLLTRDYLTVKVWDLNMEARPIQTYQVHDYLRSKRLFPVRERAAFSTKFELCLERERLASSCPGPYNNFFRMYDRNSKRDVTLEASWVQQLAPELLLMPRCVCVGGKRRRDDISVGSLDFSKTILHPVGHPAESLIVIVATWSLYIFQDE

SEQ ID NO: 964136 - protein, 67 aa, Homo sapiens
SEHSAYLELPGIHDILEPPQLDTDGDLDGGRCKILLLLTGLQLHQHLVELMGRASAPTVSAPRSVRL

SEQ ID NO: 964137 - protein, 68 aa, Homo sapiens
GDSRGPPDLTPRASLCSLHHSSRQRRILNPLSKARYRTHNLIVPSRICFHCGYDRNFSVISFLKIVLE

SEQ ID NO: 964138 - protein, 33 aa, Homo sapiens
MSHSLSMGYTPWTSNGWEKGLSAQITCGGVVMC

SEQ ID NO: 964139 - protein, 62 aa, Homo sapiens
VDAVSAPVLGTSPGSFEQVCFAAPLNFPGASHNEIMHVGRKVSQARWKQAARTCDKGVLCWS

SEQ ID NO: 964140 - protein, 91 aa, Homo sapiens
MTAVPANSGEEREEHELVESMVVLEEAGSISDRGPCVIHHKMPLSLGWQWLGWSRWLEKVRVVDRVPLAASRGVRDADLCNVMKLGHLKIP

SEQ ID NO: 964141 - protein, 61 aa, Homo sapiens
VGPYPEDTVHRDYHIHMNAAAATLTIHLQDGMVTNTMPHSLNKDHPEHPVTRKYQVVACHN

SEQ ID NO: 964142 - protein, 109 aa, Homo sapiens
MTTSTETINSHEAAAATLTIHLQEGLGTKHKPNYAQAKSSRNTTDPKVSLVGIAKYFLVNVPQQSTTLNLWREETTTMCKDSITFGGKCAGKKSASFLLWLNVVAMRAV

SEQ ID NO: 964143 - protein, 64 aa, Homo sapiens
AILEPGISSEHIWGESSRWGDSERAVSGNAVDGVGLMLQTLVLACMCLSTEPLDFVVREACMVC

SEQ ID NO: 964144 - protein, 50 aa, Homo sapiens
LIRAESAIYITAHGNAKIVNPLSKGGDRTHNLMVPSRFLDHCTTTGTPVG

SEQ ID NO: 964145 - protein, 41 aa, Homo sapiens
MGVPQAGGQIRAVATGLHNSHSIRDSEPYPRPTPQLRAIRD

SEQ ID NO: 964146 - protein, 71 aa, Homo sapiens
PNYSYTTATAMPDLSHVCDLHHSSRQRQILNPLREATDGTRNLMVPSQIVFLLRHNGNSPPSLFFNTAFNP

SEQ ID NO: 964147 - protein, 192 aa, Homo sapiens
GLPEAPALLQWRMLTVEADDSEHKYSSTPLDWVTLETNIAYWLHPRTSVSRALVRAELSRAPDSRDLRSSRRMVTEAQPCDVFPNKSLGLASSECFGGVGPQLPHSQGVRSQRLCRSRGTELHCRRGSTWFRFSGKCGLVLLFGAGCIVLFCFVSLGPHLQHMELPRLGDCIGAAAAGLHQSHSYTRSELQF

SEQ ID NO: 964148 - protein, 74 aa, Homo sapiens
NGLSLQDLYCRAVVSCTVPVHLVDKLPLPIALRSHLKSFSMCQRAMNASDDARVVPTPLTTMLHHTKWSSLLQM

SEQ ID NO: 964149 - protein, 104 aa, Homo sapiens
PEMLLSLNRSTLTHTVIPATSGHEGAATALVLHFQETLRTLALLLGQFAKNMTHALQSHIVAVEIEALREQRRREQWLAGAKAGLVDSAFQLHSWDNRKARRVR

SEQ ID NO: 964150 - protein, 42 aa, Homo sapiens
MVKQHNVEAELPVCHKEKEFYVSENALKEVMLINYYTLSRED

SEQ ID NO: 964151 - protein, 65 aa, Homo sapiens
LSLFPTVTAFIGFLSGMNSLVDYKVSVVNEGFTTFKAFVIFLPWGRCLMGDDHLPEALPPGGEAQ

SEQ ID NO: 964152 - protein, 56 aa, Homo sapiens
RVLTLVTWCTAPAPIALRSHLKSISMAKDLNARMMHGGSYSLTTSTTHKRSSLRKV

SEQ ID NO: 964153 - protein, 58 aa, Homo sapiens
GRLSSTALDYGSGDEDSKSEKRKNKDPLYAKMEERFYRYGIKPEWMMVHRILNHRCVP

SEQ ID NO: 964154 - protein, 44 aa, Homo sapiens
RSELRCGTVVDESDYGTMRLRVRSLPLLSVAMSCGVGRRRGSDL

SEQ ID NO: 964155 - protein, 84 aa, Homo sapiens
VPVPEFLDFASLGVSPEADVLVVAHPADAGTSLVPSVPVLRAEGRELVKGFSSGRLAHTRQCRDGLTICRQQDGDEGVHSLFGC

SEQ ID NO: 964156 - protein, 70 aa, Homo sapiens
EILISGRQGREPELPGLLPLPGASLEYTEMRSNCRSLGPVVSAGGVDAMFITDHLPELGTDLVATLTSLD

SEQ ID NO: 964157 - protein, 149 aa, Homo sapiens
SGPQWRGPKPAFGQEHEQLPKSQAEPLSGDKEPLADTSSNQRKKFKMQSAAFSIAADVKDVKAAHSNENLSDSQQEPPKSEVSEGPVEPSNWDQNVQSMETQIDEAQAVTQPVPLANKPVPAQSTFASKTGGMEGGTAATSSLTADNDF

SEQ ID NO: 964158 - protein, 80 aa, Homo sapiens
EDTVNIATPMTSHCQPAGSIIILPEGQTSKTSPVSNHSVSSTNSAGRTINNEDNFHSAKPMTLNITVVITSFFTYTCNTG

SEQ ID NO: 964159 - protein, 64 aa, Homo sapiens
VIRKYSHWKSVDYWKISHILDRTGEEVLSGVSSYQDSLLKAIVVTQGAQTRHSQIAKTFILDGH

SEQ ID NO: 964160 - protein, 86 aa, Homo sapiens
YRTVGHLSGSHGYVGWHGSGDQTSGGCSCTYFTPIGKSPCMSLEQPGDPHCWLRILGTLPAVWMSLGGRVLASMPHLVVGYRCSNI

SEQ ID NO: 964161 - protein, 68 aa, Homo sapiens
QWGMQLVHREAELVEVDVDVDQQVTSGASGCYSQPQSKRMCSMLAWTMKQSCCRLAGLQNKTQVPMVV

SEQ ID NO: 964162 - protein, 41 aa, Homo sapiens
MTFLYVNVSIVLGFLSYALWPITVVQYCQRVLSWLTATALC

SEQ ID NO: 964163 - protein, 50 aa, Homo sapiens
PLPWIPVAQQPALPSIQLGRESRVCQQGLGPAWLPASVMGTSCLSRHLLC

SEQ ID NO: 964164 - protein, 41 aa, Homo sapiens
QWCMIESRPSTEGVTQEGGGEGDNAPVAGARWPWDHFKLET

SEQ ID NO: 964165 - protein, 74 aa, Homo sapiens
ADHGVAGQGSAERRAVREEEVHAGLGELLRSLSNSTARQCDLEAGQPDCKDPSSVSFADDFVRRGKQHYNCEHS

SEQ ID NO: 964166 - protein, 69 aa, Homo sapiens
MGGGWLRIRPPGSAVCACVAMEHRHIEKLVMPSTQRPMVDGSGEQSSTFAITQVCPQSPRHRGTRSHRA

SEQ ID NO: 964167 - protein, 74 aa, Homo sapiens
KAHDGRPPEPRHQWTGAQHDCGACTWRTCTARTKDEDLFDIEDDIIYTTGLHGARTGPRRGGHVTSGRAIVRLR

SEQ ID NO: 964168 - protein, 33 aa, Homo sapiens
ASWRAWFVEEGAWCSLTIAEPGHYLPMCRKRTM

SEQ ID NO: 964169 - protein, 89 aa, Homo sapiens
MARTYRREALQVPPLPYMPVEILASLKRTWSHPLLVTNPLRCSLLQLPASNHEHDTSNCHMLLAHMARSPIRCATLRHIPLVHVGQHYN

SEQ ID NO: 964170 - protein, 63 aa, Homo sapiens
MARTGEKGEFSRPQCWLQCGWRHCFTLETLQLPVLRVTVDNWCSHITMASWKPWPNAMPMGNT

SEQ ID NO: 964171 - protein, 35 aa, Homo sapiens
YSRGPQKAHDGRPRGPVSAVTVWGWQHEGDGVVWM

SEQ ID NO: 964172 - protein, 89 aa, Homo sapiens
MARHAGAQSLAFCCSAARHTRRQLTMDDDIAALVVENGSGMCKAGFAGEDAPRAVFPSIVGRPQAPGRDGGGMGQKDTYVGDEGPEQER

SEQ ID NO: 964173 - protein, 46 aa, Homo sapiens
GSRSARWRAHEPFSVTEDYPLHPSKIETQLVVGACLARVATMHIDP

SEQ ID NO: 964174 - protein, 53 aa, Homo sapiens
MSASTLMRRACSVSTLVFGSHLQPEERCQICEDNPGRSQVVAPENLVPQVLRW

SEQ ID NO: 964175 - protein, 60 aa, Homo sapiens
MPACHWFERDEPRHNVWGLSLFKPSRSRMVGPLTNLHNFPPTSGLQFLLCKASGHSHSLV

SEQ ID NO: 964176 - protein, 67 aa, Homo sapiens
CHSCSEDPGVPLSGDANKTDLTYQYYRMPTRGKSGLAMTMHISYQLQGMVYTARAFWGGHGVDIGHG

SEQ ID NO: 964177 - protein, 127 aa, Homo sapiens
MKPKNPEFTSGLAIASYRLDDLPPSYNAIDPLRQAIRLNPDNQYLKVLLALKLHKMREEGEEEGEGEKLVEEALEKAPGVTDVLRSAAQFYRRKDEPDKAIELLKKALEYIPNNAYLHCHIGCCYRA

SEQ ID NO: 964178 - protein, 68 aa, Homo sapiens
MKAMIQCFTLLNMRLFVFLLTSGTMIDSGLYYAGLLCTKHEPYSVAVPGAVVKEDGALFPCEALRVPS

SEQ ID NO: 964179 - protein, 58 aa, Homo sapiens
VLAGLADDALARSRSCRDAFLYEGTKVGIAMPWDAKYNEKEILRLQNGLEIYQYLRTY

SEQ ID NO: 964180 - protein, 128 aa, Homo sapiens
RTGDLLKAASINVNISANKKRLGRFCGPLGSPLSNPPEKRRNYMSQGNKMLLSFHTDFSNAENGTIMFYKGFLAIYQAVDLDECASRSKSGEEDPRAQCHHRVSLTTSEAYFCLLPPGYELHEDTLPC

SEQ ID NO: 964181 - protein, 34 aa, Homo sapiens
AGAQTDPFDGGHLCTLTILTSYECEEMKSSNLTK

SEQ ID NO: 964182 - protein, 79 aa, Homo sapiens
SRGSGDVIATLTLSQRTEAREVNELPKSQRARNRDGLGALDLWLLLSCSSWSWQMDTSVTCDDGETAGPFRGSHLKVGI

SEQ ID NO: 964183 - protein, 61 aa, Homo sapiens
MNLISRREEGEVTDLEEGMITLGEEAGFRNTFCDCVPIAQPCDVDHRRKDVVHKTDEGVGD

SEQ ID NO: 964184 - protein, 94 aa, Homo sapiens
EVLMYSPHMNDTTNSTTADHDNFHHGISAGFMEKQIRDPEKYQEYRLILLETTGYVMAQIDGLYVGAKKRAILEGTKPMTLFQIQFLNSVGDNI

SEQ ID NO: 964185 - protein, 44 aa, Homo sapiens
MKETIILCWEPNGSKFAVLHGEAPRISVSFYHVKNNGKIEPDSL

SEQ ID NO: 964186 - protein, 42 aa, Homo sapiens
MKRHHSFAGTNEVVCCAARRGPRISVSFYHVKNNGKIEPDSL

SEQ ID NO: 964187 - protein, 37 aa, Homo sapiens
METLIAFGWEPNGSKFAVLDGEAPRLSFFFYHGPKQR

SEQ ID NO: 964188 - protein, 136 aa, Homo sapiens
WVTWAVPNISGPPCLLLERYNSFYLEDPYFPPKVDLQVSQWIVGEQHVRPGQAATRSLGLARSPRSPLSLEVGTPLTALEGLGDEVVVVGQVSAAVGTAIISGGQSIPGRPENVLVDDIKPGIGFARGNRGSKFRN

SEQ ID NO: 964189 - protein, 84 aa, Homo sapiens
DLSYRSSWQPSDVRYDIERSVTREASERVNDNDEMVESTEESSRDCMWSLTVEEKNLLSVAYKNVIGARRRSWRIISSIEPDSL

SEQ ID NO: 964190 - protein, 57 aa, Homo sapiens
WYPCMSPTNTSTSDNRQLKNIWCDHHLDRIRWFWTKVRMRKDCNARSTVAATLNRIA

SEQ ID NO: 964191 - protein, 43 aa, Homo sapiens
VGTVRVIDNNCVSSGQIDFEAPSSSGKQEAELVSNRCIEPDSL

SEQ ID NO: 964192 - protein, 30 aa, Homo sapiens
MMYRPTPDRVFGHHPTENLRFFLVFCILFI

SEQ ID NO: 964193 - protein, 49 aa, Homo sapiens
MQWRTNSHSGLCQKAVYTSSANFKPRPCFDFAHLPVHGEGLDVYMSVVK

SEQ ID NO: 964194 - protein, 176 aa, Homo sapiens
CFGGIVILTVLPGASGAGHRVRWGRCVLRFGLLGSVATGEVCHKIWALCTVGLCYVVSASVVMSSTLLSTLCVAGLVIHVACLGLGVQAAGVVTVTMLLYVCRVLRTVRQLVKVCTPLVRVPEFHDSVTGSGKFSLIRQTRAAVPPYVLLEEGALGKTDGPLVEAEETMTRVPWPQ

SEQ ID NO: 964195 - protein, 183 aa, Homo sapiens
MCCCTPRCPVYVLLFCSALGFPRPLGALLVLRSRIPTHLVAPSTYVEEGTTKSEVFYPGETVVHWCLVRQQLVCVGAKHMDACEYGRGVIPSILAFALADMCLQHPVTSSPSFYTLRSYARGLRLELSTYLFGQEPDQPGLKEDLRLERSGQARTFHLLEPMFTDRDIHHADPEFLLYEQGYP

SEQ ID NO: 964196 - protein, 36 aa, Homo sapiens
RSHHSLKSRPKPPSLICASWGHALEGVCCGELDAIA

SEQ ID NO: 964197 - protein, 35 aa, Homo sapiens
MPERKGYCCVRQAPVMPTTGARCIQLDRHMGSSWV

SEQ ID NO: 964198 - protein, 71 aa, Homo sapiens
LHAKVICDCCNGPVVVTRYKCSVCPDYDLRSVCEGKGLHLWGTPSSHTPAPSGTCLSGILAQPAWIRQGET

SEQ ID NO: 964199 - protein, 60 aa, Homo sapiens
MRYTSIRCTFLTLQCTQWRRADSLSRKSIPASELFSRRVPSQVWRADAILAMLPSIVNKD

SEQ ID NO: 964200 - protein, 175 aa, Homo sapiens
NAIGSGNDLDIILRFAIQDISVEETWQGMGSFSECQSKDGPVIQNCHMCMNYPQYSLEGIGTCTSHATDPRGTDTELDVSMTMLRKDEPVTNLNNAFEVAEKYLDIPKMLDAEDIVNTALPDEKAIMTYVSSFYMPFSRSAERLKLPPSGSCKVLACNQENEHLMEDYETAGRDL

SEQ ID NO: 964201 - protein, 35 aa, Homo sapiens
LIPSCTAEVCDLNVPVLYSMRFSSLRSRCTTFYYV

SEQ ID NO: 964202 - protein, 44 aa, Homo sapiens
IDNNRLRKKYSTLLTKCARRLAEVPVGRSVMEVCGHCTGSLLSL

SEQ ID NO: 964203 - protein, 39 aa, Homo sapiens
SGTRLLALAVHVTQPKDGGFCEVCKNAGGILGSPGYRSS

SEQ ID NO: 964204 - protein, 47 aa, Homo sapiens
MRIPYPRRFFILVSTMDEISSGQNALVLPACMLTVHLVPCLRLLITV

SEQ ID NO: 964205 - protein, 63 aa, Homo sapiens
TLEDPDENIKITLVDSRTSEVKELRSSRCLQFRSIAGNPCSVNFVSSSTKISIGSCMNLRQTG

SEQ ID NO: 964206 - protein, 36 aa, Homo sapiens
LDLLHIWACSVTMLPQFSHLLQQFGAMQLEGPTHMT

SEQ ID NO: 964207 - protein, 34 aa, Homo sapiens
LEDPNKLNGNVRFIHCPTILGLPAAVLIIRMSPS

SEQ ID NO: 964208 - protein, 60 aa, Homo sapiens
ESTVSPEEFSKFISDAPGCCRLDGCIPHPPHGAMPWSLTQALKAVDINEVSWFLVYIQRP

SEQ ID NO: 964209 - protein, 94 aa, Homo sapiens
RIDGFSAELQTRSRPPRTPAQYPMTGARGRGLEVERSPSPPLALSCSNSTRSLLSPLVHQSFQFDEDDGDGEDEEDVADEEDVNEDAHDTEAKV

SEQ ID NO: 964210 - protein, 34 aa, Homo sapiens
GYTLAAVHQRVCHLVEARLLVKVPHPTLEGLCKG

SEQ ID NO: 964211 - protein, 55 aa, Homo sapiens
IADPLLSRLALSPLSTPLPAQGSHWASGSGQLAKSGVPHHPPTEPSCHCFYLDLD

SEQ ID NO: 964212 - protein, 134 aa, Homo sapiens
MPLICDRTQDSRQAVCRVVCIRETGTHAHAELGRVRIVLALAAVVALVGQYDTMDEEAVDVPILHGQARVVGQLPSSHPAHGPRCTHSACLHFETHVLAFLCPHICNRRRNSSSVSRTWSRALVAVLPARKVTV

SEQ ID NO: 964213 - protein, 45 aa, Homo sapiens
MVMTWRQAVVALLQGRSWKQPWPSLARSPGRRSTVSSLMSRTISR

SEQ ID NO: 964214 - protein, 32 aa, Homo sapiens
MKGDVGTPVLVWHSVIPILISEAGEAAEGPVV

SEQ ID NO: 964215 - protein, 39 aa, Homo sapiens
GSDVNDVRQESEEVSCGRRGASLQLGLKLGKLLKVIFCT

SEQ ID NO: 964216 - protein, 37 aa, Homo sapiens
TVRRSSRGSRIQECEDPPWPCLPGWGGSQLFTDLEVI

SEQ ID NO: 964217 - protein, 42 aa, Homo sapiens
MASHTEPSESSPFSQQAIDSVAGLVEVFGGVGHPTSGPQALA

SEQ ID NO: 964218 - protein, 80 aa, Homo sapiens
MPTAKYLINKRRITTQRLTNQTNRRTNDNHTQRLKDEPELLYIVSLIIYIASDYTSSELLRLLIYTNQPTIYEPSHGPSG

SEQ ID NO: 964219 - protein, 113 aa, Homo sapiens
RGGTAGPILSLPRTLPPSPPPPCVCNDLFLSSVRYLGFHLSCPCSSQIQIDPCMPYRHQRGPPFLPLYLFANSYAFHSHSRGIYVSHSDALIQVIGINGLPSWAYRHANITMV

SEQ ID NO: 964220 - protein, 36 aa, Homo sapiens
MSWSDGHVYLTLETPPSSIFLLLCCSRVQNQQQGLQ

SEQ ID NO: 964221 - protein, 53 aa, Homo sapiens
AGPPFRWPCFPGSPGGLQHQEVWVTCLFQCQPVSPNVSLTPLPPSEVLEGQGG

SEQ ID NO: 964222 - protein, 100 aa, Homo sapiens
RTDGHALLSAHSIRRKGMKVTCSTVKLIWCHTLPSSEGESSCSTLLCCALCLLRDAILLAPDFMPCGHLGLCMVPSGTGWVIPLDVDPAVHCNALATWPV

SEQ ID NO: 964223 - protein, 39 aa, Homo sapiens
MYEVQLPHISWWHLCARQCVLGLLIAEWAWSSMVPSGRG

SEQ ID NO: 964224 - protein, 49 aa, Homo sapiens
RPRLLMAMCLFDHIFTCICDHAGVILKIKMPAACWKPDSSMTCGIGYIP

SEQ ID NO: 964225 - protein, 61 aa, Homo sapiens
MLVPRPIAMGCCLCCADCSFSFCGCWPQLCAWDSDSAVSTNQYILVSLPFISADHGAIWDG

SEQ ID NO: 964226 - protein, 48 aa, Homo sapiens
RVSSRLCSGTSVSDTGKVVSRILEALHEQDLGPALEWAVSHRQRLLEL

SEQ ID NO: 964227 - protein, 75 aa, Homo sapiens
LPAVDLEDPVGSYESLLEYLAPQSLGLARRFFCSAYILRIYSIPSSQYLIYQSNNHQPYMTNQGNVRKYCYPARN

SEQ ID NO: 964228 - protein, 52 aa, Homo sapiens
RIRTGKRRLWRLAAAEEEVVAVATGACEPLGGVPEITYTVASLISVGLVIGK

SEQ ID NO: 964229 - protein, 36 aa, Homo sapiens
IFYEEKRNKQNKPLQKKGPEKSTVESPPAERRRITK

SEQ ID NO: 964230 - protein, 54 aa, Homo sapiens
NAAIKPRPITTRKAEPINCIRPSVLGHWKENVEWNWILGQEIFPGINNMVSSDV

SEQ ID NO: 964231 - protein, 194 aa, Homo sapiens
DSILPEHATVFLMPHLGSCSSHWSLLKFVLFPGLSGGSNLVSGQGSQNLLHFLYWKSPYLRLDSIRGQQHSGLRRAVNIIIENALFHLQKEQALSDVLNQFLGHILRVELGTELKEQGAFFRTSWAVTFLLSFSQVEKPLVSWYCRPKNQTSLKPIVFTTWSNSCFPVVLGWMANSSSASMVVTPHTDRFGHGG

SEQ ID NO: 964232 - protein, 208 aa, Homo sapiens
TAAIQAGTGHGSSASPVHIIQVREIAHIERDGYAQILRDLGGIGLANACGPCIGQWDRKDIKKGEKNTIVTSYNRNFTGRNDANPEIHAFVTSPEIVTALAIAGTLKFNPESDYLTGTDGKKFRLEAPDADELPKGEFDPGQDTYQHPPKDSSGQHVDVSPNRQRLQLLEPFDKWDGKDLEELQILIKVKGKCTTDHISAAGPGSVPG

SEQ ID NO: 964233 - protein, 44 aa, Homo sapiens
CVLSKNSRMLSPVLGSLDSSPKPCVSFFFSLKFSTAPAFISNVW

SEQ ID NO: 964234 - protein, 42 aa, Homo sapiens
SPTCVLQRNYLFSAQYVQPSCIASRLTSLFSEDDTNLVLQHT

SEQ ID NO: 964235 - protein, 117 aa, Homo sapiens
VLVKRFAMPDSGAPILRKLVTWSPNSLMAFTCLIQVTVSQMKSHKVGVIFVWPCLCEFHVVTRFIFFQSVMHTHIAFSPALPHHSLCFLDIREGQIRATSLGSAAFIFLTHVPFSMR

SEQ ID NO: 964236 - protein, 89 aa, Homo sapiens
EARTVKRKVSLFHEKCCIVLKEIVYLPELRCGIISVDPVSVNWLSFVRNRFRNGLCSVKDGEPHFRGGPTAQATSRSGPQTGVSLSSVQ

SEQ ID NO: 964237 - protein, 69 aa, Homo sapiens
MGCLSLPWHVLTCVTGGDDVVPYAAYSFSYTTMTEQDYDTLSSSSFVTFVNYFYEPSADVDVLLLYERF

SEQ ID NO: 964238 - protein, 97 aa, Homo sapiens
EAWGMDALVAEERGGHAKGNEVRPVAGSADVRTTQTLAPLQHVHAHLSPLQNILPIEFWRVIDSSEFSSLILLFGSCWHNLGTQVLQYVLVYRGSNF

SEQ ID NO: 964239 - protein, 64 aa, Homo sapiens
AGAMLEEWKAGTHVAGEGISSVHYDDHCNLLAQWFPDDTEYRGPKTINPAVRMPDELGLIKASR

SEQ ID NO: 964240 - protein, 47 aa, Homo sapiens
LATGTGGSLRGPWVECSAGLDRDLLTYQGQVKMTFLDPGTLTEISKE

SEQ ID NO: 964241 - protein, 48 aa, Homo sapiens
LSWYRLWCTDKLQVILALCAFYLSLNYLTTSHTKSHTKSHPKGHAKSH

SEQ ID NO: 964242 - protein, 45 aa, Homo sapiens
RARYRLFVQLEVDQLLRKQKGCVVVTLQEPHHAPHEEPPHAPPDA

SEQ ID NO: 964243 - protein, 38 aa, Homo sapiens
ESSSVPVRGDAGTSCGTACYCLELVSMDLELHRPPPKC

SEQ ID NO: 964244 - protein, 69 aa, Homo sapiens
PDRLFVWLLRVGSVAWLFGWLLGWLIVWRLGWLMVWRFGWLFVGRLGWLFATAQLQAQCQVIWDTIDCD

SEQ ID NO: 964245 - protein, 89 aa, Homo sapiens
KLAYRSLGGSWMRLLAWLVVWLLVWLFVRPVGWLMVGLFARLFGGASGGSSRGAWCRHLEGLFVWLLVWLFVLLFSPFPVSTFLSSPQR

SEQ ID NO: 964246 - protein, 48 aa, Homo sapiens
GRSSSVPARSVAVEGHLAWLVVGGLLLLGLASNLSNLSIGPVQFLLHV

SEQ ID NO: 964247 - protein, 49 aa, Homo sapiens
MSLVLAFARLFGLPLVGLLGWLFVWLFVVARRGISVFVRRRSSPCFPTK

SEQ ID NO: 964248 - protein, 41 aa, Homo sapiens
MPVPTSYSSLYPMTQDATQRATLKSRPMSHAISPAKGPTNS

SEQ ID NO: 964249 - protein, 75 aa, Homo sapiens
LVAARSVQYGIALCRGLTMMLLAFCPGVSGPGLGVSPARGSDPMGSRGPSPFQSAVRLPYSRAGSAGAAWDRALS

SEQ ID NO: 964250 - protein, 34 aa, Homo sapiens
ASRSRMSREQSEGSGTDDSDQYGPSFLGITEFLP

SEQ ID NO: 964251 - protein, 59 aa, Homo sapiens
MLVQGCGTACYCLQLVSSGSSNFICPLDRRSPLEHPPCSFTKKPHEPPRSHTQEPSPRS

SEQ ID NO: 964252 - protein, 110 aa, Homo sapiens
RGSRHVCGSCGWLMGGARVCLLVWLLGWLVGRRVEWRFGWRVVRLIVGLIAWLVVECGESAKYFDAGRDSDDYGSGGGSSGHAKSTQRATPRATPGRHATSHTTGPAKCR

SEQ ID NO: 964253 - protein, 88 aa, Homo sapiens
PAGLAAGASEGHGSDNSVEHADYRAKLSQIRLIYHTELEKYEQPANEFTTHVMNLSARAKPDLRPISPKDIERKSVSSTKRHTKSPTN

SEQ ID NO: 964254 - protein, 54 aa, Homo sapiens
TWSEAVASPSEDLHEVVGQVPASHVQTHDGVVGAAYPSYIGTVWLTPSPGASQR

SEQ ID NO: 964255 - protein, 56 aa, Homo sapiens
HASIFTYGIDYYTRAYFTSATIIIAIPDEPPKEPHYEPPKAPHYEPPNAPEEPRNE

SEQ ID NO: 964256 - protein, 75 aa, Homo sapiens
AGPGALGMLSVEVQDCKPTWLQCRQLHLQLTLITKSHTNDAAQRASQWATQGPPQEPRNEPHDEPTMSPPMSHPT

SEQ ID NO: 964257 - protein, 70 aa, Homo sapiens
CRYRSLGGSSGGSLGGVEYDKFIESGRKWFCHVDDDNYVNALVVPLSPCSKGLFALKALLLHHGTRSAPK

SEQ ID NO: 964258 - protein, 71 aa, Homo sapiens
EPVRLFVARWGGSCVWLVGNTKLDDIIYFKFLPVRKDKRNKAYFTKRRCPRRVSLPDPPNLLHLNHTTPHI

SEQ ID NO: 964259 - protein, 34 aa, Homo sapiens
VSWYRPFVWHFGWLVVLARLANCILHLLHAPHEE

SEQ ID NO: 964260 - protein, 38 aa, Homo sapiens
SHAQRRREEATEGSTKVNRKAADRGSPMPKKARLPSED

SEQ ID NO: 964261 - protein, 55 aa, Homo sapiens
MIRDSTEEGEIKTNQILSGCQISQQVLLPKLALAKILLEAESRSREIPSVLSTSS

SEQ ID NO: 964262 - protein, 81 aa, Homo sapiens
GSPAQRRGTTAASGGGSGGLFSSFSLLQHPPPLSVHLLYAVHLSVLSSSVLSILCAVHPLLLSTSSVLSTSSVLSTSSVLS

SEQ ID NO: 964263 - protein, 33 aa, Homo sapiens
EEVQEAEVEDKGTKKPVGAGGAGQGQRLMQQAL

SEQ ID NO: 964264 - protein, 35 aa, Homo sapiens
LDSTEEVERQPTLVSTVTPVPMLTCVSSSVASSVL

SEQ ID NO: 964265 - protein, 45 aa, Homo sapiens
NTEEESKTLSLVSRDAKPLEVYSVDFMVDNAQLGFLVSDRDRNLL

SEQ ID NO: 964266 - protein, 39 aa, Homo sapiens
EKELLLQKKGPGITNDEAPNTVPIPAPEPANPSVLSSCP

SEQ ID NO: 964267 - protein, 33 aa, Homo sapiens
RALRTRGLCKPPGWAALSVDVEGDCLELGRTSS

SEQ ID NO: 964268 - protein, 55 aa, Homo sapiens
DEEELELALLERLFRLAGVGSGGRPSSVLSTSSVLSTSSVLSTPLCSSSVPLCAV

SEQ ID NO: 964269 - protein, 39 aa, Homo sapiens
LEVPGAPDGLHSCMDLLCAVTSSVLSTSSVLSSCPPPLS

SEQ ID NO: 964270 - protein, 43 aa, Homo sapiens
QRIPEAEEDEEEEDKEEELELELLERLLCAVHLLCAVHLLCAV

SEQ ID NO: 964271 - protein, 45 aa, Homo sapiens
MSASLCCHLLCAVHLLCAVHVLSTSSVLSISSVLSTSSVLSTSSV

SEQ ID NO: 964272 - protein, 103 aa, Homo sapiens
SSCACPPPLCCRTAQMRSFTLALRKELVACDLGTGVGERTPGSRALEEGGPEMVWDQRRPEVEVGESTPPLCCPPPLCCPPPLCCPPLCCPPPLCCPPPLCCP

SEQ ID NO: 964273 - protein, 43 aa, Homo sapiens
ILEDPDSTEEAQRRNWFVCFAYPQCWHGHSCPTMIHSHALAPV

SEQ ID NO: 964274 - protein, 89 aa, Homo sapiens
MTCTEEVYSYRGGDEGADGMLCTRYLHNSSMSASANSCAKSWLQSGQMDESQHSQTSEKPIRWFQNSSQMGCECCPLSVPSCVLSTSSV

SEQ ID NO: 964275 - protein, 89 aa, Homo sapiens
HELEEETEEASPAIVLGTTSSVLSTSSVLSMLSTSSVLSTSSVLSSCPPPLCCPPPLCCPPPLCCPCAVHLLCAVQPPVLSTSSVPSSV

SEQ ID NO: 964276 - protein, 41 aa, Homo sapiens
VEDPSTEEEQKQPRFIMGSITPTDYTLSKLPPCAVHLLWCG

SEQ ID NO: 964277 - protein, 77 aa, Homo sapiens
IAGLVLLGAVTTGAVVAAVMWRRKSSDRKGGSYTLGCKPVTVPSGSECVYSRACKSVRQRALVWRLRGNELFLPPVT

SEQ ID NO: 964278 - protein, 34 aa, Homo sapiens
KYQDVEENENGEFQAKYCGDLAVMLLRRIPGMNS

SEQ ID NO: 964279 - protein, 36 aa, Homo sapiens
CRLTLEYPRSFVYTYQVNGYNTDFMLVFSLKVYCFL

SEQ ID NO: 964280 - protein, 39 aa, Homo sapiens
NLLQKLSEPKPIFFTLNIAAAKPTPPKSQVTLTKEFPVS

SEQ ID NO: 964281 - protein, 48 aa, Homo sapiens
MAHGGFLNSHPKYEMRGNRKSLAILKATPFLSKENGPVLYNCTCVEIE

SEQ ID NO: 964282 - protein, 34 aa, Homo sapiens
NDIDAFFRKVRGILNKLTPEKLTSYALSSSNVGF

SEQ ID NO: 964283 - protein, 63 aa, Homo sapiens
MIRAHKYLNGIRPTGYLGNGANAHLCVLAVQRVMSLMYVNVCVEARLVLNMQITYIKVDDNNE

SEQ ID NO: 964284 - protein, 32 aa, Homo sapiens
MVVFGYTTAMAIEEYLRHGGQGRGLESVKWGS

SEQ ID NO: 964285 - protein, 58 aa, Homo sapiens
MFYTQRQQQLLWPYASHRKYEGWRTIVHFNEFLAASGWDERCTASSCVEIDHTDLEVP

SEQ ID NO: 964286 - protein, 35 aa, Homo sapiens
ASVGFLRLKRIRLYCFIFSDVDLVPMDDRNLYRSG

SEQ ID NO: 964287 - protein, 61 aa, Homo sapiens
NAQYAGHRRSVVVPWLAPAGMPKSGTIIDGADSMMTPCSQTNQHILEGCSHVPGHVSVTSI

SEQ ID NO: 964288 - protein, 39 aa, Homo sapiens
ESYQQVGFTNSDVGSGHPDGGAAIKGSFVEKSMVLRVRP

SEQ ID NO: 964289 - protein, 39 aa, Homo sapiens
DVAEISDMKPSYDGNSTGPIDSDIVEVSYNVNTCRYVYG

SEQ ID NO: 964290 - protein, 120 aa, Homo sapiens
GRTRSEDDEDITIDLFGCDNDEDDNGVWLSCGRSGYVLYAEKKAKKPALVAKSSILLDVKPWDDETDIAQLEACVRSIQLDGLVWGASKLVPVGYGIRKLQIQCVVEDDKVGTDLLEEEI

SEQ ID NO: 964291 - protein, 110 aa, Homo sapiens
MAPVHLWRYEQRGAPVELAKREEPVRVVDYIVSCDDIVPDNLNSLPNSSDHDMALVWMDEGVRAMARNAPCEYQLIDCAQYYLDKIDVIKQADYVPSDQVLLRCRVLTSG

SEQ ID NO: 964292 - protein, 106 aa, Homo sapiens
YKFVSMLDFTSKANYYTQVDPKLEPGVNELPLGANRRIRILESISTIGLRPRCRSQDTPDWCMTRYSKVRSFNDDSTYADQYSERSKSRSVSIYFTFLPVRKDTNV

SEQ ID NO: 964293 - protein, 38 aa, Homo sapiens
TCYIRVHEELRKLGLYVETRDGADYEGWCVARLSWLPV

SEQ ID NO: 964294 - protein, 63 aa, Homo sapiens
ELGTCNIRVIIHDNMNADADLINAGEETVTILPGASFFSSDEQFATELERGHVRNLTIASERM

SEQ ID NO: 964295 - protein, 48 aa, Homo sapiens
DSSSAPVTFVSMAHAAQEVYKTLLPAIIEELIDLVMISALIMHLPYLS

SEQ ID NO: 964296 - protein, 70 aa, Homo sapiens
MKPSARTWGGAVDSNLVTCLCPHSIVWAVSSANYQCARQCSALHSPVLPRACVCRQFPEAVLAAGLTPET

SEQ ID NO: 964297 - protein, 109 aa, Homo sapiens
MHLEYVLNCQHIIWLMILPFLSPRSLRCQRLWWSAGFDVSGYPTIEILEKGQAVDYQGSIAQEEIVASVREFSHPAWMPPAEVTLVLDKEDFDAVVNEADIILVGCDAP

SEQ ID NO: 964298 - protein, 58 aa, Homo sapiens
MSCTWALDQQFDFSIINIDHILQAPGIYIGRTTYGRSRRRDYYDRGYDPGYDDRDTNV

SEQ ID NO: 964299 - protein, 125 aa, Homo sapiens
QGHCGESPHFMYNACQLIDDGPGLSCARRHCLRIPAQVLGAVRTGRLLRLLTAVPATFRVPDHDGLRFLCVSARCRCTSRRMACWVHSCPKAFWNTCLSWSEPSGYLYLSVTSMRALLPTALVLM

SEQ ID NO: 964300 - protein, 82 aa, Homo sapiens
DLEDPEAGDRGRGRQEDLRPTDHQKCGDQRPLEVVVTAGTRSTWYPEVLRGADAFPAEARENQSSCASSALTGVPEARNSVN

SEQ ID NO: 964301 - protein, 60 aa, Homo sapiens
DRSGQAWKKSLHMRCDECQENSISWKSTVLATVLIQVAHQLLQPLLIHFLPHKAGQLLGR

SEQ ID NO: 964302 - protein, 38 aa, Homo sapiens
TAFEAWAHSIDTSDSDDKRHIGVLQVHRSSQLFWYLAE

SEQ ID NO: 964303 - protein, 49 aa, Homo sapiens
ESSLPLVLVMAAPHWHEKITMQNLNDRLAFYLEKVRALEDIIPSTLNLP

SEQ ID NO: 964304 - protein, 109 aa, Homo sapiens
MEDPPQKDYSRGFGGKFGVQSDRQDKSALGWDYQDKTQMHHSQRDYSTGFGGKYGIHTDKQDKNAVVFEYQGKTDKLESHKDYVNGLGVKFDVQTDRHDKCALAWNHQE

SEQ ID NO: 964305 - protein, 56 aa, Homo sapiens
RLFYYERTLASSANGARAQEHRSTRGSSGAGLTTVTLAGEQGNMGQPRGDTARDEA

SEQ ID NO: 964306 - protein, 41 aa, Homo sapiens
SALSHEAEHYTKMTSAPFHCRKLPVAYFSNNFHLLSTGARR

SEQ ID NO: 964307 - protein, 37 aa, Homo sapiens
MAQPTYKVRIVRDKFLGRCYRSQITCSCHSYDVVIVS

SEQ ID NO: 964308 - protein, 116 aa, Homo sapiens
IEATSFTTSGTEREIVRDIKGESCAYVALDFDAGDGHRPASSSVSAMKKLASMPGWSESSPMGKELVPDVLEALFQTFLPGIWNLARIHEYQLATPSWMCDVDIRKDLYTNTVLSG

SEQ ID NO: 964309 - protein, 63 aa, Homo sapiens
MIRMRARRPISQYYQSILIINDIIMADSNKKLRNSPLSASESQRLTQGTPADIRPASAHMTST

SEQ ID NO: 964310 - protein, 73 aa, Homo sapiens
ERIELGTVLPALPIEECPATRLLAQMGHYRRIHKKSNSLIIPTIIATHHPPITSYFYLNAVIYSTVNQHYSAI

SEQ ID NO: 964311 - protein, 114 aa, Homo sapiens
SVNHLTPSLLILDTLTNLDTLTPHPDTLTPQPGYPHSAEDSRHSSCLDTSICTHVDPHSPWTRSLTLTPSLTLDDPHSPWIPSLLILDTLTHPGYPHSSPWTLSLTLIPSILTL

SEQ ID NO: 964312 - protein, 54 aa, Homo sapiens
GCDVRSYKKDGAEFAKVALCAEDVGNTAPSDPRTSMVKLPIVHGPRYDSVSCQA

SEQ ID NO: 964313 - protein, 83 aa, Homo sapiens
VNTLQAAALRASLKKNTGYKGTLPNVLQRSVEDPGLLDCTIHVGTGTINGDDARKRKAKAKPGMCVSAVMKVEWYITCLGTCC

SEQ ID NO: 964314 - protein, 33 aa, Homo sapiens
VSYDMVTPEAAALRELEEETGYKWDIAECSPAV

SEQ ID NO: 964315 - protein, 109 aa, Homo sapiens
SGSVPDCIVRMYKEGGADFAQWRLCAVKIEERQPLSPRHHGKCQMFWPVMPVSDHPTNGIVPTRGGLISSLMGTMTCSAASYVTEIVLVAVYQRSELTAITLPGRLAFL

SEQ ID NO: 964316 - protein, 66 aa, Homo sapiens
LVGSPCWSHMPSSFMSPKSRLTIYTPGLTVLLGVLARQGVRRRLVLAPQYWIRVRDMTSRAWSNTG

SEQ ID NO: 964317 - protein, 39 aa, Homo sapiens
YQLGPDSPVAICASNKRIRALFDESLIHGLEQRDDVSCF

SEQ ID NO: 964318 - protein, 181 aa, Homo sapiens
AVQEGRELTSQVAYVELKIGEHTPSDLAIHGKCQCELARYASICQQNGIVPIVEPEILPDGDHDLKRCQYVTEKVLGELYYKALSDHHIYLEVHLAEAQTWSPQAMLCTQKLTHEEICHGDRNSAAPHSDPTLSLGYTYTCTGGQSEEEAYIKLNDINKCTPAESLGPELLLRTSLHASDL

SEQ ID NO: 964319 - protein, 53 aa, Homo sapiens
YIAMLVMCDQKERDVIYEGVSVLALAEFVITTDLLARALAVQQVSLVINYETR

SEQ ID NO: 964320 - protein, 45 aa, Homo sapiens
MAIFLMRKLLNASIVWGDHVGLQQGAFQVNWVITQSLVDRQPAPS

SEQ ID NO: 964321 - protein, 58 aa, Homo sapiens
MYLALLMPVSSQQNGIVPSMEPEILPDGDHDYEAAASNVTLRSVLWLAVYKCYLSEHH

SEQ ID NO: 964322 - protein, 47 aa, Homo sapiens
TAKLRCVLKIGEHTPYSLAIMENANVSGPVYSHYLAMQNGHCCPSVE

SEQ ID NO: 964323 - protein, 38 aa, Homo sapiens
LRSHTQNRIGDQHLVAGSSRAWMWTTLLLLGLLLVLVL

SEQ ID NO: 964324 - protein, 108 aa, Homo sapiens
IGERHPSALAIIGQMRKVLALVCQYLPEQNGSSAIVEPEILPDGDHDLKLLTVCDARRCWKLSTRALSDHHIYLEGTLLKPNMVTPGHACTQKFSHEEIAMATVTALR

SEQ ID NO: 964325 - protein, 34 aa, Homo sapiens
LRVSYTEWDRGYSIWMAWLLIGHGCGPHYFCYGL

SEQ ID NO: 964326 - protein, 107 aa, Homo sapiens
RLLPSGALVASCRNTLLVCLGWKLCASLAHAAHVPVGSPPVQRLTAVVGLPHSLAGTGLYFCQSCCPWRQQQVTVLSRWNMWLSGRVRGGPTDVEACSIGGHWPSRN

SEQ ID NO: 964327 - protein, 93 aa, Homo sapiens
METSNGTWPVMPCILPDSNGICAHRWSHEILPDGEHDLTRCQYVNAKVLGLLVYTALSDHHIYLGSAPCLTTNMVTPGQCSASRSSLITDIAM

SEQ ID NO: 964328 - protein, 73 aa, Homo sapiens
MTGDTPEAAALRELEEETGYKGDIRRMYSSGLYGPRLVKTVLYTSVAQSPVNRKMMPENAEAIAQSLVCCVSE

SEQ ID NO: 964329 - protein, 86 aa, Homo sapiens
AYCTWMVTLSYIIQLGRIKCGLLFLLLVVSVSECDHSAEATRIRDGNGRLVCGFAPFSCFACSVFTDCKGDVLFVKMERSQICASN

SEQ ID NO: 964330 - protein, 139 aa, Homo sapiens
MCALILPKWKHPQGAGSDREPPWLKAIFHDLQSQCSLTPLWKADGQHGVPYCHCREGQWSPYGAVSTSVGPPLTLSSATWSSCSACDLLLSLRTALWQNLASASQAVGETYHASCAELAGFQRDLGSLRRLCHSFRPSY

SEQ ID NO: 964331 - protein, 40 aa, Homo sapiens
AHAVSSSWWVRVVLAPAIRRTVASCSEHLACMLVLEAVCC

SEQ ID NO: 964332 - protein, 32 aa, Homo sapiens
QNGIGDHASGGRLLKGMVVDHIYFCLVFCWCW

SEQ ID NO: 964333 - protein, 67 aa, Homo sapiens
SGQCVAGGPDANMTEENEYAHLPALWILQQNIKPGKADWTPSSRALSNSDTGMLSAPGMVPAAASSR

SEQ ID NO: 964334 - protein, 166 aa, Homo sapiens
VQGRMELSSSKWRCVLKIGEHTRSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSC

SEQ ID NO: 964335 - protein, 134 aa, Homo sapiens
YPAMCAGQHRGSGSCWKDRRIAGDPFVWSSRAAGYPAPIITSRSIQMGVSKCPSGSAELETRVLPAQCRIARSQELLRGSDELNVCPSSTTELSLSCSLRATCVRESDGVILHTVLTSAGLGCIEARLSLHAGT

SEQ ID NO: 964336 - protein, 76 aa, Homo sapiens
DIDVSRAWYMPEGIEEEFATGGTDRKDVLISTRQTMSTTYPRSRASWTMEPRSDPLPYLNYPAIAKALTTSDEHHT

SEQ ID NO: 964337 - protein, 74 aa, Homo sapiens
DTWQLCAEDWGTHPHQTLAIMENANVLGPVMPVSMPAECALLPICGRLRSSLDGDHDYEALPCMLTETGAWLAC

SEQ ID NO: 964338 - protein, 111 aa, Homo sapiens
CNSAERRNRPWRPVCDVLHPTRASSLCSRPCLGKEMPTTNSPSPGFGFGRCFAGIISVTGDCHDVYSTVGHAWVHTDRWRTFGNVPFVASFFFKLPESSCFWEYTIIYETR

SEQ ID NO: 964339 - protein, 77 aa, Homo sapiens
SLELDEADYYYKSEEEGKSLECKRAAWEHLRLIGCGERRTRDSLGNRPRPDRYGVYLTYDMQGKKAKDYRYRQYYLP

SEQ ID NO: 964340 - protein, 63 aa, Homo sapiens
MARLFGQGSLDILLLRSLQVLLLPAPGLQGRGLQGSAVGEGQGPGLQQGALVNGIEVDGRLLL

SEQ ID NO: 964341 - protein, 33 aa, Homo sapiens
IHNGIPDTGDTNSSVYMNYNQLLTFVIKVAPLT

SEQ ID NO: 964342 - protein, 44 aa, Homo sapiens
VESNMELQTMIAAVDTDSPREVCIRVAADMSSDGNFTWGRVVAL

SEQ ID NO: 964343 - protein, 78 aa, Homo sapiens
DYMQNMEQKRRQLEESQDSLSEELAKLRAQGKQLTTIAGVQLLWPKPDTLYVGWTHCLFCSVKRISVYCKDGGRVTGN

SEQ ID NO: 964344 - protein, 48 aa, Homo sapiens
DRYGQRSGRNRSVPARLWGESYHASGAELAWLPMVTWRMAVQGYRARN

SEQ ID NO: 964345 - protein, 38 aa, Homo sapiens
MVSAPRASWSEFATEGTDRKGRLFVYQRRRLSTYIPRV

SEQ ID NO: 964346 - protein, 125 aa, Homo sapiens
EGILIRVSDKGVPVRQRSRGMDSLALMNMQRRAARFNLAEPSKNTASPEEFAQCELENRCVVACSEILVSLQEAQERPSSKRKADITKAKLMLGWEPVVPLEESLDRAIDYFRKELEYQANDSVS

SEQ ID NO: 964347 - protein, 125 aa, Homo sapiens
LQNQRMLLEVVTRQVAHKKSSLQTSAKQIEDRIFEVKHQHRKVENQIKMAKMVLMNELNKQANGLIEELEGITTERKRKLEQQLQSIMVLNRQFEHVQNFINWAVCSKTSVPFLFSKELVRGISQ

SEQ ID NO: 964348 - protein, 70 aa, Homo sapiens
KIFSQKLGYLLFRDFGLIHLEEARPLVEFYEEIKKYEKLETEEERVSRSREIFDSYIMKELLACLHPVYR

SEQ ID NO: 964349 - protein, 99 aa, Homo sapiens
TTYTLVPQGSCPVSVGGWLPAQHDDMNNPQIMQSPQHPCEVGRKLATIFTPTSQTARDTVKRERMVELSPPVQVLGRSPRSHQSLPEPGRLQHSHLDTG

SEQ ID NO: 964350 - protein, 33 aa, Homo sapiens
MAFMIQIPEYDDPVILHYNVPVLKCGLVAPSDL

SEQ ID NO: 964351 - protein, 47 aa, Homo sapiens
MCNIHQDRKGDFNISRCILLAVNARVTFTLVDLPHHPGTYCWAPDYP

SEQ ID NO: 964352 - protein, 62 aa, Homo sapiens
PLRSHTQNGIGDQHLVAGSIKGMAVDHITSAWSTSRCWLLGVDYMKWQGSVHLWDRHGSRNL

SEQ ID NO: 964353 - protein, 43 aa, Homo sapiens
KWYQHGESLKNLRRRNIKSYDYRLSKDVHAYQYASLLSSYLYP

SEQ ID NO: 964354 - protein, 57 aa, Homo sapiens
SPYRIWTETHAVDAPTIQIMCIYDAMIPEYEIRRYYLQDLVKVDVGSYGPPLITRTK

SEQ ID NO: 964355 - protein, 137 aa, Homo sapiens
RAPPCGPNIEGLKSQEGYFNTGYALCLSQCKSVGIDPGVHCEMYFSYQSIKSLQQVILGKRNDFHKLSIPWLWLRPSVIGIISVNGDCHDVYSTVMTSLGPYRPLENIRQCPLLEASFFFKLPESSCYWGYTIIYET

SEQ ID NO: 964356 - protein, 67 aa, Homo sapiens
MDTQQEAWHHECQVSTVSCCLYLGKPTIQAAVVAPYPASVHTTHTPQRVEVLMLNVRRNHPQHMQGV

SEQ ID NO: 964357 - protein, 58 aa, Homo sapiens
LRGLIYCHACMIWTKEERRRDYSGSFVAGSSRVLITTDLLFQRIAVQQVSIVINYETR

SEQ ID NO: 964358 - protein, 78 aa, Homo sapiens
CVSLHRMGIGDTASGGRLLKGLACGPHLLLLGLLLWLVLDDDYWKGRAQAPMGALVLEPWARQGSVYFGGGRAQAPLG

SEQ ID NO: 964359 - protein, 47 aa, Homo sapiens
CESHITNSNATKGGQSEKLSTHMGYASEPYTTSGCITMTSMNLRAIL

SEQ ID NO: 964360 - protein, 48 aa, Homo sapiens
LAGWPRGSPAGFHNGFRICRHMHHEGLELKLFLGTTVGFNVKNVSVRD

SEQ ID NO: 964361 - protein, 74 aa, Homo sapiens
CGHITELNLSKCTMKLGVKLFLGDNVGFNVKNVSVRDVRRDREDSDSKDDPPMDAAGYTAQVIILNHPGQISAG

SEQ ID NO: 964362 - protein, 61 aa, Homo sapiens
MHHELRVMLFLGTNVGFNVNECVYVRDVRRGKCCIVTAKMTHQWKQTGFTAQVIILNHPGQ

SEQ ID NO: 964363 - protein, 34 aa, Homo sapiens
MMVKPQKHAALRELEEETGYEGGHGRNVLQRLYE

SEQ ID NO: 964364 - protein, 31 aa, Homo sapiens
MVKPQKQLLSGSLKKKLGYEGDIAGFVLQRS

SEQ ID NO: 964365 - protein, 46 aa, Homo sapiens
MNGITSVEMHPEALSEALPGDDVGFNVQDMCLYRDVLSCHVKPWCT

SEQ ID NO: 964366 - protein, 79 aa, Homo sapiens
VISLNSNAPQRWMSAEALNTHGLARNHINKGGITRLQECRAIFQLFYHERRSILFLRAQHNLHAIVSLCGNTNTVGIRR

SEQ ID NO: 964367 - protein, 32 aa, Homo sapiens
TFNPFLLIQRIEIAFVHFPYYSPHFIARTQVV

SEQ ID NO: 964368 - protein, 61 aa, Homo sapiens
HHLSQRRHHRRWRKPGDGATDADSNESPRSYNTCDDDEGPDRMQCMPSGGLIPKWGRLALT

SEQ ID NO: 964369 - protein, 62 aa, Homo sapiens
MAHLGKKPVSGGRPPTERRVNGINGVSHVSLFDIQDPNTVAVLDSNLCNNNAVVVSDNINSL

SEQ ID NO: 964370 - protein, 77 aa, Homo sapiens
TLRGVMHEEDGGVGVAGAHFGLGALQGWEQGGVHQGWYSTSLAGGDHLCHSKVRILVNGTWDYELDILLSRKICGNE

SEQ ID NO: 964371 - protein, 134 aa, Homo sapiens
VSSFVEATSLGQLNIGLQSHNCHYVVSIWGPFDFQLDHALATADSNGLHNIIGHHLNPLSSDFFHGPFAEVFRRIFSIFPFSGKSRNTSVPKARAFLPRAQASSLPMKPPPIILSDLTSREIFFKLLKSPIFLK

SEQ ID NO: 964372 - protein, 108 aa, Homo sapiens
TPPESVYKHLRWTMEGPDSSYSCLLIHMSITDCSKAWREPPIHTKYLDSRVAMILIFMVLGVQSQHHVEATVGNAPIVGGHRPHRPIRGKVFAAVHATLNDGFEGGLV

SEQ ID NO: 964373 - protein, 77 aa, Homo sapiens
GPACLCDDCSKPPWVFQCPSSPTLTPNPDSFTKKTGVSSQEYPWHLSLFEAPCFPLPSFQGRGNLFSLKADPYANCL

SEQ ID NO: 964374 - protein, 90 aa, Homo sapiens
MVDPPAACTLDLKKPQAFNSDVGDFGSHPLKLYRGSHSYNRPRTYILITILASKLKLRTPFQAHYNPFLRTSNSTSTNSFLMNSNKAWLT

SEQ ID NO: 964375 - protein, 128 aa, Homo sapiens
FGAKNIKDGHFKWLCICLLQCESVGLDPGVHCEMFFSYQSIKSLQQVFLGKEMTSTNSPSPGYGYLALRIGIISVNRLTVTMCIVQLDKPGVHTDLWRTYGNVPLVARFFFKLPESKLAAGVNTIIYE

SEQ ID NO: 964376 - protein, 45 aa, Homo sapiens
MAWNWHTGLCLYAQRLLALRVVAKPSRLLPSYTKLHSLLTYWVSR

SEQ ID NO: 964377 - protein, 89 aa, Homo sapiens
TETQKTNLLILIHFLLLKDIGEVICALLVTGTKEVGKFSFIIVSRLGLSSLVITSGVFVKHVDHAYYGPLFLSVAHLCFQKARAGKRHE

SEQ ID NO: 964378 - protein, 95 aa, Homo sapiens
THGSSMLSTMHLITELVRTKSLVKNCIVLIDSTPDRQWYESHYAAAPVAAQKGANADSCRKHAHFKPKNDLTKLQKQICMKGQTNATQSACLLAG

SEQ ID NO: 964379 - protein, 79 aa, Homo sapiens
VITCRVCIVCNAGFHVVNVVGELSPYCVVRNICSREYRAVTQYVGPVQSGECIFEPENVVTSTEQFSQLQHSTQWGVRA

SEQ ID NO: 964380 - protein, 93 aa, Homo sapiens
ECYVDYTVLIVSNSTSSDYETFWQCFVWSSLAGQECTSSGAYECPGVLLIMAQFRKPTNRPRSIHYSSWVSGARAALNTLIQSKRFGARGTLS

SEQ ID NO: 964381 - protein, 50 aa, Homo sapiens
RYSDTSFRFSAADIAFTSDLINRRGLIIPPKYPITEGTSLTPSWQSIQLH

SEQ ID NO: 964382 - protein, 78 aa, Homo sapiens
VTLEDTDTIECQNQGACHPMCLSPATQSAEPASQGSGAMPPKVPEALPFNSHSSTRPAEEQAEVMWSTAMPFRRRPPD

SEQ ID NO: 964383 - protein, 108 aa, Homo sapiens
DNIECGYIQTFKRTVFRKGKLGHRKHCELPTTPSASGSREITISCVLLGGHTNFSPYLTGCNNGLHSLSPKSFLFQNQRNFPHLIFGSQLAVPISNGFVRGYRGSEFR

SEQ ID NO: 964384 - protein, 61 aa, Homo sapiens
MAGVLYELKNYMDYEKAKNRYKRTKNWEELRHLIRECLRRFSIVLSAKIIYLLQEFRVAVW

SEQ ID NO: 964385 - protein, 75 aa, Homo sapiens
LEDPLTLDAHWEVAGAQAVKSPAGRAGFDKVSYSVPISPAHSAGDRRDELWGHNQQSEVGKRPWGREPCIPMRAF

SEQ ID NO: 964386 - protein, 65 aa, Homo sapiens
VGEGVTGGYFLLALLRLGRAVDTLVMARLSALLGVAMALGTLACGTQAVAVRAASIVAVDKTSCW

SEQ ID NO: 964387 - protein, 78 aa, Homo sapiens
SSLPETPVYPRASAQSHVHPRSALSAAASPTVYTALRTISSARQKYPTSDTFPTLPAKVSIQEQVTASGFIRSMRGYG

SEQ ID NO: 964388 - protein, 54 aa, Homo sapiens
PTGSSTAAGSQSWQRTGIKDTEWSDSRKTRRQQQQPGWNDGQTHGRTWPWYVNR

SEQ ID NO: 964389 - protein, 72 aa, Homo sapiens
TLEDPGTLVMANAVPTQMVPQFFILHWQTELVWNAKHVVFGKVKEGMNIVGGHGSALSQEWPDPARRSTIAD

SEQ ID NO: 964390 - protein, 54 aa, Homo sapiens
YFRAVLRDHTEYSSLHTRTSHCWGMSSQQQKQPCIPPPQLQQRQVKQPCQPPPQ

SEQ ID NO: 964391 - protein, 68 aa, Homo sapiens
MSSPGVKASPATQDRPADRAESSLAETKIFVPAPLGNLRGDEEKKPGVKGAELQINNSQMRRKENADE

SEQ ID NO: 964392 - protein, 118 aa, Homo sapiens
DYRLSKTTADFLKSKLTELQRTHITLLQEHNNALKPIEELTRKESENVARAVLKELSEKLLLAEKALASKQLQVDDMKQTIAKQEEHLITMTILRPQMEDYILILPGFGILTHIVTYY

SEQ ID NO: 964393 - protein, 106 aa, Homo sapiens
RLQMAAVLRSSCDPGSCCRLNRPPSAAAAKPSPADQTARRLHHSADRPALPQASPSIASQRQTAAPSDLDSPGRNLGWPQALDRDPDSWPPPKGSVTLSETYFLPT

SEQ ID NO: 964394 - protein, 72 aa, Homo sapiens
MLIEFYRLQSRLLYEGYEAPPVPLSYTLCLEVNCQSSFCDLTVERYGKHGVSNPSLGLSYCVIRYVNATFVV

SEQ ID NO: 964395 - protein, 96 aa, Homo sapiens
AACIRKQAKSCLQRLALKRYEGTALQLLCQAAAYLDLLVAVCLQFMLDPCQLLLDGALGAVINHFALKGRRLGVPKDKHQILLLALLDLIGCIIEG

SEQ ID NO: 964396 - protein, 61 aa, Homo sapiens
EAGCEEKRHEGSSSESVPPGTTVSRVKLLDTMGDTFPQKLVAAVSYQRFTDCYKCFYQVQP

SEQ ID NO: 964397 - protein, 42 aa, Homo sapiens
AKMLGEALSKNPGYIKLRKSRAAQNISKTIATSQNRIYLTAC

SEQ ID NO: 964398 - protein, 75 aa, Homo sapiens
DLEAPPVSSQCCRQVAEAWVERSSYSYGSGLGSRRWLQSHAVAEAMGGGLSSVGGGSTTIKYTTTSSSSRKSYKH

SEQ ID NO: 964399 - protein, 52 aa, Homo sapiens
RCVDSSGSRPLLQVLSGAQPLGPVTQLLFVAFFMAFCVGCHAYLYHLDVRLL

SEQ ID NO: 964400 - protein, 59 aa, Homo sapiens
MTLMDLNQMDTHMGVKKVEQTRSLVVLEWTPHNSMNGMIIIGIPSCAYGGTDARDFVSR

SEQ ID NO: 964401 - protein, 162 aa, Homo sapiens
QLKESEEEDFSVRYQMKAWNFQRMKKRKRSTEENTTQFENLCKLMKDILEKQVDTVVVSNRLVTSPCCIVTSTYGWTENMERIMKAQAQRDKHNNGLQWQTKKHLEINPDHTIIETLRQKAEAAKNDKYCEGSGHLALLNCASCLTGFSLEDHQTHANRIYR

SEQ ID NO: 964402 - protein, 89 aa, Homo sapiens
RQETWTETLMRKYSDPQNDQPSTWWTCYVKRQYMNKSTYQDLDSEGSPGSHRLQRPWAELSSKKCPQSFAFISVTSFITASSSKQHVFT

SEQ ID NO: 964403 - protein, 102 aa, Homo sapiens
CRVCIKGTETLHFGGHLLSMVKWFLGRQWNHLVQVPESNVLHWEDTKVFRQLCFERLHFWPAGDPAWAQYIADRRDGGFINGRFGKRQKGLLAHNDEGIRFR

SEQ ID NO: 964404 - protein, 42 aa, Homo sapiens
KGTFPEILINYDFFKVQNLDQEIGIVYEANPGVPPATISGSL

SEQ ID NO: 964405 - protein, 113 aa, Homo sapiens
RPQERNSTIDIHTQIENMIITKAKNGHLDYDRPTAEFSVHKAPTGPSQRPMLCIFSSSPSQLPKTRNSQNRDPGTPRSPPEISQILNIPLLREQKRAKSYPKEEAGRATEIGK

SEQ ID NO: 964406 - protein, 67 aa, Homo sapiens
QSVHVIETLTKYQTSVPTEVNSININQGQNHVCRKPRKECTIDFTTGSELLITKDQERAPGCGRHHG

SEQ ID NO: 964407 - protein, 57 aa, Homo sapiens
EHITLALVDGRGTAIPTADKLLYAAVSKAGCFMTVEDQITAVRKFIEMGFIDEKRIA

SEQ ID NO: 964408 - protein, 56 aa, Homo sapiens
PDGTESSQTHIKIDIYSILSMTGGGGGGVLDGRELPPPTELRPPPNGSATDMETED

SEQ ID NO: 964409 - protein, 70 aa, Homo sapiens
EGAEDCGTERLADALKMHYSSFLAGEREVVVYLMVELPPPTELRATPKWLCTLLELEATIQAPTTTCHRT

SEQ ID NO: 964410 - protein, 54 aa, Homo sapiens
SKNGISVESYLSGCFLTYHSSTVGSMCQSVLSSLAECSVRENGVVNGWQIGAPT

SEQ ID NO: 964411 - protein, 70 aa, Homo sapiens
MVELPPPTETEATPNGSATAGTEANSNAKNTATRSSCFLHPGLSHCRHHWNRHSHWKTVDCTTEMLPIGE

SEQ ID NO: 964412 - protein, 71 aa, Homo sapiens
RQAHLNAQPQVTMQQTCCTCTRSGTFDCFHVGTLPLLKSKRQCWVNGCFLLYKPCTLLLLIKSLACCLSEK

SEQ ID NO: 964413 - protein, 72 aa, Homo sapiens
CAICWCQWCRRGLCAWVEEAATPIAVVYGVGWWLQYQQWQEPLRGGLSSIGGGSTTIKYTTTSSSSRKSYKH

SEQ ID NO: 964414 - protein, 127 aa, Homo sapiens
TIQDPLFSESNISDGALHRHQWLWRVPVVSAVALLPGVDGQLAYSSSSVLGCLRWLQSQHWQEPLGVALRALLEAACSTIQYTTTSLLQLGRAISTRRASATSRSPPGPQAPSLAAEPSPHFAFRRK

SEQ ID NO: 964415 - protein, 126 aa, Homo sapiens
TDPAGSPLLRKAHIYWGKQESKPRAGGIMDEEMMADDCAPASVTPTLSGWIPRRMPRHFPHFGNWIGLSLLRLSARLQENEVSLTPSLPCIGVGYITSRGGLCGEGYDGADILYMLPYILGGRRCE

SEQ ID NO: 964416 - protein, 89 aa, Homo sapiens
YWLTRSQFHLHLLIKAIQDTQEASFLLDLDRPVMISDSKRFILFESCHTATVEVETEQKEVLELCQLPEASDRKSSYSHLANPLREFSL

SEQ ID NO: 964417 - protein, 44 aa, Homo sapiens
LVDLYQDPPSPKGNILWCSSTVSSGYSGAECVSAVASRLVWSER

SEQ ID NO: 964418 - protein, 35 aa, Homo sapiens
YSLSYLATVTGSVGSRAQAVTSEDTEHYDLIAILA

SEQ ID NO: 964419 - protein, 68 aa, Homo sapiens
NCRKTRYRAPNYTNLYRLINQIVSSITASLRFDGALNVDLYSEFQNNLVPYPRIHFPLATYAPNMPFL

SEQ ID NO: 964420 - protein, 127 aa, Homo sapiens
SLQDPLFSERHMAALKTPCEARDRSTENPECFIRHQSDQICQTLRRNWRKPRGIDHWVRIRFKGQILMPHIGYGMQSHHNVHMLPRGFRMFLVHNVEELEVLLMCNISYCAEIAHDVALRRRGYRAR

SEQ ID NO: 964421 - protein, 54 aa, Homo sapiens
EQDTKVPVPGYTKVPEPCPINDHYQAQLSRRPSRSNLGAQTSPCRSQPPDARTP

SEQ ID NO: 964422 - protein, 85 aa, Homo sapiens
MIYELFLLEEEVVVYYLVELPPPTETEDTPNGSATAGTEATSNAKTTAIGIAASSTQAYATADTTGTAIATGDGGPHHRDVAFRR

SEQ ID NO: 964423 - protein, 34 aa, Homo sapiens
IRSVLSTSRNTTSECNGYGPFGVFHLGYMVPWKP

SEQ ID NO: 964424 - protein, 66 aa, Homo sapiens
SKNAYQEDIYVLTPKFPRIGPEHQPNGRNTLKPLEFMLQYDAMDRNSLQSAVSHIAQVASVYSPLF

SEQ ID NO: 964425 - protein, 83 aa, Homo sapiens
MALPAGGGGGGVLDGGTAASNRAEATPNGSATAGTEATSNAKTTAIGVAASSTQAYATADTTGTAIATGDGGLHHRDVAFRRR

SEQ ID NO: 964426 - protein, 76 aa, Homo sapiens
LACSRILLADAMVIRDATLTGPSLLHTHRLPLESLSVNPLAPGMVGPAVIINNKMQKKTKKAHKKMDKHQKHHKYH

SEQ ID NO: 964427 - protein, 97 aa, Homo sapiens
WDRRATQTHLGAHTLFLLAAEVVVSLMVDLPPPTELRTPPMALPLLALKPPPKPDHCHKSSIIPPPMPETTDDTTGTAIATGDSGLHHRDIAFRRKG

SEQ ID NO: 964428 - protein, 111 aa, Homo sapiens
MQEFVIALAGFLKTVRESVNVPEWVDTVKLAKHKELAPYDKNWFYTRAVSTARHLYLRGDADVGSMIQDLWWTLRQTALMPSHFSRGSNSVARRVLQCPGGAENGVTRMSR

SEQ ID NO: 964429 - protein, 68 aa, Homo sapiens
IARAPSVLSISGPRVHDALVQQSWISTLMVQLTFQEFLILDDKDGRGSPQKKPWKKATKSSSDYMPLQ

SEQ ID NO: 964430 - protein, 84 aa, Homo sapiens
MYKCRAVKAARRVEPVSHRMEQALCALASLIRIHPVRGPFSFPDLLRKAVRALTNSCWFTFSYSISLHCAPSALVCQGKGMRSG

SEQ ID NO: 964431 - protein, 56 aa, Homo sapiens
MEAELEDERKQRSMAELAARKKLEMDLKDLEAHIELAPNKEPETKLIRHACGTLSG

SEQ ID NO: 964432 - protein, 86 aa, Homo sapiens
SKNSPRWTAQSARPTSIPKYARYFSTAKRKFIIADTTCAMSRYTRNMATECVHLMTCAIILARRPLRACETHDPVVTDYIASIARA

SEQ ID NO: 964433 - protein, 35 aa, Homo sapiens
MFSLSTSGFRGFILGFLSSCLIARHSSNFKHTIVP

SEQ ID NO: 964434 - protein, 65 aa, Homo sapiens
ESISTYDISTHLASQGIHLPTYVGYYTYTGKAKTTYLLLQSSIYQVQHLGPGYSIRTRHPDDRTI

SEQ ID NO: 964435 - protein, 76 aa, Homo sapiens
SQALTYSDKPASGIISYIGSERMTLLAPLNSVFTDGTHSNDAHTRNMLRNQIIKDQLASTYLYHGQTLETLGGKKL

SEQ ID NO: 964436 - protein, 113 aa, Homo sapiens
MADQVHGQVQVTSPHRHLPPTMDYYRAYILLLDRYFYTGKTDPPIRTLNLNLQVNSRTGYSYSTRHPEQSHEMSASTLHDDRYNSSTTYLSAEIIRGQTGIVQSAEGHKALST

SEQ ID NO: 964437 - protein, 82 aa, Homo sapiens
MAQMGDFHKGTDGTLQAWICCKVRLMAASTHVDVGQSAHGGFIRQGNAVVFSGLHSEGVLPRTDRATHLVQVGGQAVVEIRH

SEQ ID NO: 964438 - protein, 110 aa, Homo sapiens
MLIVTIAIHVGMDRVHVRMTAPSQQHPHHRWIVVRLEELRWNVLFPFPAVDSVIFAMVDMALDAEYTVLHIRDPPARVVHPIHQALRHNDSSLLSLHTNYYTTRKIHPPH

SEQ ID NO: 964439 - protein, 147 aa, Homo sapiens
HIHIDISSHTGHQQDIPTPPHGIFSPRKLALHSGSRSAYPGISLRQSELIQHPEQARRCQASTLWRKASSFSYLSLKSSTDSLKLSISRMTRLYTMVAVRILSRKTTTEGLVIGAVVPLRDSWALLQVPVTDLQLQVRVGLLQGAHL

SEQ ID NO: 964440 - protein, 43 aa, Homo sapiens
ASLLRRGLLQVGQLLLQALNLHLLDRADLEMQIESLKEEILSV

SEQ ID NO: 964441 - protein, 75 aa, Homo sapiens
DRTCLYLNDIDSLGCSQYWIMINIITISSSTMVCRFFGWSIFPNMSSTRESYSSRTWSYLIELVAVANASVEIRH

SEQ ID NO: 964442 - protein, 49 aa, Homo sapiens
AAAVTLAGSRISNITMNIDVEEKLQYMDIFKLYLVQLILTITTVFLAIV

SEQ ID NO: 964443 - protein, 79 aa, Homo sapiens
RLYEDPQGTHLQVRLCAELSGTRVTATSDPSSSGVLEIVAGDKGLGWLCIDCDRRELGSNGGQCLSYGLDTYRIHYYPQ

SEQ ID NO: 964444 - protein, 86 aa, Homo sapiens
TQEDPLFSESNISVVQSTVSRGYGGASGVRTWLYGLVDGMQPSLLVAVWSCAVGEWRSGLPATWTDASCGRWPAVSRMDGEHVPTT

SEQ ID NO: 964445 - protein, 51 aa, Homo sapiens
KKYIKDYMNSIIGKLEEQRPERVKAFMTGDEEQIKHILAKYNKNYQYLYLV

SEQ ID NO: 964446 - protein, 85 aa, Homo sapiens
VIIALPARNRRCLVYLMLELSPPSEMSATLNGSATAGTVATSNAKTTAIRVAASSTPAKATADTTGTAIATETVDCTTEMLPFGE

SEQ ID NO: 964447 - protein, 88 aa, Homo sapiens
CEYLLDLGQMHADSDLCSPPGMYIQEYLHAELGLQLNLQVLHGAPELRNLALAATEHSSLQVATYAIIYLDLGQMHAVATYWSTYKAV

SEQ ID NO: 964448 - protein, 50 aa, Homo sapiens
CCGDLEDPRQLLCLGEEPFLDILRFFSAIFSYWVTHLVQNAAQVHARCSV

SEQ ID NO: 964449 - protein, 87 aa, Homo sapiens
ASQGSTHSQTEITSPEEPCMMHELSQMQTHITNTSVVLSLDNNRNLVLDSIIDEVNPNMIEIAQRHRAEAESWYQTMYDEQQVGVSK

SEQ ID NO: 964450 - protein, 45 aa, Homo sapiens
WWNAARAPLHPIGSQYPRILVLSLQFPLGFHVFLVPSQASWMAAC

SEQ ID NO: 964451 - protein, 80 aa, Homo sapiens
GAGGQVDALMAGDYLHEAVLDAELSQMQPLVSATSVVLSMDTTRYLDLDSIIAEVKAQYEEIANLQPVTEAESWYQTKYG

SEQ ID NO: 964452 - protein, 56 aa, Homo sapiens
MCLGCGGSMSMWTLACCSLCCGPEPHLNELRDQAVLQGCFHAALGLQLNLLVLTWC

SEQ ID NO: 964453 - protein, 112 aa, Homo sapiens
AAIISWIWVPAACEASFGLLHGWTPCDALMLSLVTAAHSPVFCMVRQSSEISALAALPLLAVGAPPRWPAPLSWRRTIPRHPMRFFSANLLILGHASRTECGSVPRQVHAPQ

SEQ ID NO: 964454 - protein, 51 aa, Homo sapiens
MACFHADAGDCSSISRCCMQNRPLVSSRLYSSDAFMLSVGLQLNLQVYRAR

SEQ ID NO: 964455 - protein, 51 aa, Homo sapiens
MRDMYEKMAEKNRKDAEEWFFTNDREQLNLRGGHQAAELVQSWQRAEISGA

SEQ ID NO: 964456 - protein, 57 aa, Homo sapiens
MTLVGSRLWLLTPLCLVCPALAYVDNAYWLWTFQWTPPAEEQQGPLRATLRVARPVP

SEQ ID NO: 964457 - protein, 38 aa, Homo sapiens
VVERCRLDSELRNMQDLVEDLKNKYEDEVNQLDGSVPQ

SEQ ID NO: 964458 - protein, 61 aa, Homo sapiens
ILDDQCTAVGLMDLTSQPITKMCKNNAPVCEPFPCPLRPSRHRQENARALLLMRVLEGLMD

SEQ ID NO: 964459 - protein, 81 aa, Homo sapiens
PDTAITAGSIPLRIALSSPTTSYTVTDEVNEPTPTIRSTWPPVVLNLRVHRLRRTNLQLLHTSPIIRENQASCDSLTLTIK

SEQ ID NO: 964460 - protein, 78 aa, Homo sapiens
MTDKIHPISESPTFSICIYEEFFYACLICYRKQYRAYGNGLTEFWGFSISFLLDSVIEGIKTSPPSLSPQNVLDKRVL

SEQ ID NO: 964461 - protein, 86 aa, Homo sapiens
QRIPIGRGYTVPKGNQMHQAAQFKGQLDTLMIWKHVMMYPNVMYHTPFLQGGLIILEGKVQRDYKMKTDNTTYTLWRYPTHTMHVL

SEQ ID NO: 964462 - protein, 77 aa, Homo sapiens
LYTGTELSWSLVLHCRIVLPSGHILHIADDFTDHSLTISSLGLPVVLIYEYTDYRGLIFNSYILPPLFLEGRRAETP

SEQ ID NO: 964463 - protein, 81 aa, Homo sapiens
RVYLTERRRDEHKASPFQSLSSRNKLRLDVDESTQTLFSAVIRRIVPLLVLPLNVEADSPCLSVPPTPRGRSKSHLVSSLG

SEQ ID NO: 964464 - protein, 44 aa, Homo sapiens
VVSGDSKNILFVIHKTSMSTIAHASDTYIVYGEAMIEDLSQIST

SEQ ID NO: 964465 - protein, 78 aa, Homo sapiens
IRTISSSGTVSSWKKMALVDSKGFDEYITELGVGIALRKMGAMAKPGLYQSLVIGKTPHHIKLQSTIENKQSFSLYPE

SEQ ID NO: 964466 - protein, 40 aa, Homo sapiens
GILPDDASCGAVQRACCAVKEAGIREQCVLSEEQIRKKKM

SEQ ID NO: 964467 - protein, 77 aa, Homo sapiens
QQASENTQGKRTQDSEGDRERPQPIRTMRTSIRPTWARQPDQDMPHKRIRVDTTMADLMPSHRHLVSSLVHLVSSSW

SEQ ID NO: 964468 - protein, 91 aa, Homo sapiens
VSNIPPSRAYVRMDRSTEEATFISLPEKPGDSEDTASAASLLEEQQYSPASPGSSSKLLTQLNKNLSLPSLQSATLALQHLVLLRCKRGSS

SEQ ID NO: 964469 - protein, 130 aa, Homo sapiens
WLYSAEISVVGEHAMPEACALKWFRDNQYLGAPSSQNPAIPTPPPSTRSLNERAETPPLPIPPTPPDIQPLERYWAAHQQLRETDIPQLSQASRLSTQQVLDWFDSRLPQPAEVVVCLDEEEEEEEEEQP

SEQ ID NO: 964470 - protein, 75 aa, Homo sapiens
RGKDKIHTGKRHGLRGDWEGPQAIQDHADEHRPMGPSPRQDMPHKRIIVDTTMAVLMPCHQHLVSSLVHLGLFSW

SEQ ID NO: 964471 - protein, 39 aa, Homo sapiens
MAVWLLLLCQGLLKAIHFRKELVNAQCAKFIDEQPYSHL

SEQ ID NO: 964472 - protein, 77 aa, Homo sapiens
MTRMMLYLVAQHSSLLKRNKGTVKDAIVSTALHVEPENYFMLLSLMVGNRYGAQTRIDSSHIDCKATPLTLYGYYCG

SEQ ID NO: 964473 - protein, 38 aa, Homo sapiens
VINSISEVLSAELPVFSKGFKYLKPFPYKKGSTTFIRA

SEQ ID NO: 964474 - protein, 159 aa, Homo sapiens
IYTTLCHRVGITKRSRRCMNPTTIHKSVLGGKFGVHTERQDSAAVGFDYKEKLAKHESQQDYSKGIGGQYGVQKARMAKNASTFEDVTQVSSAYQKTVPVEAVTSKPSHIRAQLRNPRYRTKQQEDRRKAEAAHAQRMATERQAAKKRQEELEDKPQHN

SEQ ID NO: 964475 - protein, 87 aa, Homo sapiens
MRQGLDVLGQQVVMFHAPVPEYAGGELVVSDRRAGSVPSSPSPRWAFLYGDEAVEQDRASGCSYVFEVLQDGDNGLQGNMVGQNHKY

SEQ ID NO: 964476 - protein, 101 aa, Homo sapiens
FVVLAHWRSHSPYISSSHAPRVFLVIEAHGYARACPFLRLASLYRSIESWPAHPSLPGFEASGSFIFLAGRTSQSSSKEPHIHLAVVNLHLIGVVWPTQSV

SEQ ID NO: 964477 - protein, 44 aa, Homo sapiens
MFLRVLDYPSARELFVETGSSCVHEKKIGLFHCGQSSNESRPSS

SEQ ID NO: 964478 - protein, 97 aa, Homo sapiens
SEYQLMDWIPNAQCPVLAVLACFQSALPTRGRLAISVFFKGDKHWVLTEAVLEPGYPKHIKELGRGLPTDKIDAALFWMPRISNIIWYLSIARTTNI

SEQ ID NO: 964479 - protein, 45 aa, Homo sapiens
VKNCTLNLMQRTAVGQLSLKSGTLTYTVCCRSFTRVFIYGQNHKY

SEQ ID NO: 964480 - protein, 50 aa, Homo sapiens
PSLRKATSLWCSPASPVAMAVPVVSADGSRPGLDGMQLLAMAVCLGCWKV

SEQ ID NO: 964481 - protein, 92 aa, Homo sapiens
LSEDPLNCCTVDSMGLDQGDWSCCSWFRVPQQQLAGTWFMPCLRCLVLRSTPCEVRLGAAAEQTKEALLWLHAQKTVICACLSLYMSITRDF

SEQ ID NO: 964482 - protein, 84 aa, Homo sapiens
SERIKSLWLQSTVSSGYCGASGCRQRLRPGWRKQLLLVLVVLALDGGCQFPAVAEPLGSGLQLLLESGSFHPSTYTTYLSRSQQ

SEQ ID NO: 964483 - protein, 45 aa, Homo sapiens
PPASARRHHRSSSSSSSSSKSNSDLGIETARVTLAAAAAATVVAG

SEQ ID NO: 964484 - protein, 53 aa, Homo sapiens
PDAQPPPAPCLEKSVEAAAELSAKDLKEKKEKVEEKASRKERKKEVAAARGWG

SEQ ID NO: 964485 - protein, 38 aa, Homo sapiens
KRSGTLSSICWIPHTQYSITIYVGRWGQTAQGGAPGSG

SEQ ID NO: 964486 - protein, 117 aa, Homo sapiens
LLSERHMRRGPARLTLGLRTVRPMMLAGRTLMLIALPARSERGGGVLDGGTAASNRAEATPNGSATAGTERHLQRQDHCHWSSCFLHPGLSHCRHHWHRHSHWRRWTAPQRCCLSEK

SEQ ID NO: 964487 - protein, 99 aa, Homo sapiens
SVGTWLNAMGGGSSYSYDSGLGVGSGFSSSSGRAIGGGLSSVGGGCSTIKYTNTSSSSRKSYKPKVLLLAHGHTVLKAQSLTAEPSPHVAFRKRGDPLK

SEQ ID NO: 964488 - protein, 75 aa, Homo sapiens
PSTAPRKWKEEDSVGTRGPWKHLRGPPAMGRPHVDTFKTSRWAHHSPPYIFSMVAVIWTWFNFQSRVSRRGSGDL

SEQ ID NO: 964489 - protein, 82 aa, Homo sapiens
CAMVMYADVTTATLFSLAMAGCQFSGMMLATLLHWGGPWLGGTSRLAEPCPPPLARCSDCRRTQLRASRGRLLAGGRAVARG

SEQ ID NO: 964490 - protein, 91 aa, Homo sapiens
MVLWMVRKQLLLWTVLLGGWKWRSDSCQWTQPWGVASALSEAAVHHHATSPPPPPAGRAISTKVRLLALGPTVLRPLSGCRALSSCCLSEK

SEQ ID NO: 964491 - protein, 79 aa, Homo sapiens
PDAELPQFTKLPPSPTFKLEVLTSSIPGAVDEMTSWNGIRTVKKSHYYHEASDAGHDGNAMEHDLPHAPRHMHPLVGVP

SEQ ID NO: 964492 - protein, 53 aa, Homo sapiens
AVVQSPEFLLHGCDNAQDAIKSPRSLTMHKRVVFCDSLLHLSSCQLYQEAQSK

SEQ ID NO: 964493 - protein, 39 aa, Homo sapiens
MLREEEYVAPPRGPLPTNTQDGPRTLSCAVDENLSIPRN

SEQ ID NO: 964494 - protein, 68 aa, Homo sapiens
MPTQPGSLGSSLWLLQQSPCPLQRQWWPGWLHVERAGFGSRSLYGLGGSERISIGGGSWPRGGVPETR

SEQ ID NO: 964495 - protein, 33 aa, Homo sapiens
ATAAPETTSIAGRVSSAVLVGPVLVLVCLLAGA

SEQ ID NO: 964496 - protein, 59 aa, Homo sapiens
MHSLLPKPQLTAASIAPSCSPGHKPELNMVETPLASYPAGKEPPPETTYHSVADGATAV

SEQ ID NO: 964497 - protein, 53 aa, Homo sapiens
ACNVLPLQWRSLGAPQAIQTAGCKASPPHAPPRPPLPLELVTLEMLLKPEWMT

SEQ ID NO: 964498 - protein, 53 aa, Homo sapiens
EYSAPSLYDAISPGHHLTLPVTYTVNLSQTLGHFILPFCGHSCLLGGARWLGG

SEQ ID NO: 964499 - protein, 75 aa, Homo sapiens
TTIHYNYMCNSSCMGGMNPEAILTIITLENSSGIYLGRNSFEVRVGACPGRDRRKTKETLRTKGETHHELPPGSP

SEQ ID NO: 964500 - protein, 60 aa, Homo sapiens
MQTWTGGVHELYGQSSPETRRFVCTSTDLQRGEHPLSWFPHTQPFSDDKVFGSLSPIRGQ

SEQ ID NO: 964501 - protein, 71 aa, Homo sapiens
MQLTLYISSNLRAADTQLQHDGRESKAGRRWSPWGRPPSQINYELFNCGNFNIRYWSWNYRGCWHQCCMDT

SEQ ID NO: 964502 - protein, 79 aa, Homo sapiens
RGVTRLRVAANCLISPDSPVYCLTAACNEILGTIYISGNCPGHVNDLKQYSSNSMYMNYNPKSNKIQFLAQVYCILALI

SEQ ID NO: 964503 - protein, 32 aa, Homo sapiens
MKGEIGTLAGVRSSSLADVHLDEVSLSPQTTW

SEQ ID NO: 964504 - protein, 38 aa, Homo sapiens
VKHERIRILGSVIVPQLHLHLLTEAFHGCTGSFFLLIL

SEQ ID NO: 964505 - protein, 92 aa, Homo sapiens
SFHRLMSGQYDYCVITVVIFTVILAYERIGIHLSPYSKDVVQDNYNSFLSTAVGPPGSLLYIRASIMSISETGRSSSGKTHKGNLCRAVGRI

SEQ ID NO: 964506 - protein, 125 aa, Homo sapiens
NQLRHIRRWVQHLPWNRHARTRMLYEDEVLIFKFHPIDGLANSAIMACEVTPLHTYNPGNILCKQDTLKPNPFSPVLSTRKFSAVIWDHCLQTASKETRPKGSPSHGTVEAHGGVRSDRTNPIAL

SEQ ID NO: 964507 - protein, 32 aa, Homo sapiens
MAWGENVLITRSTDNEDTETDGKRVSNILLAG

SEQ ID NO: 964508 - protein, 188 aa, Homo sapiens
MAEWALVVTAGRESAPGYGVPAIPKDPNLRCEEITIPMCRGIGYNMTSFPNEMNHETQDEAGLEVHQFWPLVEIKCSPDLKFFLCSMYTPICLEDYHKPLPFAGVSEREPARDAHPSCSSTASNGRREWRASTCPLHGDPDNLCMEQPSYTEAGSGGRSGGSGGSGSGSGSGGKRKQGGSGSGGSGAG

SEQ ID NO: 964509 - protein, 69 aa, Homo sapiens
KSGRHQCSIDLKKNVLVIGTTGTQTYFLPEGELPPCAKLVSGTGQDESSDKEVADTIKHSVMNSGRKKH

SEQ ID NO: 964510 - protein, 39 aa, Homo sapiens
MADCGHIFHDTKVVMDTLARVLSSWMVQEALLMILLAGD

SEQ ID NO: 964511 - protein, 115 aa, Homo sapiens
AEWHSGTEKCLPAQYGLFLGTSLGSVLSTGETQLLSVRVWTICVFHLVMVHEAQSLQGIALGSHSSTPEELRSLLPENTFTEDGRFTPSSSQISKKFSSVTSSGALKKCSTLLGC

SEQ ID NO: 964512 - protein, 39 aa, Homo sapiens
IRKSPVAGCYLAASVSCYYWETISIWLCPGTFNILLAGD

SEQ ID NO: 964513 - protein, 80 aa, Homo sapiens
AGDLYRIPQQEWHSVAILTESEHFGYMLLSARQLVFLVVLSTLAFQIKYQCPLFLSVEELLNTFNVLIFIITCSYPIVLI

SEQ ID NO: 964514 - protein, 35 aa, Homo sapiens
LFRGAVQLQNSSGPERIRIFGSPRSHSSTFIFSSK

SEQ ID NO: 964515 - protein, 149 aa, Homo sapiens
RGSKSIQDLQNRHLYTTTGGETEFTNDDLPPTAYYITSVLSEDNSIQTMITFEQGGRWTAPEEDLKTVNVMLQQKTRMSAAFIFMLPESISQKLNVPMAPLSEPNAVSIVIAHGSVRDAISVMVPDVSISDDGGYSWTQMLAGPHYYTI

SEQ ID NO: 964516 - protein, 68 aa, Homo sapiens
ARMAYQETCILFIRIFRITLSCRRPAKAMMTFCLIQVLTGFFRVCVNNKLYEYVFLCDTNPYRDYGLG

SEQ ID NO: 964517 - protein, 47 aa, Homo sapiens
AFLAQRRATEKATRAGCHAPIQATYAQASAGSWRGSYLGSANLVPYC

SEQ ID NO: 964518 - protein, 159 aa, Homo sapiens
RISRGEESGSCHKPQDRTLDPFGLPPRNSMEIRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFR

SEQ ID NO: 964519 - protein, 75 aa, Homo sapiens
ALARHKSSFLQVVSLSRIMTEPSMSAGASSWRSAYNRLDALKKPLPLYIQRVHAGDIVTWDVAHIPGGQGSSLPP

SEQ ID NO: 964520 - protein, 74 aa, Homo sapiens
DCGIIWRTGAAAVVRLYLRDIPGPEKKLSEFRMVASLRGVHGLSAMISPSRPRQPTPNVMGKVLGACSASAIGP

SEQ ID NO: 964521 - protein, 80 aa, Homo sapiens
WGVPSDIDLGVRLCCEADVGTVEADRRQRLGPGGATKMHELGLDEVELEKVQDLDREGWEAGAGSNEAIVTIELCLWRLL

SEQ ID NO: 964522 - protein, 124 aa, Homo sapiens
YTIFPGGRRGPPTVFYIFVMSLSSVLRLESSSIGCSFPDCLRPAPFPLVVIAMALARDSGNLVHPFMRVTELDDEAFGYLKRVIVTPAVYPRFIEFLHFDIQSTGQKSHRVNTRRGPSRCFVLI

SEQ ID NO: 964523 - protein, 67 aa, Homo sapiens
EHHILGRSKPCRASIISTTQVQQTLYLVSRPLDVIAGYNTYRELDQYFLLNSDLNFQHCPLSLAERP

SEQ ID NO: 964524 - protein, 97 aa, Homo sapiens
EPGEHHFSDAKDRVGASVISTTQVQQRLLVFALSVLLDIIVQGLAVLSLEFRPNFQHVHYHYRETMILIRTLSRVPLPFMDVISTDQQNTGACFECT

SEQ ID NO: 964525 - protein, 93 aa, Homo sapiens
MMRGDYNQASYSKDLYPLLPSAFMNVTRINFARIAQAYTPVIQTSYLRSAYSAHPVYVPQYWEDSIGRGDEPTVAWFISFFVCLVMSKFNFKF

SEQ ID NO: 964526 - protein, 37 aa, Homo sapiens
MLAWMLGAQVSIMNYEEYKHCWDTFVDHQWMSQQSAW

SEQ ID NO: 964527 - protein, 33 aa, Homo sapiens
MGQQSQTETTQKYHLAFMMVTNVAKMTRVNKRL

SEQ ID NO: 964528 - protein, 40 aa, Homo sapiens
SRVIPQALVGEGQSSAHISVSGNLRTFVCLHEEDSCRLVA

SEQ ID NO: 964529 - protein, 58 aa, Homo sapiens
MAYQQSSVEFVVLYLMNLPTILRLIQVCAFSCSEDARLVSGVLTMALLAKLYLVHSLC

SEQ ID NO: 964530 - protein, 42 aa, Homo sapiens
RRVLGHGVSAKTKDGVREVQKLAYVKSCAAKVYVRENTIWFP

SEQ ID NO: 964531 - protein, 117 aa, Homo sapiens
MPTLEDTLHLRNKVEAIEIDNLAREICSRMANDENIISRHIKQGTNPYTFCIMNQLEITLQGEPKLRPPKPDYYLRTAKRAHPVYVVTIDVKIHRSRRRTYRAGRWLVVHDRILVQL

SEQ ID NO: 964532 - protein, 82 aa, Homo sapiens
QLQQLKEFEGKTLGVSHQQKAWYFQRMNEEKKKQEEKKTKFENLCKIMKDIIGEKKLKMVVVSNRIGDISIAVVVTMHIMAG

SEQ ID NO: 964533 - protein, 36 aa, Homo sapiens
SHTALVSSAVGVIFINTQTKFIIASRSCKHVSGDLS

SEQ ID NO: 964534 - protein, 73 aa, Homo sapiens
MYPQGKDEREIITKHHIARTNPYTFCYECTRINFARRAKANTPVNQTSYLRYCLESRPVYVGQQCEDSIGRGD

SEQ ID NO: 964535 - protein, 70 aa, Homo sapiens
MTRTTEMQGVTEKSYDVNSSLSHDVSTDHQSALCFNGFFWTLALEYEIDPSSIGGDCQRSNRKEYRSMPE

SEQ ID NO: 964536 - protein, 33 aa, Homo sapiens
TVNDASTIRYRPLIKVNDTIQIDLETGKITDFI

SEQ ID NO: 964537 - protein, 63 aa, Homo sapiens
EDYAVINPTLDYSVSDTTDSRTTIICMNKRNFNSSAAQSGCPDPTSMCRKPYCMIWTLEKDNA

SEQ ID NO: 964538 - protein, 47 aa, Homo sapiens
MRSDPTLLWLWHGPVAIAPIRPLAWEPPYTMGVAQEIARFYVPRVLC

SEQ ID NO: 964539 - protein, 92 aa, Homo sapiens
MCSRGSRNTKAVVSAAGNHSKRFSFAEKADFGLKKPCVHWPCATDPRASSGGPHLGPSSETAQNALLGAAFCKGKLGSGNKPQPRCGLAAFV

SEQ ID NO: 964540 - protein, 110 aa, Homo sapiens
CNRPPSRMCYFSALRNEATLRAKGQEVSLLSCVPAITRTIKCAHERSVHLFIDSVLHPGMQSTAYLCKDMDSFSQGLCPSCKKGRCTTLGYYTHQEQQSKKSKSLFLMTR

SEQ ID NO: 964541 - protein, 72 aa, Homo sapiens
PIPIRKPVSTPLEPSSASYGADITRREATTLVSARGDHTKDCPQGAPVMAQWLMNLTRNHEVAGSVPCLWMS

SEQ ID NO: 964542 - protein, 76 aa, Homo sapiens
ENYGYPPQLRSFYFPARMIPTSKYLINNLTSQHPTMTRVKAEAQEQDDNHTQDKRTNLISYTSILNHLLLPFLFSS

SEQ ID NO: 964543 - protein, 44 aa, Homo sapiens
RLLEDPPPPPDSPILKDCLTYSLQVLETLRSIIAASSRPPHSLC

SEQ ID NO: 964544 - protein, 70 aa, Homo sapiens
RLHGTPFSVQQPRTGNSQHHASHQPPSVYPQGLQQYTTVGYLHAPLVSDCCGRELLMSLLVMSYLKVEAH

SEQ ID NO: 964545 - protein, 43 aa, Homo sapiens
GSTAPRAGGHLRSVISLCTTHSPAAARCALHADLSDAGCRAGL

SEQ ID NO: 964546 - protein, 62 aa, Homo sapiens
LCPYYAHDRKFGIAVRLAIQAYARREITAILIQYPLKLHRRSRSHNRPRGLQSSSHVGVVPE

SEQ ID NO: 964547 - protein, 70 aa, Homo sapiens
ELGTDLGQRCCLGRPGLAYPRSFYTLYPHEDPVVAIGACRALQSLFGEISTCYGACSHEGEAVEHCQREY

SEQ ID NO: 964548 - protein, 112 aa, Homo sapiens
KLGTGLGRRAAWDGQAWHTPILYTLVPHCKTRGWLEGACRGLRLVWGIEMKLWSQLPGRRSRGTLPERILRIRGIYQLHSQGLKSKGLVVLEATVWGESHGARKGKKESRVQ

SEQ ID NO: 964549 - protein, 108 aa, Homo sapiens
IGSVPVSKASCEHGRVRLRSPGRASPIVFTRTFAASSVGTSRAWLRSLLLPSEHDDDRGFSMVIELLQSIAPPQHRSGAWLGQTPGGPPLHHDSTWVGMRRMDRDAIR

SEQ ID NO: 964550 - protein, 59 aa, Homo sapiens
PAPWISFFAFLAPWDSPQDWGFMDHLPLTLQALTVASVDASDPQYALLAMFHGFSFRGA

SEQ ID NO: 964551 - protein, 82 aa, Homo sapiens
RRAVSFTVHAVITSSSHSPIIYHMIALQSIFICGFTPSSSFMEYSCFELSSEPTSFWVRYLLDCFFDYCRMRNARPVYRLMC

SEQ ID NO: 964552 - protein, 68 aa, Homo sapiens
RCTLDSVISQSPEYPPSWEPGIYTQISQCSQLRSSPLYEYIQATEISIPPLIDVAYILTPAKASCTGQ

SEQ ID NO: 964553 - protein, 114 aa, Homo sapiens
GQCAQRAPRPLYKYIRRAEIVEYLPLSDVAMYLDTVPKLPSRENEKHWVPSDNSEVSRLWDTSLYIRMSLASEILNYAHFTHFVASAFMLPLSSSLHDVFLLLFVAAVDRGDPL

SEQ ID NO: 964554 - protein, 119 aa, Homo sapiens
VNHVPYRQIRRIRHPYPTALTVNAIHGSGALPICVPPHHRLHIVVGIPRSGHSLHQQSNRNRPRVMSAHSIVHSIRTPRRKNEEKNAPHKETSYAFMLCMKELRAKVVALCSFEDSAAI

SEQ ID NO: 964555 - protein, 107 aa, Homo sapiens
CAPALYEYIQEQRSQYRPETIHIRGASLKGRLLFIGWIKVDGDTVYQAKPKDSAEPALLPTDRAAVDDSDDNGQGQPDPEQQSISMIEISGAPWAPFNIHIEGNASL

SEQ ID NO: 964556 - protein, 70 aa, Homo sapiens
NHDRRQHEGVNRGTAKSGRYNPRKEKGHVAGFCEPVHSSALPAVPDALQRLSMRYIQEAEHLNSPPLKLM

SEQ ID NO: 964557 - protein, 41 aa, Homo sapiens
WVRLVPSDIALLGSSPGSSRRTAVWISRDLIGATLLVVVRH

SEQ ID NO: 964558 - protein, 108 aa, Homo sapiens
MTCKRNYISTQHQNVYYGVALRAVGGYQQKGSYHQIASYHDYYACYLKCNEKANFSVLTDLPVAPVTAGCAFSSHQETESRCSLSQNSRLSSDILIRMTLYRNRNPVD

SEQ ID NO: 964559 - protein, 60 aa, Homo sapiens
QQTASLTAQRHLSLRIKPIANLHPAPRPASATPRLSESLHIIHRDRVVIVHPGPPSSSLS

SEQ ID NO: 964560 - protein, 54 aa, Homo sapiens
MGRGNNRGGDYRCCELVIGNYAYLVRFGLGGVGAGLARKKARYGDSAVCDARVE

SEQ ID NO: 964561 - protein, 77 aa, Homo sapiens
ILVLIALTLPIILDVPHEVNGHAVSFASVGVNGAETEEYTDDGGLIFNSYILPPLFLEPGDLRLLDVDNRVVLPIEA

SEQ ID NO: 964562 - protein, 98 aa, Homo sapiens
GTLGVWKHNMNAEPRMMKTVPYHNDHEAQQTTPGLQTTVSVSSDIGAGLSGSQCFMKRLVQSPVLHLPGITLLSRRAEGEVTALDNGVITLGAAAGLR

SEQ ID NO: 964563 - protein, 159 aa, Homo sapiens
GPNPSHSPSLKNRKPSRIPARFTTVNESSSVHLPGSDHIRKFTKQDRSHSFSYTRHCTIETNRVSKEFIEFLKTFHKTGQEIYKQTKLFLEGMHYKRDLSIEEQSECAQDFYHNVAERMQTRGKVPPERVEKIMDQIEKYIMTRLYKYVFCPETTDDEK

SEQ ID NO: 964564 - protein, 82 aa, Homo sapiens
MADQLTEEQIAEFKGALLIVGQKMTMAPSQQRNLERDMRALGQNPTEAELQDMINEVDADGNGTIDFPEFLTMMARKMKDTD

SEQ ID NO: 964565 - protein, 127 aa, Homo sapiens
MGKNDLQLRHIKRPEGRKPSDVAHKSIGASWWFGYQKQNGLSLGHSTCREEVFVEASSGTEDIDSQKMLCVPRALYEELLSNYQQNRNEMRHLQQELERTRRQLVQQAKMLKKYGALVSEMQELRDL

SEQ ID NO: 964566 - protein, 77 aa, Homo sapiens
RRWIVKIYKKHREIKLSGKEHQYKLSVTAYDCGKKRATEDVLVKISIKPTCTPWVADGTTVIEYEPGHARGRLFQNI

SEQ ID NO: 964567 - protein, 82 aa, Homo sapiens
IIVSKKPGCVYRGKMPRFALQDVGVDLVCDRWNGEYTCRCFWVALVCISLCSHARVCVGGRMCTTECTRGDFQSQDFIIVIV

SEQ ID NO: 964568 - protein, 129 aa, Homo sapiens
MDLAFVVLGIHDDWQVGRHVHAPDRESEKSPAAEYAPELKSCSTRRRSMGLSPSCREPTPFSSVSLSVLSLSFSRYGIRSFSVQCKNLCRWMSAAQVVRMSMAVRRVCLRDGTKTMTGFLGECLVIAWY

SEQ ID NO: 964569 - protein, 66 aa, Homo sapiens
TSLGRVAAPTHPGWDQDHQHFSITRLSQDGVGGRSMCKGAKDTLMKATGSHTPLGCCLGRKALVIP

SEQ ID NO: 964570 - protein, 105 aa, Homo sapiens
MEHRGKEGRTAPKMSCATADESAQADCSVYKYILYLYETKLNLCLPGSSNKPTSDSRVAVRCTTLHPDNLVFNSRDGVSPCWSGWSQSDLVIRLPLPPKGLGLQA

SEQ ID NO: 964571 - protein, 34 aa, Homo sapiens
RYHISRGVGPLHQYASTGAVQLSSPVADYSDLGY

SEQ ID NO: 964572 - protein, 37 aa, Homo sapiens
SFDQDPPRVVFGFEASGSFIFLGCESSRTQSSLVTVT

SEQ ID NO: 964573 - protein, 94 aa, Homo sapiens
SAYLAKGDIVVEAWADLLQMPLSLKESLPLYVVADVDTLLTVLVGIFFPSVTGIMAGSNRSGDLRDAQKSIPVGTILAIITTSLVYFSSVVLLG

SEQ ID NO: 964574 - protein, 51 aa, Homo sapiens
YGPVPYRYQPMTGIFSCTEGPKLHLSPLAQVIKSFLGYELLTGSNLALDSI

SEQ ID NO: 964575 - protein, 90 aa, Homo sapiens
LLSRYIGPTFKCLQKSEDVNVHLVATITPKHVTKNNNQNNKQKQRNETKKLPVPTTSRCRDEVLTSLPQRGFLSGMSVKKMAAPWPGSKL

SEQ ID NO: 964576 - protein, 59 aa, Homo sapiens
RALLVSRAQELCSSSLQPYGVSASFYAKQLIPSHLWSFLVLLFTTFPTSPTPSNLPRAQ

SEQ ID NO: 964577 - protein, 91 aa, Homo sapiens
GERVLHQQDGQVGSVNVQPADKVAALSMLSNSTSSLTLKRQYLGGKSVSYIAERLSFLQQAWEGTSSSGAFTACKQEGDQASSHWQIEYET

SEQ ID NO: 964578 - protein, 63 aa, Homo sapiens
MDQLRLLIILRKAAEEAWHADLQGITIYVAQDRTADNSDDIDKQSATMTSDNADDKAAIILDP

SEQ ID NO: 964579 - protein, 61 aa, Homo sapiens
EEGRSAYDLMVMLAKRIPGWSECNLVMKVAVGLALTYHTVDCEQGFVRRGSQTSMPVCHGH

SEQ ID NO: 964580 - protein, 34 aa, Homo sapiens
LDFRCNVDWSKERPPYRVCENTSLSLGQQEQYQY

SEQ ID NO: 964581 - protein, 86 aa, Homo sapiens
YFRVNTDAEIISSKKGHVRKMLRHADASAIVEYAYNDKAMYEKQRNMLTEELNGNIIAAFTSQQITQLWTKCKRYSQKNKNIFWMK

SEQ ID NO: 964582 - protein, 40 aa, Homo sapiens
MRCNYYTNGGLKREYYSIVIVKESQVRLVLGLMGERLSAL

SEQ ID NO: 964583 - protein, 61 aa, Homo sapiens
MSNPTQADQFRYRKMTSFLLDYYFGRLELDLRHTIIPAKSPEKCRKNIIPDLLAMNPLHAQ

SEQ ID NO: 964584 - protein, 65 aa, Homo sapiens
SHIVQHCYCRQCFDSALSSDTVRNWKTPAGHHSDLPLMVGTLWNAFFLGGLKSPRCLVSGEQINN

SEQ ID NO: 964585 - protein, 59 aa, Homo sapiens
HDIWPGSTGGSVIPSTNARIQRLVTFYQSGDSWEKYVHSVRYQSTLWPCIGSGIPTFTD

SEQ ID NO: 964586 - protein, 185 aa, Homo sapiens
YRWHSVIPSTNARIQRLGVVSNWRFMGEVCALCQNTSATANGRGIREWHSHPLQTYPSSSGPVEVFITETPSQPNSHPIAVKCTTAISHFQVHTQVETWKFCRPLEGSYHTRPLKLLHHQRPEAWLWEPSASSISVQQYGHQEVTRFDFSNTSIMLTYNQQHLPMETRLPFLLYVATSESMTEYR

SEQ ID NO: 964587 - protein, 153 aa, Homo sapiens
WCCRGVKQWPMSYCREATRRAGSTGGCSCGSEQGAREAGQMLCPLGAATPGGCGEDTPLPGPWPALGGFCFTVNAGLLPSPEMFPWKEGVCLKVQMLVCMEWFGQLNQQVSEVFNTVAQELLQRSDEEGQAPRGDAAVALNKGPARQAKCCAH

SEQ ID NO: 964588 - protein, 113 aa, Homo sapiens
TDYSRTHRVTSSLTARDTTTVSSWLMPRLPFCTSSSSVLTIDGSMAAIFGSHGPGAYVSLWQQLYMLSADTGCKDDNHQILLPRDRENREPDEPEGIGRLTGADTTDYTRTHR

SEQ ID NO: 964589 - protein, 182 aa, Homo sapiens
SEVALESREENPVCFLGEHWTAEEMQYLNIKEDCNAMAFCAKMRSSKKTEVNLEAPEPGVEVIFYLSDREPLRLGSGEYTAEELCIRAAQACRISPLCHNLFALYDENTKLWYAPNRTITVDDKMSLRLHYRMRFYFTNWHGTNDNEQSVWRHSPKKMKGKRGDEKEIRLQLQSAETRRRNA

SEQ ID NO: 964590 - protein, 74 aa, Homo sapiens
MVKGGAKLGRIGVITKQRGGTLDSIDVVHVRAANGNSFATRLSNLFVLGKGNKPLDFSSPGKGIRLTLAEEKKR

SEQ ID NO: 964591 - protein, 190 aa, Homo sapiens
LHERRGANEGQDDQLASPGSRRPRSCRQSVVIGQELGGGILCEQGHHLWQTVGQARGHLGALLVQEQVVQRGDGIEQDRLHRGAEHADQSRDATRLEDGEQPLPVVGEVVQELVVQRAVSRSLVFCMVRTTADTSWGEPIRARRDASFFDSWFTIMAALVTTTGSSSSEQFGELGQRASGQLGIVLVVEK

SEQ ID NO: 964592 - protein, 51 aa, Homo sapiens
MPQLTTVAARLELGIEVAKRPLAGLAVAVQGRSRCCGCESCRTFLINRELL

SEQ ID NO: 964593 - protein, 58 aa, Homo sapiens
MLNEDMRKHDDQGCHVDYDFDIRGIFTILSESIEKQINLSFSKTYPGCNLNKGLFKSQ

SEQ ID NO: 964594 - protein, 134 aa, Homo sapiens
PCLLVGLLMKSSGRCQYGPRSRLLPKKPWLWLLLVRSPGGSQSLGHRGGDPDTVLPAPPVCSPQLLVLTRVLLEGWQEAVTSRVQHSQGFLGGPGNRMSCCVAAHGQLGLKASLGTHRQRGPGSLSLPQGDRAN

SEQ ID NO: 964595 - protein, 228 aa, Homo sapiens
VSGSNIVVHSGQQDRFYERLSSPIKKRVHLQGFFHDTLSERDRAPALARIRSFMQARFAEPLRELSRRDAHRHGPTFEESEILAWPPERNSLADLRWRVVRGGLRFGGTLSEGIALGLQTGFDSGSTLDYIYRDEARGKGPLGRMVDRNYLDAIGWRGIRVRGQHLQELLRDAAQRLRGQGTPVHVLDVAAGHGRYVLEALGQGEQRADRIVLRDFSDLNVTQGQALI

SEQ ID NO: 964596 - protein, 144 aa, Homo sapiens
ASNGATGLAYPAQPQQQQQPPHHLPQQMPVQHLRLQTMMEEPQTVPEMPVETPPLSTIDMESQERIKAERKRMRNRIAASKCRKRKLERIARLEEKVKTLKAQNSELASTANMLREQVAQLKQKVMNHVNSGCQLMLTQQLQTF

SEQ ID NO: 964597 - protein, 105 aa, Homo sapiens
MREKDMKKEDDVEEEEEDVEEEEEDVEKEEEDVEKEEEDVEKEEEDVEEEDVEEEDVEKEDVEEEDVEKEDVEKEDVEKEDVEKEDVEKEGVEKEDVEVDAAANL

SEQ ID NO: 964598 - protein, 66 aa, Homo sapiens
MEIHEIMTPERWHTSLHIMKIIGDQVSEVEQGTDLSMSASLCQYSLYLDSFFRDFSKTLASYSALG

SEQ ID NO: 964599 - protein, 50 aa, Homo sapiens
MLCIMGNISRSPIAEADSGNLYTDQTSQRIGRVDSAVRGEGALGYAVQGE

SEQ ID NO: 964600 - protein, 108 aa, Homo sapiens
IVDTALFSSVVTERSGSPDDSSICLSPTTLSNHRIQIVIDLLHVPEQASLVQGTDILELASLLCRSCFNSAALILIVRGVMSSLYFHESIIISTASNCVRVKNLSHKF

SEQ ID NO: 964601 - protein, 40 aa, Homo sapiens
MVLLRLLLRVLLPPLLLVRLRLWRRLFSWLLALLTLPRFS

SEQ ID NO: 964602 - protein, 129 aa, Homo sapiens
PRLIKMCKKIAVRHLQKQGAGPSLRKTLTPDYTIGCKRVLISNDYYPALSRSNVQVVTDNVQRIEADGVVTADGIKHPADCIIFGTGFQATDPLPRNCIIGRHGIDLMDTWQDGAHAYLGTTVPGYPNL

SEQ ID NO: 964603 - protein, 61 aa, Homo sapiens
SGERVLALGFLFLQEEPSDRELLSEALRLSCPGGEQQPGGGSRNVRRLIEQAALELLQLHL

SEQ ID NO: 964604 - protein, 131 aa, Homo sapiens
RPTLTLQTSKSPDAYVECVVPKFEKNGMTSTVTQNSRHARIVVTSKIAADNILEVYKSQDGGKVFLYERKPLASAFKPSRFEHAAQDCLSSTGAGLSAGGDLMWGLSSPSEAAMASLRSDSDTEVIPSQRR

SEQ ID NO: 964605 - protein, 34 aa, Homo sapiens
KPLWYGNQNDGPQQDHPEQWSGSSNNGPPPPQGK

SEQ ID NO: 964606 - protein, 169 aa, Homo sapiens
MDLIEEIRGDKTQALCEREVIQEKECALIRDSFRDGDPVHRHRKLYELALRPHVGLPVHFGQMECLKVIVSSRFTGKRVGYLGVMLLLDERHDAHLLITNSIKNDLSQGIQAVQGLGLGSLSTRGSAEMCRDLAPEVEKLLLQPSPYVRKKAILTAVHMIRKVPELSSV

SEQ ID NO: 964607 - protein, 40 aa, Homo sapiens
GRYCGTAGGEEVGLSDSSWTSNQHGADFVSLGEKVHTFPF

SEQ ID NO: 964608 - protein, 48 aa, Homo sapiens
MTRISGRSLSTVSVASRMRARIIGSFSGIATSPMIANGSIGNSEASPS

SEQ ID NO: 964609 - protein, 46 aa, Homo sapiens
DAPPKDDEMETDSRRRKKSLSVDFSLGMRKSCPCWPWLSRVQDFLI

SEQ ID NO: 964610 - protein, 33 aa, Homo sapiens
TDIIHPSIIQMYIEHLCLGPIGELVTTKTFLSH

SEQ ID NO: 964611 - protein, 55 aa, Homo sapiens
SWPHTQCVQVCKLIILATDVLVDRARSCPCTLKMTTCQVESGSYEDDGTSLPPNN

SEQ ID NO: 964612 - protein, 70 aa, Homo sapiens
TPAWTVVSRSPHRCCLAAQSCVYRCGNSSSLPRMSLLVSTILALVVKDDKSQVESGTLEDDWNFLCHLRR

SEQ ID NO: 964613 - protein, 61 aa, Homo sapiens
EIVGSCGEGVDSFPVQRIHPIGRELRRTAPCTHRHPDKARASGLNGHISNAKRKTHTNNSS

SEQ ID NO: 964614 - protein, 33 aa, Homo sapiens
APPSQGGEIEQHGMVRSEISSTRTSVSQIPFYS

SEQ ID NO: 964615 - protein, 55 aa, Homo sapiens
HIGFMKKQWNIEHLFHRSGTVGGQDTIRPLWRHYFQNTQGLIFVVDSNDRELVEQ

SEQ ID NO: 964616 - protein, 70 aa, Homo sapiens
SSRGFPGEKGEVGCNWTGWSGLVKMETKDCLVLLERKGILEEGGNGRTRNLRFMEAEAKRTYRSLDVEEP

SEQ ID NO: 964617 - protein, 42 aa, Homo sapiens
CAMKSYEYIVRKSTITQYTRTASAIVLVQSLSVQVVLPDQHH

SEQ ID NO: 964618 - protein, 90 aa, Homo sapiens
MDSDTPPEGLLARPPDDSGHQDDGPQQRAAKTWMAITDILAHLLFKISNDHPNEDTVNSLYPDFLLQPAGSINILSVGTHQPADPQEEEE

SEQ ID NO: 964619 - protein, 79 aa, Homo sapiens
PSLLRLFSAVLGGSGLGHWALLLLLRPAVLLEAGDGLAGPSCRLWLHHRGCTLSRAWMAFDRQQIRLPRELVEGTPLDV

SEQ ID NO: 964620 - protein, 36 aa, Homo sapiens
MLTAPRSRLGSPGAVLTALGLLDVSDIIRIPIYFFW

SEQ ID NO: 964621 - protein, 60 aa, Homo sapiens
PFLLFFFSDIGRSSSSVIIEKFIKLSSLLRTPSTTTTSFLLFGGFSLTSKHKNMLGLLHI

SEQ ID NO: 964622 - protein, 74 aa, Homo sapiens
MVEPDIQEPSEQPSSAQPPGFSALTPIRVSTSPSRHGAFLHLRIDGLGSLSSIEFPTPHLALYWSLEYTESCAQ

SEQ ID NO: 964623 - protein, 49 aa, Homo sapiens
TTPKIYQRDLDRNGADGASSVYKSPALHDKTEVRALKRFRRLLLAHHIT

SEQ ID NO: 964624 - protein, 42 aa, Homo sapiens
YQDSILNQSNSHIRLQSSYTLQLLLVLPADIGWPSVHDDAMR

SEQ ID NO: 964625 - protein, 38 aa, Homo sapiens
LMLTATTKAAAAAAEATAIASPKATTKAAAAGGIAAGG

SEQ ID NO: 964626 - protein, 108 aa, Homo sapiens
GNSSWLLAPLSGGMQHRQVFIIQRSGKSYLAGREDSSYTYESGSTYTSRSTDELQTGPPFTKAQPAQTQAPLVLQVDGTGDTSSEEDEDEEEDYDDDEEEDKEKDGAE

SEQ ID NO: 964627 - protein, 132 aa, Homo sapiens
MLTAPHLRDYFEQYGKIEVIETHELTDRSAKKRGFAFVTFDDHDSVDKIVIQKYHTVNGHNCEVRKALSKQEMASASSSQRGRSGSGSFGGGRGGGFGGNDNFGRGGNFSGRGGFGGSRGGGGYGGSGDGYN

SEQ ID NO: 964628 - protein, 52 aa, Homo sapiens
MSCHRCSPGAQKTVDASVHQINGQVVPASPSLLVNMLLCETAEEDTAAPGIR

SEQ ID NO: 964629 - protein, 97 aa, Homo sapiens
RIVVLLMRNRMLGEDGGRWPPGFRGSLAVRPSSWIPTIITRGLGRELLSLTEVSGVPDRVADYESIYIWYGESKVCIVHIIYLCSELSSEPGAPRTR

SEQ ID NO: 964630 - protein, 134 aa, Homo sapiens
MVQVRTSNIHAESCNGTYLHTLLVAAFSVYLLWRIAEKAEALGQRLPVLPQQAVVGSQVPAAAPASLDFPPARSENLKGDFNLSCLVGERALSSLRCQLLLVLAIFFFLIFELTDEVGRGLMFIPSLVPPEKVN

SEQ ID NO: 964631 - protein, 70 aa, Homo sapiens
VVVGEGMLLGSPCVPGVGLSLSSESESEESLEEEELETAAVGLIIFILIVILRRRRAIHSSITSPISPSP

SEQ ID NO: 964632 - protein, 39 aa, Homo sapiens
MVISDTRRYRSVLDSETPLLSCLAKRAAVGGRVHCGALD

SEQ ID NO: 964633 - protein, 53 aa, Homo sapiens
SDGYQRPTIYTWYVSDLRWPCMQQFQNPDFPPEVEEQDASTSTNSLSTSTEFP

SEQ ID NO: 964634 - protein, 43 aa, Homo sapiens
WSLHATCYSEEDRSRILIQGILQAGILLLKLLELITGCSTSTI

SEQ ID NO: 964635 - protein, 46 aa, Homo sapiens
SQDINSCVRHLLRILNCSKATRYGILPAAGQFLEGSGSVHARSPSH

SEQ ID NO: 964636 - protein, 72 aa, Homo sapiens
IPVVLFAREGKGFGECTFGLKIRRKFPYKRSEVLMYIIKEWLMCTPEIIEQMQDYALEKVVGIQLKEVDARG

SEQ ID NO: 964637 - protein, 41 aa, Homo sapiens
IHVASDEEYSTCDNPRDVSGLGGGKGSISADEIFLLHDYGV

SEQ ID NO: 964638 - protein, 49 aa, Homo sapiens
DPYQDINFLQLNPKYLLQGIACSFNDSRGTPTVYSIDDVPSDSVLSCID

SEQ ID NO: 964639 - protein, 42 aa, Homo sapiens
FSCFILGFSVEYATQYPSAVGSPWLQVLGSQGGSEDCSPGGP

SEQ ID NO: 964640 - protein, 73 aa, Homo sapiens
MQTVSAFVTLEFARQNSNEDVSPWAIMRMTAPVKQQGVWMRMAVTTRAMWLIEEYAMSDFRSVCRRQMELVII

SEQ ID NO: 964641 - protein, 70 aa, Homo sapiens
FPGIKTVSAEPGAVVLKQYINNLSEAAGQHLWGELGPAMDSELEKHAGPGMEDFKNKSEDDINKRTTAEQ

SEQ ID NO: 964642 - protein, 46 aa, Homo sapiens
SITVSVHRPKSQLSRLTVGQKLWFLFNVVMLHTNVSQSSLNGPSKW

SEQ ID NO: 964643 - protein, 98 aa, Homo sapiens
TTQCIKTVRQNLERCTEQYINNLSEAAGQHRGENGACLDSELRNMQDPVEDLTNKYEDEINKPNHQLRIELCRYLKKDVDSYAYMNKVELEATVDSPG

SEQ ID NO: 964644 - protein, 123 aa, Homo sapiens
MWLQVGAHAGVIERDLQLVHGLQEQPLTLVRLVFKKEASFVIRSEGLMMARMREAMVRHFHTFLHLGSTQVKVHLVVGTGHGGQIEVTHPVEFQLEGQDRFQVTVNATTANSSLALNVENLGN

SEQ ID NO: 964645 - protein, 37 aa, Homo sapiens
MYGSTVVVATGFQGLHVIIGSTFLTICFIRQLIFHFT

SEQ ID NO: 964646 - protein, 76 aa, Homo sapiens
CDDLIAMHVDSASLCCRQLRLLIGMDIYLKGSLIHLFTNYRVSETNNLLIHDYYAKTWGSIHSFAWGDTGEIKSSM

SEQ ID NO: 964647 - protein, 67 aa, Homo sapiens
MRNKARKKLLADQAEARRSKTKGMHSKRREERLQAVKEEIIKTLSKEEETRNRTSHFVCAYWPSVIT

SEQ ID NO: 964648 - protein, 59 aa, Homo sapiens
MYRQRGEVHFLVSSSLDKVLMINTPSGLEALFTALACFLGLRPAGLSLVSQELLAGLIC

SEQ ID NO: 964649 - protein, 65 aa, Homo sapiens
MQIRSDTPEEPQSSHSTHVTEVHDTKGVYLQLDLRRFRCLCKCYDVILYCGEDALFHHGQKLLAT

SEQ ID NO: 964650 - protein, 44 aa, Homo sapiens
TIEDPSADKAKYLTRKPGSQLWRLLRCWMMILLQTELPHVPCVT

SEQ ID NO: 964651 - protein, 354 aa, Homo sapiens
YSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGAQGARVCGGCAERDAETGGLQMTRTGAGTRPHQGTSDGVDIQGCDVQRFGDTGAAGRPAAQLSPRTWSREAARLWLKLCAGAGACTHSWPVPDAFNSSRKGLRADFPHAGQSRAPCCTPLRLRWAARGAARTGGWRPGNWDGSRGMVRAETSHSELGDLRDGARHKGRPETGQRVGAKTAHTARACWTTQRDLGKGRHTDPRPRVSRLGTRDVPRGHEGRAEREGQQGTEST

SEQ ID NO: 964652 - protein, 137 aa, Homo sapiens
MIAATCGLPEGAWHNEALSQPTARVIQCIFYIHQQTVNTRDTHVKREPPESPTLTPAEPLWLTHIFLQLSLSRRISRLSLCECGDSTHSSCAPLWVFKAFLTLAEPSPWLEQFTWGQHIFRPRCPPEKKDSGGSGHS

SEQ ID NO: 964653 - protein, 288 aa, Homo sapiens
LLRCVPRVLGSSVAGSRCGPLAFPAAPAAGTPCVHPAFGLLSVRAGSERGGLLRLGTLRCGVVRSCTPRRQSLVDFLSDEIREEQKNSEAENLPKMSGGWELELNGTEAKLVRKVPGKKSGSVSTLTKIPQHCDGEEEPSQGQKVEEQEPEDDINPNSWVEVIKNDDGKKALVWTCHYPEDEVGQEDEVRVTSSLSGKLALQSTGRKSEWKDTNYTLNTRFLGTGPLYDHLVIFLADPGVATTFADELVELSKPWSTRRNLLFVKTSEVWYEPVEQTDVDPSYGGLGP

SEQ ID NO: 964654 - protein, 127 aa, Homo sapiens
MRRMWATQGLAVALALIVRAGADWAARARATAKFVFSYLGRFYQDLKDGDVTFSPATIEKESYKVLPGSNEANGELGCATISGAIDVLQPPKSINEVSSASWPNLYPCGERSVRSYKKKGRPRYCEP

SEQ ID NO: 964655 - protein, 290 aa, Homo sapiens
FFVFFGGVKRAYWQGQQEFNQKGQTPGHHLTLSELLLLLIFLLLGLQQGQNQQQGLQRRLGGTQEDGLQAPPGRVHVGKAGQITRGQWTVFKGVFPISGSLGLTLVVENAGAPSCPAPAKYPRLGVPKRSFLDVPLGAAGGEKMLGPHKRGNGPRKGVKRRGKIGKDRGKFRGGERAMNTMAAGAGEENKKVLPKNGAGGWGGETPTRVVWPHYFPEEGANKTPGVGGVPFLGRNTGGPEKKGGPPWVETRMTPRGVNIHPDDRNFRVRGPEEPGGRHHLYGTEAEKPPR

SEQ ID NO: 964656 - protein, 99 aa, Homo sapiens
MRSHTDLSRLFDGELVHRLRGNARRHLGHGSNKPWSKYAAPLQGGGMVRGDVALSKRARIAAHSWVCFVKRVTGTLKTAKELPWSSLAWHDVACDRLGQ

SEQ ID NO: 964657 - protein, 164 aa, Homo sapiens
MCTLCPPLTRLGQAKRLAIKGADIMLTGTNWPYFAPRVPAGPVTFPPSGSGAQSERRMPRKSPGWTRVGRKQCGQDREARNPSARPPRLVLELPPTGVRPRAVARRRLLPGDKDHKIGAPLKLELDIGLTRQVGVQGRTQNRARIEGPEAPVHGCEAGAAEGRT

SEQ ID NO: 964658 - protein, 71 aa, Homo sapiens
SSVFSAAVVGPAHSWGGLCRVAPMGKRAQFACGRLSPSSYALPPGWHVSMLNVYPEVAHMGERSRRPEFIV

SEQ ID NO: 964659 - protein, 136 aa, Homo sapiens
WKKPADLNWLLGGRGLRSSVRGRVRFSLFHHLTGFCGCAQDVALWPWGIGLPVRRIGAELVLGDSVVSECCVSGGAKTFWVRGGLRHHIGGWKASPGAEILRGISEPPQRNLCAVGKRPVSTSAQEAWGGGKYRPR

SEQ ID NO: 964660 - protein, 152 aa, Homo sapiens
SRGVAPNQVVPRGGRKEALRAPFRELPSGAGIQARSGNPRIRGAVGPGLPTSDHPSGAGDPGFPGVHACTMLWCAPRWGLSSLRSWAQGAEHPGEPEKEAAWGDTGVVATYVTHGGVDTVGVRTRGDVERGGVYQTFKQRVCAGHWVGLGER

SEQ ID NO: 964661 - protein, 315 aa, Homo sapiens
DQPGASASSGTVDTRSEAGKPGGALSSAKLGKHSVTALRIRKARGRLQQANTDRHSSPTGIFEVTVSMRERLVPRGSLPSPGKSVSSPTSSKTPTPYETPEDPFHKAQARAVKVEKRLRVEYPRFGNVRAEAKAKDSEDYAGFGSELQEIRRDTRTLNAEGTDAIGPKCRWNTQSPQVTRNLLIRALEGGRNKNFSEKSLPDLAGTDNRGTVKGRNVILIFEPRPQIPERRAAKVHALVEQSRLHQPYQYTPGSPSHRDRPKLANQVGTDDRCMSIQTNRLHVKLPITGTHKGLHNRMPMYSTQAYICGKARELA

SEQ ID NO: 964662 - protein, 122 aa, Homo sapiens
GKGGGAELLLRRLLLPPPCLCPKGAGWSRRRDGSSSGGGGGGREAACVFSSSPRAPAVILASGAAPMRLLAGWLCLSLASVWLARRMWTLREPARPRIPVNVNMISWPPVVGSVLAGRGGGM

SEQ ID NO: 964663 - protein, 536 aa, Homo sapiens
YGRSRAGASGDRSRATGQKYTGGRRRVKESADPLSVKRHSSLHRQPSPSARAASARAWSAPEAASLTWHIVTGGGVAGRKVDDGQWTAVLFACRGARVDSDPQIWLCLRSCEAFAFIEHLSLAPFAWRALRAALRVSLCFYTHRTAPHVRDSYGVSTWLPYLGGNALVPRDVFACAYAWGPCHACWLHTHGHRYLDTHGAYPHGTLAPETCASQRAASMPDANGANRVHPTLGEPGPACRAGPKRVARSIACGKRINCTSDIPLVDWPSHAQLVCAKTFHVTGYTKVQDRSAVLGEEHPNTGWLCRARGAINGGIPELTGAPGGDIEYHGARPRKEEREAVPSGPQALAALHGGPSVTSRGGDHITGSYTRNGKAASDTRRIGQDRRRLTAEGQLSKAAVGKAHEHGQVPRGGPMTPHESKRPHGNPATPGKPSWQRGPPKTGRAVPTKRGCPTPGDYPTATSGGRITNPKGPTRAEGQHPPHRRHTTPPAPQHAPHGTPSCSVHPSSGPSTTPNNHDTCKTLARAEHLTHPTNAQ

SEQ ID NO: 964664 - protein, 318 aa, Homo sapiens
MRAFPKRNRGTEVWPARGPCGQRQVGPRSAVETRNTPSLGITRGGAGGEGATITARMCGTRKKRAYRGPWEGPLEGKWTPDVGANHRGKANPRAGWVKEKPPRNTTKGPPVGGTGVEATRHAMRRHGNPKAHPFLPLARDSPFGALLKGGTNVIGPKLTLAPQQRARGGEMPGKDAFPAKRQRGPHVWGRGATTYNPECVDVQGRHTKRKKTTLCNGGATDKHDPAEKKNRVSGGETLGRAWVKPHTNTGPRAGETTTRMWGRPRCDKRVRGTPPEEEHRIVSTQRRRQTRGAAERRPTKKAEHVIDKMPTYYADGNN

SEQ ID NO: 964665 - protein, 174 aa, Homo sapiens
MGQTQKKVVEASERGAALSQESSWRRSRLTHAVPPGSSLGGSRALLSGTERVCVRSPKGCGWSPRGNQVSSRCLRRQPPEYIILVPSNLAQRYQGYSGRLMRRLWREWHWVCRWCPLWHRRASDLTCCPLGRATFSFRTWTLSSHPLRGAVLWRSVGRRTCTDRPCSQGREVLR

SEQ ID NO: 964666 - protein, 271 aa, Homo sapiens
MYSEAICEKAVEHEPPGCTYRLGAVTLMQESAGSDARSWTDDQMSCGMGLRSIEWDLEDLEETIGIVEANPGKFKPQPGPAGEKGVVERMREAVQEMKDHMVSPTAVAFLERNNREILAGSQLPRSPPSDLLDASAVSATSRYIEEQAGHTAADHGLNRINQLEEVSGKHPGSEAYVRARWRRAGRAGIMLDAFARRLDTPSPAWTGVLREVGQSIPHDGVVESLRGGVSPWWGQVVGGTSSRDPDLLFQTRRVSTRVVSGRSSSSQSIFL

SEQ ID NO: 964667 - protein, 146 aa, Homo sapiens
MEDMNEYSNIEESQRDPRSARARISRMTVQVLCEARAGIQAKKDLTEYLVSMGGSGRRDKLTTDPVSGKIKRMGIGGLSKMLQAVDKRWANVKRTQVWMGKFDRSQKEAKVLKGKETSKKVWVGELGPDTSEEQLKILGAWQDDNM

SEQ ID NO: 964668 - protein, 103 aa, Homo sapiens
MKRFYTNVGITGGRKWHRAYKAARYSEQAKLDHSRQKSCWERKYTERGAVENNEFFGTKLAFDTVVYTVVTELCACRNMFKKRVAHNSSEEKLYKPNGKKESR

SEQ ID NO: 964669 - protein, 136 aa, Homo sapiens
MTISPQRRSSSAVAAETDERGSWPRDVRRVVAGHLGGRCDTAAPLRTGSLGPGSSRGPCGRRHCSRRRAWLGPAPWALGRGEPPGGGGGPCWRFLANQCRFVTGLRVRRAQQIAQSTAALLRELTPRLLGALRRCT

SEQ ID NO: 964670 - protein, 230 aa, Homo sapiens
MLTARTGHNFAPRVPCSPVPSSGRSGPSSSIARKQPRWRCLAPRRCPPASGKPEPVAFLPHTLLGCLPPGGRRAAWSRRLVPRRSHRTPKFGPPATERPSAWRATFEFRPSLRDPGTREKQGAGHGVPCWQAGCRLPWGRGGGIPADKVGIRGTEVPPFRHFTALTGTPEHTALASRAPCVSTRPHYGGRIRGVRPLVWAVHAVPTRGLGPPVCGGALPLVRGAVPHREI

SEQ ID NO: 964671 - protein, 192 aa, Homo sapiens
MFVHSRPGWWRLLLLGRSRITDETCLPAAGLSQRMLEAGGSEAEQARARDLDCLMQRPRLPLRLLPEPKKPGTCGVSPERRRRQPSRAFACTLPGCWRLEAVTQQQREAIWSGSYSDLAFRCASSQSPRSPEPVASISERRRRNPAEALLGWGLHDRAGLIKWRQQGAQTRVEGLLERRRTWNYTVGHQSTL

SEQ ID NO: 964672 - protein, 203 aa, Homo sapiens
KYRSGTRPGLNRHRGRISRFRVTARFALRPPRPCALAMSGHRHRGRLGAVAPWMMWAPHGRARSAAAVRAFLERGTPNWNGFMYSDGSPIPSWAAWGSRLGGVRWCRPCENCHQGQPLGWNTSLKPDSVRSQLETSLRRLQCPQVDLFYLHSKLTTDPGGKDAECVPAVTTDGHGSCDAWPLPTMQAANLAEIVYPPAKETSG

SEQ ID NO: 964673 - protein, 229 aa, Homo sapiens
DVWTRLGQAGLDVSCHVVIERFYTPCWASFGNSGLLVSLVESLASGCLGLARVAGNSAEKGRLWRCDRRKSKGGGKMNEEISSDSEYREPEPPRKPEEEEEEELEETALEKKLRLVEFIPRGTLRHQEEEKAEALLHLSEGPGGGGRLKEDVALRQEWARHAGHLGGQRGRSKPQSFSVTFAVLTGGRPRLFYSRLLEYAHAGRVTLRRIFRLRCPKRTAGHQSKGGTR

SEQ ID NO: 964674 - protein, 554 aa, Homo sapiens
KRPEAVGDFWMPSRRRTRSTEVENQPPCSAAIHGQSLVAVVCPHVLRKQMQHLVTHTGTAHKFTNAEQPSEPWGNQKSCTSSSPASSVQAISNHQQAANNTFTHLLQFTCSGYIHCSIYLTSNASTAQQWHLPSIIQLHSWLPWHQVPNQQAPLAEPHSDTHVRLQMAIRVCWHHGLSAPYTLANTCARDKHHYATQMGTHHKEEMSAQRSWRDDMHTSCETSDSEHLRGHPEADIIQAKGKPHRKQRTPTDNGNTLMPTTEGLSRATPETASTSNEHAWPSDERPRKQHSPWSTSARDTATRQRTRTQPCTKEQYRRERTPTKSHALGQATKPPRATITMPRAKAASAEQSKNNVQTVHTLNNPPKDSAYQRQGRRDDDNDKSWTETTATTDDTKNDKTHCTDKRRDTNENTNRQPMATTRNPNIPSQRNTSKHRAEPHVTTPRMSEDPTRRRHATEPQDQATEHTGSRPTPQRAEQNRGKTAEGTTESSNDSEKSSDKEHSRAPDEKHTTDRCETTTERQQKETEDTQDARDGRHRRNDAQDKTTQTRLHQP

SEQ ID NO: 964675 - protein, 170 aa, Homo sapiens
MVVMGVSHEKYDNSLKIISNAILQHNCLAPLAKVIHDDNFGIVVRTHDRQIHAITGTQKTVDGPPGNCGVMAAGASSTNIIPCTLRGCLPIGRSEAKAHRLQSVEAGEGVDYGYGTSVVPHWPSVVSWCDRDHAVIVKNACQHTELSTQRKGGESKASERGPLKGILGYT

SEQ ID NO: 964676 - protein, 243 aa, Homo sapiens
MEIAPLEAPPVRARTGTLKRPQLMPGLPGPGRPPPMGASRLQPSAVTFPSDEDIVSGAVYAQKTPGDLAQNVTVDEGHRAAYNAGLPRRLNCRQIPKLLRQLQGITDLGHRSDCLDLKGEKLDYKTVEALEEVFKRLQSKVVDLEQTTLDEDGASALFDIDRGTTSSRHPLFNIFFNKAQSGTRGLGRAGRPTLLPQEEAALQVILGRPGKRPPFWDHFVGPFCGPWPWAIRNNRWSAALGER

SEQ ID NO: 964677 - protein, 80 aa, Homo sapiens
TAGRGPVLIRHRGLAAKGDQMISVNCVYKGGSMSPSVMVPIDAVDGHRRTSWEPVGLMLLLPPKMKSEDMAEEDVYWPSA

SEQ ID NO: 964678 - protein, 184 aa, Homo sapiens
MPEYKLVVVGAWAVLGKSALTIQLYPEPFCGRIRPTIDGFLTGSKVVIDGETCLLYILEYRRQEEYSAMRDQYMRTGKVRSCGVFAINKHHCLFEDIHQYREQIRRVKDSVDVPMVAGGDPCVTCPERSVESRRLRTSPEGYGSPTIEDLGPGPRREVKDALSTRWCVTNPAGTSLGKLKALHD

SEQ ID NO: 964679 - protein, 252 aa, Homo sapiens
MAVELVLIGTEASSVTLLLLLFACAGSGLVARCVAMPELACKGGGPPPVAAQVLLDHFTDRPVAKQKRVVGGAYGVMCQRKYLMYRTVPQFLLMKMTKSEFCSGFQTSDYLEEHVWRLFKKVEVAVERIVGWYHTGPKLSHKNDIAINELMNKILSYSVSVIIECEAEGPRVVPTASVHFSGRTSSDDGTASNLENRLNHVTSEIATQRKLRKLAVEHLLAEISIDTTVGTLSQRITNQVHGLKGLNSKLLG

SEQ ID NO: 964680 - protein, 159 aa, Homo sapiens
GAEVKDRTDREEEGCWIGVGAAPRTCAYLPMVEEPWRSAAAPLPPPTSHWPTGLPLLLGFCAPTSTTATQSHTRPPGYLAREETRYDEAEPTETETSDGTNMETELIMEGSPAEWHDDDQPPGPSPPYQMISQHRTVKQHVHLEERDTQIERTNCKATK

SEQ ID NO: 964681 - protein, 238 aa, Homo sapiens
MLPKNNTKTNLAGHYMAGGGRTHTRMLSYNSCRTWRQKPWVPKTPHVFLYRTERVGEETFAPRAPPNIKKGGAPEFKISEIKRQCVYNPARYKLDHCTDTTSRSSDDTLSTYYLTYQPSNLHNTERKHTQHHFNYTRPTITTSNTLPHTKTPMHPQAPIAYNIFLYAYTYTRTQTPKIRKSIPLISHHTTTSLTNITHLHSNNAISANTDITHYPSLTPHTTNNRNNQHLNIQQNTIT

SEQ ID NO: 964682 - protein, 103 aa, Homo sapiens
MSEITTKDLKEKKEVVEEAENGRDAPVNGNANEENGEQEADNEVDEEEEEGGEEEEEEEEGDGEEEDGDEDEEAESVTGKRAVKDDEDDRCLIPRSKKTDEDD

SEQ ID NO: 964683 - protein, 316 aa, Homo sapiens
QNHGGRGWCNSALRLALAARGRALAMSGHRHRVSPRCWAPWRWVRRLARARHVSAAVRSFLERGTPNWTRCFMSATASPRPSWGGLGLGAWSDGDLQMLNTLSPRPTLWRIDNITNSLTIVRLPAGDFIEEAAVVPSSGPSSYRTRHLDHVYPGAMRQLALLAILGATREGTNVRVSLVLLQNMLSLEKLAEICTLCNEAMGWTPAHVCTRAFVQGYHPEGGKCSFSCASGTLPLRYYCLTKPSWVGGLFDVGCSPTFGTRTGNTACGAGSVRNSWGLRPYTESLLGRSDQFEDICVGCESPEAAYWARAPIVTSV

SEQ ID NO: 964684 - protein, 76 aa, Homo sapiens
TTSARYEAWFECGGEDLTQGDVAELHAALAVNISAARGLQDVLRTSLAPSVHHEDARFWRWITSNLLKTVMCCFTE

SEQ ID NO: 964685 - protein, 202 aa, Homo sapiens
MCELGSAFMKASHLGTPQFTGVSCGSARRAFWLAAWVWPRPCLPSRRPTPSPLTCGPLCIQGWLRVSENITTLGRADGVTLGFLVGIDSEALRIQLSPPYSSCGIAVLRSYLMPVLKSCSQEAAAALALPLALGLGYAVSGHLPFVRPEFTVGSRTSLGPHWLVIPRPPCLYYPVGSLAQGLPLRPPCDPASTFKRPGRGPS

SEQ ID NO: 964686 - protein, 302 aa, Homo sapiens
MVKSVAISTVPRLWANFHYGAGHPMKPHRLDIDPYLVLHYGLYKKMIVFKPYQASQHDSCAASTPRTTIDFLQRVESHQYARFTKSRYLPSIGRQYDCPVFPGLLRFCSRERRRISLQGATQLNNEICDTAINWAWWSGAYAKNGLRPLDFCYVNDIVIGILELLKYHPRVLYIDIGHSTMVTGFKEAFYLTDRVMTVSFHKYGNYFFPCPVTLYEVGAESGRTTCLDVPCGMAFDDRGSKPFSGVFTGSGFFNPVRCAPVGATPGRTHGGFTTPPAGGVRFEAIPPAGGDSPGRGVNTREA

SEQ ID NO: 964687 - protein, 308 aa, Homo sapiens
PGATCKGAHTGVVRDPRRNFKGKLFTMAPDPFKSPCKCEGGGVFIKFSFAAGHPLIGVATNLLWHSPREWNTRLTISLITEEKSVRVALSIFSLITHLSRRERHAWEEESSLWRGTACAWGPQCVCAPKYENPPALRAGCVSDALCIYISLSPRENIAVGPRETGACVCRVRECFVRRAWSPQVCGTAHNSPTQVVRCWAPAFFTLSPSADTPPFFTHFQPPAKKFSHIAASSSPHSSRSRRTPPSGVLLPPDVSRDFITCWAPPPGRRAILVMQPTTTSSSSSFSQRVDEDDKTPIHDGGRYQPPHQ

SEQ ID NO: 964688 - protein, 214 aa, Homo sapiens
ADGLLPTGPPTARMTSDGQPASSPGPANPTGGYEPACRNTTHNTRPHGQAAPGHPGPSPTVHLSHGRPTPHCDMESPTQSEITLQTKIPMSTQDTRRSAPARNGTAPPKRPQRESRVARTWRLGRHPQLLARTRGHRSTTVRTQERWHPTHRATPVPKGHPGTRRGQAQPPVAHRRDCDSSKNTRATLTTRQTTAEAQGPLTPPSAHTPYDGPQ

SEQ ID NO: 964689 - protein, 265 aa, Homo sapiens
SLEFFIFSFLENEMFPIIGDSKPRPPRMRGAKRGVLCRAYMCHTIGQWLATTGSGVLSKRPHQTRPYTVPSVHKPPRRAWRPRKDRKNSWSYKSSVEAHILLATPETRARTSDDTDYAPNTQQRVSRRDVQTLSRHIKPLSIKSLTTRASRPLHHTTSHDDARASQHAKKESVVSSLPLAHISPPRRLRARERSTNSSYREQTREVDTYYEEISTPKDVLIPLPLMRSKMVSYYHPQPSCCSRKHAVACDVVTKHTLSNALLVVD

SEQ ID NO: 964690 - protein, 431 aa, Homo sapiens
MWCVPCCSVSMHCGVLCTHMCLVCHDMWTMACGDTCDMMWVPMLHTSTHTASSVYVRMCTCGAMLLCTVLSHVPIACEPLMWLGRCVEGHVHVARGDVCMHVNIHTSDGAKCCATGKWCVPPGDICDSQWMAAWGARHCWCAVSHQTGTCSAQGLGAEEDGAQHVGLWVTPCIALNLDQDPEGLDWADKYMHPRGRHMAHGRRMTRPSAEGLWRSDGELKLTALPGDGEGLVQGQGGDRERHAGWQELEGHLCHPGDPVGQGGDISDAGPTGTTRQNQGGPPASHGGQCRTGPRSYTTAVQRDQHKWPKAHRTPGHSVDRDNAIDYMNRVARVQTANGTDSSREPEAIVRTQIAEREPLPNEGQPPSNPHTSLRQYASPQHYKNKPEQQATPRPELINNLSRQNRSRRIKRTEDERQNRGRDTTEMRSLKR

SEQ ID NO: 964691 - protein, 425 aa, Homo sapiens
GCNRVNWMMSPGLRLKPWGGGAQSEMGRKGMLEWLLRDCRSEFPNLGRGQGEASGTQPGPSHPWPRSGWAWPVALETGHCARGGSTIHAQTSVLEISMAVFPKTFNPRCKGTYRAQIQISNRAGGGKREFGWEGFWRIFFEKKRGNSTGNKALKENPKTDTRQRVLPPQQKKQKGDISGSGKISRKSSQRNVGNPQEVPFNTVTKGISEDKKGVGTLIYHTYSAGHKSCVDPNILWGPIPYRTTTKHENNICRGSTKMCGEVRGQTTKGDTTRQRGTPSGAKTASVHLGTPTTIPGHTQQGGTNSGAGDPPKKEEKRTNQTTGQNSARGINPRDLKRAPRQEKGDSTASKERPSPTDRRTRTNRGKRQADTHTAETHTRDIARETQAMNRSNTQRNNHPATKTVRDPHRKQPPSERTTNKQRQKK

SEQ ID NO: 964692 - protein, 425 aa, Homo sapiens
RYGKNKRLTTGGKKGAKKNAVLIHNSTNRLVCCDSTCYVQYEILERRSSPGPKEPKLHTDGLQGLVLFCTVQLYAAFAITCMHSCHFSNTSTACIHCKHVLGVQNCLTKPFHVHCDSLPRSTQTVSPLAQTTVATTTLSLRRSPLDCHPDLTAWLYFAFRSCIMLIWLFTLTHTLPTNLTTTGHDPLYCYSRHTSTGYRRNTSCDTTRLDIVTQLIIDPLTERLTSLSYLERYGNENTDVYNILTLDFPECNQWRIWRTQWTNVTNNRLCTSAPKMPILKFHHPIPTLDSVPYTGLKQHDRVKTQLVVGKRNAHQMAFGTLRTTQQATSGDSTLQQGLNRTDKARPGPNQATTMVATPTHHGATHNTSAQRTPASGTTMNHPPRHQHNTRLSQHEQQTPPHHTGPHTTPLDHTAKPPPHTPQTSA

SEQ ID NO: 964693 - protein, 489 aa, Homo sapiens
GLDARGYLIGGYMTRGGSLGPSPLTRGLLWQRGEEGRFRWWVGDVSVVAGISPARWRVSLFPLGASGVGRGVAPGVLYSLGEASVWVHVRVTPACVACVAQISVWSIPRKCELVTRVWLCEGQVAEAPKGVKEGGREGGCVSPVCGTVSERRETHAWGGPSVCRPQGEWALVRGGPLSRERRVCFYNQTSFLGECVHIKYLWGTEVYFLYRKAGRESPRVSHTSVEPALWGPRGVGSTTVGEGGPYVRQGVERFPAGVQAPSNGGLLEAFVRPNEGTVVGKGGPKDKRGARGELGIVPVGKEAPRGGAQINGAPTNVITPGEGGGPTPQNKGATTWGSRGAKVSNGRQCGTTGVGGPIEEASSSTKQGINPHNNGVGPHRGNVRPFGAPQGGVGQQDQYGGGGQHRRRARLASEKHHRRGDLGQAPNKLPTGWFHNPPSGPDTSVGGPTTAKRAVARSMLAQPFCGESPPRREKVETPSKSNPSGGAEK

SEQ ID NO: 964694 - protein, 77 aa, Homo sapiens
MGPRCSQDKIYGDLDGGSQICVMAQALGEFRELIAQLANSKRGHPQAGGGGGRDGREPPGAPSGPAHTGGTLGDRPK

SEQ ID NO: 964695 - protein, 305 aa, Homo sapiens
MESRSVAQVGVQGLRSRSVNSASRVQAILRPRPPLSWGSTDAHHQPGNFIFSREGVHYVGQAGSRTPEAQMIRPPRPPKVLGITGVMPPCPGRLALKVALNNKIRKDWEGRLRPSSLSGQVCWLPGQQTGAWRTAGPGSHKGPGAPSNIPGAAQNPIYPNKRGADPPSGSGPAILGTMIGKVRVNLQAKSLKSRSGDKPCCNKKRRGSTGPPEDPKVAKPGGGALMEKKWGLGAVFNAKTRSIAEKEHGPLDGSTEDEAQPRLQLSVCPNGNTLSNRKETTRYTRPENPQTSDANNRRANKYNQE

SEQ ID NO: 964696 - protein, 109 aa, Homo sapiens
MPDSWCSPQISPLWARGDTWRRRFGPRIDCAPRRLAGGHTYPCVKHLINTTRPDGGAHLCNVHQQISTKNGRFENLGWPLGRGQRGSWVSWAIWGINSFKRHYYPFGGR

SEQ ID NO: 964697 - protein, 472 aa, Homo sapiens
MAHLPVALHSAADILGELQWTPAGVTSGRFLARSQTYIRALAQHIERQSVGASSTYTRDGNQAPREYMWRTTCVWSLTKRAAPTRGFCVAHECVVSSHTEVTAYLHMWALQRVCESCVKGYTKASITRRPRRRDKRGVCALRRREGCYQRKAPQLAGNPRCGNTKIRWGDARCPLAALVCAPDEKTTRLGGEVYTQKTSLIRRTPAGDCWGAGHTRRRGSFISSRSNSNRYYRRGVQPDGATGDRTCGNSPFHNINLGGAFCATTGGLPTLPRGKTPSWCESGKTLSGDGPRGGTSGRKNHRQRRTDKLMRLTALCRRPLPTNYWGTRAITQARKRRRNTPTPPAKGGDYPYIPETKRTKRATKSISNRHIYDEGAESRDDVGDIYPKRDPGPPVGPQEGATRKQDSERNRRLVAKVSARVKVTGAPHKTASTSRPQQPLGTRTIHKRGVRPEERHITSEAKKTGRSWSKDP

SEQ ID NO: 964698 - protein, 423 aa, Homo sapiens
NEASRREVSAVPGDDVRAVSVHLWCVHLSSLPGAPGEHKKHKAPVSCAVHVCCVAVCAELTVNAVSLVQLLGVLMLLVTLCAVLLCVPGRLECPVMHCICTVAVDACMSMCMMPFPESGAAVECCVRMLLIDRGYCWCLFASFAKAMLSAELRSFDFSNRMDDLDKGSCVPEGLGSLKTLCGVLDCAIQLNMERAGCYPNVEVTPLLEQCLDCQYKRHSEGLCRNMAERWMACRGERNTGLAAQSLRISSDWTEAAPLAFDKRRNEGISVWTVTLTMTPLTWRHCGIDAPFWGSCGPEIEPLVKGPFGGIFCIGNGHAPWKPRSFGSRHNVARAQRVDALGVQRHGTNALVGPPKEGYHTFGGSVGHAHFVRRAKVRRVSLGDCLSNGRHRFHLRETLGDKAGTGCGKGSLRGGARRESGRGA

SEQ ID NO: 964699 - protein, 64 aa, Homo sapiens
QSETCQNRHSVKRGGSTGAPRTGGKQGTPGGRKSADANQWTAQNQKGRRRRNQDEPPPTHGPSD

SEQ ID NO: 964700 - protein, 165 aa, Homo sapiens
MSRLFKKPLYYTTTKKLCRRQKNTKQKEAEPICGGNEHPSPGGANNHSAPYEHNCVPTNRRGGHPTGKKKQTSPLMKKKNPTCRGKKAGDNKTTAPHGERQSVGARNPSEPPLHQHPLTTTKHRPKTHGGGATATNNNPPLKTTATPRQGARPPNATPTSVHNSA

SEQ ID NO: 964701 - protein, 342 aa, Homo sapiens
MLQDVWCEISHIAGQGCVPQHHVLLRTHLSFFSLSPQGKSLTTRGHVGDRAYSRLSSRERGHAWTHVALCVNRGDTSGHTHRPVGDRGRDSRCVETQDCGHTLSTRPRQQGVAHTEVGGSLHPTAGENSSADTGRLWGRVSPEEGKLGKDIPHPGVLPNAQQTHTPVGRQTTQLIQQESPQTLKEREVGQKDTPPGQKTGVDVINHVEPTSVGVAPIMVSRIHTIPLPHNITHQRGRGGNAKPKEGGRWPTPHGRTIVDPPIYRRGGNPNGPPQQRQKKDTVATKIDHTKPGWENNHTEGGTYIVGANNNIARKPHYDADVGKPDDMGVTPVATLVWDEKQQ

SEQ ID NO: 964702 - protein, 303 aa, Homo sapiens
FFFFGGVGSLLNGYGWYYGVRVQGKQGQRPGFQPKNVVDFSSLPYCDLTGGWVSSEKAPEGRDQVSFQGLKVWNVEGLSVHMWRGSPALSRRWADKERNSVPCDRVAEGLSHILCNTQCESSVGERTSRARANARGHLVAEREAPHSSGDSARQMCAGGSERARGDSRKNGKTRGAEECPSVCGERGRTSLWGAVTQTQSVSKCETPPCGRSHHQSGWYRCAVVGNPKDANKRRCCDYKSGEARTVRTRGAPHGGARGERGDNITRERKALVWVSPTCGGVATDRERPFGVGRESWGGSTHLL

SEQ ID NO: 964703 - protein, 91 aa, Homo sapiens
MGGDHTGFQKSSAKRRENSSKEAPQHWGGTNTPGEKNPQERIGPTGRDLTAAGESKRAGTRAQSAHQISTTPNSSRANKAAGNNQRQLNHQ

SEQ ID NO: 964704 - protein, 258 aa, Homo sapiens
MANGGHHKVGSCYKSKSNGGGGAVSPRENNVRCEPHKLPSLEGERAWLSLGGPIEGGAPGAGQQNTKTHALTTRDLVENTVPQRVNNTGTPVDVPKKPPGVCAWESTPGQTGGPGTTKTAGENNNPDASTQVGPRGTTRGAHTRASGPKKTCYPPKNPGSTKLFPGGPFCTENPTTTNGRGDRPHHLNAQHRDNNRRRQQKPPTRATNTTIENNGNRYLTPQTEPATHHTSANPALDNTRHGQTQTMNNNHTYNPVDH

SEQ ID NO: 964705 - protein, 357 aa, Homo sapiens
QKNNIYFFSHTNPAEKKNKEGGAAGGDTEGAPPPPKKSGGGGGAPPTPGGGRGAPLCVCPRVGGSLSLWGGALPSLSLWGGGGAGAPPPGRARPPSLFFHTKRIYMCGGRGATPAGANQRWRQRERETKGARARGEHNQKEEQRGRQTKERRKRDDKNKTTKREGAQQRGAGGNNRERQKRAPTNTVWGGGERRERERGGGVLAGEGAAVEARPGEAKKAARAEEEGSLPNPHTEAGGERTATRRVNHTHPAGGAPPHTQTRRRPPGHPRAAPPPNSHSSLGGGDIQAVEGTQPSSLPQREGRAHPRVSTSSEPSPPDNARGWRAKPTHTTQGKTTPPFKPHTLSRMTKRRSVGVRP

SEQ ID NO: 964706 - protein, 266 aa, Homo sapiens
GGGGGGGGGGSTTKKKARRVVGGEDDAGGGGGGGGGAAPEEPGGDECKNTPPHHPPHTPQTTTQHGARRWGRETRVAAPPNKNHKRQTAPLMHAERRRLLRGPHQSGGSPHNKHRHPTAGGGLAHKKRPQGAAARHTNKRGGGLLRPPKQTEKSRGGASHVTPPGERRGSTACRQRNSPHGPAPLRFVVFPPGGGPHPSRQQLGGCAHLWAGPPPRSAFCCFTVASHDHLPLFSHTPTRAVSFFSPPILVRTNPGSATFDPPRCFL

SEQ ID NO: 964707 - protein, 146 aa, Homo sapiens
MWVEKCAPRRGVKLRLHSLGETPRGATAKGPIGRGGKRASATVDTVWRLWRKAPNATEQRVAVHSARAQERNTGGEFAEVGPRGPVGRVVPRGTHVREHRGRREPEETPCGGENTGENEWETDIHKKIPTGHTCEEETSVWTPKFP

SEQ ID NO: 964708 - protein, 150 aa, Homo sapiens
APLVTQTGPFISDVISSFPQFREFGMLTGSYVLGVAFLGVGAPPFSPSRQHGPVALAIKEKRAGRSMIEPEALQTSILLPRMASAIGSLPPAALKRQKQAIRFQKIRRQMEAPGAPPRTLTWEAMEQIRYLHEEFPESWSVPRLAEGFDV

SEQ ID NO: 964709 - protein, 146 aa, Homo sapiens
MKPEGKAQGLPTFHACMLAGLSRFHFPTVAPSWPWWAGGPAGREIGPRFTVQRLAWRRFRCNGLVRQVVSLERDVSPCVYGFPGGAPLATHLWTDQDFSRWLCFAVTPFYLSLADRFLENSSLFGEPLIWTPLVVVFLHIPELACE

SEQ ID NO: 964710 - protein, 215 aa, Homo sapiens
MCLCPIHKHNFKLLRQGVQDVKKPVGEPHCVVLGAPGQFCAHVGPQNVPREIPANVALWRCEEFPSFFLKIFSSHNEMWTFCPTRVCPILVGAVCAEFNPTRVDNIKNPGETLNPVLQNSRRTPVIITQKFHFLLPGGPTESHGQNYRGRGSLWGKPLVSRAKRASQEGKTPRPKRGPPPIEKCPSVSKQPGVGFRPGGYKQTTRRNTTPQRQHL

SEQ ID NO: 964711 - protein, 246 aa, Homo sapiens
MGLWSYSGGGVRGKQSKSITVECGCAALPCVKPGGVPETLVGTDPPGGSWRPAHFLLEHLTVCYLRMSQGYIILKRRSPRVCSLEKGRDIRGISCVAKDLHTDTKSPRVRKHTSCEIVDSDSEITTEIYNPQRGGAYRCLSHIARAGGPEGNLRDLSGGPRKEGPYITPRRDTTLYNTLSTGASVGREHPRGERDGAIHTWREGDEEAISTPYSSRDDRRVLHQEVLTPRAAERRKTPAGVVHQNI

SEQ ID NO: 964712 - protein, 429 aa, Homo sapiens
MERLPSGANNKLVKLGRVIQEEMGWVDGINSEYGPSPKGGVGVYKKGVQGATTAWARQTTWMRHKKHLRFRGSRGNPGVLPKVPQGAPGVSPPNEMQVSQRVRVVNSKRGGSLEERGEKRENATLWRTLCDHPNTRCQYMRSWGTWLTKSDSKCDLCVTQGHTTRVNKTLSLSGSLPRCATPIFLSLIQSGKATCGARKSKDGATEGITLGIWNHQDAETLERKGPPERALGVGPPSNPGDSAHHYGKGHRHTLRSIKTQIHKHNTTRYQEENKGGLPPWDIPQRNPRVKGEKASPQKGEPPRGHHTHSDPGRRPTVISYPPYKKKNTQLNTNRRGREDVQERQLLQEGKKLSEAPQVQTHEGQKRTTTNTRARQETNTHGEDPRSTESDGTQKATSDNHRSYTSNTAAGARPHQQESQRKREEEAHKS

SEQ ID NO: 964713 - protein, 135 aa, Homo sapiens
MRFRSATTNHKQRTKATNQKTTHTNKTAEEKHNKAKKKDRRQHAQGQNEQSLYTKDQQATTCDKDARRSKKNKHKKTKKRPRKQAKEKKKKEKKKKKEKKTREKDTENNSEKRKKKRTTKNQEERGKKEKNREKK

SEQ ID NO: 964714 - protein, 100 aa, Homo sapiens
YQAGRVTKVLGRTGSQWTCARRCAVEFMDDTSRSIIRNVKGPVREELKCSPFCESEREVPEVALSLGARWVLDVGIRSHLVDGNGLSSRSAPFLYVPSTP

SEQ ID NO: 964715 - protein, 39 aa, Homo sapiens
SVRRIAQQLYSVRPVARNQYQLQINQNERERNRRGATGA

SEQ ID NO: 964716 - protein, 299 aa, Homo sapiens
LLLAMAGPGPGLRRSRVCWPRTDLGCIICQWAAGLARHAALRATASAATAWMALWGCPLTPCRCGLPHLPAMWLPAACMPAAAVKNTATACDLCRQCTCLLPALLMIHGVAPDPCPSSPVPGAPVPSPAAGLRMAPGCLALNLAAGVGTAWCPAVVPLCSRTVGLPCRTVEPLSASVVARYPPIPTGPFSLFTVPINVTSKHVRSTRLLREGNYCEQSTKQYMNDSYHKKPKFPSLPDNACSTIRPGTTSYRPILHHTYLSAKAGVYRDLISYVKPSEQPWSVAPEQQQEIHRTMAHGP

SEQ ID NO: 964717 - protein, 230 aa, Homo sapiens
MRRSRNKTKQSLVAGPTDQTNNNLDRHTTPLYRVEAEQRRPHTHTKVSGAPPHRMHRWERPATAENQHPSRKYDKAHSSPQQNNTVDETENDAYSYSDEDETATPPPTPGRTKHTPETRYHHTAPKLTDENEYMFSGPPTLASLFRESRRTKSLPAHNTLPKHRIDRASTTPRERRGPTSPPAAQYKQRSYPNDGGYFPSPTTIENDPSTHPPQYFHKHRSHLTRECDSR

SEQ ID NO: 964718 - protein, 106 aa, Homo sapiens
MKAGTRNPRHVPIGRDSAAADGEPSSVAVFLEHKPSLSSMPAGGGHAGSLDWPMTPCAFIPADKLNMILLPGCLMENPALHDAKLRFESQEMYRDWGHAPITTPIL

SEQ ID NO: 964719 - protein, 184 aa, Homo sapiens
MSCAEYVGDRQTSRGTTKRNNPPFSGKVGAPSNPLRGPTVCFFFGETTPPEGVYFPNKRTHGERGYKIYSPERNSPKGKDQHFFGARVFLLPKDRARKGRHRIFLTDTTFPCWGCNVGPPTHNIFGASVRGGEFGPPSWWKEITTQEKGGPGRFHTPPERKPLVKRRTIWWRPLGGERYYHRFL

SEQ ID NO: 964720 - protein, 245 aa, Homo sapiens
LHHGGVRVCQADSSENASIAEDMISKDYYFDSYAHFGQSKRGKMLKDEVRTLTYRNSMFHNRHLFKDKVVLDVGSGTGILCMFAAKARGPKGSSEIECSSISDYAVKIVKANKLDHVVTIITGEGAATVELPVATVDIIISECMGYVPLHTSPCSTPVLYAGTSGGARWPHFSQNGPRWYVTATRGPGQLQQTNKIHWWERTVYWLDHVLASTRCGHKGALVMWDPKEVSTKRLLIKEWTLYRQG

SEQ ID NO: 964721 - protein, 110 aa, Homo sapiens
AGYRLPLPASFPADLPMGSSPPKGSGNIKQRYRVPEKLRVQLHDHVPRVLHSAGNTMQNQNCVGGKILRRSVHNLAVELENENEERGLGPVGGGCGCPSSTVGRPRNTGL

SEQ ID NO: 964722 - protein, 493 aa, Homo sapiens
MRVGAERKVQLGFPRHPSPSGAAPPSAGRADPRRNISLMRQRAQGRASKRTPQAEPTSMWRSQDDSQGAPPEELPDRTSTREQAQEKDDTYHTGLKTGPPKAEHQARHVGHHRMQQHSHNSAEDTIKYRTPKRSTRQRGEKYTNTHKCDSKHERPRHTENGAHNHEEETHIYSDQKIANTESKGTKKTDPTKIKAHQQRISRDKQAPTRETKKTGTHNNNKKRRTKTHRDTTTQQPTHKANQPEQNEKTTNEKSRPHEASPSTNAGNTAGEPVRSHDIRQRSKTNTTLQEENRRHMADERQQAIATPHDAQDETPIPNARTHTPSEEATPGRANRTTKNRARERKTKITEVCHPDRHKSSKTTKDNTLNVVAYTQANKHGDQQADSTREQATTQTPAYRTKQQPNDRTTPPPRGTLRSARDTKKEDAMKRNNRHASTEKEEKRNMTKEDTHTEGNNNRNRDRKHKRTHQVEGHPQKNKLVHTNKETKDQKIDD

SEQ ID NO: 964723 - protein, 40 aa, Homo sapiens
VHVGEPRGLGCLHRRGISHRPRACRKVMGSWLQSKREGIS

SEQ ID NO: 964724 - protein, 228 aa, Homo sapiens
QAERPVRCFSESGLAWQPGEDEGRRGLPRGGGRMLGAWAVEGTAVALLRLLLVLLPAGSGTRARVAGCRLRGGRSAESVIWAVNAGWRGACGRAGDPLPKGPFGSAGGGPSLKTYGMKLPFLRSNPEGTKILYQNCAVQMREHPWATEVPITAGTGDYRCVGSSDNFAGGSTFCTRPHATQGYFEVYRFEVGHVVVDRRPGHTLGLVWDMQSSPIEFILIEPPQRGHA

SEQ ID NO: 964725 - protein, 188 aa, Homo sapiens
MVPGRHGGSQERRTIKGAMETNKRLGTQEEEKTWGEDLRDPRETQEGKRRRNGSTCRDPVWSKKPVRRHPAGGGQGTNKHEEEKRGRDYYKGPLGDRAPTPGRNITENARKGEHHGAKGGGPYKSQEIKKQDEPRHKHASNKGGRTQADRVKRATESRKERRRGWNKTNTKMRTTQTHDTEHTTTYHR

SEQ ID NO: 964726 - protein, 306 aa, Homo sapiens
KYQYEFSLKSRCFPGQSAGAGFGQKRVKRGNVVEKKWNVDVAQAQGSLCLGANRDLGLPLGDVGEVNKQALPSGVSKFYVRRERGSGGLLLSPPPEAVKTYFFRGIYTSRAPFTAPKTEWPEAPVAPSSLGLLERSGAPCGAKKEGAVRTQRGRWWGWALGEHPAGARAPRACLSLAEGASVGGPGREVVSERVCRGAPPVGFARGGDICFLPRDSEVVLCGGAPQSNLREKSRGGTTRVELPVGPTIQVDTPEGITGPVDTPQVASPKGGAKPQRGPVQGTTNPKRPSHGRQKTQSGVKHTRVGP

SEQ ID NO: 964727 - protein, 284 aa, Homo sapiens
MGKKGLIWQGSRNLIKKAKSQVISFLSSLYRLSLLSFFILFFLSLCAAAWAQEPAAGAEKAVGQQKTVYSPTSRLPWARLVPIYPVGKLRVFSRVFPHFSFTVNNLVLEPGSSRPAFRIPKSVFPKNSSWECSCGAVGRGVLPPIGTAQTRSREGRRIGDIRGRTYLRGGGKKMFSSVLLTRTSSSGGGCRTPLFWQNCCPKGPKYSPRHRGMVYSPKLVEHKTRLFLGINCGAGGKNQISWEERWTREKIPFLKEIFTKLIPKKEGVFTNPVDNLRRVDSVPL

SEQ ID NO: 964728 - protein, 175 aa, Homo sapiens
CGNWNQNFFPFGWEKKTHGVVGVSGTPYPSHPSPRTPKKDKQRPPNVASLLCPSVKPRERLSGCGVGRQVERRPGKGQGRCLRLHRAGAVPVGALAPGFIEGTHGRGVGLGIGGAQPCGALAARLDGVPPKNFEGAPISAGIGGLPRGDVLLLCPPHILCTTPGVCYSPRALSPL

SEQ ID NO: 964729 - protein, 121 aa, Homo sapiens
MPLCFIKPNGNPLGHGGKFFGITRGPRVGPGWPGKRVRVAGPQGGAGPGEGSQKQRGHGGIPGGLGPGGPQGDPSVVDSPGYIAPTTVAEAETNKHTQQQRPCRSSRERRQKISPPVGARV

SEQ ID NO: 964730 - protein, 85 aa, Homo sapiens
GYLVEKQLSDFTRTRRVFRLVEHIGLSEETLFWLFRDALQQPSRPVQLRCIPYLLPMSGDLHPACRLAELNRYSLKLGMDWCVLT

SEQ ID NO: 964731 - protein, 569 aa, Homo sapiens
NFQLPYLNWGQRSEVMQTITKGPPTKGVQAFSTISYSIDVRYIYSNTGATLGMWIEKWEKISNTGEVEDIRVSFHMSCVGARGACDIGARGTSSTYMWIRTRQGGVIKNYLPLFGDRYRDIGEDETQNISPHIIYTDRWKHKWRQCEEYNLERGQKSPLYLKIYILVEKKGIAEIFITPYTQGRGGYIEEQGETNSVKRGKTFRQNILYTDKRTHLRGLLVRVEKEHTAAQSKCANRIVEDKKLSHHHWGENCVLWFNPLCGGTIYSPIIPLSGCLDTRTDKREMNPQINTVQGSKRVGFPRKGVYNIKEKQHECGEEVLNYRAQQRGGETRRKPLYTDDGHKNHRGPPQRRWVGKHTRINHTNITNGGCAVEVYSEHADQETPYQPQDDHGMKLPINSSEAKKSYYETSNDVGVTSNRKKKEPERNVVPLVVCCEPHYRGWCGRYERHKKSPMREREESNTRGERLTPPRSTRKREDEKTPHLEHGIAAAAHKKRRPGSNQRRDPNQKIVCEGSPQGHATKDGFSQTQEDPGQVGSLNKGGAERTHQRDTTYIDEQKNPVAKRKETAH

SEQ ID NO: 964732 - protein, 135 aa, Homo sapiens
MVDPLTACTEHLEKPQTLNAEPMKAARRAAVPCKATGWSCPRPWEPTFCISMTWIWSMELKKYYFGTLRFNDCPIGFRTCMGPAAPSFWPISPIWKRSIYPMPVPPLYLEVTNLLLILQANRQKGLALSQMRLWT

SEQ ID NO: 964733 - protein, 96 aa, Homo sapiens
MPHMHEGLMCKRPLRPVLTPSQRQSGVVSPAEDVTWAGDCVCFRDSVFQHILWSAFPRVICALGCPNPLVVQGLVCLDDMAQSPSIHLKPPSPSTR

SEQ ID NO: 964734 - protein, 146 aa, Homo sapiens
MKVLEVGLALLLGALLGILLLLGSEPGSPLWSMHGLVDEMNYNWEIAQVDPYDERPFMMGSFRIHVQYGRASQCGVEVTVTVSPISKVVSLWALDEIRAAGKEDLGCTRTLKKDMTQKITDLALSILDRMLQAYSPCTFASWLRKP

SEQ ID NO: 964735 - protein, 93 aa, Homo sapiens
RTGAETLLQGTPCWLRTDIPRSSFRLVLVGDGGTEKKLTFVKRHLTGEFENPSMSATLGVEVHPLVFHSQQMDLLKFNCMGHSPAPRRNSRGL

SEQ ID NO: 964736 - protein, 152 aa, Homo sapiens
MVREGPPGTRERTLCGGEARWRATGLVGDVIQRFERRCFTLVGMKMLQAPDELSCESNYQDLRRGSPSYPALIRLHGASRACGCAMFWWNGSIVSSAPLGPMIDTPDSVRLPQCTIRGDFSCPRSAGMSSTQGDSVEGGPAGKIQLWGFQRQ

SEQ ID NO: 964737 - protein, 70 aa, Homo sapiens
MCSAAERACLHVWREPCLRRSEEVDHLRQKGEGPPEGRQIDQDKVAQMYRDWVKNLWERDFPLSGGHRGR

SEQ ID NO: 964738 - protein, 129 aa, Homo sapiens
ETELRAADPAQVITIGDERFRCPVGTLPGLPSWCMESCGIQITTFNSIMKCDRWTVRKDLYCQRSAVVADTHAMYPYGYCQNRNDEGEALTLETDVPSEVSPNQLLLRDAAEFLPVLDRLVPLLVLVVS

SEQ ID NO: 964739 - protein, 40 aa, Homo sapiens
MAPWVPDFGPRPPVFCARGDKFRGPPIGGAQFQYAGSRIT

SEQ ID NO: 964740 - protein, 167 aa, Homo sapiens
MGAAPRRQCQGGPLGAPGVLTPYLVSPSAGSYGNCGNVVSYPRGGGIYESLFSSHNKYSEPEHIFLGGGGTKVVCQRFPRGTLFKEYIGLPDNIFAQGYSRGVQVPQRVCVPPRRLYSLPQRSGCVPGEQPPLGDTCLGPPRGNNCSSTAGFSHGTGVLQPRVYEGV

SEQ ID NO: 964741 - protein, 234 aa, Homo sapiens
LQLPDPGAERARAQVAEGAVRNIQAVGHMADPRSELDHPSPLGPPLQLASAEVWIGPSPDLSLVLLQALTLDLRWLPHLSGASGVRDAGVERDILVTRWVQKGMQASVDHQQEGHYQARTRKNPRSPLRQLTFKRRRGSCTREVYALVYSDKYWMQPQLLAQCHCARDSVQLKAKLGSKNGAVLETWMPFSKRGRKDGRTCSSSGDVQLEEGKDYPFARFNKTVQVPVYSEQEY

SEQ ID NO: 964742 - protein, 123 aa, Homo sapiens
MYPPLSIKVVRRGDTKARAPYDDRGTRLWVYHNEGCSPKQTSSLCARRADNNKTTLLRWQGHSHNQTNKEKNYTSAAGIILSKEGGAIIWLWRTRRSVCGRRPVLVYVGPPTAWGTTYGVWNL

SEQ ID NO: 964743 - protein, 227 aa, Homo sapiens
DANGVSRDSRREAGGAGQEGLLAVPGPAKVVSNGLMGRTVVAPELTADVLLLGLWMYCDWMPLMLSMPDTACPRAILPDALGFRNPKFWLHLCPYLAAKSFSPVLTYMGLLGDVRGPPETLASLTVLWAPVYPAISNAYLHAGRKSTTPFPGRPVQPMLYFLKESSAQVRSFDIFAAAESQPCSDRLDSLSHFNNTGPSYPTKSSSPAPKSRTRLSNLAYISTRRPP

SEQ ID NO: 964744 - protein, 192 aa, Homo sapiens
CDAECAESTAAGDVSLWRGGGHRRSARAVWPRPSPPPSLVTFSGPGGWGSAPGGGDVVQEEKIFAGKVLRLHICCVRLAPSGLEEATEDTSVEKLKERCLNALLLIGSLEDPKSITHHKLSTLLREGAEVMPGHILEENIQDPRCPIIREKSVLHHHFPKMAVSQQKNVTKQDQKGSEDKEAILVGQRQTAL

SEQ ID NO: 964745 - protein, 234 aa, Homo sapiens
MAAIPSSGSLVATHDYYRRRLGSTSSSMTACGLARDAPRKQPGGQSSTASAGPPPDLSGYHQPQACGGASPPEPSAPDVPIGSSPSNSQPPTAVNLGRAAVQADLRINTADTKNPVRAPLLLSGRGPQHFGMAFPDHLELVPLGPPKAGNTLKTFQMARPAYTARYMKSQNTAASRDSYMSEGGPQHKTALTEHSGHVGHIAVFMEPQSFVVHHPGEDIYAGPPIVGGAAIHFR

SEQ ID NO: 964746 - protein, 120 aa, Homo sapiens
MVPSHCLDNFYEKNQVKESGNWAWDGRFRGQLGGGAGNSPWRSLPPPRGPKAMEKQESTKQGAPSTSGEPKCKVVHKSVQAQEKRREMLRRKEEREGAPGRHQVRAIGGDAPLSRVCVGV

SEQ ID NO: 964747 - protein, 384 aa, Homo sapiens
MLKTRKKKENNGGNLVLSSRGGPIRDRGKPGAPLGGRHGLEWTGPRHEGVAKTLGEKPRAQAQGATQGEPPRDTTQHKCRVHRDRNIKSNRAKTVATYPQGGEKKKKAPQSPLPNDNKGAPDNILSRGRAAATKGRLDTRTFTREAHTPEQPTEEALQSDRLWRKNTPTRGNDAHTRNVTPTEGHKNAPQKNTGEHPGEKDPLVNTEWVGPQGGTHSAFTQRTYKPEGKKGVPNGVEHEERHERPPGETGSYQATEKRPHTYYPSEYTHRVLYYEAGETTLVAKTNELRPRVPEQRKTPPLTSPSSRLTKGEKSTAEHIEIGNTRVLVAGKITTAVGESWEAPKNTHIAKKAPQERTEQGESPPHLDDSPQQGEQDHKGARQKR

SEQ ID NO: 964748 - protein, 99 aa, Homo sapiens
ARKLRVSNQIYEYDKKQSVIEILAAKPGTKDHHYFKYWQNLSIGLCCKMVMHARIGRQLGSDGSALLGKWCDECKPMYRYIVTSICFAIVRQGNLIIRS

SEQ ID NO: 964749 - protein, 212 aa, Homo sapiens
DKASSHPGMSSGPVPCWLCTSITLLGERPVQHRVVQANESDLFHELLPTGASSTRKVVWSQHFTRSPQEPHVAIQGKLVSMVEGKKNTPVPPERALELRTASTLADCFILELGQNIFRLVWLDKSNSPGTATRLRDLALVIRDSERTGLMAHGGDCHWHGEESLCEDDPEVLGPKPALKEGNPEEDLTGDKGKCPRPKHLYKVSDATGQDKP

SEQ ID NO: 964750 - protein, 269 aa, Homo sapiens
RSPSGNHDATVIVGGLHETVSEGAAVGTVCSSLYQYVNHPRATRIESLASTKDYGFVEFLSEEDADYAINDHEHDQTLWEANTGEQSIRLDNQKPVDVGANIFIGNLDPEIDEKLLYDTFSRRLGSSLQDPQNYAGAYTAGNSKGYAVELILLSFDAFGCSNSKPMNGQYLCKPSYHRHLIAFKKDSEGRCAIGISKANDFWRAPEPCSSQGLIRPHQVVLQMHLLQPFAPNLCWYHHLGSVVPSTRVPPLGPFPHPGGPSLGLPPVFP

SEQ ID NO: 964751 - protein, 110 aa, Homo sapiens
MRSTKEHNNSKSSPGGAQHNNTSAAQRSTEVEPIKQTNNTINTQAQQQQRDVREKKTNVEETKTQLSRTYEEETRTHTGGNQADQNTKETKQIHRHRGQHQKLTKAQQAP

SEQ ID NO: 964752 - protein, 69 aa, Homo sapiens
FVQVGRVAYVSFGPHAGKLVAIVDVIDQNRALVDRTLHLPSDETLSLAFTSCMQLTDFILKFPHRCPTQ

SEQ ID NO: 964753 - protein, 411 aa, Homo sapiens
GQEVKFIGSVLKGGQHFGTPFYGLQGPAILSPEGPRTGGMYLEPQSHSGYEPVFYSHHVLQYSISLLRHLVCEESPIFSLREMCGDSSLAGPGEILRDLVASVGRVALQSTYVLPVCVLCDACGVAGCGTMCIYTVCAQMCVLHPVCPQVCPCGGFLQRATSLTCALCVCESACVSSRHRANRGTHTISVCVRKSPENMTPCETSRACYERPGKPPGYIVVESAISCVPHTKLFIYPMCVPYIVWAAPKISAADKTSHEGGFVEESGTRVMSLQNYILRALLSSTRYVVVALPHNKGAGKKCSMFPTLFVVGPLLYTPRRPPEGFPKKNVWRKIFLWAATLQAGDTNPFLAHRENRWKEPFGGGVKQGHLSNSLYQKIPPVVYTHQAAGPGEGERVCPPNCGDERPAGGIL

SEQ ID NO: 964754 - protein, 131 aa, Homo sapiens
MVRRCLCGPGPSEYEFLTSRGGVAPKGMLGRGSYSVKSRFTDDRKERPPVLGVDIFSIKKDLEVTDAQVRRPGQGQTDGRDDVIARFFFPPINVKPPKKKSERTRDAGPQPGGGLFVGTARKSTIELVRNH

SEQ ID NO: 964755 - protein, 428 aa, Homo sapiens
TWVRAAAVRERDAVVPGCVCGGPRRLPPGTQEVPVPVVPSCVSPGVLCVWLLCVPGCREWCPGDPAAVPVSCAACRPLCRIVHWLCAVLQLAARVDQRSVKRALLRGPGVDSAERCLRLALQLRLRRRTGVPLAAGAADCMRVASVACRGMLQHAISGTSDGATCARAAWLLPCYVPCSKAMATVSRTPVMLSVLVRSRFIIQDPCLALWGGHARVRLPLLVLAARFIGDRSRFGWVLHTDLRTVRPHPGARHQGPMKTGGAHGTQGIAITGGGQDHQLYEGRPGLLMRLARARRGLSRTKDISISDQLGGAGLFPGVTGTRAMHGRVEKTGTTRSSSSITTRREPGEQRTGSIAERDQGGGDTPERHRQRGDPADPRRTGTPGGTHPERPRTNRQATTTEQRTAGERDDDTEQNDTGQRNEGGPRRS

SEQ ID NO: 964756 - protein, 308 aa, Homo sapiens
MTPVQRGGPGVPVWPCGWGTCGGFLRRVSAVASWWPGVAGLCGRGPGGLMAAGASRRQGRSDTEWMPVTKLGRLGQGLEDQVPLEEIVSSSSLAQFRESENHLDFFRWGASSSRMKVLRRFMPVAERREPCCRGPSGNQVFRGGILGYEIFGGDHTELAAMSAIMESSNRWLQEGRVVPTGQSGGGPIHSLGQRASSQSVPPVCRPRRAIRGGEKTYDFGEQAPPNKRVSPFATCVDHGHGYAGHYLCRVEYTSHSIPLWNPEGGDHLGPFRILRGQPLLAFKKRLASIRCAMDIRIDLDTPLRHRGA

SEQ ID NO: 964757 - protein, 48 aa, Homo sapiens
QLKIPFGPGVQPGVGPFGGVWRSKVKNVGHTKCSVAGRENITPRGENV

SEQ ID NO: 964758 - protein, 112 aa, Homo sapiens
MPIWYDQVVVRYRRHPCSIHRRCGATTEDLAISGPRRGHPMAQGKTVEPVLKTSAKTGNTHCWGAQLWSHNRPKVRPDMGELCAGEISGHIMRGPTADGTHQDGEGPLLGNR

SEQ ID NO: 964759 - protein, 175 aa, Homo sapiens
MRHQNKTPVRQWLRNPAGATTEGAGKNFYHPPGGRRDKPQSGVATTVPMRSAKISFDPTYRGKTNPVTVTKRSPPKFAAASKESPIKADPRGGDDTTPFTVSHPPLGKKLNPPSVDVRRTRAHTPDCRADTHTPKTTLLLGQNNQEEGNPAPRKIGESRPPRKNNSLERALASTR

SEQ ID NO: 964760 - protein, 332 aa, Homo sapiens
MSKQQNYTHQQNVGIYNNIRGQDNTPNEVVVLMWSPQQKGITQRGRGNNTPHKKEGRRPNVVVPPRGAYPTKSAYRHPHTVDHHLMRSPPTPGAGKTIRTNERETPPPKDRGRGSGGVIKSGRTTPNEKVGITPEEGCEYERTPTTMGERAGAGETTPERPIGRGAQPTEEQEKQTHSDCRVDTKREERPPTMVSPETYRRGHPQGGLRQQEDPLLRLWRTSRAEKQQPPRGGQNNTKRTRGDKGNPPLVCSTPARRTKTGAGPPHDQKERKGGPPSSIEEEHTPSKHQTRREYNRRLGHHKTMETEGSKRRAPIPPQRRQRQRNHADREVA

SEQ ID NO: 964761 - protein, 143 aa, Homo sapiens
MWDTKEAHTCAPLKRGPPSGVDTPAHTFHRPDVLKLGPAIFVENSLACALFSDVPLPGKSTHMALVSFFHRRPSEGRLLLEGTGGSCLGRVVGRPPLLGPGALSRGRPLASLSVETLGFVVRAPARLPGHISLHAPRTHTAQQ

SEQ ID NO: 964762 - protein, 159 aa, Homo sapiens
KLRLRWGEALTSSGRLAPRRSAPALHSPGMCSVSELCLHNSSLILHDDEVNVTEYKINALIIRSQVYSSLTPLLWPALFSTEGARAQDVKPLCGCLHLQMYGAPLGPVSRKVWLAGLKPAEGPRLSSNRWLLEPRLREQKERVNPMETFEDIPERSVRV

SEQ ID NO: 964763 - protein, 204 aa, Homo sapiens
GFRLRPNEACGLKAQGPPPSLPALQRTSQPLSCTNTLDRFSIPNDEPQMEERSEEVGSGYSLRGLPAVCNPVGRRAEAAGCSSGLGGQIMDRRKQDAIAGGAVRPAGGATHREAPRLSSSAPRQGGSGHPSRTKRCPEKGGDDPVINSVTMRKAISHGAPKRTEARVQRAEGHAASKRTGGWRRTKLEKCSPGVCTSSGREVYA

SEQ ID NO: 964764 - protein, 161 aa, Homo sapiens
LHVSERLLRFCLDRPLPDMSRDRSDRWRWRWGFHRREEAAAGAPDSVLRRPDGPQSESRPMVPGRAKRPKPPIPPPPPDQQQQQPPPQQHRAEPPRSAAAHPQAHQQQQPPHRRGLFQARRCSGPGPAPGVGSAPNQGLPGFGAPRPPGPNFPKPKKPFGG

SEQ ID NO: 964765 - protein, 437 aa, Homo sapiens
PLFLGRTVDRAYAAETMICLTGAELLMACTQCDMWKNRYSSPVWWTCVAMHASDQLHLLTWLSCMTYCLHTQRQMLTLRHTNGLVLLTASHDETCDARRDTYTGWLASTAVGYSPIPTTNARMPQALAIQGTSRKKASATRVSPWATQQAIEHGADRVPPRYLGQQSRQPASTRGTLVPVTTPQGRLCCSLTFKPGDGTRSRRARQKRPHFRVRYLNDYGHHNWRATNLRSRCHTNRPAQSMGTPAHNRLAEGRPLVAQPLRPSRTAPPEDRGGIRPIPRDAPNPGKGDTGTPRNYERTTNNDESNKATGISPHQGLTTAPSGRTPPPLAGHAGCALSPYNTRKQRESSTTTAWYPRQNFIGYGTEPFYHHPTLRLRSYFERNRKNAAHQIDRPTLIATQVHELTPLYLRAYSSAGCIVARQTERLRYSTLRKRKPK

SEQ ID NO: 964766 - protein, 137 aa, Homo sapiens
MNDKAWNSRKSTLKRKLKAHCQQEAARYGYAPQVARNARVNSLDRTTLALHTPEQTMTLRQRILFADETALRTTHTELAQHTLHGCGKRLLDDTRTSPRPTDKECRKYLHDFPLTPLSGGRTTRSTPRLPRNRDIHT

SEQ ID NO: 964767 - protein, 344 aa, Homo sapiens
TLYLGTSRIDQRVLLAETMYCLTGQRLDGSTQVTVEEPGTAAQCGGPVWPACLLIQLHLRHGVPQPMPPPRTSYPHINDCLLTQQEKGVRTLTCGCCQMGLSLILSNAVSPRLHQQSEYAHRGLDNVGMENLPILQTAHGDRSCADTKDACVVLKVSRVPKRWSLAPKAHGWPPNTTRRRRDRNPAGACSTSRAVPPSTTVTERDPAPPPQTQHPGAPRSEAQQWRMTWEPDNTPPGPNARHPPEQRPNNLCRLTHDSPPQAQGNEHHITWAMDFRESEWIPDAKYCHNRALRKTRFYQSMHTLTWETHPCDRYMIDLRDNNVNHYKDHVTLLPIPSTPPGPYA

SEQ ID NO: 964768 - protein, 136 aa, Homo sapiens
MEYEGHAGPMEISQLYLKVYSVDELSDHIPSFTMYNDFKDVGQMLMGKLAVIRGVTTKELYPEFGLDMNELSRLIALCAQLPGQKGVAHDKHESPTAYLLSFQRRRCQKHFAREAKPNQEEAREQAGMQDRGVPSS

SEQ ID NO: 964769 - protein, 183 aa, Homo sapiens
MRRAERGAGGIIRTPRRGERRPFCARERPLVRNPPVQRRGVSPEGGPLIIASCCARGGCGLSITGSFVLRLILNPPGGGGPRGGNSPRDLSPPYSPRTSWAPLKRERGTILFFGSPREGGETPQKRTREREIRGCVPPHLWAPGPQEPPGESPIKRTFHFKNGHPLLLNAGDARRAPLSSKKT

SEQ ID NO: 964770 - protein, 58 aa, Homo sapiens
MTMTANCAQNHTRELEAGTKTVSRYHASKTTTHRKTTRVDDYKNKVEERKYNKGGATM

SEQ ID NO: 964771 - protein, 278 aa, Homo sapiens
MLQRDCLLSTCDILGNDERAPMLFSPRTQHRTPLLLYHYLATALSFFVVCNHTMTKPPLSFPTYLSATNLRHTHLLPYHHTLKLLYVDLPTRYAQPSINIHKQPFLAILQQERGVMFVFAWVRAKRLRGDDESVIPTRCVTRETCRLRLLRLLRAKHREEALDLRDRTAPYLFQCVVREGGAHTRARDEIYIKRDKINLTCRIISKHESVVCDTNNNHVRHVGRLAIIGRLSLNSNDNPTDSTAGATGRDASFVVNPPQVVPFFYFYPRAILVGRAHI

SEQ ID NO: 964772 - protein, 184 aa, Homo sapiens
GSGNWPQRANRFYWASSPGKYQRLGLVATRLQLSLLLFLISGIRTFQRRALWAAFDVSLILCRGTAQTMWLYNVFSEKAQRLSTEARLCVQQDTHKSVRLWFSPTARAEGRRHHSHTQRLCVGSLTQVSPGGAPQCACVWRSPLRRETPPCVCDVMCGFSPHETRCGKRGISLATVCDRQGVSL

SEQ ID NO: 964773 - protein, 187 aa, Homo sapiens
CPWAGSPAGRERMRPHPVGPGRFPSGESSLAAAAPCIGRMRRILVPWPGLKPEARGGSSPPNLFFCGVSGAGRGTRDNEFGRCHFRGAQERLEEKRHRKRDGAPKGALERFPDEMNRHIPCSRFKPVGNLTKSSRLVETRECCPLGRSLVNQRHYSEGPPGQISPGGPNFHLFRKPDGRPFQEENLR

SEQ ID NO: 964774 - protein, 119 aa, Homo sapiens
MWEENKEKHVDTQEGNVQARSTKNSKEYVRAKVGVDGGASSVAYRKESDSWVVIKYITHNVSNLYSRVCAPPVSANVGDSSLWRVDSVWPFSVDTTGRLHVCLSKHIYSHCGLLLSHFV

SEQ ID NO: 964775 - protein, 133 aa, Homo sapiens
AEGSQGPRQGSSSRHHCSLRHTPEGVSMPKAARLNFPRPKSALERLYSGDHQRGKMICIGAAGAHEAIPEGPGPRAQEDTWRGKVTSDGAPVHHLVYLSRAAPCEILAQYVRRGQAAWHGYRECRYAPSQVPL

SEQ ID NO: 964776 - protein, 279 aa, Homo sapiens
MRLECFGYIYHKLLVHEVKDVIIKCQLAKRFTSAVASPTPNTPKFMCEDCAAKPLSLIQARQAREDGDVVATIVYHLALCKATGPVLVCAPSNIAVDQLTEKIHQTGLKVVRLCAKEPVEANRLPGVFFWPLEKQIRNYGQHCHELEKLQAGCKTRLGELVVCRTRKRYRALKRTGEEELLDERGMSSAAHVWAPVTPRAGQEGQFRSILIDERQPRQRAGVQWFRVLHRGPKSCSLVGDHLHRVPRGVFQKGAKAGMTQDVFKSPGRSATRGTGQAKR

SEQ ID NO: 964777 - protein, 216 aa, Homo sapiens
MCHDVALNAWTWTSQLTASHPSSIVFPGSNTEDYNLIVIERGAAAVATGQPGLRLLGTPGAAHPGWHGSIVKEEDDGGWQLEPLPIVTEGPDIKPVLMALRMCPGAEGPRLASPIVSTSSGLEVVAPEGTSASQVCGPGTLAGQCHHLPCSARSQADLVDVQPSVTSCLPSWTVSCPTCRMYQGAGTVELYQVCHVAPLYLNGGRDGMASDPGVVA

SEQ ID NO: 964778 - protein, 433 aa, Homo sapiens
SLRGPRWLARGSAAEVVLVAAAGGDMAGWSSDLSGGGALSPCVSLDVSPCLPCPLVERAHRLGALTGWRLCVIGPAEASPGAMASLGKGQQKEHAVTGRVRTDDKVPQLCIRRGPCQPMCLPQRATNFGRVVCPLPCCAFNVAPSQKCKPHRSRRAPFETPFQWGRCGPPGAAAAGEMLRRGPMFTRCNPLRQTGLRSLQRKEPAWGQRLLGKGLIGTETCLTKAAPAFYPEGRALRPGIPVIAEAPKERGPKPGEPLPKCYHIGPPKWSVCWGEAHPAVNNGCPGPPTVGSKCARCNVLPPPGCCRRDTGAVIDNMWFCVLRGAPVAKYARWAAPNILNQIVKVPAATPTFFVVAPRPGGCRPPQRAIVEVGGSPPRQFFFRNFGCQNPPREVTSASLHRCVQEIIRWWWSAQTRHDTFKKIDAALEKKQCV

SEQ ID NO: 964779 - protein, 120 aa, Homo sapiens
MIQVLLRIDTDYKPRLCVLNIASPGFLRARGGEEVTDEQADGSSKATGSLKRECEPEESGVESRGRLAGQGAPKETICVGGGEKSSLTIVGPGGYKRVNPEGVRAPQAGRIVRTLRESRG

SEQ ID NO: 964780 - protein, 57 aa, Homo sapiens
MIWPSYPPTELGQWKNRLKCGGAPHKLFFTPNGPAGGSGHFPKKKYILGNSPLCGGG

SEQ ID NO: 964781 - protein, 68 aa, Homo sapiens
RPSGCLQGGEPGSTRGGKSVLLQAVNPGPESEGSGVPPRPEEADETWDSKEDKIHNAENIQPGEQKYE

SEQ ID NO: 964782 - protein, 207 aa, Homo sapiens
MSDAAVNTSSEITTKDLKEKTEVVEEASEEVVETPRANGNATEENGEQEADNEVDEEEERKVWEEEEEEEEGDGEEEAGDEDEEAEISYGLSGASCTDDEDDDVIAKKQKTDEDDRQRETDKVSKVKCWGGISSLRVVRAKNPRVYARWALWREGAFVQYSMYSVSEGGEMRGEPPVGGRSIWGPSLRNPGEKRTKGANPGSGGQGA

SEQ ID NO: 964783 - protein, 51 aa, Homo sapiens
PCSAKNPIIGPITHIFNNHGTRGKEHSSQKGSSQKFPTDTRVDTNRAHEHT

SEQ ID NO: 964784 - protein, 357 aa, Homo sapiens
MRVSYQQGPVIRDEDVLDLLLGSLIHIFLGNRPPGLGRMDWTDSINLGPRDHHPLHGTRFVYTRQIGSLGRKTQELGSSSLGTGERWRRAQSFSRGPARFTLDGGTIGRRYWRVARHSVCRLVLLGGPEDLAPDWRAGPLGRLGFRAVGLENLTGYQGGRRGHKPSDRDSSGGVPRMTRCGRPEHQGCGPENPQEYSRSLGDTVWAPIDFARIQWPSSPGGDYLWREQGKFLPSYLAHRAQGGRCRAKGVPERLKGPPGGRGAKNPRIYDGGGKKRGGNTCKGGPAYKGRGEKNRAPGGTPLRAVEAGPPQEAGGGTTRCGARGQQESRRDDSLPGIQPHVMVLQCEGRLTTQGEDS

SEQ ID NO: 964785 - protein, 287 aa, Homo sapiens
MPPERRRRMKLDRRTGAKPKRKPWNEAGLDSRMRGQAGLPKKPAPFIPAVNRRPRPSACVRCVLQYAAGGVKRDWLRQRWYRLRPGGWTNRAVESVLGWELVFWRLSTNLTMDRVDCGAFCDGPEGFRATMKDSGDFRTWSNEGKRVICACSKRSQFGLEWRKMKHEEMVDMMSNRLRTDMMTQVLVTVNFRRDNLKTRLTDEFQHAMGGVPAWAETYLSGKHLPMMNVKRMTMTCAKGLGIFHYSTFNFFPRGPLAPLRTGSMQCERSYWWLGDFPLGPFIPVPDC

SEQ ID NO: 964786 - protein, 149 aa, Homo sapiens
LPAAHPGPAPGLVMQLFQDHGFFPSAQATAAFQARYADIFPSKVCLQLKIREVRQKIMQAATPTEQPPGAEAPLPVTAPHWHRLLPLPPLPAPQGALTPTSPSSDSGTAQVPRQVLHPQSRGLGQPAWEGAPQSFPNPRFPHTVCHKAG

SEQ ID NO: 964787 - protein, 274 aa, Homo sapiens
ERSRRANPSQPAGVRRRWRREGPDARTWPRRPPWRTAAPAGGAGVGGPGPPGPGQLAGPVTTLSYFQKPPRGAGRRGARGGGGRMTGPCDGAKGKGHRSSYDRKGAYGKAPSILRGGGIRGSKLSGALYEVASDRGDSRESGDLDAWIEASVGPVREVTDCPGSAKGQGTLLGGPVYKTHRGPSISWPAGTKIRGHCRKLSTPQEEVEGPDPGERVAPTGQSLPPKSRRQQQIPGDADKAWCHEQGSFVRLAQEVLFPLPPQFFHFGGVHWYYR

SEQ ID NO: 964788 - protein, 280 aa, Homo sapiens
QGELEVNYFLKIIQLWMIIRNVSLWEQDNVGSKQNAADPAMSLRGKAVVLMGKNTMMRKASRGHRGKQTQSLEKLLSSYPGECGLCVHQWEEPRLRSGTCCWPIRCQLLPVLVPLSHCEVTVAAQKTGLGAREDLLFPGFSVSPLRNLQGTHIEIRECCARLIKDCDDNLGMPAKTTRLNSATRSPGFSFGRVMPAGVRAWQAIYNPEGGLISQRRTLHSRFLEGVPQCCQESVLQIGYPTVASVAPFYHQGSNRVGRVVGRVNLPLVKRQAFGGPPLGV

SEQ ID NO: 964789 - protein, 113 aa, Homo sapiens
MTRCRARAPGSRHFVANRGTTRWPSSVWVLSAPREVAPGIRWGIILGKLSIVPRDAEGYVGDQDRRVAQWSVPRCPGVRLCVGSPIPVPGRWLVPACAKDAIKAFPYGDPPGG

SEQ ID NO: 964790 - protein, 304 aa, Homo sapiens
LADEEAAEGNPAPVAPRPTEGDDLREGPGAVMVSYVDPISMLLSLLSAQSSPARVSGLLLIPPVQPCCIACAQQNGGTGLFGVRPQCQVLCKDCSGYLELGEEALVELLATSAGAKNSAATVAVASPFNSEGLHSDSSWRITFIGSLRVIGAHSLLVGRAQQLGKALRRSRLLIKSGRIGPVTLCTISTNPIPWMVLVVRPFVQLPYLGGFYPVCNWVSPLRLLLARLGHTQGGAMCVTSHPRTLETSQPFLAFWPGPPVILPEGVWGRKGVLGKSTWLVKRPRAPPRIDLDRGKSPLGGSANP

SEQ ID NO: 964791 - protein, 182 aa, Homo sapiens
MLLRASSLAKGQLHPSQAREVRRDHRLVVRPSGTRAAGLGGRSKAGMSQGAASLSAACPVPAGRSLETGRIEEASTQGRPGCKHLPASYYIGGPRSNTAGTQDHKIAKTILRTLLHRFETVLQKARRKGFVGGTFKFPRGHKGTKRRKGELKFCFGRKEKFAWPQVIDGDALSLNRLRRLWE

SEQ ID NO: 964792 - protein, 340 aa, Homo sapiens
SEESDSDREALAAMNAAQVKPLWENAPSVKPDLYHGSMEATCGNRRLDLVPPWEGGAMQPPSAQAAGSWDGGLSRAGSAGQSSEQQLIGRGAHMLLAPELSEQRPCGKHRSMAKTHAPSHCQAGHPQNGTGHEPVQRHTADNSPMRQARDDAAERAHSRHVPRQLQDGHQSEPLSCTPHGKNQARDNTSSGAKAMPQSKNQLPLASAQGLARCCDAGRPRSRPEKRHGHLRKLPHSQGLQSPRPVGLGGQPRRPRRTDFVRTARERTSGLVKRTQTPHGPRAHNRGEQAAKPHAGQKGPPRLRPQAPHVARLQQARQGGQPAPAPQNPPAGATARPKAAH

SEQ ID NO: 964793 - protein, 218 aa, Homo sapiens
VGPGATVRSVKARTRVHSSGTWIEAGAMVRRAGGGAVRRAMLLAMAQRDTRAACRSLVKHLLTRFLRRRTDFFIGGEERDGREDWPGERMSASRRNARRLIKASDLVENSRRIMRTAWGKPSWCFELPPAGTAFDMSGHYKFKRYHTDLSATKIQLAEKTRREKRARQEGRAVGEGGGAAARLGKEAKSETSGPQIRELTDEEAEKAAGRRLSRKKDA

SEQ ID NO: 964794 - protein, 239 aa, Homo sapiens
LQPRSQRLNGPPMLGEWGGRSGPAALLPSGSPSRLLPCSFGSCMARIHPACQQAPYCGGLFASEGHPPVPVRGNAAVGGDGGQRAKVIMPYGGEHKTLCPAVYANSKESAPQTLHIEHAPSKSQAIGRRSTQPRKRETQKSVVCIHTQRSTKTYIKDTKATIARHQLADAPNHRCNMSEDRNCDRGGNQRGEKSALLMLPPRAEGANEEIRVDRRRDENTQGPRRADDTGNLSRHTLEP

SEQ ID NO: 964795 - protein, 261 aa, Homo sapiens
MWGSYKGNTTLISSYKFCVTCHAPSVEHHRVYTRVEHVKPRNNALGSLEPHVAGNKHIHVAEITHHGGVDNKRFEDHSSTTSCIYVSYTPFSVVGPPMWGHFIQTPPFLKNLVGARLTHRRNRGQTYTTNTQGGLAHITLGVAPWSTNWDTKKRHGGQKTLSRPPVDQGDTAEQPPVSVQRQHTQGQSPGAMQQRGTTQQTQPHTSHKPSSNSQHYSPLNSEQQNPDQLVNSNVARTLKREHTKQRQIAAGRAHTPTNPDG

SEQ ID NO: 964796 - protein, 239 aa, Homo sapiens
MCAEVSHTTQVLPRCVLWVCPLCGAGTIRARVFSHRYIFVEGQKCFARATQMWVEVWTWEGKPSAVGTHEWAPPRTIYKCPYREPYSQLSSGRVAPEGGPVVYTAPGALEKKLYTPFLGGDNTPWGLHSGEGAYSPENGKKEGVSPRGIHWVATIRFGGGIAYIRKAPLFRCGAQRGVSRGGAITGGPPGPSGLGETCPWGRKRSPVAKAPRPGGPGGSIGKNRVPFDKVAGTNPENAR

SEQ ID NO: 964797 - protein, 76 aa, Homo sapiens
MVFSPPGGETHKVFSNNFQKKQKTIRETTHTNNTTTRTYYNQNTYTTHKNQQTTHSTTPQLFEHEKNNNQTTRQLR

SEQ ID NO: 964798 - protein, 89 aa, Homo sapiens
LFAMDPVCAGPGVSAGRWLAGGVLCLGCDMAGVMHVTYIWMCCDALMPLLCALCCDAPACRCSPVWMLLPVCFECALTVLCVLAVTRVP

SEQ ID NO: 964799 - protein, 253 aa, Homo sapiens
SENNVVYLDLKLENLMLDKDGHIKDHRRSGLCTDGDQWSVPPMKTFCGSIWVPGPEVLEDNDYGRAGVLVGRLGCGHVRDDVRSRRALLQCRTMTKLYELILMDGDPGFPRTLGPEAKLLAFRAAQEVTPSQEAVSGVHPSDAKEIMQHRFFAGIVWQHVYSRRSSVPPFKPQVTSETDTRYFDRGDSRARMITDHSHLSKDDSMRGVDSERQVPMVPPGSSYSRQAARPDAGGGTALDRCLVTGLATAASCA

SEQ ID NO: 964800 - protein, 30 aa, Homo sapiens
MLRLYRPRWSCNKRHGSVEPFPGTVRHVLA

SEQ ID NO: 964801 - protein, 289 aa, Homo sapiens
TSRYSEPYGEDDESGWWTPESDLRGRVKRTGPIVLVRLLKALGKNRSVDFNPDFVFSAKEGTYDGSWALADVMSQLMKKRAKPRTIENEEDGESSERKRKNRGYKNAKSVEVCEHGEQKQRKALNQRSMEDLHRSNDEVKVSSQHDTPLRTDYSSADENILTKSEIQLYRKEDRKNQRRRTAMEAGTDFLKDASQYDERPLYQENEPFPPLLKAITSHGLQASPPESRRRCIPVGLWGNGICAFAALGKVKLLAFACCERWFLTRKVSHQDFGVVPPKLGRCRWPRGVR

SEQ ID NO: 964802 - protein, 47 aa, Homo sapiens
MAQRRRHLSSHVEATIVKPGLSSLQTQQSAQQTNGLTTVPGSHDVVR

SEQ ID NO: 964803 - protein, 212 aa, Homo sapiens
MFSASCVQPRVWECGSGGQSLQAPSGNSPILPDVPKADSPLAYKPSVSYPWDLAGSPPHPCAVLIPQIILCGYFYHKRPRVFRRGCEQKAENHLFSKRSRVGLIQTLTIGAERSPWGNISLFLSKRSTLVCGDLSYGALIYKRENKTLGGYFSPQDVRGPMCVQARVNYTLWGKPPISGPLKSLWARRKRIPLWVSLPREKDFLTASKNLYG

SEQ ID NO: 964804 - protein, 109 aa, Homo sapiens
MEEHSMFMDRKNPYREHGHTAQGVIYRFSAIPIKLPMTFFTKLEKTTLKFIWNQNRAHIAKSILSQKNKAGDIMLPDFKLYYKATVTKTAWYWYQNRDIDQWNRTEPRK

SEQ ID NO: 964805 - protein, 232 aa, Homo sapiens
LHPACGIPDSTAVMPRKTARTGKSNYFLKIIQLWMIIRYVIIGGADNVGSKQMQEIRMSLRGKAVVLMGKNTMMRKADPRASWKTIQLCRNVAASISWGNVGFVFHQGGPSTEIYGTCCLANKVAQLLPVLVPIAPCEVTCASPEHWSRAQRRPPFFQALGITELRISRGTIEILSDVQLIKTGDKVGAREATLLNMLKISPFSLGWSSSGCSTNVLHLTTLNVLDITGGRL

SEQ ID NO: 964806 - protein, 329 aa, Homo sapiens
KEERAKLNLCARWGPLACPRAARSRRGVAGLQRSASRGVPTRLDWPPHALAAELPCGHLPWTCALACLSCCPAAEMGAPVCTCLDGVCLVFACHGTLPLLLDPACCCCVNVMYMPDPACRAMPRCPLPSQFAVRATPLLAWPPVLLPWPGEVGCESCLTSALLPECGQLLFEQTACELVRLDLCAAGSGRRRGRLVVLEAALATLLAVVARLWARRGAGTLGPGAAAWPSVQEGFGSAAGADTRGARCEAPTNRFPGASFMLYNLGSVGSLEYEVLQMAVGLCACLTSKGLGECAPRGHVRLDRLVRTWATGELAVTALWDSQRETWGG

SEQ ID NO: 964807 - protein, 70 aa, Homo sapiens
KPEWYEWDEELIWLVEVTFYQKELAMGSDKQIVREETVFHEFLGDWRRRNSVIVIATGKKRSRNEEGYIN

SEQ ID NO: 964808 - protein, 192 aa, Homo sapiens
FLEYVAESLEPPSPFELLEPPTPGASSVLGRPCCYIFPGGLGDAAFFAVNGFTCCWSTVCAQTPMSSFWKLVLCTWTCVDAVLVTHPVRRQPPRAQQPAAAANWLELLQMCVLLVRGSCGLTWLLHGSSPPTWGSLFFNCLRGRVACLALLAERGGAEAVLLSLLCAAGHHASATHPRPRASQTHRALLRKM

SEQ ID NO: 964809 - protein, 123 aa, Homo sapiens
TQEPKTCYIISDDKGIKVTAEQTSRLLAVGDMVMATVNERRKQSSEKRYDPAGGHSDKRTVITVEKMACFVVFKCMESYVTHITGEHAKVLSQLQDQEHKAGVQTCGPRSGIQCWQHGMMSSR

SEQ ID NO: 964810 - protein, 148 aa, Homo sapiens
MPSPAAVLALQWAVSGHHFPLLLHVLVDVNVHDTVDVASCRSRLTHGPLMAIHDVLCQCDRCTGPGPQDMGSARVVSPQHDCTSCIPTTPVSPVLPPYLCSQLIDDRRVTAHLRHCTSFPLSACLRRLPHHTSSPCLRYPPTALQRLP

SEQ ID NO: 964811 - protein, 294 aa, Homo sapiens
QLRGAAMRRLAELTVDEFLRFWAFDYLSPELLMPENSPQCWQTSVNALLRSARDVLWIMPGLWSPSASLAVNGRASEHKDQLSRLKDRDPEFYKFLQENDQSLLNFSDSDSSEEEEEAVPLPAMMCWRKPVRRRMEREDRRTWGQTSPERPARAQRSTSAPVHRSPWPAHDGTRQPTATPHSKAAPMQLRTGRTRAACGQPPDGGPRTVPDANKYQVPEQRCHTMLCVTFCIRTPHWPVYTNPPLGPRAHGKPPRSSTPCQSCLALRRPPSSPSLAHLGSANQPRCLCPNLSPP

SEQ ID NO: 964812 - protein, 415 aa, Homo sapiens
GALETGPVIASRSRSRSRGRRAAEALSGRSAAAERLSQGCPCLLMNAACLPSALPWRLQPRGWSSGAGHWRLLHVRLAALGWGSRLSALRSLSPQCRSQGGRGRRPVPGPLERPPRVPTSIGRLSGGGIEALEAGLPGGGSVPACLAATRIDNWGPAFPPWPRPCRPPAEAGSRKLPTSEVVVTRSPAREGSAAGEPQRGPEAPGGAGVHGACGGRRTTQAKERRKAGVRDRYGTITRPGKLQGSLGGHVPRRTRLPPNIEHEGEENRRVDQPSAELCVRVWVKRPGEAKVADKREAITSKFDPLQGVAYSAGDQPAHISTPYKGRFPTGITLYKQCGARAVGTWAGGRLQPRSYLLTPKGRRCPAQVLEQATTLERRGERGAAEGSPEGESKNGWSTGRRRRCDATKRESTKVG

SEQ ID NO: 964813 - protein, 217 aa, Homo sapiens
CHHDLPMAQLRLVQIQFCASSTACNKYLTGRGCSVCSMAELLYCHACLEGMNADLVTAVMHAPLHDGCVHAAGLSCHCCMPPMCACYPVLCCDQCDCATLLTLLMLLMCCPWSLDLPGIPSICRAGILTDRVLPCVCLACSLHVPRRPVAAFTYSCGVCRPLDVYPCPFAPSCFFGLAMELVLVPPTGTDMRLVGDGCCHPFGPIAMPSQRAPDVIP

SEQ ID NO: 964814 - protein, 211 aa, Homo sapiens
MDKNAFPQRKTVREGGFHKPREGGVRASKEEPKHIHIKQCVGHAQEFFVLLETPKYVPRERRPISITYYTPRVLTIQVSRGAPQVFCRCVAYFYALSHTKGGGWAIVCRHTAKLRTVHTILLSVLGEIGIGLAGDFPGNLAGSNKWITAFLRPSGGVFIPKEQFWRRKFGEHKAISRISRLVRTQFEGRRCDKRRGGPEDKRVVVRGANLC

SEQ ID NO: 964815 - protein, 260 aa, Homo sapiens
MSGALYVLQMKEEDVLKFLAARNPLEVAPILIFQMEQYIYKEEKGSGIYIINRRMRTVGRSFVRGESRAIVAIENALLMSVFISSRNTGQRAVLKFAAATGSQSNVLAAFDSWNRFTNQYPRQTYSGSHEILCGLLTPGADSIEALSRRPSDVEPSYNIALRNTDSPLRYVDIAIPCNNEGAHSAGFDVVDAGSGSSVHAWQHFPLNTHGRSCLLRPSSGTPDWDCPRLSRLLLQKAVSTEGIPAARLLPLLSSLLLSLR

SEQ ID NO: 964816 - protein, 297 aa, Homo sapiens
TGRSYRLAAHRRCKLSVLRVEHALSKVHFTVERGSYYKSLTVCARRPKARRNEKVWAHYEEQPVEEVMPVLEEKERSASYKPVFVTEITDDLDFILCRMSEIGRLARLEKLMENMRNDDCHVYPSRVEGSVCPPRGGEFIAKLSKFCTMENGHLCPSRESRVSCQPYMSSTLTTAHREVLTSIRRGYPITLPFSTRVLPDQATEYAYDFIQVPQDDVMAVADAVDSVVRDIQIQSGACSTLEDLSDGVAPCQPVGFAIRRAMWGLALGERKAGQVERGPGTRPKSGSPILTVKLEKQ

SEQ ID NO: 964817 - protein, 177 aa, Homo sapiens
MVKSREPAFEHCWWQDGLSGILFLTIMHAMIRDCRYGPSMNATYDDHRESTEGRTLVVISFCGPARSAAPLTSKHDFSASLQGTSIKTERCTGTQSMQLQSKTAYEGRSMDTRATPGRSKPGRARARRSSPVRVQRPFVAAPVSCAAHALAGILGMPPQPGPLGRLPGLARFLAMTG

SEQ ID NO: 964818 - protein, 130 aa, Homo sapiens
MLPKNKRQENNVTVTDRDGRRYTQQTSMETSRRKSPASYPGITDTRNNTGEEKQVAESQQKADDNSNIVIVRVTRTTRHKLVPNDTLCEHLSHDNPQQTKQLKNASKTRRKPRSQLTRRSDTDLRYDNKT

SEQ ID NO: 964819 - protein, 324 aa, Homo sapiens
DTLVLILSWARHRVLMLTMASEVARNRTDWVIVDDQQTFFCGNVAHQQLIQITSASAAGWSLKNPKLWSVKECEPQAKNITCVPPAIAAQVCGVLRHGALYYLQIHTSGAPCSISHTDDGTCKMDSALDNHTHDSETSKCDMVPIILMPLAHSWTGQSSESKILDQYALFLAHLACHQGSMHEAGHDALIIPSTSNSLNCTPPQYLEARLRTYSEPIPILLATYGVQELVPAGLYNSLNLPGVNYKQNSQHHRTYLATEKPKNNRPQTPTTACNKLGANKPTQRTTHHPGYRYGRENRPNTGKQRHKRHINTKTHTTGTAIYEH

SEQ ID NO: 964820 - protein, 221 aa, Homo sapiens
MLYRDPAEDGVTALSVYLTPKTSDSGNWIEIDLWHQTQGCVLGHRAATRRLWARGLSFFQTFTVHLSASVTKIMLSEKHLISVCGDNNHVRTWSVSRFRGDDFHPARVATPLASFRDPGLWSRQMVHGGCQPLITEHVAPTVMRDDQQVFIQKVGAQCQPALRASLIYWAAGVLRALRGRSPRELLECVDVRGRPGGSALGPGESCSLSKAKRQALSMCAL

SEQ ID NO: 964821 - protein, 52 aa, Homo sapiens
MKFLSHEEGSEAGQNHTAGPVGPPKPPQTKEAAHTDAPGPPSNNPRPRRAKP

SEQ ID NO: 964822 - protein, 130 aa, Homo sapiens
MKAWGTWCARDEVGLWIARQGMHVGTKCKGAAIEDMSGRSLGVTRGKRDNGRHQNVWGATKRKLAPKGPTEGCGQGGRYLGHWASGSVEAYSGGQAPGAERVHSPEERPPGTSADSAGAPQHGSTRPQTA

SEQ ID NO: 964823 - protein, 156 aa, Homo sapiens
ASRLVEAGVIGEAQSETRLSVCSAASDFYSYRQSSATSSFGGLGGLCSVLFGPGVAFRAPSIHGGSGCAAYPVSSARFVSSSSSGAYGGELRAASVTASDGLLAGKEKLSHADGSKRPPGLLPGQGALPCSAVNGVARGEDPSDCVSRDAGVWCPP

SEQ ID NO: 964824 - protein, 86 aa, Homo sapiens
ARHPEPSETPLILKRRDPQQVGKVTGTPGTVTRHKAANNLQSSPEQTPHRTKTPATLCAGRDNGQNCTSDLRAGPLVAQGHPAPKT

SEQ ID NO: 964825 - protein, 123 aa, Homo sapiens
MVGEGHSTTESTQQPDPAASRKKKTPPTNYRHRRDNSRAREIPPCGDTVGVPPPRVMTREPLEVRHNPRERVNNYTDGPSRERSHHDGLSEANTTAGPLVVRHKQWGQTVVFVPSVVTAPPGK

SEQ ID NO: 964826 - protein, 128 aa, Homo sapiens
MGVPKKHNNKTTTAAIPKNHPALYLNPYSPHSISRSQKPQRRKSSLGDTKTKICDEIGQHQTNKCETQPAPQPRGCDANDKKKSPGREEPQTGWRRATYYAHKHHPHEGVSNNSRCNSDHISGVRTTP

SEQ ID NO: 964827 - protein, 359 aa, Homo sapiens
PGALAYGPAGWIWFQPRRAGLGMRSVDGCWVLLGCAAGPGLVLHLLWLHPLPLCCLSCALLWTLTCLGQSGEAVLSALWLDCRCQSCPQMEQRVLEREAEKGTEGNEERQRLREAGLVAQHPPARRSGAELALDYLCRWAQKHKNWRFQNDEADVALLHMYDSDKVPDEHFSTLLAYLEGLQGRARELTVQKAEALCGELDEEGSDPPLPGRGPAHLTGAAVALLVGSAALRAVASAGLLRPTWCSSRRVWACSQAGQLVSKGFQVLGGGAGSQHQSFEVALPPRTFLACRLYRMAGHGLSGQGDFLTYRTVLRGPTHDFFLGVIFRANRMGECPRESSFHPVYYTIEAVVYQHTWRTI

SEQ ID NO: 964828 - protein, 204 aa, Homo sapiens
MASGAVAPLGIVKHFFLLLPCEQGRVCIPFHHDCEFPEAFPAMWNCQLPFPFSHEWQQPAGPHQMPNLEDSSQPELGTLQTRTSHNTKPYLHKRTRQHLKRQPITPAKDMPRTEAPLLTSHQQPHIPPNMYQPNTRNHTRNNHTAHDTTAQQQTQHDPNNTLQPCAHNAAHQRAKNTRQHQSPHTTPATHTPHPAPTHHLVPTH

SEQ ID NO: 964829 - protein, 314 aa, Homo sapiens
SFFTHGDVVPLVSGALGACCLGIAACQHRRVSVQSPRIAVLEYLEDIDAENTLEEGTEGLFKSTRSVWDKKHGAVDEWPCGRPGCDPRVAEESCGVCPPVIIAMWTSWGVARSSAGGKRSTVKDVEGERTFQALIVTWRKIFPWSEQRDEVLMGPQQAGRLTVNWGFYPGLGSVVQLLPEPGTGGSLGKPGGGRLHTWGEVRGGTRKAGFFLSPGNKFGDPGDSSSVGRRRHNKRLKHQPMGAPKETPMGGKAPTKAKTGETTAVKRRCITQTRREGDTINSQRGERDRTSDVTTDKPTHTVISDEQAISNIRE

SEQ ID NO: 964830 - protein, 319 aa, Homo sapiens
PPTDICSQLHLLFTHSAPSVFHLATHLFPPQTLMLALSLCCLAALPVMPLLTAFSMALKHIKVSCMTAVFNQPTVPHILPPRWCPQTEANFPFHAHMNAQCPGVVCTHTPPIPHDSTQRDITHETTTHENMTQTPPWRAPLDPEGSETQETSTSLQTRHQLINSPDLLHQRPQTASLRNANQHTSPKPHQHCWRHIQTPSQAHKPSNAKKNTHSQVTHSQPKRCTTLDLAPNILAVSTAHSQLWPHDPPYDTQSPATNTKLPPSEYLPNTFAQGNKLPPSTPHYHYPCPARKSYINANPNNALLTIHRNTIHNTHFPIQ

SEQ ID NO: 964831 - protein, 203 aa, Homo sapiens
MCETHRLCGHSHKCVHTYRKFHVGGGALVGTVWSSRCRNTNFFRETSLTNTDFYNTALNQRVRNTFTHVWHTENISKTPSVVGNTLFCGNHRRLIKNGVSVKKNGPVGTPLYKNRVGREGRHPQHPWETADHIPRRQTGWLTLQKPTQVLPPEGINTITVGDNGATKDDTPDAGHPKEDNDTRRATLHKNWPRTGRTTCGSVG

SEQ ID NO: 964832 - protein, 387 aa, Homo sapiens
MANRFPTQSNVTGPRGSWAKRNSGIKKGKLGVHTGLETSHNPLDRDPAKTKPTWVLGAAPHKKKSTRNTYSPWNTVLITTRWRNRYNLTSTTGVTNQRKSVSITNHRGRGIFTDIQGFQGNKFLFSEGALYSHKFSVGGLSIERVGGAFWHRGGKIFSYCPQMLHPLCTTPCAYPPFLCVKLRVIKRHFWGGGAQTWAGGPQKLGTKTHPGEGEKKSQHSWAGEQVGDHCCKAPRDWRHPHGRPTHQKSTTWEPPEGELSHQRHMRETPQGGGDESAHRGSGEKTLPLSEQPVEENNRRRGETRGGEATPRRRPGVCGDTRGPERRISPRENPTETEREEERTSRRHQQREHHRARSDVNNHLELRNTEALEKRTQEQSIVFRQRDT

SEQ ID NO: 964833 - protein, 113 aa, Homo sapiens
MACKCDQRQTQYVCPQWTHFTCSKYNATAAGHVYTACTETALHALADGHSAQMWRGTGLILLKAIKEKAISQCRAAAEPYRGPVSVGMRFLWQQAPIAKSLVDNFSVPSQEAR

SEQ ID NO: 964834 - protein, 103 aa, Homo sapiens
MCQPHRVSKGGRRWGARVWKFRRKNHRGAPGLAPGSAPGKGGPSEAPVVITQPFFEVLHSILGDRGSYHRSGPVSGFPPKGTRLWPWGEPAEKGPGQWRRIPR

SEQ ID NO: 964835 - protein, 141 aa, Homo sapiens
SRVLFLFFLVQNFIKGSLKSNIQTPKYSCQGNPVYYAWWGRGVGHWTGGIVAFPTLLVFVKVGGGWARYLISLGVSTSAHVGSEAGELSIYRAQFLYTGGAPHGQAYDLFHLVISAQDTPCVRRSNNFWPPNSMCSQPVYA

SEQ ID NO: 964836 - protein, 43 aa, Homo sapiens
MRRDARGGARPRVETRARRYTKHEDTETKLEQRQQSRGATSTT

SEQ ID NO: 964837 - protein, 123 aa, Homo sapiens
AQVMLKPPVFCNTTSGGTSAERMEKCGEENPWGVGSVCAPGTQGCALYWDCEKKTLRGPVVVTWNTRERRTPWAWRREKHGVCAPATVCGRGGKSGCGSPEKCVDSARSPHKKERETSRGPVS

SEQ ID NO: 964838 - protein, 115 aa, Homo sapiens
SIFTMGMCVHWCRSPGGCCLGVAACQTQTCICPKPQKADLEYLEDIDAENTLEERNQGPVQEPQGAYGTRKHGGCALWPMREASAVNLFERKLTDLSSREKAMLDQLGVPALVQG

SEQ ID NO: 964839 - protein, 150 aa, Homo sapiens
MRSHRGYPTKIVGDGRHKETKRDPPPQEESRRTLYMGPENQGGAHKLGETRHSKAINHIMGFVAHEKAPRRSTGASRPPEQRGEKPQALVSSVEKNPGGKPTGEPHHGGPTESQEEPRVEQRDTARGEKRNKHARLATAEHQEGTDKQAK

SEQ ID NO: 964840 - protein, 104 aa, Homo sapiens
FCERVGAPCPGPPEEAAAQTALLIILADGRSDEIPVQQDSQIQYVLVFTQVKKQSSYNAAYSYSVGIRHSAVWTDEEPDGNFCCVMETRNVAPSGEVFAKLFIL

SEQ ID NO: 964841 - protein, 160 aa, Homo sapiens
MEGEKEDLMERLKQIEEQIKRVQQKREETDPSKGSGTMEREREAVPRAESLKTLGQGSVKKLKKAKGGPGWRASRGPEKDSENSWAWEMGRADSRISQREMGPQEKGELRLVDVGEQKAQYGTEDLGERPVLELKYGLEYPLMLEGARCENNELDERDDK

SEQ ID NO: 964842 - protein, 89 aa, Homo sapiens
SSRLLGVRGTQCVCWCWEWRDPRKTSFVQRLTGHLHAQGTPPICDQLWIQQYMNVPFPANIDIRDTVKYKEVMKNMDIGSNGGYSDLNV

SEQ ID NO: 964843 - protein, 236 aa, Homo sapiens
MPHIAIPRAPVPGQPCTPPDSEPPRAYPGAAPVTYPVSSSSANSLDRAGSQCRCYARYTRGLGLSPRCDPQSSLEAEAPSLMLPALTPCENSEVLLEGMKGFGTDEQAIIDCWGVAPANAAAADPTFPFKTAYGKDLSHKDLKAERVSETLRRQVVGSDEDPSHLLTLCDDDIGTPYNGVGHLSDGLAVIEILRVPDRQLSTFRELNRAYKARIQNDPGRGPSKRNSGHSSGPMSP

SEQ ID NO: 964844 - protein, 103 aa, Homo sapiens
MHHNKQATGECPRRKKRRILGLLDAYLKTRTFLVGERVTSAEIDSCLRACCGSIEQVLVAFFAGEALSAIANLRGSSTVRLTEPRVRGLVLEGKVKVLKNDWP

SEQ ID NO: 964845 - protein, 509 aa, Homo sapiens
HHQEGEAGHGEGGPGTLRSKEAAGARPAVRRSHDGTCWPSGSWCCEMCAHMWTCVTAVCPSPAHAPVGLACADQYMHPVVQSMVHWCAAEPSTSAECCGMVAGVELSYSVRAGLVACAWGLSGAAAVSGLKLWRCNLCTYQRAPVCPRAGASAWPAARAAGASGCLQTVSGAWETRRCQWCLPRHGRMGPVGHNPSRCADTRPTNRPRWSLGEQVDPQQVTIEHGYQGWVDRESMRTQDREEAGWFPRAHIPFESNPYIVTLGLECDLAEAHAQGRGDRWYSHIYTVYTFTRGACVPGATTDPLIRAALGALTFGGDSPPKDTTPRSSHLRPGTQLGLLTTPQGLPKGPWGRTFVTIHSADNKITAHLHYKALLGQTLDSYLRLAPIYNNDRTHWQPITRSDLPGGTYRGAAPDTRLSTARQKGNNRGNRYTSRAANHLQLRNPRVRNTSKRVPRDKNTQRRRKRVAATTTHTTVPHHPGQRRHRDDTQHEQRRSINEAKTRVDTNKAK

SEQ ID NO: 964846 - protein, 410 aa, Homo sapiens
WGGGECQVKWSQSSGAVQRLQGPRAGVGSLSGVAGRDPAFIQGPSPGEGRSRSVLRGTSFHGPASMLPHGKRAQGATAQESEAGAGQANGAPGAQGAGGPHKGQAWKGSSEAAGQRPKGCKERAAGAPNTRQQGRGHMQEKDSHNARGIPENPCDTLSVHLRGERRAPRYSSRKCPEREGPKLVGGNTPSEREKKEGRRYMRVGGTYKSREEGKPPRGRFRAKRKTQKILRETNCGGGAGEEEMPPLEDRQGENPAVVHLLGDATKEDPLGGVAGPPPVTSTGEAPGHKKSGGAIDNGENLFPGEKSGRKTHVEDKKLDKRGAPPGKGPHNTTTMKKRGPQQAVGSYNKKNIIPPVGDKDGVGPPQNGFVTHTKKCAVVGGKHSEWRIMNDTRQEGASTKAEKKNDCVPQ

SEQ ID NO: 964847 - protein, 73 aa, Homo sapiens
MYHQEHHYHGNDHHVGIKNDVEGATVGGGPTDAGVSNTGVYTKSQCRKNKTTRDGERETTKRSAKSTEEIHNP

SEQ ID NO: 964848 - protein, 203 aa, Homo sapiens
LSPPPRPTGGAPGGKVNTGPPHSGGGGGGGGPHTHPGAPDICVKQNRSPAPHTHPTPHTQRSRTRDPGEQREGAGHTGSHIPHPVVGTSEPTTMPGEHKLNRTTPQGNSTPSNNSGISHPPTRGGTRGKHPRTPQGDAAHQWDTHTQREKRGTKNKQNKKRGKQRSRKVKTRPTGSTTTLHTRTERNQGEHHTRQQHTTQKTQ

SEQ ID NO: 964849 - protein, 424 aa, Homo sapiens
MCLRCLLFLSEEFTWPKRGRGCVKVVAVRAQLWGRPTSQMWRGPGSHISCGKPFQLKPENPEGKPFRGRPTRCSCGGVYLGPPRGCWTQHRTLLTSGGGISLSVLNPLNSYHMWGGLVGNPHRVFFSLFLWAPYVACDPFVPIPPLWRQTKGWKGLHTPGEGGHNKGGGGEIAVASGRKIPWGGHLGGGAPHFFPGGKHPPVWGGVRGALEITWVTSPTPGKKFSWKATYLATTRRNEAQAARLRSDKNGGCCAPPRGGELSPAGARIGNCGPPGRPERCPPRVTPKRPVGCVVQQRCVLRQGGGHTRWSPPVCAHIYKEKVPLTERKGGERQHTVHGEKLGSLGTPPCFRRRCGVVVCAHPHSGWLFDTMLVSDKCPQPRSGRAVCAGEAHTLFLDNKQRASSLSWAGENGSCCCSHHLRKRP

SEQ ID NO: 964850 - protein, 178 aa, Homo sapiens
MAENCDLNLHVVDVALAGLFTKEPGRFATFALVAHCRIAILVPRADVYLTRMTRVVNCCMSGNIWHMTFTGALLHLAPGLMDALADWHGVVIPRGVLLIGSCGWFAPRYPRSFLSWQVLAHPAGPCGYFVAHAVLGPGYRGGNPCVTGLNLGRDFPAIRALGARPAGVGGGTRGHREY

SEQ ID NO: 964851 - protein, 186 aa, Homo sapiens
MIMIMQQQQQQQQQQQHAHARCAAQRSRRELREEKKKTRQEDSCQADMMTDARHLTEAYMQDDCRLHALTARLTDYNQIRNNHKRQSTNNAPYMQHSNSSPLISRSFVVRFVRRPVIRRSSVRSSLVSSSQSVKSGKAQHARYGTQYGKEARRDGGRYVRSFLRRLYGGMSSAKSSLKTCVRYTQL

SEQ ID NO: 964852 - protein, 300 aa, Homo sapiens
RRAAVLIQQHYRSYRRRPGLPTGLLATLPARNKGSFLTKKQDQAARKIMRFLRRCRHRMRELKQNQELEKGFPNGIGQLTLATAFFTTWGAPRAVLTRERAFLGQGSPCRQLSCSPLLEPSVGLLPPPQPCPNPLLVPPGRAPSLLVLAPENRAPILHLPAVTSGALLALSPVLLLTRSAPPDCLIYLFDALSECIRLGSTMSSWHALVFQGDRVPPDSACFGLFPPSLALFNPSTDSGNDSGGGEGGVHRNAWESAVPEGGFVHTVTEEIVRTIKAGEGEGVGSKRGPRPGLNGSADAA

SEQ ID NO: 964853 - protein, 644 aa, Homo sapiens
RAGAASGFHEIALMHAPPACLPGLVTITPLGWKPQLPAAVPHVTITCNHEHADGLMTQHAAPQNPHKHDTKPQYRSQTNKPNTRDTKKRKKQTHGGRRDNRSGIKKTERGNMHQADDPTQTQTNSHQQNETQREQTSDKHRAKQATPAKPQKTTPTQQHNQSDNKHPLTHNNKKHKNQTKPINTKTTKNDTPTHTPNHTHSTHTKDKTKHNTYTTKKNNNNNKHSQTPHTNANTTATKTKKHPDQTTKETSKAKETALTRKKAKRNETQNTPTTENRRHKTKQSISKATKTKTTNKRSKTQKQTPHTEHEAQTLKRQAKTDRNQDKHKNIREEQHSRNPARTKPRQPTNDKQGEERHSTDNAQRRKTEDRHKGKHRGRKNAEHKRTTQRRGRRADHRRHKHSQSKPTDKAAEDKSTADRERHTKTRRKETNSADSEADRGEQSQTGEDTREATRKEERKTTDNTNTTQTKTKSTPERNDTRAESEQSRKTSRRETRDKTKSTAKVERAEQRERPGIDAQEERNPEDRRQRRTREQQTRHYENAPNTRSNRQPDKTNNNRALTRTTRTTTRTRSGNERSDRRAAREQKEVENNKATKTAYTRPETERESNKAREPTEKKRKRDNRHAQKTQEERERTNRDNKEQY

SEQ ID NO: 964854 - protein, 45 aa, Homo sapiens
MARRVLRERAYRDMEASIGTLHYEGVDHATVTKLLYDERKLRFVD

SEQ ID NO: 964855 - protein, 43 aa, Homo sapiens
MTPLLLCVTHPRRRAGRHSHTVAEQHAHPSFSTQNTRTMKIRH

SEQ ID NO: 964856 - protein, 231 aa, Homo sapiens
MAWWDSEPTNGGLEMWSAIREWAVAAGRHSRSPAGRHYWEVTAEALPAVPDTEWQMWTCPGIAALVSMIVPGCTPMPSAKLGTTNAPANEKATSSRVIGQTRQGGASKLGVLTAQELLTPEWTVTPGPLEDSTTLHEQTIQGVPWWIALTLMHTPEELGNASTRPHYQRPPHVAPERNHTSEMVAKKIEKINQTPHAHQRTTHPTQNKNTPGTPYNILTQTHKNLHNNKPH

SEQ ID NO: 964857 - protein, 109 aa, Homo sapiens
MAMDQAGCNRTRQTGKLDTSALTRAERIQTRSAYRGTEWRCSAGCPLVDLENDEQAASAISELVQHSLRFPCCTCGMNVPFKRLSVVFGGTTHCFVTVSGQRGVCGELG

SEQ ID NO: 964858 - protein, 276 aa, Homo sapiens
MQPDGRKQNRRRKKKREHNERKDTHKENKRNIRQHKKASTADEREQEDSSRYYKRQASSTNQATEEAPKQEAHNSTREDTKHRKRRKRNKRQNQQNDSTNRYTTQHSTQEQPHQDETTNEVGEERRPSQTIDKNKHNGETRERRPAAETTCTIRANKYSTQEEDNKKRPTKKTEETQKRANNRTTTTDAHKSERKQGGPTERTTLNGERTRQLEKRTGQQTPAQHKHDQQKDRKTRTNEEAEQNKNQTTKQTNTAKSKQKKHKHEIVEKHIENTNP

SEQ ID NO: 964859 - protein, 252 aa, Homo sapiens
GIITAVMGVITVPLPHRTPRRCGLRPILSTTVSQLRTRTTLRTLGNSPCLYQRRAALRLVAKLLQGDHAALQPACHQPLFGGAPRSQAVGRASHLRSAALPRWSVTPFLYWLPPLTSPTVASHFSCQRRPGDPGLHFFRLLGCASIRRPPCPGLALCPTRPWPGATNFACAHCSLLGAGPPINSHPVPSYHFGPLPPALPKDPHRGLPGANLEDGPCTKAPSYHAHHQQLACQPDASPLENPQQETTKKRKP

SEQ ID NO: 964860 - protein, 136 aa, Homo sapiens
DKTKEFYIYSSSKFPGVKRGHKLMWLKKKINHRAYPRGGIKGTHHKNRKKRTVRTTTGQNTSHRGSLRFTGYRSTLPYTTRNPRGNIPVGRSTSLHRVGENARQKLGEGGVHKKFLRTNPQWARRPRAHLHREAHL

SEQ ID NO: 964861 - protein, 252 aa, Homo sapiens
MAVVIAEGNFRTGRLPEATSSSSGNCFFQNLALRFNWRDYFSCKCHNCREFLCTVYNRETVFAVRILTGNIASFFKEPEMTKQPEDWLDDVPGDDIEDEDDEIIWVSKSEIKRDAEELKRLGAEMVDLGKKRLDKIPLDADLRAAMELAQPYYRWKVAVRQWQLIGKMLRQRDVEPIRQALDKLKNRHKQQVVLFHKLEKLRDRRIDRGDDATRWGIKSVAQMPIVSKWGTLIRKRKEETRRGLKPAKIPEA

SEQ ID NO: 964862 - protein, 272 aa, Homo sapiens
MCGTTCGYSEHACVSTFCCGSLHEPCVGNTRTWRAKAHHSKLPSPHLRQKSGVGAKTWVSPLLPQELRTIMWWGDKIPWGDYSPRTRETNVTTHTRGDTYKNLPHLLGGTSQEGTPSAGAHQYTKRPTGGYYVGLLGDHNIYEGEHCPRRPHKRQSARLNHHTLHDNQLWGTHYNNCIQRTQINRGRHYNHPPDGSSAVAPRNKPSVVDAAEMVETTSIVATTRIQQATQSCGHTTEAETYSQTQRSANYRKTANRTNHGRPKRDYTQSHGE

SEQ ID NO: 964863 - protein, 413 aa, Homo sapiens
GCALALTLLRRRYQSVEENVEVRGNWEALYAVCNRQFEQAQYLGDSEFITLKRVLHIFPTLISVVIRRGDRKKYLLHGCKHAEESTLLTWSKHKPYYQESIINITTSSSTTSSNSSSRHHRQYLQNWATGQPATMNGLTYRPEQNFSENQGETDLHPTARRSTSWEIYPPDTHCTDDTLTGNAISKEHSGQQGRAGKTTNPYTGITRDSGPEVPAKETPPKPLTGPLATKSAPWPQVISPPHEGNSQPGDAGTYGHSTSPAYTITAHKNLPSQKNKIQATVRDRQPTTSERPRETTGSSANMRDNRHAVKATSENRTNRYTPTRKARGHRPPREHAPTTTHTTSPLSPRIQSTTPTTTKRTQSKEQTRHSREKGSMNTADTTNEDRGKSTLRCTQTRVNDVSKLIESRVALLA

SEQ ID NO: 964864 - protein, 283 aa, Homo sapiens
NTPNRKHWLWIGVVKWPRTGRRSAPTPGSPPGGRAPRAQAMALGSRLLPVVRSPRVATAPGPAMVLDFKSPRRFRPTWMIVTGGIAVPTAALTWQSHVRASSLRSPSRAVRARALPSFRAQWLNVGCGPAEERRAADRPPMLSPTSIAENCRDHFGLDIYDSWAFESEARSTKRGTVHSLKVKHYASKTKRHGTDSPFPLTHCGLQPGACAAGGGANWLSAPSEGAARGSLEKSPCRGRSLARCVILCYSIATVTLGGENRRRDDAPDLLRSGLAWDLRLKAR

SEQ ID NO: 964865 - protein, 232 aa, Homo sapiens
MLERSRRCVTRLGPHTYTWTMTWTYIRFLAPCVRRTSNYTIPVVLGVAAEKKYLVGAHLPIRAQKHEARVTLGCVTHHCDSIVVCPSCVPQQAPRTERAISGHCTAGPHHSRCSPLLTKPYHGPPGETSKEGHQLHATMQRHPGGQLQATRFKPSTPSATPTTEIYRREGPHATCGEKRRIIRGQRGFNPHGDRIKAQSLAHRPPHANDTRQRANKLRKHHLLTCNTWHTAP

SEQ ID NO: 964866 - protein, 273 aa, Homo sapiens
MGSRRGGHFPAALLPLWLTMILFLGPLMQLSMDALVTWQMGMKVVLAPRSWAQMPTQIMRMAAEPSDRPADMSELVYRALYACTMLATGAWDWALLVYHLHRVQFTGRLPNYSTTNYLTTGMDVRQETSDGERIYLCLLQYQVSRYNKHVIRVRYNLLILFIRTGHTDWGRVTLPFTFCNTGFPNCVVLAWSTQEAGPCRTGLCTWSVEKSDTAYCPAPQGTTKLQRQTYPSSRVSERRRGLRRLHLRSRTYVHAYARPLPDHGLTQQGIEDK

SEQ ID NO: 964867 - protein, 459 aa, Homo sapiens
GGETAPGGEKRGPHTHTHTHNEEGGGGGGRGARGGVREHTPPTTRGGGAPPREQKTQTSTHTPTQTEREAPSPNTQRGGDLGRPTHNTPHSRGAHPRGATLSGEPHTHTQAASPQQHRVHTTQSAAPTPSTFTTHTPSERERHRERANTERRAAERTHGHHTECGGRERKERETTKITREARGGGREQSTHTTQERDERERSDTHNKHRGEKEGEREGPTTNKWERAHLNKRNQREKCEKKKRKKNKDIKQRRSTSQQNAADGESTLYYTTDADTEDEGGSVETNHHLNNNTPSLKNTFPTSRGETRRNYHQFAAHPDRRKQNNPTSRRSSIDAKATPPPHKANQQHNTTTHTVVEETRNEEQRTTNREVRTQTTHPYPRRAPLRCGRHRKARQTHDPKPHTHTRRREKARKRRHQQTEHHTTHTPTQAAAQNTYVDATHTPHSETTNEQATTDSTKKT

SEQ ID NO: 964868 - protein, 468 aa, Homo sapiens
MAIDLRKNYTATPPGARDQCGRGSDLSFSVRSVVSAQEKKVRAISSPGVLCLCNKYRSLSWVSSGGDVPLLYISVRNSCETISTYFSEVLVFPQWGPSPTLPEGVKVALVPRGSAEGLSLTQKQTFCDTLLPHTSPLRANTRKKTTQRRRATGGSSENYSSFFCSGQVVVGVVNELLERQQYGTRRLSPQHHNFSASPKAPFVVLVAPPVGSHAATAIVEETPPLLVRPPLKRPPRWGAVADQYTVGRRLLTLDRAFSARWKGTILLVGGRCVLSEPPIITFTSEARFELSCASPVLGAELSPPKRSSPMMTCSYGAASLVGAAVFSTKGACILFVQRGKQRHIFCVGGSEFSYDACTFTKQHRAPVTDTPPQLGVHHRSGVCTTHPADIISIKDRNKLTCLNYSCSPRGHPSAQESILRGAAKSIYSAALTTIAVRIFARPLSRPSTSSFRSGPLTVAFDDLRARQA

SEQ ID NO: 964869 - protein, 142 aa, Homo sapiens
MTLFDEGAWNGNTRVSYKSRPPKPTRERREQLGAPKRPAAGDPHDAPEDPRTQNTNQCTRYTDPTARALTKETTGADTAWRHRTEYDDNPINGPKIRTRETTTGTRHHTALQAAYRPHKTSVTTTYPRKPSPQGEPRRRSEH

SEQ ID NO: 964870 - protein, 365 aa, Homo sapiens
LYCRLVVNLAEAALRHGRPTLSRALVHVPGLCFFVPVSEVLTAGGPVPRSPDYAVTPGAMKQDGLLARLAVVADKGENRAGEENKNPHRAGPQDVEMKGGSDGWRVNGGVHDGKTACGSVEHSQRELDTVTYVSDIKEHVKQLEKAVSGKGAEIRAAGPAGSAFHITPLNHYVLYKGAVQGFFLQNNASSRTFCSPSLEEPIGHRRADLQFPSPRGRRAASTPLLALKVEAYLQILVVIFMINQASATKRGSKKDLLWSCQKIVLRAAGPKTFEPARVYYIRPGSISLDEVILFAVFVPGGGKSIRQREALLTRPILLRLQPGVFHFFDGTQGAAPHRRGRDIGETGRQLQEPRWHGEHVGTLSR

SEQ ID NO: 964871 - protein, 53 aa, Homo sapiens
NWGRTQTLTTSFLPDRDREEAAESGFGKQLPHRSAASHSQEPASRLTTIEISL

SEQ ID NO: 964872 - protein, 316 aa, Homo sapiens
SPHPKHHTIRLGTRLGFNAGSVLWGAAVTPFCVQLHLCVHCPTRHLSQSEGALAGSVETPFLEPMLHANLPTATPQSHIPCCTWSAVGVPVTWPNVMPSMQLATPTPEDGQLGLSRGDITDVRPGTLLWQRPVVHRSMRRPGAHTQCPSNQAWTSTMQSALRANVAQDTRRDNATTRTSIVASRLLEPPERAFPHLYSALSDGAASTTAHLLTPNYHGRYNTLVHHRRHSAEDPASSCSCTHVRLDYPSSPEAATNHRKLPPPGQISALRPRNTVLTETSCHIDKTHHGSKTKPWPPTPTTLLRIVHHDTNATCKT

SEQ ID NO: 964873 - protein, 151 aa, Homo sapiens
MKERAGCTSESEGAIRCAADEDPGEERMITWSTKTSSLCALMNTLLNGTQGVGTAMVSRPSDVAQIFDLNEFLAPKYTIERRGGSEAIGPPWRQGVKCGPCAGKSAQGGYWTGGAPRRSNEQRCATWSGATERALFRTAAVALSAGDPGPR

SEQ ID NO: 964874 - protein, 351 aa, Homo sapiens
MCESCVSHPQEQRDFSQKSVLCDRDAQTYLRTRPEMCWAAVGHTSRVGDCCPITLCVTRKKTLVRGRFSLWEKRDKRFLQAGGTTAGEHLWRSATTQSTSSAAGTVEEHPLLGALPIDRVATRRGDTRREQLPLGGAPPKRQPKTATEQVTNSNSLAEHPLLQEVGRHTSGGTTEVRDCPTDGGRRCRTNQQAAGPARPRFVASPKEAGLSGVGDSANVAGAENGRHHTSRRAPHRTGDITPSEPASMRRTTLLSQRTNHAMGENTTPPHQKMVVQNKTEGGRPHPKNSFDLWGEGGGTPPPHQNKNGCACDASGRTDDGWGGQLNSTNKKRSGGPPVWMTPPICLCGGPA

SEQ ID NO: 964875 - protein, 190 aa, Homo sapiens
WPSPTCFGPELPEGRRCHSQPMWAPAGLATACPPCSPFLLGFTPRPVVCAFLMPALLLCPLSACLILPALGPHCSPLPVLCCVGASPRRGLWLELWACCVVPLWACAVCRGLNRGSTAWTARVMPCAAAPLSSGPSQTQTRRPPENASSEIINPLSCREWAMSPSQPGYNLQGYPTSRYQTIGIIPSALI

SEQ ID NO: 964876 - protein, 195 aa, Homo sapiens
MMTDERRLLCRGTVRRVRGRPFRGTACDTCCAPPDWFLVAPGSSLVGPVEMACMLPAVRLAWPAWLGCGVTAVCAVGALLGASWPIMLPASVTVPAAVAVAAQHGSAQLYVPLYSESSLPRSPRPASVRRLHGCPVPCLCLDGGCKPASSFGTRRGSRRTELQRSINEMKRLEEMSNMFQSSGVQTTSRTKPNRR

SEQ ID NO: 964877 - protein, 281 aa, Homo sapiens
VIHQPSRRGFGPKGRSCAVSSASLRAARHFSCGFPELSRDLCAPSGRFPAWARDNFWGGVQQKVCGSCRRSLRSWPRRLAAVPVVSALPGTASVPRDRYHEQAFDIGNLNESVTPADLEKVFAEHKISYSGQFLLSKSGYAFVEHALDDHWAMKAIETFLRDKEESHRKHAYDDDTLRSPKHTQEPEHIQIRKDYSTSSDGKLRGTKQPATGKATEPEPVSQVKPRELKTAVSEMSPYNNPRPEQAKRIQQLTGTIGEPCQKDTYIPNDKSHRTATARGAE

SEQ ID NO: 964878 - protein, 153 aa, Homo sapiens
MPRNQRGGVGPKAPPDEEGAAGECVTPRDKARGSADARRERQQSRGEAAHPWCGDIGAAGGPHYKQRINEEREKHPYTTESDHHVTCGAVEETPPQRVLWPQKSHAPRYVAPKRIPLGGGGQNHQGGGAADDSSKRETPHMGGPNNLHTGETK

SEQ ID NO: 964879 - protein, 503 aa, Homo sapiens
GAVGPCIQVSENWRAFKALIAAQYSGAQVRVLLRTTPLPFSAKPTAPLNFSAKFPAGKVPAFAGCMHGILCVCSSQRHYAYSCEHMQELRGKYIQKARSPGWMQRVSLLLIPDLVPPAQIPGDVTTNLEAIMHPPSNSTATLRTANGRKVTRDTLSAACWALPLPLTRPTDAYSSDGAEQRTLTTKSLDTINSIVLDNHTSRRDYIHKATATQADPYLKPAQGTKKPQTNTKTRNWANPYHHLATCHNPTEHHKINSSGPYGHSASTKTVEHNSADEHQNWGTRKHGMHKQKRIMARQEPHKQTVKHTTHTTAPTVGPNRTKQGGIAPREHNNRINTRTRPPHRAHATHRTKRQRKAQQPSGRESRHHRTSPCAKQEQHQWTDTLDATQGTTIEIKVEKANQLGPKRENPTHTQQHHHSEQTPKDTHIWRVQRNCNHKAGAKRSRQTEHDNRTDTQGRETNGNKTNTHGKPTTETKEATIETPRETHRRKNGTPEKNHQTKKH

SEQ ID NO: 964880 - protein, 230 aa, Homo sapiens
WSARRRYQAAGASVPEPRPIVDWDLRASWAATVPRSCLRAASAAAPAPGRAALAGPELTLSQLAGTNAKLVLPTRQVAAGPCKFSLELRRSIHVATATTACLALLMLTRHHPRAHTTHRTSRQHAHHSTSRTMRSPSPGGLHSHSGPFHHPSYLAFSELTQPASIPHPLPSSTDSTCFLHLHATPFPQLRAAAIASLSTHNTSRIRPPLGRGTRQRGLHAQALRLPPPTH

SEQ ID NO: 964881 - protein, 429 aa, Homo sapiens
ALQTCVAEPDPVSKKKALWLGEVCSLTPGNPSDFGEVRWCGWIYEVSEIKTHPGLTMVKPRSLLKILIEKITLDVRDTHLESQLLRRLRQENHLNPGRRMVAVDAKIRVIGTPAWLTRENKKQKKPFNGAVTGTVDVMLQGMPGYGEVVTKWAQMLFFTKEVKLGFRSYSSGDKMWAPFLSHKSREKHTNVGGIIQPEINTAMGTREKALVEHLAEHGVAQVGATDATSEVWRFRVLNFALEAIVFSHRSSPQAKHTLWSDETWWRLGCPKEFPHHILAETAWICGKLSPFVTTKRGRPPPCDYTNKIYIRRDSGHHGASQPVIRWHTRGAGPKRTTGEITMTGNAITPHTWAHWVHTHTFAKDTTNYRDSVEIVKYTPHGRLHTRHLLNLSRNTADRKYPCTTLHRVRPPKNQTIPQPRYFSGKHSSD

SEQ ID NO: 964882 - protein, 521 aa, Homo sapiens
EETGMLTDGPALRWPGSDFTGSTVSKQHLVPLSPAAEACDTMRIIIYLPAWWSQKMAVKLYLCQRATSSKHKLLYNMESVLLCHVQLRGYGCLDRGTGYTVHSTENMHGPISRCTLDIDPRLTQHGRHIGMQTNKQQTTWLTRLTHSHYEQQLSTVLILQAHSALSKHAYIGHLQRLLCRLAQHHNQEMTRRHNQGTNSLQSTPYAQRTTAHHHEPPNSTPHGTRPETYRQTSSEGHHDMRTIRHHNDAPPYKYTPTQTQHMNPAPHHNKEPEPHGHAPTPCQTAPNPLTSRTRRQTCAQCSNIQKKNQIDTHREGQPSRLTTMTTSGKPKTNDRTHTNNQRKDQQNKTHKTQGDKKIQAPRQTREIHQHKCELARTTATSQQRTEDTHKKKQTNEHNGKNNDGGKQPSKTRGRATGRKHTHNRHSTQAAHNHRDTTRRRHQQRHPEKEHNTPEVKIRTSHKQTTTNATPRTPNKPTRANANGKHETTTPDHNHTPRHTENSQSISDIKNQRGNEPDRHNS

SEQ ID NO: 964883 - protein, 109 aa, Homo sapiens
MRGPTLVRRQKVRAITYYLMGGGRHASPPLVVSSSHQTDTSTDPKSEGPCTHTSQVCRATILRGRTQGWSAHATDLPPNYTLGRGGEQTTLFMEGQNLVAARPFIYTKK

SEQ ID NO: 964884 - protein, 71 aa, Homo sapiens
LCARRYDKMVDYMQPGGTPATEGLGRLGTLLTDFQRGGTESGWREDTEATLKWEEAAAQSYHALGLAPGPQ

SEQ ID NO: 964885 - protein, 406 aa, Homo sapiens
GCSPGVLLKCQCWCKELRGTKTAVHNGAGGELSSQCCSAWTCDVGPQAMQYQVLNEVVILTEAPPPTCTNVDVYLDGHLITMVQGDGVIRVHPDWAARMYDGRETGDSMQSNPTCLDHHRYTPILDTQLRMIHNTRTNTMEPPKRKISSSRRINAMTTMTAHGQQQKLGHEPIMTRRTGTRQTNDAYKHNRAEQAIPDNPPKPTMRLHTTYRPPTPRCSRETPQKERHAPGDRTERPNARKTALANSAQQITGDRHRQKSPTQRRDETGANTAKAGDGTSAHKGNKSTTKYQEYQNNEPTPANNSSTQREPLQKETQQPQTQGKPGTREKPHSSHQDGRTGHKSTIETRESHRNKEDTGATRRQKGPTKTAQTTKKRTEHKDRRSTTHKTNNEQQNTKQRTRPGRT

SEQ ID NO: 964886 - protein, 365 aa, Homo sapiens
ALLVVLRGGGSGCLGPQPTRSALRFPSAPQELEGKQSMAGILVGRVMPHTCAHCLPVPGAPGGNASSRTEAQVPNGKAARRLCHCSSQAFTPGPRAASASTGSPGAPNPRTEAGRHVACHGPVTFLLVLLTLVHALHYGFTETSDGGESIYWGPIAGQARNTGGPAVADSGGLPGSSIEVRGFKVARCRENRFLPGHDALDRGARGSAEQAREVEAPGVPCNMSARGGIRHQETAEGPEETSCASVYVHESARDAIPLVVNGAPDTWADATWRESNLRLWGLMGSGRARGIITVPRQYVFLATLRCIITLLLNVVKTEINNNYGRINPSSSTSYYMGRCYMLPLHNSCQVVTGAPYAVESSTGPD

SEQ ID NO: 964887 - protein, 447 aa, Homo sapiens
GTPRVWQCGEAALENTVTCPAPCSQCVVFGMPLGAKVMTSMLVFHAAMVPLAVLAPVEHDGAMLTPTYRYNDEQAGALCLGPLPYLRAGSCPWRNPDHGASGSRGQANLTNKLASHSNGELVGCALNLRTLARHTMPPCACATPYTDTAPQRLNQNFGALPLIPGNPNSQLNLVAKAHGSYRLRLSTGLSTGCSHSVGYHPPDTTEDGYKAIRPFSGAPISRHLADTFRRTAWASHEHHTGKPRSGGAFIHFTRKTHLGTPQDIQLMEPIRARKENQSELLQAVPTYGMNRFPNLNSSAATLRARPRPVGPSTPATISELYLPRPAYNDMSQNTFTVRSTISPRLRARNFGLHTDFLPLYKEHITATLISLDPSSQSLFGPLVLYTPITPLNSGPTTPPRTIARPQRRATHDTFPPLCTSYPQRSHITPPYSTLSSTAYIFRYATFS

SEQ ID NO: 964888 - protein, 311 aa, Homo sapiens
NKRRSEASGYSDEGYRERISGPREPEQPTVARGLVTHHTPGGACSCRSRPQSPSTATMSMRGLRTSSHMNCKTQRERRERQRSSGENTQPQGPQETRQEDKSSSNKQKTTRHTKKNRQERTKETENKDTQRSRRITTTPNATQKTADQRTDHRPTRRDPTSATQQRTPPPHSTEPHTKHPPTSSDPPPAHRNRATHGTAAANTTGHHDDRTAANGTDSETDRPRHEERTKKTAETNADTKRQHNAAAHGNRDEHRAGRQSQGERRRQRTESARTHTQPTRPPNSSTTSTKTREHPPAPNTEHTQEHRNERH

SEQ ID NO: 964889 - protein, 216 aa, Homo sapiens
MYRAAEEKGALEEPYNVERHIRAQKSLPRRGGVRARANHPTLSGKTPHIEGGSRKGGSKTPEQKGVSTTPSESGPRPGAFSSREKVKVHSGVGTEPRHKKSHKDKERPGPTKAGGKTKGEQLPGWPPPLKGAPTGWSQRQRAPRWREQDHPPRLKPGENTPQVCRPNWGQCHGNTPEHHKVVHPPEEHTDLEGLHTGWTTVRGGATQYVSDTQTTE

SEQ ID NO: 964890 - protein, 459 aa, Homo sapiens
LKIRENSVVTLVWNQTPQLKKGADTAKANRGATEKKSRSLKSDQDRRDSSKRTETVFPKAKQVKKKAVAFCKLHMQFVLKSEKGNRRERGAIIETCTFLLKTQKFEKETRSPYETGKYVSIVTTPKTQCTNKCRQPFCSAQTISMRPQAPKASIDSKSKQANEVAATISSSKSPETSTAMAFILILYRALVNHQGGQRAEWPRNSKTSEQHSAASAHINLGAHTKTNSTGRRITVRKMFEPALIPWHSHRTNIKHFSHPNNGPLRARKTPYSHELIPLVNQRAKWTHSPNTNGYINKAAGKGTLFTEAKKGSSDTGENWGTGTLPYTIMANNTPIWEIGRHKRNTSRATNAWPNDTSGTTSTEHPSEPPIKRETIGGHISTPHRTRKHTHRRQDQKDKGKRKRITEEKTTTQETRKWTNRETYGHKQRTETTRHKKQGTKIQTQRTTKQNQERKHPDAR

SEQ ID NO: 964891 - protein, 144 aa, Homo sapiens
MRLGVESGEELARVYSLRHISTSLGQRCVDEASVKLEGSDWRGRSEAAEPWCTKRASTPLEELNGILCQGTGWLCAAHQGCDLRTEQLVLCVPLQEPVGRWDQDYDRAVLATAVTPSSPCYLLYLPRLTECSGLRIGSSSPVSA

SEQ ID NO: 964892 - protein, 181 aa, Homo sapiens
MMSRQPVPSLSWSAQLRFPAAPRMNVPFKRLSVVFGEHTAAGDSVRTEWCHSGEDGRNRGLGAHMMSEPARDGARVGSNADWVHGPSCELSAGNKHDRDIWHMHDRNIVGLPVICPNAITPPPYPWHRVPQGALERNFMEAWMDKREDKKGRNRKEPCPYRWLPTKYRTSIKAMKILELDT

SEQ ID NO: 964893 - protein, 80 aa, Homo sapiens
GVGALCGFEGRSFLAFPTLRAYHTLRLALEIPGLLEPQGLLLYNGNALVAMDFHVHLALLDVPAVHAQCLTTGSGGLAGD

SEQ ID NO: 964894 - protein, 232 aa, Homo sapiens
MIAVVENRRARDASYTKYSVLLLKRLQLCYGICSRLAGTAALPEEERTPTPVHYRPHGAKFKINPEENGQREAVCRTCPFPVVLSPRIPASVEGRRGLDPGQIYANNDKLSKRLKKCGSHSVFEARDSTVSILDKKFTVDCDHADPVTSSMRLSGLDFYILNDPEGGPVLQVWDGPEADGMLLRLSPDRSPSACTPEGSLSGVQPSTTEYKEFCHPQREEAEWVGLTLGGGH

SEQ ID NO: 964895 - protein, 142 aa, Homo sapiens
MCGPCAPGERRVFGAPNCVAPQRGCICCGHPHSRSCGGAPPQGGEARGTSAPHPRRGWRLIPEGGGEVCKKDAAVVGGTQPSHILIPPGGDTPRGAEGGGGEPTTPPEGGRRKHVGRECMATRSILINEKEGCLFDGRLTVE

SEQ ID NO: 964896 - protein, 450 aa, Homo sapiens
SLQGLLIPRSKKNQEQAPSALSLANTTQKPGMGRGRHRKRLPQQVCVCTCGSLLVVVPDGSGVYSGTVRVTRGCGVARESRGETGARPVWPRERNEQEANKIRSGQAGPPWRGPRVGVGRGVHHSKGLRGGVVGLVGTVPGDETEKRQKARNKHTTALPWKWNTWRCTHAELVEQHWRIYPTSRAENTSITPSPVAHRGKRGRQGCEPRATGVWMHGEKPHKDKQQPHRGDPCEAHRGITTHRGKSDTSERPHWCSMAKNNEAGVRKRYSGKRPPERNTLQHQRTAATFLGCQQNGDTQNRDQEEGFDTREHATRRGLEKRKRPRSHHKEGTVEIHPHNPTGSQPQERQAKRRKQYPRGATPKVHLEQNRKEPRDTSPGKTRATGSTHGRNNNHGCGAPKKWGRKSRGGGGYSPTNNDDENNTNTENQEYKDQKSKKKKERGERATRRAE

SEQ ID NO: 964897 - protein, 222 aa, Homo sapiens
MCCCSWLRGSCCCYGGMSTILHHGSQPGPVWRGNDPSHHPAPGRSSRSYMMPSPPGLAVTFHHLRMSPRVLLDTEGPLEEEEDGEELIARWHGKGHIGTSHELDAYEAEGHGIVDDERRRGADGHVYEWSAGTAGAMSEAVTREAGRGRWVRDAPEGLHVMSSQMRKDRRSALLPDKEHVSCENGHNGGTGRGVTEADDRRDIGENVEGFLEKGTLWWREVG

SEQ ID NO: 964898 - protein, 169 aa, Homo sapiens
MESESSGQEVARVRDKCQLPGVSEGGGEMVEGARCVRLKRETTCGCLCDTPEDVPLEGVALPRTPVLSPQPFPCDVFHLQFLGDRSYSTRKRRQVTRVHTQCETHSCVGAVWGTTTVRKGGPIAPQCENVLFRPGVQRLTRGELKTPGGATRPLWGQMPRPMLKRGKGD

SEQ ID NO: 964899 - protein, 184 aa, Homo sapiens
MTHDKTKQKPHTKHQQKNKRRQGYQPNRQRSRIKTKTKNKEQTRHEPRPRQHSQGRPQTTKNKKSSATTHTQENRRTPATTKRKKERKTQQRKAGNKEKQTHTKREKHDTPKEDTHPTQTQDTTKPRDGRHTSAQHKNKDTPEPKQSTQTQNNTTTKQEKKKRKTKKPTKNKQKRKQQTPNAHE

SEQ ID NO: 964900 - protein, 122 aa, Homo sapiens
MAIPNCSINRRLPLITAKSEDRQMLTAEVWEQYYGWNIGDIESGGGTEHDKAKVFNESWTTIRNSHLTLKQGIAMLPCKVTPTELRLRETGHESIPQSTDQFPLPWELATGGEQDEGGDTRE

SEQ ID NO: 964901 - protein, 126 aa, Homo sapiens
MVPRLHQRKPPPSRETRGVIASQPLITDPTNNRAGSPCCGFTSVRCRVVTPPLVDAGRVEDGPQLKKPSNRRRITVESVDETKQLLEDNKHIHTPPMIVVKYFSYISLPPYTDKSCVTTIRSYLMD

SEQ ID NO: 964902 - protein, 84 aa, Homo sapiens
LHPGEISSLLLTQNLFGGLLTATRMKFGAITRIRGPPLGDQSPVLLLFAAMRKIHLRSLLLRPTSPREHLTNFKSDLLSLAAED

SEQ ID NO: 964903 - protein, 130 aa, Homo sapiens
MVFEAEDHVQAIGEDEEHEQGGEQPHPDAGGEEAGTVAGVGELLPITLKAWIWKSCSIICQGEGCVRAKKRLPFLLRLLTYSQWKEYDAGPCDLGSIEVGDGAFLWTSSAPWYTSAGQNWVEAVGQNELE

SEQ ID NO: 964904 - protein, 121 aa, Homo sapiens
AQEQSPAATATAATAAGASAPLVPASVPAGAFGSTVPSLPVSSLCALCISLFRWLADALSSPAAPVAHTPTPDNPTPSRTNQPGPTPAHRITPPHSSDHTNNLPLHSLHLTSDATQHATYT

SEQ ID NO: 964905 - protein, 92 aa, Homo sapiens
MEVVAITGLAVALTRRGKQRDKLPWIEEVAVSVHFQDQNDVELNRLNSNLHACDSGGLHPMAGGGQAHSTLCEPQDLLQKAAGEFGLTTDCA

SEQ ID NO: 964906 - protein, 388 aa, Homo sapiens
QRREAIKRSRGCVLIRPRAVQRRSAAGAVSWGLVPAMRLTPRALCSCLPSACLCVDELPPVAGLRLWLLLCSLWPHGQWCAEGRMHDACLNAWWTCSHLMGPAECPVIPAFMCLQPFLFQVKAPCALKCLDLAVSLRQGLGLCAVILHDAGRQKLVADTLRNVTKCAKKNIVNLLTKLVVNTGSETIVDRRAFIPWIGSTWTLDLGEQSPTLALSQRWRHRRQPFAHRNVVSSVGSILAVSTQSWLGAKGPVAYSSKLPRPVMGMHPYRGHRAQRAPRKGAWGWAGGPWGIQPRRPWCIVPKNFRGSSLKRAPPAVAAVIRWTNFPWAVAWLPFGALDRLWRRPWCLERPWAPCGGNRVPGPTVGRRHRRPIGLTNLAVEPLQPEHPA

SEQ ID NO: 964907 - protein, 267 aa, Homo sapiens
MSLLELLPSQVTTATHVKKIPPRYPRRTDDDLGTSCTSHMPLTLRHRPESQAPHVHPTAHWHTPRATLQESSHSHSDWIPDADATRTTRIAPKGDTPTNAATLTAKTQRKQTKDEPHRHNLANQVDNPTYHAEYTRRNIATALLNNNFTSVTQPPWTTLTPTLKKNPTVTQHHHTTAAQPHHAQCHTCRNVRLCDPTYMRDNTHNPLDTLRDRHYQPNPHPPLHHSQGASTRSAGHIYRWPTAIIGNDPMRHRPHVKHGDPTSLGDT

SEQ ID NO: 964908 - protein, 264 aa, Homo sapiens
YRTASPTTCDITNPPRTNVAVLELAQYASVALGSRSCMRKMASSSGEGKELYLSWVVEVPGGTSVAILQDCLVPAVPSSTTCCELLLRALQARAYYFHRLILQGFLAPYLMLHSLLLVVVEDEYLMAGPAIILMGRGHRTGLRVSQWYACRGESGVPCSLVPMFVRMSHVPACSFKGRSIACRHACGPGTGVAPFVGFIQERAWLRQQGKEVGETLLELRLPPSDEDYLYREELAQFHRHGALTQLNVAFSREQSHKVYVQNLL

SEQ ID NO: 964909 - protein, 254 aa, Homo sapiens
TRQSSNLHLLSIPALTMSLRLQSSSASYGGGIRGVASCQLRVMCRGVSTCSPRFVSWGTQLAGYWRAAVTLWSPGWTRAAYVALDAWLLTVASGTVANGSAGPLPRLAYCAGAALRPALASRSHLRDALLHLRERSHPLAPTCGPDSPTARNPQIEPAPGTSAYPLRSNRGLPASPLPTAQRANQPRHPQATVVATNIPWLTLGATRMIQPRTPPKRNGPIDSQREPTREVSTITLTHRRPSLRHRRRTQRPHR

SEQ ID NO: 964910 - protein, 115 aa, Homo sapiens
MESWMLANYNQFFAMIGSKVNWKSWEPWMEWVVDHRKEQEQDHRDIRGALLQKVLRISHQKILMKNNSTGDWLRELLISKESSQNLRYFQINQDEEEEEDEGLNFIYLEKFCMSS

SEQ ID NO: 964911 - protein, 94 aa, Homo sapiens
MSLGVNRRGLGNVLLVWSLVTVRLLRSLLVSSPGVPWWLEGGVWRDAAVDADECAGAPVRSRAAAEPLVPRAGLENLASLELASAPGAWRARRK

SEQ ID NO: 964912 - protein, 306 aa, Homo sapiens
MPVVLLTASSCSVRLAEGNSSAVENCVLPEICACASNCERLTLHGKCHNVESFSEVYQRTVFSVRDLRLVTLASLLKEPEMTYAGRKTGSTTFPVMTSKTKTMKYIWVSKKEIKGDAEELKRLGADMVIWGRTRWIKIPLDADLRAAMELAQGIKMEGRRRSCSSSVKMLRQREYEPIRQALDKLKNVRTAGGAVHRLGKLRDRLIDQGDDALRVRVLNLVGRCHSQARGVIMIRKRSKGENGHKRGNRKAEFPGSGRVCGTEGKSAAREKAGGRGPLGGKTTHRGKAHVHAGGGNHSAPPYLVAK

SEQ ID NO: 964913 - protein, 294 aa, Homo sapiens
VLPPLRRRVSLPVAIGRRDRRAGSLTMAPACAELVLLLTTLPEPCFLPSSGAPDTRRHGGRGPEVTPTLGRAHGPGARSCWFIPLTLVTYPHYEAVGIDIAKLGRNGEKESGDADILLSNEAVSMALRKEHTSAALTEDSPVTPEVTCDSTGCYVRCLVGVRLNQPPCSIVNVGSLPLGRAMFVFYCLVLSVATRLGRIVRLGIVLKRPGGSIPIMWVAPNRIAGVSALSLRCRSRALWTRGLAGDWCPDCTLSERSRLVNRRLQAFNEPSAEAGKIRAQRSRDEPLCLRTALY

SEQ ID NO: 964914 - protein, 105 aa, Homo sapiens
GWAGSGGARGLCALGAKPAAPERGLGWAFPMGKAHVLFLPITGTMEQWLPYGAMIPGLGLGLPVAQSYPGSVSASSTAYLWWQEKRGPAEQQARPSCPGLQWSTR

SEQ ID NO: 964915 - protein, 346 aa, Homo sapiens
MINAHVRMVSRSRATTSARRLRGDRPAPESEPRRRDTSRANRRQPPPRRLSESRGGGGMSEAGEATTTHHTSRGSEEAAPGPQDPAPRARWAVVRPRAGPVPRAHVAGNPWWGRRAPASQRALGRRFLGPPAPGREDGGRKRVLASKSRWHLSMGHAFRKWILELISSERVTPKEGCFCVHSGVASRKKYPGGNFSARVVGRMGGTWRRVGCCLKGERVAEVHNCDCPGGVLVKGSRTVQNRRRNGRDDMEGAWPSPECAELIDEDGVQRAHFRRVSEMNYAREKGTCRCQSESEKKLARGQTVVERAQKRARELSEEGERRGSAVCECVRERIREREEIYLYFRG

SEQ ID NO: 964916 - protein, 288 aa, Homo sapiens
MAWDYGVDPGPSADPPQQPHSAIVTVELSVCLLSGPCVVPPVGGKSPLPHTLVHLKCVVGSSLCGPLHLWLCPIQAPPGSPRLRGGNVWCVGGKLFAPVGVPFFLNLCGGATSLCVVGVWLFSLKHIFIRGPWGGGLTISSLSPLSVAISYPRGRAENSSRGGLPSGDTWGTAWGVLWGGPVVPYAGALHHEGGGLFPPSEEKPRGLCPCGRGNNPRGPRVCAVWPRHNLPCGVGPPQFFPWGGPRRGTPVGQCGQRNRTPERRTPSPREKSPPSNIETTRRAPREET

SEQ ID NO: 964917 - protein, 247 aa, Homo sapiens
MFCMSSSTGPEQEECHEQGLLERDGRGASTRFRETLTVGLVVISGAWKSVHCEVVDRDGQWVSDIRAAQRRMMWPGVSWYLRDIITRLQESFETVIERCPTPVICCRPWVAALGRSVWTLVSACDSGTCAPDAFFQVQGGGRGFELRCRNTVCACRWSLGDQSLVHERGRFNARNDDVRDRGPGAVAGSDGVFPERKRVLLVLPYAAAGIAADPCRCCSTVTCGSRTIVGEPHHVVPPYVFSPPFVS

SEQ ID NO: 964918 - protein, 414 aa, Homo sapiens
CGAGSCMEHIRKKRHFSESEASQILRSLVLACELHALMECGLWLHLRPQAWRTSMYCLTDTALVAPGENHRLRGFSAGLRACRCPWGCPCMTAPAFTACMYCCTHEACLCCRHGGYRTSPAEPSLEPWCRHFLYMNGLSGVHGPPSSGGLWTMGRADATGWPWDHMLQQSGDGGGFFHLDCGKALCRGGNPAREGQWTLVSLRCAHLDQVGTPGHMLGLKSIEMGDIAGVQELRLGLQRTGQDGCSIPSGHSTDIALDWAPGKACHTEFRSLETPGHDSQTYEGIHYKHDQTNFQLGAHYQHPVVAHRQGRQEGCSFTTLTNEMDGFVGQEKQGKSHTMIVGDHKIDCDRVNTARTKRLGQTNSHSQTHLRTITPVGPGGALSHSLTDTKETKHRGVSRGVSNTGDGPETQKMG

SEQ ID NO: 964919 - protein, 143 aa, Homo sapiens
RKRGVSWAQYTTFGNQPHGQKKEVFGFLSPPRGWTGVCGPGGRVVRTPLGGPYLSLSLSLSLSQNIFSLSQRVCVSATETTHREVCGVSLCGETKRGMSPAGALQTSLSKTPQEKTRERVSSGETTEKRGLSVSPLERVSLCV

SEQ ID NO: 964920 - protein, 249 aa, Homo sapiens
VDEILRKVADTRLVIIMLVNNETGIVMPVPEISQLHYSPVTRNGWHAGLPPILVHTDAVTGLGEAERVDVEDLVRGLPYRSVGHKFIWSQGLAALYIRGTLVKFNPSLPYDYLEVDKERNFRPGTENNPNDMLALEKAAELVTQNCEAYEAHMTGVREYLEREVCGAGFGQKRIHLNEPSFQAAMRFPIPVKLCIRGPGFKATGGCLRQWRVLMARVVAACHSGPLGATAGAARFSPPPGLSPVLAEYG

SEQ ID NO: 964921 - protein, 461 aa, Homo sapiens
MRVALCPSGRCGPISLSARGVSPRALRPMREEWPHCGACGPQTSGVVSHTCYSRCVRESACAYYATTVWGVVTTHREPPDVCAQPPQNLSREPQECGHERVSSALHHFISPALCVDTRPRECVCQACVSLTHSVTHSLRESGKRPHTVCAESVVCQLTSDHPRAVLCGLSALVGSPSGITNICSERHTILCYTHRGTTHKGAERHFTTILETGRCRPPVEKKISSHISQQKKISPGVENNVLSSFHPEGRLLWGVSGAPRFSVYNKVVVDNDAPSVVDLLSTHNRRREKDAACGTNMRCCRNQVLSTTISTHTQRWAHKNIIYPPINAGGSIKKKRPYNEKAPESYGDHTNNFRRSYSSQEKAGVPPDASCGSTWEGEQNNKRRSKCVDLPPITTLIVNAYCEGPPPPPPPEKIGRTDGVHQLTHTTHADREASHHCTPHKKRVTATSPGWVPQEAPNVPQ

SEQ ID NO: 964922 - protein, 271 aa, Homo sapiens
MEYQDAVRMLNTLQTNAWYLEQVKRQLGDPQTQLEAMELYLARSGLQCGGLGPVNIIHVTGTKGKGSTCAFTECILLKLWLKRGFFSSPHLVQVREAEIRINVAAISPELFTKYFWRLSTWCRRPRIGMLCLHAPLRSVPEQLMGLSTSSSKRLVDLAVVEGWALAGLMSAPNIIRKPCGVRRLLSLGVDHTSLRGGYGWRKIALAEGGVLGKVSLASIVLHLEVPASAEGRARDLMSHTVSVMGLQKGAGGTLPEVRTRAERFVSAMLFG

SEQ ID NO: 964923 - protein, 30 aa, Homo sapiens
PPHHPSPPSPPPPPPPIPLPNLTARYEAWV

SEQ ID NO: 964924 - protein, 343 aa, Homo sapiens
RRNIGLGQLVLIGTREAQRTFVMFFAPGVVNTASGCSRLGMTWETNTTAWKMPKSMWLKWTDGPLRRVLRPGGARIPHLKLSSQAKKAVKYQVLGTSRHSENWMLQTLKRKEPVTPEPGKVGNLASAPELNARGCIEASSSKQLLRLARLHKGGTTFIQSSSPPRGLWVHLERPWVPNLGSKLALGLEHSENCQGFAQGGIVHQHYELCSGKTRFVGNPTLSLVPEMRTKVDQVQGESGILEVTGGEYVGSRRLACCTEDLSDRRPVHGLQEGPVWFGKLGALSVVQGAPVFWHSLEDSSMTPSGRKDNLLIQVYWHRVGTCKNRGQLGGSSQGSLDLGGKNR

SEQ ID NO: 964925 - protein, 291 aa, Homo sapiens
MNLASQSWGGLAAGQLLFANFNQDNTEREQGHQEQLVLAARAVAAGPIAVWYAKSGYNISLPFFLWITLRTDSYAMHRYRKHCVHSLADALVSPRSHSWPSLSPLQHHRQRYQAHATFTARRTDDSCKPTTLHPNNRTSGPSERFNPGTQALDYAIAMGSDVPMLPLQATTSAGPCNACLADYRTQGQNGHTKDPCQGPAAAGLVKFNQPDRNWPYLGAGTPRGQAAEPNSGATQSDTSGPHRSYPNFNIPGTKPWPTPTWTIPGALPRNQVPFTPAATWAVLQAQVWAHL

SEQ ID NO: 964926 - protein, 275 aa, Homo sapiens
MEAAKYDFEIVLPAVPLGPPSSSFSHPSWASCSSKRAFDQGAEAIYEHSHRGEAVENTSSTSMRTSSSLEVPIQARRTAGPGQHAVSRMKLEPQLVEDDVSEGTSLHWTGNQCAACFGYTRQRGLRLAKTKTSCVTLSLLGSFLEMVTRSMLKAVLHGTIHTGEIGPLGETDEYTNTREEKKKRGGPGGPLRKFGARVREEEYIGARIGCDRWRGRAEPFESWFSSGHPKVVLRRVRQSGEEKCRAGGHPTPQNEREHRGEYWPNKPGGKPGHKG

SEQ ID NO: 964927 - protein, 238 aa, Homo sapiens
GLGSCLPHCVAAESRYTSSGVSALGRQSANLLPRRDCPGILPAAPQDAAPVPRAGPVELGTGTVRAPWVAAEGVLLPLLFWPRGSRESSWAGAKPQDGGPRWASPEPWLGSPSPPDTKWGKERPLYKGANFPGGDKSVGGRDGIWSSPACPLNGPEGQQVAPAGGRESLEYFPVEETFIRLVLEATQLGSSQRAVLSHWHTNSIITVGVLKFRNKTGVVRVIRSLVTPKWLGKYQWGA

SEQ ID NO: 964928 - protein, 131 aa, Homo sapiens
MSQNPYKCRHPSRTQQWYCVFMESSYARSHWQRYSVHRGEVRAVAVDTTGTYMATSGLDHQLTIFDLRGHVQPLSTRNLPLEHVTALLPKAHCMFRRNGIPFDTSGPVRHGQPPPLQPPTTDPGRACLNCP

SEQ ID NO: 964929 - protein, 188 aa, Homo sapiens
MNSWHLWLVGRSSCRLTSNAPRRSFAGGTWDREYVGLDDQTEYAEFRVSEEAQTNVRRRRCSRVYSRNPPDPDEPGEQQLRYSTKAAVAAQAWYILGQVLASTEERCTALPGVTRPLAVGLKEQDSLQARSSLDEDDPNILLAIQVSLQESGLALDEETRDFLSKEASLGAIGTSLPSRLDLWPRKYG

SEQ ID NO: 964930 - protein, 207 aa, Homo sapiens
MRVGRGAEVHARLTPAPLPPRAQNNQTSRASPTHDSNYSHKQRQQKNEQTALTDRTPQHKTPTQCHKHTTQQKSSTRIMYRYDTALTRTQHRHVPGILPTPAATDAQNEPTSPPSHNRLDKTHTIYTTLHFSSPHARTHAEHEAYHHTQHPKTQHTQETATATTHTHPTKPYGPPTSAPTTPATPNEQTHHITPPPIAHPKNPTHQT

SEQ ID NO: 964931 - protein, 122 aa, Homo sapiens
MTSKQPALLKIPDWMCCIKCCMPDAHAAPELFHEQTSMSMSHAIIDLMLSAVPLLLLTCCGAPYACVDPLSCLTCVPWHMPGLLSAPVPFSVLGPCALPWMCMLRLAMSSDIMWLCKRLLTL

SEQ ID NO: 964932 - protein, 413 aa, Homo sapiens
MGKKCSLEDLARDGRLVPTCAWKAPFPGKDTLKPALVGLLRVPGFQFSASGVIDSRIDSTCANSVDFRRKRQALLWPRKDPELPEKWSVHIGWVLQTQGLTTVANRAFLLLQAVCSKFGCENHFPRLIEDLCTASSEAAPDSVDVLYLEGTQPNILPRKYTPRGLTKTRLLLFQQVASPGNIYWSSGPHQDRKRVLTPLHFWARFNVLGAHYNNFSILPNTDTTEGRYPPWERTRRVKARKRRGVSPIVGPLFAAPLRRHKVSECGPCVIHPSFFISADIFRGSLSRGMPMGGAMSRPHYMFLPFRFFRGFEPRGGGSTHGISIIFPRCGKTAFILPYHPRLNDSWPPIYIKGDCGRLPPCTKTFHLQRPFLHNAGGAQHIIIFNHNKVLQQLFSPPKRKKCPGDTLWRRVVL

SEQ ID NO: 964933 - protein, 229 aa, Homo sapiens
WRSSSCSNALRICCNAKLNLTSRALEPAGNEMCIPAQRRGVLQLCGPEPGGVPGTSPPVVSCYNASDHVYEGLLSTATVNLDGSYCDCVLACPGLVSRMNSCTRDGSNRPRVSRSVAPVARGPAVTLTSGTRPTSPLESPTPLFRAAALQSPAICGLKHICHHFYLRPSEDPDPAANPCQRQSVRLLRQGVEHEASRDVGAQVTDGAVGPPRTVAIQAVSCEQGGPMSP

SEQ ID NO: 964934 - protein, 154 aa, Homo sapiens
MSSDFIPVAGRSLSAASAFLIAWTGLASTSMLSPTADGWQEPLNCYYGRDAVWQRGCPRPAAALDCGSPYIWVQPFPGRVPSWRSHLFHSLHVCAKGWECRGMRSRGRGLAFTQWGPGAPLNGHRLKFPYESERLQRNWSHLLHLTHDTHPPHD

SEQ ID NO: 964935 - protein, 154 aa, Homo sapiens
GRMARARAVAGGGRRRRCHPPLSPRRRRVIRASWPEPSDETAVRAGCVLSLAVRVAGAEDVELRSPLTRSLYVNMISRPGVWLGWGSRGGAGKEKHQVVVCAKLEQKLCRITPGLSLVQSYLDQGTRDLLKPTSIENIGLGIYPIISFFVSVVF

SEQ ID NO: 964936 - protein, 302 aa, Homo sapiens
MSCNTHRKVCSFTPEPGEHKPTGRNEQLQTRRLRAVTLTAKVCSFILSQETTNPPEGTNSEHIQTSEGTNSRRATLRAVTLTVRVRGFILEVSETKNPPIPDTSWQPRRDFRLSPSSKTIAYRRAVRQSLIAKQIEAIKLQMVLQMEPQMSSTNNFYQGPLDRPTALPLAREFPSEGHYKLQGPFFTPIQQEVARVVIGQFQQQLGCLFRGGMGGDSVLAVSQPRLSRELLCWAPLWRTEELQHVHWEPSGAASSPQSEVGRPGPVRVALVVGVGRQGPRRSAGGPGHIRRAPLRLPAGSFC

SEQ ID NO: 964937 - protein, 385 aa, Homo sapiens
TLCKDHVSEGWSTALDMLTRNRVQPSVTYSPGHVGARRYTLSCVVTELSEHHGTDLQHQALTRLLLSSDGLALVYLYPAGTYPAGLDLTHALWFPCRSQSLQGGMSGHADSSLKHRLSWPGVQTCADTPLPHRTAEQLLAGPGRGWRLTRALDMDPAHTCCASLAPFITPWGYAHPAPPWAALRHQRQRLADGALPMPTPAYAAAPRSPWAHRNTTCGPKPKTPTTWGILEQASMGPYYTRRTKHATSTPRDAMSPRNRKRHKARALQPGNRRTNRATPPIPNTWGRTLEPYPQHTPNGHPWQTPPTADKQPPKVDQGQQRGEHNSRRGTTSGGPHPQGTHSAQGRPPKSGRNSNHGTYGTLTPPQRRPPWGAATPARTEHKRKE

SEQ ID NO: 964938 - protein, 77 aa, Homo sapiens
WAQVLRSRWPFLTLASGSSAGRSWDMANSGCMDVTGPDEESLLYFAYGSNLLTERIHLRNPSAVYFMCGPACRILRR

SEQ ID NO: 964939 - protein, 279 aa, Homo sapiens
MIWKRELLLASGMAAPVGGEPGPHSQWRGVKAWVDIYSQLQQEVGAAGGELEPKTRGSLTGRLIEVLENPRFNSLVVSLCRSNVMTVQSTEALTTTVPALDVRIPRWDLSVPVGLPDQCLLLCQVPTCVTRDSSARELECASAVLGCWKQTSTWRNSSHNDCALGDTAFPGNVLLSLFKNLLLKKIKRCERKGTESVTEEKCAVLFSASFTLGPGNPHPAPGLFSAPGGHQSMENKRNKCQSQYPGVDNAFSEMDLVLFVVPERCPGESMVNPLNRSSW

SEQ ID NO: 964940 - protein, 112 aa, Homo sapiens
SFFCIFFLGTKFYKRVFRRATIQTPKYSLPGKPGLVRGGTVAWGMWQGALVAFPPFRESVKVGVWVAQYILHSCGSFQHMCSPRVVSEAEGASLIEGANLFTRVWWLPEGRA

SEQ ID NO: 964941 - protein, 539 aa, Homo sapiens
HGENLGTTAFYNELRVAPEEHPVLLTEGPPGTPKGQPRRKTDPVLMVLSTSQAPAAMIRIAYSSACCLVPLLPARLAPGYPSAGPFAWHLRTLSGPAAGRASTPHHLCLPRDFATRTRRFVATISPQYVSRSPMPASMAPYGPMVPASTHWTLAAITFNMETKLPLRTQYTGGLVNPRAFYKLRILRNRDRRNRPWVHTSTGRADMKLTFHNARTAIRSRIRPIKPAEQDRTMGQNPYYPQTAPSQPNGKLLISKSGAQLGALCITPKLSPLTPIYRSSYVATANKGPTPTYNDEKAAIGPQVSIPVADPPGAALPTLFPIARTILSRLVRTTASVTRAAGGYLTRPRPIAALPPLVIGVPSAALSAFVRYYGPGTFLFPAILAATLGRRVPYPWLAPLGLYPPLVFLCPVGRSFPRRTRVVPPCCILIPALPFSTHRLVFPAQSVSASLVDYNTRALVRFATSRDSPGRSQSPVIVSLLCASSLSPGLALHAIALLAPRACPDYSTDLRSGFPGRALFAPPCMAGRRAWLPHSPLMSS

SEQ ID NO: 964942 - protein, 298 aa, Homo sapiens
MVEAGVNRRGCGSCRLRSAGGWAAPSGEHADSSWYSFGSGGGYGSGFGGVDGLLLLEVRRARCMETQLTELASYLDLVRALEEANTELEVKIRDWYQEAGSGARPLDYSISIYRTIEDVCRTKIRSQSPCDNDNILLQIDKARLAADDFRTKFETEQALGLSVDGRSSMACRCVLDELIPGSEPNWRCMIDEAQRMMLANLKNEPRGGDERPGRQVRWCSIPCGRWTRAQRVAPCSSHPQRRCVSCMSKMAENNLGDGRRWVLQRDRGTGPARWAATSELVRIGRVSLGARRPAGLGI

SEQ ID NO: 964943 - protein, 273 aa, Homo sapiens
MCALCAPVCALWCHAVWCKCVSAECWPREVLVPVVVRGAGWLQPVPWNLHCFECAQRGVTYVDITVGSFVCTTCSGLLRGLNPPHRVKSISMTTFTEPEVVFLQSRGNEVCRKIWLGLSDARTSLVPDSRDPQKVKEFLQEKAMRRRDGMSPQTKSRVPTYTKGSASTPCAGLHPRREAPSGHFWVILAPVSLQVAAFHSSQPVSQSHARTFQGRSTQALPILCQRSQVMTSCVENRVGTPFCWPPNGPGFIAEFRALQVAKSSNEGLPQLVD

SEQ ID NO: 964944 - protein, 514 aa, Homo sapiens
ERARHVNKFWFYSAGGVDSTARTACYIALEPRTSHCCAHLIMALLRKEKASSARKQAAQQQPGHSGSTVTKLLLTSFYNGTQQPYQLSECKTSNPPTATQQLQTQHRLSNYLNPIHSVPCTRSTHHAHTHTRLRARTNLSMTTNSTLAQHLHTLNTLRSNTLAHHLQQPKPSATRLLNPNTGPPNTGNNPYSIAATPTGTIIARYLPHTRACPLTPIATGHHGQRPPTAHSDTPLQPRYTNIPRASSRHTVGNPTHGHAPSSFRRTTTAYRHPHRNADTPELPLTRLTLNSTFPPFQLATTTRNLPHTNPHTLGYTSSTALGPAKTFTLSTRPRLAKPPLFGRTRLPPQLHNAHWSVQRLFYPSVHGPPIPNSLNLPPNSTPPHPYETASPKRARYQTPPHTADTRVENPFDDILALRRHMWRHHTNETTNPAHSNLNPILAPADHNPQRKPTLNTPTSWTIIDPPTNITQHEIKIDTLWDANTKLLTPEQRAHKQLKHSYHHSAQPHPSAATP

SEQ ID NO: 964945 - protein, 253 aa, Homo sapiens
LGRAAWVNGRGCSARFPGFSANGLVCYAPVPATVIVRRLPEWVAAMIPPASKLEHGASPPAARSWHPRYYGPLCSTSSNSSCSSTECPGKPFPTPQCLPKADPGHWWASFLFGKSTLPFMATVLESAEHSEAPQASSSVTGCGLVRDARVSSPAVSTSIAALGPVLTCAGYHQPQGLRRRLVDQRLVDEVRASRRTKLLHNATDSPTFFLLRWSSTQVFELEIFHPEGLVIAEELCISLPPGVDCAGCCDGTN

SEQ ID NO: 964946 - protein, 141 aa, Homo sapiens
MCLCKRCEPLCAVARGGRCAFSLILVETRVVASQQLSRSGCSMCGLPTSPRSVKWAPVRGSRGLFSTEQTSVPINPTPSLSDTVQEKHRGEWAERPQTISPSPWEKCVWDRVLRTDEELPAAPFFLRPDCDLMAPVAPNVF

SEQ ID NO: 964947 - protein, 443 aa, Homo sapiens
MCWVCGLVPSCVCCCEHVMWLQCVCMLLHCACHALPACLGAFLAEPLCGCPVICAVLADVLTCASMDGAVAWMNAACCGCVLCFACFVGQLECWLLSLNLRLRVLACFVLMCQCVHCVLACAPMDAHAFLRLPLNWALLACCWLRSDATLCVCAGILTLQLTLCGTRTVRVLCLQRYGTYHGLAATTWEQELPCVFGKTCPTEFTREGPFGYKWLQNDNHCNVSQFPRNHVACVAPGGMNALRENQGEPRYGCSLKKHSLGWRQHKFVIHFTFALNARNKPFDVSLKGPRGRGRYGLDNPLPWALIEEEPPGAFGEPTPTSLATKGALVYKCCAHLWEHQDLFVGIGNKRTCHVGHRPVGNTCTHTLRNRGKGPPLWAYNGAQVAAAPRQTQVLFTEHKRWGTPLNADNCTHAHSQQRSPTMCGNICRSPHGTITSKRDNQLC

SEQ ID NO: 964948 - protein, 79 aa, Homo sapiens
YLLCVFHLLKLATRGWGASVLVKGPGSGPQHPMLSWRNPRSLGPKPGSGVVAGCANLPQMAIPLPGMPAIMGGEALGVG

SEQ ID NO: 964949 - protein, 206 aa, Homo sapiens
MNYGYLSRRSLVSRYGSVDPYVSKWVPVVTLLMSEMELTTIIGDHHLPTEDIIKTHKWVKEEGAVVRHSKNPSVNVRTRVVVEGVDVLLHLLHSLLDSWCIWCNKRGPLVMAHMYIPEDMIEFRSSEPQPRSYGSLVLLASYEIASIQSTGEGDWLLVMVYEGSSSWHSPVSGGCMVCAEVPKAVDEIFTHIIVGTLWAAACRIIA

SEQ ID NO: 964950 - protein, 298 aa, Homo sapiens
GPSGRSCSAGAAEPGAQSREAAAASALPCAACSPGRSMGAWHGVAAVRLCSPWRAAGLGAALLSPQVAARGGRWRCPGPGAPCELPGRLVPNLPLDAFQRGGHGALERVAWEGGSGPGLPGPANPYVNYCGALPSHPCAPGPCLNPRQMPGFGETSGQAEVGLGTRGALPRSKGGGGAGETPKGGARKDQLVAGEGHGVLCGAVPARTETQAKERKKAKRAGQTRYGTFTKAKQFGKKPRRANGFPRRETGITPGLFDAIEARKGTDRAGCLEPKPFNPEARLAFAGAPWVPKENAGA

SEQ ID NO: 964951 - protein, 148 aa, Homo sapiens
MHAVLTLPCGVHSGCLWVHGCVLPVLCCCGAFPLCLPAVLGAALPALCACSPCLPCCLPCVWVNRCDACDCLCLLAVWPWCLKLACCDNLVVLPDGCSDVCLACPSWCIGLMLLLTGCELLMLERQVACSNCSSCGYWGTLVLSCCAM

SEQ ID NO: 964952 - protein, 195 aa, Homo sapiens
METGPELCTNNLWMEKQHLLLERMMMMKFQILWETFDEASKNEANCMESTSDRYNLKKLLGAAILYYDWFLRNLVHGSDKIYISNILKAKPLDTAALSDWVIHNSSLTVISREAAESQSEPRLTKGPWPKRTTTERKTNHVGRHWAQRNVKNHAGRGPNGHQNTAQRLPRNRAHRRGPTKAGAQADTNGDAKEQG

SEQ ID NO: 964953 - protein, 344 aa, Homo sapiens
MDLFPLVRPAWKAVGLENADACSVTSSNSLGFGGHLGHVCQCLPLAYVVMVSCVCSGCLSRAACRPDLSPRAWVTAPCPWLVSNLQVLEVALGMTGGSPVSLLTPASYYCNCFLVTCLAQRPYSGLLMRHINLIPTNLHWQRWPGTGSLPEGFSSFQGRMVQTLGDLGRLWVTAGDYTVRLPWDGSGDSLAGVTVRLLSLRFQIFLDSKDLSERAVSWNPSSFLDFILSVKEWNNLSLVPLRQLLGDNPKVLAYCNSPYGIMDPSKLSSRWPTNVRLMTSETDAVGKGHWGPHSSFGDLTAWADSYVLTREPLSPGACDLNSQSGRRLRGDHSVTMSVLCTPAP

SEQ ID NO: 964954 - protein, 274 aa, Homo sapiens
MEIPPCEVPEDTNQGSGWSTGGVVGEHSHKGDKLIARGRRQLPRGMREETQGGPPPKKWRGGKRGDISARRQGGHNTGPHRKHTPPGEKKKTTTPSHETDNNLNHHGESNSPGNITTRGPIIRAAPTCVVRDSTRGSPIGRPLWCNIPTEWVKQLGAPQTPCGHTQGAHRTVATAQKNSAPKTSRSDNECHTRTTWNTEDTTPTVDQTAPGPRTHNHETSAPEKKDPPVTKKSHKRRDGESKPNNHNDGTNSPHGHARENKESVRGTTTPQKKT

SEQ ID NO: 964955 - protein, 167 aa, Homo sapiens
MRISSDLRHTTSQVLLRAPKRTCTHTNEYTASRQRTQLAGVTEDQTVKRTQLLRLPRHLTLRKLDTTPHESLKPKVRGDHPETKAAPLTHWRHPHGTIVHAHPPKRPRPPTMQRRCRRGAPSARTQRKPPQRAQRATGHTAPTDANPPATAQHKNARRDDGEKHDRP

SEQ ID NO: 964956 - protein, 297 aa, Homo sapiens
MCCILHDVVPEERWSQEKPWEGGVGNDTALLTGMATDVFYAPVHRSALAMAFGNGTHTDKYEERSAGLGWLKPVTPCTYGEAERGADHLRSAVRDQPGKHPISTKRKPISTKITNTLAGHGLRMPVIPATFGGRGAENCLNLRRGGCREPKVATLQLQTGVTAVRLQSQTRTRHTPGHLRSTVGNGLPTHEDPTNCMTNPTYRRAPMGQNEQLSTNPTAPTVCQRDDTHTIEERGMPNPSPPTVPVTSPPEATTTNTPQTVAPQRGHTARHKADKATTHTPKPDGAPRTTHAHQTYP

SEQ ID NO: 964957 - protein, 279 aa, Homo sapiens
EKMEDGKVEGHPSCEPTLLPPPVRNAIGAVSTRRKSGGGRSDCPCCQGEEESCGYSVKGAGDAAGRQKSAPGWGFHTALRDYGPGMMEHGQGADESGATLPRMSVALEACKPLGEQERAVILELKRAECERRGRALRRACSPVPGTCATTVNQVEETRYCVDQNLVKEYFPVQVVTHGLLGIYQELLGLAFHHEEGASAWHEDVRLYTERDAASGEVVGKFYLDLYPRDRKVRAQRTGFGCSPADCGRMGARQIGIADMVANFTSPSEAPRWWQMRGGD

SEQ ID NO: 964958 - protein, 283 aa, Homo sapiens
AVRDLVPKPVDTPSEEPVVALRKGRIPHSCMWAVSSPRIPSLWFSAPIVETGPTPSHVVWDEVSPFLPTRMSNNLRRGLPETLQRKNSGNASRDPIIENLRIHHLASRVAQGKEHGPTKDSPGDTTVNLQGITILEDSDCIDNFTTRFFGAFTYRGFRKSVPLLRDSLEPVWDLPGRKGLDFPFTPGFATRRWSLKHRKHQSLIGRTGRREQEHPGEHFDVAKEREKPNIDNCAPPQRAHTERTVLRAAIMGHHSPVPTLSVYYPLRFFPNTLQIHEPTVRAR

SEQ ID NO: 964959 - protein, 123 aa, Homo sapiens
VCLLLHTVFGTEHGSGSTLFQVLRPPSEFALRWKAPGPSSTCHTPDCWDLNRHRSYWFSSFLAKQTDELPDCVQEMYYSTDGGGASAINKPGRILYRMQWPSLMTIPSSRGFYVSNRRSECEL

SEQ ID NO: 964960 - protein, 86 aa, Homo sapiens
FLCGPIFFPPELGVCGRRMNWELLLWLVVLCCAAPASWCSLLRFLRADGALTGYFVAVCVQARLPEMWELTDMVVWVTGAVQGGNR

SEQ ID NO: 964961 - protein, 31 aa, Homo sapiens
MTGDTPIKGNAYIIHPAQPVTTNYCLRHTPE

SEQ ID NO: 964962 - protein, 342 aa, Homo sapiens
RHSFFSGTTLLPPLHDAHTLARDTDSELPHGLQAAQHERQRLTAARLHTLTPPSLACTRWQRPTRSHDTHGTLPTHAWRDCLATNASAARTCHAYLLLRSLCSSHLRLLRTLQSAPSCTLPDSPSARPSPFASLTPTTCPMFWLPLAPWTLLHHSLVHLLFLMLTLSAAPHVANHTHYYTEHSLFLSARLLYALTRTLQHLLHHPLLTTPHTSTDHTPSVCSAAALAPPRQHTLFTPPNSRSSAHPPPPPPPPAPRAQAVVPPQRQTPGSTQLDAHAHIPPLIITHTRPGRYTTQPLSRTTLNRRPSRAHPQRAPITTQRPQQSLPLKIAHDPCGPPLYAHT

SEQ ID NO: 964963 - protein, 158 aa, Homo sapiens
MCRRVRKSPAGEERSDVPERTTVERTSRRGETSPQTRLVWPRRGRQHHVGRSQRRGPTGGCLKEGGGGNKYSPLREKKGLLLQGKTSEEGTLQNDEAASWLPTQENKKLAATKRRQIHSHGGGREDAWWAQNTNTGATKHVWDEAIRDKSTDAMCANR

SEQ ID NO: 964964 - protein, 212 aa, Homo sapiens
MGTEGVSDTKLVPWYPSGDMATLRRELGGATSHPVQWHRGALGLAHNGHHIEPPRGQPRLCTPFAARGPCTLPVALTVGTTRRTLCVGTVVGNQCLDTVGPWTVASTWPYGVPEPHHASQLRNRTDGGPSSHPMALIGAQHAGGSRNRNSRHTQVLVERTPAYRDTHTRKRPARHRLGGADRQPAPHTGTGATTLGEHVTGDPLPGRRTRDE

SEQ ID NO: 964965 - protein, 108 aa, Homo sapiens
WKQKSHSVNPGWECRGAISAHCNLPLPGSGNSNASASLVPGTTGARHQTRLIIWGILNRDGVFHHCWARLGLELLTSRLIHPPRPPKVAGDIQGVEPFGAQTKLLCIL

SEQ ID NO: 964966 - protein, 170 aa, Homo sapiens
IPALREAKRREDSLSPGVRDLPGQYSETPFSQKKKKKKKKNIVSAPRPRAPRKKSFRRHQCGGGARAGAQEGKGKWGHKRCGITNRERDSGRHRDKGAGSFSPTKKKKRRAGGEQPRERGSGENKISQRWGESIEEGDQLQGKLIKTAGEIHNGEGPQISQKLTPPARGS

SEQ ID NO: 964967 - protein, 84 aa, Homo sapiens
MTDQETTQERGRARKKGEKNQASTNTSNQRGRNERHQNGEKNKATQEAVNRETKKRRQDKSRERKQAKEEKQTYKEEKEKREKG

SEQ ID NO: 964968 - protein, 461 aa, Homo sapiens
YSLDPENPTKSCKSMRFQSIVFTIKNTRETAPGPSKGHALYSNTATHSHLAHSMSTISPANQMCHPFTQRYTWWQYGQGVAPAPTANGRHGTTTASAWHPTHTADACTSFSLPPLHSKHHASMQSHCLHTFTWRSQHRQTFIIGSIRTPSYPHVAHHTATLTRIADRPGTITKQPPMRLRIYNPITIARFLALCPTILHAIAYPLTVLHTAPHPSNLVHYNTLSHSQRSVWPPRHSTHNSSPFPEATATTLHTHTRNTTYHCATAAPTSNISSPIHTHSTTGSHSTHSAHTTQNKNTPPQQEKNNKHHPPNTSNRHHTKHTRSTHDTNTRSHTTTRHPHAPRHSRLPPSHPRTDLPRTTKEATTTNMHRQHHTKKYAGTPRTNNENKQTNSIHHGTLTNNHLEAHPPHAHRCTKGTRHTEAPTNAPPHRPTHRTTTPPYTHTHPTHDRTLHYTTPTPHTTN

SEQ ID NO: 964969 - protein, 171 aa, Homo sapiens
MALYPPTRSSSTGHLLYCNHPLYQPRLPFSTRHLLSPDLSVDTTLVPQKLAVATGVILIKCPYLSQAHHSSIFSSAHTLSHTSVTLAYTCHFTLGALGTSPTQTHTSPAHARKHPTVRWDPCHWCKIAHPRHTCKPQGTQAPWAHRVHLGHLHFPFHPTLMVHPISLPGPI

SEQ ID NO: 964970 - protein, 118 aa, Homo sapiens
ILIQSEKSDRRLNFVSCYDVLESLLKYMLDIMRIEWLYKRVRIKDSEMSLQRINNIHNIPSKRLDYGSSTCDRSMVPGSKVYFQSGRGPLLGVKEVSFVPLDAWCETSKLFIPYDTLV

SEQ ID NO: 964971 - protein, 282 aa, Homo sapiens
EEDDITDSSSKWQRRDYLLLVMEGTDDGRRAGGMICDQEVKVLLDQLRFPNGVQLVSCRRLVLVAEDKHGQDTEESTFLAMMKGWGCSVSGEHAWISRQTSGPAASGGYWVGMSTIRPNPGLFHAGLSYLERTWIKRMIVQCSLVDSETVMKVVPLVRKPRPRSQGQGCLPEKPAMSPRWCWWPTYISEVQEHDGHLYLGSFRSAFLCRLQAAGCRALQIAGPGKAGMESSHSGSNAWSSEELGDTGVVPVCTMHPVVPEEVGGNGRRHNPEEGPGPRGGAS

SEQ ID NO: 964972 - protein, 170 aa, Homo sapiens
MEYRDTAVTQASGTHKKKPLGRRKKKAAGDTPTQIIKTRRGGTNRVRLGETTPQEGGRRRAHTRRDTKTRSGTHRRRARLTQKIKSPPLGREQQHKHAAHEKRHPQNASEDKKTKGANEHQAGQHEGTGAAELDRQHHLPTDQEARESDAHRTGQQRTAQNNRTPQNTSN

SEQ ID NO: 964973 - protein, 66 aa, Homo sapiens
PRMQTSYLRTAKRAYPSSLALEDGEDLLRVEGDNTYPEAWEIAWLSKDRILVQLEEFAHRSLYIPL

SEQ ID NO: 964974 - protein, 144 aa, Homo sapiens
GGPSCRLHGHFLACAWARFSTELPLNIRCSKEKKWTMKEIKRSAGWVPVKNVKETQLLAKRQHKKADCTGHNWLHSGASVGLMTWEEMHLPQEERSSVKGKPVVFELATNGSSLVRVPGSSAHRECKAEALKEFPSAGVFDTSR

SEQ ID NO: 964975 - protein, 463 aa, Homo sapiens
DCARLGGYGPVPVHEMSNEGSGCGAQGVASVGSSTCGCVPHVPVCQTWDMACGDTCDMSGSPCCHLNPPATSFMYSAHVGMLLCTGVSHVPIACDASDGAWMMLWNDMLQLLLVDVCSMGLYTSDGCDMLCPLWMCCVPLCEHLLHRNVDVLGRCALCLGWCLPVSPLIGHLAVATRGSWVAVTNGCPSDVGELLGYDSIVIDPYNGGFHEPTWGGHEAYGAVEHGNQGNSPCGGMLQRGAHLGGTGWNAMEHKGGKARWLWRRRSLDICTLLPREGRTVDCACQRAKVGQRLKRGTARQSRVAASGKKGPGGKRAPPWWTPFPKKGPHRERPQKGGRGGPSGTGAPVHQHGEQPRRGKLQWEWRHPRAGLLPGCPWCKYTRGCSQGGSSSPKRQLECRCGNELCPQTPQSVFGVEEWVHQSRSAARVVAPWVVMTHRLCNQLRLVGYTFSTMCRPTVDCTQL

SEQ ID NO: 964976 - protein, 212 aa, Homo sapiens
IPALREAKRREDSLSPGVRDLPGQYSETPFSRNKETKKTKRTKTNKKKTQKTTNVGRAAPRRPREEPFKDTTRGGGARGAPKRRERRKVGANAGAPRERTRGAQRHSGGRSLSTTKIKKPPAGERPPRTAVLARRQLPKRGGESKERRKIRGGLYIKPQRGAPQAGTPKEYTKMKKPTDRRGENTVKHAKPNRRRRHQHETNSNRNSHHQQR

SEQ ID NO: 964977 - protein, 517 aa, Homo sapiens
REGARHRPGSVSAGGEPRVPRAWGRAQSRCADPPLRSRAHPLRQGYRLFLIACADQALASVLIARHEPRSLMRWWEPQHQYRQSVDPSSQRRAPKYSTRLNHCRQSNCGPHRKADIERIQGLAGSGPGTKSARSYDQCWPMYLGSKRRPNVLDLTVWIALDYIRSSATFHAVGRHRIRTNSDDFGEQVGANSIEGPDPRNHIRRLLLPHNECPNLPRVADRHGAKEAIWSSTVPTVSRGVIPSLTGWPLWAYCKGFLDGGGQGRAIEGPAGGPDFGCLRKGGFFPHLRKQFCFERDREAPGSVLDLANEGSGPILKAPRLSRPLEGPVTGYHNGPGLGEGHRGTEPWWAHEGSRQGAPGEKRPNPRDGMSPGEDAGGGPGGGHRGRDRAPEKVAGGTETQRLRNHVEKTTGKMMPPRGESHGRERGAKTGPPKDQHVSSRVWGHPTDCCSAGQHAKKNRTPGDVHTMMVDKRRHVSYQHELNTQYGGVVRDQQAESMAVITRTNEGDKHPLLPRLLT

SEQ ID NO: 964978 - protein, 146 aa, Homo sapiens
MGCSVQSSVNEPCSTSVLSFTGNRFKVPVCVDHTPSDVPSVSIISKWSDQAFWTSVCVLSKLGWSYIPKGKYIPCCSSINEIELEAEKSDVMDNWKTHMLQTAWKMDDRKIGRGFICYVARMVYDERVLVNVAALSGIVEYGPASP

SEQ ID NO: 964979 - protein, 120 aa, Homo sapiens
MISAAGGTRVALPRCRTARPFSILHPHSKLATAPDPTPSPSSHHSTLPQQPILLAPLCRSTTLCLSYNPLVPSVWAAFGRASPILWLPFFLYALLVVLASLVCSLTVGRALCAVARSSAA

SEQ ID NO: 964980 - protein, 166 aa, Homo sapiens
CWELEAEELGRSERCDQAPSLVLPLSCRSCLENNFFSLKKERKVVVRPHALSSFSLPPGEEARGGCSAVGAARRAGRRAVPARAPCIPSTPGPHHDRRDRLPPLSFISKFLRTKGLTSERQLQTFSQSLQELVGSNIINITVFPEKPWQGDRVPGVFASTIKSGSS

SEQ ID NO: 964981 - protein, 585 aa, Homo sapiens
RGKIIFYWKPHQRQNLVPGYKALFFSWQLGSFLPVGPMEWLFFLLPWVLGSGPGPNLGGWVVNENLKGTILSHRARRLPVSGRPQDKEIFGGRVWTHPASFLGVPHNTTHKALIQDSENKSVHVVSHLYTPICGDTNRATPTERGACESGSVCVRDNEGVTLSLRGWESDNSGVLCERLTDCVARTSCGDIQRGDSPLGGPKTSLLLTNSLSVRGERTPLQKERREGGKWCVEGPFFLLWRPRESGGVAPQQREEKKGVSPKRKVRKGVVAPEVAPPKNYTEGANPVWKKIMCPDNRGANETRGAPRGGGHNHARRGVGPPAGGTSQKELRPPGLENKQQAGGEEGPLNTKKEGGGWKKIPLLGGARWKETTGGRPQRNTSGRDLLVGTTEATTPQPQKRREKPLTHPGFLGVANSGGPPRDKYQTTGVVTQGATHKRKDPTSHPYKKRSEGEKERGGTTLVETEKPTGRPPPQEDPCGKAGAQIARGTTHRSLTKSDGVTHKELHTDPRSSTDHDEPTHNRHTLACRSPRCDEQNKTGSVGQHEWGGTHREKRAIPGESTEKRKTITRATHSWCEPTRHARRDN

SEQ ID NO: 964982 - protein, 34 aa, Homo sapiens
MRIFRRDHTRMSPINQEWSQGDASDIHYLPPQAP

SEQ ID NO: 964983 - protein, 92 aa, Homo sapiens
VVTEPLRLFLARVLLSAPARMNEEYDVIVLGTGYGMYPVRYNVSEWKKVLHMDRNLYYGGESASITHWKIYTKDLKYQDHTRVNGERKRLEC

SEQ ID NO: 964984 - protein, 133 aa, Homo sapiens
VEHQLRVAQRSVPSTEPPAAGRDAANRDVPAPCVALPWTWFAGGLSPAPACLLLHARLVCAGAALPGVCSLPSRDLQALKQTSLQVWWDIGGHSKTATLGTGAPFAFSGLWGIAPQRAFRGNKNLQKKELHLT

SEQ ID NO: 964985 - protein, 144 aa, Homo sapiens
MLERPLQLTVLATSESQNAWSTPNLVERGPPLKGTDPLMRNPLIPKAVQAVSTNNSPRFNHDFLCRGTRYIPLPFVDPYFPQYEGLFQGNGKIPVDDAPVCDFTPKGPMCPNQNALMGDELPLESLEDFLPTGAGIEKARWAIW

SEQ ID NO: 964986 - protein, 169 aa, Homo sapiens
NWIPSPQEGLIFSFTKSGLGVSWALFGPVCRRRPGRWAAGHSGELAEGLVKFFSSSGDDSSFLLLIERSGRGMCTGSGSDVWCGQFSVLFQQETGSSLSCGGPKGLSVGERRIRVGEAVNILLESGVNTFGAVGEGNLAGDTCGTPHLLAESHREKVPKWTRGANLYRG

SEQ ID NO: 964987 - protein, 255 aa, Homo sapiens
TPVQLGGPGGPGGPGMGNLRWLPAGGFGSGILGPGSAAVDGAWGLRPLELAGGKAQRIKEWMPVTKLGRLVKDMKIKSWRRSILISLPIRESEIIDFFLGASLKDEVGRYMPVHNADPVPGQRTECSRHLVANRGTTMGHEDVGVHVLQMEVGHRTIRWGPIHRRSISHTYPVSRRGITGGEQRIGKPTECSLLAKGDNGPVDGILVRRNAYIPLAPQGGTRASDSGTLCPKKAGSLMGVVIGIDWGNNFKARGA

SEQ ID NO: 964988 - protein, 219 aa, Homo sapiens
CGPRHTLFVHLSAAPRSFRRPPMAAAAVPEIASLVPPAVDSPLMPRICNARPPYYPFRYYAIPCIMRMGFTPCPALCSRDLYFPPVYFRRTVPVSPGCVFVVIVLHCPPLIFTLSHPSRVLHPCLSPLVVSYFAPRANLIFLCPRVISPHVFRFPRLNFPNTFLYNSCTTLLRSESEKISVRCGEFYGPQTKRERQNTKKNFPPPPQFTQSSSYFFRLY

SEQ ID NO: 964989 - protein, 195 aa, Homo sapiens
RRCSGGARGPWWPWDGEPRWLPRRFLAVGILGPGVCWPWTGAWGLMACGGSLECNGRWISEWMPWHQCLGLLVSMDIEDQVPWRRSIYFSLATLRNTEDRLISSLGASIKEMTFWKIMPVKADPVPGQRTRFGAFCWLSGDYNGPRTVVGVKCSKEVATAIRGANHPGQALHRPRAQKATGGNKIGKAPHCPLQW

SEQ ID NO: 964990 - protein, 111 aa, Homo sapiens
MQTAVVRLRRDPAAMRPTGGDSPHHIKTAPGGTPRRVSREQNSPERGAAWEEPHTRGSLLTKPGGSPKRQSPPEIFKIYTPPEPRRRPSYPTPCHTTTHYVALMRSHVHVR

SEQ ID NO: 964991 - protein, 399 aa, Homo sapiens
MWVWVACCSGLRGLAGDYTPYSVRCPQLSSYLLLCLLLTAGPSCQGLCCAQTIVHSPKSRRRHLWRIVGGHLAHVVDVQFDAGTTTNSKCPGKCTWPGSTSTGFGQVGPAEWVSSTVKDLLANAMVHARAEGLAWAMHTVTGTPVVAPNQQFPVGIPETLWVHATHLHWSLADDTILWMTHARSHQKTPRHTLGLPSSLLTASKQFIGTIEWSEPGHILGGLGYSRSGTDPAKPTPIDHSELAKHTLARISNWALGMPGSLGPKDLGTLHSSAHASPFQLHTGSDPTWPHVGWANLPCWFLAGDWTWPLTDRAPLFERGPTALQIAPPCTHSVLTPLAVGVAPTIYPTRIATPHKRGNSARDIIAHKLRILAPPLCVVLIAPRGYDIITMGGQSHMGLT

SEQ ID NO: 964992 - protein, 243 aa, Homo sapiens
GGKGGERKKEKKEGEWRARASAATHTPLKLCSSPCCGASLAAALLAICACSPGGPSAFVTSCWPGPGCGPKAALQGDRWPKVRQGCPTLAFVGRTDVLSFKQNQGDCGAVNNFSLRMIICPFCRFPICCYTGNFGAKRVPKGAIETFGPYLAIFRANGWLSEDKTYWNPSLVLLGPRDPGEKPHGIERTVHCPQALLSRGFKFWAPECRGTRGRDVYHIPRRGTHTRSYFLGAQRENTINLLA

SEQ ID NO: 964993 - protein, 185 aa, Homo sapiens
MATKNKNKKQKQKPVCAARAPPAPLERENVFFNTHTLAVCGARARAPPAIGLQTPAHHLGRASYTRAVPPLTRGDTPGPHKREKSARERGESLHPPTTFKQTHAPEGRASHHPERGVLCGEKTQISSREDGEQFLYESALTSYRWGENLYILSPRGESSSTEPQESPRELIFQDIFDPPPRSPRG

SEQ ID NO: 964994 - protein, 118 aa, Homo sapiens
PDCLELRGRGTNPTMTPHRLVHRAAAVALLLCASPGWRLGRCPGCGQGVQAGVSRVACGGVSEDAGVSQPDGLQLRSLSEARLKDEQGAESAEYIHPSNFASPNLKLPCCHPDPKETD

SEQ ID NO: 964995 - protein, 153 aa, Homo sapiens
SDALGMLFYFIAFLKNRELKSTLFKKPHHWENYKGFWCLELVCGWATPNAIRANWILGIEWLFQEHEWRNVGPNYSVVVHGSGGGGGGVRSQKDAASKNKRGKVKGPRHTTRAHGRGTSYELSWVPAAGSRGGVTSAQGRLWKQWRRCSKGHP

SEQ ID NO: 964996 - protein, 111 aa, Homo sapiens
RCLSPPPPDRKPPLAAALGEAEPPGPVDATDLPKVQIPPPATRPCAQPRVQPAAPLQLMTGCQQSYMSGEGYQSLQSMMKTEGPSLRCPAPRLRPPAHLPTTPMSTRPNPP

SEQ ID NO: 964997 - protein, 78 aa, Homo sapiens
QPIKASILWAIQYIPPELDQVSKMDFLTGISPPQQAHPFKTYFYEALVDCKKSDAASESHGGIAREAYTEDNASQAAS

SEQ ID NO: 964998 - protein, 164 aa, Homo sapiens
LPLRGLAVSFLASLLSRLLAVPLRFVPPPRAFYPRARPCPLLSHRLLLARSSLPLASCHPPAAAIFLLVSFFWPTCLFPLAPSTLTLSPLVTCGVSRSVVLSSSVVLFSFVLFRLQFASVVVVCCGMFSACFFVLLPSCMIVFASDLISLLLVCILLLVCAKPS

SEQ ID NO: 964999 - protein, 72 aa, Homo sapiens
ERVHVRYPLPPQGPIEAREYLVPLTKGSRNHKNPPESEQNTSVVSSVDVVSEWKLRQYIWYDYTWYMGVYDR

SEQ ID NO: 965000 - protein, 128 aa, Homo sapiens
LVFFFVLSVTLLLSVLLSLFCFLVRVLVFFSLFSSCWPPLFFGLLVARLVFFPSSFFSSVVAWSASVLFSLSVSSCLRSSCSPPLWFLFALVSLLLAVSAVLFVSLFRCSWLVRLFSSFLVYRFVVSV

SEQ ID NO: 965001 - protein, 64 aa, Homo sapiens
DPVKPLGLPHIVNGPAPTSQEQEGPHRTCEPRLTVRRESIQQTAEQRLYQRTYTGPEDRLTDAH

SEQ ID NO: 965002 - protein, 30 aa, Homo sapiens
SVSAFNTLWTEQIRGLCCHPSDRPPISLSR

SEQ ID NO: 965003 - protein, 31 aa, Homo sapiens
KPEGARRVQFVMGLFGKTQEKPPKETQWEWS

SEQ ID NO: 965004 - protein, 205 aa, Homo sapiens
VANEFISVTRNAPDYKFFRYYSTTRFYSLSYILLASRFSSRNYISLLWNFCGLIISGRAVIIVFHSGGHNILTLYSKLYVITPLYCVEYTIIGEFCPDIMSPKVHPSISHMLLQPGLLSPMFLLWSILVGITLLWGSRVLEKFVRIFSDYLSSIVRSWVSSKLALIFCVIAWFLLTGINGGTSGFPNKVPLELLLVPAKCAPKSR

SEQ ID NO: 965005 - protein, 117 aa, Homo sapiens
MCAGRMFAWPFVSGLCGFMVIGVYAAGGRPGVVVIGFGVCGQKHNSVVVDGDASVEDCQHRCVCLVCMVFECVNELHGGLSALLVVTGQHAGCEITMMQHMWPLVHAVQGVGSDLYS

SEQ ID NO: 965006 - protein, 166 aa, Homo sapiens
AVGSPPFPLFLCFGSLWSVCLPVLCVCLWCVAAVALVVSLPSCPLLQQFCSRVFSPYVRRFCARAWLFPCCSLSLLFGLSSYFRPLRLRLSVRSLLFCCVVVRIAFCLSSRSVIHLTPLCCHCSLSSVLLSLGMCGPCTVPVWFLSFFHLVLVLPTSACYVLVYSC

SEQ ID NO: 965007 - protein, 99 aa, Homo sapiens
IADCGSAKFTCRYAKRCVRLERKDCVLGSERDELMLRQTTVIGVERGRDTPWRRYRGILLRLSSERKICLYGNVTSACVGRPLLCHESNSKMSDASLLQ

SEQ ID NO: 965008 - protein, 372 aa, Homo sapiens
PPCGHAVIPVSGRLRGGRILEPGVETAGNIARPVQTKKTTTKHNQNCARAARATQKDFQTNPGSAERAPRRDVDTARNTDVPKGNAAEHATEGRRATPKSKPRRGATPRRRETHHQREGPPPDKTQGEYNKKPGSNKSSTPIKHKTPPASKARKKDRQTTQQETNKDKQRKNKQKPTKPEARQRRHSKHSNKLEEQARPSTSTARTEQKRKTETETEANKLERSRGKREDRTRNAAESDAEESKNTRRTSKEERGTDEQQKDEQRSHDRANERHGRKDSDERRARTRQSEKDERRKKGTKDEAEELGSEGGRHRQQDRGKEETGKGEGEHRKHGDDDEERDKRAHIQRMTARRRTGRASRTLDEDDNENHDE

SEQ ID NO: 965009 - protein, 74 aa, Homo sapiens
MFLRSYDSHALFTTGTMTECDVLDCAVDPPWDDATRQWCLHYGLACVASGGASRSLLLDANPATAVAHMCQLRG

SEQ ID NO: 965010 - protein, 115 aa, Homo sapiens
FYFFFSQVKIILLLRVTRKKRHWWFKSNVQNHNRPKGLDSRAQAHEGGDQNRPKVRQQPHIKRVNVGASHTHTHYTLRQGSESVVDERGKFSGWLSLGGIHFINYEGCGRGGNCG

SEQ ID NO: 965011 - protein, 139 aa, Homo sapiens
KRETKKSGAIYYYFLFIGDRVSLGHPGVECAGGVWVFSFTATSPPLPGFKCESRCLSLAEQCGTTGSRHQCRGYTLFFFCVGARGISFLCGHTRGCGRVRRGHQINSSKCGSLRKRGYIASPKSDSVGDSVERARLHPL

SEQ ID NO: 965012 - protein, 343 aa, Homo sapiens
QRRLEDPGRPHESTHQDARGCYQMVTTFSLYHILPVLHKLAHVRRSAQGGEPDCPWLLPPVTPRVCSISGGWLDVRRWMASFVLEELRRQTLPVPPNAILPMDLASMIGHTTRWASEGAKTPPPGTLIDVTENVRSDVLAGSAMSGTGHSGRAKMWREGQAARMKEAGHPEWLGRHGPNWPTHKLAWRDVALHATGQRPGANAKWTADAMEQSPLGDGLARDRKPRMIARTTNLGLKLTLSKEPLSMGHKEEDHWGHFGKPLEQLEKGGTQKVNHRVQGSCSYDALSEENHMDKYGRRVWDKRENIKNPRENQELAERTQRNNPSEDRRPTYTKGGNAKNGTA

SEQ ID NO: 965013 - protein, 133 aa, Homo sapiens
AVGCERPGEIHQESTHQDARDCLQSDDHASPSNTFFRSSQMDHVRRRLKGEPSVPWRCPQCLRRVCIYRGWRLCRGRGWPWFLRLVGARALEFPGSHNGQAYPKALAARDWPINRAGSWHSSTGRSLVTRHQE

SEQ ID NO: 965014 - protein, 56 aa, Homo sapiens
MPSVPAYIARVKARRSIFEKIQAKRERLSAVKTCELHMMSKSPKPGQGKQIPPKRI

SEQ ID NO: 965015 - protein, 94 aa, Homo sapiens
MIRKIVGPRVGAFGEHVRDINLVRRRACQSGLQDHWFPTRASKRETGVATHGVGVPNPRKKPPRGTTDGLRTTQRDAGAYRVLAREASEAGKMS

SEQ ID NO: 965016 - protein, 206 aa, Homo sapiens
LEVGTFIITSPKSVKLLAHGPTASKLACVPGVLTLRFGSDVQEPPPFTFPGGVCEGAQEQKGGHMCKRSPRHVCRVSCGRKLRGAGGCQEASTGCCSLWPVGAVVKRSRNVLEVAGVQVRKTWAQPVEERGLQVLKGRSVKRRVSHTKGTVIIRRAYVEVSYSVAKPRKTRVAPRENSVGPPGRHRRSQCVVLPKVTSGSTTLLLV

SEQ ID NO: 965017 - protein, 437 aa, Homo sapiens
AAAGGGEGGAGPQRWGYRQPEGPSSVSPPAAWHRVLNPLQPSSPTCPAGRPDRLAGTSRTANPGHWPRFGTPAPAPRNRADRSATTAREATHGTDSTALEPIARLNRRRPSPGPSAPRGTHLRANPQPHATGGLRQRGTPPSATATTPPLGPGDPPHGAPPRQPQRIIPHLRGPLGPPHVAATGPPPEPAYPPRTHTHTKDHTPQRGSTTPTRTTLNATGPNARPPRPSHAMAASPSTHPAHAPPMAPPPTPATTRARAQARAPPPPPPPPTRAPLVPPPVGPHPARRAHPPPPLPPLPPPRRSVPPHTPAPGRPPPSPSRRPPPPPPLPSDSPLPTPAVLPGAPLAPAPPTPPPAAPRPPHPAHAPPCPPPRVCTRLRPRAPPASSPPPPAAPAPAPFSPHPPPSPLSAAPTCLQPPLSGHPPHTTCAFSHASLPT

SEQ ID NO: 965018 - protein, 156 aa, Homo sapiens
MPVQRGGPVSALVALGWGTCGGFPGGFGSGILVAVGRWPVDGGLGPDGLLDASLDVQWPEDKEWMPVTNVGACLCQMDIERSSPWMEIYLFSLPINGITRSFDFFLVEASLKDDGFERLCHVHECMTLCLCQLHQVFTGNLLAIRGLQMAHCQDLR

SEQ ID NO: 965019 - protein, 222 aa, Homo sapiens
MSVGIDWAPSGVPRGREISRLRRCVRDRGRRHTPVIREERAAISRADVESTPEGRGETKWPISPDGEQTKKVVSKGEVQSPTQVVAPLVGVRGGAPQSFLGEMLWGWGPTSLWIGAQCWLEHPTGGAYNGGKKVFAKGGLWGPLWVQTSTLLRPHGPTRGLAGGGCCISSPEGPRLAAAPLSPGGPLWDIPSRKCAPVAKPPASSVCKAGLTSPSVGALPTY

SEQ ID NO: 965020 - protein, 335 aa, Homo sapiens
PRGPQILWGGGKKNGGGGVLLSPPPPPKKTTPTERGTKPPAQTSGGGPTRDKVCGDKKIGVGNSTSGPPSTQTRRRGGGTLRLVTRRIRLCTENAAVSHQQKEPQDNTKSPRNNTPAAEGGSSTKSARVASRARVGSMTHPEESWDNKYELATALEVERRGGVSPERESEYLLRASTGESAMEVRHHYTHTARPPTRREMSGRAARRKRQRKPPRGSRRPRRERGDSPTRAVERATRPHDREKNKNTSLATRAGEVRNDPRRMQKAHPARTGRACAPPESRTSHTVGRRDASQCTHPQETLCRYNTTVAPPPRVVTIHTTSEQQVDDRPPHVGVP

SEQ ID NO: 965021 - protein, 530 aa, Homo sapiens
QVTAHYTKAACEKPHRKIPRARVYPHGRPNTASSTVQAGTKATTKYTNGLNPPQGNTTRVHTTHYTSQQRHPPSGLTPIEHRKANSPRRKMPQAPRDTNNRGIMRPQERTKRVIPTTNNPHHKGHTHTNIPHGPPLSIPPAPATTPPAHHINNTHHTDAGPHSAPPQPSAPQGRPTVKQSTDESTSRPPLDTTSQQGAHPREEHPLRKETTTHSNQEQPTTTHIIRADASCTTSTHNTEKHQHTRENEVESEHTNYVDHHMRRYTQRGARRKRRKTHGQSAATKCEKQHPPNKQPTELQPPNGRTNHTLRWSSTITTEAKHTHRKPHTKSRDAFRHQHRSHTSLVKLSHHTDTNRSKHNHQHQERRPPECTHAPATASQPHNTKHTTRGGLRLSTTLNKQTTNNNTTTRRSTSSHASGARPEPPTLDTTTTAHTYATQHHTRLPPHPPPAQYTRQTTHRATPNNRRHHQPTHPQPILPTDNHPRDTTPGTADTDYRQCATAQREQRRHDPRNDTEPKLQHKQTREIKTKT

SEQ ID NO: 965022 - protein, 414 aa, Homo sapiens
FIPVTFVLHGRGTLVATRWSWWAGFDPSDLVQLDVCSLAAAVACVSDPILPGQCESPYPPQDSLPQPSERTGRFTVDSEGAVQWDECTITTIPCMMGARDCGVHVKTVMQMFDSSFFECVRCLEGTLLTTVSLGVWSTCVALISNVHGDIDCNDVRKVDWMMSLVGAVPTAGHLCPMSNQIGECLGNAPIVSPSVVQLKHCWDPIVARGWNSHVNQTVGGPAQGLDQTRTKRHVRKSLQVSYVTPWATKRAPLAFLSQLRFTLPWALSARDALRTVRLGKHRWRNEQGQVASGGQLGQLTRQINQDDGAEQRANSGKCVGPHGGSNFACKIPELLWLGDISAMLIRPCPKEGNLDVATGSWVPGRIGAQYVDGLPTLVMAINLFTPHVGHGIVTDDTAIPIAIPRAIGLRPEIG

SEQ ID NO: 965023 - protein, 45 aa, Homo sapiens
KTNHNLKPKTTNAQTKHKYSTTPNDVIQACLERTTSASEVVSEEA

SEQ ID NO: 965024 - protein, 307 aa, Homo sapiens
QHVTYAVYERQIPPISASSSNTTVVAIIAFRRYCGSTAQIISTIRLIRPNAAKSIVRPSISEKLKEIRFFLFQLHHRQPQTCLYHFNHDRNNSLPDAQNAFTGPLCVMSVRHNSTTRQQNAEHYTDCSANAHARPRIFAHILIGTRRRDTGLFGNGITGFTQAITALFQCLLRFATNLTQLFFDFSPDELSTSSSVSERDFNSARRCSVVCSFDIVFSRVSKVRDYLLRFSTVRRLPACFQASFLRLLAKVSRFRVLGTLYPAFALFCFRLGLNLGWGSRHLIFRLCDFFWMIRPQWLLTGGRIPQG

SEQ ID NO: 965025 - protein, 179 aa, Homo sapiens
MESEVDSRLVSHQDGKWQVSHGRSKATIISVKPTGHYWYSSEPLDEPTARLIATVPVNYRTWRLDDLIDFLFCDPAGGVRPDIFDQYRRVYHSRIPRTFVTGEWAKKLAYETGVPNIRSLVQGRPVEAIYREEGEPGDILNFRQNPIKGSGCYSIHSGGTGQYGNDMDAHLSMKGHYSR

SEQ ID NO: 965026 - protein, 150 aa, Homo sapiens
IGCPSTPAVLYGHRYDGGLCWAKEDRIIATDGNNNAGGDLRVVTLTAMAAQHRPFGFARIHFMPAVTTVFMRSVKLRQLYASSGQLKQPNIEINDLTYRPHIVTPLLLYYTKQVPPAIRRFVVRADPQDRNLPLRHMAILPSATIIFVHG

SEQ ID NO: 965027 - protein, 208 aa, Homo sapiens
MVLATLLGLPGWAPIGSCLPCQYSYGNFRLCEAAGINPGGSGLGPLLFPAGRCCWPGWAGLNLFQVLPSCPAQFTSAGSTVQLDGDLVFYNSVGKLALSPWAAIIPRTHVGLKVSVGVEGPQGFPSQWLHLAAGLLKGGGKGQARRAGSILGRLGGLVPRLSSHQCSQLAVAQSLLLVQPRGAGAMPCCCCDQGVLWVLPNAVVGRCA

SEQ ID NO: 965028 - protein, 155 aa, Homo sapiens
MYTCAMLVRKAIYRFNAIPIKLPMTFFTELEKTTLKFIWNQKRVRIAKAILSQKNKSLEASHLPDFKLYYKATVTKRAWYWYQNRDIDQWNRTEPSEITLHIYNYLIFDKAEKNKQWGKDSLFNKWCWENWLAICRKLKLDPFLTHYTRNQFKMD

SEQ ID NO: 965029 - protein, 262 aa, Homo sapiens
MKINYPLLALAIGAFGIGTTEFSPMGLLPVIARGVDVSIPAAGMLISAYAVGVMVGAPLMTLLLSHRARRSALIFLMAIFTLGNVLSAIAPDYMTLMLSRILTSLNHGAFFGLGSVVAASVVPKHKQASAVATMFMGLTLANIGGVPAATWLGETIGWRMSFLATAGLGVISWLSLFFLITYRLVARGHDPGSETKEPGGINSVRRVAWFCIADDGSWEPGAIGYSSTPIISPGSASIYPRITGFRPGMLVLIGVGILSELF

SEQ ID NO: 965030 - protein, 185 aa, Homo sapiens
MSHKAETSIPSQDNGQDREYCMGYGGEPQWDSPDGEGPIENDAPRSEGTPDTPNDRQLGTTQYKTNRHNGIIDRDNIGPLTPPRALRNALSKSPYGMANTVIPPAQKRVTPPQVRDSDRRKHMAQYEQYLRAPALESPVAIGPRTYQYDAIQANTTHLADTDHRAIPLAISHRCHKHGGPPGVRH

SEQ ID NO: 965031 - protein, 273 aa, Homo sapiens
MNWQSLPVHRLLPRPNKFEALATCDSPGFSAHGVVERVGCVTDENLPMMSACAGPPGPALRELVKSQSRKMSRAAQSCRGKVNPTQCEALTMLCCQVMGNDVAINTGGRFLDNFELNVFRPMVIHNFLQSVRLLGAWHGTVLNKALPPVGIEPNRERINQLLNEIADAGDCVLTPTLVNDKAAEDLPNKSAIKTGLTFKAAGLPLGYLSEAEFDSWVRPRPDGRQYDSRAVNLARYGCRPRTGPTEAAALRVIAGWLTLAGSDFAVHKVRAPG

SEQ ID NO: 965032 - protein, 176 aa, Homo sapiens
LVFTQGGELQLAQISAHLQASVSVGFTPFSVPQPLKLAGTTGTRHYAPANFFILFIFLEKCESLWSLCVSPRGVESVQGGGELCVCSHTWKPLPPSWVFHTAIFLRVLPHAPSQNIHSGAHIYVRAPRHTHTPARGIYICVCSFFIVHTKHEGVFSPHTVCITTQDIVSLCRYISL

SEQ ID NO: 965033 - protein, 123 aa, Homo sapiens
CQCRGVAILAHLQPSTFPGFKRFSCAPASRVAGTTSTRHHTRLTPVFFLVKNGAFATPARLWSLSNLPTSQADLVPVPLGLSQECAEIHRHLATVALLGLLIFCDFHTNKPVCHVQRFVALSI

SEQ ID NO: 965034 - protein, 130 aa, Homo sapiens
KLTSQCLQAEQEALAGEGPQETDNHGKRQRGTRHFWPVFGAGKTERFEGGRACTLLNNQNSHKRLTQLFYEKQQGGSSAPIKPNSPSHQVPSQQTLWEFTICDHCKFVGVCGYTKVCKPVFKGYKFQPGL

SEQ ID NO: 965035 - protein, 317 aa, Homo sapiens
NWAALKNEGLDFSHTQQLPGTDYTIAGMVASQCGIPLFAPFEGNASASVSSFFPQNICLGDILKNSGYQNYFVQGANLRFAGKDVFLKSHGFDHLYGSEELKSVVADPHYRNDWGFYDDTVLDEAWKKFEELSRSGQRFSLFTLTVDTHHPDGFISRTCNRKKYDFDGKPNQSFSAVSCSQENIATFINKIKASPWFKDTVIVSLLTISDEQHGVENTSISRIRKYTWFFGHFRGDKAAAKRRLAGESCNHDGNNRRRRCSGHSPGGNNYLSDLVVTTVSPGKSMSGIFLHIQEQNLWVGAIFFRLWEIPSKIRVSL

SEQ ID NO: 965036 - protein, 135 aa, Homo sapiens
MDANTYDPLFSYPFPSLFPSTPALCPEVPSLPAVSACVHMSSTLRPRCRGPFLGVLDLGPGSKSAWSHPTGVHLRILRTWGGPRAHALQNLGFALGALVWWAPWGQFVGHRYPGLDPLFSLCGFEGLCPPFLNEL

SEQ ID NO: 965037 - protein, 259 aa, Homo sapiens
MLRGELVCEGANLPSTHYRGVSSPLCVTLFKEADSPTKVCPNFLWGYIEYRVFEPCVVPGQKGGVSRKKKPKKKRARAPKVFEGKTQFPLFRGAQRLSGARKFPQDPQGGRNEYSRYLAGDPPPIFKAEGSDISKFARIKAAGFNPVRIYEGSRRETNTERKTRRQRKKDDEKTQKEDEQQKKQKAKGEKHKQKKNQKKKERHREKKSEQKQRQKEKTQRNTKGERKEAAGRKKKDANNKCSQKEKQREANKDQHNKQQ

SEQ ID NO: 965038 - protein, 91 aa, Homo sapiens
TVGCSTLQARHVALEQSVYHNLKNVITGEIWERCHQCGVMKAGIAPTHPGRINEGLELAEDVLYEEMLATLDNGGHTAWIVAGLRGILLAV

SEQ ID NO: 965039 - protein, 65 aa, Homo sapiens
IEPSLSTSMLDQDIPTCSRYVQVRLVPPDLRSYVTEYRPEYSRSVSIYFKFLPVREDQRNMAYFT

SEQ ID NO: 965040 - protein, 64 aa, Homo sapiens
NSNKLHLLRHTDLRIAHCILFNQPHSPRSTSHSHPNPHKLHRRSRPHSHPRRYVHVMILASRLR

SEQ ID NO: 965041 - protein, 50 aa, Homo sapiens
YDLECRPLQLRQKYEDKMYSAWGTVTHMSIKNFSVYSCPEFLSPVVPHYD

SEQ ID NO: 965042 - protein, 46 aa, Homo sapiens
RAHTLSMTTLAVGYLPNYLICRAVCWQISLAMRLLETFWGSFLVVR

SEQ ID NO: 965043 - protein, 32 aa, Homo sapiens
AFKLNTHYLKNPKRITELLTPNWYNLFHFGSV

SEQ ID NO: 965044 - protein, 72 aa, Homo sapiens
KTEHQVRGGLFLDVVILQGASMLQLFPIKDQPMLVRRNAFLILDLCLDILNVVSLGSTSKVMVLPVTVFTKI

SEQ ID NO: 965045 - protein, 87 aa, Homo sapiens
VGNGVAAPCLLVWLAVVAESSAGGLVDLLRGSEMTLTYLDLYHNGTHLTGGHAVLTCTDCQVGNPLPPVGGGRWQHLTAPACVYHIQ

SEQ ID NO: 965046 - protein, 123 aa, Homo sapiens
GEWSVAEQLASFAAEMEQQNQDYTILLDVKARLEQEIATYRRLLEGEDAHLTQYKKEPGDHPSGAYHCGLSVQDGKVISSLLMQCPPDHPLRTQLPLCLATQGGSGVHACPICPKVSVLSSRY

SEQ ID NO: 965047 - protein, 60 aa, Homo sapiens
GDLEVPVATAGEHCLQLWETQHCQLEISEQPCYVVHTSFAFHVSELLTCLQHDVDSVPEL

SEQ ID NO: 965048 - protein, 107 aa, Homo sapiens
GYLLDAENCYCVQLSQIQCADWQLWRSSWPSFAARWSSKTQEYKILLDVKMLGGAVRLPPTCLPAGGRGCPPDSVQERTGAHPVRCVPLWTRVQDGTVISSLRAVST

SEQ ID NO: 965049 - protein, 78 aa, Homo sapiens
AHGIRTLVAARLWLHSNPSVSAALVKIALSIRIPPPSLDLDSVSYTATEGMKVELQLGCPDVDGTRWVSSFFSRGRRR

SEQ ID NO: 965050 - protein, 79 aa, Homo sapiens
TCVQIRADWSVEEQLASFAAEMEQQNQEYKILLDVKTRLEQEIASYCYLLEGEDAHLTQYTKEPVTTLSGAYHLWTEVQ

SEQ ID NO: 965051 - protein, 46 aa, Homo sapiens
SPSSSLTRLLSGGVPGCPKTPGLPLPNLEEEAAPSGLQAGLPRTCM

SEQ ID NO: 965052 - protein, 36 aa, Homo sapiens
LRTYLSAWGSGVEVLVSVLVALAMDSTDWCLPAEIW

SEQ ID NO: 965053 - protein, 117 aa, Homo sapiens
MIWTPCSVNDLRGPPAISPHPAERVDPWLSLEKQPWFHGPLNRLDAESLLSLCKEGSYLVRLSETSPQDCSLSLRSSQGFLHLKFARTRENQCGAGPTQRALPQRARARPPLQFTPT

SEQ ID NO: 965054 - protein, 123 aa, Homo sapiens
DPRSIVHSGKGSMCVLNSEPVSGVLLSQSGKEEGRGSCERVMRLREVGYLAALTLGRVLHRSIKVDWHIWAPFTGHNDVSLLRAGPVCTVGVPGAVCQAAVCDVHAGVALVAVALPVLAGDLF

SEQ ID NO: 965055 - protein, 62 aa, Homo sapiens
YFTGRMTQYHFPGSTWHALEYCQRFQLPLLLKHSYEIFSPPNAGAYTLSPTGTISYEGIKII

SEQ ID NO: 965056 - protein, 65 aa, Homo sapiens
MRSKCSRVTTFLFPVQVITTSTCRDDFIELYHPEPIHAGLQSTDGVDFGTVDYCSKSFESSTAAL

SEQ ID NO: 965057 - protein, 64 aa, Homo sapiens
IQGLVRAAQRLQVARQGLQLAPVVVGFVLGLAEQLRACGPQRLSGLHPLERHPSSASCMLLDAI

SEQ ID NO: 965058 - protein, 76 aa, Homo sapiens
PRVSNKLFSVCPNRFPRRPKNPPPNTNYLYSYPSTIMASQRHLSSEPLSLKKTLALVLIVPTTSPVIVTIHEYSKR

SEQ ID NO: 965059 - protein, 41 aa, Homo sapiens
MIELVPEAGGPIPAGKTLSNLISCKYMSPVSSGLIWVPHTS

SEQ ID NO: 965060 - protein, 39 aa, Homo sapiens
SHGKKVRVYARLTTDYVKLDFGVTFGLWCSLRIGEISEE

SEQ ID NO: 965061 - protein, 49 aa, Homo sapiens
MGYNLLWARPTQAPGWATSCLTDHLTDDERTDEANALQARSLDLLLANG

SEQ ID NO: 965062 - protein, 122 aa, Homo sapiens
SVSPVQVVSDFEQRLRGNSGVEIYMRRCNICEVSWDLERRRVSGDVRERDLLRFTVDVPDRDLLRVTGDVLDIDLMRVIGEVLLRDRLLVTGGVLDLDLLRVTGGVLERERRRVVGVLDLER

SEQ ID NO: 965063 - protein, 38 aa, Homo sapiens
MPMIFPIRLHNSSDPVPYKRRRRACLITSPSLILAKSR

SEQ ID NO: 965064 - protein, 37 aa, Homo sapiens
YSQANLDQTYAAISFTIIFIGVNLTFFPQHFLGPIRA

SEQ ID NO: 965065 - protein, 43 aa, Homo sapiens
FALSLHLTLHYCMAQQDFTCYIMHRNGIKQPPRESPAQFAIRI

SEQ ID NO: 965066 - protein, 75 aa, Homo sapiens
QRDLRTKRTIVESSTVRTINLREIRVAFFPAASCLEMAGEGSRKGAHCDPTIGSRFRVLITGWEGTVASLRGAHG

SEQ ID NO: 965067 - protein, 92 aa, Homo sapiens
RQRIRNFGPCCPLYVKPKEIYNDSGEFSEQCCKTPSSDLANMGISGFSSTLKAIHDDQVFLPFLGRARTAQAQKDARFGEAEPKRDSGSKLR

SEQ ID NO: 965068 - protein, 122 aa, Homo sapiens
MNIGGAITEKAYQCKECGKAFSASNGLTRHRRIQTGENPSECKVCGKAFLLSSCLVQASEGYTRGEKRYQCRECGKAFIQNAGFFPASPSPHWLKNPISAVSAVNSLVSGHFLRHIRKTSVK

SEQ ID NO: 965069 - protein, 76 aa, Homo sapiens
SPHRRARKAQGHAWVGSGGSERSQICSKATEQLQKKLSAPESLLLLMSPSMAFRVHSRNGKSYTFLISSDYERPVW

SEQ ID NO: 965070 - protein, 46 aa, Homo sapiens
QISIVPDVPGFLLSRSKLDTMFLTTVKQELRTSVRTPPPLTTAMGI

SEQ ID NO: 965071 - protein, 37 aa, Homo sapiens
GADTLIEVIPDYDEDLVQEASSEDVLGVHMVDKDTER

SEQ ID NO: 965072 - protein, 51 aa, Homo sapiens
RNHSKGVTSAIRDLQLRRGSSGHQVRIRLRILSLKYVALMSESRTLTANAV

SEQ ID NO: 965073 - protein, 43 aa, Homo sapiens
GNRECKLKCMDISDYHVVPGLEQGRLSTRLKAFNHSAPRADTD

SEQ ID NO: 965074 - protein, 38 aa, Homo sapiens
MSESNEDDGEDTLGEEVGYAIRFEDCTSENTLIKYMTT

SEQ ID NO: 965075 - protein, 45 aa, Homo sapiens
KTQTRIHSGEKPYKCETCGARFVHVWPPPMPSVLYPPLGRDSRYP

SEQ ID NO: 965076 - protein, 34 aa, Homo sapiens
TLVGSPNGSRKIEVELQCPPLGMASSFSEGRIIR

SEQ ID NO: 965077 - protein, 77 aa, Homo sapiens
ERVAPVIGSRPRVNPDVHQPPSGPHASPPVARLYGSMVWRELAALVIDHADTPSRQNGVRQVLPLHGRHEGSNLYHI

SEQ ID NO: 965078 - protein, 43 aa, Homo sapiens
MSAHMMLIGTCCTAVHTSSSGTHVNTATDRLGGFVDRREELQP

SEQ ID NO: 965079 - protein, 37 aa, Homo sapiens
YPADVLLFKEILAFYSQEVRDRFQMKLSWLRMTTCFW

SEQ ID NO: 965080 - protein, 48 aa, Homo sapiens
TYTVCGGSSTNPSRSLKVDQDILLAAKVLPVEDAQDFPPLLEQLNEQF

SEQ ID NO: 965081 - protein, 67 aa, Homo sapiens
MLRLYCMRLYCMRLYCSRLYYSGPFASSVIMYHLCIKTPSPSCMFILETPLLMALALAEAASSYKIA

SEQ ID NO: 965082 - protein, 115 aa, Homo sapiens
MRLLLKNTKLRCLISVPRVAASTAKENKHSPVRQQVAPTDDETGKELVLALYDYQEKSPREVTMKKGDILTLLNSTNKDWWKVEVNDRQGFVPAAYVKKLDPAQSASRENLLEEQ

SEQ ID NO: 965083 - protein, 40 aa, Homo sapiens
MVGTCGPSPTHRLIYTHRDLRLINILLLSLTAQDLMWSLM

SEQ ID NO: 965084 - protein, 103 aa, Homo sapiens
MRSYDMRHPYRCSSPGSFCGEDLRFHSSAMPSRMHSLQRSPRCCTQHGGQGCPVALWLQLAGSLIDHALVSPRLSLSLPPLGPMQRSTTHRFELSPGGQRGRD

SEQ ID NO: 965085 - protein, 65 aa, Homo sapiens
TTPDKAEGSEYQVLYIADDNEIRSLFPGHPHSAYEQAFQLVTRSVRIVCYRMSVQGWPVSIWTTL

SEQ ID NO: 965086 - protein, 104 aa, Homo sapiens
VELLPSVAKREMSKQLMNTCPNIWYRRSFEHQLNLIPSLFIANGARSSYERNLVTRCTLPRNCQTILQKYQPLMPYSLWCQRSFSCIIKQLVYQEVSGTKSMTK

SEQ ID NO: 965087 - protein, 43 aa, Homo sapiens
NYKSYKYYDTVGVKVCLTYDVFRDPSPFLNSKVEELKGGAREE

SEQ ID NO: 965088 - protein, 62 aa, Homo sapiens
ESLKAMIAWEWTIEKGGVCEEDKTDKKKTRKISHSAQTYDPREGYNLQPPDLRAVTLFRELQ

SEQ ID NO: 965089 - protein, 79 aa, Homo sapiens
VIVESPVNDGFCSLLRWQREGREGRVHTERRQEHVGRGSRAGSHPVHVQLLNVGEGRLSGGVPAHLASDVLEYAGGPSF

SEQ ID NO: 965090 - protein, 50 aa, Homo sapiens
ASITHRYQIWTTVVDWIHPDLTIVIDILWTTTLYFSMRNYNAGTYQNDIA

SEQ ID NO: 965091 - protein, 34 aa, Homo sapiens
RASVCCILRSEASRSFCPWHRVQRGSSGSCNAGD

SEQ ID NO: 965092 - protein, 42 aa, Homo sapiens
TYCPVFTGRGTYSNRGNYNQRWNAQQGGTTTRTSEDEETILA

SEQ ID NO: 965093 - protein, 44 aa, Homo sapiens
MGAGHDISPGRFPEALDELRCPPFLQPLDLTGKGWPGGTYALDF

SEQ ID NO: 965094 - protein, 76 aa, Homo sapiens
MIFVGAVDHRLPALLVYHSSQLHLLAVHLNVRNIVLKDSRDVDLRNTDPCSKTTEECRSYPHGTIPQTITSLLFVI

SEQ ID NO: 965095 - protein, 70 aa, Homo sapiens
VTPDFICRRHLPCLFTEETLIQIRKQILFSFEEGGNSDHAGTLLNRPHRKGEKVGFMSRLEAFGTTNLRS

SEQ ID NO: 965096 - protein, 60 aa, Homo sapiens
EAPPRFTVIKQSGVDATFQGPATGSCLVRSWNLVRHNCWDSTWLRNAQDAKGGRIIGGLM

SEQ ID NO: 965097 - protein, 40 aa, Homo sapiens
NICTAALCRVGHEDVMDLAGHLTNYELVCVWVYDALNSVI

SEQ ID NO: 965098 - protein, 137 aa, Homo sapiens
DISIPEAYPICSVTFGEDPGTDERCCDLVVSLRIGHNFGTTPRSSWFLLPLLRSLELFRRLQKIFNSAQTGSFKQLTVKEAVLNGLVGTEVYNVVLCRRDYRQAGPSLAMMFEDQSLTSDYIDLLFECCRTMCDQTA

SEQ ID NO: 965099 - protein, 99 aa, Homo sapiens
GLTGGFALYEPSPMMMGLTEKHRAFTHFLTGVRTIIGSMYTETALIDTLIYQLSTSHTEKNRSRQDIVATLGATSDYCISLACSCTAAYATLHLLGQPQ

SEQ ID NO: 965100 - protein, 52 aa, Homo sapiens
MSISGQCLPLSVFHGTNNSIPRIPFTHTFKGRGLSSKYYSLSVPSYGHTMQV

SEQ ID NO: 965101 - protein, 83 aa, Homo sapiens
MPLSCFLWCNWTYRTSALRRSSVHATAVLTPTRELCTDPAEREFSAAARREQSHLYMEGLGGTLDKYCDREYAVKTHHLCWRG

SEQ ID NO: 965102 - protein, 33 aa, Homo sapiens
MQPITRYYQSILIINNHNGYSNNNLANYAPTCL

SEQ ID NO: 965103 - protein, 76 aa, Homo sapiens
MKKNRENTREQQNNTNTTKTKETELVQAAAAGGAAPGGARPPPARRDEGRRAPSPSPTQTHPTLPAVMRRARPGGH

SEQ ID NO: 965104 - protein, 245 aa, Homo sapiens
DVVCYNDVLDLVVSYLLCVRDEQCEPCVVANETVADVVVVLLQELNVDDVYLVAILWLCRVPSVVLLVNPFLSWLEPFGDATGDIQWPSPESLPACLPPDTTLPLPVILMSGRDAAGTDVVIIADGTASMPCDAGCDAHASSTIVRDYPLAVLTSQGVSEPLETECTVQMGELNLEVHPGATVSFHNSNVADRADSNSARIVQPALGPPRDNERSPQRCNSTLTSFWRNFHTAHYTLPRTINLGP

SEQ ID NO: 965105 - protein, 111 aa, Homo sapiens
QRQLQPLAAHSASPSLGDGNNSSKDDLPLHEAAGNSLFSYFHARWLVMFDVDSTVISEEGNRDAFFTRGNFRGKRHHWLNSSANHKFNATNCLNGYYHWNLGKRLLGEQPG

SEQ ID NO: 965106 - protein, 79 aa, Homo sapiens
MSDVPLREDVLEQIGEILLFGGSSQAVMLTQAKRLSYKAGEVPKFTPRYVFGKKGSAPPRENGGFPLGVSKKIFPRANK

SEQ ID NO: 965107 - protein, 183 aa, Homo sapiens
SLESKILRATCITPHPIKKKQKKRTKQHTRVWGGACRAPGREEAFREKPHMRVRGRARGRTQRERDIRAMKHEGTHSAVMSPKERETRGGAQRAKRRGAEEIFSPRPNRQQKKSAHAGGRQKHHEKRALWQKHKISPAKRETRYHGESHTNQRGTSSIHKERGETTKDAGRTPAKHITHTSRP

SEQ ID NO: 965108 - protein, 242 aa, Homo sapiens
DFKYTDTLLLVKFKHVLPAEILSQITCNNLQMPYPFEHFLFSMSYTFNTCSAGIFATTCPILLNNMCPLIILSVTCQLSATHGFRRKPRSIYQSRIPVTLGFQRHAQTSNQCQLHETLATHTQHNTHTHHTHTHTPTPFFVAAAPRAAPAKNPSPKHTQPRAYASAPRGPPPTTHYPLHNPPAQPSTLPTTQKTPCGTPSTKRAPATQLPPHPTYNPPRAVHHSPPPLTKHPTHGLTPPTTM

SEQ ID NO: 965109 - protein, 129 aa, Homo sapiens
MGIILTVTSRALITITSRDSIGPITSSLYDLCLLKPMDRLTCVPNHNKQADRSLEKFKGMRDPSAQSMALKGVTFNGPSISRMLNDDSSVAKGPTEVLNEQRKPLESITVWDNRRLIPRLLSHVTQEGP

SEQ ID NO: 965110 - protein, 49 aa, Homo sapiens
MRRRKRHQSRKESSEREKRRRERRGTRGEEREEWGGSATETKTDDAQTT

SEQ ID NO: 965111 - protein, 96 aa, Homo sapiens
CDHLEEYYPAVGFLATVQSVGVAVLPETVVNESIGMSEKAADKMESNMRAEEEAFASLSNFFSSRICLQCSPCVLRVYLAYCTIVTMRQFQHRWAM

SEQ ID NO: 965112 - protein, 160 aa, Homo sapiens
MGAHPLDTRLSHRVGLYSLLSLVPRVVFNHGLPPIINYCSAEMISPVACCAAGHKEKDELFLAQLVAHPLHWGGPCSLLFSATMSAPVRGLHYTVNSPGVPASPSSGEWMVVPYTSISSCYPHCPLVVWYPSSQEMHRHRVSGAMFLCTTPGHLLLGGPQ

SEQ ID NO: 965113 - protein, 82 aa, Homo sapiens
EHGHKNHQQSAGGLNSTVHQEDNVLWSSVIYPKMRGWFSTCKSINVMTSVEEGRDFMIVSIDAEDVDRFWYPFMMKKKLSAD

SEQ ID NO: 965114 - protein, 106 aa, Homo sapiens
MSHHTHKIKMIGDINIGPEIMKLLEETTGEMFQDMGQGKDFVAKISKTKMDRWDYIELKGFCKTGETVSGVRRQSVERENMCRLFIRQGTSVESIQGIQQQKENPF

SEQ ID NO: 965115 - protein, 70 aa, Homo sapiens
FLERHNLPGSVAGIRNPSYLGALSTDESAGNPGAPRFTEPILCPGNSTWAHEWNSIVHNNYIYKSNGKLI

SEQ ID NO: 965116 - protein, 116 aa, Homo sapiens
MCGFRGCLFLVVFRCARPFSYVSPRGSWVPTCTLRFPGTACRIAYPELSEMSGSASQCLTDPRSFPPAAPIAALRHFFTAPRLPQAPPPLQRRAATRRRRLSLVAAMTTASTSQCA

SEQ ID NO: 965117 - protein, 35 aa, Homo sapiens
GRARHSLVVSFSPPLRPSFLSFRPVDVPRYPLFYP

SEQ ID NO: 965118 - protein, 118 aa, Homo sapiens
MRPCNSLFIEMVRQYLWLSIVLSFVEINMSHTPRPPPRAAYIERKMVSPHNIGVFFARPLRHQFMVAHHAPSLLYCGILYQQYKRFLYGAHRVQFPRVHARGASSKKSAHNNRYTANY

SEQ ID NO: 965119 - protein, 36 aa, Homo sapiens
MRSNHQAADSVSGSHGVEGTVASCVGQWVRHISPGH

SEQ ID NO: 965120 - protein, 99 aa, Homo sapiens
EDEWPGLSVTNEEIFGSDADSEEMPDSIMRTEDRPKCWLVTNDSDSGQHMGVASRYPGACECAAASPFPSVDRSLGPGRIGQVIACKPSDFHVKADSDT

SEQ ID NO: 965121 - protein, 110 aa, Homo sapiens
MWKLLSWAEMRTRIYVERNVETPYKWHCENAPVGTPVCGLPQIYVLRAPGKYAPVPRILCVSGREISRNVISLRGSFVRRGVYTITEDPHDKYVCRYTNHHVCLCRYIYM

SEQ ID NO: 965122 - protein, 272 aa, Homo sapiens
MLCTKKCVGRPGVLCAHTSSVGRIPPSAPPGKSSNEKTKGGVCCTTGAEKHSDVGGHMGAGITFSSFITTPLLFLRQGTLLVLRGCGEATISVVAGCCTPTGGQDNRVLGATLSPILFPRGGFPRSSSFSPPEGEGRRVMEGEEEKSQAPYSPQVGAAGKTQRVSSNDGGHSYSSNFKTVFPQRGERQALFCAAPQGCCNHSGVGSFPKPECWAPTTRVSGWGVGVWSAQLCLFVLGGLTHRRRGANSGGLWQQGPFGVFLGAPLLRRRGCL

SEQ ID NO: 965123 - protein, 337 aa, Homo sapiens
PAHMAENPLHGPGELAIINSVYPVEDSTLHLGCCRDCDDDRLWMCPPCCLCEPWPSGYAVHSALCEAAYPGTLRPLLSAWQMSSSHAAQGLLRTPYAIKEEGTSWSVVAQLQPLIFPACCINQTMSSPIGGSTQPTTNNKKEQHQNTPFCTPAGTEQLTYIITHQHHNHHHIPNKYKIFIPKSHKIRNPKYKLTYSTLKLINQITPTRKQQHTPPRGSHTAPASHVTTHKHNEIRNALSGDPPEEENQPTQRMHKGHTTQNHNTRPPTTQRAANHEDERGAGNGARKDASDGKATKKTQTAEDANEHAGKETRSPDNKAQTTSTNESPSRTRTRRRE

SEQ ID NO: 965124 - protein, 525 aa, Homo sapiens
MRQSGMGVTHGPKYSKYKYPAILNTWLWVRWLRRLETMYLSPRCGRGEGVHVGVNSRVAFEKRDRYTLLCAVGRNMALCGISCGSERQHPTLSSRHCDSRRPPCEIFSQEGLSQDETQGSTPRRICEICDTLVNIYLLSETAHKRRYFVIFSPTTHRGEISLSECVSVYKMLCVLWGRHLSPQEGVLLVCALYVRVSLCAEDVERGGFCVPPLCVVYLSQCLRGVLPHSHRCVARKKCVDRRNKGARDTVHNTESVPHCGAQNINQKEKTSSNIWVWLPPERFRGGSPHTRVGPPHVVPPQKEEAPRENHSPAETSPRDKTPPIRQRVYPPRGRETNTRTRMSLIEEKPPRDEETLPLRDGRRSAEHNTRVAKDRCWWSPQQHTRRGEAPIPRNLEPPDFCKEDRIQRAALSHRGEPPTGSRKNPPKEFKKRGHTPAACVNTTSEKKLLQSPPKRGWWGGDLAEPHERGDPRKRGHQISEDIATTTEKSMTYTDTAEKHQHNQAETSCRTHDGPPANYDKDVYDK

SEQ ID NO: 965125 - protein, 293 aa, Homo sapiens
MNVIQNCPIDVRRPLYKNVVLSSEAPPCSGDCRDVRTCKRDYEGEWLRWLEVLRHQQRELTRLGGSLPEACGVSMVVDASHACAHAVWFGGSDAGLDSQSSFRSATPKKDYEEYGPEASAGTTPSLESCPSVCLERVVNDGVSVGEQVSFSNPEKAPSVNSDVVLLPSSVLALAVHEARAGPSVQAIYAVCRALCCQLCPFSRPPAISLSLLLPSRSLLLTISILEVATVDFELVVVTIFEMGSPRVSGRLGGRAFPQRWYKVPGLNGFFRVSRGPAIRKSWGSRGGLLPTCV

SEQ ID NO: 965126 - protein, 168 aa, Homo sapiens
LVNGPCDKRFATSEELLSHLRTHTAFPGTDKLLSGSPARRLWPALPAAAMACHMHIPTSGAPGSPGTLALCRPHHALGLQQPAYHALTPMSPAFPRLDAPCAGALTVDLDRYVRPPLSPRRNGRRELTRRASGAWGISEGGREGERGTTDGRGGGEESRERRDHGPGW

SEQ ID NO: 965127 - protein, 131 aa, Homo sapiens
MALPITTPASRGRTKRDAPLTGKKKRKSPSPRPWGQEKRVVEPGDKDVRGVTWDEYYRCGTTRTFIDELTCRFKVPHEWCPVTLGSELRRSRVLTIRGLNRGGSLKETGCSGPHGKNLGDKRGVSKRGRRM

SEQ ID NO: 965128 - protein, 65 aa, Homo sapiens
LYEDPREYSPMMVKGELTGCPPIQVRHCGRSSELTDVTYHVTLRLRCGDNTYRYCLFRTNIGRNW

SEQ ID NO: 965129 - protein, 37 aa, Homo sapiens
MLRFELRRLQSYINAYRNEDIFIVKSSMQAIKHHWES

SEQ ID NO: 965130 - protein, 41 aa, Homo sapiens
NGVLNGSRKSVKSYRTTLDRLYSDSVNVLMNYRASFQTLRE

SEQ ID NO: 965131 - protein, 85 aa, Homo sapiens
VSTEGMELMNYLLTPCRPPDQCPKYQQGEARRTWTLSIAERSRAQGISANQFVDSRFYLLLDLITINMTSISSIILIELLISLSA

SEQ ID NO: 965132 - protein, 69 aa, Homo sapiens
ESRVLDDSLGLDNEMDLSLRLLDCVTTMFMVARSTSERLCLISSLKFLKAATLSSTLLPDSGAPATSAQ

SEQ ID NO: 965133 - protein, 289 aa, Homo sapiens
MRVWCGVSVGTRVCGRGRLYVRDPVYTQSRFSHTLVALWKEPIEISLQRLSRGEISRGDESPETRRGACPNKEGGWVGIISRVLYPPYRDTRVAPPLFYRHVCNPCVVCGDPPHTGAVCGAHPMCVISSTPQQKDFFHTTHIIQDHNNVVAFLTRRGDIIPVEEHTRRGDYYRRESLLYSPPICRGEWSHLFIHTSLWLLFLKKPLLIDEHNTGLPCVAWWTTPGGGDTPWLFRHQNVVRPPVVVLTTLSGGWGTPRREGSTRWWRRPGGAPGWGGYSPRGGGRGPTVC

SEQ ID NO: 965134 - protein, 39 aa, Homo sapiens
EGNILPWTGQLYQLVRIAKVSGYRRTVWVLKKYHIDLDP

SEQ ID NO: 965135 - protein, 224 aa, Homo sapiens
SHSLSLTLSRLASIANLKGPAWTTMAYDDSVMKEDCLDGDHTFEDKDLQLAESNERKNVLTKDFLREEEEIAAQVRNSSREEVEEDSELYFIGDRNRAEKKRKHSSDDYYYGDISSLVEIVDEERKREKKSPAQQVYVIQLQDLLESVSDPHVTAELQCPPKKTGEILCALQAITESKKEHHRNEKSVASSGELPLEDGVSHKSTKMKPLYVNTETLYLREPDG

SEQ ID NO: 965136 - protein, 432 aa, Homo sapiens
MAYDQTPSTPVNAQYKTETSILLQNPTYGTHLRSRIQCRHTPNSDSTANQLSRTPTPPTQTWLRNSNTAHKRTTDIPTPVHHELCGDHNNRKIRVAQTSQELQAHSSKFSTGNSTQYQIGQDSTLGDNRQTNSTNKYHQGRKKKRTNKDAKGEIQIRTQKNAHTDTATLPKPLRHQHTQNRHKQITDQPPTPPPTTARATHTHRPRARTPGHDGKSPNHFNANPYIPQADRHTLRHPATHHERTPNTHTPQHTANTTTHKKGTQTVTKHMTPTHHDDPPHPHTTTTPIHTQYTTNYHKQHHPSNYLHHPTTPQTPPQHNNNNTLYTKPHTQQEHEEKDKQPHAHDKQYYTTTLTHMHPQRNHPTTRTQDTRQRKRHRTKTETITSRTSLLALSTTTNARHPHDKPGPTTLEGHDTDTDQLSDHPLPHKHHNT

SEQ ID NO: 965137 - protein, 139 aa, Homo sapiens
EEDRKAYGATWATATAHRQVDRKLPRRPRYMLVGLHHHRINVRQIPPRLLWESWYEGHYHLNEEPRASAQSCPNLDMIVELCGHVKQQRVNACVEKSKTWGCLPSVDVSAIGLLQSSGERESSRNAACHREGQILQQKS

SEQ ID NO: 965138 - protein, 292 aa, Homo sapiens
PECRVDENPFHKKKIESERALISQCGKTVVNVSYRPAYDQMNLNTRGNQKDTRGLHVSVNQVAQLKSFPSSILGSAYHASQGARFLAQTVHSHQRRAEMSPDGLVRRAKSVTHASNYQYGSLWKTEANTDEISSHVSNEAIDFIDCVREKGGTGPRSNGEAGDLPITPPPSSMAYLMKIKQFRLKEAFDDIRQRRNMVSPKFGFMGQLLQYESQKFGGVQRDYMLRGPPIVPKGEADTVFTDRAIPRQSSTGGSGWLLDIPCLDAGTLVLTNQEPRDQKGLVNSHRVTGWRT

SEQ ID NO: 965139 - protein, 219 aa, Homo sapiens
MDLTFQGAPPPTKATTAVEAPASTRGVPKAPQVQRDPAFGVKPTHRPGKPRPHTTGGPLGLPTRKPPSGQRATRSSPPKKGLGWGPTRAETLTTTHGRSTPLHKRNPPSQKNTRTQNFVGGPRKIPTPLKEQAIFSDPPHISRPPLCQARGWRDCVSGLPHRNPPTKGPSQQTPMCGPTQKVETHRGAGTPHTALSPPRRINYLSPSLLSLINPPLHRG

SEQ ID NO: 965140 - protein, 41 aa, Homo sapiens
DVCYLRRGKWTRKSWNSKARGENGIQTRTVYRREDDLIPCY

SEQ ID NO: 965141 - protein, 118 aa, Homo sapiens
VSSPWGCGPLAAGSPGGCCLGLLVANTDVFLSKPQKAALEYLEDIEPENTGEENARTIKAKELWKKNGAVIMASVGGRGWFPSCLRGSCGSVLPCKSMLVPAWCSPPIYADGRGAHQD

SEQ ID NO: 965142 - protein, 91 aa, Homo sapiens
PAGPVVRAGARDGDVSQANELKDREALMEAIDFRRLRNLRSPGGGFLGLAGLDKAWGPGLAGEGGTLLVAPEHWVWRNPPKTIYGDLEERC

SEQ ID NO: 965143 - protein, 89 aa, Homo sapiens
YRPETQEKKQRLVARAEKKAAGADVPTKRPPVLRAGVNTVTTLVERWSSAGGDCTRRGSHRAGVFLPALCRMGVPYCIIKGKARLGRLV

SEQ ID NO: 965144 - protein, 67 aa, Homo sapiens
KDSRARFGCWRLQSEFISKQLEGTMAKCERTFIAIKPDGVQRGLERDNIKLLTEADQRGGPPLYHPM

SEQ ID NO: 965145 - protein, 108 aa, Homo sapiens
MAPAGVQGTVFLLALISHYASTWALTAHFTYLTNDGRGETRMPRWYRPFAEFGIMRFYSDRGDSAALVLRCPDAHMKAMYLTSDLTLDPSNVDSLFYAAHGQPGPLRM

SEQ ID NO: 965146 - protein, 80 aa, Homo sapiens
SASGDRSASYQVSHEVDLLCTECLAYGLQFNLDFMLGASTSFYRVTNSFSAAVRFLISSILFILNSPPPCPACFSAFLAT

SEQ ID NO: 965147 - protein, 143 aa, Homo sapiens
MTLGSSAQESPISREYNELLWAISDSDYYSDDINRAVCLFPSIDVLKQNTTAASMETCTKRWGQVSSRDRVRIACLFSLLPGVPQNNKKPGVPKTGLWLCGFQMNYGQVQFDSGQCHEARGSKKKAGKTRIKGALKGQPAREF

SEQ ID NO: 965148 - protein, 139 aa, Homo sapiens
RTDILYQRNTMFSHYVNLVALIPQSLIGGLPSPGLTPSPWCWVCSPAECQGLGSWRGLLSAMDIPSFQPMYTSGPRSKVVFISMKKGLQEAVDELVVPQHLVLQGCVQLLVGGTWEVKGLHHINLFCFTLFLCMYNISS

SEQ ID NO: 965149 - protein, 71 aa, Homo sapiens
VVLTSVIYRWVNTPDEDMEELGPMNILWYQTRSAPLHQDYGVLKADEGIIVQGPSLSLDDRRDIRSCEYLL

SEQ ID NO: 965150 - protein, 44 aa, Homo sapiens
MNALENHNSQIQLRCSSPQSILVQGAHRVIAEHQTTQQQMKTSQ

SEQ ID NO: 965151 - protein, 281 aa, Homo sapiens
VDDVSSDDNGQDLTHIQASPLTASTVRPQEPTCAWALVVHGGVDWHEEAGLPLPGVKEMYKYLHKNNRWWVDRQHPKREIWTYSIRDCRWEALTDLWLTHSLKALISHQLPGRTVSNVLVTTSSDKFPALVPKVLASMAWGLCCRIVEHLQCNQRNGKESCIRGGIMREIRLEKHVYGGDGDGVEEELRYEKGVTCLSGGYPARRSGGTEARPGVLEVIDRQDQRHLASDILTFETRIGFIPASSSRRTPVDAECGDEEGGPKAERVSVSHLKAGFEQLGF

SEQ ID NO: 965152 - protein, 34 aa, Homo sapiens
PTQYKLVSDTIGQRVDPLDARLFRDHNRYETSCR

SEQ ID NO: 965153 - protein, 529 aa, Homo sapiens
KFKDHGNPSKTWSLSKPLLTSTLVTKMSTKLRTEACWLARDSGWTAKQEEHRNFLPEPQNSLLWPHCAATRLALTSLDITWLQLKRPPRTYALLQESSATLDNTPPWKNRTDTTCAYLYSTTHSMRALHTATPHTDCATIAPASYHTWRDIGTLPAPARNAHSAPPTLCHILETGDTGTRHNEHHAKLCLAHAHTFAHHIYSCSRNTSSPTGACLTAMSEFHPERLLAITLLHNRIHVDMHTYKYTFETVTNTLEHLLEEALGYQLQYYPLRHSGDVSTQFRVTAPRNLDRPLTNNGEYLEAFADPHTMRSNPDVPLGVPLEPNRHNNNWAHRNTAKLGQNGDTQHNHRTLTTWRRTTPFTAHVLDDERTLLHRGIPTRTPNTPNFSFAHSLGVEHKRTLGDIISYRCQRFAMKEPRRNLLTTGYDSHQPYFGMARYLSETEQLSRNKSYATIAHQAHGNQYHRPHAKQDTITHKGRRTRYHTTTTWDTKGKHIEETNTPVADPLGKTIDTPAKVETDGPTQGDNRTRD

SEQ ID NO: 965154 - protein, 103 aa, Homo sapiens
MLGYIQLHKGPIRCMAPYGTTDNPSADRHKKLFTKEPLETVHIILITLYISILDLRLVTIRVFYVVKPPLIPDYPKATLGSDATRHKCHLDEANSYASSSYVR

SEQ ID NO: 965155 - protein, 122 aa, Homo sapiens
STSDGSPVCVRGISSPTMEHLTEKMKTTIQRGLVLRNESCSENYTTDFIIPAVFKKRAKAVFDCRKNVLSHMQQGEAPSPFARNFGTRNLCQSYGVDHLQNSRRPGAEEKNLTTMTPYVCWG

SEQ ID NO: 965156 - protein, 302 aa, Homo sapiens
KWSLALSPRLECVVRLSSLTSASGVKRSPASPPVSGYRRCTPPPPRANFGIFEYERGSHGLWVRLVLKLPDPRDPPSIGLPKLVRYTGVSHRHLCRNTILKLPEDLIRAPHFNKDHVARYITIPRTRGNYHCVNTPAHTQLLTGAPHTPQESHSFRYNDLAPRTRPRPLAPRPTTPTATRHPTPSVNAATRHGTRNTHVSPPPRSLQTPTDPPKHTIRCRHPRAIHNQHTLTPNAPRMTSAHTAQSGPQPNHRHVTHTRQKSPTTTANGQGTSRAREKPHPPATRAPRTSHLAPNTQNPPQP

SEQ ID NO: 965157 - protein, 265 aa, Homo sapiens
MAFLMAYRTKNSRLYYDYARGPKVVGPYAGYYNPSLIAIETLHQRAPKIRRLAIYHHPHTISLSPTVRRLTNRIFYVMNSPLTHSTQNRRVVNHSDRRHSVYMRKRSSRPTCYVHQVCLDHGLERSQASTELKSLIRVDYVRRLRYSAHTIQSYNIDTVLARLRARLRLCMTMNTDIKEEPHTYSGPHSYTLLLGLIDTDKKISDWLLAIMTRGHKDDIYPSIIYSQEPIRMTPLRALAKRGGRKCRSHGMRNIDFTCGGAPFCP

SEQ ID NO: 965158 - protein, 81 aa, Homo sapiens
LNEVVWSFQLLLMMGYLVHWLGWLETMACCTAVVTLTSMELERVGDAAREDGLDLRPRERTGVIPWDAPSGRMTFSLSSLL

SEQ ID NO: 965159 - protein, 119 aa, Homo sapiens
MVVNPRLSVRMVAKRLPGCKGMESKSEWSRGREGRQVKSSSYTEQRRCGDSLGVKPGIRSTSILGYHYDSTMGLLGAGEACIRISEGWYVVNTYRPNPMQEKRRDSCQRRGGRARSVKT

SEQ ID NO: 965160 - protein, 136 aa, Homo sapiens
MAVCAMVPDDLPVLSSLAKVVSRLVKVDDKLPMRHVRWHACDISTKAQSGGIAGDLRLGGTPKILLTYHGQLQSVKGHYPKHARPAVVLNPGYSSIPPVFPGSDLNWKGEKTNSKDDNIRAMQGEVIVCYKGAVWP

SEQ ID NO: 965161 - protein, 97 aa, Homo sapiens
MYRIISDRNSRRSKGSYVESVKISCATGMGDWQRLGEAQHWTGPRRKTVEQATEGRGRAQGARPIRRGRDLAWKRKREQQAQVGNERRRKGGHRKGK

SEQ ID NO: 965162 - protein, 78 aa, Homo sapiens
STYAGYSMPDHMKRTLDGKDALISSYTKYELICMYNREQTDVGWKAGQRGAPNAERRCFKEMGKPELVMFLPAIRRPS

SEQ ID NO: 965163 - protein, 43 aa, Homo sapiens
SSVPATVLRHGGVIPGLVLVNGGATVLRHGGVIPGLVLVPSTS

SEQ ID NO: 965164 - protein, 214 aa, Homo sapiens
METSNLSSLGGVYHLVGDGAGKTPRGLGPSNVLAGDPGGAWGEPPSWGDTLLAQEGPLARRSPGGPPQERSPSKVGNLGSKSPRLSSWGKGGVPLLNWSFVENPIFSPPSAERHPEPEGTPALLFPFFWAWVREPVSLGRIEPLSLENSHPQQLHPRGDPTSPCSALFKKGSFKGGHPLKNIRRRVSWRGLVPLNLCVITNYLGRIFAVSWPPG

SEQ ID NO: 965165 - protein, 548 aa, Homo sapiens
SDQSPGGRRGPLPGAQQSARLPLSPGPHKYNNHTPTHITITILHQYTKTTISQRPSIQHKTHNTHTSHTTINTTTTHNQTHPQANNTPQTPPHKSHTKPTHPHTTHKTTNNPHHTTHKQTHQPTTNTENTTHQQTYTTSHLHTPPTQKKTNNINIAKPYNNTTKHPNKHPPTTTNPPNQINNTQNHHRKQQTTHNPTSTVKPPTTTHPHPPTNTSTNKKTKPNKQPQQKPTDHPTPHPHNTTNTNTHTYHNHKQHTNHEPTTTGNQKTHTPRTNTNHETHNTTHNRSTPQPPHNPPPIPPRTTQANPQHHPHKHNTPPPRHTQLTTRPAKPRTPPHQPTEPPRGTTTPTLTTTTPAHDTDHNITSTQPPPPTQATHPTTTHTRQPPDHTPPTRNTSTNSNTTPPQPNRTKPPTDPAAPPPPPPPPTPPHTHTPPQPRPTRPTADTPSNSTNALNTTHYDRAHNERQNTAKDNDKTHTTQTPQRPDHNQQKHNHRPHQQPAAPARAGTAETTEPSTGTPPRPRETRTRTADHRAETKNRPTAQAHTHHH

SEQ ID NO: 965166 - protein, 290 aa, Homo sapiens
SQLPALGENKKVIVDFSSPNIAKEMHVGHLRSTIIGESISRLFEFAGYDVLRLNHVGDWRDPVWHAHRSPARQISRLSNSFTSYPADLQGLSIRNLMTEDLITEDGTLQDSEHISCAEFCSRAKNTRYLQKACEALSVIVSRPRVKHKIYDALARPPFNQRRPRDIPLYQRMDDTDSPVTTRHSRTRLRNRIQPPAPRLDRTKTTHMGDLTGHKRVVTKSVHSKPTKDQTTSSWSAHVRVSETTITSNPDLDTSKQQQQPKPRPHQQPPTTNNVTRCTTKQHNHCNTHNH

SEQ ID NO: 965167 - protein, 274 aa, Homo sapiens
MGKVKVGVNGLGRIGRLVTEDCFEARGKAVILLPSMTTFIEPQASMVYMFQIVIRTHGQIPCDTVQRLMNGKLVINWQIPVTHAFQEEIPPKVKWGDAGGSDTVSGTSYLACTSSNQWQKAWGIQLCMGGSQKGFISLMSPLVRDAPMFVMGVNHEKYYEQRSRSVKQCPPCKHQLALATLAKGIHENFGIVEGLMTTCACPSLAPRRLWMSPPRKLWRDGQRGLSRTFILASTGRCQRVCGQDIHELNGKLTVMAFRCPNGNGCQSVDLSLTT

SEQ ID NO: 965168 - protein, 119 aa, Homo sapiens
YYKPGLLLMCFILPTLVPWYFWGETFQNRVCAATFLRYAVGLNATWLVNNAATSSDICPYDKNINPRENILGSLGAVGEGFHNYHHSFSYDYSATLERALFRVALFTVDFSECHIFEIV

SEQ ID NO: 965169 - protein, 115 aa, Homo sapiens
MGARCSEIRDCHRLPEKDENLDLASLTCILRRYLAHSVMTGDSRAVLEAHTWVQVNERSPGALKILSDERGHGKALMDSTSSFIRMTHSDYPATRDLLDGMGVQYNMSGILRKCD

SEQ ID NO: 965170 - protein, 39 aa, Homo sapiens
CTKSSLVVREMAWSSQEMTLKSYIYSGLPPLVPNFSIQL

SEQ ID NO: 965171 - protein, 67 aa, Homo sapiens
GPFQRRRLICPKAAEAETTDETLCVLFFYNPTNAQKKKNPNPTRERNTPPTPTLCGKKRGCAWGETQ

SEQ ID NO: 965172 - protein, 123 aa, Homo sapiens
PSSFTKWIPGKDAHSTLLSRKETSNLYKIQFHRCKAWIRWMPTTCLTEAVLPKLHPGMRTYPVLTRGQLEHVVWGAGPGSAPCGDSQVATPALMDCSEQALKTIMEYLGVPKGAEPECCLIQE

SEQ ID NO: 965173 - protein, 145 aa, Homo sapiens
MCEKACAWRECTLDSSCGDTKIAKDFPNTSICSKNIRIPPDGYELETVWAYAMPRSIQLACAWHTLIRQTTNGRLACLADTLDATSEIRWYARRQTHKCKAMHRKAFVGATSYGCLSSLSGPLVAPRNLRRSMFKAHAIALDRGA

SEQ ID NO: 965174 - protein, 214 aa, Homo sapiens
SGKETAKELAQRGARDIFSFRDVEQTGECAWPTEIQTHDRGTMSGVVCGNWTCLILSSIRAFAYGLRELEDKASAPRILIKQMQEVMSVSCTRRSADGFESAHRMSDQLGSLRSLIPVLLCRELNTDIRSLESEGYGKMVVFPIDIRPGGTESSLPVNRARAVDRFLDRCEGHWLYVSACHRLARYYSLLVSARGTWRHQENLYNGRPRDGLRE

SEQ ID NO: 965175 - protein, 112 aa, Homo sapiens
HFQSSASSSTEENSFPLSLPNHYQLQLKSLGASVISDPISAYPQIGSGTFLQSNAFSLFLVGTLKQDLQGELQHVPTIFVSAEGPLGKSHSTPLVGRLLCARCIHQLEATFI

SEQ ID NO: 965176 - protein, 151 aa, Homo sapiens
MSAACDRSRSRSYDRSVASAVIAVGSASRRDLTDGPLLFRRRDRLLTREGMVNPKAVRCAREYIAGRRPIVTVLSRVLTGGAVSVEVIDFGKSEERHREQLARVCHEMIHVHGIDVGQFEIGHRTLYSRIASGNVEPVVEAFPRARKSRTH

SEQ ID NO: 965177 - protein, 74 aa, Homo sapiens
EAADRQSLLEKHMRKPCPDPAPVQLIVQVVEQAAKPSVNEQNQVQPAPDNKRNLILKLLALKVAAHLKWDLHIL

SEQ ID NO: 965178 - protein, 136 aa, Homo sapiens
LGGKFSLCHQGGVQVGAMSSCFSVEASCVFGPQCGASRAFPLFQGRFVLLSSGLRELAWEHTRCVAPPWPAGIIVVSICYRINKARCISSVCVCGTRDVVSSYLSQTPLVCISLTPLCGLSLTKGVCVRDYNRGCV

SEQ ID NO: 965179 - protein, 70 aa, Homo sapiens
MVSTGAACKFERSRPGLNHEQEKHLKGEENAHKRGKYCKDAHVCCFTGVVKNMRRGVPPKDTRTRRNWSG

SEQ ID NO: 965180 - protein, 139 aa, Homo sapiens
MVTRPGVALYTEWTLRVPEIAKVLRRKRNHGLCADPISGQALWGGDIRMRQPRGRISLTLGLASGILFGGGLTIVFGTWGGSPFWGAISFSPMGGTIVFWQGTKKRPVGIQKIETISKLATTDMETQRFPPRDQISLTI

SEQ ID NO: 965181 - protein, 220 aa, Homo sapiens
GKPTGSWQVQEHETGDPRMKPKNVSRDLGLAADLPGGAWKEQLHRSLGCVTASRNCVVISDVLSRVDKHGPPAGPWLVTWMIEKGPVGWDHVACVPSDACREGWWSDCLLSRSPGMRPEPGAVGSNRAVPVGAIRPDNANAQSGDLNTAWLAPILPDGDWRDLVPSMHEGSAGPEGLGSIIGLNPLACCPGERNSCGALDALAPARLLGGALQVVHSQAA

SEQ ID NO: 965182 - protein, 127 aa, Homo sapiens
MLTHDQENSTKQHWGRPNPMNPRPPVRRHSKTTHGGSHFTQSLGGRTNLIQTWHGIGEGRNGSPEGALKKARSPRQITEGRPLVLTLETRHGKDGEIRGEGKADTAAANKKTSVRGGGRVAQSSGEQ

SEQ ID NO: 965183 - protein, 233 aa, Homo sapiens
MQGLRVLLEARRFQGMCCCLGWVGSSMGMMPGPSNCSISHDCQGGESEELLRRDDPCIQQIYWNVMDSSEYTNESRSMGSTSYVTTEYHSNAEVAQLTVMYRGDIRDADGDPVISLWTRWVRFGIHVPLSEYRRIAGHVYDWSGDASSARAMLLKGSDVCVTLGGQRLGGIHPALEKLATSAPKWENGKKSLSVYCVQAVHPGYHMNGAGEKHNGRQRGRTTGKRTVRKGSCQ

SEQ ID NO: 965184 - protein, 75 aa, Homo sapiens
QLGPTFRVELVLIIGTHFVPGLWVISVPTNIWMNNATTHEIQCCSTSSTSNKYKKGDQAPMLLGLTDDLAEHVFG

SEQ ID NO: 965185 - protein, 106 aa, Homo sapiens
MRLEVFSDLPLPGACCVDGRRASAVRCSLQYLDWRGPSFLLVRGLVLERLYMCLGTVWACASEVSPGLIEGPSPLSGGLSACTYAATRKGSFIFERLGKPGNKSKF

SEQ ID NO: 965186 - protein, 277 aa, Homo sapiens
VLMRAFTSSCREKYGDEMFGQCRKVTHEVYERTFSVTPAPSSCTPLCVPNYDNVHPNYHKEPFLQHAEGVVPDECTSNVGEPEHFKPIRKTFHASFLSTIAMPVVLKLWLASMRPPPDQEFRIPALLVFQTHSMERSSVLDQVVIFSPLVVASTFHVTHYEAGFDYHTFDKDMIHIADNRRSPGVMGDFFIRLDPQIGGELKSNPEEDGTETLMIFTHIQEPVSMYYTAGKCLGYREELYLRSVHQACRDSVKQGEGPKCFRVDLSKGSVEPENKGA

SEQ ID NO: 965187 - protein, 132 aa, Homo sapiens
MLGYIANYGMGIECCGPPYVPTTTLRVTTIIILHQQRPLNVRDYVYRSPVLHHRAVTVSSSPSSAFLPIEAPAPAIPDMPPGATLKLTVLLIDPEHNLSCRYTIFTLSSVALSGWKRVHDYEMLARRVSSMA

SEQ ID NO: 965188 - protein, 87 aa, Homo sapiens
HELEDMKMKNSVLKSEIHKGKAHQGQSRAIERLKKKKFENEFLLVVNFPTIPFRIHNRNGKSYLVLLASDYQRAKWRKTIQKLLWKV

SEQ ID NO: 965189 - protein, 58 aa, Homo sapiens
THYWLRMSLAIQGVLDTGKELSDDNTIGKEEIQHMLSQFVEHCKQLTELANARGPYDR

SEQ ID NO: 965190 - protein, 34 aa, Homo sapiens
PTTGYYWPLVGRVVGSRTPSGRLVITDVEQAEGL

SEQ ID NO: 965191 - protein, 55 aa, Homo sapiens
GGAGFSFGASPALGSLPSCEGALGGRGDTRNCRDARIHGEQTAGLDHWGVADFLY

SEQ ID NO: 965192 - protein, 34 aa, Homo sapiens
SVTDTDLSLLRSSSCCCSNSGTAAWRRGTPEVCS

SEQ ID NO: 965193 - protein, 61 aa, Homo sapiens
MVSDNELQEMSNQGSKYVNKEIQDVSNMRVCFTLSEPKESSKNKKYLRKEPIIDKRLRSNL

SEQ ID NO: 965194 - protein, 51 aa, Homo sapiens
EQRYQSPSICERIVHYSSLSGHLEVEVAVIGVTSNKGIIKVIFILSRTESR

SEQ ID NO: 965195 - protein, 33 aa, Homo sapiens
IDFLLLVEIKDIIKRHQEQSLRIRTMPPMLCIL

SEQ ID NO: 965196 - protein, 70 aa, Homo sapiens
EYMYYKPGNASHCVMCHDASSTKLGISVQQDSSVRVQMTNQAGNRNDSAGGDSVKQRRPCRLPLTRAGRS

SEQ ID NO: 965197 - protein, 35 aa, Homo sapiens
MVCWSNWSVFWSTLAVASSIHRILASVRRALARPR

SEQ ID NO: 965198 - protein, 43 aa, Homo sapiens
GSSQMKRVPSTGPKKDQFLMKLKQEALTCARNGGADYILFADP

SEQ ID NO: 965199 - protein, 104 aa, Homo sapiens
GSSRFIPLFVPSHVPFCPIRVPFFSILPVMSTFRILLMGAFYRVLIGAFYRVLMGAFYKPIASYRALIGVFYRALMGAFYNPLVRQKSSPRPHSTQEVQLARPR

SEQ ID NO: 965200 - protein, 38 aa, Homo sapiens
MTHHAVSDHEATLKVLALSFYPAEITLTWQRDGEDKTQ

SEQ ID NO: 965201 - protein, 34 aa, Homo sapiens
MLWCSRGFPTCRILNSPLAIFHKNFYTIFYIVQT

SEQ ID NO: 965202 - protein, 31 aa, Homo sapiens
MVSSGLLASHHKSYSVGVDFDVLRDEDYAWQ

SEQ ID NO: 965203 - protein, 62 aa, Homo sapiens
MITRWDTVCTLSVSKLSRIAQALQQAEVYRDTVHMLLEWLTEAEQTLRLRGALPDDTEALQS

SEQ ID NO: 965204 - protein, 82 aa, Homo sapiens
RLLLRMLEKRMDRAEHKGRFSTDTDERAAAKDVHRLQGQSCKEPPEVQSFREKMAFFTRASELISQALSACIPQPGTDGSNF

SEQ ID NO: 965205 - protein, 119 aa, Homo sapiens
SLTASSEIKAELNDDEEEREQNSPIYISRIIPGGVAERHGGLERGDQLLSVNGVSVEGEHHEKAVNLLKAAKVQLTLVVRYTPKVLTHMEARFEKLRKSQAFGSSSICSFSSMQPLQTA

SEQ ID NO: 965206 - protein, 79 aa, Homo sapiens
SHYASENYIGEHVSAPPNCRSNRLLKDEGLSKVQCSVYSAQQCSVVQKVCSATLNLNKNGGGAFEKYGFTKACHYRAKF

SEQ ID NO: 965207 - protein, 45 aa, Homo sapiens
MGMNNEKKLRKKALPVKQELMNSCESRGAHAPKAHGSVPQTACHK

SEQ ID NO: 965208 - protein, 39 aa, Homo sapiens
RGSRNAANYSIARIPNLWFVRYVPRCPGETPTTAAFHSV

SEQ ID NO: 965209 - protein, 40 aa, Homo sapiens
MHGQCGIVAGMKTILAVVGHVLQAELGSERALNPMVQRST

SEQ ID NO: 965210 - protein, 48 aa, Homo sapiens
PDYEPDISSTILVATSTSAVSCLLMWSFLNREVKAHLVSKTNISCVAF

SEQ ID NO: 965211 - protein, 58 aa, Homo sapiens
AEHIQAETELCAEADELRARLTAKKQEEEEICHYLEARVAEEEERCQHLQAEKKKMQR

SEQ ID NO: 965212 - protein, 72 aa, Homo sapiens
AFRVHKHTYAITPMKAQVEEDGEEKSPSKKKKKIQKKEEKAEPPQSYELPKMRVEQQLNARDCTYRAVCPMT

SEQ ID NO: 965213 - protein, 73 aa, Homo sapiens
PTRYFVTTVFRATIRADYVLRDYVLLSTLLPTTYFRLHTSDYILLTTYFRTPTKKDYLKSMEKWLTDKETPEE

SEQ ID NO: 965214 - protein, 130 aa, Homo sapiens
PPPRSRSSSKPSCLSFPSSWDYRHAPPRPVFLVETKTYTIYRFTWKGISQWRSHSQYFTSNRVGINRDRDSQSCCPSWSAGGYTSGTFIAHYNLKFLGSSDPPASGLLNKLGTTWHSDPLYLICNSSLKL

SEQ ID NO: 965215 - protein, 36 aa, Homo sapiens
FTQAQPLQSSAFRTTPYTGLSCLILDALDPSRSRCG

SEQ ID NO: 965216 - protein, 36 aa, Homo sapiens
TTKCILESEKPKGWGQNTDGPSTGISGPGDFLAHTR

SEQ ID NO: 965217 - protein, 41 aa, Homo sapiens
TGKLVVLVSVGLLGLRMLEDCPDTAGLPGMKGHRGFSGLDS

SEQ ID NO: 965218 - protein, 49 aa, Homo sapiens
AVMIRSYSSMKLRCICFSFLKAMSVHAHARQHEEEAVPQHLLVLFVCAA

SEQ ID NO: 965219 - protein, 38 aa, Homo sapiens
MFYSSVSKLVPGCRHIRRRRMGHTSLQITSKYQREIIG

SEQ ID NO: 965220 - protein, 76 aa, Homo sapiens
KILVVMNGQSLPMTHRFQLSETNRTLFLFGVTNVYCEDPYEVLKYVNSGECQHAVTHVTLEFSSMPGPPEFTASYT

SEQ ID NO: 965221 - protein, 94 aa, Homo sapiens
HPAYTSCLCTERLITTRSHCARAVYTRQTGQHLSGRRRSDCGGDTSPTVTNKPSYSTRRITSGYKDLGCSLAISCTVSNCHSSSFAQRQQQHGR

SEQ ID NO: 965222 - protein, 94 aa, Homo sapiens
TQEDRKTGENSHQIKKHMIVYFLIFFYRSLSPRLECNLSSLQAPSPGFTPSSGLSLPSSWDYSGVQAYLANFGIFSKGGVFAMWAKRSPTPGLK

SEQ ID NO: 965223 - protein, 81 aa, Homo sapiens
MKARLDLQSLRRTRWPASAQLIHHPVTPRPPCPPISHGADTVLKLCAQIEEKREAVEGRTERPRDEFVILPKSPSPIDSYS

SEQ ID NO: 965224 - protein, 160 aa, Homo sapiens
MYVLRLSRLLIHAMLQVLIARTSVAIGTYQEFDRYLYPIEDADVFIPGMTPQKTPSACQYSIPTPSKHGGKRYRNPIYSCLRISLLLIESWLEPVRVPLGVCSADNLVYDTSDSDDYHLLKDLEEGIQTLMGRLEDGSRRTGQILKQTYSKFDTNSHILP

SEQ ID NO: 965225 - protein, 52 aa, Homo sapiens
TSLVFWRELRDNVSYASRHNNDLHMLGGLSDMFNALSSRSQTKSVLEIGLSP

SEQ ID NO: 965226 - protein, 82 aa, Homo sapiens
FLTCPLLGTTGEKMIRFWGRPMYGAYWMNIRCSLLLANATARVHYREHASKMFAHICKAKRVNMLQADVMLQYTMASSGKPY

SEQ ID NO: 965227 - protein, 83 aa, Homo sapiens
GVSPMEGVKTDNDHHQPEGGRRSDWLRGADSMIKRHTPLEQADEVPTAEAAACQMSADQIQCSTVAAINETDTPAQLEMEDED

SEQ ID NO: 965228 - protein, 68 aa, Homo sapiens
RSHIITAIIPVGMYYDLLIKSLRISSGYFGQESQRLLRVVGIKKIYDGTLNELGLYSHGEENTEGQPM

SEQ ID NO: 965229 - protein, 76 aa, Homo sapiens
WRVESYKDPPRNNSIDIVNAIYGINKCDHMEAKLFWCLERSYACRLVFEHLLLFSTHNIKVMRFWVVTYDAGAAEA

SEQ ID NO: 965230 - protein, 46 aa, Homo sapiens
CTKESCMGVELEGRIIRAALTNKTSYNETCSIMYVAQIQYATKPPC

SEQ ID NO: 965231 - protein, 49 aa, Homo sapiens
NRRDEMKKRDAGGRAYSNGCINYEELVRDYADIGEERFLCLPISSVSLA

SEQ ID NO: 965232 - protein, 294 aa, Homo sapiens
MHSPLLTGIQDGLSSTSFRHTSAGNSYPASNPLADSQHYLLLNTFRQNYILSSRTLSYIGTDYTDDKIPTSLRLPNTVTQSSTREHFTILSRTGTRLDKVFPLKTQENNPPFQAPLRPDLRLPSKGYATQASVTSHSHRTRNRKHTNMTTKTSSQSPKSNLVTPALPFPTPHTHAPQSQSTGSHFTTQCRASLPSYTSSHHPHHTPGLRAHYRLQHTTATTPQQQLTTAPTHHPIPGTNSAITPFNSHTYHNPLRSTPPKTTVNFSTLNLHDHYRHLDRKQHCSHDSATPSGPH

SEQ ID NO: 965233 - protein, 138 aa, Homo sapiens
SGAVISYSSEMISFDSMSHIQVMLMREVGSSYGLGQLCPCGFAGYSPHQGAFTGLCRESAAFPGARCKLSMDLPFCSLEDGGPLLTAPLGSVPMGTVWGLWPHICLLHCPSRGLSMRAPLLQQTSAWTPRHFHASSEI

SEQ ID NO: 965234 - protein, 118 aa, Homo sapiens
MASLEASGGCAGNDCRDESGVKLSRARWLGETDGGIPVMCRTPDVMKYSQKRVHSSDTGNWSFRCGLETMGTEAPSVNGPGTSGENDPQKGGGEQKPGGIRGGRKEGPDVETHDGTAN

SEQ ID NO: 965235 - protein, 475 aa, Homo sapiens
WKRSLTLSPRWECRGAISAHGKLRLLRGFHAILRGLSLRGGGVGTCRHRATSAQLIFGYFIVKKGVFTSVGHRKWSQISWMFGEIWRRSWASPKVAGRLQGGEMSPGLGPFFIFFYKGDFFINSLREFGGRLKRSTKSGRAPGVVCNHTGEVCEILFLCAQARRERCTHTFVCGAGVWANKSDTRGGGYTERETSAPRGVYITGGWARSKTTHTAGGGEIVLGECAAPVVVCAHKKPPLCVSAAPKIEETRENSRGVLRPCGGVHPIPPNVVARTAGREILNHHTKRAPNKHHCSFKQHVGAKKGRPPQFWCVPNGDGPPPTKIGVVRRGGSTYRGEAGNHNNKRSIMRRRRGARELQTNHTQLNAGGRPTRWVVAGRQYTCLESSAHTTLSVWRDASNTGARGRNNNFGGARCVAANPIFVGTPMREKTPSFTKTNLQYYRSGGGREQNHTTNTKTRHTTKTQLEQVEVTVRKQ

SEQ ID NO: 965236 - protein, 120 aa, Homo sapiens
MSREACVVGDKESMRRTPGGWARSGCYERYTRGCGGLSYTSDIYKEEPPQNEGGHIRAESRGPWGGYKCTREHLLSHSGGPSGVHNFFHRCVLYTRVLQGRKPSLVNPPLRGGEAPISPY

SEQ ID NO: 965237 - protein, 156 aa, Homo sapiens
MVVWQYLGARVEEATARPSYDIVSSNVQRALTLQGAALEILLQVVDLHRSVKKTPSGNSFMRKISFEDALDDAEGRQQSMMFSKILTGHMCMCTCRYQNLQKWGMRIEGLYLALAHTRAPHSSRRMSSKTGRYRAGGRKLEEMAMNSRDGPWEAAS

SEQ ID NO: 965238 - protein, 42 aa, Homo sapiens
MGGKHGDAHAHGPPSRTTRTIPLRTPPWPPARAAQKRQAPCE

SEQ ID NO: 965239 - protein, 359 aa, Homo sapiens
KKENSVETQCLGLGKTGMCLESGNVTEIQTPRWAAQHASKVASKHTAHRHTPSHLGGAATQNTNYSPCKFTSGVGQIKGHEHSSMHSMLHRHTTQTYFTQGTAQPPVAASQQQHRHLWCVASQCTPLCWCAQTWIDTTSQPQVAQYIHQQHIYAASLNVLRQHIQDTPGHLGRAAHHQEASTHSMAITDKHSRQASQKHKASALLQAMATTIIPRANPAEAAASPGTPNSTTGVANLAEVGQEPSQHATLHAPTLSQPQQCNRSTMEPFSRFRLSAPGQPARVSHRVGKGLKLTQETDPPGDNPTARQRTTNLPRGLPGYKRNTLGNSTAGDTTTPTITPPRPGTRTSTGHPLNTAGAE

SEQ ID NO: 965240 - protein, 228 aa, Homo sapiens
VPGELVKHGHQEQSHPANGDDSPVIIYTSLTGMPMCEDYWMQASVCLVTPDSGPLTESWQTSYCLPRSSDWWLASTTISIEGCQSLRERHYAHLGSHYSRSTHFSPFCKKPPFLSELLVSCISEFAVLVTVFIILLDLHIGLSMELMDTTELESLWNCQQTERYVSLCHASREETVFQKRCCAAGQEPTLWHIRNERTGTGRGVGSVRCTPKRSTNLGDWHTWRESRV

SEQ ID NO: 965241 - protein, 426 aa, Homo sapiens
KKVLGPSSERVPFAVTSGRVVSPVSRDGPPELLLESQCDHYSGDGFELLRKMPPSPDDKENQAPKGAGPDLRFEISSEDGLQRRGRELGAGRGRTLIAKVHEARGHARLRHLSLSGMRGARHPGQSTMMLISLPGRAAPRRPSVARTYKIPITSRHGTRATDASRTHEIPHRGLHRAERTTLRDSAPLTWYTHSLALHSHQGGTPEREPTCELQERRMTRSTTSETTKTVTPGACDAARLDTMPGTGHPLPSDRSQTEPGGDGKRDQGQPTRTTAPSPAPAPTPQHHRPRTHWRPLEGDTTHVHGTIATPPASLSAERPPPGRRANPEQIQNASRGAPTQDPRPDRRTHAKDSTDTHQTARGPRPLTSHSRRNAHAKKHPQQHSANERDDHDTTLDHTRGEYTHQTGRHPNTAEDHTTDAPLENDA

SEQ ID NO: 965242 - protein, 229 aa, Homo sapiens
MIRGVSSRRGVAGGTNLGFTVQPSVPSVGLKVILPWSSSLPKVSVGTSRGRNNQAYTPHRGYNCCCVVLCCVVERQRGFSPSVVGKDCGSSNFRENFGGSFPAFSLPKVAGDNRVVSQPEPKPGFSLSSSGKEGWDDLLYRAEWDILQIYPPQRHSASSSKAHPGSGTWRSTLVPVVAVGTSGWQSELPCLGPSDGPDGRDHGRLPGVYRSSELPVLDSGRVRGRTWWR

SEQ ID NO: 965243 - protein, 104 aa, Homo sapiens
LLAARGAGPGTGLGAGSAFTPDWRKPTKFSTGDHLLHGPLPRFDQGCDGSWEAGSLMNISSCVLTTISSNSQMIWTNALTPVFERPTIMYMPRADCSGLKSCLD

SEQ ID NO: 965244 - protein, 59 aa, Homo sapiens
MLYPNRGGFPSETNTHRGDKLERLRAKQYSTHGAQPPYYKGGNGTSTKSVHLVRRTSDD

SEQ ID NO: 965245 - protein, 102 aa, Homo sapiens
MGVSIKLCGRRRQRPHPPIPKAISHMLRKPHKRGGLWRARPKGSGHTSGGQLGEEEQTKNHNRVLAAPQYTIGGGGPPDDSNTRGTPVRRAGPHHEGRKGEQ

SEQ ID NO: 965246 - protein, 235 aa, Homo sapiens
MITGGALYGLCKVQRLWRLRALAPVNGPTLLPGVPAGLPLPSPTWSANSHLCNSELKPNQCKVSGKTLQGAPATCGGAAASYAGLRAFACAAVPPGVLPARWASWCTHARVRSGERPYQCPICRLRFTEATALRRHAKRKHPEAMGVPLCAPDPSVSASSWDEEGIPAKQGAKERRDTEGKGEPAEPRPRTKLPGRLKPGVWCVGLIQGRDTLFPGLRVGQCGGDSHWGLLVTPS
